United States Patent 9,050,297 (MODIFIED POLYNUCLEOTIDES ENCODING ARYL HYDROCARBON RECEPTOR NUCLEAR TRANSLOCATOR) - sequence listing, part 10

SEQ ID NO: 17139 - DNA, 375 bp, Artificial Sequence
  Description of Artificial Sequence: Synthetic coding sequence
atggctgatgaggaggaggaccccacctttgaggaggagaatgaggagattggaggcggcgctgagggcggccagggcaagaggaagaggctcttcagcaaggagctgcgctgcatgatgtatggctttggagatgaccagaacccctacacagaatctgtggacatcctggaggacctggtgattgagttcatcacagagatgacccacaaggccatgagcatcggccggcagggccgggtgcaggtggaggacatcgtgttcctgatcaggaaggaccccaggaagtttgcccgggtgaaggacctgctgaccatgaatgaggagctgaagagggccaggaaggcctttgatgaggccaactacggcagctag

SEQ ID NO: 17140 - DNA, 375 bp, Artificial Sequence; identical to SEQ ID NO: 17139
  Description of Artificial Sequence: Synthetic coding sequence

SEQ ID NO: 17141 - DNA, 3600 bp, Artificial Sequence
  Description of Artificial Sequence: Synthetic coding sequence
atgcccctgactggagtggagcccgccaggatgaacaggaagaagggggacaagggctttgagagcccccggccctacaagctgacccaccaggtggtgtgcatcaacaacatcaacttccagaggaagtctgtggtgggctttgtggagctgaccatcttccccaccgtggccaacctgaaccgcatcaagctgaacagcaagcagtgccgcatctacagagtgcgcatcaatgacctggaggccgccttcatctacaatgaccccaccctggaggtgtgccacagcgagagcaagcagaggaacctgaactacttcagcaatgcctatgctgctgctgtgtctgctgtggaccctgatgctggaaatggagagctgtgcatcaaggtgcccagcgagctgtggaagcacgtggatgagctgaaggtgctgaagatccacatcaacttcagcctggaccagcccaagggcggcctgcactttgtggtgcccagcgtggagggctccatggccgagcggggggcccacgtgttcagctgtggctaccagaacagcacccgcttctggttcccctgtgtggacagctacagcgagctgtgcacctggaagctggagttcaccgtggatgctgccatggtggccgtgtccaatggagacctggtggagaccgtgtacacccatgacatgaggaagaagaccttccactacatgctgaccatccccacagctgccagcaacatcagcctggccatcggcccctttgagatcctggtggacccctacatgcatgaggtgacccacttctgcctgccccagctgctgcccctgctgaagcacaccaccagctacctgcacgaggtgtttgagttctatgaggagatcctgacctgccgctacccctacagctgcttcaagacagtgttcattgatgaggcctacgtggaggtggccgcctatgcctccatgagcatcttcagcaccaacctgctgcacagcgccatgatcattgatgagacccccctgacccggcgctgcctggcccagagcctggcccagcagttcttcggctgcttcatcagcaggatgtcctggagcgatgagtgggtgctgaagggcatcagcggctacatctacggcctgtggatgaagaagaccttcggcgtgaatgagtaccgccactggatcaaggaggagctggacaagatcgtggcctatgagctgaagacaggaggagtgctgctgcaccccatctttggaggcggcaaggagaaggacaacccagccagccacctgcacttcagcatcaagcacccccacaccctgtcctgggagtactacagcatgttccagtgcaaggcccacctggtgatgaggctgattgaaaatcgcatctccatggagttcatgctgcaggtgttcaacaagctgctgagcctggccagcacagccagcagccagaagttccagagccacatgtggagccagatgctggtgtccaccagcggcttcctgaagagcatcagcaatgtgtctgggaaggacatccagcccctcatcaagcagtgggtggaccagagcggcgtggtgaagttctacggcagctttgccttcaacaggaagagaaatgtgctggagctggagatcaagcaggactacaccagccctggcacccagaagtatgtgggccccctgaaggtgacagtgcaggagctggatggcagcttcaaccacaccctgcagatcgaggagaacagcctgaagcatgacatcccctgccacagcaagagcagaagaaacaagaagaagaagatccccctgatgaatggagaggaggtggacatggacctgagcgccatggatgctgacagccccctgctgtggatcagaattgatcctgacatgtctgtgctgaggaaggtggagtttgagcaggccgacttcatgtggcagtaccagctgcgctatgaaagagatgtggtggcccagcaggagagcatcctggccctggagaagttccccaccccagccagccggctggccctgacagacatcctggagcaggagcagtgcttctacagagtgaggatgtctgcctgcttctgcctggccaagatcgccaacagcatggtgtccacctggacaggccccccagccatgaagagcctcttcaccaggatgttctgctgcaagagctgccccaacatcgtgaagaccaacaacttcatgtccttccagagctacttcctgcagaagaccatgcctgtggccatggccctgctgagagatgtgcacaacctgtgccccaaggaggtgctgaccttcatcctggacctgatcaagtacaatgacaacaggaagaacaagttcagtgacaactactacagagctgagatgattgatgccctggccaacagcgtgaccccagctgtgtctgtgaacaatgaggtgaggaccctggacaacctgaacccagatgtgcggctcatcctggaggagatcacccgcttcctgaacatggagaagctgctgcccagctaccgccacaccatcaccgtgtcctgcctgcgggccatccgggtgctgcagaagaatggccacgtgcccagcgaccctgccctcttcaagagctatgcagaatatggccactttgtggacatcagaattgctgccctggaggccgtggtggactacaccaaggtggacaggagctatgaggagctgcagtggctgctgaacatgatccagaatgaccctgtgccctacgtgcgccacaagatcctgaacatgctgaccaagaacccccccttcaccaagaacatggagagccccctgtgcaatgaggccctggtggaccagctgtggaagctgatgaacagcggcaccagccatgactggaggctgcgctgtggggctgtggacctgtacttcaccctgtttggcctgagccggcccagctgcctgcccctgcctgagctgggcctggtgctgaacctgaaggagaagaaggctgtgctgaaccccaccatcatccctgagagcgtggccggcaaccaggaggccgccaacaaccccagcagccacccccagctggtgggcttccagaaccccttcagcagcagccaggatgaggaggagattgacatggacacagtgcatgacagccaggccttcatcagccaccacctgaacatgctggagcggcccagcaccccaggcctgagcaagtacagacctgccagcagccgcagcgccctgatcccccagcacagcgctggctgtgacagcacccccaccaccaagccccagtggagcctggagctggccaggaagggcaccgggaaggagcaggcccccctggagatgtccatgcaccctgctgccagcgcccccctgagcgtcttcaccaaggagagcacagccagcaagcacagcgaccaccaccaccaccaccaccacgagcacaagaagaagaagaagaagcacaagcacaagcacaagcacaagcacaagcatgacagcaaggagaaggacaaggagcccttcaccttcagcagccctgccagcggccgcagcatccgcagccccagcctgagtgactag

SEQ ID NO: 17142 - DNA, 1770 bp, Artificial Sequence
  Description of Artificial Sequence: Synthetic coding sequence
atgaagagggtgaggacagagcagatccagatggctgtgtcctgctacctgaagaggcggcagtatgtggacagtgatggccccctgaagcagggcctgcggctgagccagacagctgaggagatggccgccaacctgactgtgcagagcgagagcggctgtgccaacatcgtgtctgctgccccctgccaggccgagccccagcagtatgaggtgcagtttggccgcctgaggaacttcctgacagacagcgacagccagcacagccatgaggtgatgcccctgctgtaccccctgtttgtgtacctgcacctgaacctggtgcagaacagccccaagagcacagtggagagcttctacagccgcttccacggcatgttcctgcagaatgccagccagaaggatgtgattgagcagctgcagaccacccagaccatccaggacatcctgagcaacttcaagctgcgggccttcctggacaacaagtatgtggtgcggctgcaggaggacagctacaactacctgatccgctacctgcagagcgacaacaacacagccctgtgcaaggtgctgaccctgcacatccacctggatgtgcagcctgccaagaggacagactaccagctgtatgccagcggcagcagcagccgctcagaaaataatggcctggagcccccagacatgcccagccccatcctgcagaatgaagctgccctggaggtgctgcaggagagcatcaagagggtgaaggatggcccccccagcctgaccaccatctgcttctacgccttctacaacacagagcagctgctgaacacagctgagatcagcccagacagcaagctgctggccgccggctttgacaacagctgcatcaagctgtggagcctgcggagcaagaagctgaagtctgagccccaccaggtggatgtgagccgcatccacctggcctgtgacatcctggaggaggaggatgatgaagatgacaatgccggcacagagatgaagatcctgcggggccactgcggccctgtgtacagcacccgcttcctggccgacagcagcggcctgctgagctgcagcgaggacatgagcatccgctactgggacctgggcagcttcaccaacacagtgctgtaccagggccacgcctaccctgtgtgggacctggacatcagcccctacagcctgtactttgccagcggcagccatgacagaacagcccggctgtggagctttgacaggacctaccccctgcgcatctatgccggccacctggctgatgtggactgtgtgaagttccaccccaacagcaactacctggccaccggcagcacagacaagacagtgcggctgtggagcgcccagcagggcaacagcgtgcggctcttcaccggccaccggggccctgtgctgagcctggccttcagccccaacgggaagtacctggccagcgctggggaggaccagaggctgaagctgtgggacctggccagcggcaccctgtacaaggagctgcggggccacacagacaacatcaccagcctgaccttctccccagacagcggcctgattgccagcgcctccatggacaacagcgtgcgggtgtgggacatccggaacacctactgcagcgccccagcagatggcagcagcagcgagctggtgggcgtgtacacaggccagatgagcaatgtgctgtctgtgcagttcatggcctgcaacctgctgctggtgacaggcatcacccaggagaaccaggagcactag

SEQ ID NO: 17143 - DNA, 255 bp, Artificial Sequence
  Description of Artificial Sequence: Synthetic coding sequence
atgaagagggtgaggacagagcagatccagatggctgtgtcctgctacctgaagaggcggcagtatgtggacagtgatggccccctgaagcagggcctgcggctgagccagacagctgaggagatggccgccaacctgactggaaatggaggcggcagcagcggcggcgtgtccctggagcaggagaacagccggcagtacccctgtggcatcaccagccccctgctgaagacagtgcctgagagagctgactag

SEQ ID NO: 17144 - DNA, 978 bp, Artificial Sequence
  Description of Artificial Sequence: Synthetic coding sequence
atgaagagggtgaggacagagcagatccagatggctgtgtcctgctacctgaagaggcggcagtatgtggacagtgatggccccctgaagcagggcctgcggctgagccagacagctgaggagatggccgccaacctgactgtgcagagcgagagcggctgtgccaacatcgtgtctgctgccccctgccaggccgagccccagcagtatgaggtgcagtttggccgcctgaggaacttcctgacagacagcgacagccagcacagccatgaggtgatgcccctgctgtaccccctgtttgtgtacctgcacctgaacctggtgcagaacagccccaagagcacagtggagagcttctacagccgcttccacggcatgttcctgcagaatgccagccagaaggatgtgattgagcagctgcagaccacccagaccatccaggacatcctgagcaacttcaagctgcgggccttcctggacaacaagtatgtggtgcggctgcaggaggacagctacaactacctgatccgctacctgcagagcgacaacaacacagccctgtgcaaggtgctgaccctgcacatccacctggatgtgcagcctgccaagaggacagactaccagctgtatgccagcggcagcagcagccgctcagaaaataatggcctggagcccccagacatgcccagccccatcctgcagaatgaagctgccctggaggtgctgcaggagagcatcaagagggtgaaggatggcccccccagcctgaccaccatctgcttctacgccttctacaacacagagcagctgctgaacacagctgagatcagcccagacagcaagctgctggccgccggctttgacaacagctgcatcaagctgtggagcctgcggagcaagaagctgaagtctgagccccaccaggtggatgtgagccgcatccacctggcctgtgacatcctggaggaggaggtgtag

SEQ ID NO: 17145 - DNA, 1770 bp, Artificial Sequence; identical to SEQ ID NO: 17142
  Description of Artificial Sequence: Synthetic coding sequence

SEQ ID NO: 17146 - DNA, 1869 bp, Artificial Sequence
  Description of Artificial Sequence: Synthetic coding sequence
atgtctgagcgggaggagaggagatttgtggagatcccccgggagagcgtgcggctgatggccgagagcacaggcctggagctgagtgatgaggtggccgccctgctggccgaggatgtgtgctaccgcctgcgggaggccacccagaacagcagccagttcatgaagcacaccaagaggaggaagctgactgtggaggacttcaacagagccctgcgctggagctctgtggaggccgtgtgtggctacggcagccaggaggccctgcccatgaggcctgcccgggagggggagctgtacttcccagaagatcgggaggtgaacctggtggagctggccctggccaccaacatccccaagggctgtgccgagacagctgtgcgggtgcacgtgtcctacctggatggaaaaggaaacctggccccccagggctctgtgcccagcgctgtgagcagcctgacagatgacctgctgaagtactaccaccaggtgaccagggctgtgctgggagatgacccccagctgatgaaggtggccctgcaggacctgcagaccaacagcaagattggagccctgctgccctactttgtgtatgtggtgtctggagtgaagtctgtgtcccatgacctggagcagctgcaccggctgctgcaggtggcccggagcctcttcaggaacccccacctgtgcctgggcccctacgtgcgctgcctggtgggctctgtgctgtactgtgtgctggagcccctggccgccagcatcaaccccctgaatgaccactggaccctgagagatggagctgccctgctgctgagccacatcttctggacccacggggacctggtgtctggcctgtaccagcacatcctgctgagcctgcagaagatcctggccgaccctgtgcggcccctgtgctgccactacggggctgtggtgggcctgcacgccctgggctggaaggctgtggagcgggtgctgtacccccacctgagcacctactggaccaacctgcaggccgtgctggatgactacagcgtgtccaatgcccaggtgaaggcagatggccacaaggtgtatggagccatcctggtggccgtggagcggctgctgaagatgaaggcccaggccgctgagcccaacagaggaggccctgggggccggggctgccggcggctggatgacctgccctgggacagcctgctcttccaggagagcagcagcggcggcggcgctgagcccagctttggaagtggcctgcccctgcccccaggaggagctggccctgaggaccccagcctgtctgtgaccctggccgacatctaccgggagctgtatgccttcttcggggacagcctggccacccgcttcggcaccggccagcctgcccccacagccccccggcccccaggggacaagaaggagcctgctgctgccccagattctgtgaggaagatgccccagctgacagccagcgccatcgtgagcccccatggagatgagagcccccggggcagcggcggcggcggccctgccagcgccagcggccctgctgccagcgagagccggcccctgccccgggtgcaccgggcccggggggccccccggcagcagggccctggcaccggcaccagagatgtgttccagaagagcagatttgcccccaggggggccccccacttccgcttcatcatcgccggccggcaggccggccgccgctgccggggccgcctcttccagacagccttccctgccccctacggccccagccctgccagccgctacgtgcagaagctgcccatgattggaagaaccagcaggcctgcccggcgctgggccctgagtgactacagcctgtacctgcccctgtag

SEQ ID NO: 17147 - DNA, 153 bp, Artificial Sequence
  Description of Artificial Sequence: Synthetic coding sequence
atgtctgagcgggaggagaggagatttgtggagatcccccgggagagcgtgcggctgatggccgagagcacaggcctggagctgagtgatgaggtggccgccctgctggccgaggatgtgtgctaccgcctgcgggaggccacccagaactag

SEQ ID NO: 17148 - DNA, 438 bp, Artificial Sequence
  Description of Artificial Sequence: Synthetic coding sequence
atgtctgagcgggaggagaggagatttgtggagatcccccgggagagcgtgcggctgatggccgagagcacaggcctggagctgagtgatgaggtggccgccctgctggccgaggatgtgtgctaccgcctgcgggaggccacccagaacagcagccagttcatgaagcacaccaagaggaggaagctgactgtggaggacttcaacagagccctgcgctggagctctgtggaggccgtgtgtggctacggcagccaggaggccctgcccatgaggcctgcccgggagggggagctgtacttcccagaagatcgggaggtgaacctggtggagctggccctggccaccaacatccccaagggctgtgccgagacagctgtgcgggtgcacgtgtcctacctggatggaaaaggaaacctggccccccagggcagctag

SEQ ID NO: 17149 - DNA, 1473 bp, Artificial Sequence
  Description of Artificial Sequence: Synthetic coding sequence
atggccacagagttcatcaagagctgctgcggcggctgcttctatggagaaacagagaagcacaacttctctgtggagcgggacttcaaggctgctgtgcccaacagccagaatgccaccatctctgtgccccccctgacctctgtgtctgtgaagccccagctgggctgcacagaggactacctgctgagcaagctgcccagtgatggcaaggaggtgccctttgtggtgcccaagttcaagctgagctacatccagcccaggacccaggagacccccagccacctggaggagctggagggcagcgcccgggccagctttggagacaggaaggtggagctgagcagcagcagccagcacggccccagctatgatgtgtacaaccccttctacatgtaccagcacatcagcccagacctgagccgccgcttccccccaagaagtgaggtgaagaggctgtatggctctgtgtgtgacctgcggaccaacaagctgcccggcagccctggcctgagcaagtccatgtttgacctgaccaacagcagccagcgcttcatccagagacatgacagcctgagctctgtgcccagcagcagcagcagcaggaagaacagccagggcagcaacagaagcctggacaccatcaccctgtctggagatgagcgggactttggccgcctgaatgtgaagctgttctacaacagctctgtggagcagatctggatcaccgtgctgcagtgccgggacctgtcctggcccagcagctatggagacacccccaccgtgtccatcaagggcatcctgaccctgcccaagcctgtgcacttcaagagcagcgccaaggagggcagcaatgccatcgagttcatggagacctttgtgtttgccatcaagctgcagaacctgcagacagtgcggctggtgttcaagatccagacccagacccccaggaagaagaccatcggagaatgttccatgagcctgcggaccctgagcacccaggagatggactacagcctggacatcaccccacccagcaagatctctgtgtgccacgccgagctggagctgggcacctgcttccaggccgtgaacagccgcatccagctgcagatcctggaggcccgctacctgcccagcagcagcacccccctgaccctgtccttctttgtgaaggtgggcatgttcagcagcggggagctgatctacaagaagaagacccggctgctgaaggccagcaatggccgggtgaagtggggcgagaccatgatcttccccctcatccagagcgagaaggagatcgtgttcctgatcaagctgtacagccgcagctctgtgcggaggaagcactttgtgggccagatctggatcagcgaggacagcaacaacatcgaggccgtgaaccagtggaaggagaccgtcatcaaccctgagaaggtggtgatccgctggcacaagctgaaccccagctag

SEQ ID NO: 17150 - DNA, 1473 bp, Artificial Sequence; identical to SEQ ID NO: 17149
  Description of Artificial Sequence: Synthetic coding sequence

SEQ ID NO: 17151 - DNA, 1473 bp, Artificial Sequence; identical to SEQ ID NO: 17149
  Description of Artificial Sequence: Synthetic coding sequence

SEQ ID NO: 17152 - DNA, 1281 bp, Artificial Sequence
  Description of Artificial Sequence: Synthetic coding sequence
atggccacagagttcatcaagagctgctgcggcggctgcttctatggagaaacagagaagcacaacttctctgtggagcgggacttcaaggctgctgtgcccaacagccagaatgccaccatctctgtgccccccctgacctctgtgtctgtgaagccccagctgggctgcacagaggactacctgctgagcaagctgcccagtgatggcaaggaggtgccctttgtggtgcccaagttcaagctgagctacatccagcccaggacccaggagacccccagccacctggaggagctggagggcagcgcccgggccagctttggagacaggaaggtggagctgagcagcagcagccagcacggccccagctatgatgtgtacaaccccttctacatgtaccagcacatcagcccagacctgagccgccgcttccccccaagaagtgaggtgaagaggctgtatggctctgtgtgtgacctgcggaccaacaagctgcccggcagccctggcctgagcaagtccatgtttgacctgaccaacagcagccagcgcttcatccagagacatgacagcctgagctctgtgcccagcagcagcagcagcaggaagaacagccagggcagcaacagaagcctggacaccatcaccctgtctggagatgagcgggactttggccgcctgaatgtgaagctgttctacaacagctctgtggagcagatctggatcaccgtgctgcagtgccgggacctgtcctggcccagcagctatggagacacccccaccgtgtccatcaagggcatcctgaccctgcccaagcctgtgcacttcaagagcagcgccaaggagggcagcaatgtgtgccacgccgagctggagctgggcacctgcttccaggccgtgaacagccgcatccagctgcagatcctggaggcccgctacctgcccagcagcagcacccccctgaccctgtccttctttgtgaaggtgggcatgttcagcagcggggagctgatctacaagaagaagacccggctgctgaaggccagcaatggccgggtgaagtggggcgagaccatgatcttccccctcatccagagcgagaaggagatcgtgttcctgatcaagctgtacagccgcagctctgtgcggaggaagcactttgtgggccagatctggatcagcgaggacagcaacaacatcgaggccgtgaaccagtggaaggagaccgtcatcaaccctgagaaggtggtgatccgctggcacaagctgaaccccagctag

SEQ ID NO: 17153 - DNA, 1767 bp, Artificial Sequence
  Description of Artificial Sequence: Synthetic coding sequence
atggacctggaggaggccgaggagttcaaggagcgctgcacccagtgtgccgctgtgtcctggggcctgacagatgagggcaagtactactgcaccagctgccacaacgtgacagagcgctaccaggaggtgaccaacacagacctgatccccaacacccagatcaaggccctgaacagaggcctgaagaagaagaacaacacagagaagggctgggactggtacgtgtgtgagggcttccagtacatcctgtaccagcaggccgaggccctgaagaacctgggcgtgggccctgagctgaagaatgatgtgctgcacaacttctggaagcgctacctgcagaagagcaagcaggcctactgcaagaaccctgtgtacaccaccggcaggaagcccaccgtgctggaggacaacctgagccacagcgactgggccagcgagcctgagctgctgagtgatgtgtcctgcccccccttcctggagagcggggctgagagccagagcgacatccacaccaggaagcccttccctgtgtccaaggccagccagagcgagacctctgtgtgcagcggcagcctggatggagtggagtacagccagaggaaggagaagggcatcgtgaagatgaccatgccccagaccctggccttctgctacctgagcctgctgtggcagcgggaggccatcaccctgagtgacctgctgcgctttgtggaggaggaccacatcccctacatcaatgccttccagcacttccctgagcagatgaagctgtatggccgggaccggggcatcttcggcatcgagagctggccagactatgaggacatctacaagaagacagtggaggtgggcaccttcctggacctgccccgcttcccagacatcacagaggactgctacctgcaccccaacatcctgtgcatgaagtacctgatggaggtgaacctgcctgatgagatgcacagcctgacctgccacgtggtgaagatgacaggcatgggagaggtggacttcctgacctttgaccccatcgccaagatggccaagacagtgaagtatgatgtgcaggccgtggccatcatcgtggtggtgctgaagctgctcttcctgctggatgacagctttgagtggagcctgagcaacctggccgagaagcacaatgagaagaacaagaaggacaagccctggtttgacttcaggaagtggtaccagatcatgaagaaggcctttgatgagaagaagcagaagtgggaggaggcccgggccaagtacctgtggaagtctgagaagcccctgtactacagctttgtggacaagcctgtggcctacaagaagcgggagatggtggtgaacctgcagaagcagttcagcaccctggtggagagcacagccacagctgggaagaagagccccagcagcttccagttcaactggacagaggaggacacagacaggacctgcttccacggccacagcctgcagggcgtgctgaaggagaagggccagagcctgctgaccaagaacagcctgtactggctgagcacccagaagttctgccgctgctactgcacccacgtgaccacctatgaggagagcaactacagcctgagctaccagttcatcctgaacctcttctccttcctgctgcgcatcaagaccagcctgctgcacgaggaggtgtccctggtggagaagaagctgtttgagaagaagtacagcgtgaagaggaagaagagccgcagcaagaaggtgcggcggcactag

SEQ ID NO: 17154 - DNA, 1002 bp, Artificial Sequence
  Description of Artificial Sequence: Synthetic coding sequence
atgaagctgtatggccgggaccggggcatctttggaattgaatcctggccagactatgaggacatctacaagaagacagtggaggtgggcaccttcctggacctgccccgcttcccagacatcacagaggactgctacctgcaccccaacatcctgtgcatgaagtacctgatggaggtgaacctgcctgatgagatgcacagcctgacctgccacgtggtgaagatgacaggcatgggagaggtggacttcctgacctttgaccccatcgccaagatggccaagacagtgaagtatgatgtgcaggccgtggccatcatcgtggtggtgctgaagctgctcttcctgctggatgacagctttgagtggagcctgagcaacctggccgagaagcacaatgagaagaacaagaaggacaagccctggtttgacttcaggaagtggtaccagatcatgaagaaggcctttgatgagaagaagcagaagtgggaggaggcccgggccaagtacctgtggaagtctgagaagcccctgtactacagctttgtggacaagcctgtggcctacaagaagcgggagatggtggtgaacctgcagaagcagttcagcaccctggtggagagcacagccacagctgggaagaagagccccagcagcttccagttcaactggacagaggaggacacagacaggacctgcttccacggccacagcctgcagggcgtgctgaaggagaagggccagagcctgctgaccaagaacagcctgtactggctgagcacccagaagttctgccgctgctactgcacccacgtgaccacctatgaggagagcaactacagcctgagctaccagttcatcctgaacctcttctccttcctgctgcgcatcaagaccagcctgctgcacgaggaggtgtccctggtggagaagaagctgtttgagaagaagtacagcgtgaagaggaagaagagccgcagcaagaaggtgagaagacactag

SEQ ID NO: 17155 - DNA, 894 bp, Artificial Sequence
  Description of Artificial Sequence: Synthetic coding sequence
atgagccgcttcaagttcattgatattggcatcaacctgacagaccccatgttccggggcatctaccggggcgtgcagaagcaccaggatgacctgcaggacgtcatcggccgggctgtggagattggagtgaagaagttcatgatcaccggcggcaacctgcaggacagcaaggatgccctgcacctggcccagaccaacggcatgttcttcagcacagtgggctgccaccccacccgctgtggggagtttgagaagaacaacccagacctgtacctgaaggagctgctgaacctggccgagaacaacaagggcaaggtggtggccatcggggagtgtggcctggactttgaccggctgcagttctgccccaaggacacccagctgaagtactttgagaagcagtttgagctgtctgagcagaccaagctgcccatgttcctgcactgcaggaacagccatgctgagttcctggacatcatgaagaggaacagagacagatgtgtgggcggcgtggtgcacagctttgatggcaccaaggaggccgccgccgccctgattgacctggacctgtacatcggcttcaacggctgcagcctgaagacagaggccaacctggaggtgctgaagagcatccccagcgagaagctgatgattgaaacagatgccccctggtgtggggtgaagagcacccatgctggcagcaagtacatcagaacagccttccccaccaagaagaagtgggagagcggccactgcctgaaggacagaaatgagccctgccacatcatccagatcctggagatcatgtctgctgtgagagatgaggaccccctggagctggccaacaccctgtacaacaacaccatcaaggtgttcttccctggcatctag

SEQ ID NO: 17156 - DNA, 753 bp, Artificial Sequence
  Description of Artificial Sequence: Synthetic coding sequence
atgatcactggaggcaacctgcaggacagcaaggatgccctgcacctggcccagaccaacggcatgttcttcagcacagtgggctgccaccccacccgctgtggggagtttgagaagaacaacccagacctgtacctgaaggagctgctgaacctggccgagaacaacaagggcaaggtggtggccatcggagaatgtggcctggactttgaccggctgcagttctgccccaaggacacccagctgaagtactttgagaagcagtttgagctgtctgagcagaccaagctgcccatgttcctgcactgcaggaacagccacgccgagttcctggacatcatgaagaggaacagagacagatgtgtgggcggcgtggtgcacagctttgatggcaccaaggaggccgctgctgccctgattgacctggacctgtacatcggcttcaacggctgcagcctgaagacagaggccaacctggaggtgctgaagagcatccccagcgagaagctgatgattgaaacagatgccccctggtgtggggtgaagagcacccacgccggcagcaagtacatcagaacagccttccccaccaagaagaagtgggagagcggccactgcctgaaggacagaaatgagccctgccacatcatccagatcctggagatcatgtctgctgtgagagatgaggaccccctggagctggccaacaccctgtacaacaacaccatcaaggtgttcttccctggcatctag

SEQ ID NO: 17157 - DNA, 333 bp, Artificial Sequence
  Description of Artificial Sequence: Synthetic coding sequence
atgatcactggaggcaacctgcaggacagcaaggatgccctgcacctggcccagaccaacggcatgttcttcagcacagtgggctgccaccccacccgctgtggggagtttgagaagaacaacccagacctgtacctgaaggagctgctgaacctggccgagaacaacaagggcaaggtggtggccatcggagaatgtggcctggactttgaccggctgcagttctgccccaaggacacccagctgaagtactttgagaagcagtttgagctgtctgagcagaccaagctgcccatgttcctgcactgcaggaacagccacgccgagttctag

SEQ ID NO: 17158 - DNA, 2286 bp, Artificial Sequence
  Description of Artificial Sequence: Synthetic coding sequence
atggccagcgagcggggcaaggtgaagcacaactggagcagcaccagcgagggctgccccaggaagaggagctgcctgcgggagccctgtgatgtggcccccagcagcaggcctgcccagaggtctgccagccgcagcggcggccccagcagccccaagaggctgaaggcccagaaggaggatgatgtggcctgcagccggcggctgtcctggggcagcagcagaagaagaaacaacagcagcagcagcttcagcccccacttcctgggccctggggtgggcggggccgccagcaagggctgcctgatccggaacacccggggcttcctgagcagcggcggcagccccctgcggcctgccaatgccagcctggaggagatggccagcctggaggaggaggcctgcagcctgaaggtggacagcaaggacagcagccacaacagcaccaacagcgagtttgctgctgaggccgagggccagaatgacaccatcgaggagcccaacaaggtgcagaagaggaagagggaccggctgcgggaccagggcagcaccatgatctacctgaaggccatccagggcatcctgggcaagtccatgcccaagaggaaaggagaggccgccacccgggccaagcccagcgctgctgagcaccccagccacggggagggccctgcccggtctgagggccctgccaagacagctgagggcgccgcccggtctgtgacagtgacagctgcccagaaggagaaggatgccaccccagaggtgtccatggaggaggacaagacagtgcctgagaggagcagcttctatgacagaagagtggtgattgacccccaggagaagcccagcgaggagcccctgggggacagaagaacagtgattgacaagtgcagcccccccctggagttcctggatgacagcgacagccacctggagatccagaagcacaaggaccgggaggtggtgatggagcaccccagcagcggcagtgactggagcgatgtggaggagatcagcacagtgcgcttcagccaggaggagcctgtgtccctgaagcccagcgctgtgcctgagcccagcagcttcaccacagattatgtgatgtacccaccccacctgtacagcagcccctggtgtgactatgccagctactggaccagcagccccaagcccagcagctaccccagcacaggcagcagcagcaatgatgctgcccaggtgggcaagagcagccgcagcaggatgtctgactacagccccaacagcacaggctctgtgcagaacaccagccgggacatggaggccagcgaggagggctggagccagaacagccgctccttccgcttcagccgcagcagcgaggagcgggaggtgaaggagaagaggaccttccaggaggagatgccaccccggccctgtggcggccacgccagcagcagcctgcccaagagccacctggagcccagcctggaggagggcttcatcgacacccactgccacctggacatgctgtacagcaagctgtccttccagggcaccttcaccaagttcaggaagatctacagcagcagcttccccaaggagttccagggctgcatcagtgacttctgtgaccccaggaccctgacagactgcctgtgggaggagctgctgaaggaggacctggtgtggggcgccttcggctgccacccccactttgcccgctactacagcgagagccaggagaggaacctgctgcaggccctgcggcaccccaaggctgtggcctttggagagatgggcctggactacagctacaagtgcaccacccctgtgcctgagcagcacaaggtgtttgagcggcagctgcagctggccgtgtccctgaagaagcccctggtgatccactgccgggaggctgatgaggacctgctggagatcatgaagaagtttgtgcccccagactacaagatccaccgccactgcttcaccggcagctaccctgtgattgagcccctgctgaagtacttccccaacatgtctgtgggcttcaccgctgtgctgacctacagcagcgcctgggaggcccgggaggccctgcggcagatccccctggagcgcatcatcgtggagacagatgccccctacttcctgccccggcaggtgcccaagagcctgtgccagtatgcccaccctggcctggccctgcacacagtgcgggagatcgcccgggtgaaggaccagcccctgagcctgaccctggccgccctgcgggagaacaccagccggctgtacagcctgtag

SEQ ID NO: 17159 - DNA, 2286 bp, Artificial Sequence; identical to SEQ ID NO: 17158
  Description of Artificial Sequence: Synthetic coding sequence

SEQ ID NO: 17160 - DNA, 822 bp, Artificial Sequence
  Description of Artificial Sequence: Synthetic coding sequence
atgagagctgctggggtgggcctggtggactgccactgccacctgagcgccccagactttgaccgggacctggatgatgtgctggagaaggccaagaaggccaacgtggtggccctggtggccgtggccgagcacagcggggagtttgagaagatcatgcagctgtctgagcgctacaacggctttgtgctgccctgcctgggcgtgcaccctgtgcagggcctgcccccagaggaccagaggtctgtgaccctgaaggacctggatgtggccctgcccatcatcgagaactacaaggaccggctgctggccatcggggaggtgggcctggacttcagccccaggtttgctggcactggagagcagaaggaggagcagaggcaggtgctgatccggcagatccagctggccaagaggctgaacctgcctgtgaatgtgcacagccgctctgctggccggcccaccatcaacctgctgcaggagcagggcgctgagaaggtgctgctgcacgcctttgatggccggcccagcgtggccatggagggcgtgcgggccggctacttcttcagcatcccccccagcatcatccgcagcggccagcagaagctggtgaagcagctgcccctgaccagcatctgcctggagacagacagccctgccctgggccctgagaagcaggtgagaaatgagccctggaacatcagcatctctgctgagtacatcgcccaggtgaagggcatctctgtggaggaggtgattgaggtgaccacccagaatgccctgaagctgttccccaagctgcggcacctgctgcagaagtag

SEQ ID NO: 17161 - DNA, 825 bp, Artificial Sequence
  Description of Artificial Sequence: Synthetic coding sequence
atgagagctgctggggtgggcctggtggactgccactgccacctgagcgccccagactttgaccgggacctggatgatgtgctggagaaggccaagaaggccaacgtggtggccctggtggccgtggccgagcacagcggggagtttgagaagatcatgcagctgtctgagcgctacaacggctttgtgctgccctgcctgggcgtgcaccctgtgcagggcctgcccccagaggaccagaggtctgtgaccctgaaggacctggatgtggccctgcccatcatcgagaactacaaggaccggctgctggccatcggggaggtgggcctggacttcagccccaggtttgctggcactggagagcagaaggaggagcagaggcaggtgctgatccggcagatccagctggccaagaggctgaacctgcctgtgaatgtgcacagccgctctgctggccggcccaccatcaacctgctgcaggagcagggcgctgagaaggtgctgctgcacgcctttgatggccggcccagcgtggccatggagggcgtgcgggccggctacttcttcagcatcccccccagcatcatccgcagcggccagaagcagaagctggtgaagcagctgcccctgaccagcatctgcctggagacagacagccctgccctgggccctgagaagcaggtgagaaatgagccctggaacatcagcatctctgctgagtacatcgcccaggtgaagggcatctctgtggaggaggtgattgaggtgaccacccagaatgccctgaagctgttccccaagctgcggcacctgctgcagaagtag

SEQ ID NO: 17162 - DNA, 762 bp, Artificial Sequence
  Description of Artificial Sequence: Synthetic coding sequence
atgagagctgctggggtgggcctggtggactgccactgccacctgagcgccccagactttgaccgggacctggatgatgtgctggagaaggccaagaaggccaacgtggtggccctggtggccgtggccgagcacagcggggagtttgagaagatcatgcagctgtctgagcgctacaacggctttgtgctgccctgcctgggcgtgcaccctgtgcagggcctgcccccagaggaccagaggtctgtgaccctgaaggtgggcctggacttcagccccaggtttgctggcaccggggagcagaaggaggagcagaggcaggtgctgatccggcagatccagctggccaagaggctgaacctgcctgtgaatgtgcacagccgctctgctggccggcccaccatcaacctgctgcaggagcagggcgctgagaaggtgctgctgcacgcctttgatggccggcccagcgtggccatggagggcgtgcgggccggctacttcttcagcatccccccatccatcatccgcagcggccagaagcagaagctggtgaagcagctgcccctgaccagcatctgcctggagacagacagccctgccctgggccctgagaagcaggtgagaaatgagccctggaacatcagcatctctgctgagtacatcgcccaggtgaagggcatctctgtggaggaggtgattgaggtgaccacccagaatgccctgaagctgttccccaagctgcggcacctgctgcagaagtag

SEQ ID NO: 17163 - DNA, 723 bp, Artificial Sequence
  Description of Artificial Sequence: Synthetic coding sequence
atgagagctgctggggtgggcctggtggactgccactgccacctgagcgccccagactttgaccgggacctggatgatgtgctggagaaggccaagaaggccaacgtggtggccctggtggccgtggccgagcacagcggggagtttgagaagatcatgcagctgtctgagcgctacaacggctttgtgctgccctgcctgggcgtgcaccctgtgcagggcctgcccccagaggaccagaggtctgtgaccctgaaggacctggatgtggccctgcccatcatcgagaactacaaggaccggctgctggccatcggggaggtgggcctggacttcagccccaggtttgctggcactggagagcagaaggaggagcagaggcaggtgctgatccggcagatccagctggccaagaggctgaacctgcctgtgaatgtgcacagccgctctgctggccggcccaccatcaacctgctgcaggagcagggcgctgagaaggtgctgctgcacgcctttgatggccggcccagcgtggccatggagggcgtgcgggccggctacttcttcagcatcccccccagcatcatccgcagcggccagctgctgagcctcttcagcaagaagcagaagctggtgaagcagctgcccctgaccagcatctgcctggagacagacagccctgccctgggccctgagaagcagcagaacatcctgcccaggtag

SEQ ID NO: 17164 - DNA, 846 bp, Artificial Sequence
  Description of Artificial Sequence: Synthetic coding sequence
atgagagctgctggggtgggcctggtggactgccactgccacctgagcgccccagactttgaccgggacctggatgatgtgctggagaaggccaagaaggccaacgtggtggccctggtggccgtggccgagcacagcggggagtttgagaagatcatgcagctgtctgagcgctacaacggctttgtgctgccctgcctgggcgtgcaccctgtgcagggcctgcccccagaggaccagaggtctgtgaccctgaaggacctggatgtggccctgcccatcatcgagaactacaaggaccggctgctggccatcggggaggtgggcctggacttcagccccaggtttgctggcactggagagcagaaggaggagcagaggcaggtgctgatccggcagatccagctggccaagaggctgaacctgcctgtgaatgtgcacagccgctctgctggccggcccaccatcaacctgctgcaggagcagggcgctgagaaggtgctgctgcacgcctttgatggccggcccagcgtggccatggagggcgtgcgggccggctacttcttcagcatcccccccagcatcatccgcagcggccagctgctgagcctcttcagcaagaagcagaagctggtgaagcagctgcccctgaccagcatctgcctggagacagacagccctgccctgggccctgagaagcaggtgagaaatgagccctggaacatcagcatctctgctgagtacatcgcccaggtgaagggcatctctgtggaggaggtgattgaggtgaccacccagaatgccctgaagctgttccccaagctgcggcacctgctgcagaagtag

SEQ ID NO: 17165 - DNA, 1824 bp, Artificial Sequence
  Description of Artificial Sequence: Synthetic coding sequence
atggccgagaagagaagaggcagcccctgcagcatgctgagcctgaaggcccacgccttctctgtggaggccctgattggagctgagaagcagcagcagctgcagaagaagaggaggaagctgggcgctgaggaggccgccggggctgtggatgatggcggctgcagccggggcggcggggccggggagaagggcagcagtgaaggagatgagggcgccgccctgcccccacctgctggggccaccagcggccctgcccggagcggggctgacctggagagaggagctgctgggggctgtgaagatggcttccagcagggcgccagccccctggccagccctgggggcagccccaagggcagccctgcccggagcctggcccggcccggcacccccctgcccagcccccaggccccccgggtggacctgcagggcgctgagctgtggaagcgcttccatgaaattggaacagagatgatcatcaccaaggccggccgcaggatgtttcctgccatgagggtgaagatcagcggcctggacccccaccagcagtactacatcgccatggacatcgtgcctgtggacaacaagcgctaccgctacgtgtaccacagcagcaagtggatggtggccggaaatgctgacagccctgtgcccccccgggtgtacatccacccagacagccctgccagcggggagacctggatgaggcaggtgatcagctttgacaagctgaagctgaccaacaatgagctggatgaccagggccacatcatcctgcacagcatgcacaagtaccagccccgggtgcacgtgatcaggaaggactgtggagatgacctgagccccatcaagcctgtgcccagcggggagggcgtgaaggccttctccttccctgagaccgtcttcaccaccgtgacagcctaccagaaccagcagatcacccggctgaagattgacaggaacccctttgccaagggcttccgggacagcggcaggaacaggatgggcctggaggccctggtggagagctatgccttctggaggcccagcctgcggaccctgacctttgaggacatccctggcatccccaagcagggcaatgccagcagcagcaccctgctgcagggcactggaaatggagtgcctgccacccacccccacctgctgagcggcagcagctgcagcagccctgccttccacctgggccccaacaccagccagctgtgcagcctggccccagctgactacagcgcctgtgcccggagcggcctgaccctgaaccgctacagcaccagcctggccgagacctacaaccggctgaccaaccaggccggggagacctttgccccacccaggacccccagctatgtgggcgtgagcagcagcacctctgtgaacatgtccatgggcggcacagatggagacaccttcagctgcccccagaccagcctgtccatgcagatcagcggcatgagcccccagctgcagtacatcatgcccagccccagcagcaatgcctttgccaccaaccagacccaccagggcagctacaacaccttccggctgcacagcccctgtgccctgtatggctacaacttcagcaccagccccaagctggccgccagccctgagaagatcgtgagcagccagggcagcttcctgggcagcagccccagcggcaccatgacagaccggcagatgctgccccctgtggagggcgtgcacctgctgagcagcggcggccagcagagcttctttgacagcaggaccctgggcagcctgaccctgagcagcagccaggtgtctgcccacatggtgtag

SEQ ID NO: 17166 - DNA, 918 bp, Artificial Sequence
  Description of Artificial Sequence: Synthetic coding sequence
cggggccgccacatctggaagctgggcttccccaagggcggctgtgaagatggcttccagcagggcgccagccccctggccagccctgggggcagccccaagggcagccctgcccggagcctggcccggcccggcacccccctgcccagcccccaggccccccgggtggacctgcagggcgctgagctgtggaagcgcttccacgagatcggcacagagatgatcatcaccaaggccggccgcaggatgtttcctgccatgagggtgaagatcagcggcctggacccccaccagcagtactacatcgccatggacatcgtgcctgtggacaacaagcgctaccgctacgtgtaccacagcagcaagtggatggtggccggaaatgctgacagccctgtgcccccccgggtgtacatccacccagacagccctgccagcggggagacctggatgaggcaggtgatcagctttgacaagctgaagctgaccaacaatgagctggatgaccagggccacatcatcctgcacagcatgcacaagtaccagccccgggtgcacgtgatcaggaaggactgtggagatgacctgagccccatcaagcctgtgcccagcggggagggcgtgaaggccttctccttccctgagaccgtcttcaccaccgtgacagcctaccagaaccagcagatcacccggctgaagattgacaggaacccctttgccaagggcttccgggacagcggcaggaacaggatgggcctggaggccctggtggagagctatgccttctggaggcccagcctgcggaccctgacctttgaggacatccctggcatccccaagcaggagtacagagacctgaagacagactacatcttccctgagcgggacaacctggtgtcccgggagaccaagctgtag

SEQ ID NO: 17167 - DNA, 2049 bp, Artificial Sequence
  Description of Artificial Sequence: Synthetic coding sequence
atgcagctggagcactgcctgagccccagcatcatgctgagcaagaagttcctgaatgtgagcagcagctacccccacagcggcggcagcgagctggtgctgcatgaccaccccatcatcagcaccacagacaacctggagaggagcagccccctgaagaagatcacccggggcatgaccaaccagagcgacacagacaacttcccagacagcaaggacagccctggagatgtgcagaggagcaagctgagccctgtgctggatggagtgtctgagctgcggcacagctttgatggcagcgctgctgaccgctacctgctgagccagagcagccagccccagagcgctgccacagcccccagcgccatgttcccctacccaggccagcacggccctgcccacccagccttcagcatcggcagccccagccgctacatggcccaccaccctgtgatcaccaacggggcctacaacagcctgctgagcaacagcagcccccagggctaccccacagctggctacccctacccccagcagtatggccacagctaccagggcgcccccttctaccagttcagcagcacccagcccggcctggtgcctgggaaggcccaggtgtacctgtgcaaccggcccctgtggctgaagttccaccgccaccagacagagatgatcatcaccaagcagggccgcaggatgttccccttcctgtccttcaacatcagcggcctggaccccacagcccactacaacatctttgtggatgtgatcctggccgaccccaaccactggaggttccagggcggcaagtgggtgccctgtgggaaggctgacaccaacgtgcagggcaacagagtgtacatgcacccagacagccccaacacaggagcccactggatgaggcaggagatcagctttgggaagctgaagctgaccaacaacaagggggccagcaacaacaacggccagatggtggtgctgcagagcctgcacaagtaccagccccggctgcacgtggtggaggtgaatgaagatggaacagaggacaccagccagcccggccgggtgcagaccttcaccttccctgagacccagttcatcgctgtgacagcctaccagaacacagacatcacccagctgaagattgaccacaacccctttgccaagggcttccgggacaactatgacaccatctacacaggctgtgacatggaccggctgacccccagccccaatgacagccccaggagccagatcgtgcctggggcccgctatgccatggccggcagcttcctgcaggaccagtttgtgagcaactatgccaaggcccgcttccaccctggagctggagctggccctggccctggaacagacagatctgtgccccacaccaacggcctgctgagcccccagcaggccgaggaccccggggcccccagcccccagcgctggtttgtgaccccagccaacaaccggctggactttgctgccagcgcctatgacacagccacagactttgctggaaatgctgccaccctgctgtcctatgctgctgctggggtgaaggccctgcccctgcaggccgccggctgcaccggccggcccctgggctactatgctgaccccagcggctggggcgcccggagccccccccagtactgcggcaccaagagcggctctgtgctgccctgctggcccaacagcgctgctgctgctgccaggatggccggggccaacccctacctgggggaggaggccgagggcctggccgctgagaggagccccctgcccccaggagctgctgaagatgccaagcccaaggacctgagtgacagctcctggattgagacccccagcagcatcaagagcattgacagcagtgacagcggcatctatgagcaggccaagagaagacgcatcagccctgctgacacccctgtgtctgagagcagcagccccctgaagtctgaggtgctggcccagagggactgtgagaagaactgtgccaaggacatcagcggctactacggcttctacagccacagctag

SEQ ID NO: 17168 - DNA, 1188 bp, Artificial Sequence
  Description of Artificial Sequence: Synthetic coding sequence
atgcacccagacagccccaacacaggagcccactggatgaggcaggagatcagctttgggaagctgaagctgaccaacaacaagggggccagcaacaacaacggccagatggtggtgctgcagagcctgcacaagtaccagccccggctgcacgtggtggaggtgaatgaagatggaacagaggacaccagccagcccggccgggtgcagaccttcaccttccctgagacccagttcatcgctgtgacagcctaccagaacacagacatcacccagctgaagattgaccacaacccctttgccaagggcttccgggacaactatgacaccatctacacaggctgtgacatggaccggctgacccccagccccaatgacagccccaggagccagatcgtgcctggggcccgctatgccatggccggcagcttcctgcaggaccagtttgtgagcaactatgccaaggcccgcttccaccctggggccggggccggccctggccctggaacagacagatctgtgccccacaccaacggcctgctgagcccccagcaggctgaagatcctggggcccccagcccccagcgctggtttgtgaccccagccaacaaccggctggactttgctgccagcgcctatgacacagccacagactttgctggaaatgctgccaccctgctgtcctatgctgctgctggggtgaaggccctgcccctgcaggccgccggctgcaccggccggcccctgggctactatgctgaccccagcggctggggcgcccggagccccccccagtactgcggcaccaagagcggctctgtgctgccctgctggcccaacagcgctgctgctgctgccaggatggccggggccaacccctacctgggggaggaggccgagggcctggccgctgagaggagccccctgcccccaggagctgctgaagatgccaagcccaaggacctgagtgacagctcctggattgagacccccagcagcatcaagagcattgacagcagtgacagcggcatctatgagcaggccaagagaagacgcatcagccctgctgacacccctgtgtctgagagcagcagccccctgaagtctgaggtgctggcccagagggactgtgagaagaactgtgccaaggacatcagcggctactacggcttctacagccacagctag

SEQ ID NO: 17169 - DNA, 1056 bp, Artificial Sequence
  Description of Artificial Sequence: Synthetic coding sequence
atgcacccagacagccccaacacaggagcccactggatgaggcaggagatcagctttgggaagctgaagctgaccaacaacaagggggccagcaacaacaacggccagatggtggtgctgcagagcctgcacaagtaccagccccggctgcacgtggtggaggtgaatgaagatggaacagaggacaccagccagcccggccgggtgcagaccttcaccttccctgagacccagttcatcgctgtgacagcctaccagaacacagacatcacccagctgaagattgaccacaacccctttgccaagggcttccgggacaactatgacaccatctacacaggctgtgacatggaccgggccggccctggccctggaacagacagatctgtgccccacaccaacggcctgctgagcccccagcaggctgaagatcctggggcccccagcccccagcgctggtttgtgaccccagccaacaaccggctggactttgctgccagcgcctatgacacagccacagactttgctggaaatgctgccaccctgctgtcctatgctgctgctggggtgaaggccctgcccctgcaggccgccggctgcaccggccggcccctgggctactatgctgaccccagcggctggggcgcccggagccccccccagtactgcggcaccaagagcggctctgtgctgccctgctggcccaacagcgctgctgctgctgccaggatggccggggccaacccctacctgggggaggaggccgagggcctggccgctgagaggagccccctgcccccaggagctgctgaagatgccaagcccaaggacctgagtgacagctcctggattgagacccccagcagcatcaagagcattgacagcagtgacagcggcatctatgagcaggccaagagaagacgcatcagccctgctgacacccctgtgtctgagagcagcagccccctgaagtctgaggtgctggcccagagggactgtgagaagaactgtgccaaggacatcagcggctactacggcttctacagccacagctag

SEQ ID NO: 17170 - DNA, 2739 bp, Artificial Sequence
  Description of Artificial Sequence: Synthetic coding sequence
atgagcctgcccatcggcagcgctgaggtggccagcgagcgggtggagctgtggaggagcggcttccgctggtggcagcgctgcctgtgcttctgccgctacagaagagtggccatggctgctgtggacagtgatgtggagagcctgccccggggcggcttccgctgctgcctgtgccacgtgaccacagccaaccggcccagcctggatgcccacctgggcggcaggaagcaccgccacctggtggagctgcgggccgccaggaaggcccagggcctgcggtctgtgtttgtgtctggcttccccagagatgtggacagcgcccagctgtctgagtacttcctggcctttggacctgtggcctctgtggtgatggacaaggacaagggcgtgtttgccatcgtggagatgggagatgtgggcgcccgggaggccgtgctgagccagagccagcacagcctgggcggccaccggctgcgggtgcggccccgggagcagaaggagttccagagccctgccagcaagagccccaagggggccgccccagacagccaccagctggccaaggccctggccgaggccgcagatgtgggcgcccagatgatcaagctggtgggcctgcgggagctgtctgaggccgagcggcagctgcggagcctggtggtggccctgatgcaggaggtgttcacagagttcttccctggctgtgtggtgcaccccttcggcagcagcatcaacagctttgatgtgcacggctgtgacctggacctcttcctggacctgggggacctggaggagccccagcctgtgcccaaggcccctgagagccccagcctggacagcgccctggccagccccctggacccccaggccctggcctgcaccccagccagccccccagacagccagcccccagccagcccccaggacagcgaggccctggactttgagacccccagcagcagcctggccccccagaccccagacagcgccctggccagcgagaccctggccagcccccagagcctgcccccagccagccccctgctggaggaccgggaggagggggacctgggcaaggccagcgagctggccgagacccccaaggaggagaaggccgagggcgccgccatgctggagctggtgggcagcatcctgcggggctgtgtgcctggggtgtacagagtgcagacagtgcccagcgcccggcggcctgtggtgaagttctgccaccggcccagcggcctgcatggagatgtgtccctgagcaaccggctggccctgcacaacagccgcttcctgagcctgtgcagcgagctggatggccgggtgcggcccctggtgtacaccctgcgctgctgggcccagggccggggcctgagcggcagcggccccctgctgagcaactatgccctgaccctgctggtgatctacttcctgcagacccgggacccccctgtgctgcccaccgtgtcccagctgacccagaaggccggggagggggagcaggtggaggtggatggctgggactgcagcttccccagagatgccagccggctggagcccagcatcaacgtggagcccctgagcagcctgctggcccagttcttcagctgtgtgtcctgctgggacctgcggggcagcctgctgagcctgcgggagggccaggccctgcctgtggccggcggcctgcccagcaacctgtgggagggcctgcggctgggccccctgaacctgcaggacccctttgacctgagccacaacgtggccgccaacgtgaccagccgggtggccggccgcctgcagaactgctgcagagctgctgccaactactgccgcagcctgcagtaccagaggaggagcagccggggccgggactggggcctgctgcccctgctgcagcccagcagccccagcagcctgctgagcgccacccccatccccctgcccctggcccccttcacccagctgacagctgccctggtgcaggtgttccgggaggccctgggctgccacatcgagcaggccaccaagaggaccaggtctgagggcggcggcactggagagagcagccagggcggcaccagcaagaggctgaaggtggatggccagaagaactgctgtgaggagggcaaggaggagcagcagggctgtgctggagatggaggagaggacagagtggaggagatggtgattgaggtgggggagatggtgcaggactgggccatgcagagccctggccagcccggggacctgcccctgaccaccgggaagcatggagcccctggagaggagggccagcccagccatgctgccctggccgagcggggccccaagggccatgaagctgcccaggagtggagccagggcgaggccggcaagggggccagcctgcccagcagcgcctcctggaggtgtgccctgtggcaccgggtgtggcagggcagaagaagagcccggcggcggctgcagcagcagaccaaggagggcgccggcggcggggccggcaccagggctggctggctggccacagaggcccaggtgacccaggagctgaagggcctgagcggcggggaggagaggcctgagacagagcccctgctgagctttgtggcctctgtgtccccagctgacaggatgctgactgtgacccccctgcaggacccccagggcctcttcccagacctgcaccacttcctgcaggtgttcctgccccaggccatccgccacctgaagtag

SEQ ID NO: 17171 - DNA, 2625 bp, Artificial Sequence
  Description of Artificial Sequence: Synthetic coding sequence
atggctgctgtggacagtgatgtggagagcctgccccggggcggcttccgctgctgcctgtgccacgtgaccacagccaaccggcccagcctggatgcccacctgggcggcaggaagcaccgccacctggtggagctgcgggccgccaggaaggcccagggcctgcggtctgtgtttgtgtctggcttccccagagatgtggacagcgcccagctgtctgagtacttcctggcctttggacctgtggcctctgtggtgatggacaaggacaagggcgtgtttgccatcgtggagatgggagatgtgggcgcccgggaggccgtgctgagccagagccagcacagcctgggcggccaccggctgcgggtgcggccccgggagcagaaggagttccagagccctgccagcaagagccccaagggggccgccccagacagccaccagctggccaaggccctggccgaggccgcagatgtgggcgcccagatgatcaagctggtgggcctgcgggagctgtctgaggccgagcggcagctgcggagcctggtggtggccctgatgcaggaggtgttcacagagttcttccctggctgtgtggtgcaccccttcggcagcagcatcaacagctttgatgtgcacggctgtgacctggacctcttcctggacctgggggacctggaggagccccagcctgtgcccaaggcccctgagagccccagcctggacagcgccctggccagccccctggacccccaggccctggcctgcaccccagccagccccccagacagccagcccccagccagcccccaggacagcgaggccctggactttgagacccccagcagcagcctggccccccagaccccagacagcgccctggccagcgagaccctggccagcccccagagcctgcccccagccagccccctgctggaggaccgggaggagggggacctgggcaaggccagcgagctggccgagacccccaaggaggagaaggccgagggcgccgccatgctggagctggtgggcagcatcctgcggggctgtgtgcctggggtgtacagagtgcagacagtgcccagcgcccggcggcctgtggtgaagttctgccaccggcccagcggcctgcatggagatgtgtccctgagcaaccggctggccctgcacaacagccgcttcctgagcctgtgcagcgagctggatggccgggtgcggcccctggtgtacaccctgcgctgctgggcccagggccggggcctgagcggcagcggccccctgctgagcaactatgccctgaccctgctggtgatctacttcctgcagacccgggacccccctgtgctgcccaccgtgtcccagctgacccagaaggccggggagggggagcaggtggaggtggatggctgggactgcagcttccccagagatgccagccggctggagcccagcatcaacgtggagcccctgagcagcctgctggcccagttcttcagctgtgtgtcctgctgggacctgcggggcagcctgctgagcctgcgggagggccaggccctgcctgtggccggcggcctgcccagcaacctgtgggagggcctgcggctgggccccctgaacctgcaggacccctttgacctgagccacaacgtggccgccaacgtgaccagccgggtggccggccgcctgcagaactgctgcagagctgctgccaactactgccgcagcctgcagtaccagaggaggagcagccggggccgggactggggcctgctgcccctgctgcagcccagcagccccagcagcctgctgagcgccacccccatccccctgcccctggcccccttcacccagctgacagctgccctggtgcaggtgttccgggaggccctgggctgccacatcgagcaggccaccaagaggaccaggtctgagggcggcggcactggagagagcagccagggcggcaccagcaagaggctgaaggtggatggccagaagaactgctgtgaggagggcaaggaggagcagcagggctgtgctggagatggaggagaggacagagtggaggagatggtgattgaggtgggggagatggtgcaggactgggccatgcagagccctggccagcccggggacctgcccctgaccaccgggaagcatggagcccctggagaggagggccagcccagccatgctgccctggccgagcggggccccaagggccatgaagctgcccaggagtggagccagggcgaggccggcaagggggccagcctgcccagcagcgcctcctggaggtgtgccctgtggcaccgggtgtggcagggcagaagaagagcccggcggcggctgcagcagcagaccaaggagggcgccggcggcggggccggcaccagggctggctggctggccacagaggcccaggtgacccaggagctgaagggcctgagcggcggggaggagaggcctgagacagagcccctgctgagctttgtggcctctgtgtccccagctgacaggatgctgactgtgacccccctgcaggacccccagggcctcttcccagacctgcaccacttcctgcaggtgttcctgccccaggccatccgccacctgaagtag

SEQ ID NO: 17172 - DNA, 495 bp, Artificial Sequence
  Description of Artificial Sequence: Synthetic coding sequence
atgtgcccccctgtgtccatgagatatgaggaggagggcatgagctacctgtatgcctcctggatgtaccagctgcagcacggggaccagctgagcatctgcttcacctgcttcaaggccgccttcctggacttcaaggacctgctggagagcgaggactgggaggaggacaactgggaccctgagctgatggagcacacagaagctgagagcgagcaggagggcagcagcggcatggagctgtcctggggccagagccctggccagcctgtgcagggcggcagcgaggcctggggccctggcaccctggccgccgcccctgagggcctggaggatgctggcctggacccccactttgtgcccacagagctgtggccccaggaggccgtgcccctgggcctgggcctggaggatgctgactggacccagggcctgccctggaggtttgaggagctgctgacctgcagccactggcccagcttcttccccagctag

SEQ ID NO: 17173 - DNA, 1236 bp, Artificial Sequence
  Description of Artificial Sequence: Synthetic coding sequence
atgctgagcctgcgggagcagcagctgcaggtgtggttcaagaacagaagagccaagctggcccgggagcggcggctgcagcagcagccccagagggtgcccggccagaggggccgcggggcccgggccgcccccctggtgcctgctgccagcgccagcgccccccagaggggccccagcggcatcctgcctgctgctgagcccaccatctgcagcctgcaccaggcctggggcggccctggctgccgggcccagaagggcatcccagctgccctgagccctggccctggccccatcccagcccccatccctggccctgcccagatccctggccccctgcccggcagcatccctggccccatccctggccctgcccagatccccagccccatcccagcccccatccctggccccatcagcggccctgtgcagatccctggccccttccggggccccatccctggccccatcagcggccctgcccccatccctggccccatcagcggccccttcagcggccccaaccctggccccatccctggccccaaccctggccccatccctggccccatcagcggccccatccctggccccatctctgtgcccatccctggccccatccctggccccatcagcggccccatcagcggccccaaccctggccccatccctggccccatccctggccccatcagcggccccaaccctggccccatccctggccccatcagcggccccaaccctggcctcatccctggccccatccctggccccatcagcggccctggccccatcatcggccccatccccagccctgcccagatccctggccctggccgcctgcagggccctggccccatcctgagccctggccgcatgaggagccctggcagcctgcccggcctggcccccatcctgggccctggcagcggccctggcagcggctctgtgcctgcccccatccctggccctggcagcctgcctgccccagcccccctgtggccccagagcccagatgccagtgacttcctgcctgacacccagctgttcccccacttcacagagctgctgctgcccctggaccccctggagggcagctctgtgtccaccatgaccagccagtaccaggagggagatgacagcatgggcaagaagcacagcggcagccagccccaggaggagggcggctctgtgaatgaaaaccacagcggcccccggctgctgctggacctgtag

SEQ ID NO: 17174 - DNA, 1527 bp, Artificial Sequence
  Description of Artificial Sequence: Synthetic coding sequence
atggatgaggccggcaaccaccacagcgagcagaccatcaccaggacagagaaccagaccccccacgccctggcccacaggaggatgggcccctgcctgagctgcagccagctgtacagccagtacctgggcctgagccagacccacagcagcccccccctggccctggaccccccccggcggcagaggcaggagaggacagtgtacacagagagccagcagaaggtgctggagttctacttccagaaggaccagtaccccaactatgaccagaggctgaacctggccgagatgctgagcctgcgggagcagcagctgcaggtgtggttcaagaacagaagagccaagctggcccgggagcggcggctgcagcagcagccccagagggtgcccggccagaggggccgcggggcccgggccgcccccctggtgcctgctgccagcgccagcgccccccagaggggccccagcggcatcctgcctgctgctgagcccaccatctgcagcctgcaccaggcctggggcggccctggctgccgggcccagaagggcatcccagctgccctgagccctggccctggccccatcccagcccccatccctggccctgcccagatccctggccccctgcccggcagcatccctggccccatccctggccctgcccagatccccagccccatcccagcccccatccctggccccatcagcggccctgtgcagatccctggccccttccggggccccatccctggccccatcagcggccctgcccccatccctggccccatcagcggccccttcagcggccccaaccctggccccatccctggccccaaccctggccccatccctggccccatcagcggccccatccctggccccatctctgtgcccatccctggccccatccctggccccatcagcggccccatcagcggccccaaccctggccccatccctggccccatccctggccccatcagcggccccaaccctggccccatccctggccccatcagcggccccaaccctggcctcatccctggccccatccctggccccatcagcggccctggccccatcatcggccccatccccagccctgcccagatccctggccctggccgcctgcagggccctggccccatcctgagccctggccgcatgaggagccctggcagcctgcccggcctggcccccatcctgggccctggcagcggccctggcagcggctctgtgcctgcccccatccctggccctggcagcctgcctgccccagcccccctgtggccccagagcccagatgccagtgacttcctgcctgacacccagctgttcccccacttcacagagctgctgctgcccctggaccccctggagggcagctctgtgtccaccatgaccagccagtaccaggagggagatgacagcatgggcaagaagcacagcggcagccagccccaggaggagggcggctctgtgaatgaaaaccacagcggcccccggctgctgctggacctgtag

SEQ ID NO: 17175 - DNA, 1206 bp, Artificial Sequence
  Description of Artificial Sequence: Synthetic coding sequence
atgctgagcctgcgggagcagcagctgcaggtgtggttcaagaacagaagagccaagctggcccgggagcggcggctgcagcagcagccccagagggtgcccggccagaggggccgcggggcccgggccgcccccctggtgcctgctgccagcgccagcgccccccagaggggccccagcggcatcctgcctgctgctgagcccaccatctgcagcctgcaccaggcctggggcggccctggctgccgggcccagaagggcatcccagctgccctgagccctggccctggccccatcccagcccccatccctggccctgcccagatccctggccccctgcccggcagcatccctggccccatccctggccctgcccagatccccagccccatcccagcccccatccctggccccatcagcggccctgtgcagatccctggccccttccggggccccatccctggccccatcagcggccccttcagcggccccaaccctggccccatccctggccccaaccctggccccatccctggccccatcagcggccccatccctggccccatctctgtgcccatccctggccccatccctggccccatcagcggccccatcagcggccccaaccctggccccatccctggccccatccctggccccatcagcggccccaaccctggccccatccctggccccatcagcggccccaaccctggcctcatccctggccccatccctggccccatcagcggccctggccccatcatcggccccatccccagccctgcccagatccctggccctggccgcctgcagggccctggccccatcctgagccctggccgcatgaggagccctggcagcctgcccggcctggcccccatcctgggccctggcagcggccctggcagcggctctgtgcctgcccccatccctggccctggcagcctgcctgccccagcccccctgtggccccagagcccagatgccagtgacttcctgcctgacacccagctgttcccccacttcacagagctgctgctgcccctggaccccctggagggcagctctgtgtccaccatgaccagccagtaccaggagggagatgacagcatgggcaagaagcacagcggcagccagccccaggaggagggcggctctgtgaatgaaaaccacagcggcccccggctgctgctggacctgtag

SEQ ID NO: 17176 - DNA, 1206 bp, Artificial Sequence
  Description of Artificial Sequence: Synthetic coding sequence
atggtgctggcccagagccgggtgtctgctggggtgggcagcccccactgcagcggcagcggcggcggcggcagtgacagcttcccctggccagccagccaccctggcaacccccagtgcagcttcagcacagccttcctggccagcccccggctgagccggggcaccctggcctacctgcccccagccccctggagcagcctggccacccccagcgccctgctgggcagcagctgtgcccctcctcctcctccagcccgctgcccccagccccgggccctgagccctgagctgggcaccaaggccggcccccggcggccccaccgctgggagctgcccaggagccccagccagggcgcccagggccctgccccccggcggcggctgctggagaccatgaagggcatcgtggccgccagcggcagcgagacagaagatgaagattccatggacatccccctggacctgagcagcagcgctggcagcggcaagagaagaagaagaggcaacctgcccaaggagagcgtgcagatcctgcgggactggctgtatgagcaccgctacaatgcctaccccagcgagcaggagaaggccctgctgagccagcagacccacctgagcaccctgcaggtgtgcaactggttcatcaatgcccggcggcggctgctgcctgacatgctgaggaaggatggcaaggaccccaaccagttcaccatcagcagaagaggagccaagatcagcgagaccagctctgtggagagcgtgatgggcatcaagaacttcatgcctgccctggaggagacccccttccacagctgcacagctggccccaaccccaccctgggccggcccctgagccccaagcccagcagccctggctctgtgctggcccggcccagcgtcatctgccacaccaccgtgacagccctgaaggatgtgcccttcagcctgtgccagagcgtgggcgtgggccagaacacagacatccagcagattgctgccaagaacttcacagacaccagcctgatgtacccagaggacacctgcaagagcggccccagcaccaacacccagagcggcctcttcaacaccccaccacccaccccaccagacctgaaccaggacttcagcggcttccagctgctggtggatgtggccctgaagagagctgctgagatggagctgcaggccaagctgacagcctag

SEQ ID NO: 17177 - DNA, 819 bp, Artificial Sequence
  Description of Artificial Sequence: Synthetic coding sequence
atgaagggcaagaagggcatcgtggccgccagcggcagcgagacagaagatgaggacagcatggacatccccctggacctgagcagcagcgctggcagcggcaagagaagaagaagaggcaacctgcccaaggagagcgtgcagatcctgcgggactggctgtatgagcaccgctacaatgcctaccccagcgagcaggagaaggccctgctgagccagcagacccacctgagcaccctgcaggtgtgcaactggttcatcaatgcccggcggcggctgctgcctgacatgctgaggaaggatggcaaggaccccaaccagttcaccatcagccggcggggggccaagatcagcgagaccagctctgtggagagcgtgatgggcatcaagaacttcatgcctgccctggaggagacccccttccacagctgcacagctggccccaaccccaccctgggccggcccctgagccccaagcccagcagccctggctctgtgctggcccggcccagcgtcatctgccacaccaccgtgacagccctgaaggatgtgcccttcagcctgtgccagagcgtgggcgtgggccagaacacagacatccagcagattgctgccaagaacttcacagacaccagcctgatgtacccagaggacacctgcaagagcggccccagcaccaacacccagagcggcctcttcaacaccccaccacccaccccaccagacctgaaccaggacttcagcggcttccagctgctggtggatgtggccctgaagagagctgctgagatggagctgcaggccaagctgacagcctag

SEQ ID NO: 17178 - DNA, 759 bp, Artificial Sequence
  Description of Artificial Sequence: Synthetic coding sequence
atggacatccccctggacctgagcagcagcgctggcagcggcaagagaagaagaagaggcaacctgcccaaggagagcgtgcagatcctgcgggactggctgtatgagcaccgctacaatgcctaccccagcgagcaggagaaggccctgctgagccagcagacccacctgagcaccctgcaggtgtgcaactggttcatcaatgcccggcggcggctgctgcctgacatgctgaggaaggatggcaaggaccccaaccagttcaccatcagccggcggggggccaagatcagcgagaccagctctgtggagagcgtgatgggcatcaagaacttcatgcctgccctggaggagacccccttccacagctgcacagctggccccaaccccaccctgggccggcccctgagccccaagcccagcagccctggctctgtgctggcccggcccagcgtcatctgccacaccaccgtgacagccctgaaggatgtgcccttcagcctgtgccagagcgtgggcgtgggccagaacacagacatccagcagattgctgccaagaacttcacagacaccagcctgatgtacccagaggacacctgcaagagcggccccagcaccaacacccagagcggcctcttcaacaccccaccacccaccccaccagacctgaaccaggacttcagcggcttccagctgctggtggatgtggccctgaagagagctgctgagatggagctgcaggccaagctgacagcctag

SEQ ID NO: 17179 - DNA, 759 bp, Artificial Sequence; identical to SEQ ID NO: 17178
  Description of Artificial Sequence: Synthetic coding sequence

SEQ ID NO: 17180 - DNA, 759 bp, Artificial Sequence; identical to SEQ ID NO: 17178
  Description of Artificial Sequence: Synthetic coding sequence

SEQ ID NO: 17181 - DNA, 759 bp, Artificial Sequence; identical to SEQ ID NO: 17178
  Description of Artificial Sequence: Synthetic coding sequence

SEQ ID NO: 17182 - DNA, 819 bp, Artificial Sequence; identical to SEQ ID NO: 17177
  Description of Artificial Sequence: Synthetic coding sequence

SEQ ID NO: 17183 - DNA, 759 bp, Artificial Sequence; identical to SEQ ID NO: 17178
  Description of Artificial Sequence: Synthetic coding sequence

SEQ ID NO: 17184 - DNA, 861 bp, Artificial Sequence
  Description of Artificial Sequence: Synthetic coding sequence
atgacctgcagcggcaagagctgtgccctggcccggagcagcctgaccagcagccagggcatcgtggccgccagcggcagcgagacagaagatgaggacagcatggacatccccctggacctgagcagcagcgctggcagcggcaagagaagaagaagaggcaacctgcccaaggagagcgtgcagatcctgcgggactggctgtatgagcaccgctacaatgcctaccccagcgagcaggagaaggccctgctgagccagcagacccacctgagcaccctgcaggtgtgcaactggttcatcaatgcccggcggcggctgctgcctgacatgctgaggaaggatggcaaggaccccaaccagttcaccatcagccggcggggggccaagatcagcgagaccagctctgtggagagcgtgatgggcatcaagaacttcatgcctgccctggaggagacccccttccacagctgcacagctggccccaaccccaccctgggccggcccctgagccccaagcccagcagccctggctctgtgctggcccggcccagcgtcatctgccacaccaccgtgacagccctgaaggatgtgcccttcagcctgtgccagagcgtgggcgtgggccagaacacagacatccagcagattgctgccaagaacttcacagacaccagcctgatgtacccagaggacacctgcaagagcggccccagcaccaacacccagagcggcctcttcaacaccccaccacccaccccaccagacctgaaccaggacttcagcggcttccagctgctggtggatgtggccctgaagagagctgctgagatggagctgcaggccaagctgacagcctag

SEQ ID NO: 17185 - DNA, 279 bp, Artificial Sequence
  Description of Artificial Sequence: Synthetic coding sequence
atggacatccccctggacctgagcagcagcgctggcagcggcaagagaagaagaagaggcaacctgcccaaggagagcgtgcagatcctgcgggactggctgtatgagcaccgctacaatgcctaccccagcgagcaggagaaggccctgctgagccagcagacccacctgagcaccctgcaggtgtgcaactggttcatcaatgcccggcggcggctgctgcctgacatgctgaggaaggatggcaaggaccccaaccagttcaccatcagcaggtag

SEQ ID NO: 17186 - DNA, 402 bp, Artificial Sequence
  Description of Artificial Sequence: Synthetic coding sequence
atggacatccccctggacctgagcagcagcgctggcagcggcaagagaagaagaagaggcaacctgcccaaggagagcgtgcagatcctgcgggactggctgtatgagcaccgctacaatgcctaccccagcgagcaggagaaggccctgctgagccagcagacccacctgagcaccctgcaggtgtgcaactggttcatcaatgcccggcggcggctgctgcctgacatgctgaggaaggatggcaaggaccccaaccagttcaccatcagccggcggggggccaagatcagcgagaccagctctgtggagagcgtgatgggcatcaagaacttcatgcctgccctggaggagacccccttccacagctgcacagctggccccaaccccaccctgggctag

SEQ ID NO: 17187 - DNA, 741 bp, Artificial Sequence
  Description of Artificial Sequence: Synthetic coding sequence
atggacatccccctggacctgagcagcagcgctggcagcggcaagagaagaagaagaggcaacctgcccaaggagagcgtgcagatcctgcgggactggctgtatgagcaccgctacaatgcctaccccagcgagcaggagaaggccctgctgagccagcagacccacctgagcaccctgcaggtgtgcaactggttcatcaatgcccggcggcggctgctgcctgacatgctgaggaaggatggcaaggaccccaaccagttcaccatcagccggcggggggccaagatcagcgagaccagctctgtggagagcgtgatgggcatcaagaacttcatgcctgccctggaggagacccccttccacagctgcacagctggccccaaccccaccctgggccggcccctgagccccaagcccagcagccctggctctgtgctggcccggcccagcgtcatctgccacaccaccgtgacagccctgaaggatgtgcccttcagcctgtgccagagcgtgggcgtgggccagaacacagacatccagcagattgctgccaagaacttcacagacaccagcctgatgtacccagaggacacctgcaagagcggccccagcaccaacacccagagcggcctcttcaacaccccaccacccaccccaccagacctgaaccaggacttcagcggcttccagctgctggtggatgtggccctgaagagagctgctgagatggagctgtag

SEQ ID NO: 17188 - DNA, 660 bp, Artificial Sequence
  Description of Artificial Sequence: Synthetic coding sequence
atggacatccccctggacctgagcagcagcgctggcagcggcaagagaagaagaagaggcaacctgcccaaggagagcgtgcagatcctgcgggactggctgtatgagcaccgctacaatgcctaccccagcgagcaggagaaggccctgctgagccagcagacccacctgagcaccctgcaggtgtgcaactggttcatcaatgcccggcggcggctgctgcctgacatgctgaggaaggatggcaaggaccccaaccagttcaccatcagccggcggggggccaagatcagcgagaccagctctgtggagagcgtgatgggcatcaagaacttcatgcctgccctggaggagacccccttccacagctgcacagctggccccaaccccaccctgggccggcccctgagccccaagcccagcagccctggctctgtgctggcccggcccagcgtcatctgccacaccaccgtgacagccctgaaggatgtgcccttcagcctgtgccagagcgtgggcgtgggccagaacacagacatccagcagattgctgccaagaacttcacagacaccagcctgatgtacccagaggacacctgcaagagcggccccagcaccaacacccagagcggcctcttcaacaccccaccacccacctag

SEQ ID NO: 17189 - DNA, 396 bp, Artificial Sequence
  Description of Artificial Sequence: Synthetic coding sequence
atggacatccccctggacctgagcagcagcgctggcagcggcaagagaagaagaagaggcaacctgcccaaggagagcgtgcagatcctgcgggactggctgtatgagcaccgctacaatgcctaccccagcgagcaggagaaggccctgctgagccagcagacccacctgagcaccctgcaggtgtgcaactggttcatcaatgcccggcggcggctgctgcctgacatgctgaggaaggatggcaaggaccccaaccagttcaccatcagccggcggggggccaagatcagcgagaccagctctgtggagagcgtgatgggcatcaagaacttcatgcctgccctggaggagacccccttccacagctgcacagctggccccaaccccacctag

SEQ ID NO: 17190 - DNA, 417 bp, Artificial Sequence
  Description of Artificial Sequence: Synthetic coding sequence
atggacatccccctggacctgagcagcagcgctggcagcggcaagagaagaagaagaggcaacctgcccaaggagagcgtgcagatcctgcgggactggctgtatgagcaccgctacaatgcctaccccagcgagcaggagaaggccctgctgagccagcagacccacctgagcaccctgcaggtgtgcaactggttcatcaatgcccggcggcggctgctgcctgacatgctgaggaaggatggcaaggaccccaaccagttcaccatcagccggcggggggccaagatcagcgagaccagctctgtggagagcgtgatgggcatcaagaacttcatgcctgccctggaggagacccccttccacagctgcacagctggccccaaccccaccctgggccggcccctgagcccctag

SEQ ID NO: 17191 - DNA, 759 bp, Artificial Sequence; identical to SEQ ID NO: 17178
  Description of Artificial Sequence: Synthetic coding sequence

SEQ ID NO: 17192 - DNA, 507 bp, Artificial Sequence
  Description of Artificial Sequence: Synthetic coding sequence
atggacatccccctggacctgagcagcagcgctggcagcggcaagagaagaagaagaggcaacctgcccaaggagagcgtgcagatcctgcgggactggctgtatgagcaccgctacaatgcctaccccagcgagcaggagaaggccctgctgagccagcagacccacctgagcaccctgcaggtgtgcaactggttcatcaatgcccggcggcggctgctgcctgacatgctgaggaaggatggcaaggaccccaaccagttcaccatcagccggcggggggccaagatcagcgagaccagctctgtggagagcgtgatgggcatcaagaacttcatgcctgccctggaggagacccccttccacagctgcacagctggccccaaccccaccctgggccggcccctgagccccaagcccagcagccctggctctgtgctggcccggcccagcgtcatctgccacaccaccgtgacagccctgaaggatgtgcccttcagcctgtag

SEQ ID NO: 17193 - DNA, 2523 bp, Artificial Sequence
  Description of Artificial Sequence: Synthetic coding sequence
atggccggccctggcagcactggaggccagattggagctgctgccctggccggcggggcccggagcaaggtggcccccagcgtggactttgaccacagctgcagcgacagcgtggagtacctgaccctgaactttggcccctttgagaccgtgcaccgctggaggcggctgcccccctgtgatgaatttgtgggcgcccggcgcagcaagcacacagtggtggcctacaaggatgccatctacgtgtttggaggagacaatggcaagaccatgctgaatgacctgctgcgctttgatgtgaaggactgctcctggtgccgggccttcaccaccggcaccccaccagccccccgctaccaccacagcgctgtggtgtatggcagctccatgtttgtgtttggaggctacacaggagacatctacagcaacagcaacctgaagaacaagaatgacctgtttgagtacaagtttgccaccggccagtggacagagtggaagattgagggccgcctgcctgtggcccggagcgcccacggggccaccgtgtacagcgacaagctgtggatctttgctggctatgatggaaatgcccggctgaatgacatgtggaccatcggcctgcaggaccgggagctgacctgctgggaggaggtggcccagagcggggagatcccccccagctgctgcaacttccctgtggccgtgtgccgggacaagatgtttgtgttcagcggccagagcggggccaagatcaccaacaacctcttccagtttgagttcaaggacaagacctggacccgcatccccacagagcacctgctgcggggcagccccccaccaccccagaggagatatggccacaccatggtggcctttgacagacacctgtatgtgtttggaggagctgctgacaacaccctgcccaatgagctgcactgctatgatgtggacttccagacctgggaggtggtgcagcccagcagtgacagcgaggtgggcggcgctgaggtgcctgagcgggcctgtgccagcgaggaggtgcccaccctgacctatgaggagcgggtgggcttcaagaagagcagagatgtgtttggcctggactttggcaccaccagcgccaagcagcccacccagcctgccagcgagctgcccagcggccgcctcttccacgccgccgccgtcatcagtgatgccatgtacatctttggaggcaccgtggacaacaacatccgctctggagagatgtaccgcttccagttcagctgctaccccaagtgcaccctgcatgaagattatggccgcctgtgggagagccggcagttctgtgatgtggagtttgtgctgggggagaaggaggagtgtgtgcagggccacgtggccatcgtgacagcccggagccgctggctgcggaggaagatcacccaggcccgggagcggctggcccagaagctggagcaggaggccgcccctgtgccccgggaggcccctggggtggccgccggcggggcccggccccccctgctgcacgtggccatccgggaggccgaggcccggccctttgaggtgctgatgcagttcctgtacacagacaagatcaagtaccccaggaagggccacgtggaggatgtgctgctgatcatggatgtgtacaagctggccctgtccttccagctgtgccgcctggagcagctgtgccggcagtacatcgaggcctctgtggacctgcagaatgtgctggtggtgtgtgagagcgctgcccggctgcagctgagccagctgaaggagcactgcctgaactttgtggtgaaggagagccacttcaaccaggtgatcatgatgaaggagtttgagcggctgagcagccccctgattgtggagatcgtgcggaggaagcagcagcccccacccaggacccccctggaccagcctgtggacatcggcaccagcctcatccaggacatgaaggcctacctggagggcgctggagctgagttctgtgacatcaccctgctgctggatggccaccccaggcctgcccacaaggccatcctggccgcccggagcagctactttgaggccatgttccgctccttcatgccagaagatggccaggtgaacatcagcatcggggagatggtgcccagccggcaggcctttgagagcatgctgcgctacatctactatggagaggtgaacatgcccccagaggacagcctgtacctgtttgctgccccctactactacggcttctacaacaaccggctgcaggcctactgcaagcagaacctggagatgaatgtgacagtgcagaatgtgctgcagatcctggaggccgctgacaagacccaggccctggacatgaagaggcactgcctgcacatcatcgtgcaccagttcaccaaggtgtccaagctgcccaccctgcggagcctgagccagcagctgctgctggacatcatcgacagcctggccagccacatcagtgacaagcagtgtgccgagctgggcgctgacatctag

SEQ ID NO: 17194 - DNA, 930 bp, Artificial Sequence
  Description of Artificial Sequence: Synthetic coding sequence
atgcccaggcactgcagcgctgctggctgctgcacccgggacacccgggagaccaggaacagaggcatctccttccaccggctgcccaagaaggacaacccccggcggggcctgtggctggccaactgccagaggctggaccccagcggccagggcctgtgggaccctgccagcgagtacatctacttctgcagcaagcactttgaggaggactgctttgagctggtgggcatcagcggctaccaccggctgaaggagggcgctgtgcccaccatctttgagagcttcagcaagctgcggaggaccaccaagaccaagggccacagctacccacctggccctgctgaggtgtcccggctgcggcgctgcaggaagcgctgcagcgagggccggggccccaccacccccttcagccccccacctccagcagatgtgacctgcttccctgtggaggaggccagcgccccagccaccctgcctgccagccctgctggccgcctggagcccggcctgagcagccccttcagtgacctgctgggccccctgggcgcccaggctgatgaagctggctgcagcgcccagcccagccctgagcggcagcccagccccctggagcccaggcctgtgagccccagcgcctacatgctgcggctgcccccacctgctggggcctacatccagaatgagcacagctaccaggtgggcagcgccctgctgtggaagagaagagctgaggccgccctggatgccctggacaaggcccagaggcagctgcaggcctgcaagagaagagagcagaggctgcggctgcggctgaccaagctgcagcaggagcgggcccgggagaagagggcccaggctgatgcccggcagaccctgaaggagcacgtgcaggactttgccatgcagctgagcagctccatggcctag

SEQ ID NO: 17195 - DNA, 1140 bp, Artificial Sequence
  Description of Artificial Sequence: Synthetic coding sequence
atgggagacagcagaagaagaagcctgggcaaccagcccagcagcgaggccgccggccgctctgagcgggagcaggatggagacccccggggcctgcagagctctgtgtatgagagccggcgggtgacagatcctgagcggcaggacctggacaatgctgagctgggccctgaggaccctgaggaggagctgcccccagaggaggtggccggggaggagttccctgagaccctggaccccaaggaggccctgtctgagctggagcgggtgctggacaaggacctggaggaggacatccctgagatcagccggctgagcatcagccagaagctgcccagcaccaccatgaccaaggccaggaagagaagaagaagaagaaggctgatggagctggccgagcccaagatcaactggcaggtgctgaaggacaggaagggccgctgtgggaagggctacgcctggatcagcccctgcaagatgagcctgcacttctgcctgtgctggcccagcgtgtactggacagagcgcttcctggaggacaccaccctgaccatcaccgtgcctgctgtgtcccggcgggtggaggagctgagccggcccaagcgcttctacctggagtactacaacaacaacagaaccacccctgtgtggcccatccccaggagcagcctggagtaccgggccagcagccggctgaaggagctggccgcccccaagatccgggacaacttctggagcatgcccatgtctgaggtgtcccaggtgtcccgggccgcccagatggctgtgcccagcagccgcatcctgcagctgagcaagcccaaggccccagccaccctgctggaggagtgggaccctgtgcccaagcccaagccccacgtgtctgaccacaaccggctgctgcacctggcccggcccaaggcccagagcgacaagtgtgtgcctgaccgggacccccgctgggaggtgctggatgtgaccaagaaggtggtggccagcccccgcatcatcagcctggccaagcccaaggtgaggaagggcctgaatgaaggctatgaccggcggcccctggcctccatgagcctgcccccacccaaggccagccctgagaagtgtgaccagcccaggcctggcctgtag

SEQ ID NO: 17196 - DNA, 1068 bp, Artificial Sequence
  Description of Artificial Sequence: Synthetic coding sequence
atgggagacagcagaagaagaagcctgggcaaccagcccagcagcgaggccgccggccgctctgagcgggagcaggatggagacccccggggcctgcagagctctgtgtatgagagccggcgggtgacagatcctgagcggcaggacctggacaatgctgagctgggccctgaggaccctgaggaggagctgcccccagaggaggtggccggggaggagttccctgagaccctggaccccaaggaggccctgtctgagctggagcgggtgctggacaaggacctggaggaggacatccctgagatcagccggctgagcatcagccagaagctgcccagcaccaccatgaccaaggccaggaagagaagaagaagaagaaggctgatggagctggccgagcccaagatcaactggcaggtgctgaaggaccggcccagcgtgtactggacagagcgcttcctggaggacaccaccctgaccatcaccgtgcctgctgtgtcccggcgggtggaggagctgagccggcccaagcgcttctacctggagtactacaacaacaacagaaccacccctgtgtggcccatccccaggagcagcctggagtaccgggccagcagccggctgaaggagctggccgcccccaagatccgggacaacttctggagcatgcccatgtctgaggtgtcccaggtgtcccgggccgcccagatggctgtgcccagcagccgcatcctgcagctgagcaagcccaaggccccagccaccctgctggaggagtgggaccctgtgcccaagcccaagccccacgtgtctgaccacaaccggctgctgcacctggcccggcccaaggcccagagcgacaagtgtgtgcctgaccgggacccccgctgggaggtgctggatgtgaccaagaaggtggtggccagcccccgcatcatcagcctggccaagcccaaggtgaggaagggcctgaatgaaggctatgaccggcggcccctggcctccatgagcctgcccccacccaaggccagccctgagaagtgtgaccagcccaggcctggcctgtag

SEQ ID NO: 17197 - DNA, 450 bp, Artificial Sequence
  Description of Artificial Sequence: Synthetic coding sequence
atgtccttcctgctgcccaagctgaccagcaagaaggaggtggaccaggccatcaagagcacagctgagaaggtgctggtgctgcgcttcggcagagatgaggaccctgtgtgcctgcagctggatgacatcctgagcaagaccagcagtgacctgagcaagatggccgccatctacctggtggatgtggaccagacagctgtgtacacccagtactttgacatctcctacatccccagcacagtgttcttcttcaacggccagcacatgaaggtggactatggcagcccagaccacaccaagtttgtgggcagcttcaagaccaagcaggacttcatcgacctgattgaggtgatctacagaggagccatgaggggcaagctgattgtgcagagccccatcgaccccaagaacatccccaagtatgacctgctgtaccaggacatctag

SEQ ID NO: 17198 - DNA, 450 bp, Artificial Sequence; identical to SEQ ID NO: 17197
  Description of Artificial Sequence: Synthetic coding sequence

SEQ ID NO: 17199 - DNA, 450 bp, Artificial Sequence; identical to SEQ ID NO: 17197
  Description of Artificial Sequence: Synthetic coding sequence

SEQ ID NO: 17200 - DNA, 891 bp, Artificial Sequence
  Description of Artificial Sequence: Synthetic coding sequence
atggagagagctgtgcccctggccgtgcccctgggccagacagaggtgttccaggccctgcagaggctgcacatgaccatcttcagccagagcgtgagcccctgtgggaagttcctggccgccggcaacaactacggccagatcgccatcttcagcctgagcagcgccctgagcagcgaggccaaggaggagagcaagaagcctgtggtgaccttccaggcccatgatggccctgtgtacagcatggtgtccacagacagacacctgctgtctgctggagatggagaggtgaaggcctggctgtgggccgagatgctgaagaagggctgcaaggagctgtggaggcggcagcccccctaccgcaccagcctggaggtgcctgagatcaatgccctgctgctggtgcccaaggagaacagcctcatcctggccggcggggactgccagctgcacaccatggacctggagaccggcaccttcaccagggtgctgcggggccacacagactacatccactgcctggccctgcgggagaggagccctgaggtgctgtctggaggagaagatggagctgtgcggctgtgggacctgaggacagccaaggaggtgcagaccatcgaggtgtacaagcatgaagaatgttcccggccccacaacggccgctggattggctgcctggccacagacagcgactggatggtgtgtggcggcggccctgccctgaccctgtggcacctgcggagcagcacccccaccaccatcttccccatccgggccccccagaagcacgtgaccttctaccaggacctggtgctgacagctgctggcaacagctgccgggtggatgtgttcaccaacctgggctaccgggccttcagcctgtccttctag

SEQ ID NO: 17201 - DNA, 1026 bp, Artificial Sequence
  Description of Artificial Sequence: Synthetic coding sequence
atggagagagctgtgcccctggccgtgcccctgggccagacagaggtgttccaggccctgcagaggctgcacatgaccatcttcagccagagcgtgagcccctgtgggaagttcctggccgccggcaacaactacggccagatcgccatcttcagcctgagcagcgccctgagcagcgaggccaaggaggagagcaagaagcctgtggtgaccttccaggcccatgatggccctgtgtacagcatggtgtccacagacagacacctgctgtctgctggagatggagaggtgaaggcctggctgtgggccgagatgctgaagaagggctgcaaggagctgtggaggcggcagcccccctaccgcaccagcctggaggtgcctgagatcaatgccctgctgctggtgcccaaggagaacagcctcatcctggccggcggggactgccagctgcacaccatggacctggagaccggcaccttcaccagggtgctgcggggccacacagactacatccactgcctggccctgcgggagaggagccctgaggtgctgtctggaggagaagatggagctgtgcggctgtgggacctgaggacagccaaggaggtgcagaccatcgaggtgtacaagcatgaagaatgttcccggccccacaacggccgctggattggctgcctggccacagacagcgactggatggtgtgtggcggcggccctgccctgaccctgtggcacctgcggagcagcacccccaccaccatcttccccatccgggccccccagaagcacgtgaccttctaccaggacctgatcctgtctgctggccagggccgctgtgtgaaccagtggcagctgagcggggagctgaaggcccaggtgcccggcagcagccctggcctgctgagcctgagcctgaaccagcagcctgctgcccctgagtgcaaggtgctgacagctgctggcaacagctgccgggtggatgtgttcaccaacctgggctaccgggccttcagcctgtccttctag

SEQ ID NO: 17202 - DNA, 2868 bp, Artificial Sequence
  Description of Artificial Sequence: Synthetic coding sequence
atgagcaagaccaacaagagcaagagcggcagccgcagcagccgcagccgcagcgccagccgcagccgcagccgctccttcagcaagagccgcagccgcagccgcagcctgagccgcagcaggaagaggcggctgagcagccgcagccgcagccgcagctacagccctgcccacaaccgggagaggaaccacccccgggtgtaccagaacagagacttccggggccacaacagaggctacagaagaccctactacttccggggcaggaacagaggcttctacccctggggccagtacaacagaggaggctacggcaactaccgcagcaactggcagaactaccggcaggcctacagcccccggcggggccgcagccgcagccgcagccccaagaggaggagccccagccccaggagccgcagccacagcaggaacagcgacaagagcagcagtgacaggagcagaagaagcagcagcagccgcagcagcagcaaccacagccgggtggagagcagcaagaggaagagcgccaaggagaagaagagcagcagcaaggacagccggcccagccaggccgccggggacaaccagggagatgaggccaaggagcagaccttcagcggcggcaccagccaggacaccaaggccagcgagagcagcaagccctggccagatgccacctacggcaccggcagcgccagccgggccagcgctgtgtctgagctgagcccccgggagaggagccctgccctgaagagccccctgcagagcgtggtggtgagaagaagaagcccccggcccagccctgtgcccaagcccagcccccccctgagcagcaccagccagatgggcagcaccctgcccagcggggccggctaccagagcggcacccaccagggccagtttgaccacggcagcggcagcctgagccccagcaagaagagccctgtgggcaagagcccccccagcacaggcagcacctacggcagcagccagaaggaggagagcgctgccagcggcggggccgcctacaccaagcgctacctggaggagcagaagacagaaaatggcaaggacaaggagcagaagcagaccaacacagacaaggagaagatcaaggagaagggcagcttcagtgacaccggcctgggagatggcaagatgaagagtgacagctttgcccccaagacagattctgagaagcccttccggggcagccagagccccaagcgctacaagctgagagatgactttgagaagaagatggctgacttccacaaggaggagatggatgaccaggacaaggacaaggccaagggcaggaaggagagcgagtttgatgatgagcccaagttcatgagcaaggtgattggagccaacaagaaccaggaggaggagaagagcggcaagtgggagggcctggtgtatgcccctcctgggaaggagaagcagaggaagacagaggagctggaggaggagagcttccctgagaggagcaagaaggaggaccggggcaagaggtctgagggcggccaccggggctttgtgcctgagaagaacttccgggtgacagcctacaaggctgtgcaggagaagagcagcagccccccacccaggaagaccagcgagagccgggacaagctgggcgccaagggggacttccccaccgggaagagcagcttcagcatcacccgggaggcccaggtgaatgtgaggatggacagctttgatgaggacctggcccggcccagcggcctgctggcccaggagaggaagctgtgccgggacctggtgcacagcaacaagaaggagcaggagttccgcagcatcttccagcacatccagagcgcccagagccagaggagccccagcgagctgtttgcccagcacatcgtgaccatcgtgcaccacgtgaaggagcaccacttcggcagcagcggcatgaccctgcacgagcgcttcaccaagtacctgaagaggggcacagagcaggaggccgccaagaacaagaagagccctgagatccacagaagaattgacatcagccccagcaccttcaggaagcacggcctggcccatgatgagatgaagagcccccgggagcccggctacaaggccgagggcaagtacaaggatgatcctgtggacctgcggctggacattgaaagaaggaagaagcacaaggagcgggacctgaagaggggcaagagccgggagagcgtggacagccgggacagcagccacagccgggagaggtctgctgagaagacagagaagacccacaagggcagcaagaagcagaagaagcacagaagagcccgggacaggagccgcagcagcagcagcagcagccagagcagccacagctacaaggccgaggagtacacagaggagacagaggagcgggaggagagcaccactggatttgacaagagccggctgggcaccaaggactttgtgggccccagcgagcggggcggcggccgggcccggggcaccttccagttccgggcccggggccggggctggggccggggcaactacagcggcaacaacaacaacaacagcaacaatgacttccagaagaggaaccgggaggaggagtgggaccctgagtacacccccaagagcaagaagtactacctgcatgatgaccgggagggggagggcagtgacaagtgggtgtcccggggccggggccgcggggccttcccccggggccggggccgcttcatgttcaggaagagcagcaccagccccaagtgggcccatgacaagttcagcggggaggagggggagattgaagatgatgaaagtggcacagagaaccgggaggagaaggacaacatccagcccaccacagaatag

SEQ ID NO: 17203 - DNA, 2868 bp, Artificial Sequence; identical to SEQ ID NO: 17202
  Description of Artificial Sequence: Synthetic coding sequence

SEQ ID NO: 17204 - DNA, 123 bp, Artificial Sequence
  Description of Artificial Sequence: Synthetic coding sequence
atgagcaagaccaacaagagcaagagcggcagccgcagcagccgcagccgcagcgccagccgcagccgcagccgctccttcagcaagagccgcagccgcagccgcagcctgagccgctcctag

SEQ ID NO: 17205 - DNA, 1416 bp, Artificial Sequence
  Description of Artificial Sequence: Synthetic coding sequence
atggagctgagcagcaagaagaagctgcacgccctgagcctggccgagaagatccaggtgctggagctgctggatgagagcaagatgagccagagcgaggtggcccggcgcttccaggtgtcccagccccagatcagccgcatctgcaagaacaaggagaagctgctggccgactggtgcagcggcacagccaaccgggagaggaagaggaagcgggagagcaagtacagcggcattgatgaggccctgctgtgctggtaccacatcgcccgggccaaggcctgggatgtgacaggccccatgctgctgcacaaggccaaggagctggccgacatcatgggccaggactttgtgcccagcatcggctggctggtgcgctggaagagaagaaacaacgtgggctttggagcccggcacgtgctggcccccagcttccccccagagcccccacctcctggcctgaccagccaggcccagctgcccctgagcctgaaggacttctccccagaagatgtgtttggctgtgccgagctgcccctgctgtacagagctgtgcccggcagctttggagcctgtgaccaggtgcaggtgctgctgtgtgccaacagccggggcacagagaagagaagagtgctgctgggcggcctgcaggccgccccccgctgcttcttcggcatccgctctgaggccctgcctgccagctaccacccagacctgggcatcccctggctggagtggctggcccagtttgaccgggacatgggccagcagggccggcaggtggccctgctgctggccgcccgggtggtggaggagctggccggcctgcccggcctgtaccacgtgaagctgctgcccctggccgccagcagcaccaccccacccctgcccagctctgtggtgcgggccttcaaggcccactaccgccaccggctgctgggcaagctggccgccatccagagcgagagagatggcaccagcctggccgaggccggggccggcatcaccgtgctggatgccctgcacgtggccagcgctgcctgggccaaggtgcccccccagctgatcttcagcagcttcatccaggagggcctggcccctgggaagaccccacccagcagccacaagaccagcgagatgcctcctgtgcctgggggcctgagcctggaggagttcagcagatttgtggacctggagggggaggagcccaggtctggagtgtgcaaggaggagatcggcacagaagatgagaagggggaccgggagggcgcctttgagcccctgcccaccaaggcagatgccctgcgggccctgggcaccctgcggcgctggtttgagtgcaacagcaccagccctgagctgtttgagaagttctatgactgtgaggaggaggtggagcggctgtgctgcctgtag

SEQ ID NO: 17206 - DNA, 1539 bp, Artificial Sequence
  Description of Artificial Sequence: Synthetic coding sequence
atggccgaggcctctgtggatgccagcaccctgcctgtgacagtgaagaagaagaagagcctgagcattgaggagaagattgacatcatcaatgctgtggagagcggcaagaagaaggccgagattgctgctgaatatggcatcaagaagaacagcctgagcagcatcatgaagaacaaggacaaggtgctggaggcctttgagagcctgcgctttgaccccaagaggaagaggctgaggacagccttctacacagacctggaggaggccctgatgcgctggtacagaattgcccagtgcctgaatgtgcctgtgaatggccccatgctgcggctgaaggccaatgactttgcccagaagctgggccacaatgacttcaagtgcagcaatggctggctggaccgcttcaagagccgctatggcctggtgttccgggcccagcctgtggaggccaccggggtgcctgtggaccccagcacagtgtggtaccagaatgtgctgccctactacctgaatgactaccaccccaagaatgtgttcaacatcaaggagaccggcctgctgtacaggatgctgcccaccaacacctttgccttcaagggggagacctgcagcgtgggcaagctgtgcaaggaccgcatcaccctggtggtgggcaccaacatggatggcagcgagaagctgcccctgctggtgattggcaagaagaggaccccccactgcttcaagggcctgaagagcctgcctgtgtgctatgaggccaacaggatggcctggatgaccagtgatgtgtttgagcagtggatgaggaagctggatgaggagttccaggcccagcagaggagagtggtgatctttgtggagagcttccctgcccaccctgaggtgaagaacctgaagagcattgagctggccttcttccccagctgcctgagcagcaagtgcatcgccatgaagcagggcgtcatcaagagcctgaagatcaagtaccgccactgcctgatcaagaagttcctgagctctgtggagggcagcaaggagttcaccttcagcctgctggatgctgtggacaccctgcacctgtgctggagggctgtgaccccagagaccatcgtgaagagctatgaggaggccggcttcaagagccagaagggggagagtgacatcaccaatgctgagaaggacaccggcctggacctggtggctgatgccctgggcgccggcgtggagttccctgagggcctgagcattgaggagtatgctgccctggatgatgacctggagacctgtgaggccgccccaaatggagacagcatctgcaccaaggagagcaagagtgatgaaacaggcttctacaccagtgatgaagaagatgatgatggcagccctggaacagagctgcccctgcccagcaagtctgaggccatcacagccctggacaccctgaagaagttcctgcggagccaggacatgaatgatggcctgcagaacagcctggccgacctggagaacttcatcaacagcctgagccccaagtag

SEQ ID NO: 17207 - DNA, 1782 bp, Artificial Sequence
  Description of Artificial Sequence: Synthetic coding sequence
atggccttcaggaaggcctacagcatcaaggacaagctgcaggccatcgagcgggtgaagggcggggagcggcaggcctctgtgtgccgggactttggagtgcctgggggcaccctgcggggctggctgaaggatgagcccaagctgcgctggttcctggagcagctgggcggggaggtgggcacccagaggaagaagatgaggctggccaatgaggaggagattgacagagctgtgtatgcctggttcctggccctgcggcagcacggcgtgcccctgagcggccccctcatccaggcccaggccgaggcctttgcccggcagatctacggcccagaatgtaccttcaaggccagccacggctggttctggcgctggcagaagagacatggcatcagcagccagcgcttctacggggaggccggccccccagcccccagccctgcccctggcccccctgtgaaggaggagcccgccctgcccagcggggccggccccctgcctgaccgggccccagcccctcctcctcctgctgagggcggctatggagatgagcagatctacagcgcctctgtgacaggcctgtactggaagctgctgcctgagcaggccgcccctcctggagctggggaccccggggccggcggctgcggccgccgctggaggggggacagagtgacagtgctgctggccgccaacctgaccggcagccacaagctgaagcccctggtgattggccgcctgcctgacccccccagcctgcggcaccacaaccaggacaagtttcctgccagctaccgctacagcccagatgcctggctgagccggcccctgctgcggggctggttctttgaggagtttgtgcctggggtgaagcgctacctgcggcgcagctgcctgcagcagaaggctgtgctgctggtggcccaccccccctgccccagccctgctgcctccatgcctgccctggacagtgaagatgcccctgtgcgctgcaggcctgagcccctgggccccccagaggagctgcagaccccagatggagctgtgcgggtgctcttcctgagcaagggcagcagccgggcccacatcccagcccccctggagcagggcgtggtggccgccttcaagcagctgtacaagcgggagctgctgcggctggccgtgtcctgtgccagcggcagccccctggacttcatgaggagcttcatgctgaaggacatgctgtacctggccggcctgtcctgggacctggtgcaggccggcagcattgagcgctgctggctgctgggcctgcgggccgcctttgagcccaggcctggagaggacagcgctggccagcctgcccaggccgaggaggccgctgagcacagccgggtgctgagtgacctgacccacctggccgccctggcctacaagtgcctggcccctgaggaggtggccgagtggctgcacctggatgatgatggcggccccccagagggctgccgggaggaggtgggccctgccctgcccccagctgcccccccagccccagccagcctgcccagcgccatgggcggcggagaagatgaggaggaggccacagattatggaggcacctctgtgcccacagctggggaggccgtgcggggcctggagacagccctgcgctggctggagaaccaggacccccgggaggtgggccccctgcggctggtgcagctgcggagcctcatctccatggcccggcggctgggcggcatcggccacaccccagctggcccctatgatggagtgtag

SEQ ID NO: 17208 - DNA, 1929 bp, Artificial Sequence
  Description of Artificial Sequence: Synthetic coding sequence
atgtacccagctggccccccagctggccctgtgccccggcggggccggcggcccctgcccggccccccagccccagccccagcccctgtgcctgctgcccggcccccacctccagcccctggcccccggccccgggtggccgtgaagatggccttcaggaaggcctacagcatcaaggacaagctgcaggccatcgagcgggtgaagggcggggagcggcaggcctctgtgtgccgggactttggagtgcctgggggcaccctgcggggctggctgaaggatgagcccaagctgcgctggttcctggagcagctgggcggggaggtgggcacccagaggaagaagatgaggctggccaatgaggaggagattgacagagctgtgtatgcctggttcctggccctgcggcagcacggcgtgcccctgagcggccccctcatccaggcccaggccgaggcctttgcccggcagatctacggccctgagtgcaccttcaaggccagccacggctggttctggcgctggcagaagagacatggcatcagcagccagcgcttctatggagaggccggccccccagcccccagccctgcccctggcccccctgtgaaggaggagcccgccctgcccagcggggccggccccctgcctgaccgggccccagcccctcctcctcctgctgagggcggctatggagatgagcagatctacagcgcctctgtgacaggcctgtactggaagctgctgcctgagcaggccgcccctcctggggccggggaccctggagctgggggctgcggccgccgctggaggggggacagagtgacagtgctgctggccgccaacctgaccggcagccacaagctgaagcccctggtgattggccgcctgcctgacccccccagcctgcggcaccacaaccaggacaagtttcctgccagctaccgctacagcccagatgcctggctgagccggcccctgctgcggggctggttctttgaggagtttgtgcctggggtgaagcgctacctgcggcgcagctgcctgcagcagaaggctgtgctgctggtggcccaccccccctgccccagccctgctgcctccatgcctgccctggacagtgaagatgcccctgtgcgctgcaggcctgagcccctgggccccccagaggagctgcagaccccagatggagctgtgcgggtgctcttcctgagcaagggcagcagccgggcccacatcccagcccccctggagcagggcgtggtggccgccttcaagcagctgtacaagcgggagctgctgcggctggccgtgtcctgtgccagcggcagccccctggacttcatgaggagcttcatgctgaaggacatgctgtacctggccggcctgtcctgggacctggtgcaggccggcagcattgagcgctgctggctgctgggcctgcgggccgcctttgagcccaggcctggagaagattctgctggccagcctgcccaggccgaggaggccgctgagcacagccgggtgctgagtgacctgacccacctggccgccctggcctacaagtgcctggcccctgaggaggtggccgagtggctgcacctggatgatgatggcggccccccagagggctgccgggaggaggtgggccctgccctgcccccagctgcccccccagccccagccagcctgcccagcgccatgggcggcggggaggatgaggaggaggccacagattatggaggcacctctgtgcccacagctggggaggccgtgcggggcctggagacagccctgcgctggctggagaaccaggacccccgggaggtgggccccctgcggctggtgcagctgcggagcctcatctccatggcccggcggctgggcggcatcggccacaccccagctggcccctatgatggagtgtag

SEQ ID NO: 17209 - DNA, 1566 bp, Artificial Sequence
  Description of Artificial Sequence: Synthetic coding sequence
atggccaacaagggcaacaagaagaggcggcagttcagcctggaggagaagatgaaggtggtgggcgctgtggacagcggcaagaggaaaggagatgtggccaaggagtttggcatcacccccagcaccctgagcaccttcctgaaggacaggaccaagtttgaggagaaggtgcgggaggcctctgtgggcccccagaggaagaggatgaggtctgccctgtatgatgacatcgacaaggctgtgtttgcctggttccaggagatccacgccaagaacatcctggtgactggatctgtcatcaggaagaaggccctgaacctggccaacatgctgggctatgacaacttccaggcctctgtgggctggctgaaccgcttccgggacagacatggaattgccctgaaggctgtgtgcagagaagattctgaccggctgatgaatggcctgggcatcgacaagatcaatgagtggcacgccggggagatcatcaagctgattgctgactacagcccagatgacatcttcaatgctgatgaaacaggagtcttcttccagctgctgccccagcacaccctggccgccaagggggaccactgccggggcggcaagaaggccaagcagaggctgacagccctcttctgctgcaatgccagcggcacagagaagatgaggcccctcatcgtgggccgcagcgccagcccccactgcctgaagaacatccacagcctgccctgtgactaccgggccaaccagtgggcctggatgacccgggacctcttcaatgagtggctgatgcaggtggatgccaggatgaagagagctgagcggcgcatcctgctgctgattgacaactgcagcgcccacaacatgctgccccacctggagcgcatccaggtgggctacctgcccagcaactgcacagctgtgctgcagcccctgaacctgggcatcatccacaccatgaaggtgctgtaccagagccacctgctgaagcagatcctgctgaagctgaacagcagcgaggaccaggaggaggtggacatcaagcaggccatcgacatgattgctgctgcctggtggagcgtgaagcccagcacagtggtgaagtgctggcagaaggccggcatcgtgcccatggagtttgctgaatgtgacacagaatctgctgccagcgagccagacatcgccatcgagaagctgtggcacacagtggccatcgccacctgtgtgcccaatgaggtgaacttccaggactttgtgacagcagatgatgacctgatcatcagccaggacacagacatcatccaggacatggtggccggggagaacaccagcgaggccggctctgaagatgaaggagaggtgtccctgcctgagcagcccaaggtgaccatcacagaggccatcagctctgtgcagaagctgcggcagttcctgagcacctgtgtggacatcccagatgccatcttcggccagctgaatggaattgatgagtacctgatgaagagggtgacccagaccctgattgacagcaagatcacagacttcctgcagaccaagtag

SEQ ID NO: 17210 - DNA, 1566 bp, Artificial Sequence; identical to SEQ ID NO: 17209
  Description of Artificial Sequence: Synthetic coding sequence

SEQ ID NO: 17211 - DNA, 684 bp, Artificial Sequence
  Description of Artificial Sequence: Synthetic coding sequence
atgcctggctgccgcatcagcgcctgtggccctggggcccaggagggcacagctgagcagaggagccccccaccaccctgggaccccatgcccagcagccagcccccaccacccacccccaccctgacccccacccccaccccaggccagagcccccccctgcctgatgctgctggggccagcgctggagctgctgaggaccaggagctgcagcgctggaggcagggcgccagcggcattgctggcctggccggccctgggggcggcagcggggctgctgctggggccggcggccgggccctggagctggccgaggcccggcggcggctgctggaggtggagggcagaagaaggctggtgtctgagctggagagccgggtgctgcagctgcacagggtcttcctggccgctgagctgcggctggcccacagagctgagagcctgagccggctgagcggcggcgtggcccaggccgagctgtacctggccgcccacggcagccggctgaagaagggcccccggcggggcagaagaggccggcccccagccctgctggccagcgccctgggcctgggcggctgtgtgccctggggcgccggccgcctgcggcggggccacggccctgagccagacagccccttcagaagaagccccccccggggccctgccagcccccagaggtag

SEQ ID NO: 17212 - DNA, 153 bp, Artificial Sequence
  Description of Artificial Sequence: Synthetic coding sequence
tgaggacggcccccagccctgctggccagcgccctgggcctgggcggctgtgtgccctggggcgccggccgcctgcggcggggccacggccctgagccagacagccccttccgccgcagccccccccggggccctgccagcccccagaggtag

SEQ ID NO: 17213 - DNA, 375 bp, Artificial Sequence
  Description of Artificial Sequence: Synthetic coding sequence
tacctgctgctggagtactgtgagggcaatgacctggacttctacctgaagcagcacaagctgatgtctgagaaggaggcccggagcatcgtgatgcagatcgtgaatgccctgcgctacctgaatgagatcaagccacccatcatccactatgacctgaagccaggcaacatcctgctggtggatggaacagcctgtggggagatcaagatcacagactttggcctgagcaagatcatggatgatgacagctatggagtggatggcatggacctgaccagccagggcgccggcacctactggtacctgcccccagagtgctttgtggtgggcaaggagccccccaagatcagcaacaaggtggatgtgtggtag

SEQ ID NO: 17214 - DNA, 1242 bp, Artificial Sequence
  Description of Artificial Sequence: Synthetic coding sequence
atgtctgtgcagagcagcagcggcagcctggagggccccccatcctggagccagctgagcaccagccccaccccaggcagcgctgctgctgcccggagcctgctgaaccacaccccaccttctggccggccccgggagggcgccatggatgagctgcacagcctggacccccggcggcaggagctgctggaggcccgcttcaccggggtggccagcggcagcacaggcagcacaggcagctgcagcgtgggcgccaaggccagcaccaacaatgaaagcagcaaccacagctttggcagcctgggcagcctgagtgacaaggagagcgagaccccagagaagaagcagagcgagagcagccggggcaggaagaggaaggccgagaaccagaatgaaagcagccagggcaagagcattggaggccggggccacaagatcagtgactactttgagtaccagggcggcaatggcagcagccctgtgcggggcatccccccagccatccgcagcccccagaacagccacagccacagcacccccagcagctctgtgcggcccaacagccccagccccacagccctggccttcggggaccaccccatcgtgcagcccaagcagctgtccttcaagatcatccagacagacctgaccatgctgaagctggccgccctggagagcaacaagatccaggacctggagaagaaggagggcagaattgatgacctgctgcgggccaactgtgacctgcggcggcagattgatgagcagcagaagctgctggagaagtacaaggagcggctgaacaagtgcatctccatgagcaagaagctgctgattgagaagagcacccaggagaagctgagcagccgggagaagtccatgcaggaccggctgcggctgggccacttcaccaccgtgcgccacggggccagcttcacagagcagtggacagatggctttgccttccagaacctggtgaagcagcaggagtgggtgaaccagcagagagaagatattgagcggcagaggaagctgctggccaagaggaagcccccaacagccaacaacagccaggcccccagcaccaacagcgagcccaagcagaggaagaacaaggctgtgaatggagcagaaaatgacccctttgtgcggcccaacctgccccagctgctgaccctggccgagtaccacgagcaggaggagatcttcaagctgcggctgggccacctgaagaagaggtag

SEQ ID NO: 17215 - DNA, 2301 bp, Artificial Sequence
  Description of Artificial Sequence: Synthetic coding sequence
atgtctgtgcagagcagcagcggcagcctggagggccccccatcctggagccagctgagcaccagccccaccccaggcagcgctgctgctgcccggagcctgctgaaccacaccccaccttctggccggccccgggagggcgccatggatgagctgcacagcctggacccccggcggcaggagctgctggaggcccgcttcaccggggtggccagcggcagcacaggcagcacaggcagctgcagcgtgggcgccaaggccagcaccaacaatgaaagcagcaaccacagctttggcagcctgggcagcctgagtgacaaggagagcgagaccccagagaagaagcagagcgagagcagccggggcaggaagaggaaggccgagaaccagaatgaaagcagccagggcaagagcattggaggccggggccacaagatcagtgactactttgagtaccagggcggcaatggcagcagccctgtgcggggcatccccccagccatccgcagcccccagaacagccacagccacagcacccccagcagctctgtgcggcccaacagccccagccccacagccctggccttcggggaccaccccatcgtgcagcccaagcagctgtccttcaagatcatccagacagacctgaccatgctgaagctggccgccctggagagcaacaagatccaggacctggagaagaaggagggcagaattgatgacctgctgcgggccaactgtgacctgcggcggcagattgatgagcagcagaagctgctggagaagtacaaggagcggctgaacaagtgcatctccatgagcaagaagctgctgattgagaagagcacccaggagaagctgagcagccgggagaagtccatgcaggaccggctgcggctgggccacttcaccaccgtgcgccacggggccagcttcacagagcagtggacagatggctttgccttccagaacctggtgaagcagcaggagtgggtgaaccagcagagagaagatattgagcggcagaggaagctgctggccaagaggaagcccccaacagccaacaacagccaggcccccagcaccaacagcgagcccaagcagaggaagaacaaggctgtgaatggagcagaaaatgacccctttgtgcggcccaacctgccccagctgctgaccctggccgagtaccacgagcaggaggagatcttcaagctgcggctgggccacctgaagaaggaggaggccgagatccaggccgagctggagcggctggagcgggtgaggaacctgcacatccgggagctgaagaggatcaacaatgaagacaacagccagttcaaggaccaccccaccctgaatgaaagatacctgctgctgcacctgctgggccggggcggcttcagcgaggtgtacaaggcctttgacctgtatgagcagagatatgctgctgtgaagatccaccagctgaacaagtcctggagagatgagaagaaggagaactaccacaagcacgcctgccgggagtaccgcatccacaaggagctggaccacccccgcatcgtgaagctgtatgactacttcagcctggacacagacaccttctgcaccgtgctggagtactgtgagggcaatgacctggacttctacctgaagcagcacaagctgatgtctgagaaggaggcccggagcatcgtgatgcagatcgtgaatgccctgcgctacctgaatgagatcaagccacccatcatccactatgacctgaagccaggcaacatcctgctggtggatggaacagcctgtggggagatcaagatcacagactttggcctgagcaagatcatggatgatgacagctatggagtggatggcatggacctgaccagccagggcgccggcacctactggtacctgcccccagagtgctttgtggtgggcaaggagccccccaagatcagcaacaaggtggatgtgtggagcgtgggcgtcatcttcttccagtgcctgtatggcaggaagcccttcggccacaaccagagccagcaggacatcctgcaggagaacaccatcctgaaggccacagaggtgcagtttcctgtgaagcctgtggtgtcctctgaggccaaggccttcatccgccgctgcctggcctacaggaaggaggacagatttgatgtgcaccagctggccaatgacccctacctgctgccccacatgagaagaagcaacagcagcggcaacctgcacatggccggcctgacagccagccccaccccacccagcagcagcatcatcacctactag

SEQ ID NO: 17216 - DNA, 2013 bp, Artificial Sequence
  Description of Artificial Sequence: Synthetic coding sequence
atggctgtgctcttcctgtatgacctgaagaccaccgggaagaccccagagaagaagcagagcgagagcagccggggcaggaagaggaaggccgagaaccagaatgaaagcagccagggcaagagcattggaggccggggccacaagatcagtgactactttgagtaccagggcggcaatggcagcagccctgtgcggggcatccccccagccatccgcagcccccagaacagccacagccacagcacccccagcagctctgtgcggcccaacagccccagccccacagccctggccttcggggaccaccccatcgtgcagcccaagcagctgtccttcaagatcatccagacagacctgaccatgctgaagctggccgccctggagagcaacaagatccaggacctggagaagaaggagggcagaattgatgacctgctgcgggccaactgtgacctgcggcggcagattgatgagcagcagaagctgctggagaagtacaaggagcggctgaacaagtgcatctccatgagcaagaagctgctgattgagaagagcacccaggagaagctgagcagccgggagaagtccatgcaggaccggctgcggctgggccacttcaccaccgtgcgccacggggccagcttcacagagcagtggacagatggctttgccttccagaacctggtgaagcagcaggagtgggtgaaccagcagagagaagatattgagcggcagaggaagctgctggccaagaggaagcccccaacagccaacaacagccaggcccccagcaccaacagcgagcccaagcagaggaagaacaaggctgtgaatggagcagaaaatgacccctttgtgcggcccaacctgccccagctgctgaccctggccgagtaccacgagcaggaggagatcttcaagctgcggctgggccacctgaagaaggaggaggccgagatccaggccgagctggagcggctggagcgggtgaggaacctgcacatccgggagctgaagaggatcaacaatgaagacaacagccagttcaaggaccaccccaccctgaatgaaagatacctgctgctgcacctgctgggccggggcggcttcagcgaggtgtacaaggcctttgacctgtatgagcagagatatgctgctgtgaagatccaccagctgaacaagtcctggagagatgagaagaaggagaactaccacaagcacgcctgccgggagtaccgcatccacaaggagctggaccacccccgcatcgtgaagctgtatgactacttcagcctggacacagacaccttctgcaccgtgctggagtactgtgagggcaatgacctggacttctacctgaagcagcacaagctgatgtctgagaaggaggcccggagcatcgtgatgcagatcgtgaatgccctgcgctacctgaatgagatcaagccacccatcatccactatgacctgaagccaggcaacatcctgctggtggatggaacagcctgtggggagatcaagatcacagactttggcctgagcaagatcatggatgatgacagctatggagtggatggcatggacctgaccagccagggcgccggcacctactggtacctgcccccagagtgctttgtggtgggcaaggagccccccaagatcagcaacaaggtggatgtgtggagcgtgggcgtcatcttcttccagtgcctgtatggcaggaagcccttcggccacaaccagagccagcaggacatcctgcaggagaacaccatcctgaaggccacagaggtgcagtttcctgtgaagcctgtggtgtcctctgaggccaaggccttcatccgccgctgcctggcctacaggaaggaggacagatttgatgtgcaccagctggccaatgacccctacctgctgccccacatgagaagaagcaacagcagcggcaacctgcacatggccggcctgacagccagccccaccccacccagcagcagcatcatcacctactag

SEQ ID NO: 17217 - DNA, 2157 bp, Artificial Sequence
  Description of Artificial Sequence: Synthetic coding sequence
atggatgagctgcacagcctggacccccggcggcaggagctgctggaggcccgcttcaccggggtggccagcggcagcacaggcagcacaggcagctgcagcgtgggcgccaaggccagcaccaacaatgaaagcagcaaccacagctttggcagcctgggcagcctgagtgacaaggagagcgagaccccagagaagaagcagagcgagagcagccggggcaggaagaggaaggccgagaaccagaatgaaagcagccagggcaagagcattggaggccggggccacaagatcagtgactactttgagtaccagggcggcaatggcagcagccctgtgcggggcatccccccagccatccgcagcccccagaacagccacagccacagcacccccagcagctctgtgcggcccaacagccccagccccacagccctggccttcggggaccaccccatcgtgcagcccaagcagctgtccttcaagatcatccagacagacctgaccatgctgaagctggccgccctggagagcaacaagatccaggacctggagaagaaggagggcagaattgatgacctgctgcgggccaactgtgacctgcggcggcagattgatgagcagcagaagctgctggagaagtacaaggagcggctgaacaagtgcatctccatgagcaagaagctgctgattgagaagagcacccaggagaagctgagcagccgggagaagtccatgcaggaccggctgcggctgggccacttcaccaccgtgcgccacggggccagcttcacagagcagtggacagatggctttgccttccagaacctggtgaagcagcaggagtgggtgaaccagcagagagaagatattgagcggcagaggaagctgctggccaagaggaagcccccaacagccaacaacagccaggcccccagcaccaacagcgagcccaagcagaggaagaacaaggctgtgaatggagcagaaaatgacccctttgtgcggcccaacctgccccagctgctgaccctggccgagtaccacgagcaggaggagatcttcaagctgcggctgggccacctgaagaaggaggaggccgagatccaggccgagctggagcggctggagcgggtgaggaacctgcacatccgggagctgaagaggatcaacaatgaagacaacagccagttcaaggaccaccccaccctgaatgaaagatacctgctgctgcacctgctgggccggggcggcttcagcgaggtgtacaaggcctttgacctgtatgagcagagatatgctgctgtgaagatccaccagctgaacaagtcctggagagatgagaagaaggagaactaccacaagcacgcctgccgggagtaccgcatccacaaggagctggaccacccccgcatcgtgaagctgtatgactacttcagcctggacacagacaccttctgcaccgtgctggagtactgtgagggcaatgacctggacttctacctgaagcagcacaagctgatgtctgagaaggaggcccggagcatcgtgatgcagatcgtgaatgccctgcgctacctgaatgagatcaagccacccatcatccactatgacctgaagccaggcaacatcctgctggtggatggaacagcctgtggggagatcaagatcacagactttggcctgagcaagatcatggatgatgacagctatggagtggatggcatggacctgaccagccagggcgccggcacctactggtacctgcccccagagtgctttgtggtgggcaaggagccccccaagatcagcaacaaggtggatgtgtggagcgtgggcgtcatcttcttccagtgcctgtatggcaggaagcccttcggccacaaccagagccagcaggacatcctgcaggagaacaccatcctgaaggccacagaggtgcagtttcctgtgaagcctgtggtgtcctctgaggccaaggccttcatccgccgctgcctggcctacaggaaggaggacagatttgatgtgcaccagctggccaatgacccctacctgctgccccacatgagaagaagcaacagcagcggcaacctgcacatggccggcctgacagccagccccaccccacccagcagcagcatcatcacctactag

SEQ ID NO: 17218 - DNA, 2157 bp, Artificial Sequence; identical to SEQ ID NO: 17217
  Description of Artificial Sequence: Synthetic coding sequence

SEQ ID NO: 17219 - DNA, 2319 bp, Artificial Sequence
  Description of Artificial Sequence: Synthetic coding sequence
atgatggaggagctgcacagcctggacccccggcggcaggagctgctggaggcccgcttcaccggggtgggcgtgtccaagggccccctgaacagcgagagcagcaaccagagcctgtgcagcgtgggcagcctgagtgacaaggaggtggagaccccagagaagaagcagaatgaccagaggaacaggaagaggaaggccgagccctatgagaccagccagggcaagggcaccccccggggccacaagatcagtgactactttgaatttgctgggggcagcgcccctggcaccagccctggccgctctgtgccccctgtggcccggagcagcccccagcacagcctgagcaaccccctgccccggcgggtggagcagcccctgtatggcctggatggcagcgctgccaaggaggccacagaggagcagagcgccctgcccaccctgatgtctgtgatgctggccaagccccggctggacacagagcagctggcccagagaggagctggcctgtgcttcacctttgtgtctgcccagcagaacagccccagcagcacaggcagcggcaacacagagcacagctgcagcagccagaagcagatcagcatccagcaccggcagacccagagcgacctgaccatcgagaagatcagcgccctggagaacagcaagaacagcgacctggagaagaaggagggcagaattgatgacctgctgcgggccaactgtgacctgcggcggcagattgatgagcagcagaagatgctggagaagtacaaggagcggctgaacagatgtgtgaccatgagcaagaagctgctgattgagaagagcaagcaggagaagatggcctgccgggacaagtccatgcaggaccggctgcggctgggccacttcaccaccgtgcgccacggggccagcttcacagagcagtggacagatggctacgccttccagaacctgatcaagcagcaggagcgcatcaacagccagcgggaggagattgagcggcagaggaagatgctggccaagaggaagcccccagccatgggccaggcccccccagccaccaatgagcagaagcagaggaagagcaagaccaacggggctgaaaatgagacccccagcagcggcaacacagagctgaaggacacagccccagccctgggcgcccacagcctgctgcggctgaccctggccgagtaccacgagcaggaggagatcttcaagctgcggctgggccacctgaagaaggaggaggccgagatccaggccgagctggagcggctggagcgggtgaggaacctgcacatccgggagctgaagaggatccacaatgaagacaacagccagttcaaggaccaccccaccctgaatgaccgctacctgctgctgcacctgctgggccggggcggcttcagcgaggtgtacaaggcctttgacctgacagagcagagatatgtggccgtgaagatccaccagctgaacaagaactggagagatgagaagaaggagaactaccacaagcacgcctgccgggagtaccgcatccacaaggagctggaccacccccgcatcgtgaagctgtatgactacttcagcctggacacagacagcttctgcaccgtgctggagtactgtgagggcaatgacctggacttctacctgaagcagcacaagctgatgtctgagaaggaggcccggagcatcatcatgcagatcgtgaatgccctgaagtacctgaatgagatcaagccacccatcatccactatgacctgaagccaggcaacatcctgctggtgaatggaacagcctgtggggagatcaagatcacagactttggcctgagcaagatcatggatgatgacagctacaacagcgtggatggcatggagctgaccagccagggcgccggcacctactggtacctgcccccagaatgttttgtggtgggcaaggagccccccaagatcagcaacaaggtggatgtgtggagcgtgggcgtcatcttctaccagtgcctgtatggcaggaagcccttcggccacaaccagagccagcaggacatcctgcaggagaacaccatcctgaaggccacagaggtgcagtttcctcccaagcctgtggtgaccccagaggccaaggccttcatccgccgctgcctggcctacagaaaagaagatagaattgatgtgcagcagctggcctgtgacccctacctgctgccccacatcaggaagtctgtgtccaccagcagccctgctggagctgccatcgccagcaccagcggggccagcaacaacagcagcagcaactag

SEQ ID NO: 17220 - DNA, 2157 bp, Artificial Sequence
  Description of Artificial Sequence: Synthetic coding sequence
atgatggaggagctgcacagcctggacccccggcggcaggagctgctggaggcccgcttcaccggggtgggcgtgtccaagggccccctgaacagcgagagcagcaaccagagcctgtgcagcgtgggcagcctgagtgacaaggaggtggagaccccagagaagaagcagaatgaccagaggaacaggaagaggaaggccgagccctatgagaccagccagggcaagggcaccccccggggccacaagatcagtgactactttgagcggcgggtggagcagcccctgtatggcctggatggcagcgctgccaaggaggccacagaggagcagagcgccctgcccaccctgatgtctgtgatgctggccaagccccggctggacacagagcagctggcccagagaggagctggcctgtgcttcacctttgtgtctgcccagcagaacagccccagcagcacaggcagcggcaacacagagcacagctgcagcagccagaagcagatcagcatccagcaccggcagacccagagcgacctgaccatcgagaagatcagcgccctggagaacagcaagaacagcgacctggagaagaaggagggcagaattgatgacctgctgcgggccaactgtgacctgcggcggcagattgatgagcagcagaagatgctggagaagtacaaggagcggctgaacagatgtgtgaccatgagcaagaagctgctgattgagaagagcaagcaggagaagatggcctgccgggacaagtccatgcaggaccggctgcggctgggccacttcaccaccgtgcgccacggggccagcttcacagagcagtggacagatggctacgccttccagaacctgatcaagcagcaggagcgcatcaacagccagcgggaggagattgagcggcagaggaagatgctggccaagaggaagcccccagccatgggccaggcccccccagccaccaatgagcagaagcagaggaagagcaagaccaacggggctgaaaatgagaccctgaccctggccgagtaccacgagcaggaggagatcttcaagctgcggctgggccacctgaagaaggaggaggccgagatccaggccgagctggagcggctggagcgggtgaggaacctgcacatccgggagctgaagaggatccacaatgaagacaacagccagttcaaggaccaccccaccctgaatgaccgctacctgctgctgcacctgctgggccggggcggcttcagcgaggtgtacaaggcctttgacctgacagagcagagatatgtggccgtgaagatccaccagctgaacaagaactggagagatgagaagaaggagaactaccacaagcacgcctgccgggagtaccgcatccacaaggagctggaccacccccgcatcgtgaagctgtatgactacttcagcctggacacagacagcttctgcaccgtgctggagtactgtgagggcaatgacctggacttctacctgaagcagcacaagctgatgtctgagaaggaggcccggagcatcatcatgcagatcgtgaatgccctgaagtacctgaatgagatcaagccacccatcatccactatgacctgaagccaggcaacatcctgctggtgaatggaacagcctgtggggagatcaagatcacagactttggcctgagcaagatcatggatgatgacagctacaacagcgtggatggcatggagctgaccagccagggcgccggcacctactggtacctgcccccagaatgttttgtggtgggcaaggagccccccaagatcagcaacaaggtggatgtgtggagcgtgggcgtcatcttctaccagtgcctgtatggcaggaagcccttcggccacaaccagagccagcaggacatcctgcaggagaacaccatcctgaaggccacagaggtgcagtttcctcccaagcctgtggtgaccccagaggccaaggccttcatccgccgctgcctggcctacagaaaagaagatagaattgatgtgcagcagctggcctgtgacccctacctgctgccccacatcaggaagtctgtgtccaccagcagccctgctggagctgccatcgccagcaccagcggggccagcaacaacagcagcagcaactag

SEQ ID NO: 17221 - DNA, 2253 bp, Artificial Sequence
  Description of Artificial Sequence: Synthetic coding sequence
atgatggaggagctgcacagcctggacccccggcggcaggagctgctggaggcccgcttcaccggggtgggcgtgtccaagggccccctgaacagcgagagcagcaaccagagcctgtgcagcgtgggcagcctgagtgacaaggaggtggagaccccagagaagaagcagaatgaccagaggaacaggaagaggaaggccgagccctatgagaccagccagggcaagggcaccccccggggccacaagatcagtgactactttgaatttgctgggggcagcgcccctggcaccagccctggccgctctgtgccccctgtggcccggagcagcccccagcacagcctgagcaaccccctgccccggcgggtggagcagcccctgtatggcctggatggcagcgctgccaaggaggccacagaggagcagagcgccctgcccaccctgatgtctgtgatgctggccaagccccggctggacacagagcagctggcccagagaggagctggcctgtgcttcacctttgtgtctgcccagcagaacagccccagcagcacaggcagcggcaacacagagcacagctgcagcagccagaagcagatcagcatccagcaccggcagacccagagcgacctgaccatcgagaagatcagcgccctggagaacagcaagaacagcgacctggagaagaaggagggcagaattgatgacctgctgcgggccaactgtgacctgcggcggcagattgatgagcagcagaagatgctggagaagtacaaggagcggctgaacagatgtgtgaccatgagcaagaagctgctgattgagaagagcaagcaggagaagatggcctgccgggacaagtccatgcaggaccggctgcggctgggccacttcaccaccgtgcgccacggggccagcttcacagagcagtggacagatggctacgccttccagaacctgatcaagcagcaggagcgcatcaacagccagcgggaggagattgagcggcagaggaagatgctggccaagaggaagcccccagccatgggccaggcccccccagccaccaatgagcagaagcagaggaagagcaagaccaacggggctgaaaatgagaccctgaccctggccgagtaccacgagcaggaggagatcttcaagctgcggctgggccacctgaagaaggaggaggccgagatccaggccgagctggagcggctggagcgggtgaggaacctgcacatccgggagctgaagaggatccacaatgaagacaacagccagttcaaggaccaccccaccctgaatgaccgctacctgctgctgcacctgctgggccggggcggcttcagcgaggtgtacaaggcctttgacctgacagagcagagatatgtggccgtgaagatccaccagctgaacaagaactggagagatgagaagaaggagaactaccacaagcacgcctgccgggagtaccgcatccacaaggagctggaccacccccgcatcgtgaagctgtatgactacttcagcctggacacagacagcttctgcaccgtgctggagtactgtgagggcaatgacctggacttctacctgaagcagcacaagctgatgtctgagaaggaggcccggagcatcatcatgcagatcgtgaatgccctgaagtacctgaatgagatcaagccacccatcatccactatgacctgaagccaggcaacatcctgctggtgaatggaacagcctgtggggagatcaagatcacagactttggcctgagcaagatcatggatgatgacagctacaacagcgtggatggcatggagctgaccagccagggcgccggcacctactggtacctgcccccagaatgttttgtggtgggcaaggagccccccaagatcagcaacaaggtggatgtgtggagcgtgggcgtcatcttctaccagtgcctgtatggcaggaagcccttcggccacaaccagagccagcaggacatcctgcaggagaacaccatcctgaaggccacagaggtgcagtttcctcccaagcctgtggtgaccccagaggccaaggccttcatccgccgctgcctggcctacagaaaagaagatagaattgatgtgcagcagctggcctgtgacccctacctgctgccccacatcaggaagtctgtgtccaccagcagccctgctggagctgccatcgccagcaccagcggggccagcaacaacagcagcagcaactag

SEQ ID NO: 17222 - DNA, 2157 bp, Artificial Sequence; identical to SEQ ID NO: 17220
  Description of Artificial Sequence: Synthetic coding sequence

SEQ ID NO: 17223 - DNA, 1521 bp, Artificial Sequence
  Description of Artificial Sequence: Synthetic coding sequence
atggatgtgcggctgtaccccagcgccccagctgtgggcgcccggcctggagctgagcctgctggcctggcccacctggactactaccacggcggcaagtttgatggagacagcgcctacgtgggcatgtctgatggcaaccctgagctgctgagcaccagccagacctacaacggccagagcgagaacaatgaagattatgagatcccccccatcaccccacccaacctgcctgagcccagcctgctgcacctgggggaccacgaggccagctaccacagcctgtgccacggcctgacccccaacggcctgctgcctgcctacagctaccaggccatggacctgcctgccatcatggtgagcaacatgctggcccaggacagccacctgctgagcggccagctgcccaccatccaggagatggtgcacagcgaggtggccgcctatgattctggccggcccggccccctgctgggccgcccagccatgctggccagccacatgtctgccctgagccagagccagctgatcagccagatgggcatccgcagcagcatcgcccacagcagccccagccccccaggcagcaagagcgccacccccagccccagcagcagcacccaggaggaggagagcgaggtgcacttcaagatctctggagagaagaggccttctgctgaccccgggaagaaggccaagaaccccaagaagaagaagaagaaggaccccaatgagccccagaagcctgtgtctgcctatgccctcttcttccgggacacccaggccgccatcaagggccagaaccccagcgccacctttggagatgtgtccaagatcgtggcctccatgtgggacagcctgggggaggagcagaagcaggcctacaagaggaagacagaagctgccaagaaggagtacctgaaggccctggccgcctaccgggccagcctggtgtccaagagcagcccagaccagggcgagaccaagagcacccaggccaaccccccagccaagatgctgccccccaagcagcccatgtatgccatgcctggcctggccagcttcctgacccccagcgacctgcaggccttccgcagcggggccagccctgccagcctggcccggaccctgggcagcaagagcctgctgcccggcctgagcgccagccccccacctcctccttccttccccctgagccccaccctgcaccagcagctgagcctgccccctcatgcccagggcgccctgctgagcccccctgtgtccatgagccctgccccccagccccctgtgctgcccacccccatggccctgcaggtgcagctggccatgagccccagccccccaggcccccaggacttcccccacatcagcgagttccccagcagcagcggcagctgcagccctggccccagcaaccccaccagcagcggggactgggacagcagctaccccagcggggagtgtggcatcagcacctgcagcctgctgccccgggacaagagcctgtacctgacctag

SEQ ID NO: 17224 - DNA, 1467 bp, Artificial Sequence
  Description of Artificial Sequence: Synthetic coding sequence
atgcagcagaccaggacagaggccgtggccggggccttcagccgctgcctgggcttctgtggcatgaggctgggcctgctgctgctggcccggcactggtgcatcgccggggtcttcccccagaagtttgatggagacagcgcctacgtgggcatgtctgatggcaaccctgagctgctgagcaccagccagacctacaacggccagagtgaaaataatgaagattatgagatcccccccatcaccccacccaacctgcctgagcccagcctgctgcacctgggggaccacgaggccagctaccacagcctgtgccacggcctgaccccaaatggcctgctgcctgcctacagctaccaggccatggacctgcctgccatcatggtgagcaacatgctggcccaggacagccacctgctgagcggccagctgcccaccatccaggagatggtgcacagcgaggtggccgcctatgacagcggccggcccggccccctgctgggccggcctgccatgctggccagccacatgtctgccctgagccagagccagctgatcagccagatgggcatccgcagcagcatcgcccacagcagccccagccccccaggcagcaagagcgccacccccagccccagcagcagcacccaggaggaggagagcgaggtgcacttcaagatcagcggggagaagaggcccagcgctgaccccgggaagaaggccaagaaccccaagaagaagaagaagaaggaccccaatgagccccagaagcctgtgtctgcctatgccctcttcttccgggacacccaggccgccatcaagggccagaaccccagcgccacctttggagatgtgtccaagatcgtggcctccatgtgggacagcctgggggaggagcagaagcagagcagcccagaccagggcgagaccaagagcacccaggccaaccccccagccaagatgctgccccccaagcagcccatgtatgccatgcctggcctggccagcttcctgacccccagcgacctgcaggccttccgcagcggggccagccctgccagcctggcccggaccctgggcagcaagagcctgctgcccggcctgagcgccagccccccacctcctccttccttccccctgagccccaccctgcaccagcagctgagcctgccccctcatgcccagggcgccctgctgagcccccctgtgtccatgagccctgccccccagccccctgtgctgcccacccccatggccctgcaggtgcagctggccatgagccccagccccccaggcccccaggacttcccccacatcagcgagttccccagcagcagcggcagctgcagccctggccccagcaaccccaccagcagcggggactgggacagcagctaccccagcggggagtgtggcatcagcacctgcagcctgctgccccgggacaagagcctgtacctgacctag

SEQ ID NO: 17225 - DNA, 591 bp, Artificial Sequence
  Description of Artificial Sequence: Synthetic coding sequence
agaagaagaaggaagaggaggacccccatgagccgccgcagcctgtgccggcccacccacagcagcagcgagaccctgcggccccccagccgggtgaggacccctgtgcccctgtctgtgacctgccccaagtcctggccaccctgtggcacagcctgggagaggaacagaagcaggaccagcaggaccagcctgagcagccctgctgcccgggaccctgcccacctggcccaccccaccccacctgctgctggcaccggcacagctgccacccctgtgggctctgtggccagcgccccagctgcctgcagccctggcaccaacagaagcaccagccccaacccagccagcctgcccagcctgcggctggccggccgccactgcagcgagcctgagggcctgacagctgagaagaggccctggccagaggccggctggcccatcggggagagcagtgacacccccatcgcccggggcctgagcctcttcctgaacctgcccccagacagcgctgaggccgcccactgccccccaccagcccagaggacctgcaggaacctgcccccagctgacctgctggcccctggatag

SEQ ID NO: 17226 - DNA, 1395 bp, Artificial Sequence
  Description of Artificial Sequence: Synthetic coding sequence
atgtctgatggcaaccctgagctgctgagcaccagccagacctacaacggccagagcgagaacaatgaagattatgagatcccccccatcaccccacccaacctgcctgagcccagcctgctgcacctgggggaccacgaggccagctaccacagcctgtgccacggcctgacccccaacggcctgctgcctgcctacagctaccaggccatggacctgcctgccatcatggtgagcaacatgctggcccaggacagccacctgctgagcggccagctgcccaccatccaggagatggtgcacagcgaggtggccgcctatgattctggccggcccggccccctgctgggccgcccagccatgctggccagccacatgtctgccctgagccagagccagctgatcagccagatgggcatccgcagcagcatcgcccacagcagccccagccccccaggcagcaagagcgccacccccagccccagcagcagcacccaggaggaggagagcgaggtgcacttcaagatctctggagagaagaggccttctgctgaccccgggaagaaggccaagaaccccaagaagaagaagaagaaggaccccaatgagccccagaagcctgtgtctgcctatgccctcttcttccgggacacccaggccgccatcaagggccagaaccccagcgccacctttggagatgtgtccaagatcgtggcctccatgtgggacagcctgggggaggagcagaagcaggcctacaagaggaagacagaagctgccaagaaggagtacctgaaggccctggccgcctaccgggccagcctggtgtccaagagcagcccagaccagggcgagaccaagagcacccaggccaaccccccagccaagatgctgccccccaagcagcccatgtatgccatgcctggcctggccagcttcctgacccccagcgacctgcaggccttccgcagcggggccagccctgccagcctggcccggaccctgggcagcaagagcctgctgcccggcctgagcgccagccccccacctcctccttccttccccctgagccccaccctgcaccagcagctgagcctgccccctcatgcccagggcgccctgctgagcccccctgtgtccatgagccctgccccccagccccctgtgctgcccacccccatggccctgcaggtgcagctggccatgagccccagccccccaggcccccaggacttcccccacatcagcgagttccccagcagcagcggcagctgcagccctggccccagcaaccccaccagcagcggggactgggacagcagctaccccagcggggagtgtggcatcagcacctgcagcctgctgccccgggacaagagcctgtacctgacctag

SEQ ID NO: 17227 - DNA, 591 bp, Artificial Sequence; identical to SEQ ID NO: 17225
  Description of Artificial Sequence: Synthetic coding sequence

SEQ ID NO: 17228 - DNA, 1395 bp, Artificial Sequence; identical to SEQ ID NO: 17226
  Description of Artificial Sequence: Synthetic coding sequence

SEQ ID NO: 17229 - DNA, 1155 bp, Artificial Sequence
  Description of Artificial Sequence: Synthetic coding sequence
atggagcaggagcgggagggcttcagcgaggaggtgaccttccagatccaggagatggtgcacagcgaggtggccgcctatgattctggccggcccggccccctgctgggccgcccagccatgctggccagccacatgtctgccctgagccagagccagctgatcagccagatgggcatccgcagcagcatcgcccacagcagccccagccccccaggcagcaagagcgccacccccagccccagcagcagcacccaggaggaggagagcgaggtgcacttcaagatctctggagagaagaggccttctgctgaccccgggaagaaggccaagaaccccaagaagaagaagaagaaggaccccaatgagccccagaagcctgtgtctgcctatgccctcttcttccgggacacccaggccgccatcaagggccagaaccccagcgccacctttggagatgtgtccaagatcgtggcctccatgtgggacagcctgggggaggagcagaagcaggcctacaagaggaagacagaagctgccaagaaggagtacctgaaggccctggccgcctaccgggccagcctggtgtccaagagcagcccagaccagggcgagaccaagagcacccaggccaaccccccagccaagatgctgccccccaagcagcccatgtatgccatgcctggcctggccagcttcctgacccccagcgacctgcaggccttccgcagcggggccagccctgccagcctggcccggaccctgggcagcaagagcctgctgcccggcctgagcgccagccccccacctcctccttccttccccctgagccccaccctgcaccagcagctgagcctgccccctcatgcccagggcgccctgctgagcccccctgtgtccatgagccctgccccccagccccctgtgctgcccacccccatggccctgcaggtgcagctggccatgagccccagccccccaggcccccaggacttcccccacatcagcgagttccccagcagcagcggcagctgcagccctggccccagcaaccccaccagcagcggggactgggacagcagctaccccagcggggagtgtggcatcagcacctgcagcctgctgccccgggacaagagcctgtacctgacctag

SEQ ID NO: 17230 - DNA, 537 bp, Artificial Sequence
  Description of Artificial Sequence: Synthetic coding sequence
atgtctgatggcaaccctgagctgctgagcaccagccagacctacaacggccagagcgagaacaatgaagattatgagatcccccccatcaccccacccaacctgcctgagcccagcctgctgcacctgggggaccacgaggccagctaccacagcctgtgccacggcctgacccccaacggcctgctgcctgcctacagctaccaggccatggacctgcctgccatcatggtgagcaacatgctggcccaggacagccacctgctgagcggccagctgcccaccatccaggagatggtgcacagcgaggtggccgcctatgattctggccggcccggccccctgctgggccgcccagccatgctggccagccacatgtctgccctgagccagagccagctgatcagccagatgggcatccgcagcagcatcgcccacagcagccccagccccccaggcagcaagagcgccacccccagccccagcagcagcacccaggaggaggagagcgaggtgcacttcaagatctctggatag

SEQ ID NO: 17231 - DNA, 366 bp, Artificial Sequence
  Description of Artificial Sequence: Synthetic coding sequence
atggctgctgcccgggccaccaccccagcagatggagaggagcccgcccctgaggccgaggccctggccgccgcccgggagaggagcagccgcttcctgagcggcctggagctggtgaagcagggcgctgaggcccgggtcttccggggccgcttccagggccgggctgctgtgatcaagcaccgcttccccaagggctaccgccacccagccctggaggcccggctgggcagaagaagaacagtgcaggaggcccgggccctgctgcgctgccggcgggccggcaaggagtacctgccccagctgtccttcctgtggaccatgctgcccacagcctacatctggaagaagctgaaggcccagtag

SEQ ID NO: 17232 - DNA, 762 bp, Artificial Sequence
  Description of Artificial Sequence: Synthetic coding sequence
atggctgctgcccgggccaccaccccagcagatggagaggagcccgcccctgaggccgaggccctggccgccgcccgggagaggagcagccgcttcctgagcggcctggagctggtgaagcagggcgctgaggcccgggtcttccggggccgcttccagggccgggctgctgtgatcaagcaccgcttccccaagggctaccgccacccagccctggaggcccggctgggcagaagaagaacagtgcaggaggcccgggccctgctgcgctgccggcgggccggcatcagcgcccctgtggtgttctttgtggactatgccagcaactgcctgtacatggaggagattgagggctctgtgacagtgcgggactacatccagagcaccatggagacagagaagaccccccagggcctgagcaacctggccaagaccatcggccaggtgctggccaggatgcatgatgaggacctgatccacggggacctgaccaccagcaacatgctgctgaagccacccctggagcagctgaacatcgtgctgattgactttggcctgtccttcatcagcgccctgcctgaggacaagggcgtggacctgtatgtgctggagaaggccttcctgagcacccaccccaacacagagaccgtgtttgaggccttcctgaagagctacagcaccagcagcaagaaggcccggcctgtgctgaagaagctggatgaggtgcggctgcggggcaggaagaggtccatggtgggctag

SEQ ID NO: 17233 - DNA, 1146 bp, Artificial Sequence
  Description of Artificial Sequence: Synthetic coding sequence
atgatcagcgcccacaggaagctgtgcctgcccggcagcagcaacagccctgccagcgccttccgggtggccggcaccacagctgtgaagatgtctgacaagaaccagattgctgcccgggccagcctcatcgagcagctgatgagcaagaggaactttgaggacctgggcaaccacctgacagagctggagaccatctacgtgaccaaggagcacctgcaggagacagatgtggtgcgggctgtgtacagagtgctgaagaactgccccagcgtggccctgaagaagaaggccaagtgcctgctgagcaagtggaaggctgtgtacaagcagacccacagcaaggccaggaacagccccaagctgtttcctgtgcggggcaacaaggaggagaacagcggccccagccatgaccccagccagaatgagaccctgggcatctgcagcagcaacagcctgagcagccaggatgtggccaagctgtctgagatgattgtgcctgagaacagagccatccagctgaagcccaaggaggagcactttggagatggagaccctgagagcacaggcaagaggagcagcgagctgctggaccccaccacccccatgaggaccaagtgcatcgagctgctgtatgctgccctgaccagcagcagcacagaccagcccaaggctgacctgtggcagaactttgcccgggagattgaggagcacgtgttcaccctgtacagcaagaacatcaagaagtacaagacctgcatccgcagcaaggtggccaacctgaagaaccccaggaacagccacctgcagcagaacctgctgagcggcaccaccagcccccgggagtttgctgagatgacagtgatggagatggccaacaaggagctgaagcagctgcgggccagctacacagagagctgcatccaggagcactacctgccccaggtgattgatggcacccagaccaacaagatcaagtgccgccgctgtgagaagtacaactgcaaggtgaccgtcatcgaccggggcaccctcttcctgcccagctgggtgaggaacagcaacccagatgagcagatgatgacctacgtgatctgcaatgaatgtggggagcagtggtaccacagcaagtgggtgtgctggtag

SEQ ID NO: 17234 - DNA, 1056 bp, Artificial Sequence
  Description of Artificial Sequence: Synthetic coding sequence
atgtctgacaagaaccagattgctgcccgggccagcctcatcgagcagctgatgagcaagaggaactttgaggacctgggcaaccacctgacagagctggagaccatctacgtgaccaaggagcacctgcaggagacagatgtggtgcgggctgtgtacagagtgctgaagaactgccccagcgtggccctgaagaagaaggccaagtgcctgctgagcaagtggaaggctgtgtacaagcagacccacagcaaggccaggaacagccccaagctgtttcctgtgcggggcaacaaggaggagaacagcggccccagccatgaccccagccagaatgagaccctgggcatctgcagcagcaacagcctgagcagccaggatgtggccaagctgtctgagatgattgtgcctgagaacagagccatccagctgaagcccaaggaggagcactttggagatggagaccctgagagcacaggcaagaggagcagcgagctgctggaccccaccacccccatgaggaccaagtgcatcgagctgctgtatgctgccctgaccagcagcagcacagaccagcccaaggctgacctgtggcagaactttgcccgggagattgaggagcacgtgttcaccctgtacagcaagaacatcaagaagtacaagacctgcatccgcagcaaggtggccaacctgaagaaccccaggaacagccacctgcagcagaacctgctgagcggcaccaccagcccccgggagtttgctgagatgacagtgatggagatggccaacaaggagctgaagcagctgcgggccagctacacagagagctgcatccaggagcactacctgccccaggtgattgatggcacccagaccaacaagatcaagtgccgccgctgtgagaagtacaactgcaaggtgaccgtcatcgaccggggcaccctcttcctgcccagctgggtgaggaacagcaacccagatgagcagatgatgacctacgtgatctgcaatgaatgtggggagcagtggtaccacagcaagtgggtgtgctggtag

SEQ ID NO: 17235 - DNA, 1056 bp, Artificial Sequence; identical to SEQ ID NO: 17234
  Description of Artificial Sequence: Synthetic coding sequence

SEQ ID NO: 17236 - DNA, 1056 bp, Artificial Sequence; identical to SEQ ID NO: 17234
  Description of Artificial Sequence: Synthetic coding sequence

SEQ ID NO: 17237 - DNA, 1476 bp, Artificial Sequence
  Description of Artificial Sequence: Synthetic coding sequence
atgaagaccttcacctggaccctgggcgtgctcttcttcctgctggtggacaccggccactgccggggcggccagttcaagatcaagaagatcaaccagaggcgctacccccgggccacagatggcaaggaggaggccaagaagtgtgcctacaccttcctggtgcctgagcagaggatcaccggccccatctgtgtgaacaccaagggccaggatgccagcaccatcaaggacatgatcaccaggatggacctggagaacctgaaggatgtgctgagccggcagaagcgggagattgatgtgctgcagctggtggtggatgtggatggcaacatcgtgaatgaggtgaagctgctgaggaaggagagcaggaacatgaacagccgggtgacccagctgtacatgcagctgctgcacgagatcatcaggaagagggacaacagcctggagctgagccagctggagaacaagatcctgaatgtgaccacagagatgctgaagatggccacccgctaccgggagctggaggtgaagtatgccagcctgacagacctggtgaacaaccagagcgtgatgatcaccctgctggaggagcagtgcctgcgcatcttcagccggcaggacacccacgtgtccccacccctggtgcaggtggtgccccagcacatccccaacagccagcagtacaccccaggcctgctgggcggcaatgagatccagagggaccccggctacccccgggacctgatgcctcctccagacctggccaccagccccaccaagagccccttcaagatcccccctgtgaccttcatcaatgaaggccccttcaaggactgccagcaggccaaggaggccggccacagcgtgtctggcatctacatgatcaagccagagaacagcaatggccccatgcagctgtggtgtgagaacagcctggaccccggcggctggacagtcatccagaagaggacagatggctctgtgaacttcttcaggaactgggagaactacaagaagggcttcggcaacattgatggagagtactggctgggcctggagaacatctacatgctgagcaaccaggacaactacaagctgctgattgagctggaggactggagcgacaagaaggtgtatgcagagtacagcagcttccggctggagcctgagagcgagttctaccgcctgcggctgggcacctaccagggcaatgctggggacagcatgatgtggcacaacgggaagcagttcaccaccctggaccgggacaaggacatgtatgccggcaactgtgcccacttccacaagggcggctggtggtacaatgcctgtgcccacagcaacctgaatggagtgtggtacagaggaggccactaccgcagcaagcaccaggacggcatcttctgggccgagtacagaggaggcagctacagcctgcgggctgtgcagatgatgatcaagcccatcgactag

SEQ ID NO: 17238 - DNA, 717 bp, Artificial Sequence
  Description of Artificial Sequence: Synthetic coding sequence
atggctgtgttttctggagtgctggagagcgccctcttcctggaccagaacaccctgcaggcccggcagggcagccgcagccccctgaccatggacaagtttgtgatccgcaccccccgcatccagaacagcccccagaagaaggacagcggcggcaaggtgtacaagcaggccaccatcgagagcctgaagagggtggtggtggtggaggacatcaagcgctggaagaccatgctggagctgcctgaccagaccaaggagaacctggtggaggccctgcaggagctgaagaagaagatccccagccgggaggtgctgaagagcaccagaattggccacacagtgaacaagatgaggaagcacagcgacagcgaggtggccagcctggcccgggaggtgtacacagagtggaagaccttcacagagaagcacagcaaccggcccagcattgaggtgcggagtgaccccaagacagagagcctgaggaagaatgcccagaagctgctgtctgaggccctggagctgaagatggaccacctgctggtggagaacatcgagcgggagaccttccacctgtgcagccgcctcatcaatggcccctacagaagaacagtgcgggccctggtgttcaccctgaagcacagagctgagatccgggcccaggtgaagagcggcagcctgcctgtgggcacctttgtgcagacccacaagaagtag

SEQ ID NO: 17239 - DNA, 741 bp, Artificial Sequence
  Description of Artificial Sequence: Synthetic coding sequence
atggacctgctgcgggagctgaaggccatgcccatcaccctgcacctgctgcagagcaccagggtgggcatgtctgtgaatgccctgaggaagcagagcagtgatgaggaggtgattgccctggccaagagcctcatcaagtcctggaagaagctgctggatgccagtgatgccaaggcccgggagcggggccggggcatgcccctgcccaccagcagcagagatgccagcgaggccccagaccccagcaggaagaggcctgagctgccccgggcccccagcaccccccgcatcaccaccttcccccctgtgcctgtgacctgtgatgctgtgaggaacaagtgccgggagatgctgacagctgccctgcagacagaccatgaccacgtggccatcggggctgactgtgagcggctgagcgcccagatcgaggagtgcatcttcagagatgtgggcaacacagacatgaagtacaagaacagagtgcgcagccgcatcagcaacctgaaggatgccaagaacccagacctgcggagaaatgtgctgtgtggggccatcaccccccagcagattgctgtgatgaccagcgaggagatggccagtgatgagctgaaggagatcaggaaggccatgaccaaggaggccatccgggagcaccagatggccaggactggaggcacccagacagacctcttcacctgtgggaagtgcaggaagaagaactgcacctacacccagtag

SEQ ID NO: 17240 - DNA, 900 bp, Artificial Sequence
  Description of Artificial Sequence: Synthetic coding sequence
atgatgggcaaggaggaggagatcgccagaattgcccggcggctggacaagatggtgaccaagaagtctgctgagggcgccatggacctgctgcgggagctgaaggccatgcccatcaccctgcacctgctgcagagcaccagggtgggcatgtctgtgaatgccctgaggaagcagagcagtgatgaggaggtgattgccctggccaagagcctcatcaagtcctggaagaagctgctggatgccagtgatgccaaggcccgggagcggggccggggcatgcccctgcccaccagcagcagagatgccagcgaggccccagaccccagcaggaagaggcctgagctgccccgggcccccagcaccccccgcatcaccaccttcccccctgtgcctgtgacctgtgatgctgtgagaaataaatgtcgggagatgctgacagctgccctgcagacagaccatgaccacgtggccatcggggctgactgtgagcggctgagcgcccagatcgaggagtgcatcttcagagatgtgggcaacacagacatgaagtacaagaacagagtgcgcagccgcatcagcaacctgaaggatgccaagaacccagacctgcggagaaatgtgctgtgtggggccatcaccccccagcagattgctgtgatgaccagcgaggagatggccagtgatgagctgaaggagatcaggaaggccatgaccaaggaggccatccgggagcaccagatggccaggactggaggcacccagacagacctcttcacctgtgggaaatgtaggaagaagaactgcacctacacccaggtgcagaccaggagcagtgatgagcccatgaccacctttgtggtgtgcaatgaatgtggcaaccgctggaagttctgctag

SEQ ID NO: 17241 - DNA, 819 bp, Artificial Sequence
  Description of Artificial Sequence: Synthetic coding sequence
atggacctgctgcgggagctgaaggccatgcccatcaccctgcacctgctgcagagcaccagggtgggcatgtctgtgaatgccctgaggaagcagagcagtgatgaggaggtgattgccctggccaagagcctcatcaagtcctggaagaagctgctggatgccagtgatgccaaggcccgggagcggggccggggcatgcccctgcccaccagcagcagagatgccagcgaggccccagaccccagcaggaagaggcctgagctgccccgggcccccagcaccccccgcatcaccaccttcccccctgtgcctgtgacctgtgatgctgtgaggaacaagtgccgggagatgctgacagctgccctgcagacagaccatgaccacgtggccatcggggctgactgtgagcggctgagcgcccagatcgaggagtgcatcttcagagatgtgggcaacacagacatgaagtacaagaacagagtgcgcagccgcatcagcaacctgaaggatgccaagaacccagacctgcggagaaatgtgctgtgtggggccatcaccccccagcagattgctgtgatgaccagcgaggagatggccagtgatgagctgaaggagatcaggaaggccatgaccaaggaggccatccgggagcaccagatggccaggactggaggcacccagacagacctcttcacctgtgggaagtgcaggaagaagaactgcacctacacccaggtgcagaccaggagcagtgatgagcccatgaccacctttgtggtgtgcaatgaatgtggcaaccgctggaagttctgctag

SEQ ID NO: 17242 - DNA, 729 bp, Artificial Sequence
  Description of Artificial Sequence: Synthetic coding sequence
atgatgggcaaggaggaggagatcgccagaattgcccggcggctggacaagatggtgaccaagaagtctgctgagggcgccatggacctgctgcgggagctgaaggccatgcccatcaccctgcacctgctgcagagcaccagggtgggcatgtctgtgaatgccctgaggaagcagagcagtgatgaggaggtgattgccctggccaagagcctcatcaagtcctggaagaagctgctggatgccagtgatgccaaggcccgggagcggggccggggcatgcccctgcccaccagcagcagagatgccagcgaggccccagaccccagcaggaagaggcctgagctgccccgggcccccagcaccccccgcatcaccaccttcccccctgtgcctgtgacctgtgatgctgtgagaaataaatgtcgggagatgctgacagctgccctgcagacagaccatgaccacgtggccatcggggctgactgtgagcggctgagcgcccagatcgaggagtacatcctgtgggtgggcgctgtgggcctgggcttctggtggagccaggaggccgcctggccaggggccctgtggtggctgctggatgccacagcccagctgagccggggccacctgcccggctggagccctgcctgggtggtgcggctgagccacctgcggcgggcccctggccctgctgagggcctcatcctgagcgcctgtggggcctag

SEQ ID NO: 17243 - DNA, 249 bp, Artificial Sequence
  Description of Artificial Sequence: Synthetic coding sequence
atggacctgctgcgggagctgaaggccatgcccatcaccctgcacctgctgcagagcaccagggtgggcatgtctgtgaatgccctgaggaagcagagcagtgatgaggaggtgattgccctggccaagagcctcatcaagtcctggaagaagctgctggatgccagtgatgccaaggcccgggagcggggccggggcatgcccctgcccaccagcagcagagatgccagcgaggccccagacccctag

SEQ ID NO: 17244 - DNA, 741 bp, Artificial Sequence; identical to SEQ ID NO: 17239
  Description of Artificial Sequence: Synthetic coding sequence

SEQ ID NO: 17245 - DNA, 813 bp, Artificial Sequence
  Description of Artificial Sequence: Synthetic coding sequence
atggacctgctgcgggagctgaaggccatgcccatcaccctgcacctgctgcagagcaccagggtgggcatgtctgtgaatgccctgaggaagcagagcagtgatgaggaggtgattgccctggccaagagcctcatcaagtcctggaagaagctgctggatgccagtgatgccaaggcccgggagcggggccggggcatgcccctgcccaccagcagcagagatgccagcgaggccccagaccccagcaggaagaggcctgagctgccccgggcccccagcaccccccgcatcaccaccttcccccctgtgcctgtgacctgtgatgctgtgaggaacaagtgccgggagatgctgacagctgccctgcagacagaccatgaccacgtggccatcggggctgactgtgagcggctgagcgcccagatcgaggagtgcatcttcagagatgtgggcaacacagacatgaagtacaagaacagagtgcgcagccgcatcagcaacctgaaggatgccaagaacccagacctgcggagaaatgtgctgtgtggggccatcaccccccagcagattgctgtgatgaccagcgaggagatggccagtgatgagctgaaggagatcaggaaggccatgaccaaggaggccatccgggagcaccagatggccaggactggaggcacccagacagacctcttcacctgtgggaagtgcaggaagaagaactgcacctacacccaggtgcagaccaggagcagtgatgagcccatgaccacctttgtggtgtgcaatgaatgtggcaaccgctggaagtag

SEQ ID NO: 17246 - DNA, 465 bp, Artificial Sequence
  Description of Artificial Sequence: Synthetic coding sequence
atgggccaggaggaggagctgctgcgcatcgccaagaagctggagaagatggtggccaggaagaacacagaaggagccctggacctgctgaagaagctgcacagctgccagatgagcatccagctgctgcagaccacccgcatcggcgtggccgtgaatggagtgaggaagcactgcagcgacaaggaggtggtgtccctggccaaggtgctgatcaagaactggaagaggctgctggacagccctggcccccccaagggggagaagggggaggagcgggagaaggccaagaagaaggagaagggcctggagtgcagcgactggaagccagaggccggcctgagcccccccaggaagaagcgggaggaccccaagacccggcgggacagcgtggacagcaagagcagcgccagcagcagccccaagaggccttctgtggagcgggcctgcagcctgatgcagtag

SEQ ID NO: 17247 - DNA, 1047 bp, Artificial Sequence
  Description of Artificial Sequence: Synthetic coding sequence
atgggccaggaggaggagctgctgcgcatcgccaagaagctggagaagatggtggccaggaagaacacagaaggagccctggacctgctgaagaagctgcacagctgccagatgagcatccagctgctgcagaccacccgcatcggcgtggccgtgaatggagtgaggaagcactgcagcgacaaggaggtggtgtccctggccaaggtgctgatcaagaactggaagaggctgctggacagccctggcccccccaagggggagaagggggaggagcgggagaaggccaagaagaaggagaagggcctggagtgcagcgactggaagccagaggccggcctgagcccccccaggaagaagcgggaggaccccaagacccggcgggacagcgtggacagcaagagcagcgccagcagcagccccaagaggccttctgtggagaggagcaacagcagcaagagcaaggccgagagccccaagacccccagcagccccctgacccccacctttgccagctccatgtgcctgctggccccctgctacctgactggagacagcgtgcgggacaagtgtgtggagatgctgtctgctgccctgaaggcagatgatgactacaaggactatggagtgaactgtgacaagatggccagcgagattgaggaccacatctaccaggagctgaagagcacagacatgaagtacagaaacagagtgcgcagccgcatcagcaacctgaaggaccccagaaatcctggcctgcggagaaatgtgctgagcggggccatctctgctggcctgattgccaagatgacagctgaggagatggccagtgatgagctgcgggagctgagaaatgccatgacccaggaggccatccgggagcaccagatggccaagacaggaggcaccaccacagacctcttccagtgcagcaagtgcaagaagaagaactgcacctacaaccaggtgcagaccaggtctgcagatgagcccatgaccacctttgtgctgtgcaatgaatgtggcaaccgctggaagttctgctag

SEQ ID NO: 17248 - DNA, 684 bp, Artificial Sequence
  Description of Artificial Sequence: Synthetic coding sequence
atggagaagctgttcaatgaaaatgaaggcatgcccagcaaccagggcaagattgacaatgaggagcagccccctcatgagggcaagccagaggtggcctgcatcctggaggacaagaagctggagaatgaaggcaacacagagaacacaggcaagagggtggaggagcccctgaaggacaaggagaagccagagagcgctgggaaggccaagggggagggcaagtctgagaggaagggcaagtctgagatgcagggcggcagcaagacagagggcaagccagagcggggcggccgggcagagggggagggggagccagacagcgagcgggagcctgagagcgagggggagcctgagagcgagaccagggctgctgggaagaggcctgcagaagatgacatccccaggaaggccaagaggaagaccaacaagggcctggcccagtacctgaagcagtacaaggaggccatccatgacatgaacttcagcaatgaagacatgatccgggagtttgacaacatggcccgggtggaggacaagaggaggaagagcaagcagaagctgggcgccttcctgtggatgcagaggaacctgcaggaccccttctacccccggggcccccgggagttccggggcggctgccgggccccccggcgggacacagaggacatcccctacgtgtag

SEQ ID NO: 17249 - DNA, 684 bp, Artificial Sequence; identical to SEQ ID NO: 17248
  Description of Artificial Sequence: Synthetic coding sequence

SEQ ID NO: 17250 - DNA, 603 bp, Artificial Sequence
  Description of Artificial Sequence: Synthetic coding sequence
atggagaagccctacaacaagaatgaaggcaacctggagaatgaaggcaagccagaagatgaggtggagccagatgatgagggcaagagtgatgaggaggagaagccagatgtggagggcaagacagaatgtgagggcaagagagaagatgaaggagagcctggagatgagggccagctggaggatgagggcagccaggagaagcagggccgctctgagggggagggcaagccccagggcgagggcaagccagccagccaggccaagccagagagccagcccagggctgctgagaagaggcctgcagaagattatgtgcccaggaaggccaagaggaagacagaccggggcacagatgacagccccaaggacagccaggaggacctgcaggagcggcacctgagcagcgaggagatgatgagagaatgtggagatgtgtcccgggcccaggaggagctgaggaagaagcagaagatgggcggcttccactggatgcagagagatgtgcaggacccctttgccccccggggccagaggggcgtgcggggcgtgcggggcggcggccggggccagaggggcctgcatgacatcccctacctgtag

SEQ ID NO: 17251 - DNA, 603 bp, Artificial Sequence; identical to SEQ ID NO: 17250
  Description of Artificial Sequence: Synthetic coding sequence

SEQ ID NO: 17252 - DNA, 603 bp, Artificial Sequence; identical to SEQ ID NO: 17250
  Description of Artificial Sequence: Synthetic coding sequence

SEQ ID NO: 17253 - DNA, 1077 bp, Artificial Sequence
  Description of Artificial Sequence: Synthetic coding sequence
atgcctgctgggggccaggccccccagctgacccctgtgatcccagccttctgggaggcccggggcctgcccaacagcaagggccgggacaaggtgcacatctgccagtgtgaggagtggaagggccacatctcctatgtggagcgggacatcaccaccagcgagatcaagagcctgccccaggtgtctgtgcgggccttccacgccgccagcggcaccctggagtggaggaaaggaaatggctacggccggggcaagggctggggctggggccgggtggagagccgggaggccggccccagcgtggacagagatggcggcctgcgggtgtgctgcagccagaggtctgccaagccagagaaggaggagcagcctgtgcagaacccccggcgctctgtgaaggacaggaagaggcggggcaacctggacatggagaagctgtacagtgaaaatgaaggcatggccagcaaccagggcaagatggagaatgaggagcagccccaggatgagaggaagccagaggtgacctgcaccctggaggacaagaagctggagaatgaaggcaagacagaaaataaaggcaagacaggagatgaggagatgctgaaggacaagggcaagccagagagcgagggggaggccaaggagggcaagtctgagcgggagggggagagcgagatggagggcggcagcgagcgggagggcaagccagaaattgagggcaagccagagagcgagggggagcccggcagcgagaccagggctgctgggaagaggcctgcagaagatgatgtgcccaggaaggccaagaggaagaccaacaagggcctggcccactacctgaaggagtacaaggaggccatccatgacatgaacttcagcaatgaagacatgatccgggagtttgacaacatggccaaggtgcaggatgagaagaggaagagcaagcagaagctgggcgccttcctgtggatgcagaggaacctgcaggaccccttctacccccggggcccccgggagttccggggcggctgccgggccccccggcgggacatcgaggacatcccctacgtgtag

SEQ ID NO: 17254 - DNA, 561 bp, Artificial Sequence
  Description of Artificial Sequence: Synthetic coding sequence
atggagaagctgtacagtgaaaatgaaggcatggccagcaaccagggcaagatggagaatgaggagcagccccaggatgagaggaagccagaggtgacctgcaccctggaggacaagaagctggagaatgaaggcaagacagagaacaagggcaagacaggagatgaggagatgctgaaggacaagggcaagccagaaattgagggcaagccagagagcgagggggagcccggcagcgagaccagggctgctgggaagaggcctgcagaagatgatgtgcccaggaaggccaagaggaagaccaacaagggcctggcccactacctgaaggagtacaaggaggccatccatgacatgaacttcagcaatgaagacatgatccgggagtttgacaacatggccaaggtgcaggatgagaagaggaagagcaagcagaagctgggcgccttcctgtggatgcagaggaacctgcaggaccccttctacccccggggcccccgggagttccggggcggctgccgggccccccggcgggacatcgaggacatcccctacgtgtag

SEQ ID NO: 17255 - DNA, 648 bp, Artificial Sequence
  Description of Artificial Sequence: Synthetic coding sequence
atggagaagctgtacagtgaaaatgaaggcatggccagcaaccagggcaagatggagaatgaggagcagccccaggatgagaggaagccagaggtgacctgcaccctggaggacaagaagctggagaatgaaggcaagacagagaacaagggcaagacaggagatgaggagatgctgaaggacaagggcaagccagagagcgagggggaggccaaggagggcaagtctgagcgggagggggagagcgagatggagggcggcagcgagcgggagggcaagccagaaattgagggcaagccagagagcgagggggagcccggcagcgagaccagggctgctgggaagaggcctgcagaagatgatgtgcccaggaaggccaagaggaagaccaacaagggcctggcccactacctgaaggagtacaaggaggccatccatgacatgaacttcagcaatgaagacatgatccgggagtttgacaacatggccaaggtgcaggatgagaagaggaagagcaagcagaagctgggcgccttcctgtggatgcagaggaacctgcaggaccccttctacccccggggcccccgggagttccggggcggctgccgggccccccggcgggacatcgaggacatcccctacgtgtag

SEQ ID NO: 17256 - DNA, 177 bp, Artificial Sequence
  Description of Artificial Sequence: Synthetic coding sequence
atggagaagctgtacagtgaaaatgaaggcatggccagcaaccagggcaagatggagaatgaggagcagccccaggatgagaggaagccagaggtgacctgcaccctggaggacaagaagctggagaatgaaggcaagacagagaacaagggcaagacaggagatgaggagatgtag

SEQ ID NO: 17257 - DNA, 153 bp, Artificial Sequence
  Description of Artificial Sequence: Synthetic coding sequence
atggagaagctgtacagtgaaaatgaaggcatggccagcaaccagggcaagatggagaatgaggagcagccccaggatgagaggaagccagaggtgacctgcaccctggaggacaagaagctggagaatgaaggcaagacagagaacaagtag

SEQ ID NO: 17258 - DNA, 276 bp, Artificial Sequence
  Description of Artificial Sequence: Synthetic coding sequence
atggagaagctgtacagtgaaaatgaaggcatggccagcaaccagggcaagatggagaatgaggagcagccccaggatgagaggaagccagaggtgacctgcaccctggaggacaagaagctggagaatgaaggcaagacagagaacaagggcaagacaggagatgaggagatgctgaaggacaagggcaagccagagagcgagggggaggccaaggagggcaagtctgagcgggagggggagagcgagatggagggcggcagcgagcgggagtag

SEQ ID NO: 17259 - DNA, 648 bp, Artificial Sequence; identical to SEQ ID NO: 17255
  Description of Artificial Sequence: Synthetic coding sequence

SEQ ID NO: 17260 - DNA, 390 bp, Artificial Sequence
  Description of Artificial Sequence: Synthetic coding sequence
atggagaagctgtacagtgaaaatgaaggcatggccagcaaccagggcaagatggagaatgaggagcagccccaggatgagaggaagccagaggtgacctgcaccctggaggacaagaagctggagaatgaaggcaagacagagaacaagggcaagacaggagatgaggagatgctgaaggacaagggcaagccagagagcgagggggaggccaaggagggcaagtctgagcgggagggggagagcgagatggagggcggcagcgagcgggagggcaagccagaaattgagggcaagccagagagcgagggggagcccggcagcgagaccagggctgctgggaagaggcctgcagaagatgatgtgcccaggaaggccaagaggaagtag

SEQ ID NO: 17261 - DNA, 648 bp, Artificial Sequence; identical to SEQ ID NO: 17255
  Description of Artificial Sequence: Synthetic coding sequence

SEQ ID NO: 17262 - DNA, 648 bp, Artificial Sequence; identical to SEQ ID NO: 17255
  Description of Artificial Sequence: Synthetic coding sequence

SEQ ID NO: 17263 - DNA, 231 bp, Artificial Sequence
  Description of Artificial Sequence: Synthetic coding sequence
atggagaagctgtacagtgaaaatgaaggcatggccagcaaccagggcaagatggagaatgaggagcagccccaggatgagaggaagccagaggtgacctgcaccctggaggacaagaagctggagaatgaaggcaagacagagaacaagggcaagacaggagatgaggagatgctgaaggacaagggcaagccagagagcgagggggaggccaaggagggcaagagctag

SEQ ID NO: 17264 - DNA, 648 bp, Artificial Sequence; identical to SEQ ID NO: 17255
  Description of Artificial Sequence: Synthetic coding sequence

SEQ ID NO: 17265 - DNA, 621 bp, Artificial Sequence
  Description of Artificial Sequence: Synthetic coding sequence
atggagaagctgtacaaggaaaatgaaggcaagccagaaaatgaaagaaacctggagagcgagggcaagccagaagatgagggcagcacagaagatgagggcaagagtgatgaggaggagaagccagacatggagggcaagacagaatgtgagggcaagagagaagatgaaggagagcctggagatgagggccagctggaggatgagggcaaccaggagaagcagggcaagtcagaaggagaggacaagccccagagcgagggcaagccagccagccaggccaagccagagagccagcccagggctgctgagaagaggcctgcagaagattatgtgcccaggaaggccaagaggaagacagaccggggcacagatgacagccccaaggacagccaggaggacctgcaggagcggcacctgagcagcgaggagatgatgagagaatgtggagatgtgtcccgggcccaggaggagctgaggaagaagcagaagatgggcggcttccactggatgcagagagatgtgcaggacccctttgccccccggggccagaggggcgtgcggggcgtgcggggcggcggccggggccagaaggacctggaggatgtgccctacgtgtag

SEQ ID NO: 17266 - DNA, 552 bp, Artificial Sequence
  Description of Artificial Sequence: Synthetic coding sequence
atggagaagccctacaacaagaatgaaggcaacctggagaatgaaggcaagccagaagatgaggtggagccagatgatgagggcaagagtgatgaggaggagaagccagatgctgagggcaagacagaatgtgagggcaagaggaaggccgagggggagcctggagatgagggccagctggaggacaagggcagccaggagaagcagggcaagtctgagggggagggcaagccccagggcgagggcaagccagccagccaggccaagccagagggccagcccagggctgctgagaagaggcctgctggggactatgtgcccaggaaggccaagaggaagacagaccggggcacagatgacagccccaaggacagccaggaggacctgcaggagcggcacctgagcagcgaggagatgatgagagaatgtggagatgtgtcccgggcccaggaggagctgaggaagaagcagaagatgggcggcttccactggatgcagagagatgtgcaggacccctttgcccagggcgacaacggggtgtctggagagtag

SEQ ID NO: 17267 - DNA, 552 bp, Artificial Sequence; identical to SEQ ID NO: 17266
  Description of Artificial Sequence: Synthetic coding sequence

SEQ ID NO: 17268 - DNA, 600 bp, Artificial Sequence
  Description of Artificial Sequence: Synthetic coding sequence
atggagaagccctacaacaagaatgaaggcaacctggagaatgaaggcaagccagaagatgaggtggagccagatgatgagggcaagagtgatgaggaggagaagccagatgctgagggcaagacagaatgtgagggcaagaggaaggccgagggggagcctggagatgagggccagctggaggacaagggcagccaggagaagcagggcaagtctgagggggagggcaagccccagggcgagggcaagccagccagccaggccaagccagagggccagcccagggctgctgagaagaggcctgctggggactatgtgcccaggaaggccaagaggaagacagaccggggcacagatgacagccccaaggacagccaggaggacctgcaggagcggcacctgagcagcgaggagatgatgagagaatgtggagatgtgtcccgggcccaggaggagctgaggaagaagcagaagatgggcggcttccactggatgcagagagatgtgcaggaccccttcccccggggccagaggggcgtgcggggcgtgcggggcggcggccggggccagaggggcctgcatgacatcccctacctgtag

SEQ ID NO: 17269 - DNA, 354 bp, Artificial Sequence
  Description of Artificial Sequence: Synthetic coding sequence
atgcagaagagctgtgaagaaaatgaaggcaagccccagaacatgcccaaggccgaggaggaccggcccctggaggatgtgccccaggaggccgagggcaacccccagcccagcgaggagggcgtgtcccaggaggccgagggcaacccccggggcggccccaaccagcccggccagggcttcaaggaggacacccctgtgcgccacctggaccctgaggagatgatccggggcgtggatgagctggagcggctgcgggaggagatccggcgggtgaggaacaagtttgtgatgatgcactggaagcagaggcacagccgcagccggccctaccctgtgtgcttccggccctag

SEQ ID NO: 17270 - DNA, 354 bp, Artificial Sequence; identical to SEQ ID NO: 17269
  Description of Artificial Sequence: Synthetic coding sequence

SEQ ID NO: 17271 - DNA, 225 bp, Artificial Sequence
  Description of Artificial Sequence: Synthetic coding sequence
atgcagaagagctgtgaagaaaatgaaggcaagccccagaacatgcccaaggccgaggaggaccggcccctggaggatgtgccccaggaggacacccctgtgcgccacctggaccctgaggagatgatccggggcgtggatgagctggagcggctgcgggaggagatcagaagagtgaggaacaagtttgtgatgatgcactggaagcagaggcacagcaggtag

SEQ ID NO: 17272 - DNA, 1155 bp, Artificial Sequence
  Description of Artificial Sequence: Synthetic coding sequence
atgccccagctggacagcggcggcggcggggccggcggcggagatgacctgggcgccccagatgagctgctggccttccaggatgaaggagaggagcaggatgacaagagccgggacagcgctgctggccctgagcgggacctggccgagctgaagagcagcctggtgaatgaaagtgaaggagctgctggaggagctggcatccctggggtgcctggggccggggccggggcccggggggaggccgaggccctgggccgggagcacgccgcccagaggctcttcccagacaagctgcctgagcccctggaggatggcctgaaggccccagaatgtaccagcggcatgtacaaggagaccgtgtacagcgccttcaacctgctgatgcactacccacctccttctggagctggccagcacccccagccccagccccccctgcacaaggccaaccagccccctcatggagtgccccagctgagcctgtatgagcacttcaacagcccccaccccaccccagccccagctgacatcagccagaagcaggtgcaccggcccctgcagaccccagacctgagcggcttctacagcctgaccagcggctccatgggccagctgccccacacagtgtcctggttcacccaccccagcctgatgctgggcagcggcgtgcccggccaccctgctgccatcccccacccagccatcgtgccccccagcggcaagcaggagctgcagccctttgacaggaacctgaagacccaggccgagagcaaggccgagaaggaggccaagaagcccaccatcaagaagcccctgaatgccttcatgctgtacatgaaggagatgagggccaaggtgattgctgagtgcaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagagaagaagccgggagaagcaccaggagagcaccacagagaccaactggccccgggagctgaaggatggaaatggccaggagagcctgtccatgagcagcagcagcagccctgcctag

SEQ ID NO: 17273 - DNA, 1098 bp, Artificial Sequence
  Description of Artificial Sequence: Synthetic coding sequence
atgccccagctggacagcggcggcggcggggccggcggcggagatgacctgggcgccccagatgagctgctggccttccaggatgaaggagaggagcaggatgacaagagccgggacagcgctgctggccctgagcgggacctggccgagctgaagagcagcctggtgaatgaaagtgaaggagctgctggaggagctggcatccctggggtgcctggggccggggccggggcccggggggaggccgaggccctgggccgggagcacgccgcccagaggctcttcccagacaagctgcctgagcccctggaggatggcctgaaggccccagaatgtaccagcggcatgtacaaggagaccgtgtacagcgccttcaacctgctgatgcactacccacctccttctggagctggccagcacccccagccccagccccccctgcacaaggccaaccagccccctcatggagtgccccagctgagcctgtatgagcacttcaacagcccccaccccaccccagccccagctgacatcagccagaagcaggtgcaccggcccctgcagaccccagacctgagcggcttctacagcctgaccagcggctccatgggccagctgccccacacagtgtcctggttcacccaccccagcctgatgctgggcagcggcgtgcccggccaccctgctgccatcccccacccagccatcgtgccccccagcggcaagcaggagctgcagccctttgacaggaacctgaagacccaggccgagagcaaggccgagaaggaggccaagaagcccaccatcaagaagcccctgaatgccttcatgctgtacatgaaggagatgagggccaaggtgattgctgagtgcaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagagaagaagccgggagaagcaccaggagagcaccacagacaacagcctgcactacagctag

SEQ ID NO: 17274 - DNA, 1155 bp, Artificial Sequence
  Description of Artificial Sequence: Synthetic coding sequence
atgccccagctggacagcggcggcggcggggccggcggcggagatgacctgggcgccccagatgagctgctggccttccaggatgaaggagaggagcaggatgacaagagccgggacagcgctgctggccctgagcgggacctggccgagctgaagagcagcctggtgaatgaaagtgaaggagctgctggaggagctggcatccctggggtgcctggggccggggccggggcccggggggaggccgaggccctgggccgggagcacgccgcccagaggctcttcccagacaagctgcctgagcccctggaggatggcctgaaggccccagaatgtaccagcggcatgtacaaggagaccgtgtacagcgccttcaacctgctgatgcactacccacctccttctggagctggccagcacccccagccccagccccccctgcacaaggccaaccagccccctcatggagtgccccagctgagcctgtatgagcacttcaacagcccccaccccaccccagccccagctgacatcagccagaagcaggtgcaccggcccctgcagaccccagacctgagcggcttctacagcctgaccagcggctccatgggccagctgccccacacagtgtcctggttcacccaccccagcctgatgctgggcagcggcgtgcccggccaccctgctgccatcccccacccagccatcgtgccccccagcggcaagcaggagctgcagccctttgacaggaacctgaagacccaggccgagagcaaggccgagaaggaggccaagaagcccaccatcaagaagcccctgaatgccttcatgctgtacatgaaggagatgagggccaaggtgattgctgagtgcaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagagaagaagccgggagaagcaccaggagagcaccaccggcggcaagagaaatgccttcggcacctacccagagaaggctgctgccccagcccccttcctgcccatgacagtgctgtag

SEQ ID NO: 17275 - DNA, 1485 bp, Artificial Sequence
  Description of Artificial Sequence: Synthetic coding sequence
atgccccagctggacagcggcggcggcggggccggcggcggagatgacctgggcgccccagatgagctgctggccttccaggatgaaggagaggagcaggatgacaagagccgggacagcgctgctggccctgagcgggacctggccgagctgaagagcagcctggtgaatgaaagtgaaggagctgctggaggagctggcatccctggggtgcctggggccggggccggggcccggggggaggccgaggccctgggccgggagcacgccgcccagaggctcttcccagacaagctgcctgagcccctggaggatggcctgaaggccccagaatgtaccagcggcatgtacaaggagaccgtgtacagcgccttcaacctgctgatgcactacccacctccttctggagctggccagcacccccagccccagccccccctgcacaaggccaaccagccccctcatggagtgccccagctgagcctgtatgagcacttcaacagcccccaccccaccccagccccagctgacatcagccagaagcaggtgcaccggcccctgcagaccccagacctgagcggcttctacagcctgaccagcggctccatgggccagctgccccacacagtgtcctggttcacccaccccagcctgatgctgggcagcggcgtgcccggccaccctgctgccatcccccacccagccatcgtgccccccagcggcaagcaggagctgcagccctttgacaggaacctgaagacccaggccgagagcaaggccgagaaggaggccaagaagcccaccatcaagaagcccctgaatgccttcatgctgtacatgaaggagatgagggccaaggtgattgctgagtgcaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagagaagaagccgggagaagcaccaggagagcaccacagaccccggcagccccaagaagtgccgggcccgcttcggcctgaaccagcagacagactggtgtggcccctgcaggaggaagaagaagtgcatccgctacctgcctggagagggccgctgccccagccctgtgcccagtgatgattctgccctgggctgccccggcagccctgccccccaggacagccccagctaccacctgctgccccgcttccccacagagctgctgaccagccctgcccggcacctgcacccccaggtgagccccctgctgagcgccagccagccccagggcccccaccggcccccagctgccccctgccgggcccaccgctacagcaacagaaacctgcgggaccgctggcccagccgccacaggaccccaggccgcctgcaggagcccaccccctag

SEQ ID NO: 17276 - DNA, 807 bp, Artificial Sequence
  Description of Artificial Sequence: Synthetic coding sequence
atgtacaaggagaccgtgtacagcgccttcaacctgctgatgcactaccccccacccagcggggccggccagcacccccagccccagccccccctgcacaaggccaaccagcccccccacggcgtgccccagctgagcctgtatgagcacttcaacagcccccaccccaccccagccccagctgacatcagccagaagcaggtgcaccggcccctgcagaccccagacctgagcggcttctacagcctgaccagcggctccatgggccagctgccccacacagtgtcctggttcacccaccccagcctgatgctgggcagcggcgtgcccggccaccctgctgccatcccccacccagccatcgtgcccccatctgggaagcaggagctgcagccctttgacaggaacctgaagacccaggccgagagcaaggccgagaaggaggccaagaagcccaccatcaagaagcccctgaatgccttcatgctgtacatgaaggagatgagggccaaggtgattgctgaatgtaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaggaggagccgggagaagcaccaggagagcaccacagatcctggcagccccaagaagtgccgggccaggtttggcctgaaccagcagacagactggtgtggcccctgcaggtag

SEQ ID NO: 17277 - DNA, 1110 bp, Artificial Sequence
  Description of Artificial Sequence: Synthetic coding sequence
atgccccagctggacagcggcggcggcggggccggcggcggagatgacctgggcgccccagatgagctgctggccttccaggatgaaggagaggagcaggatgacaagagccgggacagcgctgctggccctgagcgggacctggccgagctgaagagcagcctggtgaatgaaagtgaaggagctgctggaggagctggcatccctggggtgcctggggccggggccggggcccggggggaggccgaggccctgggccgggagcacgccgcccagaggctcttcccagacaagctgcctgagcccctggaggatggcctgaaggccccagaatgtaccagcggcatgtacaaggagaccgtgtacagcgccttcaacctgctgatgcactacccacctccttctggagctggccagcacccccagccccagccccccctgcacaaggccaaccagccccctcatggagtgccccagctgagcctgtatgagcacttcaacagcccccaccccaccccagccccagctgacatcagccagaagcaggtgcaccggcccctgcagaccccagacctgagcggcttctacagcctgaccagcggctccatgggccagctgccccacacagtgtcctggttcacccaccccagcctgatgctgggcagcggcgtgcccggccaccctgctgccatcccccacccagccatcgtgccccccagcggcaagcaggagctgcagccctttgacaggaacctgaagacccaggccgagagcaaggccgagaaggaggccaagaagcccaccatcaagaagcccctgaatgccttcatgctgtacatgaaggagatgagggccaaggtgattgctgagtgcaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagagaagaagccgggagaagcaccaggagagcaccacagatggcatcccagcctgcaccatcctgagcccctag

SEQ ID NO: 17278 - DNA, 810 bp, Artificial Sequence
  Description of Artificial Sequence: Synthetic coding sequence
atgtacaaggagaccgtgtacagcgccttcaacctgctgatgcactaccccccacccagcggggccggccagcacccccagccccagccccccctgcacaaggccaaccagcccccccacggcgtgccccagctgagcctgtatgagcacttcaacagcccccaccccaccccagccccagctgacatcagccagaagcaggtgcaccggcccctgcagaccccagacctgagcggcttctacagcctgaccagcggctccatgggccagctgccccacacagtgtcctggttcacccaccccagcctgatgctgggcagcggcgtgcccggccaccctgctgccatcccccacccagccatcgtgcccccatctgggaagcaggagctgcagccctttgacaggaacctgaagacccaggccgagagcaaggccgagaaggaggccaagaagcccaccatcaagaagcccctgaatgccttcatgctgtacatgaaggagatgagggccaaggtgattgctgaatgtaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaggaggagccgggagaagcaccaggagagcaccactggaggcaagagaaatgccttcggcacctacccagagaaggccgccgccccagcccccttcctgcccatgacagtgctgtag

SEQ ID NO: 17279 - DNA, 1446 bp, Artificial Sequence
  Description of Artificial Sequence: Synthetic coding sequence
atgccccagctggacagcggcggcggcggggccggcggcggagatgacctgggcgccccagatgagctgctggccttccaggatgaaggagaggagcaggatgacaagagccgggacagcgctgctggccctgagcgggacctggccgagctgaagagcagcctggtgaatgaaagtgaaggagctgctggaggagctggcatccctggggtgcctggggccggggccggggcccggggggaggccgaggccctgggccgggagcacgccgcccagaggctcttcccagacaagctgcctgagcccctggaggatggcctgaaggccccagaatgtaccagcggcatgtacaaggagaccgtgtacagcgccttcaacctgctgatgcactacccacctccttctggagctggccagcacccccagccccagccccccctgcacaaggccaaccagccccctcatggagtgccccagctgagcctgtatgagcacttcaacagcccccaccccaccccagccccagctgacatcagccagaagcaggtgcaccggcccctgcagaccccagacctgagcggcttctacagcctgaccagcggctccatgggccagctgccccacacagtgtcctggttcacccaccccagcctgatgctgggcagcggcgtgcccggccaccctgctgccatcccccacccagccatcgtgccccccagcggcaagcaggagctgcagccctttgacaggaacctgaagacccaggccgagagcaaggccgagaaggaggccaagaagcccaccatcaagaagcccctgaatgccttcatgctgtacatgaaggagatgagggccaaggtgattgctgagtgcaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagagaagaagccgggagaagcaccaggagagcaccacagaccccggcagccccaagaagtgccgggcccgcttcggcctgaaccagcagacagactggtgtggcccctgcaggaggaagaagaagtgcatccgctacctgcctggagagggccgctgccccagccctgtgcccagtgatgattctgccctgggctgccccggcagccctgccccccaggacagccccagctaccacctgctgccccgcttccccacagagctgctgaccagccctgctgagcccgcccccaccagccctggcctgagcacagccctgagcctgcccaccccaggccccccccaggcccccaggagcaccctgcagagcacccaggtgcagcagcaggagagccagaggcaggtggcctag

SEQ ID NO: 17280 - DNA, 1101 bp, Artificial Sequence
  Description of Artificial Sequence: Synthetic coding sequence
atgtacaaggagaccgtgtacagcgccttcaacctgctgatgcactaccccccacccagcggggccggccagcacccccagccccagccccccctgcacaaggccaaccagcccccccacggcgtgccccagctgagcctgtatgagcacttcaacagcccccaccccaccccagccccagctgacatcagccagaagcaggtgcaccggcccctgcagaccccagacctgagcggcttctacagcctgaccagcggctccatgggccagctgccccacacagtgtcctggttcacccaccccagcctgatgctgggcagcggcgtgcccggccaccctgctgccatcccccacccagccatcgtgcccccatctgggaagcaggagctgcagccctttgacaggaacctgaagacccaggccgagagcaaggccgagaaggaggccaagaagcccaccatcaagaagcccctgaatgccttcatgctgtacatgaaggagatgagggccaaggtgattgctgaatgtaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaggaggagccgggagaagcaccaggagagcaccacagatcctggcagccccaagaagtgccgggccaggtttggcctgaaccagcagacagactggtgtggcccctgcaggaggaagaagaagtgcatccgctacctgcccggggagggccgctgccccagccctgtgcccagtgatgacagcgccctgggctgccccggcagccctgccccccaggacagccccagctaccacctgctgccccgcttccccacagagctgctgaccagccctgctgagcccgcccccaccagccctggcctgagcacagccctgagcctgcccaccccaggccccccccaggcccccaggagcaccctgcagagcacccaggtgcagcagcaggagagccagaggcaggtggcctag

SEQ ID NO: 17281 - DNA, 372 bp, Artificial Sequence
  Description of Artificial Sequence: Synthetic coding sequence
atgtacaaggagaccgtgtacagcgccttcaacctgctgatgcactaccccccacccagcggggccggccagcacccccagccccagccccccctgcacaaggccaaccagcccccccacggcgtgccccagctgagcctgtatgagcacttcaacagcccccaccccaccccagccccagctgacatcagccagaagcaggtgcaccggcccctgcagaccccagacctgagcggcttctacagcctgaccagcggctccatgggccagctgccccacacagtgtcctggttcacccaccccagcctgatgctgggcagcggcgtgcccggccaccctgctgccatcccccacccagccatcgtgccctag

SEQ ID NO: 17282 - DNA, 810 bp, Artificial Sequence
  Description of Artificial Sequence: Synthetic coding sequence
atgtacaaggagaccgtgtacagcgccttcaacctgctgatgcactaccccccacccagcggggccggccagcacccccagccccagccccccctgcacaaggccaaccagcccccccacggcgtgccccagctgagcctgtatgagcacttcaacagcccccaccccaccccagccccagctgacatcagccagaagcaggtgcaccggcccctgcagaccccagacctgagcggcttctacagcctgaccagcggctccatgggccagctgccccacacagtgtcctggttcacccaccccagcctgatgctgggcagcggcgtgcccggccaccctgctgccatcccccacccagccatcgtgcccccatctgggaagcaggagctgcagccctttgacaggaacctgaagacccaggccgagagcaaggccgagaaggaggccaagaagcccaccatcaagaagcccctgaatgccttcatgctgtacatgaaggagatgagggccaaggtgattgctgaatgtaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaggaggagccgggagaagcaccaggagagcaccacagagaccaactggccccgggagctgaaggatggaaatggccaggagagcctgtccatgagcagcagcagcagccctgcctag

SEQ ID NO: 17283 - DNA, 444 bp, Artificial Sequence
  Description of Artificial Sequence: Synthetic coding sequence
atgtacaaggagaccgtgtacagcgccttcaacctgctgatgcactaccccccacccagcggggccggccagcacccccagccccagccccccctgcacaaggccaaccagcccccccacggcgtgccccagctgagcctgtatgagcacttcaacagcccccaccccaccccagccccagctgacatcagccagaagcaggtgcaccggcccctgcagaccccagacctgagcggcttctacagcctgaccagcggctccatgggccagctgccccacacagtgtcctggttcacccaccccagcctgatgctgggcagcggcgtgcccggccaccctgctgccatcccccacccagccatcgtgcccccatctgggaagcaggagctgcagccctttgacaggaacctgaagacccaggccgagagcaaggccgagaagtag

SEQ ID NO: 17284 - DNA, 1767 bp, Artificial Sequence
  Description of Artificial Sequence: Synthetic coding sequence
atgccccagctgggcggcggcggcggcggcggcggcggcggcagcggcggcggcggcggcagcagcgctggagctgctggaggaggagatgacctgggcgccaatgatgagctgatccccttccaggatgaaggaggagaggagcaggagcccagcagtgacagcgccagcgcccagagggacctggatgaggtgaagagcagcctggtgaatgaaagtgagaaccagagcagcagcagtgacagcgaggccgagcggcggccccagcctgtgcgggacaccttccagaagccccgggactactttgctgaggtgcggcggccccaggacagcgccttcttcaagggccccccctacccaggctaccccttcctgatgatcccagacctgagcagcccctacctgagcaatggccccctgagccctgggggcgcccggacctacctgcagatgaagtggcccctgctggatgtgcccagcagcgccaccgtgaaggacaccaggagccccagccctgcccacctgagcaacaaggtgcctgtggtgcagcacccccaccacatgcaccccctgacccccctcatcacctacagcaatgaccacttcagccctggcagcccccccacccacctgagccctgagattgaccccaagacaggcatcccccggcccccccaccccagcgagctgagcccctactaccccctgagccctggagctgtgggccagatcccccaccccctgggctggctggtgccccagcagggccagcccatgtacagcctgcccccaggcggcttccgccacccctacccagccctggccatgaatgcctccatgagcagcctggtgagcagccgcttcagcccccacatggtggccccagcccaccctggcctgcccaccagcggcatcccccacccagccatcgtgagccccatcgtgaagcaggagcccgccccacccagcctgagccctgctgtgtctgtgaagagccctgtgacagtgaagaaggaggaggagaagaagccccacgtgaagaagcccctgaatgccttcatgctgtacatgaaggagatgagggccaaggtggtggctgaatgtaccctgaaggagagcgctgccatcaaccagatcctgggcaggaagtggcacaacctgagccgggaggagcaggccaagtactatgagctggccaggaaggagcggcagctgcacagccagctgtaccccacctggagcgcccgggacaactacggcaagaagaagaagaggaagcgggagaagcagctgagccagacccagagccagcagcaggtgcaggaggccgagggcgccctggccagcaagagcaagaagccctgtgtgcagtacctgcccccagagaagccctgtgacagccctgccagcagccacggctccatgctggacagccctgccaccccatctgctgccctggccagccctgctgccccagctgccacccacagcgagcaggcccagcccctgagcctgaccaccaagccagagacccgggcccagctggccctgcacagcgctgccttcctgagcgccaaggccgccgccagcagcagcggccagatgggcagccagccccccctgctgagccggcccctgcccctgggctccatgcccacagccctgctggccagccccccatccttccctgccaccctgcacgcccaccaggccctgcctgtgctgcaggcccagcccctgagcctggtgaccaagagcgcccactag

SEQ ID NO: 17285 - DNA, 1017 bp, Artificial Sequence
  Description of Artificial Sequence: Synthetic coding sequence
atggagtacttcatggtgcccacccagaaggtgcccagcctgcagcacttcaggaagacagagaaggaggtgattggaggcctgtgcagcctggccaacatccccctgaccccagagacccagagggaccaggagcggcgcatcagaagagagatcgccaacagcaatgaaagaagaaggatgcagagcatcaatgccggcttccagagcctgaagaccctcatcccccacacagatggagagaagctgagcaaggccgccatcctgcagcagacagctgagtacatcttcagcctggagcaggagaagacccggctgctgcagcagaacacccagctgaagcgcttcatccaggagctgagcggcagcagccccaagagaagaagagctgaggacaaggatgagggcatcggcagcccagacatctgggaggatgagaaggccgaggacctgcggcgggagatgattgagctgcggcagcagctggacaaggagaggtctgtgaggatgatgctggaggagcaggtgcgcagcctggaggcccacatgtacccagagaagctgaaggtgattgcccagcaggtgcagctgcagcagcagcaggagcaggtgcggctgctgcaccaggagaagctggagcgggagcagcagcagctgcggacccagctgctgcccccaccagcccccacccaccaccccaccgtcatcgtgcctgcccctcctcctccacccagccaccacatcaacgtggtgaccatgggccccagcagcgtcatcaacagcgtgtccaccagccggcagaacctggacaccatcgtgcaggccatccagcacatcgagggcacccaggagaagcaggagctggaggaggagcagaggagagctgtgattgtgaagcctgtgcgcagctgcccagaggcccccaccagtgacacagccagtgacagcgaggccagtgacagtgatgccatggaccagagccgggaggagcccagcggagatggagagctgccctag

SEQ ID NO: 17286 - DNA, 741 bp, Artificial Sequence
  Description of Artificial Sequence: Synthetic coding sequence
atgtaccaggtgtctggccagaggcccagcggctgtgatgccccctacggggcccccagcgctgcccctggccctgcccagaccctgagcctgctgcccggcctggaggtggtgacaggcagcacccaccctgctgaggccgcccctgaggagggcagcctggaggaggccgccacccccatgccccagggcaatggacctggcatcccccagggcctggacagcacagacctggatgtgcccacagaggccgtgacctgccagccccagggcaaccccctgggctgcacccccctgctgcccaatgacagcggccaccccagcgagctgggcggcacccggcgggctggaaatggagccctgggcggccccaaggcccacaggaagctgcagacccaccccagcctggccagccagggcagcaagaagagcaagagcagcagcaagagcaccaccagccagatccccctgcaggcccaggaggactgctgcgtgcactgcatcctgagctgcctcttctgtgagttcctgaccctgtgcaacatcgtgctggactgtgccacctgtggcagctgcagcagcgaggacagctgcctgtgctgctgctgctgcggcagcggggagtgtgccgactgtgacctgccctgtgacctggactgtggcatcctggatgcctgctgtgagagcgctgactgcctggagatctgcatggagtgctgcggcctgtgcttcagcagctag

SEQ ID NO: 17287 - DNA, 1689 bp, Artificial Sequence
  Description of Artificial Sequence: Synthetic coding sequence
atgtctgaggaggacaggaccttctcctttggacctggcaccaggaagctgggcttcatgagccagctgagccctgcctgcagcgtgaccctgggcaagagcctgcccctgagcggcctgggcgtcttcagcagcaagatggatgctgtgcctgtgatcctggccagcccctgccagcccctgtgctttgaggaggacacctgcctgatctacctgctgcccctgctgatccaccgggagcccgccccagctgccaccatggccagcagaattggcctgaggatgcagctgatgagggagcaggcccagcaggaggagcagcgggagaggatgcagcagcaggccgtgatgcactacatgcagcagcagcagcagcagcagcagcagcagctgggcggcccccccaccccagccatcaacacccctgtgcacttccagagccccccacctgtgcctggagaggtgctgaaggtgcagagctacctggagaaccccaccagctaccacctgcagcagagccagcaccagaaggtgcgggagtacctgtctgagacctacggcaacaagtttgctgcccacatcagccctgcccagggcagccccaagcccccacctgctgccagccctggggtgcgggccggccacgtgctgagcagcagcgctggcaacagcgcccccaacagccccatggccatgctgcacatcggcagcaaccctgagcgggagctggatgatgtgattgacaacatcatgaggctggatgatgtgctgggctacatcaaccctgagatgcagatgcccaacaccctgcccctgagcagcagccacctgaatgtgtacagcagtgacccccaggtgacagccagcctggtgggcgtgaccagcagcagctgcccagctgacctgacccagaagcgggagctgacagatgctgagagccgggccctggccaaggagcggcagaagaaggacaaccacaacctgattgaaagaagaagacgcttcaacatcaatgaccgcatcaaggagctgggcatgctgatccccaaggccaatgacctggatgtgcgctggaacaagggcaccatcctgaaggcctctgtggactacatccggaggatgcagaaggacctgcagaagagccgggagctggagaaccacagccggcggctggagatgaccaacaagcagctgtggctgcgcatccaggagctggagatgcaggcccgggtgcacggcctgcccaccaccagccccagcggcatgaacatggccgagctggcccagcaggtggtgaagcaggagctgcccagcgaggagggccctggagaggccctgatgctgggcgctgaggtgcctgaccctgagcccctgcctgccctgcccccccaggcccccctgcccctgcccacccagccccccagccccttccaccacctggacttcagccacagcctgagctttggaggccgggaggatgagggccccccaggctacccagagcccctggcccctggccacggcagccccttccccagcctgagcaagaaggacctggacctgatgctgctggatgacagcctgctgcccctggccagtgaccccctgctgagcaccatgagccctgaggccagcaaggccagcagccgccgcagcagcttctccatggaggagggagatgtgctgtag

SEQ ID NO: 17288 - DNA, 1473 bp, Artificial Sequence
  Description of Artificial Sequence: Synthetic coding sequence
atgacagccagcagcggctgggagcccgccccagctgccaccatggccagcagaattggcctgaggatgcagctgatgagggagcaggcccagcaggaggagcagcgggagaggatgcagcagcaggccgtgatgcactacatgcagcagcagcagcagcagcagcagcagcagctgggcggcccccccaccccagccatcaacacccctgtgcacttccagagccccccacctgtgcctggagaggtgctgaaggtgcagagctacctggagaaccccaccagctaccacctgcagcagagccagcaccagaaggtgcgggagtacctgtctgagacctacggcaacaagtttgctgcccacatcagccctgcccagggcagccccaagcccccacctgctgccagccctggggtgcgggccggccacgtgctgagcagcagcgctggcaacagcgcccccaacagccccatggccatgctgcacatcggcagcaaccctgagcgggagctggatgatgtgattgacaacatcatgaggctggatgatgtgctgggctacatcaaccctgagatgcagatgcccaacaccctgcccctgagcagcagccacctgaatgtgtacagcagtgacccccaggtgacagccagcctggtgggcgtgaccagcagcagctgcccagctgacctgacccagaagcgggagctgacagatgctgagagccgggccctggccaaggagcggcagaagaaggacaaccacaacctgattgaaagaagaagacgcttcaacatcaatgaccgcatcaaggagctgggcatgctgatccccaaggccaatgacctggatgtgcgctggaacaagggcaccatcctgaaggcctctgtggactacatccggaggatgcagaaggacctgcagaagagccgggagctggagaaccacagccggcggctggagatgaccaacaagcagctgtggctgcgcatccaggagctggagatgcaggcccgggtgcacggcctgcccaccaccagccccagcggcatgaacatggccgagctggcccagcaggtggtgaagcaggagctgcccagcgaggagggccctggagaggccctgatgctgggcgctgaggtgcctgaccctgagcccctgcctgccctgcccccccaggcccccctgcccctgcccacccagccccccagccccttccaccacctggacttcagccacagcctgagctttggaggccgggaggatgagggccccccaggctacccagagcccctggcccctggccacggcagccccttccccagcctgagcaagaaggacctggacctgatgctgctggatgacagcctgctgcccctggccagtgaccccctgctgagcaccatgagccctgaggccagcaaggccagcagccgccgcagcagcttctccatggaggagggagatgtgctgtag

SEQ ID NO: 17289 - DNA, 1431 bp, Artificial Sequence
  Description of Artificial Sequence: Synthetic coding sequence
atggccagcagaattggcctgaggatgcagctgatgagggagcaggcccagcaggaggagcagcgggagaggatgcagcagcaggccgtgatgcactacatgcagcagcagcagcagcagcagcagcagcagctgggcggcccccccaccccagccatcaacacccctgtgcacttccagagccccccacctgtgcctggagaggtgctgaaggtgcagagctacctggagaaccccaccagctaccacctgcagcagagccagcaccagaaggtgcgggagtacctgtctgagacctacggcaacaagtttgctgcccacatcagccctgcccagggcagccccaagcccccacctgctgccagccctggggtgcgggccggccacgtgctgagcagcagcgctggcaacagcgcccccaacagccccatggccatgctgcacatcggcagcaaccctgagcgggagctggatgatgtgattgacaacatcatgaggctggatgatgtgctgggctacatcaaccctgagatgcagatgcccaacaccctgcccctgagcagcagccacctgaatgtgtacagcagtgacccccaggtgacagccagcctggtgggcgtgaccagcagcagctgcccagctgacctgacccagaagcgggagctgacagatgctgagagccgggccctggccaaggagcggcagaagaaggacaaccacaacctgattgaaagaagaagacgcttcaacatcaatgaccgcatcaaggagctgggcatgctgatccccaaggccaatgacctggatgtgcgctggaacaagggcaccatcctgaaggcctctgtggactacatccggaggatgcagaaggacctgcagaagagccgggagctggagaaccacagccggcggctggagatgaccaacaagcagctgtggctgcgcatccaggagctggagatgcaggcccgggtgcacggcctgcccaccaccagccccagcggcatgaacatggccgagctggcccagcaggtggtgaagcaggagctgcccagcgaggagggccctggagaggccctgatgctgggcgctgaggtgcctgaccctgagcccctgcctgccctgcccccccaggcccccctgcccctgcccacccagccccccagccccttccaccacctggacttcagccacagcctgagctttggaggccgggaggatgagggccccccaggctacccagagcccctggcccctggccacggcagccccttccccagcctgagcaagaaggacctggacctgatgctgctggatgacagcctgctgcccctggccagtgaccccctgctgagcaccatgagccctgaggccagcaaggccagcagccgccgcagcagcttctccatggaggagggagatgtgctgtag

SEQ ID NO: 17290 - DNA, 807 bp, Artificial Sequence
  Description of Artificial Sequence: Synthetic coding sequence
atggccagcagaattggcctgaggatgcagctgatgagggagcaggcccagcaggaggagcagcgggagaggatgcagcagcaggccgtgatgcactacatgcagcagcagcagcagcagcagcagcagcagctgggcggcccccccaccccagccatcaacacccctgtgcacttccagagccccccacctgtgcctggagaggtgctgaaggtgcagagctacctggagaaccccaccagctaccacctgcagcagagccagcaccagaaggtgcgggagtacctgtctgagacctacggcaacaagtttgctgcccacatcagccctgcccagggcagccccaagcccccacctgctgccagccctggggtgcgggccggccacgtgctgagcagcagcgctggcaacagcgcccccaacagccccatggccatgctgcacatcggcagcaaccctgagcgggagctggatgatgtgattgacaacatcatgaggctggatgatgtgctgggctacatcaaccctgagatgcagatgcccaacaccctgcccctgagcagcagccacctgaatgtgtacagcagtgacccccaggtgacagccagcctggtgggcgtgaccagcagcagctgcccagctgacctgacccagaagcgggagctgacagatgctgagagccgggccctggccaaggagcggcagaagaaggacaaccacaacctgattgaaagaagaagacgcttcaacatcaatgaccgcatcaaggagctgggcatgctgatccccaaggccaatgacctgtag

SEQ ID NO: 17291 - DNA, 1431 bp, Artificial Sequence; identical to SEQ ID NO: 17289
  Description of Artificial Sequence: Synthetic coding sequence

SEQ ID NO: 17292 - DNA, 735 bp, Artificial Sequence
  Description of Artificial Sequence: Synthetic coding sequence
atggccagcagaattggcctgaggatgcagctgatgagggagcaggcccagcaggaggagcagcgggagaggatgcagcagcaggccgtgatgcactacatgcagcagcagcagcagcagcagcagcagcagctgggcggcccccccaccccagccatcaacacccctgtgcacttccagagccccccacctgtgcctggagaggtgctgaaggtgcagagctacctggagaaccccaccagctaccacctgcagcagagccagcaccagaaggtgcgggagtacctgtctgagacctacggcaacaagtttgctgcccacatcagccctgcccagggcagccccaagcccccacctgctgccagccctggggtgcgggccggccacgtgctgagcagcagcgctggcaacagcgcccccaacagccccatggccatgctgcacatcggcagcaaccctgagcgggagctggatgatgtgattgacaacatcatgaggctggatgatgtgctgggctacatcaaccctgagatgcagatgcccaacaccctgcccctgagcagcagccacctgaatgtgtacagcagtgacccccaggtgacagccagcctggtgggcgtgaccagcagcagctgcccagctgacctgacccagaagcgggagctgacagatgctgagagccgggccctggccaaggagcggcagaagaaggacaaccacaacctgattgaatag

SEQ ID NO: 17293 - DNA, 807 bp, Artificial Sequence; identical to SEQ ID NO: 17290
  Description of Artificial Sequence: Synthetic coding sequence

SEQ ID NO: 17294 - DNA, 672 bp, Artificial Sequence
  Description of Artificial Sequence: Synthetic coding sequence
atggccagcagaattggcctgaggatgcagctgatgagggagcaggcccagcaggaggagcagcgggagaggatgcagcagcaggccgtgatgcactacatgcagcagcagcagcagcagcagcagcagcagctgggcggcccccccaccccagccatcaacacccctgtgcacttccagagccccccacctgtgcctggagaggtgctgaaggtgcagagctacctggagaaccccaccagctaccacctgcagcagagccagcaccagaaggtgcgggagtacctgtctgagacctacggcaacaagtttgctgcccacatcagccctgcccagggcagccccaagcccccacctgctgccagccctggggtgcgggccggccacgtgctgagcagcagcgctggcaacagcgcccccaacagccccatggccatgctgcacatcggcagcaaccctgagcgggagctggatgatgtgattgacaacatcatgaggctggatgatgtgctgggctacatcaaccctgagatgcagatgcccaacaccctgcccctgagcagcagccacctgaatgtgtacagcagtgacccccaggtgacagccagcctggtgggcgtgaccagcagcagctgcccagctgacctgacccagaagcgggagctgacctag

SEQ ID NO: 17295 - DNA, 216 bp, Artificial Sequence
  Description of Artificial Sequence: Synthetic coding sequence
atggccagcagaattggcctgaggatgcagctgatgagggagcaggcccagcaggaggagcagcgggagaggatgcagcagcaggccgtgatgcactacatgcagcagcagcagcagcagcagcagcagcagctgggcggcccccccaccccagccatcaacacccctgtgcacttccagagccccccacctgtgcctggagaggtgctgaagtag

SEQ ID NO: 17296 - DNA, 1176 bp, Artificial Sequence
  Description of Artificial Sequence: Synthetic coding sequence
atggccagcagaattggcctgaggatgcagctgatgagggagcaggcccagcaggaggagcagcgggagaggatgcagcagcaggccgtgatgcactacatgcagcagcagcagcagcagcagcagcagcagctgggcggcccccccaccccagccatcaacacccctgtgcacttccagagccccccacctgtgcctggagaggtgctgaagctggatgatgtgattgacaacatcatgaggctggatgatgtgctgggctacatcaaccctgagatgcagatgcccaacaccctgcccctgagcagcagccacctgaatgtgtacagcagtgacccccaggtgacagccagcctggtgggcgtgaccagcagcagctgcccagctgacctgacccagaagcgggagctgacagatgctgagagccgggccctggccaaggagcggcagaagaaggacaaccacaacctgattgaaagaagaagacgcttcaacatcaatgaccgcatcaaggagctgggcatgctgatccccaaggccaatgacctggatgtgcgctggaacaagggcaccatcctgaaggcctctgtggactacatccggaggatgcagaaggacctgcagaagagccgggagctggagaaccacagccggcggctggagatgaccaacaagcagctgtggctgcgcatccaggagctggagatgcaggcccgggtgcacggcctgcccaccaccagccccagcggcatgaacatggccgagctggcccagcaggtggtgaagcaggagctgcccagcgaggagggccctggagaggccctgatgctgggcgctgaggtgcctgaccctgagcccctgcctgccctgcccccccaggcccccctgcccctgcccacccagccccccagccccttccaccacctggacttcagccacagcctgagctttggaggaagagaagatgagggccccccaggctacccagagcccctggcccctggccacggcagccccttccccagcctgagcaagaaggacctggacctgatgctgctggatgacagcctgctgcccctggccagtgaccccctgctgagcaccatgagccctgaggccagcaaggccagcagcagaagaagcagcttctccatggaggagggagatgtgctgtag

SEQ ID NO: 17297 - DNA, 240 bp, Artificial Sequence
  Description of Artificial Sequence: Synthetic coding sequence
atggccagcagaattggcctgaggatgcagctgatgagggagcaggcccagcaggaggagcagcgggagaggatgcagcagcaggccgtgatgcactacatgcagcagcagcagcagcagcagcagcagcagctgggcggcccccccaccccagccatcaacacccctgtgcacttccagagccccccacctgtgcctggagaggtgctgaaggtgcagagctacctggagaacccctag

SEQ ID NO: 17298 - DNA, 99 bp, Artificial Sequence
  Description of Artificial Sequence: Synthetic coding sequence
atggccagcagaattggcctgaggatgcagctgatgagggagcaggcccagcaggaggagcagcgggagaggatgcagcagcaggccgtgatgcactag

SEQ ID NO: 17299 - DNA, 39 bp, Artificial Sequence
  Description of Artificial Sequence: Synthetic coding sequence
atggccagcagaattggcctgaggatgcagctgatgtag

SEQ ID NO: 17300 - DNA, 216 bp, Artificial Sequence; identical to SEQ ID NO: 17295
  Description of Artificial Sequence: Synthetic coding sequence

SEQ ID NO: 17301 - DNA, 39 bp, Artificial Sequence; identical to SEQ ID NO: 17299
  Description of Artificial Sequence: Synthetic coding sequence

SEQ ID NO: 17302 - DNA, 1044 bp, Artificial Sequence
  Description of Artificial Sequence: Synthetic coding sequence
atgaccctggaccaccagatcatcaaccccaccctgaagtggagccagcctgctgtgcccagcggcggccccctggtgcagcacgcccacaccaccctggacagtgatgctggcctgacagagaaccccctgaccaagctgctggccatcggcaaggaggatgacaatgcccagtggcacatggaggatgtgattgaggacatcatcggcatggagagcagcttcaaggaggagggcgctgacagccccctgctgatgcagaggaccctgagcggcagcatcctggatgtgtacagcggggagcagggcatcagccccatcaacatgggcctgaccagcgccagctgccccagcagcctgcccatgaagcgggagatcacagaaacagacacccgggccctggccaaggagcggcagaagaaggacaaccacaacctgattgaaagaagaagacgctacaacatcaactaccgcatcaaggagctgggcaccctcatccccaagagcaatgaccctgacatgcgctggaacaagggcaccatcctgaaggcctctgtggagtacatcaagtggctgcagaaggagcagcagagggcccgggagctggagcaccggcagaagaagctggagcaggccaacagaaggctgctgctgcgcatccaggagctggagatccaggcccggacccacggcctgcccaccctggccagcctgggcaccgtggacctgggcgcccacgtgaccaagcagcagagccaccctgagcagaacagcgtggactactgccagcagctgactgtgtcccagggccccagccctgagctgtgtgaccaggccatcgccttcagtgaccccctgagctacttcacagacctgtccttctctgctgccctgaaggaggagcagaggctggatggcatgctgctggatgacaccatcagccccttcggcacagaccccctgctgagcgccaccagccctgctgtgtccaaggagagcagcagaagaagcagcttcagcagtgatgatggagatgagctgtag

SEQ ID NO: 17303 - DNA, 957 bp, Artificial Sequence
  Description of Artificial Sequence: Synthetic coding sequence
atgaccctggaccaccagatcatcaaccccaccctgaagtggagccagcctgctgtgcccagcggcggccccctggtgcagcacgcccacaccaccctggacagtgatgctggcctgacagagaaccccctgaccaagctgctggccatcggcaaggaggatgacaatgcccagtggcacctgagcggcagcatcctggatgtgtacagcggggagcagggcatcagccccatcaacatgggcctgaccagcgccagctgccccagcagcctgcccatgaagcgggagatcacagaaacagacacccgggccctggccaaggagcggcagaagaaggacaaccacaacctgattgaaagaagaagacgctacaacatcaactaccgcatcaaggagctgggcaccctcatccccaagagcaatgaccctgacatgcgctggaacaagggcaccatcctgaaggcctctgtggagtacatcaagtggctgcagaaggagcagcagagggcccgggagctggagcaccggcagaagaagctggagcaggccaacagaaggctgctgctgcgcatccaggagctggagatccaggcccggacccacggcctgcccaccctggccagcctgggcaccgtggacctgggcgcccacgtgaccaagcagcagagccaccctgagcagaacagcgtggactactgccagcagctgactgtgtcccagggccccagccctgagctgtgtgaccaggccatcgccttcagtgaccccctgagctacttcacagacctgtccttctctgctgccctgaaggaggagcagaggctggatggcatgctgctggatgacaccatcagcccctttggaacagaccccctgctgagcgccaccagccctgctgtgtccaaggagagcagccgccgcagcagcttcagcagtgatgatggagatgagctgtag

SEQ ID NO: 17304 - DNA, 594 bp, Artificial Sequence
  Description of Artificial Sequence: Synthetic coding sequence
atgaccctggaccaccagatcatcaaccccaccctgaagtggagccagcctgctgtgcccagcggcggccccctggtgcagcacgcccacaccaccctggacagtgatgctggcctgacagagaaccccctgaccaagctgctggccatcggcaaggaggatgacaatgcccagtggcacctgagcggcagcatcctggatgtgtacagcggggagcagggcatcagccccatcaacatgggcctgaccagcgccagctgccccagcagcctgcccatgaagcgggagatcacagaaacagacacccgggccctggccaaggagcggcagaagaaggacaaccacaacctgattgaaagaagaagacgctacaacatcaactaccgcatcaaggagctgggcaccctcatccccaagagcaatgaccctgacatgcgctggaacaagggcaccatcctgaaggcctctgtggagtacatcaagtggctgcagaaggagcagcagagggcccgggagctggagcaccggcagaagaagctggagcaggccaacagaaggctgctgctgcgcatccaggtgttcatccgcatgtag

SEQ ID NO: 17305 - DNA, 843 bp, Artificial Sequence
  Description of Artificial Sequence: Synthetic coding sequence
atgatgaaggagaaggagaagaccatcgccatcgtgaaggtgattgacaccagcaagctgaagctgctgagcggcagcatcctggatgtgtacagcggggagcagggcatcagccccatcaacatgggcctgaccagcgccagctgccccagcagcctgcccatgaagcgggagatcacagaaacagacacccgggccctggccaaggagcggcagaagaaggacaaccacaacctgattgaaagaagaagacgctacaacatcaactaccgcatcaaggagctgggcaccctcatccccaagagcaatgaccctgacatgcgctggaacaagggcaccatcctgaaggcctctgtggagtacatcaagtggctgcagaaggagcagcagagggcccgggagctggagcaccggcagaagaagctggagcaggccaacagaaggctgctgctgcgcatccaggagctggagatccaggcccggacccacggcctgcccaccctggccagcctgggcaccgtggacctgggcgcccacgtgaccaagcagcagagccaccctgagcagaacagcgtggactactgccagcagctgactgtgtcccagggccccagccctgagctgtgtgaccaggccatcgccttcagtgaccccctgagctacttcacagacctgtccttctctgctgccctgaaggaggagcagaggctggatggcatgctgctggatgacaccatcagcccctttggaacagaccccctgctgagcgccaccagccctgctgtgtccaaggagagcagccgccgcagcagcttcagcagtgatgatggagatgagctgtag

SEQ ID NO: 17306 - DNA, 951 bp, Artificial Sequence
  Description of Artificial Sequence: Synthetic coding sequence
atgctgcaggccctgaccggcctgcagttccagctgaaggagcagctgggggagaaggagcggcggctgcagatcagccaggagatcagcgcccacaggacagagttccacatgcagttctcctacaagcctgtgctgcaccggctggtgcctgcccggccccagatctacagcagccagctgcccagcttcaccagggtgcctgcccacctggagagcagcgcccggccccagctgcagaaggcccagaggcagaaggtgaacagcttcatgaccctggaccaccagatcatcaaccccaccctgaagtggagccagcctgctgtgcccagcggcggccccctggtgcagcacgcccacaccaccctggacagtgatgctggcctgacagagaaccccctgaccaagctgctggccatcggcaaggaggatgacaatgcccagtggcacatggaggatgtgattgaggacatcatcggcatggagagcagcttcaaggaggagggcgctgacagccccctgctgatgcagaggaccctgagcggcagcatcctggatgtgtacagcggggagcagggcatcagccccatcaacatgggcctgaccagcgccagctgccccagcagcctgcccatgaagcgggagatcacagaaacagacacccgggccctggccaaggagcggcagaagaaggacaaccacaacctgattgaaagaagaagacgctacaacatcaactaccgcatcaaggagctgggcaccctcatccccaagagcaatgaccctgacatgcgctggaacaagggcaccatcctgaaggcctctgtggagtacatcaagtggctgcagaaggagcagcagagggcccgggagctggagcaccggcagaagaagctggagcaggccaacagaaggctgctgctgcgcatccaggtgttcatccgcatgtag

SEQ ID NO: 17307 - DNA, 2169 bp, Artificial Sequence
  Description of Artificial Sequence: Synthetic coding sequence
atgcccctgcaccagctgggggacaagcccctgaccttccccagccccaacagcgccatggagaatggcctggaccacaccccacccagcagaagagccagccctggcacccccctgagccctggcagcctgcggtctgctgcccacagccccctggacaccagcaagcagcccctgtgccagctgtgggccgagaagcatggagcccggggcacccatgaggtgcgctacgtgtctgctggccagagcgtggcctgtggctggtgggcctttgccccaccctgcctgcaggtgctgaacacccccaagggcatcctcttcttcctgtgtgccgccgccttcctgcagggcatgacagtgaatggcttcatcaacacagtcatcaccagcctggagaggagatatgacctgcacagctaccagagcggcctgattgccagcagctatgacattgctgcctgcctgtgcctgacctttgtgtcctactttggaggcagcggccacaagccccgctggctgggctggggcgtgctgctgatgggcaccggcagcctggtgtttgccctgccccacttcaccgctggccgctatgaggtggagctggatgctggggtgaggacctgcccagccaaccctggagctgtgtgtgccgacagcaccagcggcctgagccgctaccagctggtgttcatgctgggccagttcctgcatggagtgggcgccacccccctgtacaccctgggcgtgacctacctggatgaaaatgtgaagagcagctgcagccctgtgtacatcgccatcttctacacagctgccatcctgggccctgctgctggctacctgattggaggagccctgctgaacatctacacagagatgggcagaagaacagagctgaccacagagagccccctgtgggtgggcgcctggtgggtgggcttcctgggcagcggggccgccgccttcttcaccgctgtgcccatcctgggctacccccggcagctgcccggcagccagagatatgctgtgatgagagctgctgagatgcaccagctgaaggacagcagcagaggagaggccagcaacccagactttgggaagaccatccgggacctgcccctgagcatctggctgctgctgaagaaccccaccttcatcctgctgtgcctggccggggccacagaggccaccctcatcaccggcatgagcaccttcagccccaagttcctggagagccagttcagcctgagcgccagcgaggccgccaccctgtttggctacctggtggtgcctgctgggggcggcggcaccttcctgggcggcttctttgtgaacaagctgcggctgcggggcagcgctgtgatcaagttctgcctcttctgcaccgtggtgtccctgctgggcatcctggtgttcagcctgcactgccccagcgtgcccatggccggcgtgacagccagctatggaggcagcctgctgcctgagggccacctgaacctgacagccccctgcaatgctgcctgcagctgccagcctgagcactacagccctgtgtgtggcagtgatggcctgatgtacttcagcctgtgccacgccggctgcccagctgccacagagaccaacgtggatggccagaaggtgtacagagactgcagctgcatcccccagaacctgagcagcggcttcggccacgccacagctgggaagtgcaccagcacctgccagaggaagcccctgctgctggtgttcatctttgtggtgatcttcttcaccttcctgagcagcatcccagccctgacagccaccctgcgctgtgtgcgggacccccagaggagctttgccctgggcatccagtggatcgtggtgcgcatcctgggcggcatccctggccccatcgccttcggctgggtgattgacaaggcctgcctgctgtggcaggaccagtgtggccagcagggcagctgcctggtgtaccagaacagcgccatgagccgctacatcctgatcatgggcctgctgtacaaggtgctgggcgtgctcttctttgccatcgcctgcttcctgtacaagcccctgtctgagagcagtgatggcctggagacctgcctgcccagccagagcagcgccccagacagcgccacagacagccagctgcagagctctgtgtag

SEQ ID NO: 17308 - DNA, 1503 bp, Artificial Sequence
  Description of Artificial Sequence: Synthetic coding sequence
atgagcggccctggcccccgggagcccccacctgaggccggggccgccggcggggaggccgctgtggagggcgccggcggcggagatgctgccctgggggagcccggcctgtccttcaccaccacagacctgagcctggtggagatgacagaggtggagtacacccagctgcagcacatcctgtgcagccacatggaggccgctgctgatggagagctggagacccggctgaacagcgccctgctggccgctgctggccctggagctggagctgggggctttgctgctgggggccagggcggggccgcccctgtgtaccctgtgctgtgccccagcgccctggccgcagatgccccctgcctgggccacatcgacttccaggagctgaggatgatgctgctgtctgaggccggggctgctgagaagaccagcggcggcggagatggagcccgggcccgggcagatggagctgccaaggagggcgctggagctgctgctgctgctgctggcccagatggagcccctgaggcccgggccaagccagctgtgcgggtgcggctggaggaccgcttcaacagcatcccagctgagcccccaccagccccccggggccctgagcccccagagcccggcggggccctgaacaacctggtgaccctcatccgccaccccagcgagctgatgaatgtgcccctgcagcagcagaacaagtgcacagccctggtgaagaacaagacagctgccaccaccacagccctgcagttcacctaccccctcttcaccaccaatgcctgcagcaccagcggcaacagcaacctgagccagacccagagcagcagcaacagctgcagcgtgctggaggccgccaagcaccaggacatcggcctgccccgggccttctccttctgctaccagcaggagattgagagcaccaagcagaccctgggcagcaggaacaaggtgctgcctgagcaggtgtggatcaaggtgggggaggccgccctgtgcaagcaggccctgaagaggaacagaagcaggatgaggcagctggacaccaacgtggagcggcgggccctgggggagatccagaatgtgggggagggcgccacagccacccagggcgcctggcagagcagcgagagcagccaggccaacctgggggagcaggcccagagcggcccccagggcggccgcagccagaggcgggagcggcacaacaggatggagcgggacagaagaagacgcatccgcatctgctgtgatgagctgaacctgctggtgcccttctgcaatgctgagacagacaaggccaccaccctgcagtggaccacagccttcctgaagtacatccaggagcggcacggggacagcctgaagaaggagtttgagagcgtcttctgtgggaagacaggccggcggctgaagctgaccaggccagacagcctggtgacctgcccagcccagggcagcctgcagagcagccccagcatggagatcaagtag

SEQ ID NO: 17309 - DNA, 1008 bp, Artificial Sequence
  Description of Artificial Sequence: Synthetic coding sequence
atggccacctttgtgtctgagctggaggccgccaagaagaacctgtctgaggccctgggggacaacgtgaagcagtactgggccaacctgaagctgtggttcaagcagaagatcagcaaggaggagtttgacctggaggcccaccggctgctgacccaggacaacgtgcacagccacaatgacttcctgctggccatcctgacccgctgccagatcctggtgtccaccccagatggagctggcagcctgccctggccaggcggcagcgctgccaagccaggcaagcccaagggcaagaagaagctgagctctgtgcggcagaagtttgaccaccgcttccagccccagaaccccctgagcggggcccagcagtttgtggccaaggacccccaggatgatgatgacctgaagctgtgcagccacaccatgatgctgcccacccggggccagctggagggccgcatgattgtgacagcctatgagcacggcctggacaacgtgacagaggaggccgtgtctgctgtggtgtatgctgtggagaaccacctgaaggacatcctgacctctgtggtgtccaggaggaaggcctaccgcctgagagatggccacttcaagtatgccttcggcagcaatgtgaccccccagccctacctgaagaacagcgtggtggcctacaacaacctgattgagagccccccagccttcaccgccccctgtgccggccagaacccagccagccaccccccaccagatgatgctgagcagcaggccgccctgctgctggcctgcagcggggacaccctgcctgccagcctgccccctgtgaacatgtatgacctgtttgaggccctgcaggtgcaccgggaggtgatccccacccacacagtgtatgccctgaacatcgagcgcatcatcaccaagctgtggcaccccaaccacgaggagctgcagcaggacaaggtgcaccggcagaggctggccgccaaggagggcctgctgctgtgctag

SEQ ID NO: 17310 - DNA, 2286 bp, Artificial Sequence
  Description of Artificial Sequence: Synthetic coding sequence
atgagcaggaagggccccagggctgaggtgtgtgccgactgcagcgccccagaccccggctgggccagcatcagcagaggagtgctggtgtgtgatgagtgctgcagcgtgcacaggagcctgggccgccacatcagcatcgtgaagcacctgcggcacagcgcctggccacccaccctgctgcagatggtgcacaccctggccagcaatggagccaacagcatctgggagcacagcctgctggaccctgcccaggtgcagagcggccgcaggaaggccaacccccaggacaaggtgcaccccatcaagtctgagttcatccgggccaagtaccagatgctggcctttgtgcacaagctgccctgcagagatgatgatggagtgacagccaaggacctgagcaagcagctgcacagctctgtgaggactggaaacctggagacctgcctgcggctgctgagcctgggcgcccaggccaacttcttccaccctgagaagggcaccacccccctgcacgtggccgccaaggccggccagaccctgcaggccgagctgctggtggtgtatggagctgaccccggcagcccagatgtgaatggaagaacacccatcgactatgcccggcaggccggccaccacgagctggccgagcggctggtggagtgccagtatgagctgacagaccggctggccttctacctgtgtggcaggaagccagaccacaagaatggccactacatcatcccccagatggctgacagcctggacctgtctgagctggccaaggccgccaagaagaagctgcaggccctgagcaacagactctttgaggagctggccatggatgtgtatgatgaggtggacagaagagaaaatgatgctgtgtggctggccacccagaaccacagcaccctggtgacagagaggtctgctgtgcccttcctgcctgtgaaccctgagtacagcgccaccaggaaccagggccggcagaagctggcccgcttcaatgcccgggagtttgccaccctcatcatcgacatcctgtctgaggccaagaggcggcagcagggcaagagcctgagcagccccacagacaacctggagctgagcctgcggagccagagcgacctggatgaccagcacgactatgattctgtggccagtgatgaggacacagaccaggagcccctgcggagcactggagccaccaggagcaacagagcccgctccatggacagcagtgacctgagtgatggagctgtgaccctgcaggagtacctggagctgaagaaggccctggccaccagcgaggccaaggtgcagcagctgatgaaggtgaacagcagcctgagtgatgagctgcggcggctgcagcgggagatccacaagctgcaggccgagaacctgcagctgcggcagcccccaggccctgtgcccaccccacccctgcccagcgagcgggcagagcacacccccatggcccctgggggcagcacccacagaagagaccggcaggccttctccatgtatgagcccggcagcgccctgaagccctttggaggccccccaggagatgagctgaccacccggctgcagcccttccacagcacagagctggaggatgatgccatctacagcgtgcacgtgcctgctggcctgtaccgcatcaggaagggcgtgtctgccagcgctgtgcccttcacccccagcagccccctgctgagctgcagccaggagggcagccgccacaccagcaagctgagccgccacggcagcggggctgacagcgactatgagaacacccagagcggggaccccctgctgggcctggagggcaagcgcttcctggagctgggcaaggaggaggacttccaccctgagctggagagcctggatggagacctggaccccggcctgcccagcacagaagatgtgatcctgaagacagagcaggtgaccaagaacatccaggagctgctgcgggccgcccaggagttcaagcatgacagctttgtgccctgcagcgagaagatccacctggccgtgacagagatggccagcctcttccccaagaggcctgccctggagcctgtgcgcagcagcctgcggctgctgaatgccagcgcctaccgcctgcagagtgaatgtaggaagacagtgcccccagagcccggggcccctgtggacttccagctgctgacccagcaggtgatccagtgtgcctatgacatcgccaaggccgccaagcagctggtgaccatcaccacccgggagaagaagcagtag

SEQ ID NO: 17311 - DNA, 1332 bp, Artificial Sequence
  Description of Artificial Sequence: Synthetic coding sequence
atggaccggctgggccccttcagcaatgaccccagcgacaagccaccctgccggggctgcagcagctacctgatggagccctacatcaagtgtgctgaatgtggccccccacccttcttcctgtgcctgcagtgcttcacccggggctttgagtacaagaagcaccagagcgaccacacctatgagatcatgaccagtgacttccctgtgctggaccccagctggacagcccaggaggagatggccctgctggaggccgtgatggactgtggcttcggcaactggcaggatgtggccaaccagatgtgcaccaagaccaaggaggagtgtgagaagcactacatgaagcacttcatcaacaaccccctgtttgccagcaccctgctgaacctgaagcaggccgaggaggccaagacagctgacacagccatccccttccacagcacagatgaccccccccggcccacctttgacagcctgctgagccgggacatggccggctacatgcctgcccgggctgacttcatcgaggagtttgacaactatgcagagtgggacctgcgggacatcgactttgtggaggatgacagcgacatcctgcacgccctgaagatggctgtggtggacatctaccacagccggctgaaggagcggcagaggaggaagaagatcatccgggaccacggcctcatcaacctgaggaagttccagctgatggagcggcgctaccccaaggaggtgcaggacctgtatgagaccatgagaagatttgcccgcatcgtgggccctgtggagcatgacaagttcatcgagagccacgccctggagtttgagctgcggcgggagatcaagaggctgcaggagtacagaacagctggcatcaccaacttctgcagcgcccggacctatgaccacctgaagaagacccgggaggaggagcggctgaagaggaccatgctgtctgaggtgctgcagtacatccaggacagcagcgcctgccagcagtggctgcggcggcaggccgacattgattctggcctgagccccagcatccccatggccagcaacagcggcagaagaagtgccccacccctgaacctgaccggcctgcctggaacagagaagctgaatgagaaggagaaggagctgtgccagatggtgcggctggtgcctggggcctacctggagtacaagagcgccctgctgaatgaatgcaacaagcagggcggcctgcggctggcccaggcccgggccctgatcaagattgatgtgaacaagaccaggaagatctatgacttcctgatccgggagggctacatcaccaagggctag

SEQ ID NO: 17312 - DNA, 918 bp, Artificial Sequence
  Description of Artificial Sequence: Synthetic coding sequence
atggaccggctgggccccttcagcaatgaccccagcgacaagccaccctgccggggctgcagcagctacctgatggagccctacatcaagtgtgctgaatgtggccccccacccttcttcctgtgcctgcagtgcttcacccggggctttgagtacaagaagcaccagagcgaccacacctatgagatcatgaccagtgacttccctgtgctggaccccagctggacagcccaggaggagatggccctgctggaggccgtgatggactgtggcttcggcaactggcaggatgtggccaaccagatgtgcaccaagaccaaggaggagtgtgagaagcactacatgaagcacttcatcaacaaccccctgtttgccagcaccctgctgaacctgaagcaggccgaggaggccaagacagctgacacagccatccccttccacagcacagatgaccccccccggcccacctttgacagcctgctgagccgggacatggccggctacatgcctgcccgggctgacttcatcgaggagtttgacaactatgcagagtgggacctgcgggacatcgactttgtggaggatgacagcgacatcctgcacgccctgaagatggctgtggtggacatctaccacagccggctgaaggagcggcagaggaggaagaagatcatccgggaccacggcctcatcaacctgaggaagttccagctgatggagcggcgctaccccaaggaggtgcaggacctgtatgagaccatgagaagatttgcccgcatcgtgggccctgtggagcatgacaagttcatcgagagccacgcctgccgctggttcctgagcctggagcagtacctgtgtgtgtacatctacatcaacagaagagacaacggggtcttctacgtgaagttctacaagtag

SEQ ID NO: 17313 - DNA, 1029 bp, Artificial Sequence
  Description of Artificial Sequence: Synthetic coding sequence
atgtgcaccaagaccaaggaggagtgtgagaagcactacatgaagcacttcatcaacaaccccctgtttgccagcaccctgctgaacctgaagcaggccgaggaggccaagacagctgacacagccatccccttccacagcacagatgatcctccccggcccacctttgacagcctgctgagccgggacatggccggctacatgcctgcccgggctgacttcatcgaggagtttgacaactatgcagagtgggacctgcgggacatcgactttgtggaggatgacagcgacatcctgcacgccctgaagatggctgtggtggacatctaccacagccggctgaaggagcggcagaggaggaagaagatcatccgggaccacggcctcatcaacctgaggaagttccagctgatggagcggcgctaccccaaggaggtgcaggacctgtatgagaccatgagaagatttgccagaattgtgggccctgtggagcatgacaagttcatcgagagccacgccctggagtttgagctgcggcgggagatcaagaggctgcaggagtacagaacagctggcatcaccaacttctgcagcgcccggacctatgaccacctgaagaagacccgggaggaggagcggctgaagaggaccatgctgtctgaggtgctgcagtacatccaggacagcagcgcctgccagcagtggctgcggcggcaggccgacatcgacagcggcctgagccccagcatccccatggccagcaacagcggccgccgcagcgccccacccctgaacctgaccggcctgcccggcacagagaagctgaatgagaaggagaaggagctgtgccagatggtgcggctggtgcctggggcctacctggagtacaagagcgccctgctgaatgaatgcaacaagcagggcggcctgcggctggcccaggcccgggccctgatcaagattgatgtgaacaagaccaggaagatctatgacttcctgatccgggagggctacatcaccaagggctag

SEQ ID NO: 17314 - DNA, 1332 bp, Artificial Sequence; identical to SEQ ID NO: 17311
  Description of Artificial Sequence: Synthetic coding sequence

SEQ ID NO: 17315 - DNA, 3390 bp, Artificial Sequence
  Description of Artificial Sequence: Synthetic coding sequence
atgggagaccagcagctgtacaagaccaaccacgtggcccacggctctgaaaatctcttctaccagcagccccccctgggcgtgcacagcggcctgaaccacaactatggaaatgctgtgactggaggcggcatggatgccccccaggccagccccatcagcccccacttcccccaggacaccagagatggcctgggcctgcctgtgggcagcaagaacctgggccagatggacaccagccggcagggcggctggggcagccatgctggccctggcaaccacgtgcagctgcggggcaacctggccaacagcaacatgatgtggggcgccccagcccaggccgagcccacagatggctaccagtacacctacagccaggccagcgagatccgcacccagaagctgaccagcggcgtgctgcacaagctggacagcttcacccaggtgtttgccaaccagaacctgcgcatccaggtgaacaacatggcccaggtgctgcacacccagagcgctgtgatggatggagccccagattctgccctgcggcagctgctgagccagaagcccatggagcccccagccccagccatccccagccgctaccagcaggtgccccagcagccccaccctggcttcaccggcggcctgagcaagccagccctgcaggtgggccagcaccccacccagggccacctgtactatgactaccagcagcccctggcccaggtgcctgtgcagggcggccagcccctgcaggccccccagatgctgagccagcacatgcagcagatgcagcagcaccagtactacccaccccagcagcagcagcaggccggccagcagaggatctccatgcaggagatccagacccagccccagcagatccggcccagccagccccagcccccaccccagcagcagcagccccagcagctgcagctgcagcagaggcagggctccatgcagatcccccagtactaccagccccagcccatgatgcagcacctgcaggagcagcagcagcagcagatgcacctgcagccccccagctaccaccgggacccccaccagtacaccccagagcaggcccacacagtgcagctgatccccctgggctccatgagccagtactactaccaggagccccagcagccctacagccaccccctgtaccagcagagccacctgagccagcaccagcagcgggaggacagccagctgaagacctacagcagtgaccggcaggcccaggccatgctgagcagccatggagacctgggccccccagacaccggcatgggagaccctgccagcagtgacctgaccagggtgagcagcaccctgccccaccggcccctgctgagccccagcggcatccacctgaacaacatgggcccccagcaccagcagctgagccccagcgccatgtggccccagatgcacctgcctgatggccgggcccagcccggcagccctgagagcagcggccagcccaagggggccttcggggagcagtttgatgccaagaacaagctgacctgcagcatctgcctgaaggagttcaagaacctgcctgccctgaatggccacatgaggagccacggcggcatgagggccagccccaacctgaagcaggagatccccaggaagcaccagcccagcgtgcccaaggccgaggagcccctgaagacagtgcaggagaagaagaagttccgccacaggcctgagcccctcttcatccccccacctccttcctacaaccccaacccagctgccagctacagcggggccaccctgtaccagagccagctgcggagcccccgggtgctgggggaccacctgctgctggaccccacccatgagctgcccccctacaccccaccacccatgctgagccctgtgcggcagggcagcggcctcttcagcaatgtgctgatcagcggccacggccctggggcccacccccagctgcccctgacccccctgacccccaccccccgggtgctgctgtgccgcagcaacagcattgatggcagcaatgtgacagtgaccccaggccctggagagcagacagtggatgtggagccccgcatcaacatcggcctgcgcttccaggccgagatccctgagctgcaggacatcagcgccctggcccaggacacccacaaggccaccctggtgtggaagccctggccagagctggagaaccacgacctgcagcagagggtggagaacctgctgaacctgtgctgcagcagcgccctgcccggcggcggcaccaacagcgagtttgccctgcacagcctgtttgaggccaagggagatgtgatggtggccctggagatgctgctgctgaggaagcctgtgcggctgaagtgccaccccctggccaactaccactacgccggcagtgacaagtggaccagcctggagaggaagctgttcaacaaggccctggccacctacagcaaggacttcatctttgtgcagaagatggtgaagagcaagacagtggcccagtgtgtggagtactactacacctggaagaagatcatgaggctgggcaggaagcacaggacccggctggccgagatcattgatgactgtgtgaccagcgaggaggaggaggagctggaggaggaggaggaggaggaccctgaggaggacaggaagagcaccaaggaggaggagagcgaggtgcccaagagccctgagcccccacctgtgcctgtgctggcccccacagagggcccccccctgcaggccctgggccagcccagcggcagcttcatctgtgagatgcccaactgtggggctgactgccgctgccacgtgacccccttcctgccccaggtgttcagcagccggcaggccctgaatggccacgcccgcatccacggcggcaccaaccaggtgaccaaggcccggggggccatccccagcggcaagcagaagccaggcggcacccagagcggctactgcagcgtgaagagcagccccagccacagcaccaccagcggggagacagaccccaccaccatcttcccctgcaaggaatgtgggaaggtgttcttcaagatcaagagcagaaatgcccacatgaagacccaccggcagcaggaggagcagcagaggcagaaggcccagaaggccgcctttgctgctgagatggccgccaccattgaaagaaccactggacctgtgggcgcccctggcctgctgcccctggaccagctgagcctcatcaagcccatcaaggatgtggacatcctggatgatgatgtggtgcagcagctgggcggcgtgatggaggaggccgaggtggtggacacagacctgctgctggatgaccaggacagcgtgctgctgcagggagatgctgagctgtag

SEQ ID NO: 17316 - DNA, 3603 bp, Artificial Sequence
  Description of Artificial Sequence: Synthetic coding sequence
atgggagaccagcagctgtacaagaccaaccacgtggcccacggctctgaaaatctcttctaccagcagccccccctgggcgtgcacagcggcctgaaccacaactatggaaatgctgtgactggaggcggcatggatgccccccaggccagccccatcagcccccacttcccccaggacaccagagatggcctgggcctgcctgtgggcagcaagaacctgggccagatggacaccagccggcagggcggctggggcagccatgctggccctggcaaccacgtgcagctgcggggcaacctggccaacagcaacatgatgtggggcgccccagcccaggccgagcccacagatggctaccagtacacctacagccaggccagcgagatccgcacccagaagctgaccagcggcgtgctgcacaagctggacagcttcacccaggtgtttgccaaccagaacctgcgcatccaggtgaacaacatggcccaggtgctgcacacccagagcgctgtgatggatggagccccagattctgccctgcggcagctgctgagccagaagcccatggagcccccagccccagccatccccagccgctaccagcaggtgccccagcagccccaccctggcttcaccggcggcctgagcaagccagccctgcaggtgggccagcaccccacccagggccacctgtactatgactaccagcagcccctggcccaggtgcctgtgcagggcggccagcccctgcaggccccccagatgctgagccagcacatgcagcagatgcagcagcaccagtactacccaccccagcagcagcagcaggccggccagcagaggatctccatgcaggagatccagacccagccccagcagatccggcccagccagccccagcccccaccccagcagcagcagccccagcagctgcagctgcagcagaggcagggctccatgcagatcccccagtactaccagccccagcccatgatgcagcacctgcaggagcagcagcagcagcagatgcacctgcagccccccagctaccaccgggacccccaccagtacaccccagagcaggcccacacagtgcagctgatccccctgggctccatgagccagtactactaccaggagccccagcagccctacagccaccccctgtaccagcagagccacctgagccagcaccagcagcgggaggacagccagctgaagacctacagcagtgaccggcaggcccaggccatgctgagcagccatggagacctgggccccccagacaccggcatgggagaccctgccagcagtgacctgaccagggtgagcagcaccctgccccaccggcccctgctgagccccagcggcatccacctgaacaacatgggcccccagcaccagcagctgagccccagcgccatgtggccccagatgcacctgcctgatggccgggcccagcccggcagccctgagagcagcggccagcccaagggggccttcggggagcagtttgatgccaagaacaagctgacctgcagcatctgcctgaaggagttcaagaacctgcctgccctgaatggccacatgaggagccacggcggcatgagggccagccccaacctgaagcaggaggagggggagaaggtgctgcccccccagccccagccccccctgcccccacctcctcctcctcctcctccaccccagctgcccccagaggccgagagcctgacccccatggtgatgcctgtgtctgtgcctgtgaagctgctgccccccaagcccagcagccagggcttcaccaacagcacagtggccgcccccagcgcccgggacaagccagccagctccatgtctgatgatgagatgcctgtgctggagatccccaggaagcaccagcccagcgtgcccaaggccgaggagcccctgaagacagtgcaggagaagaagaagttccgccacaggcctgagcccctcttcatccccccaccacccagctacaaccccaacccagctgccagctacagcggggccaccctgtaccagagccagctgcggagcccccgggtgctgggggaccacctgctgctggaccccacccatgagctgcccccctacaccccaccacccatgctgagccctgtgcggcagggcagcggcctcttcagcaatgtgctgatcagcggccacggccctggggcccacccccagctgcccctgacccccctgacccccaccccccgggtgctgctgtgccgcagcaacagcattgatggcagcaatgtgacagtgaccccaggccctggagagcagacagtggatgtggagccccgcatcaacatcggcctgcgcttccaggccgagatccctgagctgcaggacatcagcgccctggcccaggacacccacaaggccaccctggtgtggaagccctggccagagctggagaaccacgacctgcagcagagggtggagaacctgctgaacctgtgctgcagcagcgccctgcccggcggcggcaccaacagcgagtttgccctgcacagcctgtttgaggccaagggagatgtgatggtggccctggagatgctgctgctgaggaagcctgtgcggctgaagtgccaccccctggccaactaccactacgccggcagtgacaagtggaccagcctggagaggaagctgttcaacaaggccctggccacctacagcaaggacttcatctttgtgcagaagatggtgaagagcaagacagtggcccagtgtgtggagtactactacacctggaagaagatcatgaggctgggcaggaagcacaggacccggctggccgagatcattgatgactgtgtgaccagcgaggaggaggaggagctggaggaggaggaggaggaggaccctgaggaggacaggaagagcaccaaggaggaggagagcgaggtgcccaagagccctgagcccccacctgtgcctgtgctggcccccacagagggcccccccctgcaggccctgggccagcccagcggcagcttcatctgtgagatgcccaactgtggggctgtgttcagcagccggcaggccctgaatggacatgcccgcatccatggaggcaccaaccaggtgaccaaggcccggggggccatccccagcggcaagcagaagccaggcggcacccagagcggctactgcagcgtgaagagcagccccagccacagcaccaccagcggggagacagaccccaccaccatcttcccctgcaaggaatgtgggaaggtgttcttcaagatcaagagcagaaatgcccacatgaagacccaccggcagcaggaggagcagcagaggcagaaggcccagaaggccgcctttgctgctgagatggccgccaccatcgagaggaccaccggccctgtgggcgcccctggcctgctgcccctggaccagctgagcctcatcaagcccatcaaggatgtggacatcctggatgatgatgtggtgcagcagctgggcggcgtgatggaggaggccgaggtggtggacacagacctgctgctggatgaccaggacagcgtgctgctgcagggagatgctgagctgtag

SEQ ID NO: 17317 - DNA, 3663 bp, Artificial Sequence
  Description of Artificial Sequence: Synthetic coding sequence
atgggagaccagcagctgtacaagaccaaccacgtggcccacggctctgaaaatctcttctaccagcagccccccctgggcgtgcacagcggcctgaaccacaactatggaaatgctgtgactggaggcggcatggatgccccccaggccagccccatcagcccccacttcccccaggacaccagagatggcctgggcctgcctgtgggcagcaagaacctgggccagatggacaccagccggcagggcggctggggcagccatgctggccctggcaaccacgtgcagctgcggggcaacctggccaacagcaacatgatgtggggcgccccagcccaggccgagcccacagatggctaccagtacacctacagccaggccagcgagatccgcacccagaagctgaccagcggcgtgctgcacaagctggacagcttcacccaggtgtttgccaaccagaacctgcgcatccaggtgaacaacatggcccaggtgctgcacacccagagcgctgtgatggatggagccccagattctgccctgcggcagctgctgagccagaagcccatggagcccccagccccagccatccccagccgctaccagcaggtgccccagcagccccaccctggcttcaccggcggcctgagcaagccagccctgcaggtgggccagcaccccacccagggccacctgtactatgactaccagcagcccctggcccaggtgcctgtgcagggcggccagcccctgcaggccccccagatgctgagccagcacatgcagcagatgcagcagcaccagtactacccaccccagcagcagcagcaggccggccagcagaggatctccatgcaggagatccagacccagccccagcagatccggcccagccagccccagcccccaccccagcagcagcagccccagcagctgcagctgcagcagaggcagggctccatgcagatcccccagtactaccagccccagcccatgatgcagcacctgcaggagcagcagcagcagcagatgcacctgcagccccccagctaccaccgggacccccaccagtacaccccagagcaggcccacacagtgcagctgatccccctgggctccatgagccagtactactaccaggagccccagcagccctacagccaccccctgtaccagcagagccacctgagccagcaccagcagcgggaggacagccagctgaagacctacagcagtgaccggcaggcccaggccatgctgagcagccatggagacctgggccccccagacaccggcatgggagaccctgccagcagtgacctgaccagggtgagcagcaccctgccccaccggcccctgctgagccccagcggcatccacctgaacaacatgggcccccagcaccagcagctgagccccagcgccatgtggccccagatgcacctgcctgatggccgggcccagcccggcagccctgagagcagcggccagcccaagggggccttcggggagcagtttgatgccaagaacaagctgacctgcagcatctgcctgaaggagttcaagaacctgcctgccctgaatggccacatgaggagccacggcggcatgagggccagccccaacctgaagcaggaggagggggagaaggtgctgcccccccagccccagccccccctgcccccacctcctcctcctcctcctccaccccagctgcccccagaggccgagagcctgacccccatggtgatgcctgtgtctgtgcctgtgaagctgctgccccccaagcccagcagccagggcttcaccaacagcacagtggccgcccccagcgcccgggacaagccagccagctccatgtctgatgatgagatgcctgtgctggtgaggatgaccctgagccccccccacagcccccagggcgccgcccccaggaccccagctgagatccccaggaagcaccagcccagcgtgcccaaggccgaggagcccctgaagacagtgcaggagaagaagaagttccgccacaggcctgagcccctcttcatccccccaccacccagctacaaccccaacccagctgccagctacagcggggccaccctgtaccagagccagctgcggagcccccgggtgctgggggaccacctgctgctggaccccacccatgagctgcccccctacaccccaccacccatgctgagccctgtgcggcagggcagcggcctcttcagcaatgtgctgatcagcggccacggccctggggcccacccccagctgcccctgacccccctgacccccaccccccgggtgctgctgtgccgcagcaacagcattgatggcagcaatgtgacagtgaccccaggccctggagagcagacagtggatgtggagccccgcatcaacatcggcctgcgcttccaggccgagatccctgagctgcaggacatcagcgccctggcccaggacacccacaaggccaccctggtgtggaagccctggccagagctggagaaccacgacctgcagcagagggtggagaacctgctgaacctgtgctgcagcagcgccctgcccggcggcggcaccaacagcgagtttgccctgcacagcctgtttgaggccaagggagatgtgatggtggccctggagatgctgctgctgaggaagcctgtgcggctgaagtgccaccccctggccaactaccactacgccggcagtgacaagtggaccagcctggagaggaagctgttcaacaaggccctggccacctacagcaaggacttcatctttgtgcagaagatggtgaagagcaagacagtggcccagtgtgtggagtactactacacctggaagaagatcatgaggctgggcaggaagcacaggacccggctggccgagatcattgatgactgtgtgaccagcgaggaggaggaggagctggaggaggaggaggaggaggaccctgaggaggacaggaagagcaccaaggaggaggagagcgaggtgcccaagagccctgagcccccacctgtgcctgtgctggcccccacagagggcccccccctgcaggccctgggccagcccagcggcagcttcatctgtgagatgcccaactgtggggctgtgttcagcagccggcaggccctgaatggacatgcccgcatccatggaggcaccaaccaggtgaccaaggcccggggggccatccccagcggcaagcagaagccaggcggcacccagagcggctactgcagcgtgaagagcagccccagccacagcaccaccagcggggagacagaccccaccaccatcttcccctgcaaggaatgtgggaaggtgttcttcaagatcaagagcagaaatgcccacatgaagacccaccggcagcaggaggagcagcagaggcagaaggcccagaaggccgcctttgctgctgagatggccgccaccatcgagaggaccaccggccctgtgggcgcccctggcctgctgcccctggaccagctgagcctcatcaagcccatcaaggatgtggacatcctggatgatgatgtggtgcagcagctgggcggcgtgatggaggaggccgaggtggtggacacagacctgctgctggatgaccaggacagcgtgctgctgcagggagatgctgagctgtag

SEQ ID NO: 17318 - DNA, 2247 bp, Artificial Sequence
  Description of Artificial Sequence: Synthetic coding sequence
atgatccgggacctgagcaagatgtacccccagaccaggcacccagccccccaccagcctgcccagcccttcaagttcaccatcagcgagagctgtgaccgcatcaaggaggagttccagttcctgcaggcccagtaccacagcctgaagctggagtgtgagaagctggccagcgagaagacagagatgcagaggcactacgtgatgtactatgagatgtcctatggcctgaacatcgagatgcacaagcaggccgagatcgtgaagaggctgaatgccatctgtgcccaggtgatccccttcctgagccaggagcagcagctgcaggcccagcacctgagccacggccacggcctgcctgtgcccctgaccccccaccccagcggcctgcagcccccagccatcccccccatcggcagcagcgctggcctgctggccctgagcagcgccctgggcggccagagccacctgcccatcaaggatgagaagaagcaccacgacaatgaccaccagagggaccgggacagcatcaagagcagctctgtgagccccagcgccagcttcagaggagctgagaagcacagaaattctgctgactacagcagcgagagcaagaagcagaagacagaggagaaggagattgctgcccgctatgacagtgatggagagaagagtgatgacaacctggtggtggatgtgtccaatgaagaccccagcagcccccggggcagccctgcccacagccccagagaaaatggcctggacaagacccggctgctgaagaaggatgcccccatcagccctgccagcatcgccagcagcagcagcacccccagcagcaagagcaaggagctgagcctgaatgagaagagcaccacccctgtgtccaagagcaacacccccacccccaggacagatgcccccaccccaggcagcaacagcaccccaggcctgcggcctgtgcctgggaagcccccaggagtggaccccctggccagcagcctgcggacccccatggctgtgccctgcccctaccccaccccatttggaattgtgccccatgctggcatgaatggagagctgaccagccctggggccgcctatgccggcctgcacaacatcagcccccagatgtctgctgctgctgctgctgctgctgctgctgctgcctacggccgcagccctgtggtgggctttgacccccaccaccacatgagggtgcctgccatcccccccaacctgaccggcatccctgggggcaagccagcctacagcttccacgtgtctgcagatggccagatgcagcctgtgcccttccccccagatgccctgattggccctggcatccccaggcatgcccggcagatcaacaccctgaaccacggggaggtggtgtgtgctgtgaccatcagcaaccccaccaggcatgtgtacacaggaggcaagggctgtgtgaaggtgtgggacatcagccaccctggcaacaagagccctgtgtcccagctggactgcctgaacagagacaactacatccgcagctgccgcctgctgcctgatggccgcaccctcatcgtgggcggggaggccagcaccctgagcatctgggacctggccgcccccaccccccgcatcaaggccgagctgaccagcagcgccccagcctgctacgccctggccatcagcccagacagcaaggtgtgcttcagctgctgcagtgatggcaacattgctgtgtgggacctgcacaaccagaccctggtgcggcagttccagggccacacagatggagccagctgcatcgacatcagcaatgatggcaccaagctgtggacaggaggcctggacaacacagtgcgctcctgggacctgcgggagggccggcagctgcagcagcacgacttcaccagccagatcttcagcctgggctactgccccaccggggagtggctggccgtgggcatggagaacagcaatgtggaggtgctgcacgtgaccaagccagacaagtaccagctgcacctgcacgagagctgtgtgctgagcctgaagtttgcccactgcggcaagtggtttgtgtccacaggcaaggacaacctgctgaatgcctggaggaccccctatggagccagcatcttccagagcaaggagagcagctctgtgctgagctgtgacatctctgtggatgacaagtacatcgtgacaggcagcggggacaagaaggccaccgtgtatgaggtgatctactag

SEQ ID NO: 17319 - DNA, 2418 bp, Artificial Sequence
  Description of Artificial Sequence: Synthetic coding sequence
atgatccgggacctgagcaagatgtacccccagaccaggcacccagccccccaccagcctgcccagcccttcaagttcaccatcagcgagagctgtgaccgcatcaaggaggagttccagttcctgcaggcccagtaccacagcctgaagctggagtgtgagaagctggccagcgagaagacagagatgcagaggcactacgtgatgtactatgagatgtcctatggcctgaacatcgagatgcacaagcaggccgagatcgtgaagaggctgaatgccatctgtgcccaggtgatccccttcctgagccaggagcaccagcagcaggtggtgcaggccgtggagcgggccaagcaggtgaccatggccgagctgaatgccatcatcggccagcagctgcaggcccagcacctgagccacggccacggcctgcctgtgcccctgaccccccaccccagcggcctgcagcccccagccatcccccccatcggcagcagcgctggcctgctggccctgagcagcgccctgggcggccagagccacctgcccatcaaggatgagaagaagcaccacgacaatgaccaccagcgggagcgggacaagctgaaccacaagagcctgagccccagcgccagcttcagaggagctgagaagcacaggaacagcgctgactacagcagcgagagcaagaagcagaagacagaggagaaggagattgctgcccgctatgacagtgatggagagaagagtgatgacaacctggtggtggatgtgtccaatgaagaccccagcagcccccggggcagccctgcccacagcccccgggagaatggcctggacaagacccggctgctgaagaaggatgcccccatcagccctgccagcatcgccagcagcagcagcacccccagcagcaagagcaaggagctgagcctgaagagggacatgggcaagctgtctgagacccggctgtctgaagatgagcagtgcaccctgggcctgcagcgctggttctgccgcctgtggttcatgaatgagaagagcaccacccctgtgtccaagagcaacacccccacccccaggacagatgcccccaccccaggcagcaacagcaccccaggcctgcggcctgtgcctgggaagcccccaggagtggaccccctggccagcagcctgcggacccccatggctgtgccctgcccctaccccacccccttcggcatcgtgccccacgccggcatgaatggagagctgaccagccctggagctgcctatgccggcctgcacaacatcagcccccagatgtctgctgctgctgctgctgctgctgctgctgctgcctacggccgcagccctgtggtgggctttgacccccaccaccacatgagggtgcctgccatcccccccaacctgaccggcatccctgggggcaagccagcctacagcttccacgtgtctgcagatggccagatgcagcctgtgcccttccccccagatgccctgattggccctggcatccccaggcatgcccggcagatcaacaccctgaaccacggggaggtggtgtgtgctgtgaccatcagcaaccccaccaggcatgtgtacacaggaggcaagggctgtgtgaaggtgtgggacatcagccaccctggcaacaagagccctgtgtcccagctggactgcctgaacagagacaactacatccgcagctgccgcctgctgcctgatggccgcaccctgattgtgggcggggaggccagcaccctgagcatctgggacctggccgcccccaccccccgcatcaaggccgagctgaccagcagcgccccagcctgctacgccctggccatcagcccagacagcaaggtgtgcttcagctgctgcagtgatggcaacattgctgtgtgggacctgcacaaccagaccctggtgcggcagttccagggccacacagatggagccagctgcatcgacatcagcaatgatggcaccaagctgtggacaggaggcctggacaacacagtgcgctcctgggacctgcgggagggccggcagctgcagcagcacgacttcaccagccagatcttcagcctgggctactgccccactggagagtggctggccgtgggcatggagaacagcaatgtggaggtgctgcacgtgaccaagccagacaagtaccagctgcacctgcacgagagctgtgtgctgagcctgaagtttgcccactgtgggaagtggtttgtgtccacaggcaaggacaacctgctgaatgcctggaggaccccctacggggccagcatcttccagagcaaggagagcagctctgtgctgagctgtgacatctctgtggatgacaagtacatcgtgactggaagtggggacaagaaggccaccgtgtatgaagtcatctactag

SEQ ID NO: 17320 - DNA, 1233 bp, Artificial Sequence
  Description of Artificial Sequence: Synthetic coding sequence
atggctgtgccctgcccctaccccaccccatttggaattgtgccccatgctggcatgaatggagagctgaccagccctggggccgcctatgccggcctgcacaacatcagcccccagatgtctgctgctgctgctgctgctgctgctgctgctgcctacggccgcagccctgtggtgggctttgacccccaccaccacatgagggtgcctgccatcccccccaacctgaccggcatccctgggggcaagccagcctacagcttccacgtgtctgcagatggccagatgcagcctgtgcccttccccccagatgccctgattggccctggcatccccaggcatgcccggcagatcaacaccctgaaccacggggaggtggtgtgtgctgtgaccatcagcaaccccaccaggcatgtgtacacaggaggcaagggctgtgtgaaggtgtgggacatcagccaccctggcaacaagagccctgtgtcccagctggactgcctgaacagagacaactacatccgcagctgccgcctgctgcctgatggccgcaccctcatcgtgggcggggaggccagcaccctgagcatctgggacctggccgcccccaccccccgcatcaaggccgagctgaccagcagcgccccagcctgctacgccctggccatcagcccagacagcaaggtgtgcttcagctgctgcagtgatggcaacattgctgtgtgggacctgcacaaccagaccctggtgcggcagttccagggccacacagatggagccagctgcatcgacatcagcaatgatggcaccaagctgtggacaggaggcctggacaacacagtgcgctcctgggacctgcgggagggccggcagctgcagcagcacgacttcaccagccagatcttcagcctgggctactgccccaccggggagtggctggccgtgggcatggagaacagcaatgtggaggtgctgcacgtgaccaagccagacaagtaccagctgcacctgcacgagagctgtgtgctgagcctgaagtttgcccactgcggcaagtggtttgtgtccacaggcaaggacaacctgctgaatgcctggaggaccccctatggagccagcatcttccagagcaaggagagcagctctgtgctgagctgtgacatctctgtggatgacaagtacatcgtgacaggcagcggggacaagaaggccaccgtgtatgaggtgatctactag

SEQ ID NO: 17321 - DNA, 2418 bp, Artificial Sequence
  Description of Artificial Sequence: Synthetic coding sequence
atgatccgggacctgagcaagatgtacccccagaccaggcacccagccccccaccagcctgcccagcccttcaagttcaccatcagcgagagctgtgaccgcatcaaggaggagttccagttcctgcaggcccagtaccacagcctgaagctggagtgtgagaagctggccagcgagaagacagagatgcagaggcactacgtgatgtactatgagatgtcctatggcctgaacatcgagatgcacaagcaggccgagatcgtgaagaggctgaatgccatctgtgcccaggtgatccccttcctgagccaggagcaccagcagcaggtggtgcaggccgtggagcgggccaagcaggtgaccatggccgagctgaatgccatcatcggccagcagctgcaggcccagcacctgagccacggccacggcctgcctgtgcccctgaccccccaccccagcggcctgcagcccccagccatcccccccatcggcagcagcgctggcctgctggccctgagcagcgccctgggcggccagagccacctgcccatcaaggatgagaagaagcaccacgacaatgaccaccagagggaccgggacagcatcaagagcagctctgtgagccccagcgccagcttcagaggagctgagaagcacaggaacagcgctgactacagcagcgagagcaagaagcagaagacagaggagaaggagattgctgcccgctatgacagtgatggagagaagagtgatgacaacctggtggtggatgtgtccaatgaagaccccagcagcccccggggcagccctgcccacagcccccgggagaatggcctggacaagacccggctgctgaagaaggatgcccccatcagccctgccagcatcgccagcagcagcagcacccccagcagcaagagcaaggagctgagcctgaagagggacatgggcaagctgtctgagacccggctgtctgaagatgagcagtgcaccctgggcctgcagcgctggttctgccgcctgtggttcatgaatgagaagagcaccacccctgtgtccaagagcaacacccccacccccaggacagatgcccccaccccaggcagcaacagcaccccaggcctgcggcctgtgcctgggaagcccccaggagtggaccccctggccagcagcctgcggacccccatggctgtgccctgcccctaccccacccccttcggcatcgtgccccacgccggcatgaatggagagctgaccagccctggagctgcctatgccggcctgcacaacatcagcccccagatgtctgctgctgctgctgctgctgctgctgctgctgcctacggccgcagccctgtggtgggctttgacccccaccaccacatgagggtgcctgccatcccccccaacctgaccggcatccctgggggcaagccagcctacagcttccacgtgtctgcagatggccagatgcagcctgtgcccttccccccagatgccctgattggccctggcatccccaggcatgcccggcagatcaacaccctgaaccacggggaggtggtgtgtgctgtgaccatcagcaaccccaccaggcatgtgtacacaggaggcaagggctgtgtgaaggtgtgggacatcagccaccctggcaacaagagccctgtgtcccagctggactgcctgaacagagacaactacatccgcagctgccgcctgctgcctgatggccgcaccctgattgtgggcggggaggccagcaccctgagcatctgggacctggccgcccccaccccccgcatcaaggccgagctgaccagcagcgccccagcctgctacgccctggccatcagcccagacagcaaggtgtgcttcagctgctgcagtgatggcaacattgctgtgtgggacctgcacaaccagaccctggtgcggcagttccagggccacacagatggagccagctgcatcgacatcagcaatgatggcaccaagctgtggacaggaggcctggacaacacagtgcgctcctgggacctgcgggagggccggcagctgcagcagcacgacttcaccagccagatcttcagcctgggctactgccccactggagagtggctggccgtgggcatggagaacagcaatgtggaggtgctgcacgtgaccaagccagacaagtaccagctgcacctgcacgagagctgtgtgctgagcctgaagtttgcccactgtgggaagtggtttgtgtccacaggcaaggacaacctgctgaatgcctggaggaccccctacggggccagcatcttccagagcaaggagagcagctctgtgctgagctgtgacatctctgtggatgacaagtacatcgtgactggaagtggggacaagaaggccaccgtgtatgaagtcatctactag

SEQ ID NO: 17322 - DNA, 2115 bp, Artificial Sequence
  Description of Artificial Sequence: Synthetic coding sequence
atgatccgggacctgagcaagatgtacccccagaccaggcacccagccccccaccagcctgcccagcccttcaagttcaccatcagcgagagctgtgaccgcatcaaggaggagttccagttcctgcaggcccagtaccacagcctgaagctggagtgtgagaagctggccagcgagaagacagagatgcagaggcactacgtgatgtactatgagatgtcctatggcctgaacatcgagatgcacaagcaggccgagatcgtgaagaggctgaatgccatctgtgcccaggtgatccccttcctgagccaggagcaccagcagcaggtggtgcaggccgtggagcgggccaagcaggtgaccatggccgagctgaatgccatcatcggccagcagctgcaggcccagcacctgagccacggccacggcctgcctgtgcccctgaccccccaccccagcggcctgcagcccccagccatcccccccatcggcagcagcgctggcctgctggccctgagcagcgccctgggcggccagagccacctgcccatcaaggatgagaagaagcaccacgacaatgaccaccagcgggagcgggacaagctgaaccacaagagcctgagccccagcgccagcttcagaggagctgagaagcacaggaacagcgctgactacagcagcgagagcaagaagcagaagacagaggagaaggagattgctgcccgctacaatgagaagagcaccacccctgtgtccaagagcaacacccccacccccaggacagatgcccccaccccaggcagcaacagcaccccaggcctgcggcctgtgcctgggaagcccccaggagtggaccccctggccagcagcctgcggacccccatggctgtgccctgcccctaccccaccccatttggaattgtgccccatgctggcatgaatggagagctgaccagccctggggccgcctatgccggcctgcacaacatcagcccccagatgtctgctgctgctgctgctgctgctgctgctgctgcctacggccgcagccctgtggtgggctttgacccccaccaccacatgagggtgcctgccatcccccccaacctgaccggcatccctgggggcaagccagcctacagcttccacgtgtctgcagatggccagatgcagcctgtgcccttccccccagatgccctgattggccctggcatccccaggcatgcccggcagatcaacaccctgaaccacggggaggtggtgtgtgctgtgaccatcagcaaccccaccaggcatgtgtacacaggaggcaagggctgtgtgaaggtgtgggacatcagccaccctggcaacaagagccctgtgtcccagctggactgcctgaacagagacaactacatccgcagctgccgcctgctgcctgatggccgcaccctcatcgtgggcggggaggccagcaccctgagcatctgggacctggccgcccccaccccccgcatcaaggccgagctgaccagcagcgccccagcctgctacgccctggccatcagcccagacagcaaggtgtgcttcagctgctgcagtgatggcaacattgctgtgtgggacctgcacaaccagaccctggtgcggcagttccagggccacacagatggagccagctgcatcgacatcagcaatgatggcaccaagctgtggacaggaggcctggacaacacagtgcgctcctgggacctgcgggagggccggcagctgcagcagcacgacttcaccagccagatcttcagcctgggctactgccccaccggggagtggctggccgtgggcatggagaacagcaatgtggaggtgctgcacgtgaccaagccagacaagtaccagctgcacctgcacgagagctgtgtgctgagcctgaagtttgcccactgcggcaagtggtttgtgtccacaggcaaggacaacctgctgaatgcctggaggaccccctatggagccagcatcttccagagcaaggagagcagctctgtgctgagctgtgacatctctgtggatgacaagtacatcgtgacaggcagcggggacaagaaggccaccgtgtatgaggtgatctactag

SEQ ID NO: 17323 - DNA, 2322 bp, Artificial Sequence
  Description of Artificial Sequence: Synthetic coding sequence
atgatccgggacctgagcaagatgtacccccagaccaggcacccagccccccaccagcctgcccagcccttcaagttcaccatcagcgagagctgtgaccgcatcaaggaggagttccagttcctgcaggcccagtaccacagcctgaagctggagtgtgagaagctggccagcgagaagacagagatgcagaggcactacgtgatgtactatgagatgtcctatggcctgaacatcgagatgcacaagcaggccgagatcgtgaagaggctgaatgccatctgtgcccaggtgatccccttcctgagccaggagcaccagcagcaggtggtgcaggccgtggagcgggccaagcaggtgaccatggccgagctgaatgccatcatcggccagcagctgcaggcccagcacctgagccacggccacggcctgcctgtgcccctgaccccccaccccagcggcctgcagcccccagccatcccccccatcggcagcagcgctggcctgctggccctgagcagcgccctgggcggccagagccacctgcccatcaaggatgagaagaagcaccacgacaatgaccaccagagggaccgggacagcatcaagagcagctctgtgagccccagcgccagcttcagaggagctgagaagcacaggaacagcgctgactacagcagcgagagcaagaagcagaagacagaggagaaggagattgctgcccgctatgacagtgatggagagaagagtgatgacaacctggtggtggatgtgtccaatgaagaccccagcagcccccggggcagccctgcccacagcccccgggagaatggcctggacaagacccggctgctgaagaaggatgcccccatcagccctgccagcatcgccagcagcagcagcacccccagcagcaagagcaaggagctgagcctgaatgagaagagcaccacccctgtgtccaagagcaacacccccacccccaggacagatgcccccaccccaggcagcaacagcaccccaggcctgcggcctgtgcctgggaagcccccaggagtggaccccctggccagcagcctgcggacccccatggctgtgccctgcccctaccccacccccttcggcatcgtgccccacgccggcatgaatggagagctgaccagccctggagctgcctatgccggcctgcacaacatcagcccccagatgtctgctgctgctgctgctgctgctgctgctgctgcctacggccgcagccctgtggtgggctttgacccccaccaccacatgagggtgcctgccatcccccccaacctgaccggcatccctgggggcaagccagcctacagcttccacgtgtctgcagatggccagatgcagcctgtgcccttccccccagatgccctgattggccctggcatccccaggcatgcccggcagatcaacaccctgaaccacggggaggtggtgtgtgctgtgaccatcagcaaccccaccaggcatgtgtacacaggaggcaagggctgtgtgaaggtgtgggacatcagccaccctggcaacaagagccctgtgtcccagctggactgcctgaacagagacaactacatccgcagctgccgcctgctgcctgatggccgcaccctgattgtgggcggggaggccagcaccctgagcatctgggacctggccgcccccaccccccgcatcaaggccgagctgaccagcagcgccccagcctgctacgccctggccatcagcccagacagcaaggtgtgcttcagctgctgcagtgatggcaacattgctgtgtgggacctgcacaaccagaccctggtgcggcagttccagggccacacagatggagccagctgcatcgacatcagcaatgatggcaccaagctgtggacaggaggcctggacaacacagtgcgctcctgggacctgcgggagggccggcagctgcagcagcacgacttcaccagccagatcttcagcctgggctactgccccactggagagtggctggccgtgggcatggagaacagcaatgtggaggtgctgcacgtgaccaagccagacaagtaccagctgcacctgcacgagagctgtgtgctgagcctgaagtttgcccactgtgggaagtggtttgtgtccacaggcaaggacaacctgctgaatgcctggaggaccccctacggggccagcatcttccagagcaaggagagcagctctgtgctgagctgtgacatctctgtggatgacaagtacatcgtgactggaagtggggacaagaaggccaccgtgtatgaagtcatctactag

SEQ ID NO: 17324 - DNA, 642 bp, Artificial Sequence
  Description of Artificial Sequence: Synthetic coding sequence
atgatccgggacctgagcaagatgtacccccagaccaggcacccagccccccaccagcctgcccagcccttcaagttcaccatcagcgagagctgtgaccgcatcaaggaggagttccagttcctgcaggcccagtaccacagcctgaagctggagtgtgagaagctggccagcgagaagacagagatgcagaggcactacgtgatgtactatgagatgtcctatggcctgaacatcgagatgcacaagcaggccgagatcgtgaagaggctgaatgccatctgtgcccaggtgatccccttcctgagccaggagcaccagcagcaggtggtgcaggccgtggagcgggccaagcaggtgaccatggccgagctgaatgccatcattggagagaagaagaacaagagtgacaccccaggcagcctgaagcagcagcagctgcaggcccagcacctgagccacggccacggcctgcctgtgcccctgaccccccaccccagcggcctgcagcccccagccatcccccccatcggcagcagcgctggcctgctggccctgagcagcgccctgggcggccagagccacctgcccatcaaggatgagaagaagcaccacgacaatgaccaccagagaggagagtag

SEQ ID NO: 17325 - DNA, 849 bp, Artificial Sequence
  Description of Artificial Sequence: Synthetic coding sequence
atgtctgatgtggaggagaacaactttgagggccgggagagccgcagccagagcaagagccccaccggcaccccagcccgggtgaagtctgagagccgcagcggcagccgcagccccagccgggtgtccaagcacagcgagagccacagccgcagccgcagcaagagccgcagccgcagcagaagacacagccaccggcgctacaccaggagccgcagccacagccacagccacagaagaagaagccgcagccgcagctacaccccagagtacagaagaagaagaagccgcagccacagccccatgagcaacagaagaagacacacaggcagccgggccaacccagaccccaacacctgcctgggcgtgtttggcctgagcctgtacaccacagagcgggacctgcgggaggtgttcagccgctatggccccctgagcggcgtgaatgtggtgtatgaccagaggacaggccgcagccggggctttgcctttgtgtactttgaaagaattgatgacagcaaggaggccatggagcgggccaacggcatggagctggatggccgccgcatccgggtggactacagcatcaccaagagggcccacacccccaccccaggcatctacatgggccggcccacccacagcggcggcggcggcggcggcggcggcggcggcggcggcggcggcggcggcagaagaagagacagctactatgaccggggctatgaccggggctatgacagatatgaggactatgactaccgctacagaagaagaagccccagcccctactacagccgctaccgcagccgcagccgcagccgcagctacagcccccggcgctactag

SEQ ID NO: 17326 - DNA, 543 bp, Artificial Sequence
  Description of Artificial Sequence: Synthetic coding sequence
atgagcaacagaagaagacacacaggcagccgggccaacccagaccccaacacctgcctgggcgtgtttggcctgagcctgtacaccacagagcgggacctgcgggaggtgttcagccgctatggccccctgtctggagtgaatgtggtgtatgaccagaggacaggccgcagccggggctttgcctttgtgtactttgaaagaattgatgacagcaaggaggccatggagcgggccaacggcatggagctggatggaagacgcatccgggtggactacagcatcaccaagagggcccacacccccaccccaggcatctacatgggccggcccacccacagcggcggcggcggcggcggcggcggcggcggcggcggcggcggcggcggcagaagaagagacagctactatgaccggggctatgaccggggctatgacagatatgaagattatgactaccgctaccgccgcagccccagcccctactacagccgctaccgcagccgcagccgcagccgcagctacagcccccggcgctactag

SEQ ID NO: 17327 - DNA, 546 bp, Artificial Sequence
  Description of Artificial Sequence: Synthetic coding sequence
atgagcaacagaagaagacacacaggcagccgggccaacccagaccccaacacctgcctgggcgtgtttggcctgagcctgtacaccacagagcgggacctgcgggaggtgttcagccgctatggccccctgtctggagtgaatgtggtgtatgaccagaggacaggccgcagccggggctttgcctttgtgtactttgaaagaattgatgacagcaaggaggccatggagcgggccaacggcatggagctggatggaagacgcatccgggtggactacagcatcaccaagagggcccacacccccaccccaggcatctacatgggccggcccacccacagcggcggcggcggcggcggcggcggcggcggcggcggcggcggcggcggcagaagaagagacagctactatgaccggggctatgaccggggctatgacagatatgaagattatgactaccgctacagaagaagaagccccagcccctactacagccgctaccgcagccgcagccgcagccgcagctacagcccccggcgctactag

SEQ ID NO: 17328 - DNA, 2508 bp, Artificial Sequence
  Description of Artificial Sequence: Synthetic coding sequence
atggccgccagcgctgctgctgccagcgctgctgctgccagcgctgccagcggcagccctggccctggagagggcagcgctggaggagagaagaggagcacagcccccagcgctgctgccagcgccagcgccagcgctgctgccagcagccctgctgggggcggcgctgaggccctggagctgctggagcactgcggcgtgtgccgggagcggctgcggcctgagcgggagccccggctgctgccctgcctgcacagcgcctgcagcgcctgcctgggccctgctgccccagctgctgccaacagcagtggagatggaggagctgctggagatggcaccgtggtggactgccctgtgtgcaagcagcagtgcttcagcaaggacatcgtggagaactacttcatgagggacagcggcagcaaggccgccacagatgcccaggatgccaaccagtgctgcaccagctgtgaagataatgccccagccaccagctactgtgtggagtgcagcgagcccctgtgtgagacctgtgtggaggcccaccagagggtgaagtacaccaaggaccacacagtgcgcagcactggacctgccaagagcagagatggagagaggacagtgtactgcaatgtgcacaagcatgagcccctggtgctcttctgtgagagctgtgacaccctgacctgccgggactgccagctgaatgcccacaaggaccaccagtaccagttcctggaggatgctgtgaggaaccagaggaagctgctggccagcctggtgaagaggctgggggacaagcacgccaccctgcagaagagcaccaaggaggtgcgcagcagcatccggcaggtgtctgatgtgcagaagagggtgcaggtggatgtgaagatggccatcctgcagatcatgaaggagctgaacaagaggggccgggtgctggtgaatgatgcccagaaggtgacagagggccagcaggagcggctggagcggcagcactggaccatgaccaagatccagaagcaccaggagcacatcctgcgctttgcctcctgggccctggagagtgacaacaacacagccctgctgctgagcaagaagctgatctacttccagctgcaccgggccctgaagatgattgtggaccctgtggagccccacggggagatgaagttccagtgggacctgaatgcctggaccaagtctgctgaggccttcggcaagatcgtggccgagaggcctggcaccaacagcacaggccctgcccccatggccccaccccgggcccctggccccctgagcaagcagggcagcggcagcagccagcccatggaggtgcaggagggctacggctttggaagtggagatgacccctacagcagcgctgagccccacgtgtctggagtgaagaggagccgctctggagagggggaggtgtctggcctgatgaggaaggtgccccgggtgtccctggagcggctggacctggacctgacagctgacagccagccccctgtgttcaaggtgtttcctggcagcaccacagaggactacaacctgattgtcatcgagagaggagctgctgctgctgccaccggccagcccggcacagccccagctggcacccctggggccccacccctggccggcatggccatcgtgaaggaggaggagacagaggccgccatcggggccccacccacagccacagagggccctgagaccaagcctgtgctgatggccctggccgagggccctggagctgagggcccccggctggccagccccagcggcagcaccagcagcggcctggaggtggtggcccctgagggcaccagcgcccctgggggcggccctggcaccctggatgacagcgccaccatctgccgggtgtgccagaagccaggggacctggtgatgtgcaaccagtgtgagttctgcttccacctggactgccacctgcctgccctgcaggatgtgcctggagaggagtggagctgcagcctgtgccacgtgctgcctgacctgaaggaggaggatggcagcctgagcctggatggagctgacagcactggagtggtggccaagctgagccctgccaaccagaggaaatgtgagcgggtgctgctggccctcttctgccacgagccctgccggcccctgcaccagctggccacagacagcaccttcagcctggaccagcccggcggcaccctggacctgaccctcatccgggcccggctgcaggagaagctgagccccccctacagcagcccccaggagtttgcccaggatgtgggccgcatgttcaagcagttcaacaagctgacagaggacaaggcagatgtgcagagcatcatcggcctgcagcgcttctttgagaccaggatgaatgaggccttcggggacaccaagttctctgctgtgctggtggagcccccacccatgagcctgcccggggccggcctgagcagccaggagctgagcggcggccctggagatggcccctag

SEQ ID NO: 17329 - DNA, 2262 bp, Artificial Sequence
  Description of Artificial Sequence: Synthetic coding sequence
atggccgccagcgctgctgctgccagcgctgctgctgccagcgctgccagcggcagccctggccctggagagggcagcgctggaggagagaagaggagcacagcccccagcgctgctgccagcgccagcgccagcgctgctgccagcagccctgctgggggcggcgctgaggccctggagctgctggagcactgcggcgtgtgccgggagcggctgcggcctgagcgggagccccggctgctgccctgcctgcacagcgcctgcagcgcctgcctgggccctgctgccccagctgctgccaacagcagtggagatggaggagctgctggagatggcactggacctgccaagagcagagatggagagaggacagtgtactgcaatgtgcacaagcatgagcccctggtgctcttctgtgagagctgtgacaccctgacctgccgggactgccagctgaatgcccacaaggaccaccagtaccagttcctggaggatgctgtgaggaaccagaggaagctgctggccagcctggtgaagaggctgggggacaagcacgccaccctgcagaagagcaccaaggaggtgcgcagcagcatccggcaggtgtctgatgtgcagaagagggtgcaggtggatgtgaagatggccatcctgcagatcatgaaggagctgaacaagaggggccgggtgctggtgaatgatgcccagaaggtgacagagggccagcaggagcggctggagcggcagcactggaccatgaccaagatccagaagcaccaggagcacatcctgcgctttgcctcctgggccctggagagtgacaacaacacagccctgctgctgagcaagaagctgatctacttccagctgcaccgggccctgaagatgattgtggaccctgtggagccccacggggagatgaagttccagtgggacctgaatgcctggaccaagtctgctgaggccttcggcaagatcgtggccgagaggcctggcaccaacagcacaggccctgcccccatggccccaccccgggcccctggccccctgagcaagcagggcagcggcagcagccagcccatggaggtgcaggagggctacggctttggaagtggagatgacccctacagcagcgctgagccccacgtgtctggagtgaagaggagccgctctggagagggggaggtgtctggcctgatgaggaaggtgccccgggtgtccctggagcggctggacctggacctgacagctgacagccagccccctgtgttcaaggtgtttcctggcagcaccacagaggactacaacctgattgtcatcgagagaggagctgctgctgctgccaccggccagcccggcacagccccagctggcacccctggggccccacccctggccggcatggccatcgtgaaggaggaggagacagaggccgccatcggggccccacccacagccacagagggccctgagaccaagcctgtgctgatggccctggccgagggccctggagctgagggcccccggctggccagccccagcggcagcaccagcagcggcctggaggtggtggcccctgagggcaccagcgcccctgggggcggccctggcaccctggatgacagcgccaccatctgccgggtgtgccagaagccaggggacctggtgatgtgcaaccagtgtgagttctgcttccacctggactgccacctgcctgccctgcaggatgtgcctggagaggagtggagctgcagcctgtgccacgtgctgcctgacctgaaggaggaggatggcagcctgagcctggatggagctgacagcactggagtggtggccaagctgagccctgccaaccagaggaaatgtgagcgggtgctgctggccctcttctgccacgagccctgccggcccctgcaccagctggccacagacagcaccttcagcctggaccagcccggcggcaccctggacctgaccctcatccgggcccggctgcaggagaagctgagccccccctacagcagcccccaggagtttgcccaggatgtgggccgcatgttcaagcagttcaacaagctgacagaggacaaggcagatgtgcagagcatcatcggcctgcagcgcttctttgagaccaggatgaatgaggccttcggggacaccaagttctctgctgtgctggtggagcccccacccatgagcctgcccggggccggcctgagcagccaggagctgagcggcggccctggagatggcccctag

SEQ ID NO: 17330 - DNA, 1503 bp, Artificial Sequence
  Description of Artificial Sequence: Synthetic coding sequence
atggaggtgtccaccaaccccagcagcaacattgatcctggggactatgtggagatgaatgacagcatcacccacctgcccagcaaggtggtgatccaggacatcaccatggagctgcactgccccctgtgcaatgactggttccgggaccccctgatgctgagctgtggccacaacttctgtgaggcctgcatccaggacttctggaggctgcaggccaaggagaccttctgcccagagtgcaagatgctgtgccagtacaacaactgcaccttcaaccctgtgctggacaagctggtggagaagatcaagaagctgcccctgctgaagggccacccccagtgcccagagcacggggagaacctgaagctgttcagcaagccagatggcaagctgatctgcttccagtgcaaggatgcccggctgtctgtgggccagagcaaggagttcctgcagatcagtgatgctgtgcacttcttcacagaggagctggccatccagcagggccagctggagaccaccctgaaggagctgcagaccctgaggaacatgcagaaggaggccatcgccgcccacaaggagaacaagctgcacctgcagcagcacgtgtccatggagttcctgaagctgcaccagttcctgcacagcaaggagaaggacatcctgacagagctgcgggaggagggcaaggccctgaatgaggagatggagctgaacctgagccagctgcaggagcagtgcctgctggccaaggacatgctggtgtccatccaggccaagacagagcagcagaacagctttgacttcctgaaggacatcaccaccctgctgcacagcctggagcagggcatgaaggtgctggccacccgggagctgatcagcaggaagctgaacctgggccagtacaagggccccatccagtacatggtgtggagggagatgcaggacaccctgtgccccggcctgagccccctgaccctggaccccaagacagcccaccccaacctggtgctgagcaagagccagacctctgtgtggcatggagacatcaagaagatcatgccagatgatcctgagagatttgacagctctgtggccgtgctgggcagccggggcttcaccagcggcaagtggtactgggaggtggaggtggccaagaagaccaagtggacagtgggcgtggtgcgggagagcatcatcaggaagggcagctgccccctgaccccagagcagggcttctggctgctgcggctgaggaaccagacagacctgaaggccctggacctgcccagcttcagcctgaccctgaccaacaacctggacaaggtgggcatctacctggactatgaaggaggccagctgtccttctacaatgccaagaccatgacccacatctacaccttcagcaacaccttcatggagaagctgtacccctacttctgcccctgcctgaatgatggaggagagaacaaggagcccctgcacatcctgcacccccagtag

SEQ ID NO: 17331 - DNA, 1026 bp, Artificial Sequence
  Description of Artificial Sequence: Synthetic coding sequence
atggaggaggagctggccatccagcagggccagctggagaccaccctgaaggagctgcagaccctgaggaacatgcagaaggaggccatcgccgcccacaaggagaacaagctgcacctgcagcagcacgtgtccatggagttcctgaagctgcaccagttcctgcacagcaaggagaaggacatcctgacagagctgcgggaggagggcaaggccctgaatgaggagatggagctgaacctgagccagctgcaggagcagtgcctgctggccaaggacatgctggtgtccatccaggccaagacagagcagcagaacagctttgacttcctgaaggacatcaccaccctgctgcacagcctggagcagggcatgaaggtgctggccacccgggagctgatcagcaggaagctgaacctgggccagtacaagggccccatccagtacatggtgtggagggagatgcaggacaccctgtgccccggcctgagccccctgaccctggaccccaagacagcccaccccaacctggtgctgagcaagagccagacctctgtgtggcacggggacatcaagaagatcatgccagatgatcctgagagatttgacagctctgtggccgtgctgggcagccggggcttcaccagcggcaagtggtactgggaggtggaggtggccaagaagaccaagtggacagtgggcgtggtgcgggagagcatcatcaggaagggcagctgccccctgaccccagagcagggcttctggctgctgcggctgaggaaccagacagacctgaaggccctggacctgcccagcttcagcctgaccctgaccaacaacctggacaaggtgggcatctacctggactatgagggcggccagctgtccttctacaatgccaagaccatgacccacatctacaccttcagcaacaccttcatggagaagctgtacccctacttctgcccctgcctgaatgatggaggagagaacaaggagcccctgcacatcctgcacccccagtag

SEQ ID NO: 17332 - DNA, 891 bp, Artificial Sequence
  Description of Artificial Sequence: Synthetic coding sequence
atggagttcctgaagctgcaccagttcctgcacagcaaggagaaggacatcctgacagagctgcgggaggagggcaaggccctgaatgaggagatggagctgaacctgagccagctgcaggagcagtgcctgctggccaaggacatgctggtgtccatccaggccaagacagagcagcagaacagctttgacttcctgaaggacatcaccaccctgctgcacagcctggagcagggcatgaaggtgctggccacccgggagctgatcagcaggaagctgaacctgggccagtacaagggccccatccagtacatggtgtggagggagatgcaggacaccctgtgccccggcctgagccccctgaccctggaccccaagacagcccaccccaacctggtgctgagcaagagccagacctctgtgtggcatggagacatcaagaagatcatgccagatgatcctgagagatttgacagctctgtggccgtgctgggcagccggggcttcaccagcggcaagtggtactgggaggtggaggtggccaagaagaccaagtggacagtgggcgtggtgcgggagagcatcatcaggaagggcagctgccccctgaccccagagcagggcttctggctgctgcggctgaggaaccagacagacctgaaggccctggacctgcccagcttcagcctgaccctgaccaacaacctggacaaggtgggcatctacctggactatgaaggaggccagctgtccttctacaatgccaagaccatgacccacatctacaccttcagcaacaccttcatggagaagctgtacccctacttctgcccctgcctgaatgatggaggagagaacaaggagcccctgcacatcctgcacccccagtag

SEQ ID NO: 17333 - DNA, 840 bp, Artificial Sequence
  Description of Artificial Sequence: Synthetic coding sequence
atggagttcctgaagctgcaccagttcctgcacagcaaggagaaggacatcctgacagagctgcgggaggagggcaaggccctgaatgaggagatggagctgaacctgagccagctgcaggagcagtgcctgctggccaaggacatgctggacatcaccaccctgctgcacagcctggagcagggcatgaaggtgctggccacccgggagctgatcagcaggaagctgaacctgggccagtacaagggccccatccagtacatggtgtggagggagatgcaggacaccctgtgccccggcctgagccccctgaccctggaccccaagacagcccaccccaacctggtgctgagcaagagccagacctctgtgtggcacggggacatcaagaagatcatgccagatgatcctgagagatttgacagctctgtggccgtgctgggcagccggggcttcaccagcggcaagtggtactgggaggtggaggtggccaagaagaccaagtggacagtgggcgtggtgcgggagagcatcatcaggaagggcagctgccccctgaccccagagcagggcttctggctgctgcggctgaggaaccagacagacctgaaggccctggacctgcccagcttcagcctgaccctgaccaacaacctggacaaggtgggcatctacctggactatgagggcggccagctgtccttctacaatgccaagaccatgacccacatctacaccttcagcaacaccttcatggagaagctgtacccctacttctgcccctgcctgaatgatggaggagagaacaaggagcccctgcacatcctgcacccccagtag

SEQ ID NO: 17334 - DNA, 1503 bp, Artificial Sequence; identical to SEQ ID NO: 17330
  Description of Artificial Sequence: Synthetic coding sequence

SEQ ID NO: 17335 - DNA, 891 bp, Artificial Sequence; identical to SEQ ID NO: 17332
  Description of Artificial Sequence: Synthetic coding sequence

SEQ ID NO: 17336 - DNA, 1494 bp, Artificial Sequence
  Description of Artificial Sequence: Synthetic coding sequence
atggagggcagcggggagcagcccggcccccagccccagcaccctggggaccaccgcatcagagatggagactttgtggtgctgaagagagaagatgtgttcaaggctgtgcaggtgcagaggaggaagaaggtgacctttgagaagcagtggttctacctggacaacgtcatcggccacagctatggaacagcctttgaggtgaccagcggcggcagcctgcagcccaagaagaagcgggaggagcccacagctgagaccaaggaggccggcacagacaacagaaatattgtggatgatggcaagagccagaagctgacccaggatgacatcaaggccctgaaggacaagggcatcaagggggaggagatcgtgcagcagctgattgagaacagcaccaccttccgggacaagacagaatttgcccaggacaagtacatcaagaagaagaagaagaagtatgaggccatcatcaccgtggtgaagcccagcacccgcatcctgagcatcatgtactatgcccgggagcccgggaagatcaaccacatgagatatgacaccctggcccagatgctgaccctgggcaacatccgggccggcaacaagatgattgtgatggagacctgtgccggcctggtgctgggcgccatgatggagaggatgggcggcttcggcagcatcatccagctgtacccaggcggcggccctgtgcgggccgccacagcctgcttcggcttccccaagagcttcctgagcggcctgtatgagttccccctgaacaaggtggacagcctgctgcacggcaccttcagcgccaagatgctgagcagcgagcccaaggacagcgccctggtggaggagagcaatggcaccctggaggagaagcaggccagcgagcaggagaatgaagattccatggccgaggcccctgagagcaaccaccctgaggaccaggagaccatggagaccatcagccaggaccctgagcacaagggccccaaggagcggggcagcaagaaggactacatccaggagaagcagaggcggcaggaggagcagaggaagaggcacctggaggccgccgccctgctgtctgaaagaaatgctgatggcctgattgtggccagccgcttccaccccacccccctgctgctgagcctgctggactttgtggcccccagccggccctttgtggtgtactgccagtacaaggagcccctgctggagtgctacaccaagctgcgggagcggggcggcgtcatcaacctgcggctgtctgagacctggctgaggaactaccaggtgctgcctgacaggagccaccccaagctgctgatgtctgggggcggcggctacctgctgagcggcttcaccgtggccatggacaacctgaaggctgacaccagcctgaagagcaatgccagcaccctggagagccatgaaacagaggagcctgctgccaagaagaggaaatgtcctgagagtgacagctag

SEQ ID NO: 17337 - DNA, 984 bp, Artificial Sequence
  Description of Artificial Sequence: Synthetic coding sequence
atgtactatgcccgggagcccgggaagatcaaccacatgagatatgacaccctggcccagatgctgaccctgggcaacatccgggccggcaacaagatgattgtgatggagacctgtgccggcctggtgctgggcgccatgatggagaggatgggcggcttcggcagcatcatccagctgtacccaggcggcggccctgtgcgggccgccacagcctgcttcggcttccccaagagcttcctgagcggcctgtatgagttccccctgaacaaggtggacagcctgctgcacggcaccttcagcgccaagatgctgagcagcgagcccaaggacagcgccctggtggaggagagcaatggcaccctggaggagaagcaggccagcgagcaggagaatgaagattccatggccgaggcccctgagagcaaccaccctgaggaccaggagaccatggagaccatcagccaggaccctgagcacaagggccccaaggagcggggcagcaagaaggactacatccaggagaagcagaggcggcaggaggagcagaggaagaggcacctggaggccgccgccctgctgtctgaaagaaatgctgatggcctgattgtggccagccgcttccaccccacccccctgctgctgagcctgctggactttgtggcccccagccggccctttgtggtgtactgccagtacaaggagcccctgctggagtgctacaccaagctgcgggagcggggcggcgtcatcaacctgcggctgtctgagacctggctgaggaactaccaggtgctgcctgacaggagccaccccaagctgctgatgtctgggggcggcggctacctgctgagcggcttcaccgtggccatggacaacctgaaggctgacaccagcctgaagagcaatgccagcaccctggagagccatgaaacagaggagcctgctgccaagaagaggaaatgtcctgagagtgacagctag

SEQ ID NO: 17338 - DNA, 963 bp, Artificial Sequence
  Description of Artificial Sequence: Synthetic coding sequence
atgagctttgtggcctatgaggagctgatcaaggagggggacacagccatcctgagcctgggccacggggccatggtggccgtgcgggtgcagagaggagcccagacccagaccaggcatggagtgctgcggcacagcgtggacctgattggccggcccttcggcagcaaggtgacctgtggccggggcggctgggtgtatgtgctgcaccccaccccagagctgtggaccctgaacctgccccacaggacccagatcctgtacagcacagacatcgccctgatcaccatgatgctggagctgcggcccggctctgtggtgtgtgagagcggcaccggcagcggctctgtgtcccatgccatcatccgcaccatcgcccccaccggccacctgcacacagtggagttccaccagcagagagctgagaaggcccgggaggagttccaggagcaccgggtgggccgctgggtgacagtgaggacccaggatgtgtgccgcagcggctttggagtgagccacgtggctgatgctgtgttcctggacatccccagcccctgggaggccgtgggccacgcctgggatgccctgaaggtggagggcggccgcttctgcagcttcagcccctgcatcgagcaggtgcagaggacctgccaggccctggccgcccggggcttcagcgagctgagcaccctggaggtgctgccccaggtgtacaacgtgaggacagtgtccctgcccccaccagacctgggcaccggcacagatggccctgctggcagtgacaccagccccttccgcagcggcacccccatgaaggaggccgtgggccacacaggctacctgaccctggcccgctcctggggcgagctgacccagaacccctgcccagccctgcccagcgcccggcggcccggccagcccaggaaccagggcggggaccctgccctgtggcccccaggatag

SEQ ID NO: 17339 - DNA, 870 bp, Artificial Sequence
  Description of Artificial Sequence: Synthetic coding sequence
atgagctttgtggcctatgaggagctgatcaaggagggggacacagccatcctgagcctgggccacggggccatggtggccgtgcgggtgcagagaggagcccagacccagaccaggcatggagtgctgcggcacagcgtggacctgattggccggcccttcggcagcaaggtgacctgtggccggggcggctgggtgtatgtgctgcaccccaccccagagctgtggaccctgaacctgccccacaggacccagatcctgtacagcacagacatcgccctgatcaccatgatgctggagctgcggcccggctctgtggtgtgtgagagcggcaccggcagcggctctgtgtcccatgccatcatccgcaccatcgcccccaccggccacctgcacacagtggagttccaccagcagagagctgagaaggcccgggaggagttccaggagcaccgggtgggccgctgggtgacagtgaggacccaggatgtgtgccgcagcggctttggagtgagccacgtggctgatgctgtgttcctggacatccccagcccctgggaggccgtgggccacgcctgggatgccctgaaggtggagggcggccgcttctgcagcttcagcccctgcatcgagcaggtgcagaggacctgccaggccctggccgcccggggcttcagcgagctgagcaccctggaggtgctgccccaggtgtacaacgtgaggacagtgtccctgcccccaccagacctgggcaccggcacagatggccctgctggcagtgacaccagccccttccgcagcggcacccccatgaaggaggccgtgggccacacaggctacctgacctttgccaccaagaccccaggatag

SEQ ID NO: 17340 - DNA, 1245 bp, Artificial Sequence
  Description of Artificial Sequence: Synthetic coding sequence
atgagcggcctggatggcggcaacaagctgcccctggcccagacaggaggcctggccgccccagaccacgccagcggggaccctgaccgggaccagtgccagggcctgcgggaggagacagaggccacccaggtgatggccaacacaggaggcggcagcctggagaccgtggccgagggcggggccagccaggaccctgtggactgtggccctgccctgcgggtgcctgtggccggcagccggggcggggccgccaccaaggccggccaggaggatgccccacccagcaccaagggcctggaggccgccagcgctgctgaggccgctgacagcagccagaagaatggctgccagctgggggagccccggggccctgctggccagaaggccctggaggcctgtggggccggcggcctgggcagccagatgatccctgggaagaaggccaaggaggtgaccaccaagaagagggccatctctgctgctgtggagaaggagggggaggccggggccgccatggaggagaagaaggtggtgcagaaggagaagaaggtggccggcggcgtgaaggaggagacccggccccgggcccccaagatcaacaactgcatggacagcctggaggccatcgaccaggagctgagcaatgtgaatgcccaggccgaccgggccttcctgcagctggagaggaagtttggccgcatgaggcggctgcacatgcagaggaggagcttcatcatccagaacatccctggcttctgggtgacagccttcaggaaccacccccagctgagccccatgatcagcggccaggatgaggacatgctgcgctacatgatcaacctggaggtggaggagctgaagcacccccgggccggctgcaagttcaagttcatcttccagggcaacccctacttcagaaatgaaggcctggtgaaggagtatgaaagaagaagcagcggccgggtggtgtccctgagcacccccatccgctggcaccggggccaggacccccaggcccacatccacaggaaccgggagggcaacaccatccccagcttcttcaactggttcagtgaccacagcctgctggagtttgacagaattgctgagatcatcaagggggagctgtggcccaaccccctgcagtactacctgatgggagagggcccccggcggggcatccggggccccccccggcagcctgtggagagcgcccggagcttccgcttccagagcggctag

SEQ ID NO: 17341 - DNA, 1254 bp, Artificial Sequence
  Description of Artificial Sequence: Synthetic coding sequence
atgagcggccgcagccggggcaggaagagcagccgggccaagaacagaggcaagggccgggccaaggcccgggtgcggcctgccccagatgatgccccccgggaccctgaccccagccagtaccagagcctgggggaggacacccaggccgcccaggtgcaggccggggccggctggggcggcctggaggccgccgccagcgcccagctgctgcggctgggggaggaggccgcctgccgcctgcccctggactgtggcctggccctgcgggcccgggccgccggggaccacggccaggccgccgcccggcccggccctgggaaggccgccagcctgtctgagcggctggccgctgacacagtgtttgtgggcacagctggcaccgtgggccggcccaagaatgccccccgggtgggcaacagaagaggccctgctgggaagaaggcccctgagacctgcagcacagctggccggggcccccaggtgattgctgggggccggcagaagaagggagctgctggggagaacacctctgtgtctgctggggaggagaagaaggaggagagagatgctggcagcggccccccagccacagagggctccatggacaccctggagaatgtgcagctgaagctggagaacatgaatgcccaggccgaccgggcctacctgcggctgagcaggaagtttggccagctgcggctgcagcacctggagaggaggaaccacctgatccagaacatccctggcttctggggccaggccttccagaaccacccccagctggccagcttcctgaacagccaggagaaggaggtgctgagctacctgaacagcctggaggtggaggagctgggcctggcccggctgggctacaagatcaagttctactttgacaggaacccctacttccagaacaaggtgctgatcaaggagtatggctgcggccccagcggccaggtggtgagccgcagcacccccatccagtggctgcccggccatgacctgcagagcctgagccagggcaaccctgagaacaacagaagcttcttcggctggttcagcaaccacagcagcattgaaagtgacaagatcgtggagatcatcaatgaggagctgtggcccaaccccctgcagttctacctgctgtctgagggcgcccgggtggagaagggcaaggagaaggagggccggcagggccctgggaagcagcccatggagaccacccagcccggggtgtcccagagcaactag

SEQ ID NO: 17342 - DNA, 1233 bp, Artificial Sequence
  Description of Artificial Sequence: Synthetic coding sequence
atgagcctgcctgagagcccccacagccctgccaccctggactatgccctggaggacccccaccagggccagaggagccgggagaagagcaaggccacagaggtgatggctgacatgtttgatggccgcctggagcccatcgtgttccccccaccccggctgcctgaggagggcgtggccccccaggaccctgcagatggcggccacaccttccacatcctggtggatgctggccgcagccatggagccatcaaggccggccaggaggtgaccccacctcctgctgagggcctggaggccgccagcgccagcctgaccacagatggcagcctgaagaatggcttccctggagaggagacccacggcctgggcggggagaaggccctggagacctgtggggccggccgctctgagagcgaggtgattgctgagggcaaggccgaggatgtgaagccagaggagtgtgccatgttttctgcccctgtggatgagaagccaggaggagaggagatggatgtggccgaggagaacagagccattgatgaggtgaaccgggaggccggccctggccctggccctggccccctgaatgtgggcctgcacctgaaccccctggagagcatccagctggagctggacagcgtgaatgctgaggccgaccgggccctgctgcaggtggagcggcgcttcggccagatccacgagtactacctggagcagagaaatgacatcatccggaacatccctggcttctgggtgacagccttccgccaccacccccagctgagcgccatgatccggggccaggatgctgagatgctgagctacctgaccaacctggaggtgaaggagctgcggcaccccaggacaggctgcaagttcaagttcttcttccagaggaacccctacttcaggaacaagctgattgtgaaggtgtatgaggtgcgcagctttggccaggtggtgtccttcagcaccctcatcatgtggaggcggggccacggcccccagagcttcatccacaggaacagacatgtgatctgcagcttcttcacctggttcagtgaccacagcctgcctgagagtgacagaattgcccagatcatcaaggaggacctgtggagcaaccccctgcagtactacctgctgggagaagatgcccaccgggcccggcggcggctggtgcgggagcctgtggagatcccccggcccttcggcttccagtgtggctag

SEQ ID NO: 17343 - DNA, 2415 bp, Artificial Sequence
  Description of Artificial Sequence: Synthetic coding sequence
atggccgcccaccggcccggccccctgaagcagcagaacaaggcccacaagggcggccgccaccggggccggggcagcgcccagagagatggcaagggccgcctggccctgaagaccctgagcaagaaggtgaggaaggagctgagccgggtggaccagaggcaccgggccagccagctgaggaagcagaagaaggaggccgtgctggccgagaagaggcagctgggcggcaaggatggccccccccaccaggtgctggtggtgcccctgcacagccgcatcagcctgcctgaggccatgcagctgctgcaggaccgggacaccggcaccgtgcacctgaatgagctgggcaacacccagaacttcatgctgctgtgcccccggctgaagcaccgctggttcttcaccagcgcccggcctggggacctgcacgtggtgctggacatggccaaggtggccgacaccatcctcttcctgctggaccccctggagggctgggacagcactggagactactgcctgagctgcctgtttgcccagggcctgcccacctacaccctggccgtgcagggcatcagcggcctgcccctgaagaagcagattgacaccaggaagaagctgagcaaggctgtggagaagcgcttcccccatgacaagctgctgctgctggacacccagcaggaggccggcatgctgctgcggcagctggccaaccagaagcagcagcacctggccttccgggacagaagagcctacctgtttgcccatgctgtggactttgtgcccagcgaggagaacaacctggtgggcaccctgaagatcagcggctacgtgcggggccagaccctgaatgtgaaccggctgctgcacatcgtgggctacggggacttccagatgaagcagattgatgcccctggggaccccttccccctgaacccccggggcatcaagccccagaaggaccctgacatggccatggagatctgtgccacagatgctgtggatgacatggaggagggcctgaaggtgctgatgaaggctgaccccggccggcaggagagcctgcaggccgaggtgatcccagaccccatggagggggagcagacctggcccacagaggaggagctgtctgaggccaaggacttcctgaaggagagcagcaaggtggtgaagaaggtgcccaagggcaccagcagctaccaggccgagtggatcctggatggcggcagccagagcggcggggagggagatgaatatgaatatgatgacatggagcacgaggacttcatggaggaggagagccaggatgagagcagcgaggaggaggaggagtatgagaccatgaccatcggggagagcgtgcatgatgacctgtatgacaagaaggtggatgaggaggccgaggccaagatgctggagaagtacaagcaggagcggctggaggagatgtttcctgatgaggtggacaccccaagagatgtggccgcccgcatccgcttccagaagtaccggggcctgaagagcttccgcaccagcccctgggaccccaaggagaacctgccccaggactatgcccgcatcttccagttccagaacttcaccaacaccaggaagagcatcttcaaggaggtggaggagaaggaggtggagggcgctgaggtgggctggtacgtgaccctgcacgtgtctgaggtgcctgtgtctgtggtggagtgcttccggcagggcacccccctcatcgccttcagcctgctgccccatgagcagaagatgtctgtgctgaacatggtggtgagaagagaccccggcaacacagagcctgtgaaggccaaggaggagctgatcttccactgcggcttccgccgcttccgggccagccccctcttcagccagcacacagctgctgacaagcacaagctgcagcgcttcctgacagctgacatggccctggtggccaccgtgtatgcccccatcaccttccccccagcctctgtgctgctcttcaagcagaagagcaatggcatgcacagcctgattgccaccggccacctgatgtctgtggaccctgacaggatggtgatcaagagggtggtgctgagcggccaccccttcaagatcttcaccaagatggctgtggtgcgctacatgttcttcaacagagaagatgtgctgtggttcaagcctgtggagctgcggaccaagtggggcagaagaggccacatcaaggagcccctgggcacccacggccacatgaagtgcagctttgatggcaagctgaagagccaggacacagtgctgatgaacctgtacaagagggtcttccccaagtggacctatgacccctacgtgcctgagcctgtgccctggctgaagtctgagatcagcagcacagtgccccagggcggcatggagtag

SEQ ID NO: 17344 - DNA, 57 bp, Artificial Sequence
  Description of Artificial Sequence: Synthetic coding sequence
tgcaagcagagctgtgtgtccatcgccagctgtgaggccgctgagctgaacctgtag

SEQ ID NO: 17345 - DNA, 2319 bp, Artificial Sequence
  Description of Artificial Sequence: Synthetic coding sequence
atgaaccggctgagaaatgccaagatctacgtggagagagctgtgaagcagaagaagatcttcaccatccagggctgctaccctgtgatccgctgcctgctgcggcggcggggctgggtggagaagaagatggtgcacaggagcggccccaccctgctgcccccccagaaggacctggacagcagcgccatgggagacagcgacaccacagaagatgaagatgaagatgaagatgaggagttccagcccagccagctgtttgattttgatgacctgctgaagtttgatgacctggatggcacccacgccctgatggtgggcctgtgcctgaacctgaggaacctgccctggtttgatgaggtggatgccaacagcttcttcccccgctgctactgcctgggcgcagaagatgacaagaaggccttcatcgaggacttctggctgacagctgccagaaatgtgctgaagctggtggtgaagtctgagtggaagagctaccccatccaggccgtggaggaggaggccagcggggacaagcagcccaagaagcaggagaagaaccctgtgctggtgtccccagagtttgtggatgaggccctgtgtgcctgtgaggagtacctgagcaacctggcccacatggacatcgacaaggacctggaggcccccctgtacctgaccccagagggctggagcctcttcctgcagcgctactaccaggtggtgcatgagggcgctgagctgcggcacctggacacccaggtgcagagatgtgaggacatcctgcagcagctgcaggccgtggtgccccagattgacatggagggggacaggaacatctggatcgtgaagccaggggccaagagccggggccggggcatcatgtgcatggaccacctggaggagatgctgaagctggtgaatggaaatcctgtggtgatgaaggatggcaagtgggtggtgcagaagtacatcgagcggcccctgctgatcttcggcaccaagtttgacctgcggcagtggttcctggtgacagactggaaccccctgactgtgtggttctacagagacagctacatccgcttcagcacccagcccttcagcctgaagaacctggacaacagcgtgcacctgtgcaacaacagcatccagaagcacctggagaacagctgccaccgccaccccctgctgcccccagacaacatgtggagcagccagcgcttccaggcccacctgcaggagatgggcgccccaaatgcctggagcaccatcatcgtgcccggcatgaaggatgctgtgatccacgccctgcagaccagccaggacacagtgcagtgcaggaaggccagctttgagctgtatggagctgactttgtgtttggagaggacttccagccctggctgattgagatcaatgccagccccaccatggcccccagcacagctgtgacagcccggctgtgtgccggcgtgcaggccgacaccctgcgggtggtgattgacaggatgctggacaggaactgtgacacaggagcctttgagctgatctacaagcagcctgctgtggaggtgccccagtatgtgggcatccggctgctggtggagggcttcaccatcaagaagcccatggccatgtgccacaggaggatgggcgtgcggcctgctgtgcccctgctgacccagaggggcagcggggaggcccggcaccacttccccagcctgcacaccaaggcccagctgcccagcccccacgtgctgcggcaccagggccaggtgctgcggcggcagcacagcaagctggtgggcaccaaggccctgagcaccaccgggaaggccctgcggaccctgcccacagccaaggtgttcatcagcctgccccccaacctggacttcaaggtggcccccagcatcctgaagcccaggaaggccccagccctgctgtgcctgcggggcccccagctggaggtgccctgctgcctgtgccccctgaagtctgagcagttcctggcccctgtgggccgcagccggcccaaggccaacagcaggccagactgtgacaagcccagggctgaggcctgccccatgaagaggctgagccccctgaagcccctgcccctggtgggcaccttccagaggcggcggggcctgggggacatgaagctgggcaagcccctgctgcgcttccccacagccctggtgctggaccccacccccaacaagaagaagcaggtgaagtacctgggcctggacagcattgctgtgggcggcagccgggtggatggagcccggccctgcaccccaggcagcacagcccgggcctag

SEQ ID NO: 17346 - DNA, 723 bp, Artificial Sequence
  Description of Artificial Sequence: Synthetic coding sequence
atgttccagaggctgaacaagatgtttgtgggggaggtgagcagcagcagcaaccaggagcctgagttcaatgagaaggaggatgatgagtggatcctggtggacttcatcgacacctgcaccggcttctctgctgaggaggaggaggaggaggaggacatcagcgaggagagccccacagagcaccccagcgtcttcagctgcctgcctgccagcctggagtgcctggccgacaccagtgacagctgcttcctgcagtttgagagctgccccatggaggagagctggttcatcaccccaccaccctgcttcaccgctgggggcctgaccaccatcaaggtggagaccagccccatggagaacctgctgattgagcaccccagcatgtctgtgtatgctgtgcacaacagctgccccggcctgtctgaggccacccggggcacagatgagctgcacagccccagcagcccccgggtggaggcccagaatgagatgggccagcacatccactgctacgtggccgccctggccgcccacaccaccttcctggagcagcccaagagcttccggcccagccagtggatcaaggagcacagcgagcggcagcccctgaacagaaacagcctgcggcggcagaacctgacccgggactgccacccccggcaggtgaagcacaacggctgggtggtgcaccagccctgcccccggcagtacaactactag

SEQ ID NO: 17347 - DNA, 558 bp, Artificial Sequence
  Description of Artificial Sequence: Synthetic coding sequence
atgttccagaggctgaacaagatgtttgtgggggaggtgagcagcagcagcaaccaggagcctgagttcaatgagaaggaggatgatgagtggatcctggtggacttcatcgacacctgcaccggcttctctgctgaggaggaggaggaggaggaggacatcagcgaggagagccccacagagcaccccagcgtcttcagctgcctgcctgccagcctggagtgcctggccgacaccagtgacagctgcttcctgcagtttgagagctgccccatggaggagagctggttcatcaccccaccaccctgcttcaccgctgggggcctgaccaccatcaaggtggagaccagccccatggagaacctgctgattgagcaccccagcatgtctgtgtatgctgtgcacaacagctgccccggcctgtctgaggccacccggggcacagatgagctgcacagccccagcagcccccgctacagccaggactgccacccccggcaggtgaagcacaacggctgggtggtgcaccagccctgcccccggcagtacaactactag

SEQ ID NO: 17348 - DNA, 495 bp, Artificial Sequence
  Description of Artificial Sequence: Synthetic coding sequence
atgttccagaggctgaacaagatgtttgtgggggaggtgagcagcagcagcaaccaggagcctgagttcaatgagaaggaggatgatgagtggatcctggtggacttcatcgacacctgcaccggcttctctgctgaggaggaggaggaggaggaggacatcagcgaggagagccccacagagcaccccagcgtcttcagctgcctgcctgccagcctggagtgcctggccgacaccagtgacagctgcttcctgcagtttgagagctgccccatggaggagagctggttcatcaccccaccaccctgcttcaccgctgggggcctgaccaccatcaaggtggagaccagccccatggagaacctgctgattgagcaccccagcatgtctgtgtatgctgtgcacaacagctgccccggcctgtctgaggccacccggggcacagatgagctgcacagccccagcagcccccgggccaggaagagctgcctgtag

SEQ ID NO: 17349 - DNA, 663 bp, Artificial Sequence
  Description of Artificial Sequence: Synthetic coding sequence
atgttccagaggctgagcagcctcttcttcagcacccccagccccccagaagatcctgactgcccccgggcctttgtgtctgaagaagatgaggtggatggctggctgatcatcgacctgcctgacagctatgctgccccacccagccctggggccgccccagccccagctggccggcccccaccagcccccagcctgatggatgagagctggtttgtgaccccaccagcctgcttcaccgctgagggccctggcctgggccctgcccggctgcagagcagccccctggaggacctgctgattgagcaccccagcatgtctgtgtatgtgacaggcagcaccatcgtgctggagcccggcagccccagccccctgcctgatgctgccctgcctgatggagacctgtctgagggggagctgaccccagcccggcgggagcccagggctgcccggcatgctgcccccctgcctgcccgggccgccctgctggagaaggccggccaggtgcggcggctgcagagggcccggcagagagctgagagacatgccctgagcgccaaggctgtgcagaggcagaacagagcccgggagagccggcccaggaggagcaagaaccagagcagcttcatctaccagccctgccagaggcagttcaactactag

SEQ ID NO: 17350 - DNA, 663 bp, Artificial Sequence; identical to SEQ ID NO: 17349
  Description of Artificial Sequence: Synthetic coding sequence

SEQ ID NO: 17351 - DNA, 234 bp, Artificial Sequence
  Description of Artificial Sequence: Synthetic coding sequence
atgttccagaggctgagcagcctcttcttcagcacccccagccccccagaagatcctgactgcccccgggcctttgtgtctgaagaagatgaggtggatggctggctgatcatcgacctgcctgacagctatgctgccccacccagccctggggccgccccagccccagctggccggcccccaccagcccccagcctgatggatgagagctggtttgtgaccccaccagcctag

SEQ ID NO: 17352 - DNA, 267 bp, Artificial Sequence
  Description of Artificial Sequence: Synthetic coding sequence
atgttccagaggctgagcagcctcttcttcagcacccccagccccccagaagatcctgactgcccccgggcctttgtgtctgaagaagatgaggtggatggctggctgatcatcgacctgcctgagggccctggcctgggccctgcccggctgcagagcagccccctggaggacctgctgattgagcaccccagcatgtctgtgtatgtgacaggcagcaccatcgtgctggagcccggcagccccagccccctgcctgatgcctag

SEQ ID NO: 17353 - DNA, 915 bp, Artificial Sequence
  Description of Artificial Sequence: Synthetic coding sequence
atggccacctggaagagcccctgcttcctgtactgcctcttcatcctgggcccccggctgaccggccagaacaacagcgtggacctgaccaatgaggagaccacagacagcaccaccagcaagatcagccccagcgaggacacccagcaggagaatggctccatgttcagcctcatcacctggaacattgatggcctggacctgaacaacctgtctgagcgggcccggggcgtgtgcagctacctggccctgtacagcccagatgtgatcttcctgcaggaggtgattcctccctactacagctacctgaagaagaggagcagcaactatgagatcatcaccggccacgaggagggctacttcaccgccatcatgctgaagaagagccgggtgaagctgaagagccaggagatcatccccttccccagcaccaagatgatgaggaacctgctgtgtgtgcacgtgaatgtgtctggaaatgagctgtgcctgatgaccagccacctggagagcacccggggccacgccgctgagaggatgaaccagctgaagatggtgctgaagaagatgcaggaggcccctgagagcgccaccgtcatctttgctggggacaccaacctgcgggaccgggaggtgacccgctgtggcggcctgcccaacaacatcgtggatgtgtgggagttcctgggcaagcccaagcactgccagtacacctgggacacccagatgaacagcaacctgggcatcacagctgcctgcaagctgcgctttgaccgcatcttcttccgggctgctgctgaggagggccacatcatccccaggagcctggacctgctgggcctggagaagctggactgtggccgcttccccagcgaccactggggcctgctgtgcaacctggacatcatcctgtag

SEQ ID NO: 17354 - DNA, 1089 bp, Artificial Sequence
  Description of Artificial Sequence: Synthetic coding sequence
atggagctgggcagctgcctggagggcggccgggaggccgctgaggaggagggggagcctgaggtgaagaagaggcggctgctgtgtgtggagtttgcctctgtggccagctgtgatgctgctgtggcccagtgcttcctggctgaaaatgactgggagatggagcgggccctgaacagctactttgagccccctgtggaggagagcgccctggagaggaggcctgagaccatcagcgagcccaagacctacgtggacctgaccaatgaggagaccacagacagcaccaccagcaagatcagccccagcgaggacacccagcaggagaatggctccatgttcagcctcatcacctggaacattgatggcctggacctgaacaacctgtctgagcgggcccggggcgtgtgcagctacctggccctgtacagcccagatgtgatcttcctgcaggaggtgattcctccctactacagctacctgaagaagaggagcagcaactatgagatcatcaccggccacgaggagggctacttcaccgccatcatgctgaagaagagccgggtgaagctgaagagccaggagatcatccccttccccagcaccaagatgatgaggaacctgctgtgtgtgcacgtgaatgtgtctggaaatgagctgtgcctgatgaccagccacctggagagcacccggggccacgccgctgagaggatgaaccagctgaagatggtgctgaagaagatgcaggaggcccctgagagcgccaccgtcatctttgctggggacaccaacctgcgggaccgggaggtgacccgctgtggcggcctgcccaacaacatcgtggatgtgtgggagttcctgggcaagcccaagcactgccagtacacctgggacacccagatgaacagcaacctgggcatcacagctgcctgcaagctgcgctttgaccgcatcttcttccgggctgctgctgaggagggccacatcatccccaggagcctggacctgctgggcctggagaagctggactgtggccgcttccccagcgaccactggggcctgctgtgcaacctggacatcatcctgtag

SEQ ID NO: 17355 - DNA, 855 bp, Artificial Sequence
  Description of Artificial Sequence: Synthetic coding sequence
atggagctgggcagctgcctggagggcggccgggaggccgctgaggaggagggggagcctgaggtgaagaagaggcggctgctgtgtgtggagtttgcctctgtggccagctgtgatgctgctgtggcccagtgcttcctggctgaaaatgactgggagatggagcgggccctgaacagctactttgagccctacagcccagatgtgatcttcctgcaggaggtgattcctccctactacagctacctgaagaagaggagcagcaactatgagatcatcaccggccacgaggagggctacttcaccgccatcatgctgaagaagagccgggtgaagctgaagagccaggagatcatccccttccccagcaccaagatgatgaggaacctgctgtgtgtgcacgtgaatgtgtctggaaatgagctgtgcctgatgaccagccacctggagagcacccggggccacgccgctgagaggatgaaccagctgaagatggtgctgaagaagatgcaggaggcccctgagagcgccaccgtcatctttgctggggacaccaacctgcgggaccgggaggtgacccgctgtggcggcctgcccaacaacatcgtggatgtgtgggagttcctgggcaagcccaagcactgccagtacacctgggacacccagatgaacagcaacctgggcatcacagctgcctgcaagctgcgctttgaccgcatcttcttccgggctgctgctgaggagggccacatcatccccaggagcctggacctgctgggcctggagaagctggactgtggccgcttccccagcgaccactggggcctgctgtgcaacctggacatcatcctgtag

SEQ ID NO: 17356 - DNA, 1179 bp, Artificial Sequence
  Description of Artificial Sequence: Synthetic coding sequence
atgagggagagacatgacacaggagcctgtgccgagccccgggtgggcctgctcttccggctgaagggccgctgccggggcggcaggaagatggagctgggcagctgcctggagggcggccgggaggccgctgaggaggagggggagcctgaggtgaagaagaggcggctgctgtgtgtggagtttgcctctgtggccagctgtgatgctgctgtggcccagtgcttcctggctgaaaatgactgggagatggagcgggccctgaacagctactttgagccccctgtggaggagagcgccctggagaggaggcctgagaccatcagcgagcccaagacctacgtggacctgaccaatgaggagaccacagacagcaccaccagcaagatcagccccagcgaggacacccagcaggagaatggctccatgttcagcctcatcacctggaacattgatggcctggacctgaacaacctgtctgagcgggcccggggcgtgtgcagctacctggccctgtacagcccagatgtgatcttcctgcaggaggtgattcctccctactacagctacctgaagaagaggagcagcaactatgagatcatcaccggccacgaggagggctacttcaccgccatcatgctgaagaagagccgggtgaagctgaagagccaggagatcatccccttccccagcaccaagatgatgaggaacctgctgtgtgtgcacgtgaatgtgtctggaaatgagctgtgcctgatgaccagccacctggagagcacccggggccacgccgctgagaggatgaaccagctgaagatggtgctgaagaagatgcaggaggcccctgagagcgccaccgtcatctttgctggggacaccaacctgcgggaccgggaggtgacccgctgtggcggcctgcccaacaacatcgtggatgtgtgggagttcctgggcaagcccaagcactgccagtacacctgggacacccagatgaacagcaacctgggcatcacagctgcctgcaagctgcgctttgaccgcatcttcttccgggctgctgctgaggagggccacatcatccccaggagcctggacctgctgggcctggagaagctggactgtggccgcttccccagcgaccactggggcctgctgtgcaacctggacatcatcctgtag

SEQ ID NO: 17357 - DNA, 1428 bp, Artificial Sequence
  Description of Artificial Sequence: Synthetic coding sequence
atgtctgactttgatgaatttgagcggcagctgaatgaaaacaagcaggagcgggacaaggaaaatagacacaggaagaggagccacagccgcagccgcagccgggacaggaagagaagaagccgcagccgggacagaagaaacagagaccagaggtctgccagccgggacagaagaagaagaagcaagcccctgaccaggggggccaaggaggagcacggcggcctcatccgcagccccaggcatgagaagaagaagaaggtgaggaagtactgggatgtgcccccacctggctttgagcacatcacccccatgcagtacaaggccatgcaggccgccggccagatcccagccacagccctgctgcccaccatgaccccagatggcctggccgtgacccccacccctgtgcctgtggtgggcagccagatgacccggcaggcccggcggctgtatgtgggcaacatccccttcggcatcacagaggaggccatgatggacttcttcaatgcccagatgaggctgggcggcctgacccaggcccctggcaaccctgtgctggccgtgcagatcaaccaggacaagaactttgccttcctggagttccgctctgtggatgagaccacccaggccatggcctttgatggcatcatcttccagggccagagcctgaagatcagaagacctcatgactaccagcccctgcccggcatgtctgagaaccccagcgtgtatgtgcctggggtggtgtccacagtggtgcctgattctgcccacaagctgttcatcggcggcctgcccaactacctgaatgatgaccaggtgaaggagctgctgaccagctttggccccctgaaggccttcaacctggtgaaggacagcgccaccggcctgagcaagggctacgccttctgtgaatatgtggacatcaacgtgacagaccaggccatcgccggcctgaatggcatgcagctgggggacaagaagctgctggtgcagagggcctctgtgggcgccaagaatgccaccctggtgtccccacccagcaccatcaaccagacccctgtgaccctgcaggtgcccggcctgatgagcagccaggtgcagatgggcggccaccccacagaggtgctgtgcctgatgaacatggtgctgcctgaggagctgctggatgatgaggagtatgaggagatcgtggaggatgtgagagatgaatgttccaaatatggcctggtgaagagcattgagatccccaggcctgtggatggagtggaggtgcccggctgcggcaagatctttgtggagttcacctctgtgtttgactgccagaaggccatgcagggcctgaccggcaggaagtttgccaacagagtggtggtgaccaagtactgtgaccctgacagctaccacagaagagacttctggtag

SEQ ID NO: 17358 - DNA, 3090 bp, Artificial Sequence
  Description of Artificial Sequence: Synthetic coding sequence
atggctgacaagacccctgggggcagccagaaggccagcagcaagaccaggagcagtgatgtgcacagcagcggcagcagtgatgcccacatggatgccagcggccccagcgacagcgacatgcccagcaggacccggcccaagagccccaggaagcacaactacagaaatgaaagtgcccgggagagcctgtgtgacagcccccaccagaacctgagccggcccctgctggagaacaagctgaaggccttcagcatcggcaagatgagcacagccaagaggaccctgagcaagaaggagcaggaggagctgaagaagaaggaggatgagaaggctgctgctgagatctatgaggagttcctggccgcctttgagggcagtgatggcaacaaggtgaagacctttgtgcggggcggcgtggtgaatgctgccaaggaggagcacgagacagatgagaagaggggcaagatctacaagcccagcagcagatttgctgaccagaagaacccccccaaccagagcagcaatgaaagaccacccagcctgctggtgattgagaccaagaagccacccctgaagaagggggagaaggagaagaagaagagcaacctggagctgttcaaggaggagctgaagcagatccaggaggagagagatgagcggcacaagaccaagggccgcctgagcagatttgagcccccccagagcgacagtgatggccagaggaggtccatggatgcccccagcagaagaaacagaagcagtggagtgctggatgattatgcccctggcagccatgatgtgggggaccccagcaccaccaacctgtacctgggcaacatcaacccccagatgaatgaggagatgctgtgccaggagtttggccgcttcggccccctggcctctgtgaagatcatgtggcccaggacagatgaggagcgggcccgggagaggaactgtggctttgtggccttcatgaacagaagagatgctgagcgggccctgaagaacctgaatggcaagatgatcatgagctttgagatgaagctgggctggggcaaggctgtgcccatccccccccaccccatctacatcccccccagcatgatggagcacaccctgcccccacctccttctggcctgcccttcaatgcccagccccgggagcggctgaagaaccccaatgcccccatgctgcccccacccaagaacaaggaggactttgagaagaccctgagccaggccatcgtgaaggtggtgatccccacagaaagaaacctgctggccctgatccacaggatgattgaatttgtggtgcgggagggccccatgtttgaggccatgatcatgaaccgggagatcaacaaccccatgttccgcttcctgtttgagaaccagaccccagcccacgtgtactaccgctggaagctgtacagcatcctgcagggcgacagccccaccaagtggaggacagaggacttcaggatgttcaagaatggcagcttctggaggcccccacccctgaacccctacctgcacggcatgtctgaggagcaggagacagaggcctttgtggaggagcccagcaagaagggggccctgaaggaggagcagagggacaagctggaggagatcctgcggggcctgacccccaggaagaatgacattggagatgccatggtgttctgcctgaacaatgctgaggccgctgaggagatcgtggactgcatcacagagagcctgagcatcctgaagacccccctgcccaagaagatcgcccggctgtacctggtgtctgatgtgctgtacaacagcagcgccaaggtggccaatgccagctactacaggaagttctttgagaccaagctgtgccagatcttcagtgacctgaatgccacctaccgcaccatccagggccacctgcagagcgagaacttcaagcagagggtgatgacctgcttccgggcctgggaggactgggccatctacccagagcccttcctgatcaagctgcagaacatcttcctgggcctggtgaacatcatcgaggagaaggagacagaagatgtgcctgatgacctggatggagcccccatcgaggaggagctggatggagcccccctggaggatgtggatggcatccccattgatgccacccccattgatgacctggatggagtgcccatcaagagcctggatgatgacctggatggagtgcccctggatgccacagaggacagcaagaagaatgagcccatcttcaaggtggcccccagcaagtgggaggccgtggatgaaagtgagctggaggcccaggccgtgaccaccagcaagtgggagctgtttgaccagcacgaggagagcgaggaggaggagaaccagaaccaggaggaggagagtgaagatgaggaggacacccagagcagcaagtctgaggagcaccacctgtacagcaaccccatcaaggaggagatgacagagagcaagttcagcaagtacagcgagatgtctgaggagaagagggccaagctgcgggagattgagctgaaggtgatgaagttccaggatgagctggagagcggcaagaggcccaagaagccaggccagagcttccaggagcaggtggagcactacagagacaagctgctgcagcgggagaaggagaaggagctggagcgggagcgggagcgggacaagaaggacaaggagaagctggagagccgcagcaaggacaagaaggagaaggatgaatgtacccccaccaggaaggagaggaagagaagacacagcaccagccccagccccagccgcagcagcagcggccggcgggtgaagagccccagccccaagtctgagaggtctgagaggtctgagaggagccacaaggagagcagccgcagccgcagcagccacaaggacagccccagagatgtgtccaagaaggccaagaggagccccagcggcagcaggacccccaagaggagccgccgcagccgcagccgcagccccaagaagagcggcaagaagagccgcagccagagccgcagcccccacaggagccacaagaagagcaagaagaacaagcactag

SEQ ID NO: 17359 - DNA, 1863 bp, Artificial Sequence
  Description of Artificial Sequence: Synthetic coding sequence
atgctgctgtgctaccgccacctgaagaccaagaggatcctgcggaggaacctgctggccctgatccacaggatgattgaatttgtggtgcgggagggccccatgtttgaggccatgatcatgaaccgggagatcaacaaccccatgttccgcttcctgtttgagaaccagaccccagcccacgtgtactaccgctggaagctgtacagcatcctgcagggcgacagccccaccaagtggaggacagaggacttcaggatgttcaagaatggcagcttctggaggcccccacccctgaacccctacctgcacggcatgtctgaggagcaggagacagaggcctttgtggaggagcccagcaagaagggggccctgaaggaggagcagagggacaagctggaggagatcctgcggggcctgacccccaggaagaatgacattggagatgccatggtgttctgcctgaacaatgctgaggccgctgaggagatcgtggactgcatcacagagagcctgagcatcctgaagacccccctgcccaagaagatcgcccggctgtacctggtgtctgatgtgctgtacaacagcagcgccaaggtggccaatgccagctactacaggaagttctttgagaccaagctgtgccagatcttcagtgacctgaatgccacctaccgcaccatccagggccacctgcagagcgagaacttcaagcagagggtgatgacctgcttccgggcctgggaggactgggccatctacccagagcccttcctgatcaagctgcagaacatcttcctgggcctggtgaacatcatcgaggagaaggagacagaagatgtgcctgatgacctggatggagcccccatcgaggaggagctggatggagcccccctggaggatgtggatggcatccccattgatgccacccccattgatgacctggatggagtgcccatcaagagcctggatgatgacctggatggagtgcccctggatgccacagaggacagcaagaagaatgagcccatcttcaaggtggcccccagcaagtgggaggccgtggatgagagcgagctggaggcccaggccgtgaccaccagcaagtgggagctgtttgaccagcacgaggagagcgaggaggaggagaaccagaaccaggaggaggagagtgaagatgaggaggacacccagagcagcaagtctgaggagcaccacctgtacagcaaccccatcaaggaggagatgacagagagcaagttcagcaagtacagcgagatgtctgaggagaagagggccaagctgcgggagattgagctgaaggtgatgaagttccaggatgagctggagagcggcaagaggcccaagaagccaggccagagcttccaggagcaggtggagcactacagagacaagctgctgcagcgggagaaggagaaggagctggagcgggagcgggagcgggacaagaaggacaaggagaagctggagagccgcagcaaggacaagaaggagaaggatgagtgcacccccaccaggaaggagaggaagaggaggcacagcaccagccccagccccagccgcagcagcagtggaagaagagtgaagagccccagccccaagtctgagaggtctgagaggtctgagaggagccacaaggagagcagccgcagccgcagcagccacaaggacagccccagagatgtgtccaagaaggccaagaggagccccagcggcagcaggacccccaagaggagcagaagaagccgcagccgcagccccaagaagagcggcaagaagagccgcagccagagccgcagcccccacaggagccacaagaagagcaagaagaacaagcactag

SEQ ID NO: 17360 - DNA, 3090 bp, Artificial Sequence; identical to SEQ ID NO: 17358
  Description of Artificial Sequence: Synthetic coding sequence

SEQ ID NO: 17361 - DNA, 3087 bp, Artificial Sequence
  Description of Artificial Sequence: Synthetic coding sequence
atggctgacaagacccctgggggcagccagaaggccagcagcaagaccaggagcagtgatgtgcacagcagcggcagcagtgatgcccacatggatgccagcggccccagcgacagcgacatgcccagcaggacccggcccaagagccccaggaagcacaactacagaaatgaaagtgcccgggagagcctgtgtgacagcccccaccagaacctgagccggcccctgctggagaacaagctgaaggccttcagcatcggcaagatgagcacagccaagaggaccctgagcaagaaggagcaggaggagctgaagaagaaggaggatgagaaggctgctgctgagatctatgaggagttcctggccgcctttgagggcagtgatggcaacaaggtgaagacctttgtgcggggcggcgtggtgaatgctgccaaggaggagcacgagacagatgagaagaggggcaagatctacaagcccagcagcagatttgctgaccagaagaacccccccaaccagagcagcaatgaaagaccacccagcctgctggtgattgagaccaagaagccacccctgaagaagggggagaaggagaagaagaagagcaacctggagctgttcaaggaggagctgaagcagatccaggaggagagagatgagcggcacaagaccaagggccgcctgagcagatttgagcccccccagagcgacagtgatggccagaggaggtccatggatgcccccagcagaagaaacagaagctctgtgctggatgattatgcccctggcagccatgatgtgggggaccccagcaccaccaacctgtacctgggcaacatcaacccccagatgaatgaggagatgctgtgccaggagtttggccgcttcggccccctggcctctgtgaagatcatgtggcccaggacagatgaggagcgggcccgggagaggaactgtggctttgtggccttcatgaacagaagagatgctgagcgggccctgaagaacctgaatggcaagatgatcatgagctttgagatgaagctgggctggggcaaggctgtgcccatccccccccaccccatctacatccccccatccatgatggagcacaccctgcccccaccacccagcggcctgcccttcaatgcccagccccgggagcggctgaagaaccccaatgcccccatgctgcccccacccaagaacaaggaggactttgagaagaccctgagccaggccatcgtgaaggtggtgatccccacagagaggaacctgctggccctgatccacaggatgattgaatttgtggtgcgggagggccccatgtttgaggccatgatcatgaaccgggagatcaacaaccccatgttccgcttcctgtttgagaaccagaccccagcccacgtgtactaccgctggaagctgtacagcatcctgcaggccaacagccccaccaagtggaggacagaggacttcaggatgttcaagaatggcagcttctggaggcccccacccctgaacccctacctgcacggcatgtctgaggagcaggagacagaggcctttgtggaggagcccagcaagaagggggccctgaaggaggagcagagggacaagctggaggagatcctgcggggcctgacccccaggaagaatgacattggagatgccatggtgttctgcctgaacaatgctgaggccgctgaggagatcgtggactgcatcacagagagcctgagcatcctgaagacccccctgcccaagaagatcgcccggctgtacctggtgtctgatgtgctgtacaacagcagcgccaaggtggccaatgccagctactacaggaagttctttgagaccaagctgtgccagatcttcagtgacctgaatgccacctaccgcaccatccagggccacctgcagagcgagaacttcaagcagagggtgatgacctgcttccgggcctgggaggactgggccatctacccagagcccttcctgatcaagctgcagaacatcttcctgggcctggtgaacatcatcgaggagaaggagacagaagatgtgcctgatgacctggatggagcccccatcgaggaggagctggatggagcccccctggaggatgtggatggcatccccattgatgccacccccattgatgacctggatggagtgcccatcaagagcctggatgatgacctggatggagtgcccctggatgccacagaggacagcaagaagaatgagcccatcttcaaggtggcccccagcaagtgggaggccgtggatgagagcgagctggaggcccaggccgtgaccaccagcaagtgggagctgtttgaccagcacgaggagagcgaggaggaggagaaccagaaccaggaggaggagagtgaagatgaggaggacacccagagcagcaagtctgaggagcaccacctgtacagcaaccccatcaaggaggagatgacagagagcaagttcagcaagtacagcgagatgtctgaggagaagagggccaagctgcgggagattgagctgaaggtgatgaagttccaggatgagctggagagcggcaagaggcccaagaagccaggccagagcttccaggagcaggtggagcactacagagacaagctgctgcagcgggagaaggagaaggagctggagcgggagcgggagcgggacaagaaggacaaggagaagctggagagccgcagcaaggacaagaaggagaaggatgagtgcacccccaccaggaaggagaggaagaggaggcacagcaccagccccagccccagccgcagcagcagtggaagaagagtgaagagccccagccccaagtctgagaggtctgagaggtctgagaggagccacaaggagagcagccgcagccgcagcagccacaaggacagccccagagatgtgtccaagaaggccaagaggagccccagcggcagcaggacccccaagaggagcagaagaagccgcagccgcagccccaagaagagcggcaagaagagccgcagccagagccgcagcccccacaggagccacaagaagagcaagaagaacaagcactag

SEQ ID NO: 17362 - DNA, 486 bp, Artificial Sequence
  Description of Artificial Sequence: Synthetic coding sequence
atggctgacaagacccctgggggcagccagaaggccagcagcaagaccaggagcagtgatgtgcacagcagcggcagcagtgatgcccacatggatgccagcggccccagcgacagcgacatgcccagcaggacccggcccaagagccccaggaagcacaactacagaaatgaaagtgcccgggagagcctgtgtgacagcccccaccagaacctgagccggcccctgctggagaacaagctgaaggccttcagcatcggcaagatgagcacagccaagaggaccctgagcaagaaggagcaggaggagctgaagaagaaggaggatgagaaggctgctgctgagatctatgaggagttcctggccgcctttgagggcagtgatggcaacaaggtgaagacctttgtgcggggcggcgtggtgaatgctgccaaggaggagcacgagacagatgagaagaggggcaagatctacaagcccagctag

SEQ ID NO: 17363 - DNA, 3237 bp, Artificial Sequence
  Description of Artificial Sequence: Synthetic coding sequence
atgatgacctctgtgggcaccaacagagcccggggcaactgggagcagccccagaaccagaaccagacccagcacaagcagaggccccaggccacagctgagcagatccggctggcccagatgatcagtgaccacaatgatgctgactttgaggagaaggtgaagcagctgattgacatcaccgggaagaaccaggatgaatgtgtgattgccctgcatgactgcaatggagatgtgaacagagccatcaacgtgctgctggagggcaacccagacacccacagctgggagatggtgggcaagaagaagggcgtgtctggccagaaggatggcggccagacagagagcaatgaggagggcaaggagaacagagaccgggaccgggactacagcagaagaagaggaggccccccaagaagaggccgcggggccagccggggccgggagtgcatgcacggggccctgagcaagccagctgtggtgcggggccaggagaatggcctggatggcaccaagagcggcggccccagcggccggggcacagagcggggcagaagaggccggggccggggccggggcggcagcggcagaagaggaggccgcttcagcgcccagggcatgggcaccttcaacccagctgactatgcagagcccgccaacacagatgacaactacggcaacagcagcggcaacacctggaacaacacaggccactttgagccagatgatggcaccagcgcctggaggacagccacagaggagtggggcacagaggactggaatgaagacctgtctgagaccaagatcttcaccgccagcaatgtgtcctctgtgcccctgcctgcagaaaatgtgaccatcacagctggccagagaattgacctggccgtgctgctgggcaagacccccagcaccatggagaatgacagcagcaacctggaccccagccaggcccccagcctggcccagcccctggtgttcagcaacagcaagcagacagccatcagccagcctgccagcggcaacaccttcagccaccacagcatggtgtccatgctgggcaaaggatttggagatgtgggggaggccaagggcggcagcaccaccggcagccagttcctggagcagttcaagacagcccaggccctggcccagctggccgcccagcacagccagagcggcagcaccaccaccagctcctgggacatgggcagcaccacccagagccccagcctggtgcagtatgacctgaagaaccccagcgacagcgctgtgcacagccccttcaccaagaggcaggccttcacccccagcagcaccatgatggaggtgttcctgcaggagaagagccctgctgtggccaccagcacagctgcccctcctccacccagcagccccctgcccagcaagagcaccagcgccccccagatgagccctggcagcagtgacaaccagagcagcagcccccagcctgcccagcagaagctgaagcagcagaagaagaaggccagcctgaccagcaagatcccagccctggccgtggagatgcctggcagcgctgacatcagcggcctgaacctgcagtttggagccctgcagtttggcagcgagcctgtgctgagtgactatgagagcacccccaccaccagcgccagcagcagccaggcccccagcagcctgtacaccagcacagccagcgagagcagcagcaccatcagcagcaaccagagccaggagagcggctaccagagcggccccatccagagcaccacctacaccagccagaacaatgcccagggccccctgtatgagcagaggagcacccagacccggcgctaccccagcagcatcagcagcagcccccagaaggacctgacccaggccaagaatggcttcagctctgtgcaggccacccagctgcagaccacccagagcgtggagggcgccaccggcagcgctgtgaagagtgacagccccagcaccagcagcatcccccccctgaatgagaccgtgtctgctgccagcctgctgaccaccaccaaccagcacagcagcagcctgggcggcctgagccacagcgaggagatccccaacaccaccaccacccagcacagcagcaccctgagcacccagcagaacaccctgagcagcagcaccagcagcggccgcaccagcaccagcaccctgctgcacacctctgtggagagcgaggccaacctgcacagcagcagcagcaccttcagcaccaccagcagcacagtgtctgcccctcctcctgtggtgtctgtgagcagcagcctgaacagcggcagcagcctgggcctgagcctgggcagcaacagcacagtgacagccagcaccaggagctctgtggccaccaccagcggcaaggccccacccaacctgcccccaggagtgccccccctgctgcccaacccctacatcatggcccctggcctgctgcacgcctacccaccccaggtgtatggctatgatgacctgcagatgctgcagacccgcttccccctggactactacagcatccccttccccacccccaccacccccctgaccggcagagatggcagcctggccagcaacccctacagcggggacctgaccaagtttggaagaggagatgccagcagccctgccccagccaccaccctggcccagccccagcagaaccagacccagacccaccacaccacccagcagaccttcctgaacccagccctgcccccaggctacagctacaccagcctgccctactacacaggagtgcccggcctgcccagcaccttccagtatggccctgctgtgtttcctgtggcccccaccagcagcaagcagcacggcgtgaatgtgtctgtgaatgccagcgccacccccttccagcagcccagcggctacggcagccacggctacaacacaggagtgtctgtgaccagcagcaacacaggagtgcctgacatcagcggctctgtgtacagcaagacccagagctttgagaagcagggcttccacagcggcaccccagctgccagcttcaacctgcccagcgccctgggcagcggcggccccatcaacccagccacagctgctgcctaccccccagcccccttcatgcacatcctgaccccccaccagcagccccacagccagatcctgcaccaccacctgcagcaggacggccaggacatcctgaactttgtggatgaccagctgggggagtag

SEQ ID NO: 17364 - DNA, 2952 bp, Artificial Sequence
  Description of Artificial Sequence: Synthetic coding sequence
atgatgacctctgtgggcaccaacagagcccggggcaactgggagcagccccagaaccagaaccagacccagcacaagcagaggccccaggccacagctgagcagatccggctggcccagatgatcagtgaccacaatgatgctgactttgaggagaaggtgaagcagctgattgacatcaccgggaagaaccaggatgaatgtgtgattgccctgcatgactgcaatggagatgtgaacagagccatcaacgtgctgctggagggcaacccagacacccacagctgggagatggtgggcaagaagaagggcgtgtctggccagaaggatggcggccagacagagagcaatgaggagggcaaggagaacagagaccgggaccgggactacagcagaagaagaggaggccccccaagaagaggccgcggggccagccggggccgggagttccggggccaggagaatggcctggatggcaccaagagcggcggccccagcggccggggcacagagcggggccggcggggccggggccggggccggggcggcagcggccggcggggcggccgcttcagcgcccagggcatgggcaccttcaacccagctgactatgcagagcccgccaacacagatgacaactacggcaacagcagcggcaacacctggaacaacacaggccactttgagccagatgatggcaccagcgcctggaggacagccacagaggagtggggcacagaggactggaatgaagacctgtctgagaccaagatcttcaccgccagcaatgtgtcctctgtgcccctgcctgcagaaaatgtgaccatcacagctggccagagaattgacctggccgtgctgctgggcaagacccccagcaccatggagaatgacagcagcaacctggaccccagccaggcccccagcctggcccagcccctggtgttcagcaacagcaagcagacagccatcagccagcctgccagcggcaacaccttcagccaccacagcatggtgtccatgctgggcaagggctttggagatgtgggggaggccaagggcggcagcaccaccggcagccagttcctggagcagttcaagacagcccaggccctggcccagctggccgcccagcacagccagagcggcagcaccaccaccagctcctgggacatgggcagcaccacccagagccccagcctggtgcagtatgacctgaagaaccccagcgacagcgctgtgcacagccccttcaccaagaggcaggccttcacccccagcagcaccatgatggaggtgttcctgcaggagaagagccctgctgtggccaccagcacagctgcccctcctccacccagcagccccctgcccagcaagagcaccagcgccccccagatgagccctggcagcagtgacaaccagagcagcagcccccagcctgcccagcagaagctgaagcagcagaagaagaaggccagcctgaccagcaagatcccagccctggccgtggagatgcctggcagcgctgacatcagcggcctgaacctgcagtttggagccctgcagtttggaagtgagcctgtgctgagtgactatgagagcacccccaccaccagcgccagcagcagccaggcccccagcagcctgtacaccagcacagccagcgagagcagcagcaccatcagcagcaaccagagccaggagagcggctaccagagcggccccatccagagcaccacctacaccagccagaacaatgcccagggccccctgtatgagcagaggagcacccagacccggcgctaccccagcagcatcagcagcagcccccagaaggacctgacccaggccaagaatggcttcagctctgtgcaggccacccagctgcagaccacccagagcgtggagggcgccactggatctgctgtgaagagtgacagccccagcaccagcagcatcccccccctgaatgaaacagtgtctgctgccagcctgctgaccaccaccaaccagcacagcagcagcctgggcggcctgagccacagcgaggagatccccaacaccaccaccacccagcacagcagcaccctgagcacccagcagaacaccctgagcagcagcaccagcagcggccgcaccagcaccagcaccctgctgcacacctctgtggagagcgaggccaacctgcacagcagcagcagcaccttcagcaccaccagcagcacagtgtctgcccctcctcctgtggtgtctgtgagcagcagcctgaacagcggcagcagcctgggcctgagcctgggcagcaacagcacagtgacagccagcaccaggagctctgtggccaccaccagcggcaaggccccacccaacctgcccccaggagtgccccccctgctgcccaacccctacatcatggcccctggcctgctgcacgcctacccaccccaggtgtatggctatgatgacctgcagatgctgcagacccgcttccccctggactactacagcatccccttccccacccccaccacccccctgaccggcagagatggcagcctggccagcaacccctacagcggggacctgaccaagtttggaagaggagatgccagcagccctgccccagccaccaccctggcccagccccagcagaaccagacccagacccaccacaccacccagcagaccttcctgaacccagccctgcccccaggctacagctacaccagcctgccctactacacaggagtgcccggcctgcccagcaccttccagtatggccctgctgtgtttcctgtggcccccaccagcagcaagcagcacggcgtgaatgtgtctgtgaatgccagcgccacccccttccagcagcccagcggctacggcagccacggctacaacacaggcaggaagtaccccccaccctacaagcacttctggacagctgagagctag

SEQ ID NO: 17365 - DNA, 3264 bp, Artificial Sequence
  Description of Artificial Sequence: Synthetic coding sequence
atgatgacctctgtgggcaccaacagagcccggggcaactgggagcagccccagaaccagaaccagacccagcacaagcagaggccccaggccacagctgagcagatccggctggcccagatgatcagtgaccacaatgatgctgactttgaggagaaggtgaagcagctgattgacatcaccgggaagaaccaggatgaatgtgtgattgccctgcatgactgcaatggagatgtgaacagagccatcaacgtgctgctggagggcaacccagacacccacagctgggagatggtgggcaagaagaagggcgtgtctggccagaaggatggcggccagacagagagcaatgaggagggcaaggagaacagagaccgggaccgggactacagcagaagaagaggaggccccccaagaagaggccgcggggccagccggggccgggagttccggggccaggagaatggcctggatggcaccaagagcggcggccccagcggccggggcacagagcggggccggcggggccggggccggggccggggcggcagcggccggcggggcggccgcttcagcgcccagggcatgggcaccttcaacccagctgactatgcagagcccgccaacacagatgacaactacggcaacagcagcggcaacacctggaacaacacaggccactttgagccagatgatggcaccagcgcctggaggacagccacagaggagtggggcacagaggactggaatgaagacctgtctgagaccaagatcttcaccgccagcaatgtgtcctctgtgcccctgcctgcagaaaatgtgaccatcacagctggccagagaattgacctggccgtgctgctgggcaagacccccagcaccatggagaatgacagcagcaacctggaccccagccaggcccccagcctggcccagcccctggtgttcagcaacagcaagcagacagccatcagccagcctgccagcggcaacaccttcagccaccacagcatggtgtccatgctgggcaagggctttggagatgtgggggaggccaagggcggcagcaccaccggcagccagttcctggagcagttcaagacagcccaggccctggcccagctggccgcccagcacagccagagcggcagcaccaccaccagctcctgggacatgggcagcaccacccagagccccagcctggtgcagtatgacctgaagaaccccagcgacagcgctgtgcacagccccttcaccaagaggcaggccttcacccccagcagcaccatgatggaggtgttcctgcaggagaagagccctgctgtggccaccagcacagctgcccctcctccacccagcagccccctgcccagcaagagcaccagcgccccccagatgagccctggcagcagtgacaaccagagcagcagcccccagcctgcccagcagaagctgaagcagcagaagaagaaggccagcctgaccagcaagatcccagccctggccgtggagatgcctggcagcgctgacatcagcggcctgaacctgcagtttggagccctgcagtttggaagtgagcctgtgctgagtgactatgagagcacccccaccaccagcgccagcagcagccaggcccccagcagcctgtacaccagcacagccagcgagagcagcagcaccatcagcagcaaccagagccaggagagcggctaccagagcggccccatccagagcaccacctacaccagccagaacaatgcccagggccccctgtatgagcagaggagcacccagacccggcgctaccccagcagcatcagcagcagcccccagaaggacctgacccaggccaagaatggcttcagctctgtgcaggccacccagctgcagaccacccagagcgtggagggcgccactggatctgctgtgaagagtgacagccccagcaccagcagcatcccccccctgaatgaaacagtgtctgctgccagcctgctgaccaccaccaaccagcacagcagcagcctgggcggcctgagccacagcgaggagatccccaacaccaccaccacccagcacagcagcaccctgagcacccagcagaacaccctgagcagcagcaccagcagcggccgcaccagcaccagcaccctgctgcacacctctgtggagagcgaggccaacctgcacagcagcagcagcaccttcagcaccaccagcagcacagtgtctgcccctcctcctgtggtgtctgtgagcagcagcctgaacagcggcagcagcctgggcctgagcctgggcagcaacagcacagtgacagccagcaccaggagctctgtggccaccaccagcggcaaggccccacccaacctgcccccaggagtgccccccctgctgcccaacccctacatcatggcccctggcctgctgcacgcctacccaccccaggtgtatggctatgatgacctgcagatgctgcagacccgcttccccctggactactacagcatccccttccccacccccaccacccccctgaccggcagagatggcagcctggccagcaacccctacagcggggacctgaccaagtttggaagaggagatgccagcagccctgccccagccaccaccctggcccagccccagcagaaccagacccagacccaccacaccacccagcagaccttcctgaacccagccctgcccccaggctacagctacaccagcctgccctactacacaggagtgcccggcctgcccagcaccttccagtatggccctgctgtgtttcctgtggcccccaccagcagcaagcagcacggcgtgaatgtgtctgtgaatgccagcgccacccccttccagcagcccagcggctacggcagccacggctacaacacaggagtgtctgtgaccagcagcaacacaggagtgcctgacatcagcggctctgtgtacagcaagacccagcagagctttgagaagcagggcttccacagcggcaccccagctgccagcttcaacctgcccagcgccctgggcagcggcggccccatcaacccagccacagctgctgcctaccccccagcccccttcatgcacatcctgaccccccaccagcagccccacagccagatcctgcaccaccacctgcagcaggacggccagacaggcagcggccagaggagccagaccagcagcatcccccagaagccccagaccaacaagagcgcctacaacagctacagctggggcgccaactag

SEQ ID NO: 17366 - DNA, 1053 bp, Artificial Sequence
  Description of Artificial Sequence: Synthetic coding sequence
atgatgacctctgtgggcaccaacagagcccggggcaactgggagcagccccagaaccagaaccagacccagcacaagcagaggccccaggccacagctgagcagatccggctggcccagatgatcagtgaccacaatgatgctgactttgaggagaaggtgaagcagctgattgacatcaccgggaagaaccaggatgaatgtgtgattgccctgcatgactgcaatggagatgtgaacagagccatcaacgtgctgctggagggcaacccagacacccacagctgggagatggtgggcaagaagaagggcgtgtctggccagaaggatggcggccagacagagagcaatgaggagggcaaggagaacagagaccgggaccgggactacagcagaagaagaggaggccccccaagaagaggccgcggggccagccggggccgggagtgcatgcacggggccctgagcaagccagctgtggtgcggggccaggagaatggcctggatggcaccaagagcggcggccccagcggccggggcacagagcggggcagaagaggccggggccggggccggggcggcagcggcagaagaggaggccgcttcagcgcccagggcatgggcaccttcaacccagctgactatgcagagcccgccaacacagatgacaactacggcaacagcagcggcaacacctggaacaacacaggccactttgagccagatgatggcaccagcgcctggaggacagccacagaggagtggggcacagaggactggaatgaagacctgtctgagaccaagatcttcaccgccagcaatgtgtcctctgtgcccctgcctgcagaaaatgtgaccatcacagctggccagagaattgacctggccgtgctgctgggcaagacccccagcaccatggagaatgacagcagcaacctggaccccagccaggcccccagcctggcccagcccctggtgttcagcaacagcaagcagacagccatcagccagcctgccagcggcaacaccttcagccaccacagcatggtgtag

SEQ ID NO: 17367 - DNA, 843 bp, Artificial Sequence
  Description of Artificial Sequence: Synthetic coding sequence
atgatgacctctgtgggcaccaacagagcccggggcaactgggagcagccccagaaccagaaccagacccagcacaagcagaggccccaggccacagctgagcagatccggctggcccagatgatcagtgaccacaatgatgctgactttgaggagaaggtgaagcagctgattgacatcaccgggaagaaccaggatgaatgtgtgattgccctgcatgactgcaatggagatgtgaacagagccatcaacgtgctgctggagggcaacccagacacccacagctgggagatggtgggcaagaagaagggcgtgtctggccagaaggatggcggccagacagagagcaatgaggagggcaaggagaacagagaccgggaccgggactacagcagaagaagaggaggccccccaagaagaggccgcggggccagccggggccgggagttccggggccaggagaatggcctggatggcaccaagagcggcggccccagcggccggggcacagagcggggccggcggggccggggccggggccggggcggcagcggccggcggggcggccgcttcagcgcccagggcatgggcaccttcaacccagctgactatgcagagcccgccaacacagatgacaactacggcaacagcagcggcaacacctggaacaacacaggccactttgagccagatgatggcaccagcgcctggaggacagccacagaggagtggggcacagaggactggaatgaagacctgtctgagaccaagatcttcaccgccagcaatgtgtcctctgtgcccctgcctgcagaaaatgtgaccatcacagctggccagtag

SEQ ID NO: 17368 - DNA, 1152 bp, Artificial Sequence
  Description of Artificial Sequence: Synthetic coding sequence
tgagtggagagcgaggccaacctgcacagcagcagcagcaccttcagcaccaccagcagcacagtgtctgcccctcctcctgtggtgtctgtgagcagcagcctgaacagcggcagcagcctgggcctgagcctgggcagcaacagcacagtgacagccagcaccaggagctctgtggccaccaccagcggcaaggccccacccaacctgcccccaggagtgccccccctgctgcccaacccctacatcatggcccctggcctgctgcacgcctacccaccccaggtgtatggctatgatgacctgcagatgctgcagacccgcttccccctggactactacagcatccccttccccacccccaccacccccctgaccggcagagatggcagcctggccagcaacccctacagcggggacctgaccaagtttggaagaggagatgccagcagccctgccccagccaccaccctggcccagccccagcagaaccagacccagacccaccacaccacccagcagaccttcctgaacccagccctgcccccaggctacagctacaccagcctgccctactacacaggagtgcccggcctgcccagcaccttccagtatggccctgctgtgtttcctgtggcccccaccagcagcaagcagcacggcgtgaatgtgtctgtgaatgccagcgccacccccttccagcagcccagcggctacggcagccacggctacaacacaggagtgtctgtgaccagcagcaacacaggagtgcctgacatcagcggctctgtgtacagcaagacccagcagagctttgagaagcagggcttccacagcggcaccccagctgccagcttcaacctgcccagcgccctgggcagcggcggccccatcaacccagccacagctgctgcctaccccccagcccccttcatgcacatcctgaccccccaccagcagccccacagccagatcctgcaccaccacctgcagcaggacggccagctgccctacctgcagatgatcctgtgctgccagaggcagcaggaggagcagacaggcagcggccagaggagccagaccagcagcatcccccagaagccccagaccaacaagagcgcctacaacagctacagctggggcgccaactag

SEQ ID NO: 17369 - DNA, 3264 bp, Artificial Sequence; identical to SEQ ID NO: 17365
  Description of Artificial Sequence: Synthetic coding sequence

SEQ ID NO: 17370 - DNA, 1803 bp, Artificial Sequence
  Description of Artificial Sequence: Synthetic coding sequence
atgcctggcagcgctgacatcagcggcctgaacctgcagtttggagccctgcagtttggaagtgagcctgtgctgagtgactatgagagcacccccaccaccagcgccagcagcagccaggcccccagcagcctgtacaccagcacagccagcgagagcagcagcaccatcagcagcaaccagagccaggagagcggctaccagagcggccccatccagagcaccacctacaccagccagaacaatgcccagggccccctgtatgagcagaggagcacccagacccggcgctaccccagcagcatcagcagcagcccccagaaggacctgacccaggccaagaatggcttcagctctgtgcaggccacccagctgcagaccacccagagcgtggagggcgccactggatctgctgtgaagagtgacagccccagcaccagcagcatcccccccctgaatgaaacagtgtctgctgccagcctgctgaccaccaccaaccagcacagcagcagcctgggcggcctgagccacagcgaggagatccccaacaccaccaccacccagcacagcagcaccctgagcacccagcagaacaccctgagcagcagcaccagcagcggccgcaccagcaccagcaccctgctgcacacctctgtggagagcgaggccaacctgcacagcagcagcagcaccttcagcaccaccagcagcacagtgtctgcccctcctcctgtggtgtctgtgagcagcagcctgaacagcggcagcagcctgggcctgagcctgggcagcaacagcacagtgacagccagcaccaggagctctgtggccaccaccagcggcaaggccccacccaacctgcccccaggagtgccccccctgctgcccaacccctacatcatggcccctggcctgctgcacgcctacccaccccaggtgtatggctatgatgacctgcagatgctgcagacccgcttccccctggactactacagcatccccttccccacccccaccacccccctgaccggcagagatggcagcctggccagcaacccctacagcggggacctgaccaagtttggaagaggagatgccagcagccctgccccagccaccaccctggcccagccccagcagaaccagacccagacccaccacaccacccagcagaccttcctgaacccagccctgcccccaggctacagctacaccagcctgccctactacacaggagtgcccggcctgcccagcaccttccagtatggccctgctgtgtttcctgtggcccccaccagcagcaagcagcacggcgtgaatgtgtctgtgaatgccagcgccacccccttccagcagcccagcggctacggcagccacggctacaacacaggagtgtctgtgaccagcagcaacacaggagtgcctgacatcagcggctctgtgtacagcaagacccagcagagctttgagaagcagggcttccacagcggcaccccagctgccagcttcaacctgcccagcgccctgggcagcggcggccccatcaacccagccacagctgctgcctaccccccagcccccttcatgcacatcctgaccccccaccagcagccccacagccagatcctgcaccaccacctgcagcaggacggccagctgccctacctgcagatgatcctgtgctgccagaggcagcaggaggagcagacaggcagcggccagaggagccagaccagcagcatcccccagaagccccagaccaacaagagcgcctacaacagctacagctggggcgccaactag

SEQ ID NO: 17371 - DNA, 1200 bp, Artificial Sequence
  Description of Artificial Sequence: Synthetic coding sequence
tgacagcacagcagcagcctgggcggcctgagccacagcgaggagatccccaacaccaccaccacccagcacagcagcaccctgagcacccagcagaacaccctgagcagcagcaccagcagcggccgcaccagcaccagcaccctgctgcacacctctgtggagagcgaggccaacctgcacagcagcagcagcaccttcagcaccaccagcagcacagtgtctgcccctcctcctgtggtgtctgtgagcagcagcctgaacagcggcagcagcctgggcctgagcctgggcagcaacagcacagtgacagccagcaccaggagctctgtggccaccaccagcggcaaggccccacccaacctgcccccaggagtgccccccctgctgcccaacccctacatcatggcccctggcctgctgcacgcctacccaccccaggtgtatggctatgatgacctgcagatgctgcagacccgcttccccctggactactacagcatccccttccccacccccaccacccccctgaccggcagagatggcagcctggccagcaacccctacagcggggacctgaccaagtttggaagaggagatgccagcagccctgccccagccaccaccctggcccagccccagcagaaccagacccagacccaccacaccacccagcagaccttcctgaacccagccctgcccccaggctacagctacaccagcctgccctactacacaggagtgcccggcctgcccagcaccttccagtatggccctgctgtgtttcctgtggcccccaccagcagcaagcagcacggcgtgaatgtgtctgtgaatgccagcgccacccccttccagcagcccagcggctacggcagccacggctacaacacaggagtgtctgtgaccagcagcaacacaggagtgcctgacatcagcggctctgtgtacagcaagacccagcagagctttgagaagcagggcttccacagcggcaccccagctgccagcttcaacctgcccagcgccctgggcagcggcggccccatcaacccagccacagctgctgcctaccccccagcccccttcatgcacatcctgaccccccaccagcagccccacagccagatcctgcaccaccacctgcagcaggacggccaggacatcctgaactttgtggatgaccagctgggggagtag

SEQ ID NO: 17372 - DNA, 798 bp, Artificial Sequence
  Description of Artificial Sequence: Synthetic coding sequence
atgatgacctctgtgggcaccaacagagcccggggcaactgggagcagccccagaaccagaaccagacccagcacaagcagaggccccaggccacagctgagcagatccggctggcccagatgatcagtgaccacaatgatgctgactttgaggagaaggtgaagcagctgattgacatcaccgggaagaaccaggatgaatgtgtgattgccctgcatgactgcaatggagatgtgaacagagccatcaacgtgctgctggagggcaacccagacacccacagctgggagatggtgggcaagaagaagggcgtgtctggccagaaggatggcggccagacagagagcaatgaggagggcaaggagaacagagaccgggaccgggactacagcagaagaagaggaggccccccaagaagaggccgggtgcggggccaggagaatggcctggatggcaccaagagcggcggccccagcggccggggcacagagcggggcagaagaggccggggccggggccggggcggcagcggcagaagaggaggccgcttcagcgcccagggcatgggcaccttcaacccagctgactatgcagagcccgccaacacagatgacaactacggcaacagcagcggcaacacctggaacaacacaggccactttgagccagatgatggcaccagcgcctggaggacagccacagaggagtggggcacagaggactggaatgaagacctgtctgagaccaagatcttcaccgccagcaatgtgtcctctgtgcccctgcctgctgagtag

SEQ ID NO: 17373 - DNA, 549 bp, Artificial Sequence
  Description of Artificial Sequence: Synthetic coding sequence
atgatgacctctgtgggcaccaacagagcccggggcaactgggagcagccccagaaccagaaccagacccagcacaagcagaggccccaggccacagctgagcagatccggctggcccagatgatcagtgaccacaatgatgctgactttgaggagaaggtgaagcagctgattgacatcaccgggaagaaccaggatgaatgtgtgattgccctgcatgactgcaatggagatgtgaacagagccatcaacgtgctgctggagggcaacccagacacccacagctgggagatggtgggcaagaagaagggcgtgtctggccagaaggatggcggccagacagagagcaatgaggagggcaaggagaacagagaccgggaccgggactacagcagaagaagaggaggccccccaagaagaggccgcggggccagccggggccgggagttccggggccaggagaatggcctggatggcaccaagagcggcggccccagcggccggggcacagagcggggccggcggggccggggccggggccggggctag

SEQ ID NO: 17374 - DNA, 705 bp, Artificial Sequence
  Description of Artificial Sequence: Synthetic coding sequence
atgatgacctctgtgggcaccaacagagcccggggcaactgggagcagccccagaaccagaaccagacccagcacaagcagaggccccaggccacagctgagcagatccggctggcccagatgatcagtgaccacaatgatgctgactttgaggagaaggtgaagcagctgattgacatcaccgggaagaaccaggatgaatgtgtgattgccctgcatgactgcaatggagatgtgaacagagccatcaacgtgctgctggagggcaacccagacacccacagctgggagatggtgggcaagaagaagggcgtgtctggccagaaggatggcggccagacagagagcaatgaggagggcaaggagaacagagaccgggaccgggactacagcagaagaagaggaggccccccaagaagaggccgcggggccagccggggccgggagttccggggccaggagaatggcctggatggcaccaagagcggcggccccagcggccggggcacagagcggggccggcggggccggggccggggccggggcggcagcggccggcggggcggccgcttcagcgcccagggcatgggcaccttcaacccagctgactatgcagagcccgccaacacagatgacaactacggcaacagcagcggcaacacctggaacaacacaggccactttgagccagatgatggcacctag

SEQ ID NO: 17375 - DNA, 1989 bp, Artificial Sequence
  Description of Artificial Sequence: Synthetic coding sequence
atgcctggcagcgctgacatcagcggcctgaacctgcagtttggagccctgcagtttggaagtgagcctgtgctgagtgactatgagagcacccccaccaccagcgccagcagcagccaggcccccagcagcctgtacaccagcacagccagcgagagcagcagcaccatcagcagcaaccagagccaggagagcggctaccagagcggccccatccagagcaccacctacaccagccagaacaatgcccagggccccctgtatgagcagaggagcacccagacccggcgctaccccagcagcatcagcagcagcccccagaaggacctgacccaggccaagaatggcttcagctctgtgcaggccacccagctgcagaccacccagagcgtggagggcgccactggatctgctgtgaagagtgacagccccagcaccagcagcatcccccccctgaatgaaacagtgtctgctgccagcctgctgaccaccaccaaccagcacagcagcagcctgggcggcctgagccacagcgaggagatccccaacaccaccaccacccagcacagcagcaccctgagcacccagcagaacaccctgagcagcagcaccagcagcggccgcaccagcaccagcaccctgctgcacacctctgtggagagcgaggccaacctgcacagcagcagcagcaccttcagcaccaccagcagcacagtgtctgcccctcctcctgtggtgtctgtgagcagcagcctgaacagcggcagcagcctgggcctgagcctgggcagcaacagcacagtgacagccagcaccaggagctctgtggccaccaccagcggcaaggccccacccaacctgcccccaggagtgccccccctgctgcccaacccctacatcatggcccctggcctgctgcacgcctacccaccccaggtgtatggctatgatgacctgcagatgctgcagacccgcttccccctggactactacagcatccccttccccacccccaccacccccctgaccggcagagatggcagcctggccagcaacccctacagcggggacctgaccaagtttggaagaggagatgccagcagccctgccccagccaccaccctggcccagccccagcagaaccagacccagacccaccacaccacccagcagaccttcctgaacccagccctgcccccaggctacagctacaccagcctgccctactacacaggagtgcccggcctgcccagcaccttccagtatggccctgctgtgtttcctgtggcccccaccagcagcaagcagcacggcgtgaatgtgtctgtgaatgccagcgccacccccttccagcagcccagcggctacggcagccacggctacaacacaggagtgtctgtgaccagcagcaacacaggagtgcctgacatcagcggctctgtgtacagcaagacccagcagagctttgagaagcagggcttccacagcggcaccccagctgccagcttcaacctgcccagcgccctgggcagcggcggccccatcaacccagccacagctgctgcctaccccccagcccccttcatgcacatcctgaccccccaccagcagccccacagccagatcctgcaccaccacctgcagcaggacggccagctgccctacctgcagatgatcctgtgctgccagaggcagcaggaggagcagacaggcagcggccagaggagccagaccagcagcatcccccagaagccccagaccaacaagagcgcctacaacagctacagctggcccacagaggccctgaccctcttcagccgcagccacctgctgcggggcctgctgagcctggagaccatggagacagccagcaagaggaaagaatgtggcggcttccccctgccccccaccccatctggcccccctcatgccagcgccagctgcctgagccacagctacaccatccccaccctgctgtatgtgctgtag

SEQ ID NO: 17376 - DNA, 1593 bp, Artificial Sequence
  Description of Artificial Sequence: Synthetic coding sequence
atggaggatgacagcctgtacctgcggggggagtggcagttcaaccacttcagcaagctgaccagcagcaggccagatgctgcctttgctgagatccagaggaccagcctgcctgagaagagccccctgagctgtgagaccagggtggacctgtgtgatgacctggcccctgtggcccggcagctggccccccgggagaagctgcccctgagcagcagaagacctgctgctgtgggcgccggcctgcagaacatgggcaacacctgctacgtgaatgccagcctgcagtgcctgacctacaccccacccctggccaactacatgctgagccgggagcacagccagacctgccaccgccacaagggctgcatgctgtgcaccatgcaggcccacatcacccgggccctgcacaaccctggccacgtgatccagcccagccaggccctggccgccggcttccaccggggcaagcaggaggatgcccacgagttcctgatgttcaccgtggatgccatgaagaaggcctgcctgcccggccacaagcaggtggaccaccacagcaaggacaccaccctcatccaccagatctttggaggctactggaggagccagatcaagtgcctgcactgccacggcatcagtgacacctttgacccctacctggacatcgccctggacatccaggccgcccagagcgtgcagcaggccctggagcagctggtgaagccagaggagctgaatggagaaaatgcctaccactgcggcgtgtgcctgcagagggccccagccagcaagaccctgaccctgcacaccagcgccaaggtgctgatcctggtgctgaagcgcttcagtgatgtgactggaaacaagatcgccaagaatgtgcagtacccagaatgtctggacatgcagccctacatgagccagcccaacacaggccccctggtgtatgtgctgtatgctgtgctggtgcacgccggctggagctgccacaacggccactacttctcctatgtgaaggcccaggagggccagtggtacaagatggatgatgctgaggtgacagccagcagcatcacctctgtgctgagccagcaggcctacgtgctcttctacatccagaagtctgagtgggagcggcacagcgagagcgtgtcccggggccgggagccccgggccctgggcgctgaggacacagacagaagagccacccagggcgagctgaagagggaccacccctgcctgcaggcccctgagctggatgagcacctggtggagcgggccacccaggagagcaccctggaccactggaagttcctgcaggagcagaacaagaccaagccagagttcaacgtgaggaaggtggagggcaccctgcccccagatgtgctggtgatccaccagagcaagtacaagtgtggcatgaagaaccaccaccctgagcagcagagcagcctgctgaacctgagcagcagcacccccacccaccaggagagcatgaacacaggcaccctggccagcctgcggggccgggcccggcgcagcaagggcaagaacaagcacagcaagagggccctgctggtgtgccagtag

SEQ ID NO: 17377 - DNA, 1593 bp, Artificial Sequence; identical to SEQ ID NO: 17376
  Description of Artificial Sequence: Synthetic coding sequence

SEQ ID NO: 17378 - DNA, 1593 bp, Artificial Sequence; identical to SEQ ID NO: 17376
  Description of Artificial Sequence: Synthetic coding sequence

SEQ ID NO: 17379 - DNA, 1593 bp, Artificial Sequence; identical to SEQ ID NO: 17376
  Description of Artificial Sequence: Synthetic coding sequence

SEQ ID NO: 17380 - DNA, 1593 bp, Artificial Sequence; identical to SEQ ID NO: 17376
  Description of Artificial Sequence: Synthetic coding sequence

SEQ ID NO: 17381 - DNA, 1593 bp, Artificial Sequence; identical to SEQ ID NO: 17376
  Description of Artificial Sequence: Synthetic coding sequence

SEQ ID NO: 17382 - DNA, 1593 bp, Artificial Sequence; identical to SEQ ID NO: 17376
  Description of Artificial Sequence: Synthetic coding sequence

SEQ ID NO: 17383 - DNA, 477 bp, Artificial Sequence
  Description of Artificial Sequence: Synthetic coding sequence
atgctgctgtttgccctgctgctggccatggagctgcccctggtggccgccagcgccaccatgagggcccagtggacctacagcctgcgctgccacgactgtgctgtgatcaatgacttcaactgccccaacatccgggtgtgcccctaccacatccgccgctgcatgaccatcagcatccgcatcaacagccgggagctgctggtgtacaagaactgcaccaacaactgcacctttgtgtatgctgctgagcagcccccagaggcccctgggaagatcttcaagaccaacagcttctactgggtgtgctgctgcaacagcatggtgtgcaatgctgggggccccaccaacctggagcgggacatgctgcctgatgaggtgacagaggaggagctgcctgagggcaccgtgcggctgggcgtgtccaagctgctgctgagctttgccagcatcatcgtgagcaacatcctgccctag

SEQ ID NO: 17384 - DNA, 1584 bp, Artificial Sequence
  Description of Artificial Sequence: Synthetic coding sequence
atggctgtgcaccgggtgaaggtgaccttcaaggatgagcccggggagggcagcggcgtggcccgctccttctacacagccatcgcccaggccttcctgagcaatgagaagctgcccaacctggagtgcatccagaatgccaacaagggcacccacaccagcctgatgcagaggctgaggaacagaggagagcgggaccgggagcgggagcgggagcgggagatgaggaggagcagcggcctgcgggccggcagccggcgggaccgggaccgggacttccggcggcagctgagcattgacacccggcccttccggcctgccagcgagggcaaccccagtgatgatcctgagcccctgcctgcccaccggcaggccctgggggagcggctgtacccccgggtgcaggccatgcagcctgcctttgccagcaagatcaccggcatgctgctggagctgagccctgcccagctgctgctgctgctggccagcgaggacagcctgcgggcccgggtggatgaggccatggagctgatcatcgcccacggccgggagaatggagctgacagcatcctggacctgggcctggtggacagcagcgagaaggtgcaggagaacaggaagagacatggcagcagccgctctgtggtggacatggacctggatgacacagatgatggagatgacaatgcccccctcttctaccagcccgggaagaggggcttctacacccccaggcctgggaagaacacagaggcccggctgaactgcttcaggaacatcggccgcatcctgggcctgtgcctgctgcagaatgagctgtgccccatcaccctgaacagacatgtgatcaaggtgctgctgggcaggaaggtgaactggcatgactttgccttctttgatcctgtgatgtatgagagcctgcggcagctgatcctggccagccagagcagtgatgctgatgctgtgttcagcgccatggacctggcctttgccatcgacctgtgcaaggaggagggcggcggccaggtggagctgatccccaacggggtgaacatccctgtgaccccccagaatgtgtatgaatatgtgaggaaatatgcagagcacaggatgctggtggtggccgagcagcccctgcacgccatgaggaagggcctgctggatgtgctgcccaagaacagcctggaggacctgacagctgaggacttccggctgctggtgaatggctgtggggaggtgaatgtgcagatgctgatctccttcaccagcttcaatgatgagagcggggagaatgctgagaagctgctgcagttcaagcgctggttctggagcatcgtggagaagatgtccatgacagagcggcaggacctggtgtacttctggaccagcagccccagcctgcctgccagcgaggagggcttccagcccatgcccagcatcaccatccggcccccagatgaccagcacctgcccacagccaacacctgcatcagccggctgtatgtgcccctgtacagcagcaagcagatcctgaagcagaagctgctgctggccatcaagaccaagaactttggatttgtgtag

SEQ ID NO: 17385 - DNA, 8400 bp, Artificial Sequence
  Description of Artificial Sequence: Synthetic coding sequence
atgaccagcatccactttgtggtgcaccccctgcccggcacagaggaccagctgaatgaccggctgcgggaggtgtctgagaagctgaacaagtacaacctgaacagccacccccccctgaatgtgctggagcaggccaccatcaagcagtgtgtggtgggccccaaccacgccgccttcctgctggaggatggccgggtgtgccgcatcggcttctctgtgcagcctgaccggctggagctgggcaagccagacaacaatgatggcagcaagctgaacagcaacagcggggccggccgcaccagccggcccggccgcaccagtgacagcccctggttcctgagcggcagcgagaccctgggccgcctggccggcaacaccctgggcagccgctggagcagcggcgtgggcggcagcggcggcggcagcagcggccgcagcagcgctggggcccgggacagccggcggcagaccagggtcatcagaacaggccgggaccggggcagcggcctgctgggcagccagccccagcccgtcatcccagccagcgtcatccctgaggagctgatcagccaggcccaggtggtgctgcagggcaagagccgcagcgtcatcatccgggagctgcagaggaccaacctggatgtgaacctggccgtgaacaacctgctgagcagagatgatgaagatggagatgatggagatgacacagccagcgagagctacctgcccggggaggacctgatgagcctgctggatgctgacatccacagcgcccaccccagcgtcatcattgatgctgatgccatgttttctgaggacatctcctacttcggctaccccagcttccgccgcagcagcctgagccggctgggcagcagccgggtgctgctgctgcccctggagcgggacagcgagctgctgcgggagcgggagagcgtgctgcggctgcgggagcggcgctggctggatggagccagctttgacaatgaaagaggcagcaccagcaaggagggggagcccaacctggacaagaagaacacccctgtgcagagccctgtgtccctgggggaggacctgcagtggtggccagacaaggatggcaccaagttcatctgcatcggggccctgtacagcgagctgctggccgtgagcagcaaaggagagctgtaccagtggaagtggagcgagagcgagccctacagaaatgcccagaaccccagcctgcaccacccccgggccaccttcctgggcctgaccaatgagaagatcgtgctgctgagcgccaacagcatccgggccaccgtggccacagagaacaacaaggtggccacctgggtggatgagaccctgagctctgtggccagcaagctggagcacacagcccagacctacagcgagctgcagggcgagagaattgtgtccctgcactgctgtgccctgtacacctgtgcccagctggagaacagcctgtactggtggggcgtggtgcccttcagccagaggaagaagatgctggagaaggcccgggccaagaacaagaagcccaagagcagcgctggcatcagctccatgcccaacatcaccgtgggcacccaggtgtgcctgaggaacaaccccctgtaccacgccggggctgtggccttcagcatctctgctggcatccccaaggtgggcgtgctgatggagagcgtgtggaacatgaatgacagctgccgcttccagctgcggagccctgagagcctgaagaacatggagaaggccagcaagaccacagaggccaagccagagagcaagcaggagcctgtgaagacagagatgggccccccacccagccctgccagcacctgcagtgatgccagcagcatcgccagcagcgcctccatgccctacaagagaagaagaagcaccccagcccccaaggaggaggagaaggtgaatgaggagcagtggagcctgcgggaggtggtgtttgtggaggatgtgaagaatgtgcctgtgggcaaggtgctgaaggtggatggagcctacgtggccgtgaagtttcctggcaccagcagcaacaccaactgccagaacagcagcggcccagatgctgaccccagcagcctgctgcaggactgccgcctgctgagaattgatgagctgcaggtggtgaagacaggaggcacccccaaggtgcctgactgcttccagaggacccccaagaagctgtgcatccctgagaagacagagatcctggccgtgaatgtggacagcaagggcgtgcatgctgtgctgaagacaggcaactgggtgcgctactgcatctttgacctggccaccgggaaggccgagcaggagaacaacttccccaccagcagcatcgccttcctgggccagaatgaaagaaatgtggccatcttcaccgctggccaggagagccccatcatcctgagagatggaaatggcaccatctaccccatggccaaggactgcatgggcggcatccgggaccctgactggctggacctgccccccatcagcagcctgggcatgggcgtgcacagcctcatcaacctgcctgccaacagcaccatcaagaagaaggctgctgtgatcatcatggctgtggagaagcagaccctgatgcagcacatcctgcgctgtgactatgaggcctgccggcagtacctgatgaacctggagcaggccgtggtgctggagcagaacctgcagatgctgcagaccttcatcagccaccgctgtgatggcaacagaaacatcctgcacgcctgtgtgtctgtgtgcttccccaccagcaacaaggagaccaaggaggaggaggaggccgagaggagtgaaagaaacacctttgctgagcggctgtctgctgtggaggccatcgccaatgccatctctgtggtgagcagcaatggacctggcaacagagctggcagcagcagcagccgcagcctgcggctgcgggagatgatgagaagaagcctgcgggctgctggcctgggcagacatgaggccggggccagcagcagtgaccaccaggaccctgtgtccccacccatcgcccctccttcctgggtgcctgaccccccagccatggaccctgatggagacatcgacttcatcctggccccagctgtgggcagcctgaccacagctgccactggaacaggccagggccccagcaccagcaccatccctggccccagcacagagcccagcgtggtggagagcaaggacaggaaggccaatgcccacttcatcctgaagctgctgtgtgacagcgtggtgctgcagccctacctgcgggagctgctgagcgccaaggatgcccggggcatgacccccttcatgtctgctgtgtctggccgggcctacccagctgccatcaccatcctggagacagcccagaagatcgccaaggccgagatcagcagcagcgagaaggaggaggatgtgttcatgggcatggtgtgccccagcggcaccaacccagatgacagccccctgtatgtgctgtgctgcaatgacacctgcagcttcacctggacaggagctgagcacatcaaccaggacatctttgaatgtaggacctgtggcctgctggagagcctgtgctgctgcacagaatgtgcccgggtgtgccacaagggccatgactgcaagctgaagaggaccagccccacagcctactgtgactgctgggagaagtgcaagtgcaagaccctgattgctggccagaagagcgcccggctggacctgctgtaccgcctgctgacagccaccaacctggtgaccctgcccaacagcagaggagagcacctgctgctcttcctggtgcagacagtggcccggcagacagtggagcactgccagtacagaccaccccgcatccgggaggacaggaacaggaagacagccagccctgaggacagcgacatgccagaccatgacctggagcccccaagatttgcccagctggccctggagcgggtgctgcaggactggaatgccctgaagtccatgatcatgtttggcagccaggagaacaaggaccccctgagcgccagcagccgcatcggccacctgctgcctgaggagcaggtgtacctgaaccagcagagcggcaccatccggctggactgcttcacccactgcctgattgtgaagtgcacagctgacatcctgctgctggacaccctgctgggcaccctggtgaaggagctgcagaacaagtacaccccaggaagaagagaggaggccatcgctgtgaccatgaggttcctgcggtctgtggcccgggtgtttgtgatcctgtctgtggagatggccagcagcaagaagaagaacaacttcatcccccagcccatcggcaagtgcaagagggtcttccaggccctgctgccctatgctgtggaggagctgtgcaatgtggccgagagcctgattgtgcctgtgaggatgggcatcgcccggcccacagcccccttcaccctggccagcaccagcattgatgccatgcagggcagcgaggagctgttctctgtggagcccctgcccccccggcccagcagtgaccagagcagcagcagcagccagagccagagcagctacatcatccggaacccccagcagaggcgcatcagccagagccagcctgtgcggggcagagatgaggagcaggatgacatcgtgtctgcagatgtggaggaggtggaggtggtggagggcgtggccggggaggaggaccaccatgatgagcaggaggagcacggggaggagaatgctgaggccgagggccagcatgatgaacatgatgaagatggcagtgacatggagctggacctgctggccgctgctgagacagaaagtgacagcgagagcaaccacagcaaccaggacaatgccagcggcagaagatctgtggtgacagctgccacagctggcagcgaggccggggccagctctgtgcctgccttcttctctgaagatgacagccagagcaatgacagcagtgacagcgacagcagcagcagccagagtgatgacatcgagcaggagaccttcatgctggatgagcccctggagaggaccaccaacagcagccacgccaatggagctgcccaggcccccaggtccatgcagtgggccgtgaggaacacccagcaccagagagctgccagcacagcccccagcagcaccagcaccccagctgccagcagcgctggcctcatctacatcgaccccagcaacctgcggcgcagcggcaccatcagcaccagcgctgctgctgctgctgctgccctggaggccagcaatgccagcagctacctgaccagcgccagcagcctggcccgggcctacagcatcgtcatccggcagatcagtgacctgatgggcctcatccccaagtacaaccacctggtgtacagccagatcccagctgctgtgaagctgacctaccaggatgctgtgaacctgcagaactacgtggaggagaagctgatccccacctggaactggatggtgtccatcatggacagcacagaggcccagctgcgctatggcagcgccctggccagcgctggggaccccggccaccccaaccaccccctgcacgccagccagaacagcgcccggcgggagaggatgacagcccgggaggaggccagcctgcggaccctggagggcagaagaagagccaccctgctgagcgcccggcagggcatgatgtctgcccggggggacttcctgaactatgccctgagcctgatgaggagccacaatgatgagcacagtgatgtgctgcctgtgctggatgtgtgcagcctgaagcacgtggcctacgtgttccaggccctgatctactggatcaaggccatgaaccagcagaccaccctggacaccccccagctggagaggaagaggacccgggagctgctggagctgggcatcgacaatgaagacagcgagcatgaaaatgatgatgacaccaaccagagcgccaccctgaatgacaaggatgatgacagcctgcctgctgagaccggccagaaccaccccttcttccgccgcagtgacagcatgaccttcctgggctgcatcccccccaacccctttgaggtgcccctggccgaggccatccccctggccgaccagccccacctgctgcagcccaatgccaggaaggaggacctgtttggccggcccagccagggcctgtacagcagcagcgccagcagcggcaagtgcctgatggaggtgacagtggacaggaactgcctggaggtgctgcccaccaagatgtcctatgctgccaacctgaagaatgtgatgaacatgcagaaccggcagaagaaggagggggaggagcagcctgtgctgcctgaggagacagagagcagcaagccaggccccagcgcccatgacctggccgcccagctgaagagcagcctgctggccgagatcggcctgacagaaagtgagggcccccccctgaccagcttccggccccagtgcagcttcatgggcatggtgatcagccatgacatgctgctgggccgctggaggctgagcctggagctgtttggccgggtcttcatggaggatgtgggcgctgagcccggcagcatcctgacagagctgggcggctttgaggtgaaggagagcaagttccggcgggagatggagaagctgaggaaccagcagagccgggacctgagcctggaggtggaccgggaccgggacctgctgatccagcagaccatgaggcagctgaacaaccactttggaagaagatgtgccaccacccccatggctgtgcaccgggtgaaggtgaccttcaaggatgagcctggagagggcagcggcgtggcccggagcttctacacagccatcgcccaggccttcctgagcaatgagaagctgcccaacctggagtgcatccagaatgccaacaagggcacccacaccagcctgatgcagaggctgaggaacagaggagagcgggaccgggagcgggagcgggagcgggagatgagaagaagcagcggcctgcgggccggcagcagaagagaccgggaccgggacttccggcggcagctgagcattgacacccggcccttccggcctgccagcgagggcaaccccagtgatgatcctgagcccctgcctgcccaccggcaggccctgggggagcggctgtacccccgggtgcaggccatgcagcctgcctttgccagcaagatcaccggcatgctgctggagctgagccctgcccagctgctgctgctgctggccagcgaggacagcctgcgggcccgggtggatgaggccatggagctgatcatcgcccacggcagagaaaatggagctgacagcatcctggacctgggcctggtggacagcagcgagaaggtgcagcaggagaacaggaagagacatggcagcagccgctctgtggtggacatggacctggatgacacagatgatggagatgacaatgcccccctcttctaccagcccgggaagaggggcttctacacccccaggcctgggaagaacacagaggcccggctgaactgcttcaggaacatcggccgcatcctgggcctgtgcctgctgcagaatgagctgtgccccatcaccctgaacagacatgtgatcaaggtgctgctgggcaggaaggtgaactggcatgactttgccttctttgatcctgtgatgtatgagagcctgcggcagctgatcctggccagccagagcagtgatgctgatgctgtgttcagcgccatggacctggcctttgccatcgacctgtgcaaggaggagggcggcggccaggtggagctgatccccaacggggtgaacatccctgtgaccccccagaatgtgtatgaatatgtgaggaaatatgcagagcacaggatgctggtggtggccgagcagcccctgcacgccatgaggaagggcctgctggatgtgctgcccaagaacagcctggaggacctgacagctgaggacttccggctgctggtgaatggctgtggggaggtgaatgtgcagatgctgatctccttcaccagcttcaatgatgagagcggggagaatgctgagaagctgctgcagttcaagcgctggttctggagcatcgtggagaagatgtccatgacagagcggcaggacctggtgtacttctggaccagcagccccagcctgcctgccagcgaggagggcttccagcccatgcccagcatcaccatccggcccccagatgaccagcacctgcccacagccaacacctgcatcagccggctgtatgtgcccctgtacagcagcaagcagatcctgaagcagaagctgctgctggccatcaagaccaagaactttggatttgtgtag

SEQ ID NO: 17386 - DNA, 8379 bp, Artificial Sequence
  Description of Artificial Sequence: Synthetic coding sequence
atgaccagcatccactttgtggtgcaccccctgcccggcacagaggaccagctgaatgaccggctgcgggaggtgtctgagaagctgaacaagtacaacctgaacagccacccccccctgaatgtgctggagcaggccaccatcaagcagtgtgtggtgggccccaaccacgccgccttcctgctggaggatggccgggtgtgccgcatcggcttctctgtgcagcctgaccggctggagctgggcaagccagacaacaatgatggcagcaagctgaacagcaacagcggggccggccgcaccagccggcccggccgcaccagtgacagcccctggttcctgagcggcagcgagaccctgggccgcctggccggcaacaccctgggcagccgctggagcagcggcgtgggcggcagcggcggcggcagcagcggccgcagcagcgctggggcccgggacagccggcggcagaccagggtcatcagaacaggccgggaccggggcagcggcctgctgggcagccagccccagcccgtcatcccagccagcgtcatccctgaggagctgatcagccaggcccaggtggtgctgcagggcaagagccgcagcgtcatcatccgggagctgcagaggaccaacctggatgtgaacctggccgtgaacaacctgctgagcagagatgatgaagatggagatgatggagatgacacagccagcgagagctacctgcccggggaggacctgatgagcctgctggatgctgacatccacagcgcccaccccagcgtcatcattgatgctgatgccatgttttctgaggacatctcctacttcggctaccccagcttccgccgcagcagcctgagccggctgggcagcagccgggagcgggacagcgagctgctgcgggagcgggagagcgtgctgcggctgcgggagcggcgctggctggatggagccagctttgacaatgaaagaggcagcaccagcaaggagggggagcccaacctggacaagaagaacacccctgtgcagagccctgtgtccctgggggaggacctgcagtggtggccagacaaggatggcaccaagttcatctgcatcggggccctgtacagcgagctgctggccgtgagcagcaaaggagagctgtaccagtggaagtggagcgagagcgagccctacagaaatgcccagaaccccagcctgcaccacccccgggccaccttcctgggcctgaccaatgagaagatcgtgctgctgagcgccaacagcatccgggccaccgtggccacagagaacaacaaggtggccacctgggtggatgagaccctgagctctgtggccagcaagctggagcacacagcccagacctacagcgagctgcagggcgagagaattgtgtccctgcactgctgtgccctgtacacctgtgcccagctggagaacagcctgtactggtggggcgtggtgcccttcagccagaggaagaagatgctggagaaggcccgggccaagaacaagaagcccaagagcagcgctggcatcagctccatgcccaacatcaccgtgggcacccaggtgtgcctgaggaacaaccccctgtaccacgccggggctgtggccttcagcatctctgctggcatccccaaggtgggcgtgctgatggagagcgtgtggaacatgaatgacagctgccgcttccagctgcggagccctgagagcctgaagaacatggagaaggccagcaagaccacagaggccaagccagagagcaagcaggagcctgtgaagacagagatgggccccccacccagccctgccagcacctgcagtgatgccagcagcatcgccagcagcgcctccatgccctacaagagaagaagaagcaccccagcccccaaggaggaggagaaggtgaatgaggagcagtggagcctgcgggaggtggtgtttgtggaggatgtgaagaatgtgcctgtgggcaaggtgctgaaggtggatggagcctacgtggccgtgaagtttcctggcaccagcagcaacaccaactgccagaacagcagcggcccagatgctgaccccagcagcctgctgcaggactgccgcctgctgagaattgatgagctgcaggtggtgaagacaggaggcacccccaaggtgcctgactgcttccagaggacccccaagaagctgtgcatccctgagaagacagagatcctggccgtgaatgtggacagcaagggcgtgcatgctgtgctgaagacaggcaactgggtgcgctactgcatctttgacctggccaccgggaaggccgagcaggagaacaacttccccaccagcagcatcgccttcctgggccagaatgaaagaaatgtggccatcttcaccgctggccaggagagccccatcatcctgagagatggaaatggcaccatctaccccatggccaaggactgcatgggcggcatccgggaccctgactggctggacctgccccccatcagcagcctgggcatgggcgtgcacagcctcatcaacctgcctgccaacagcaccatcaagaagaaggctgctgtgatcatcatggctgtggagaagcagaccctgatgcagcacatcctgcgctgtgactatgaggcctgccggcagtacctgatgaacctggagcaggccgtggtgctggagcagaacctgcagatgctgcagaccttcatcagccaccgctgtgatggcaacagaaacatcctgcacgcctgtgtgtctgtgtgcttccccaccagcaacaaggagaccaaggaggaggaggaggccgagaggagtgaaagaaacacctttgctgagcggctgtctgctgtggaggccatcgccaatgccatctctgtggtgagcagcaatggacctggcaacagagctggcagcagcagcagccgcagcctgcggctgcgggagatgatgagaagaagcctgcgggctgctggcctgggcagacatgaggccggggccagcagcagtgaccaccaggaccctgtgtccccacccatcgcccctccttcctgggtgcctgaccccccagccatggaccctgatggagacatcgacttcatcctggccccagctgtgggcagcctgaccacagctgccactggaacaggccagggccccagcaccagcaccatccctggccccagcacagagcccagcgtggtggagagcaaggacaggaaggccaatgcccacttcatcctgaagctgctgtgtgacagcgtggtgctgcagccctacctgcgggagctgctgagcgccaaggatgcccggggcatgacccccttcatgtctgctgtgtctggccgggcctacccagctgccatcaccatcctggagacagcccagaagatcgccaaggccgagatcagcagcagcgagaaggaggaggatgtgttcatgggcatggtgtgccccagcggcaccaacccagatgacagccccctgtatgtgctgtgctgcaatgacacctgcagcttcacctggacaggagctgagcacatcaaccaggacatctttgaatgtaggacctgtggcctgctggagagcctgtgctgctgcacagaatgtgcccgggtgtgccacaagggccatgactgcaagctgaagaggaccagccccacagcctactgtgactgctgggagaagtgcaagtgcaagaccctgattgctggccagaagagcgcccggctggacctgctgtaccgcctgctgacagccaccaacctggtgaccctgcccaacagcagaggagagcacctgctgctcttcctggtgcagacagtggcccggcagacagtggagcactgccagtacagaccaccccgcatccgggaggacaggaacaggaagacagccagccctgaggacagcgacatgccagaccatgacctggagcccccaagatttgcccagctggccctggagcgggtgctgcaggactggaatgccctgaagtccatgatcatgtttggcagccaggagaacaaggaccccctgagcgccagcagccgcatcggccacctgctgcctgaggagcaggtgtacctgaaccagcagagcggcaccatccggctggactgcttcacccactgcctgattgtgaagtgcacagctgacatcctgctgctggacaccctgctgggcaccctggtgaaggagctgcagaacaagtacaccccaggaagaagagaggaggccatcgctgtgaccatgaggttcctgcggtctgtggcccgggtgtttgtgatcctgtctgtggagatggccagcagcaagaagaagaacaacttcatcccccagcccatcggcaagtgcaagagggtcttccaggccctgctgccctatgctgtggaggagctgtgcaatgtggccgagagcctgattgtgcctgtgaggatgggcatcgcccggcccacagcccccttcaccctggccagcaccagcattgatgccatgcagggcagcgaggagctgttctctgtggagcccctgcccccccggcccagcagtgaccagagcagcagcagcagccagagccagagcagctacatcatccggaacccccagcagaggcgcatcagccagagccagcctgtgcggggcagagatgaggagcaggatgacatcgtgtctgcagatgtggaggaggtggaggtggtggagggcgtggccggggaggaggaccaccatgatgagcaggaggagcacggggaggagaatgctgaggccgagggccagcatgatgaacatgatgaagatggcagtgacatggagctggacctgctggccgctgctgagacagaaagtgacagcgagagcaaccacagcaaccaggacaatgccagcggcagaagatctgtggtgacagctgccacagctggcagcgaggccggggccagctctgtgcctgccttcttctctgaagatgacagccagagcaatgacagcagtgacagcgacagcagcagcagccagagtgatgacatcgagcaggagaccttcatgctggatgagcccctggagaggaccaccaacagcagccacgccaatggagctgcccaggcccccaggtccatgcagtgggccgtgaggaacacccagcaccagagagctgccagcacagcccccagcagcaccagcaccccagctgccagcagcgctggcctcatctacatcgaccccagcaacctgcggcgcagcggcaccatcagcaccagcgctgctgctgctgctgctgccctggaggccagcaatgccagcagctacctgaccagcgccagcagcctggcccgggcctacagcatcgtcatccggcagatcagtgacctgatgggcctcatccccaagtacaaccacctggtgtacagccagatcccagctgctgtgaagctgacctaccaggatgctgtgaacctgcagaactacgtggaggagaagctgatccccacctggaactggatggtgtccatcatggacagcacagaggcccagctgcgctatggcagcgccctggccagcgctggggaccccggccaccccaaccaccccctgcacgccagccagaacagcgcccggcgggagaggatgacagcccgggaggaggccagcctgcggaccctggagggcagaagaagagccaccctgctgagcgcccggcagggcatgatgtctgcccggggggacttcctgaactatgccctgagcctgatgaggagccacaatgatgagcacagtgatgtgctgcctgtgctggatgtgtgcagcctgaagcacgtggcctacgtgttccaggccctgatctactggatcaaggccatgaaccagcagaccaccctggacaccccccagctggagaggaagaggacccgggagctgctggagctgggcatcgacaatgaagacagcgagcatgaaaatgatgatgacaccaaccagagcgccaccctgaatgacaaggatgatgacagcctgcctgctgagaccggccagaaccaccccttcttccgccgcagtgacagcatgaccttcctgggctgcatcccccccaacccctttgaggtgcccctggccgaggccatccccctggccgaccagccccacctgctgcagcccaatgccaggaaggaggacctgtttggccggcccagccagggcctgtacagcagcagcgccagcagcggcaagtgcctgatggaggtgacagtggacaggaactgcctggaggtgctgcccaccaagatgtcctatgctgccaacctgaagaatgtgatgaacatgcagaaccggcagaagaaggagggggaggagcagcctgtgctgcctgaggagacagagagcagcaagccaggccccagcgcccatgacctggccgcccagctgaagagcagcctgctggccgagatcggcctgacagaaagtgagggcccccccctgaccagcttccggccccagtgcagcttcatgggcatggtgatcagccatgacatgctgctgggccgctggaggctgagcctggagctgtttggccgggtcttcatggaggatgtgggcgctgagcccggcagcatcctgacagagctgggcggctttgaggtgaaggagagcaagttccggcgggagatggagaagctgaggaaccagcagagccgggacctgagcctggaggtggaccgggaccgggacctgctgatccagcagaccatgaggcagctgaacaaccactttggaagaagatgtgccaccacccccatggctgtgcaccgggtgaaggtgaccttcaaggatgagcctggagagggcagcggcgtggcccggagcttctacacagccatcgcccaggccttcctgagcaatgagaagctgcccaacctggagtgcatccagaatgccaacaagggcacccacaccagcctgatgcagaggctgaggaacagaggagagcgggaccgggagcgggagcgggagcgggagatgagaagaagcagcggcctgcgggccggcagcagaagagaccgggaccgggacttccggcggcagctgagcattgacacccggcccttccggcctgccagcgagggcaaccccagtgatgatcctgagcccctgcctgcccaccggcaggccctgggggagcggctgtacccccgggtgcaggccatgcagcctgcctttgccagcaagatcaccggcatgctgctggagctgagccctgcccagctgctgctgctgctggccagcgaggacagcctgcgggcccgggtggatgaggccatggagctgatcatcgcccacggcagagaaaatggagctgacagcatcctggacctgggcctggtggacagcagcgagaaggtgcaggagaacaggaagagacatggcagcagccgctctgtggtggacatggacctggatgacacagatgatggagatgacaatgcccccctcttctaccagcccgggaagaggggcttctacacccccaggcctgggaagaacacagaggcccggctgaactgcttcagaaatattggccgcatcctgggcctgtgcctgctgcagaatgagctgtgccccatcaccctgaacagacatgtgatcaaggtgctgctgggcaggaaggtgaactggcatgactttgccttctttgatcctgtgatgtatgagagcctgcggcagctgatcctggccagccagagcagtgatgctgatgctgtgttttctgccatggacctggcctttgccatcgacctgtgcaaggaggagggcggcggccaggtggagctgatccccaatggagtgaacatccctgtgaccccccagaatgtgtatgaatatgtgaggaaatatgcagagcacaggatgctggtggtggccgagcagcccctgcacgccatgaggaagggcctgctggatgtgctgcccaagaacagcctggaggacctgacagctgaggacttccggctgctggtgaatggctgtggggaggtgaatgtgcagatgctgatctccttcaccagcttcaatgatgaaagtggagaaaatgctgagaagctgctgcagttcaagcgctggttctggagcatcgtggagaagatgtccatgacagagcggcaggacctggtgtacttctggaccagcagccccagcctgcctgccagcgaggagggcttccagcccatgcccagcatcaccatccggcccccagatgaccagcacctgcccacagccaacacctgcatcagccggctgtatgtgcccctgtacagcagcaagcagatcctgaagcagaagctgctgctggccatcaagaccaagaactttggatttgtgtag

SEQ ID NO: 17387 - DNA, 1593 bp, Artificial Sequence
  Description of Artificial Sequence: Synthetic coding sequence
atggaggatgacagcctgtacctgggcggggagtggcagttcaaccacttcagcaagctgaccagcagcaggccagatgctgcctttgctgagatccagaggaccagcctgcctgagaagagccccctgagcagcgaggcccgggtggacctgtgtgatgacctggcccctgtggcccggcagctggcccccaggaagaagctgcccctgagcagcagaagacctgctgctgtgggcgccggcctgcagaacatgggcaacacctgctatgaaaatgccagcctgcagtgcctgacctacaccccacccctggccaactacatgctgagccgggagcacagccagacctgccagaggcccaagtgctgcatgctgtgcaccatgcaggcccacatcacctgggccctgcacagccctggccacgtgatccagcccagccaggccctggccgccggcttccaccggggcaagcaggaggatgcccacgagttcctgatgttcaccgtggatgccatgaagaaggcctgcctgcccggccacaagcaggtggaccaccacagcaaggacaccaccctcatccaccagatctttggaggctgctggaggagccagatcaagtgcctgcactgccacggcatcagtgacacctttgacccctacctggacatcgccctggacatccaggccgcccagagcgtgaagcaggccctggagcagctggtgaagccagaggagctgaatggagaaaatgcctaccactgcggcctgtgcctgcagagggccccagccagcaagaccctgaccctgcacaccagcgccaaggtgctgatcctggtgctgaagcgcttcagtgatgtgactggaaacaagctggccaagaatgtgcagtacccagaatgtctggacatgcagccctacatgagccagcagaacacaggccccctggtgtatgtgctgtatgctgtgctggtgcacgccggctggagctgccatgatggccactacttctcctatgtgaaggcccaggagggccagtggtacaagatggatgatgccaaggtgacagcctgcagcatcacctctgtgctgagccagcaggcctacgtgctcttctacatccagaagtctgagtgggagcggcacagcgagagcgtgtcccggggccgggagccccgggccctgggcgctgaggacacagacagaagagccacccagggcgagctgaagagggaccacccctgcctgcaggcccctgagctggatgagcggctggtggagcgggccacccaggagagcaccctggaccactggaagttcccccaggagcagaacaagaccaagccagagttcaacgtgaggaaggtggagggcaccctgccccccaacgtgctggtgatccaccagagcaagtacaagtgtggcatgaagaaccaccaccctgagcagcagagcagcctgctgaacctgagcagcaccaccaggacagaccaggagagcgtgaacacaggcaccctggccagcctgcagggccgcaccaggaggagcaagggcaagaacaagcacagcaagagggccctgctggtgtgccagtag

SEQ ID NO: 17388 - DNA, 2940 bp, Artificial Sequence
  Description of Artificial Sequence: Synthetic coding sequence
atgagccccctgaagatccacggccccatccgcatccgctccatgcagacaggcatcaccaagtggaaggagggcagctttgaaattgtggagaaggagaacaaggtgtccctggtggtgcactacaacacaggaggcatcccccgcatcttccagctgagccacaacatcaagaatgtggtgctgcggcccagcggggccaagcagagccggctgatgctgaccctgcaggacaacagcttcctgagcattgacaaggtgcccagcaaggatgctgaggagatgaggctcttcctggatgctgtgcaccagaaccggctgcctgctgccatgaagcccagccagggcagcggcagctttggagccatcctgggcagcaggaccagccagaaggagaccagccggcagctgagctacagcgacaaccaggccagcgccaagaggggcagcctggagaccaaggatgacatccccttcaggaaggtgctgggcaaccctggccggggcagcatcaagacagtggccggcagcggcatcgcccggaccatccccagcctgaccagcaccagcacccccctgcggagcggcctgctggagaacagaacagagaagaggaagaggatgatcagcactggaagtgagctgaatgaagactaccccaaggaaaatgacagcagcagcaacaacaaggccatgacagaccccagcaggaagtacctgaccagcagccgggagaagcagctgagcctgaagcagagtgaagaaaatagaacatctggcctgctgcccctgcagagcagcagcttctacggcagccgggccggcagcaaggagcacagcagcggcggcaccaacctggacaggaccaacgtgagcagccagaccccatctgccaagaggagcctgggcttcctgccccagcctgtgcccctgtctgtgaagaagctgcgctgcaaccaggactacacaggctggaacaagccccgggtgcccctgagcagccaccagcagcagcagctgcagggcttcagcaacctgggcaacacctgctacatgaatgccatcctgcagagcctcttcagcctgcagagctttgccaatgacctgctgaagcagggcatcccctggaagaagatccccctgaatgccctgatccgccgctttgcccacctgctggtgaagaaggacatctgcaacagcgagaccaagaaggacctgctgaagaaggtgaagaatgccatcagcgccacagctgagcgcttcagcggctacatgcagaatgatgcccacgagttcctgagccagtgcctggaccagctgaaggaggacatggagaagctgaacaagacctggaagacagagcctgtgtctggagaggagaacagcccagacatcagcgccacccgggcctacacctgccctgtgatcaccaacctggagtttgaggtgcagcacagcatcatctgcaaggcctgtggggagatcatccccaagcgggagcagttcaatgacctgagcattgacctgcccaggaggaagaagcccctgcccccaagaagcatccaggacagcctggacctcttcttccgggcagaggagctggagtacagctgtgagaagtgtggcggcaaatgtgccctggtgcgccacaagttcaaccggctgccccgggtgctgatcctgcacctgaagcgctacagcttcaacgtggccctgagcctgaacaacaagattggccagcaggtgatcatcccccgctacctgaccctgagcagccactgcacagagaacaccaagccacccttcaccctgggctggagcgcccacatggccatcagccggcccctgaaggccagccagatggtgaacagctgcatcaccagccccagcacccccagcaagaagttcaccttcaagagcaagagcagcctggccctgtgcctggacagcgacagtgaagatgagctgaagaggtctgtggccctgagccagaggctgtgtgagatgctgggcaatgagcagcagcaggaggacctggagaaggacagcaagctgtgccccatcgagccagacaagtctgagctggagaacagcggctttgacaggatgtctgaggaggagctgctggccgctgtgctggagatcagcaagagagatgccagccccagcctgagccatgaagatgatgacaagcccaccagcagcccagacaccggctttgctgaagatgacatccaggagatgcctgagaacccagacaccatggagacagagaagcccaagaccatcacagagctggaccctgccagcttcacagagatcaccaaggactgtgatgagaacaaggagaacaagaccccagagggcagccagggcgaggtggactggctgcagcagtatgacatggagcgggagcgggaggagcaggagctgcagcaggccctggcccagagcctgcaggagcaggaggcctgggagcagaaggaggatgatgacctgaagagggccacagagctgagcctgcaggagttcaacaacagctttgtggatgccctgggcagtgatgaggacagcggaaatgaagatgtgtttgacatggagtacacagaagctgaggccgaggagctgaagagaaatgctgagaccggcaacctgccccacagctaccgcctcatctctgtggtgagccacatcggcagcaccagcagcagcggccactacatcagtgatgtgtatgacatcaagaagcaggcctggttcacctacaatgacctggaggtgtccaagatccaggaggccgctgtgcagagcgaccgggacaggagcggctacatcttcttctacatgcacaaggagatctttgatgagctgctggagacagagaagaacagccagagcctgagcacagaggtgggcaagaccacccggcaggccctgtag

SEQ ID NO: 17389 - DNA, 2940 bp, Artificial Sequence; identical to SEQ ID NO: 17388
  Description of Artificial Sequence: Synthetic coding sequence

SEQ ID NO: 17390 - DNA, 2940 bp, Artificial Sequence; identical to SEQ ID NO: 17388
  Description of Artificial Sequence: Synthetic coding sequence

SEQ ID NO: 17391 - DNA, 462 bp, Artificial Sequence
  Description of Artificial Sequence: Synthetic coding sequence
atggccgagctgccccaccgcatcatcaaggagacccagaggctgctggccgagcctgtgcccggcatcaaggccgagccagatgagagcaatgcccgctacttccacgtggtgattgctggggagagcaaggacagcccctttgagggcggcaccttcaagcgggagctgctgctggccgaggagtaccccatggccgcccccaaggtgcgcttcatgaccaagatctaccaccccaacgtggacaagctggagcgcatcagcctggacatcctgaaggacaagtggagccctgccctgcagatcagaacagtgctgctgagcatccaggccctgctgaatgcccccaacccagatgaccccctggccaatgatgtggtggagcagtggaagaccaatgaggcccaggccatcgagacagcccgggcctggacccggctgtatgccatgaacagcatctag

SEQ ID NO: 17392 - DNA, 1350 bp, Artificial Sequence
  Description of Artificial Sequence: Synthetic coding sequence
atggctgatggagaggagcccatggctgtggatggcggctgtggggacacaggagactgggagggccgctggaaccacgtgaagaagttcctggagaggagcggccccttcacccacccagactttgagcccagcacagagagcctgcagttcctgctggacacctgcaaggtgctggtgattggagctgggggcctgggctgtgagctgctgaagaacctggccctgagcggcttccggcagatccacgtgattgacatggacaccattgatgtgagcaacctgaaccggcagttcctgttccggcccaaggacatcggccggcccaaggccgaggtggccgctgagttcctgaatgacagagtgcccaactgcaatgtggtgccccacttcaacaagatccaggacttcaatgacaccttctaccggcagttccacatcatcgtgtgtggcctggacagcatcatcgcccggcgctggatcaatggcatgctgatcagcctgctgaactatgaagatggagtgctggaccccagcagcatcgtgcccctgattgatggcggcacagagggcttcaagggaaatgcccgggtcatcctgcccggcatgacagcctgcatcgagtgcaccctggagctgtacccaccccaggtgaacttccccatgtgcaccatcgcctccatgccccggctgcctgagcactgcatcgagtatgtgaggatgctgcagtggcccaaggagcagccctttggagaaggagtgcccctggatggagatgatcctgagcacatccagtggatcttccagaagagcctggagcgggccagccagtacaacatccggggcgtgacctaccgcctgacccagggcgtggtgaagaggatcatcccagctgtggccagcaccaatgctgtgattgctgctgtgtgtgccacagaggtgttcaagatcgccaccagcgcctacatccccctgaacaactacctggtgttcaatgatgtggatggcctgtacacctacacctttgaggccgagaggaaggagaactgcccagcctgcagccagctgccccagaacatccagttcagccccagcgccaagctgcaggaggtgctggactacctgaccaacagcgccagcctgcagatgaagagccctgccatcacagccaccctggagggcaagaacagaaccctgtacctgcagagcgtgaccagcattgaggagaggacccggcccaacctgagcaagaccctgaaggagctgggcctggtggatggccaggagctggccgtggctgatgtgaccaccccccagacagtgctcttcaagctgcacttcaccagctag

SEQ ID NO: 17393 - DNA, 1392 bp, Artificial Sequence
  Description of Artificial Sequence: Synthetic coding sequence
atggctgatggagaggagcctgagaagaagagaagacgcatcgaggagctgctggccgagaagatggctgtggatggcggctgtggggacacaggagactgggagggccgctggaaccacgtgaagaagttcctggagaggagcggccccttcacccacccagactttgagcccagcacagagagcctgcagttcctgctggacacctgcaaggtgctggtgattggagctgggggcctgggctgtgagctgctgaagaacctggccctgagcggcttccggcagatccacgtgattgacatggacaccattgatgtgagcaacctgaaccggcagttcctgttccggcccaaggacatcggccggcccaaggccgaggtggccgctgagttcctgaatgacagagtgcccaactgcaatgtggtgccccacttcaacaagatccaggacttcaatgacaccttctaccggcagttccacatcatcgtgtgtggcctggacagcatcatcgcccggcgctggatcaatggcatgctgatcagcctgctgaactatgaagatggagtgctggaccccagcagcatcgtgcccctgattgatggcggcacagagggcttcaagggaaatgcccgggtcatcctgcccggcatgacagcctgcatcgagtgcaccctggagctgtacccaccccaggtgaacttccccatgtgcaccatcgcctccatgccccggctgcctgagcactgcatcgagtatgtgaggatgctgcagtggcccaaggagcagccctttggagaaggagtgcccctggatggagatgatcctgagcacatccagtggatcttccagaagagcctggagcgggccagccagtacaacatccggggcgtgacctaccgcctgacccagggcgtggtgaagaggatcatcccagctgtggccagcaccaatgctgtgattgctgctgtgtgtgccacagaggtgttcaagatcgccaccagcgcctacatccccctgaacaactacctggtgttcaatgatgtggatggcctgtacacctacacctttgaggccgagaggaaggagaactgcccagcctgcagccagctgccccagaacatccagttcagccccagcgccaagctgcaggaggtgctggactacctgaccaacagcgccagcctgcagatgaagagccctgccatcacagccaccctggagggcaagaacagaaccctgtacctgcagagcgtgaccagcattgaggagaggacccggcccaacctgagcaagaccctgaaggagctgggcctggtggatggccaggagctggccgtggctgatgtgaccaccccccagacagtgctcttcaagctgcacttcaccagctag

SEQ ID NO: 17394 - DNA, 861 bp, Artificial Sequence
  Description of Artificial Sequence: Synthetic coding sequence
atgctgatcagcctgctgaactatgaagatggagtgctggaccccagcagcatcgtgcccctgattgatggcggcacagagggcttcaagggaaatgcccgggtcatcctgcccggcatgacagcctgcattgaatgtaccctggagctgtacccaccccaggtgaacttccccatgtgcaccatcgcctccatgccccggctgcctgagcactgcattgaatatgtgaggatgctgcagtggcccaaggagcagccctttggagagggcgtgcccctggatggagatgatcctgagcacatccagtggatcttccagaagagcctggagcgggccagccagtacaacatccggggcgtgacctaccgcctgacccagggcgtggtgaagaggatcatcccagctgtggccagcaccaatgctgtgattgctgctgtgtgtgccacagaggtgttcaagatcgccaccagcgcctacatccccctgaacaactacctggtgttcaatgatgtggatggcctgtacacctacacctttgaagctgagaggaaagaaaactgcccagcctgcagccagctgccccagaacatccagttcagccccagcgccaagctgcaggaggtgctggactacctgaccaacagcgccagcctgcagatgaagagccctgccatcacagccaccctggagggcaagaacagaaccctgtacctgcagagcgtgaccagcattgaggagaggacccggcccaacctgagcaagaccctgaaggagctgggcctggtggatggccaggagctggccgtggctgatgtgaccaccccccagacagtgctcttcaagctgcacttcaccagctag

SEQ ID NO: 17395 - DNA, 2409 bp, Artificial Sequence
  Description of Artificial Sequence: Synthetic coding sequence
atgtggatccaggtgaggaccattgatggcagcaagacctgcaccattgaagatgtgtccaggaaggccaccatcgaggagctgcgggagcgggtgtgggccctgtttgatgtgcggcctgagtgccagaggctcttctaccggggcaagcagctggagaatggctacaccctgtttgattatgatgtgggcctgaatgacatcatccagctgctggtgcggccagaccctgaccacctgcccggcaccagcacccagatcgaggccaagccctgcagcaacagcccccccaaggtgaagaaggccccccgggtgggccccagcaaccagcccagcaccagcgcccgggcccggctgattgaccccggcttcggcatctacaaggtgaatgagctggtggatgccagagatgtgggcctgggcgcctggtttgaggcccacatccacagcgtgacccgggccagtgatggccagagccggggcaagacccccctgaagaatggcagcagctgcaagaggaccaatggaaacatcaagcacaagagcaaggagaacaccaacaagctggacagcgtgcccagcaccagcaacagcgactgtgtggccgcagatgaagatgtgatctaccacatccagtatgatgagtacccagagagcggcaccctggagatgaatgtgaaggacctgcggccccgggcccggaccatcctgaagtggaatgagctgaatgtgggagatgtggtgatggtgaactacaacgtggagagccctggccagaggggcttctggtttgatgctgagatcaccaccctgaagaccatcagcaggaccaagaaggagctgcgggtgaagatcttcctgggcggcagcgagggcaccctgaatgactgcaagatcatctctgtggatgagatcttcaagattgaaagacctggggcccaccccctgagctttgctgatggcaagttcctgcggagaaatgaccctgaatgtgacctgtgtggcggggaccctgagaagaagtgccacagctgcagctgccgggtgtgtggcggcaagcatgagcccaacatgcagctgctgtgtgatgagtgcaatgtggcctaccacatctactgcctgaacccccccctggacaaggtgcctgaggaggagtactggtactgccccagctgcaagacagacagcagcgaggtggtgaaggccggggagcggctgaagatgagcaagaagaaggccaagatgcccagcgccagcacagagagcagaagagactggggccggggcatggcctgtgtgggccgcacccgggagtgcaccatcgtgcccagcaaccactacggccccatccctggcatccctgtgggcagcacctggaggttccgggtgcaggtgtctgaggccggcgtgcaccggccccacgtgggcggcatccacggccgcagcaatgatggagcctacagcctggtgctggccggcggctttgctgatgaggtggacagaggagatgagttcacctacacaggcagcggcggcaagaacctggccggcaacaagagaattggagcccccagcgctgaccagaccctgaccaacatgaacagagccctggccctgaactgtgatgcccccctggatgacaagattggagctgagagcaggaactggagggctgggaagcctgtgcgggtcatccgctccttcaagggcaggaagatcagcaaatatgcccctgaggagggcaacagatatgatggcatctacaaggtggtgaagtactggccagagatcagcagcagccacggcttcctggtgtggagatacctgctgcggagagatgatgtggagcccgccccctggaccagcgagggcatcgagaggagccggcggctgtgcctgcggctgcagtacccagctggctaccccagcgacaaggagggcaagaagcccaagggccagagcaagaagcagcccagcggcaccaccaagaggcccatcagtgatgatgactgccccagcgccagcaaggtgtacaaggccagtgacagcgctgaggccatcgaggccttccagctgaccccccagcagcagcacctgatccgggaggactgccagaaccagaagctgtgggatgaggtgctgagccacctggtggagggccccaacttcctgaagaagctggagcagagcttcatgtgtgtgtgctgccaggagctggtgtaccagcctgtgaccacagagtgcttccacaacgtgtgcaaggactgcctgcagaggagcttcaaggcccaggtgttcagctgcccagcctgcagacatgacctgggccagaactacatcatgatccccaatgagatcctgcagaccctgctggacctcttcttccctggctacagcaagggccgctag

SEQ ID NO: 17396 - DNA, 411 bp, Artificial Sequence
  Description of Artificial Sequence: Synthetic coding sequence
atgtggatccaggtgaggaccattgatggcagcaagacctgcaccattgaagatgtgtccaggaaggccaccatcgaggagctgcgggagcgggtgtgggccctgtttgatgtgcggcctgagtgccagaggctcttctaccggggcaagcagctggagaatggctacaccctgtttgattatgatgtgggcctgaatgacatcatccagctgctggtgcggccagaccctgaccacctgcccggcaccagcacccagatcgaggccaagccctgcagcaacagcccccccaaggtgaagaaggccccccgggtgggccccagcaaccagcccagcaccagcgcccgggcccggctgattgaccccggcttcggcatctacaagggcctggccctgagcccccggctgtag

SEQ ID NO: 17397 - DNA, 339 bp, Artificial Sequence
  Description of Artificial Sequence: Synthetic coding sequence
atgaatgtgaaggacctgcggccccgggcccggaccatcctgaagtggaatgagctgaatgtgggagatgtggtgatggtgaactacaacgtggagagccctggccagaggggcttctggtttgatgctgagatcaccaccctgaagaccatcagcaggaccaagaaggagctgcgggtgaagatcttcctgggcggcagcgagggcaccctgaatgactgcaagatcatctctgtggatgagatcttcaagattgaaagacctggggcccaccccctgagctttgctgatggcaagttcctgcggagaaatgaccctgaatgtgacctgtgtggctag

SEQ ID NO: 17398 - DNA, 897 bp, Artificial Sequence
  Description of Artificial Sequence: Synthetic coding sequence
atgggccccaaggacagcgccaagtgcctgcaccggggcccccagcccagccactgggccgctggagatggccccacccaggagcgctgtggccccaggagcctgggcagccctgtgctgggcctggacacctgccgggcctgggaccacgtggatggccagatcctgggccagctgcggcccctgacagaggaggaggaggaggagggcgctggggccaccctgagccggggccctgccttccctggcatgggcagcgaggagctgcggctggccagcttctatgactggcccctgacagctgaggtgcccccagagctgctggccgctgctggcttcttccacacaggccaccaggacaaggtgcgctgcttcttctgctacggcggcctgcagagctggaagagaggagatgacccctggacagagcacgccaagtggttccccagctgccagttcctgctgcggagcaagggccgggactttgtgcacagcgtgcaggagacccacagccagctgctgggctcctgggacccctgggaggagccagaagatgctgcccctgtggcccccagcgtgcctgccagcggctacccagagctgcccaccccaagaagagaggtgcagagcgagagcgcccaggagcccggcggcgtgtccccagctgaggcccagagggcctggtgggtgctggagcccccaggggccagagatgtggaggcccagctgcggcggctgcaggaggagaggacctgcaaggtgtgcctggacagagctgtgtccatcgtgtttgtgccctgtggccacctggtgtgtgccgagtgtgcccctggcctgcagctgtgccccatctgccgggcccctgtgcgcagccgggtgaggaccttcctgtcctag

SEQ ID NO: 17399 - DNA, 1464 bp, Artificial Sequence
  Description of Artificial Sequence: Synthetic coding sequence
atggtgatcaacctgtgcctgccccagttccggccccgcatccactgcaacaagatctctgcagatggctatgaggtggagaacctgatcagcgaggacctgaccaagaggagccacggcttcagaacagagtacttcatcaagccccctgtgtatgtgacagtgtccttccccttcaacgtggagatctgccgcatcaacatcgacctgacagctgggggcggccagaatgtgacaggcctggagatgtacaccagcgccagcagcagccgggtgtcctggaacaccccccagtgcaggaccctgggccctgctgagcccagcgtgcctgacaaggaggccttcaccctggtgggcaaggtgctgctgaagaaccagagccaggtggtgttcagccaccggggcttcaaggcccggcccccatttggagccatggaggccaccctgcccagccctgctgtggtggcccaggagctgtggaacaagggggccctgagcctgagccacgtggcccacctgcgcatctgcatcacccacgtgactggaggcggcatcccctgcatcaagaggctggaggtgtggggccagcctgccaagacctgcagccaggaggtgattgacagcatcctgctggtgaccagcgagaacctgccccaggatgtggccctgcaggccccagccctgcccatggagagtgactgtgaccccggggaccagcctgagagccagcaggcccccagcagcctgcagaagctggccgagatcatccaggatgtgcctgaggagttcctggaccccatcaccctggagatcatgccctgccccatgctgctgcccagcggcaaggtgattgaccagagcaccctggagaagtgcaacagaagtgaggccacctggggccgggtgcccagcgaccccttcaccggggtggccttcaccccccacagccagcccctgccccaccccagcctgaaggccagaattgaccacttcctgctgcagcacagcatccctggctgccacctgctgggccgggcccagacagccctggccgtcatccccagcagcatcgtgctgcccagccagaagaggaagattgagcaggccgagcacgtgcctgacagcaactttggagtgaatgccagctgcttcagcgccaccagccccctggtgctgcccaccaccagcgagcacacagccaagaagatgaaggccaccaatgagcccagcctgacccacatggactgcagcacagagcagcccggcagcatcctgggcccagaatgtgccagctgcaagagggtcttcagcccctacttcaagaaggagcctgtgtaccagctgccctgtggccacctgctgtgccggccctgcctgggggagaagcagaggagcctgcccatgacctgcacagcctgccagaggcctgtggccagccaggatgtgctgcgggtgcacttctag

SEQ ID NO: 17400 - DNA, 267 bp, Artificial Sequence
  Description of Artificial Sequence: Synthetic coding sequence
atggtgatcaacctgtgcctgccccagttccggccccgcatccactgcaacaagatctctgcagatggctatgaggtggagaacctgatcagcgaggacctgaccaagaggagccacggcttcagaacagagtacttcatcaagccccctgtgtatgtgacagtgtccttccccttcaacgtggagatctgccgcatcaacatcgacctgacagctgggggcggccagaatgtgacaggcctggagatgtacaccagcgccagctag

SEQ ID NO: 17401 - DNA, 1605 bp, Artificial Sequence
  Description of Artificial Sequence: Synthetic coding sequence
atggcccggggcctgcaggtgcccctgccccggctggccaccggcctgctgctgctgctgtctgtgcagccctgggccgagagcggcaaggtgctggtggtgcccacagatggcagcccctggctgtccatgagggaggccctgcgggagctgcacgcccggggccaccaggccgtggtgctgaccccagaggtgaacatgcacatcaaggaggagaagttcttcaccctgacagcctatgctgtgccctggacccagaaggagtttgacagagtgaccctgggctacacccagggcttctttgaaacagagcacctgctgaagcgctacagccgctccatggccatcatgaacaacgtgtccctggccctgcaccgctgctgcgtggagctgctgcacaatgaggccctgatccgccacctgaatgccaccagctttgatgtggtgctgacagatcctgtgaacctgtgtggggctgtgctggccaagtacctgagcatcccagctgtgttcttctggagatacatcccctgtgacctggacttcaagggcacccagtgccccaaccccagcagctacatccccaagctgctgaccaccaacagcgaccacatgaccttcctgcagagggtgaagaacatgctgtaccccctggccctgagctacatctgccacaccttcagcgccccctatgccagcctggccagcgagctgttccagcgggaggtgtctgtggtggacctggtgtcctatgcctctgtgtggctgttccggggggactttgtgatggactacccccggcccatcatgcccaacatggtgttcatcggcggcatcaactgtgccaacgggaagcccctgagccaggagtttgaggcctacatcaatgccagcggggagcacggcatcgtggtgttcagcctgggctccatggtgtctgagatccctgagaagaaggccatggccatcgcagatgccctgggcaagatcccccagacagtgctgtggagatacacaggcacccggcccagcaacctggccaacaacaccatcctggtgaagtggctgccccagaatgacctgctgggccaccccatgacccgggccttcatcacccacgccggcagccatggagtgtatgagagcatctgcaatggagtgcccatggtgatgatgcccctgtttggagaccagatggacaatgccaagaggatggagaccaagggggccggcgtgaccctgaatgtgctggagatgaccagcgaggacctggagaatgccctgaaggccgtcatcaatgacaagagctacaaggagaacatcatgaggctgagcagcctgcacaaggacaggcctgtggagcccctggacctggccgtgttctgggtggagtttgtgatgaggcacaagggggccccccacctgcggcctgctgcccatgacctgacctggtaccagtaccacagcctggatgtgattggcttcctgctggccgtggtgctgactgtggccttcatcaccttcaagtgctgtgcctacggctacaggaagtgcctgggcaagaagggccgggtgaagaaggcccacaagagcaagacccactag

SEQ ID NO: 17402 - DNA, 1596 bp, Artificial Sequence
  Description of Artificial Sequence: Synthetic coding sequence
atgatggatggccgcctgctggagcacccccacgcccagtttggaggcagcctgggcggcgtggtgggcttcccctaccccctgggccaccaccacgtgtatgagctggccggccaccagctgcagagcgctgctgctgctgcctctgtgcccttcagcattgatggcctgctgggcggcagctgtgccgctgctgcctctgtggtgaaccccacccccctgctgcctgctgcctgtggggtgggcggagatggccagcccttcaagctgagtgacagcggggaccctgacaaggagagccctggctgcaagagaagaaggaccaggaccaacttcaccggctggcagctggaggagctggagaaggccttcaatgaaagccactacccagatgtgttcatgagggaggccctggccctgcggctggacctggtggagagccgggtgcaggtgtggttccagaacagaagagccaagtggaggaagaaggagaacaccaagaagggccctggccgcccagcccacaacagccaccccaccacctgcagcggggagcccatggaccctgaggagatcgccaggaaggagctggagaagatggagaagaagaagaggaagcatgagaagaagctgctgaagagccagggccgccacctgcacagccctgggggcctgagcctgcacagcgcccccagcagtgacagcgacagcggcggcggcggcctgagccctgagcccccagagcccccacctcctgctgccaagggccctggggcccacgccagcggggctgctggaacagccccagcccctcctggagagcccccagcccctggcacctgtgaccctgccttctaccccagccagaggtctggagctggcccccagcccaggcctggccggcctgctgacaaggatgctgccagctgtggccctggagctgctgtggccgctgtggagagaggagctgctggcctgcccaaggccagccccttctctgtggagagcctgctgagtgacagcccccccaggaggaaggccgccagcaatgctgctgctgctgctgctgctggcctggactttgcccctggcctgccctgtgcccccaggaccctgattggcaagggccacttcctgctgtaccccatcacccagcccctgggcttcctggtgccccaggccgccctgaagggcggggccggcctggagcccgcccccaaggatgcccccccagccccagctgtgcccccagcccccccagcccaggccagctttggagccttcagcggccctggaggagccccagattctgcctttgcccggcgcagcccagatgctgtggccagccctggggccccagccccagccccagcccccttccgggacctggccagcgctgctgccacagaaggaggcggcggggactgtgctgatgctggaacagctggccctgcccctcctcctccagcccccagccccaggcctggccccaggcctcccagccctgctgaggagcccgccacctgtggggtgcctgagcccggggctgctgctggccccagccccccagagggggaggagctggacatggactag

SEQ ID NO: 17403 - DNA, 255 bp, Artificial Sequence
  Description of Artificial Sequence: Synthetic coding sequence
atggccctgagcagccagatctgggccgcctgcctgctgctgctgctgctgctggccagcctgaccagcggctctgtgttcccccagcagacaggccagctggccgagctgcagccccaggacagagctggggcccgggcctcctggatgcccatgttccagaggagaagaagaagagacacccacttccccatctgcatcttctgctgcggctgctgccacaggagcaaatgtggcatgtgctgcaagacctag

SEQ ID NO: 17404 - DNA, 840 bp, Artificial Sequence
  Description of Artificial Sequence: Synthetic coding sequence
atggacatgctggaccccggcctggaccctgctgccagcgccacagctgctgctgctgccagccatgacaagggccctgaggccgaggagggcgtggagctgcaggagggcggagatggccctggagctgaggagcagacagctgtggccatcacctctgtgcagcaggccgcctttggagaccacaacatccagtaccagttcagaacagagaccaatggaggccaggccgtcatccagaaccccttcagcaatggaggcagccctgctgctgaggccgtgtctggagaggccaggtttgcctacttccctgccagctctgtgggggacaccacagctgtgtctgtgcagaccacagaccagagcctgcaggccggcggccagttctacgtgatgatgaccccccaggatgtgctgcagacaggcacccagaggaccatcgcccccaggacccacccctacagccccaagattgatggcaccaggaccccaagagatgagaggagaagagcccagcacaatgaggtggagaggagaagaagagacaagatcaacaactggatcgtgcagctgagcaagatcatcccagactgcaatgctgacaacagcaagacaggagccagcaaaggaggcatcctgagcaaggcctgtgactacatccgggagctgcggcagaccaaccagaggatgcaggagaccttcaaggaggccgagcggctgcagatggacaatgagctgctgcggcagcagatcgaggagctgaagaatgaaaatgccctgctgcgggcccagctgcagcagcacaacctggagatggtgggggagggcacccggcagtag

SEQ ID NO: 17405 - DNA, 648 bp, Artificial Sequence
  Description of Artificial Sequence: Synthetic coding sequence
atggacatgctggaccccggcctggaccctgctgccagcgccacagctgctgctgctgccagccatgacaagggccctgaggccgaggagggcgtggagctgcaggagggcggagatggccctggagctgaggagcagacagctgtggccatcacctctgtgcagcaggccgcctttggagaccacaacatccagtaccagttcagaacagagaccaatggaggccagacaggcacccagaggaccatcgcccccaggacccacccctacagccccaagattgatggcaccaggaccccaagagatgagaggagaagagcccagcacaatgaggtggagaggagaagaagagacaagatcaacaactggatcgtgcagctgagcaagatcatcccagactgcaatgctgacaacagcaagacaggagccagcaaaggaggcatcctgagcaaggcctgtgactacatccgggagctgcggcagaccaaccagaggatgcaggagaccttcaaggaggccgagcggctgcagatggacaatgagctgctgcggcagcagatcgaggagctgaagaatgaaaatgccctgctgcgggcccagctgcagcagcacaacctggagatggtgggggagggcacccggcagtag

SEQ ID NO: 17406 - DNA, 6816 bp, Artificial Sequence
  Description of Artificial Sequence: Synthetic coding sequence
atgggcgtgcccaagaggaaggccagcggcggccaggatggagctgccagcagcgctggagctgccaagagggccaggaaggaggagctgactggagtgcgcttcaaggcccagctgaaggacccccagggccctggccctggcctggaggcctttgtgtctgctgccaagaagctgccccgggaggatgtgtatgatgtggtggagggctacatcaagatctctgtggagtgtgtggagatcttccagctgctgagcggggagaagaggcctgagagcgagaccatgctgatcttccaggtgtttgaggccatcctgctgaggacagccagtgacctgagccacttccacgtggtgggcaccaacatcgtgaagaagctgatgaacaaccacatgaagctgatctgtgagagcctgtatgccagcggctaccgcctggcccgggcctgcctgagcctgatgacagccatggtgacccagggccctgaggccgccagagatgtgtgcagccactttgacctgaacaagaagaccctgtacaccctggtgaccaagagggacagcaaaggagtgtatgatgtgcggcaggcctacgtgcagtttgccctgtccttcctgattgctggagatgacagcaccatcgtgcaggtgctggaggtgaaggagttcatcccctgcatcttcagcagcggcatcaaggaggaccgcatcagcaccatcaacatcctgctgagcaccctgaagaccaaggtggtgcacaacaagaacatcaccaagacccagaaggtgcgcttcttcaccggccagctgctgaaccacatcgccagcctgtacaactggaatggcatcacagatgtgaacccagaaaatgtgaaggtgtctgctgaggaggccggcaagaccatggtgcgggagctggtgcacaacttcctgatggacctgtgctgcagcctgaagcacggcatcaacttctatgatgccagcctgggcaccttcggccggggcggcaacctgaccctgctgcacttcctgctgggcctgaagacagctgctgatgatgacctggtggccgacctggtggtgaacatcctgaaggtgtgcccagacctgctgaacaagtacttcaaggaggtgaccttctccttcatcccccgggccaagagcacctggctgaacaacatcaagctgctgaacaagatctatgaggcccagcctgagatcagccgggccttccagacccgggagttcatccccctgccccggctgctggccatggtgatggtgaccaccgtgcccctggtgtgcaacaagtccatgttcacccaggccctgaacctggacagcacctctgtgcgccacacagccctgagcctcatcagcgtcatcctgaagagggccctgaagacagtggaccactgcctgaacaaggaggtgtggcaggagagcggcgtgtacacagctgtgatgatggaggagtttgtgcagctgttccgggaggccctgagcaagatcctgcctgacctgaacacagtggtgtgggtgtggcagagcctgaagaagcaggagaccaagcaggatgacaagaagggccagaagagaagtgatggccccccagctgcctgtgatgcccaccagtgtgatgatgctgagaccatcctgctgaaggctgtgctgctgcaggtgatctgcctgtaccagaaggtggtgccccacgtggtgatgcagtacaactttgacttcagcaagctgctgaagggcgtcatcagcgagcagggcctgcgggaggaggtgccccccatcctgcagcaccacatgctgaaggtggccctggagctgcctgccagcaagttcctgtggctgaaggcccaggagggcccagatgctgagatcattggaggagagaggagcgtcttctacctgctgatgaagatgtttgtgaccagcagccacctgcagctgaagagcctgaccaagctgctgatcatgaagatcctgcgggacaccggggtgtttgagcacacctggaaggagctggagctgtggctggagcacctggagaacaccatggaggaggacaaggagaccgtcatccagttcctggagcgcatcctgctgaccctggtggccaacccctacagctacacagacaaggccagtgactttgtgcaggaggcctccatgctgcaggccaccatgaccaagcaggaggctgatgacatgagcatccccatcagccacattgatgatgtgctggacatggtggatgtgctggtggagggcagcgagggcctggatgaggagatcggcttcaccctgtctgaggacatgatcctgctgaccttccccttctctgctgtggtgcctgctgccctggaggccaggaacaagctgctgctgggcactggaaatgaagctgctgaaaatgtggtgacctacctgacagctgtgctgacagacctgctgcacacccagagggaccccctggccctgtgcctgctgctgcaggcctatgacaagctggagcccccctgcctggtgccctgctgccagcagctgagccgcttcaaccgctactacagcctgtggatccctgagcaggcccgggaggcctggctgctgcaggcccagggcagccccagccccccagccctgcccctggccagcagcttcaccgccctgctgcaggccgcctatgagagccaggccctgagagatgagcacatccaggtgcagctgcaggccaccatgccccacctgtccatgcagcaggtgctgctggccgccaagcaggtgctgctgtacctgcggagcacagtggagaactttggccagctgggccgctctgtgggcccccccctgctgcagctgttcctggacctgctgcggcggctggtggtgcactgtgagcagctggatgcccagaaccagcagagatgtgaggccgcccgggcagaggccgacctcttcctggacatggagagcgtggccagcctggagctggccaatgaccagaccctggaggaggtgctggtggccatcctgcggcaccccaccctggagggctggttcctggccctggagcagcaggccctgcccccccacaccctgagccctgtgctggtgaagctgctggccacccacttctctgctggggtgctgcagctgctggccgccagcgcccccatcctgcagaacatcggccagctgggcctgctggcccgctacagcgaggccatcacccagagcgtgctgaaggagctgcagaacagaagagctggccctgccaccagcccccccaagaccccaccccagctggaggccctgcaggagctgcacccctacatggagggcgcccagctgcgggaggtgaccctggccctgctgagcctgcctgagacccacctggtgacccagcagcccaccaagagccctgggaaggagcggcacctgaatgccctgggcaagaccctggtgcagctgctgacctgcagcccccaggaccagctgcagagcggggagctgctgtggagcagtgaatatgtgcggggcctgggcgccctgctgcccaccctggccgtggatgagctggacacagtgctgctgcacaccctgcagagggaccctgtgctggccccagctgtgggcgctgacctgctggactactgcctggcccggaggacccaggccgccctgagcattgctgccctgctgctgcaggagagctgcacccacctgctgtggtttgagcagtggtgcctgcaggccggccctggcctgggcctgcagggcgacctggatgacttcctgcccctcatccacgtgtacctgcagtgcaggaccaggagccacttcaccaggcctgctggggtgagcagcgctgtgattcctgtgctgaggaagaccctgtggaggcagctgcagagccggctgctgagcacagacagccccccagccagcggcctgtaccaggagatcctggcccagctggtgccctttgcccgggccaaggacctgtctgtgctgatggaccggctgcccagcctgctgcacacccccagcagccacaagcgctggatcgtggccgacagcatctctgctgccctggagggcagcgctgaggagctgtgtgcctggaggaggaccctgctggagagctgtgtgaagtggctgattgtgtccttcagcggcggccagcaggatgatgacaacacccagaaccaggagaaggagatgctgctgcggctgaatgccctgctgcacgccctgaatgaggtggaccccggggactggcagaagtttgtgaagaagggcctgaagttccgctaccaggaccacaccttcctgaagatgctgctgacagctgtgcagctgctgtacagccctgagagctctgtgaggaccaagctgatccagctgcctgtggtgtatgtgatgctgatgcagcacagcctcttcctgcccaccctgctgaccagtgatggagaggagagcccagacagccaggtgaaggaggccctggtggacctgatgctgactgtggtggagatgtgccccagcgtgtgtgagagcagccactttgctgtgctgctgggcgcctatggagccaccctgtctgtgctggaccagaagatcctgctgctgctgcgggcctatgagcagaacaagctgagcctcatcaacttccgggtgctgctgtggggccctgctgctgtggagcaccacaagacctgccgcagcctgggccgcagcctgtggcagcagcccagcgtgggggacatcctgcggctgctggaccgggacaggatgatgcagaccatcctgcacttcccccagaacagaaggctgctgcccccagaggacacccaggagctgatcttcaaggacaagagccgggtggacctggatggcctgtatgacccctgcttcctgctgcagctgttcagcgagctgaccaggcctgagtttgtggtggactgcaggaagttcctggacagcaatgccctgggcctgactgtgacagccctgagcagctatgacccccagatgagggccatcgcctaccacgtgctggccgcctactacagccacctggagggcgcccgcttccaggagcagagccagctgctgtacctgctggatgtggtgagaaatggcatccgcacccaggacatgaggctgaccttcaccctggccctcttcatcgccaaggccgccctgcagatcctgaagccagaggagcacatgtacctgaaggtgagcaacttcctgctgagccatgagtacctgaacatggacaaggtgcccggcttctaccagttcttctacagcagtgactttgagcagaagacagagcagaagtgggtgtttggagtgctgcggcagggcatccgggacaagcagtgctatgagctgtgtgcccggcggggcatcttccacatcatcctgtccttcttccacagccccctgtgtgatgaggccgcccagaactggatcctggagatcctgcagaatgctgcccaggtggcccggagcgcctatgagatcatccgggactacagcctgctgacctggatcctgcacatcctggagagcaagttcctggagacccccctgctgagcaatgtcatcagcctgctgcacaccctgtgggtgaccaacctgggggacaaggctgtggagtgggagagccagaggctgtgccagcccagcagccaggagcccgccaagaggctggccctgcacctggtgaatgagttcctgtatgtgctgattgtgctgatgaagcacctgcggcccaccctggcccctgtgcagctgaccaacttcttcggcaccctggacagcgtgctgcgctaccgggccaccgtcatccaggccttccgggacatgaaccgcttcaccgtgaatgaaacagtgctgagcaccaaggatgtgctggtgctgctgcacaagtggagcctcatcgagcgggacctgaagctgcaggaggacctgcgggccgccatcgagaaggcccaggcccgggagctgatgaagatgctgaaggacaagaacaagcctgtgatgcctgcccgggccaagggcccccggggcaggaagaggaggcctggagaggccgaggagatggctgaccctgagctgatggccagcaccctggagacctgcaagggcctgctgcggagcatcctgacctactggaggcctgtgattcctggccctgaccccacccaggagcctgtggacagcgccagccctgagagtgatgcccctggccctgtgtatgctgctgccagcctggccgtgtcctgggtgctgcggtctgtggccgagcaccccctgagcagagctgaggccgccggcctcatcggctggctgaagagccacatcctgccccaccctgtggtggtggccgacctgctgaaggacagcgctgtgcgcagcagcatcttccggctgtacagccggctgtgtggggctgagggcctggccggccctgtgcaggaggtggcctgcctcttcaacacagtgatgctgcagctggtggccgcccagggccgggccggcagccccttccacccagccatggaggccctgagcctgagcagcctgtctgagaaggatgaggccacccaggccagcgctgccttcctggtgtccctgtacatcaaggacatctggctgggcgcccagaggccagacaccctgctgacccacgtgaggatggtgtgtgaggccgcagatgatgcccccagcagcgaggaggaggccatcgtggtgctgtgcaaggatgctgccagcgctgccagtgatgcctag

SEQ ID NO: 17407 - DNA, 4575 bp, Artificial Sequence
  Description of Artificial Sequence: Synthetic coding sequence
atggctgctgtgtacagcggcatcagcctgaagctgaagagcaagaccacctcctgggaggacaagctgaagctggcccactttgcctggatcagccaccagtgcttcctgcccaacaaggagcaggtgctgctggactgggcccggcagagcctggtggccttctacaagaagaagctggagctgaaggaggacatcgtggagcggctgtggatctacatcgacaacatcctgcacagcaggaagctgcagaacctgctgaagaatggcaagaccatcaacctgcagatcagcctggtgaagatcatcaatgaaagagtggccgagttcagcctgagcggcagccagaggaacatctgtgctgtgctgcgctgctgccagggcatcctgagcaccccagccctggccgtcatctacacagccaagcaggagctgatggtggccctgctgagccagctgtgctggagcgcctgccggcagcctgagggcgctgtggtggcccagctgtttgaggtgatccacctggccctgggccactacctgctgatcctgcagcagcaggtgaacccccggcgggcctttggagatgtgacagcccacctgctgcagccctgcctggtgctgcggcacctgctgagcggcggcacctggacccaggccggccagggccagctgcggcaggtgctgagccgggacatccgcagccagatcgaggccatgttccggggcggcatcttccagcctgagctgctgagcagctacaaggagggcctgctggaccagcagcagggagatgtgaagacaggagccatgaagaacctgctggcccccatggacacagtgctgaaccggctggtggatgctggctactgtgccgccagcctgcacacctctgtggtggccaacagcgtggccctgctgtacaagctgttcctggacagctacttcaaggagggcaaccagctgctgtgcttccaggtgctgccccggctgtttggctgcctgaagatcagccacctgcaggaggagcagagcaaggccctgagcaccagtgactggaccacagagctgctggtggtggagcagctgctgaacagcgtggccaacaacaacatctacaacattgctgctgaccgcatcagacatgaggaggcccagttccgcttctaccgccacgtggccgagctgctgatcaaccacgcccaggcccccatcccagcctggttccgctgcctgaagaccctcatcagcctgaaccacctgatcctggagccagacctggatgacctgctggccagcgcctggattgatgctgaggtgacagagttccgcaccaagaaggcccaggaggccctgatcagaacagtgttccagacctacgccaagctgcggcaggtgccccggctgtttgaggaggtgctgggcgtcatctgcaggcctgctgctgaggccctgcggcagcctgtgctggccagcggccccagcacagtgctgagcgcctgcctgctggagctgccccccagccagatcctggacacctggagcctggtgctggagaagttccagagcctggtgctgccctacctgcagagtgatgctgacatggccctgaagagcctgagcctgagcctgctgctgcactgcatcatgttcaacatgaggagcctggacagcagcacccccctgcccatcgtgcggaggacccagtgcatgatggagaggatgatgagggagctggtgcagcccctgctggccctgctgcctgacaccccaggccctgagcctgagctgtggctgcagaaggtgtctgattctgtgctgctgctgagctacacctgggcccaggtggatgccatgttcagcctgaactgcagccagtaccacagcatgagcggccccctgattggagtggccctggagatcagcaacctgcccagcctgctgcccggggtgaagacccagcactggaagaagattgagaagttcaccgcccagttcagcagcctgggcacctactgcctggagcagctgtacctgcagaagatgaagaggaccctgatgcagaccagcttccgctctgagggcgccatccagagcctgcgctgtgatgctgccttcatcatcggcagcggcaggaagagcctgaaccagaggaccacagcctcctgggatggccaggtgggcatggtgtctggcctgacctaccctgtggcccactggcacctgattgtgagcaacctgaccatcctgatctcctacctgtgcccagatgatgtgggctacctggcctctgtgctgctgcggaccctgcccatgggcaaggcccaggaggtgtccattgatgaggaggcctacatcaccctggagaagatcagcaaggccttcctgcacagccccctcttccctgagatgcagagcctgcacagcgccttcctgacctgtgtgaccaccagctgcagcagcatcctgtgcagcggggcccagagggacagcggcctggtgtcccagcagctgccctggctgtttgagaaggaccacatggtggtgggccactgggagaacagatttgccaaggccggccctgagggcatcgagcccagaggagagatcgcccagaacctgctgagcctggtgaagagtgacttccccatccagctggagggggagcagctggagagcatcctgggcctgctggaggtgatcagcgccctgcagctggacagcctgctgcccccctaccacgtgcactacttcctggtgctgctgtccatggctgtgaccaagctgggctgcagctgcagcagcagcctggccctgaagttcctgaccacctgctaccagctgctgggctacctgcagaagggcaagagcgcccggagcgtcttcaagatcatgtatggcagtgacatctttgaggtggtgctgaccagcctcttccgggccagcagccgcttcctgattgagatggatgatcctgcctggctggagttcctgcaggtgattggcaccttcctggaggagctgatgcagatgctgatccagatgaagctgagcctggtgctgaacttcaggaagatcacagccttcctgagcagcagcaagccctacacagaagctgccagcagcaagcagctggagaaccagaacccccagggccggcagctgctgctggtgtccctgacccggctgtgccacgtgctgggccccttcctgaaggagcagaagctgggccaggaggccccagctgccctgtctgagctgctgcagcaggtggtgctgcagacaggagctgtgctgcagctgtgcagcgtgcctggggcccggggctggaggctgcccagcgtgctgatcagctctgtgtccaccctgctggaggccgacctgggccagcactgcagagatggcggcgctgacatcagccagggcagtgacaggaccctgctgagccacgtggccctgtaccagggcgtgtacagccagatcctgctggagctgcctgccctggccggccatgaccagagcttccaggccgccctgcagttcctgaccctcttcttcctggcccctgagctgcaccccaagaaggacagcgtcttcacctccatgttccacagcgtgagaagagtgctggccgaccctgagatccctgtgcaggtgacccaggacatcgagccccacctgggcgccctcttcacccagatgctggaggtgggcaccacagaggacctgcggctggtgatgcagtgcatcctgcagggcctggatgtgagcaacatgtggaaggcagatgtgcaggccgtggtgtctgctgtgaccctgctgcggctgctgctgaactgccccctgtctggagagaaggccagcctgctgtggagggcctgcccccagatcgtgacagccctgaccctgctgaaccgggaggccagccaggagcagcctgtgtccctgactgtggtgggccctgtgctggatgtgctggccgccctgctgcggcagggcgaggaggccatcggcaacccccaccacgtgtccctggccttcagcatcctgctgactgtgcccctggaccacctgaagcccctggagtatggctctgtgttcccccggctgcacaacgtgctcttcagcatcctgcagtgccaccccaaggtgatgctgaaggccatccccagcttcctgaacagcttcaaccggctggtgttttctgtgatgagggagggccggcagaaggacaagggcagcattgatgacctgcccaccgtgctgaagtgtgcccggctggtggagaggatgtacagccacatcgccgcccgggcagaggagtttgctgtgttcagccccttcatggtggcccagtatgtgctggaggtgcagaaggtgaccctgtacccagctgtgaagagcctgctgcaggagggcatctacctgatcctggacctgtgcatcgagccagatgtgcagttcctgcgggccagcctgcagcccggcatgagggacatcttcaaggagctgtacaatgactacctgaagtaccacaaggccaagcatgaaggagagaagcgctacacagcctag

SEQ ID NO: 17408 - DNA, 255 bp, Artificial Sequence
  Description of Artificial Sequence: Synthetic coding sequence
atgctgaaggccatccccagcttcctgaacagcttcaaccggctggtgttttctgtgatgagggagggccggcagaaggacaagggcagcattgatgacctgcccaccgtgctgaagtgtgcccggctggtggagaggatgtacagccacatcgccgcccgggcagaggagtttgctgtgttcagccccttcatggtggcccagtatgtgctggaggtgcagaaggtgaccctgtacccagctgtgaagagctag

SEQ ID NO: 17409 - DNA, 1812 bp, Artificial Sequence
  Description of Artificial Sequence: Synthetic coding sequence
atgaagggggacttcaggaagaagaagtctgaggcccggacccccctggagcaggagatcttcaacctgctgcacaagaacaagcagcctgtgacagaccccctgctgacccctgtggagaaggccagcctgcgggccatgagcctggaggaggccaagatgagaagagctgagctgcagagggcccgggccctgcagagctactatgaggccaaggcccggcgggagaagaagatcaagagcaagaagtaccacaaggtggtgaagaagggcaaggccaagaaggccctgaaggagtttgagcagctgaggaaggtgaacccagctgctgccctggaggagctggagaagattgagaaggccaggatgatggagaggatgagcctgaagcaccagaacagcggcaagtgggccaagagcaaggccatcatggccaagtatgacctggaggcccggcaggccatgcaggagcagctgagcaagaacaaggagctgacccagaagctgcaggtggccagcgagagcgaggaggaggagggcggcacagaagatgtggaggagctgctggtgcctgatgtggtgaatgaggtgcagatgaatgctgatggccccaacccctggatgctgcggagctgcaccagtgacaccaaggaggccgccacccaggaggaccctgagcagctgcctgagctggaggcccacggcgtgtctgagagcgagggggaggagaggcctgtggccgaggaggagatcctgctgcgggagtttgaggagaggaggagcctgaggaagaggtctgagctgagccaggatgctgagcctgctggcagccaggagaccaaggacagcggcagccaggaggtgctgtctgagctgcgggtgctgagccagaagctgaaggagaaccaccagagcaggaagcagaaggccagcagcgagggcaccatcccccaggtgcagcgggaggagcccgcccctgaggaggaggagcccctgctgctgcagaggcctgagcgggtgcagaccctggaggagctggaggagctgggcaaggaggagtgcttccagaacaaggagctgcccaggcctgtgctggagggccagcagagcgagaggacccccaacaacagaccagatgcccccaaggagaagaagaagaaggagcagatgattgacctgcagaacctgctgaccacccagagccccagcgtgaagagcctggccgtgcccaccatcgaggagctggaggatgaggaggagaggaaccaccggcagatgatcaaggaggcctttgctggagatgatgtgatccgggacttcctgaaggagaagcgggaggccgtggaggccagcaagcccaaggatgtggacctgaccctgcccggctggggcgagtggggcggcgtgggcctgaagcccagcgccaagaagagaagacgcttcctgatcaaggcccctgagggcccccccaggaaggacaagaacctgcccaacgtcatcatcaatgagaagaggaacatccatgctgctgcccaccaggtgcgggtgctgccctaccccttcacccaccactggcagtttgagaggaccatccagacccccatcggcagcacctggaacacccagagggccttccagaagctgaccacccccaaggtggtgaccaagccaggccacatcatcaaccccatcaaggcagaagatgtgggctaccgcagcagcagcagaagtgacctgagcgtcatccagaggaaccccaagaggatcaccaccaggcacaagaagcagctgaagaagtgcagcgtggactag

SEQ ID NO: 17410 - DNA, 2154 bp, Artificial Sequence
  Description of Artificial Sequence: Synthetic coding sequence
atgaggggcaccatgatggagcgggagagcatcaagagcttctggaagcagagcgtgcccctgatggagagaattggcagcggggagaagctggtgctggccgacctgctggagcctgtgaagaccagcagcagcctggccaccgtgaagaagcagctgagccgggtgaagagcaagaagacagtggagctgcccctgaacaaggaggagattgagcgcatccaccgggaggtggccttcaacaagacagcccaggtgctgagcaagtgggaccctgtggtgctgaagaaccggcaggccgagcagctggtgttccccctggagaaggaggagcccgccatcgcccccattgaacatgtgctgagcggctggaaggcccggacccccctggagcaggagatcttcaacctgctgcacaagaacaagcagcctgtgacagaccccctgctgacccctgtggagaaggccagcctgcgggccatgagcctggaggaggccaagatgagaagagctgagctgcagagggcccgggccctgcagagctactatgaggccaaggcccggcgggagaagaagatcaagagcaagaagtaccacaaggtggtgaagaagggcaaggccaagaaggccctgaaggagtttgagcagctgaggaaggtgaacccagctgctgccctggaggagctggagaagattgagaaggccaggatgatggagaggatgagcctgaagcaccagaacagcggcaagtgggccaagagcaaggccatcatggccaagtatgacctggaggcccggcaggccatgcaggagcagctgagcaagaacaaggagctgacccagaagctgcaggtggccagcgagagcgaggaggaggagggcggcacagaagatgtggaggagctgctggtgcctgatgtggtgaatgaggtgcagatgaatgctgatggccccaacccctggatgctgcggagctgcaccagtgacaccaaggaggccgccacccaggaggaccctgagcagctgcctgagctggaggcccacggcgtgtctgagagcgagggggaggagaggcctgtggccgaggaggagatcctgctgcgggagtttgaggagaggaggagcctgaggaagaggtctgagctgagccaggatgctgagcctgctggcagccaggagaccaaggacagcggcagccaggaggtgctgtctgagctgcgggtgctgagccagaagctgaaggagaaccaccagagcaggaagcagaaggccagcagcgagggcaccatcccccaggtgcagcgggaggagcccgcccctgaggaggaggagcccctgctgctgcagaggcctgagcgggtgcagaccctggaggagctggaggagctgggcaaggaggagtgcttccagaacaaggagctgcccaggcctgtgctggagggccagcagagcgagaggacccccaacaacagaccagatgcccccaaggagaagaagaagaaggagcagatgattgacctgcagaacctgctgaccacccagagccccagcgtgaagagcctggccgtgcccaccatcgaggagctggaggatgaggaggagaggaaccaccggcagatgatcaaggaggcctttgctggagatgatgtgatccgggacttcctgaaggagaagcgggaggccgtggaggccagcaagcccaaggatgtggacctgaccctgcccggctggggcgagtggggcggcgtgggcctgaagcccagcgccaagaagagaagacgcttcctgatcaaggcccctgagggcccccccaggaaggacaagaacctgcccaacgtcatcatcaatgagaagaggaacatccatgctgctgcccaccaggtgcgggtgctgccctaccccttcacccaccactggcagtttgagaggaccatccagacccccatcggcagcacctggaacacccagagggccttccagaagctgaccacccccaaggtggtgaccaagccaggccacatcatcaaccccatcaaggcagaagatgtgggctaccgcagcagcagcagaagtgacctgagcgtcatccagaggaaccccaagaggatcaccaccaggcacaagaagcagctgaagaagtgcagcgtggactag

SEQ ID NO: 17411 - DNA, 2316 bp, Artificial Sequence
  Description of Artificial Sequence: Synthetic coding sequence
atgacagccaaccggctggccgagagcctgctggccctgagccagcaggaggagctggccgacctgcccaaggactacctgctgtctgagagtgaagatgaaggagacaatgatggagagaggaagcaccagaagctgctggaggccatcagcagcctggatggcaagaacagaaggaagctggccgagaggtctgaggccagcctgaaggtgtctgagttcaacgtgagcagcgagggcagcggggagaagctggtgctggccgacctgctggagcctgtgaagaccagcagcagcctggccaccgtgaagaagcagctgagccgggtgaagagcaagaagacagtggagctgcccctgaacaaggaggagattgagcgcatccaccgggaggtggccttcaacaagacagcccaggtgctgagcaagtgggaccctgtggtgctgaagaaccggcaggccgagcagctggtgttccccctggagaaggaggagcccgccatcgcccccattgaacatgtgctgagcggctggaaggcccggacccccctggagcaggagatcttcaacctgctgcacaagaacaagcagcctgtgacagaccccctgctgacccctgtggagaaggccagcctgcgggccatgagcctggaggaggccaagatgagaagagctgagctgcagagggcccgggccctgcagagctactatgaggccaaggcccggcgggagaagaagatcaagagcaagaagtaccacaaggtggtgaagaagggcaaggccaagaaggccctgaaggagtttgagcagctgaggaaggtgaacccagctgctgccctggaggagctggagaagattgagaaggccaggatgatggagaggatgagcctgaagcaccagaacagcggcaagtgggccaagagcaaggccatcatggccaagtatgacctggaggcccggcaggccatgcaggagcagctgagcaagaacaaggagctgacccagaagctgcaggtggccagcgagagcgaggaggaggagggcggcacagaagatgtggaggagctgctggtgcctgatgtggtgaatgaggtgcagatgaatgctgatggccccaacccctggatgctgcggagctgcaccagtgacaccaaggaggccgccacccaggaggaccctgagcagctgcctgagctggaggcccacggcgtgtctgagagcgagggggaggagaggcctgtggccgaggaggagatcctgctgcgggagtttgaggagaggaggagcctgaggaagaggtctgagctgagccaggatgctgagcctgctggcagccaggagaccaaggacagcggcagccaggaggtgctgtctgagctgcgggtgctgagccagaagctgaaggagaaccaccagagcaggaagcagaaggccagcagcgagggcaccatcccccaggtgcagcgggaggagcccgcccctgaggaggaggagcccctgctgctgcagaggcctgagcgggtgcagaccctggaggagctggaggagctgggcaaggaggagtgcttccagaacaaggagctgcccaggcctgtgctggagggccagcagagcgagaggacccccaacaacagaccagatgcccccaaggagaagaagaagaaggagcagatgattgacctgcagaacctgctgaccacccagagccccagcgtgaagagcctggccgtgcccaccatcgaggagctggaggatgaggaggagaggaaccaccggcagatgatcaaggaggcctttgctggagatgatgtgatccgggacttcctgaaggagaagcgggaggccgtggaggccagcaagcccaaggatgtggacctgaccctgcccggctggggcgagtggggcggcgtgggcctgaagcccagcgccaagaagagaagacgcttcctgatcaaggcccctgagggcccccccaggaaggacaagaacctgcccaacgtcatcatcaatgagaagaggaacatccatgctgctgcccaccaggtgcgggtgctgccctaccccttcacccaccactggcagtttgagaggaccatccagacccccatcggcagcacctggaacacccagagggccttccagaagctgaccacccccaaggtggtgaccaagccaggccacatcatcaaccccatcaaggcagaagatgtgggctaccgcagcagcagcagaagtgacctgagcgtcatccagaggaaccccaagaggatcaccaccaggcacaagaagcagctgaagaagtgcagcgtggactag

SEQ ID NO: 17412 - DNA, 2160 bp, Artificial Sequence
  Description of Artificial Sequence: Synthetic coding sequence
atgacagccaaccggctggccgagagcctgctggccctgagccagcaggaggagctggccgacctgcccaaggactacctgctgtctgagagtgaagatgaaggagacaatgatggagagaggaagcaccagaagctgctggaggccatcagcagcctggatggcaagaacagaaggaagctggccgagaggtctgaggccagcctgaaggtgtctgagttcaacgtgagcagcgagggcagcggggagaagctggtgctggccgacctgctggagcctgtgaagaccagcagcagcctggccaccgtgaagaagcagctgagccgggtgaagagcaagaagacagtggagctgcccctgaacaaggaggagattgagcgggcccggacccccctggagcaggagatcttcaacctgctgcacaagaacaagcagcctgtgacagaccccctgctgacccctgtggagaaggccagcctgcgggccatgagcctggaggaggccaagatgagaagagctgagctgcagagggcccgggccctgcagagctactatgaggccaaggcccggcgggagaagaagatcaagagcaagaagtaccacaaggtggtgaagaagggcaaggccaagaaggccctgaaggagtttgagcagctgaggaaggtgaacccagctgctgccctggaggagctggagaagattgagaaggccaggatgatggagaggatgagcctgaagcaccagaacagcggcaagtgggccaagagcaaggccatcatggccaagtatgacctggaggcccggcaggccatgcaggagcagctgagcaagaacaaggagctgacccagaagctgcaggtggccagcgagagcgaggaggaggagggcggcacagaagatgtggaggagctgctggtgcctgatgtggtgaatgaggtgcagatgaatgctgatggccccaacccctggatgctgcggagctgcaccagtgacaccaaggaggccgccacccaggaggaccctgagcagctgcctgagctggaggcccacggcgtgtctgagagcgagggggaggagaggcctgtggccgaggaggagatcctgctgcgggagtttgaggagaggaggagcctgaggaagaggtctgagctgagccaggatgctgagcctgctggcagccaggagaccaaggacagcggcagccaggaggtgctgtctgagctgcgggtgctgagccagaagctgaaggagaaccaccagagcaggaagcagaaggccagcagcgagggcaccatcccccaggtgcagcgggaggagcccgcccctgaggaggaggagcccctgctgctgcagaggcctgagcgggtgcagaccctggaggagctggaggagctgggcaaggaggagtgcttccagaacaaggagctgcccaggcctgtgctggagggccagcagagcgagaggacccccaacaacagaccagatgcccccaaggagaagaagaagaaggagcagatgattgacctgcagaacctgctgaccacccagagccccagcgtgaagagcctggccgtgcccaccatcgaggagctggaggatgaggaggagaggaaccaccggcagatgatcaaggaggcctttgctggagatgatgtgatccgggacttcctgaaggagaagcgggaggccgtggaggccagcaagcccaaggatgtggacctgaccctgcccggctggggcgagtggggcggcgtgggcctgaagcccagcgccaagaagagaagacgcttcctgatcaaggcccctgagggcccccccaggaaggacaagaacctgcccaacgtcatcatcaatgagaagaggaacatccatgctgctgcccaccaggtgcgggtgctgccctaccccttcacccaccactggcagtttgagaggaccatccagacccccatcggcagcacctggaacacccagagggccttccagaagctgaccacccccaaggtggtgaccaagccaggccacatcatcaaccccatcaaggcagaagatgtgggctaccgcagcagcagcagaagtgacctgagcgtcatccagaggaaccccaagaggatcaccaccaggcacaagaagcagctgaagaagtgcagcgtggactag

SEQ ID NO: 17413 - DNA, 963 bp, Artificial Sequence
  Description of Artificial Sequence: Synthetic coding sequence
atgaagggggacttcaggaagaagaagtctgaggcccggacccccctggagcaggagatcttcaacctgctgcacaagaacaagcagcctgtgacagaccccctgctgacccctgtggagaaggccagcctgcgggccatgagcctggaggaggccaagatgagaagagctgagctgcagagggcccgggccctgcagagctactatgaggccaaggcccggcgggagaagaagatcaagagcaagaagtaccacaaggtggtgaagaagggcaaggccaagaaggccctgaaggagtttgagcagctgaggaaggtgaacccagctgctgccctggaggagctggagaagattgagaaggccaggatgatggagaggatgagcctgaagcaccagaacagcggcaagtgggccaagagcaaggccatcatggccaagtatgacctggaggcccggcaggccatgcaggagcagctgagcaagaacaaggagctgacccagaagctgcaggtggccagcgagagcgaggaggaggagggcggcacagaagatgtggaggagctgctggtgcctgatgtggtgaatgaggtgcagatgaatgctgatggccccaacccctggatgctgcggagctgcaccagtgacaccaaggaggccgccacccaggaggaccctgagcagctgcctgagctggaggcccacggcgtgtctgagagcgagggggaggagaggcctgtggccgaggaggagatcctgctgcgggagtttgaggagaggaggagcctgaggaagaggtctgagctgagccaggatgctgagcctgctggcagccaggagaccaaggacagcggcagccaggaggtgctgtctgagctgcgggtgctgagccagaagctgaaggagaaccaccagagcaggaagcagaaggccagcagcgagggcaccatcccccaggtgcagtag

SEQ ID NO: 17414 - DNA, 2301 bp, Artificial Sequence
  Description of Artificial Sequence: Synthetic coding sequence
atgaatgtgaaccaggtggccgagaacctggccctgagccaccaggaggagctggtggacctgcccaagaactaccccctgtctgaaaatgaagatgaaggagacagtgatggagagaggaagcaccagaagctgctggaggccatcatcagcctggatggcaagaacagaaggaagctggccgagaggtctgaggccagcctgaaggtgtctgagttctctgtgtcctctgagggcagcggggagaagctgggcctggccgacctgctggagcctgtgaagaccagcagcagcctggccaccgtgaagaagcagctgaacagagtgaagagcaagaaggtggtggagctgcccctgaacaaggagaagattgagcagatccaccgggaggtggccttcagcaagaccagccaggtgctgagcaagtgggaccccatcatcctgaagaaccagcaggccgagcagctggtgttccccctgggcaaggagcagcctgccatcgcccccatcgagcacgccctgagcggctggaaggcccggacccccctggagcaggagatcttcaacctgctgcacaagaacaagcagcctgtgacagaccccctgctgacccccatggagaaggccagcctgcaggccatgagcctggaggaggccaagatgcacagagctgagctgcagagggcccgggccctgcagagctactatgaggccaaggccaggaaggagaagaagatcaagagcaagaagtaccacaaggtggtgaagaagggcaaggccaagaaggccctgaaggagtttgagcagctgcagaaggtgaaccccaccgtggccctggaggagatggagaagattgaaaatgccaggatgatggagaggatgagcctgaagcaccagaacagcggcaagtgggccaagagcaaggccatcatggccaagtatgacctggaggcccggcaggccatgcaggagcagctggccaagaacaaggagctgacccagaagctgcaggtggccagcgagagcgaggaggaggagggcggcacagaggtggaggagctgctggtgccccacgtggccaatgaggtgcagatgaatgtggatggccccaacccctggatgttccgcagctgcaccagtgacaccaaggaggccgccacccaggaggaccctgagcaggtgcctgagctggccgcccacgaggtgtctgccagcgaggccgaggagaggcctgtggccgaggaggagatcctgctgcgggagtttgaggagcggcagagcctgaggaagaggtctgagctgaaccaggatgctgagcccgccagcagccaggagaccaaggacagcagcagccaggaggtgctgtctgagctgcgggccctgagccagaagctgaaggagaagcaccagagcaggaagcagaaggccagcagcgagggcaccgtgccccaggtgcagcgggaggagcccgcccctgaggaggccgagcccctgctgctgcagaggtctgagcgggtgcagaccctggaggagctggaggagctgggcaaggaggactgcttccagaacaaggagctgcccaggcctgtgctggagggccagcagagcgagaggacccccaacaacagaccagatgcccccaaggagaagaaggagaaggagcagctgatcaacctgcagaacttcctgaccacccagagccccagcgtgcgcagcctggccgtgcccaccatcatcgaggagctggaggatgaggaggagcgggaccagaggcagatgatcaaggaggcctttgctggagatgatgtgatccgggacttcctgaaggagaagcgggaggccgtggaggccagcaagcccaaggatgtggacctgaccctgcccggctggggcgagtggggcggcgtgggcctgaagcccagcgccaagaagaggcggcagttcctgatcaaggcccctgagggcccccccaggaaggacaagaacctgcccaacgtcatcatcagcgagaagaggaacatccacgccgccgcccaccaggtgcaggtgctgccctaccccttcacccaccaccggcagtttgagaggaccatccagacccccatcggcagcacctggaacacccagagggccttccagaagctgaccacccccaaggtggtgaccaagccaggccacatcatcaagcccatcaaggccgaggatgtgggctaccagagcagcagcagaagtgacctgcctgtgatccagaggaaccccaagaggatcaccaccaggcacaacaaggaggagaagctgtag

SEQ ID NO: 17415 - DNA, 1557 bp, Artificial Sequence
  Description of Artificial Sequence: Synthetic coding sequence
atggccggctacaagcctgtggccatccagacctaccccatcctgggggagaagatcacccaggacaccctgtactggaacaactacaagacccctgtgcagatcaaggagtttggagctgtgtccaaggtggacttcagcccccagcccccctacaactatgctgtgacagccagcagccgcatccacatctacggccgctacagccaggagcccatcaagaccttcagccgcttcaaggacacagcctactgtgccaccttccggcaggacggccgcctgctggtggccggctctgaagatggaggagtgcagctgtttgacatcagcggccgggcccccctgcggcagtttgagggccacaccaaggctgtgcacacagtggacttcaccgctgacaagtaccacgtggtgtctggagcagatgactacacagtgaagctgtgggacatccccaacagcaaggagatcctgaccttcaaggagcacagcgactatgtgcgctgtggctgtgccagcaagctgaacccagacctcttcatcaccggcagctatgaccacacagtgaagatgtttgatgcccggaccagcgagagcgtgctgtctgtggagcacggccagcctgtggagagcgtgctgctcttccccagcggcggcctgctggtgtctgctgggggccgctacgtgaaggtgtgggacatgctgaagggcggccagctgctggtgtccctgaagaaccaccacaagacagtgacctgcctgtgcctgagcagcagcggccagaggctgctgagcggcagcctggacaggaaggtgaaggtgtacagcaccaccagctacaaggtggtgcacagctttgattatgctgccagcatcctgagcctggccctggcccatgaagatgagaccatcgtggtgggcatgaccaacggcatcctgtctgtgaagcacaggaagtctgaggccaagaaggagagcctgcccaggagaagaagacctgcctaccgcaccttcatcaagggcaagaactacatgaagcagagagatgacatcctgatcaacagacctgccaagaagcacctggagctgtatgaccgggacctgaagcacttccgcatcagcaaggccctggacagagtgctggaccccacctgcaccatcaagaccccagagatcaccgtgtccatcatcaaggagctgaacagaagaggagtgctggccaatgccctggccggcagagatgagaaggagatcagccacgtgctgaacttcctgatccggaacctgagccagcccaggtttgcccctgtgctgatcaatgctgctgagatcatcatcgacatctacctgcctgtgattggccagagccctgtggtggacaagaagttcctgctgctgcagggcctggtggagaaggagattgactaccagcgggagctgctggagaccctgggcatgatggacatgctgtttgccaccatgaggaggaaggagggcacctctgtgctggagcacaccagtgatggcttccctgagaacaagaagattgagagctag

SEQ ID NO: 17416 - DNA, 1500 bp, Artificial Sequence
  Description of Artificial Sequence: Synthetic coding sequence
atggccggctacaagcctgtggccatccagacctaccccatcctgggggagaagatcacccaggacaccctgtactggaacaactacaagccaccctacaactatgctgtgacagccagcagccgcatccacatctacggccgctacagccaggagcccatcaagaccttcagccgcttcaaggacacagcctactgtgccaccttccggcaggacggccgcctgctggtggccggctctgaagatggcggcgtgcagctgtttgacatcagcggccgggcccccctgcggcagtttgagggccacaccaaggctgtgcacacagtggacttcaccgctgacaagtaccacgtggtgtctggagcagatgactacacagtgaagctgtgggacatccccaacagcaaggagatcctgaccttcaaggagcacagcgactatgtgcgctgtggctgtgccagcaagctgaacccagacctcttcatcaccggcagctatgaccacacagtgaagatgtttgatgcccggaccagcgagagcgtgctgtctgtggagcacggccagcctgtggagagcgtgctgctcttccccagcggcggcctgctggtgtctgctgggggccgctacgtgaaggtgtgggacatgctgaagggcggccagctgctggtgtccctgaagaaccaccacaagacagtgacctgcctgtgcctgagcagcagcggccagaggctgctgagcggcagcctggacaggaaggtgaaggtgtacagcaccaccagctacaaggtggtgcacagctttgattatgctgccagcatcctgagcctggccctggcccatgaagatgagaccatcgtggtgggcatgaccaacggcatcctgtctgtgaagcacaggaagtctgaggccaagaaggagagcctgcccaggagaagaagacctgcctaccgcaccttcatcaagggcaagaactacatgaagcagagagatgacatcctgatcaacagacctgccaagaagcacctggagctgtatgaccgggacctgaagcacttccgcatcagcaaggccctggacagagtgctggaccccacctgcaccatcaagaccccagagatcaccgtgtccatcatcaaggagctgaacagaagaggagtgctggccaatgccctggccggcagagatgagaaggagatcagccacgtgctgaacttcctgatccggaacctgagccagcccaggtttgcccctgtgctgatcaatgctgctgagatcatcatcgacatctacctgcccgtcatcggccagagccctgtggtggacaagaagttcctgctgctgcagggcctggtggagaaggagattgactaccagcgggagctgctggagaccctgggcatgatggacatgctgtttgccaccatgaggaggaaggagggcacctctgtgctggagcacaccagtgatggcttccctgagaacaagaagattgagagctag

SEQ ID NO: 17417 - DNA, 24 bp, Artificial Sequence
  Description of Artificial Sequence: Synthetic coding sequence
atggccggctacaagcctgtgtag

SEQ ID NO: 17418 - DNA, 1638 bp, Artificial Sequence
  Description of Artificial Sequence: Synthetic coding sequence
tgagtcatctttgcccggcgctctgtgcgctgtgtgtgccggcggctgctggagggcccctgtgacttctacgccagcgctgctgagctgtgccgggtgggctcctggcacagccccatcaactgcccctgggtggaggtgtccaggaggaccctgtggggctctgtggagacccctgtgcagatcaaggagtttggagctgtgtccaaggtggacttcagcccccagcccccctacaactatgctgtgacagccagcagccgcatccacatctacggccgctacagccaggagcccatcaagaccttcagccgcttcaaggacacagcctactgtgccaccttccggcaggacggccgcctgctggtggccggctctgaagatggcggcgtgcagctgtttgacatcagcggccgggcccccctgcggcagtttgagggccacaccaaggctgtgcacacagtggacttcaccgctgacaagtaccacgtggtgtctggagcagatgactacacagtgaagctgtgggacatccccaacagcaaggagatcctgaccttcaaggagcacagcgactatgtgcgctgtggctgtgccagcaagctgaacccagacctcttcatcaccggcagctatgaccacacagtgaagatgtttgatgcccggaccagcgagagcgtgctgtctgtggagcacggccagcctgtggagagcgtgctgctcttccccagcggcggcctgctggtgtctgctgggggccgctacgtgaaggtgtgggacatgctgaagggcggccagctgctggtgtccctgaagaaccaccacaagacagtgacctgcctgtgcctgagcagcagcggccagaggctgctgagcggcagcctggacaggaaggtgaaggtgtacagcaccaccagctacaaggtggtgcacagctttgattatgctgccagcatcctgagcctggccctggcccatgaagatgagaccatcgtggtgggcatgaccaacggcatcctgtctgtgaagcacaggaagtctgaggccaagaaggagagcctgcccaggagaagaagacctgcctaccgcaccttcatcaagggcaagaactacatgaagcagagagatgacatcctgatcaacagacctgccaagaagcacctggagctgtatgaccgggacctgaagcacttccgcatcagcaaggccctggacagagtgctggaccccacctgcaccatcaagaccccagagatcaccgtgtccatcatcaaggagctgaacagaagaggagtgctggccaatgccctggccggcagagatgagaaggagatcagccacgtgctgaacttcctgatccggaacctgagccagcccaggtttgcccctgtgctgatcaatgctgctgagatcatcatcgacatctacctgcccgtcatcggccagagccctgtggtggacaagaagttcctgctgctgcagggcctggtggagaaggagattgactaccagcgggagctgctggagaccctgggcatgatggacatgctgtttgccaccatgaggaggaaggagggcacctctgtgctggagcacaccagtgatggcttccctgagaacaagaagattgagagctag

SEQ ID NO: 17419 - DNA, 198 bp, Artificial Sequence
  Description of Artificial Sequence: Synthetic coding sequence
atggccggctacaagcctgtggccatccagacctaccccatcctgggggagaagatcacccaggacaccctgtactggaacaactacaagacccctgtgcagatcaaggagtttggagctgtgtccaaggtggacttcagcccccagcccccctacaactatgctgtgacagccagcagccgcatccacatctactag

SEQ ID NO: 17420 - DNA, 987 bp, Artificial Sequence
  Description of Artificial Sequence: Synthetic coding sequence
atgtttgatgcccggaccagcgagagcgtgctgtctgtggagcacggccagcctgtggagagcgtgctgctcttccccagcggcggcctgctggtgtctgctgggggccgctacgtgaaggtgtgggacatgctgaagggcggccagctgctggtgtccctgaagaaccaccacaagacagtgacctgcctgtgcctgagcagcagcggccagaggctgctgagcggcagcctggacaggaaggtgaaggtgtacagcaccaccagctacaaggtggtgcacagctttgattatgctgccagcatcctgagcctggccctggcccatgaagatgagaccatcgtggtgggcatgaccaacggcatcctgtctgtgaagcacaggaagtctgaggccaagaaggagagcctgcccaggagaagaagacctgcctaccgcaccttcatcaagggcaagaactacatgaagcagagagatgacatcctgatcaacagacctgccaagaagcacctggagctgtatgaccgggacctgaagcacttccgcatcagcaaggccctggacagagtgctggaccccacctgcaccatcaagaccccagagatcaccgtgtccatcatcaaggagctgaacagaagaggagtgctggccaatgccctggccggcagagatgagaaggagatcagccacgtgctgaacttcctgatccggaacctgagccagcccaggtttgcccctgtgctgatcaatgctgctgagatcatcatcgacatctacctgcctgtgattggccagagccctgtggtggacaagaagttcctgctgctgcagggcctggtggagaaggagattgactaccagcgggagctgctggagaccctgggcatgatggacatgctgtttgccaccatgaggaggaaggagggcacctctgtgctggagcacaccagtgatggcttccctgagaacaagaagattgagagctag

SEQ ID NO: 17421 - DNA, 750 bp, Artificial Sequence
  Description of Artificial Sequence: Synthetic coding sequence
atgaagatcacccggcagaagcacgccaagaagcacctgggcttcttcaggaacaactttggagtgcgggagccctaccagatcctgctggatggcaccttctgccaggccgccctgcggggccgcatccagctgcgggagcagctgccccgctacctgatgggagagacccagctgtgcaccacccgctgtgtgctgaaggagctggagaccctgggcaaggacctgtatggagccaagctgattgcccagaagtgccaggtgaggaactgcccccacttcaagaatgctgtgtctggcagcgagtgcctgctgtccatggtggaggagggcaacccccaccactactttgtggccacccaggaccagaacctgtctgtgaaggtgaagaagaagccaggagtgcccctgatgttcatcatccagaacaccatggtgctggacaagcccagccccaagaccatcgcctttgtgaaggctgtggagagcggccagctggtgtctgtgcatgagaaggagagcatcaagcacctgaaggaggagcagggcctggtgaagaacacagagcagagcaggaggaagaagaggaagaagatcagcggccccaaccccctgagctgcctgaagaagaagaagaaggccccagacacccagagcagcgccagcgagaagaagaggaagaggaagaggatccggaacagaagcaaccccaaggtgctgtctgagaagcagaatgctgagggggagtag

SEQ ID NO: 17422 - DNA, 438 bp, Artificial Sequence
  Description of Artificial Sequence: Synthetic coding sequence
atgaagatcacccggcagaagcacgccaagaagcacctgggcttcttcaggaacaactttggagtgcgggagccctaccagatcctgctggatggcaccttctgccaggccgccctgcggggccgcatccagctgcgggagcagctgccccgctacctgatgggagagacccagctgtgcaccacccgctgtgtgctgaaggagctggagaccctgggcaaggacctgtatggagccaagctgattgcccagaagtgccaggtgaggaactgcccccacttcaagaatgctgtgtctggcagcgagtgcctgctgtccatggtggaggagggcaacccccaccactactttgtggccacccagtacatccccaggatgtacaccttctgcaccaactatggaggccagcagtatgtgattgatgccctgattggatag

SEQ ID NO: 17423 - DNA, 1794 bp, Artificial Sequence
  Description of Artificial Sequence: Synthetic coding sequence
atggccgagatcatccaggagagaattgaggaccggctgcctgagctggagcagctggagcgcatcggcctcttcagccacgccgagatcaaggccatcatcaagaaggccagtgacctggagtacaagatccagaggaggaccctcttcaaggaggacttcatcaactacgtgcagtatgagatcaacctgctggagctgatccagaggaggaggaccagaattggctacagcttcaagaaggatgaaattgaaaattccatcgtgcaccgggtgcagggcgtcttccagagggccagcgccaagtggaaggatgatgtgcagctgtggctgtcctatgtggccttctgcaagaagtgggccaccaagacccggctgagcaaggtgttttctgccatgctggccatccacagcaacaagccagccctgtggatcatggccgccaagtgggagatggaggaccggctgagcagcgagagcgcccggcagctgttcctgcgggccctgcgcttccaccctgagtgccccaagctgtacaaggagtacttcaggatggagctgatgcacgccgagaagctgaggaaggagaaggaggagtttgagaaggcctccatggatgtggagaacccagactacagcgaggagatcctgaagggggagctggcctggatcatctacaagaacagcgtgtccatcatcaagggagctgagttccacgtgtccctgctgagcatcgcccagctgtttgattttgccaaggacctgcagaaggagatctatgatgacctgcaggccctgcacacagatgaccccctgacctgggactatgtggcccggcgggagctggagattgagagccagacagaggagcagcccaccaccaagcaggccaaggctgtggaggtgggcaggaaggaggagcgctgctgtgctgtgtatgaggaggccgtgaagaccctgcccacagaggccatgtggaagtgctacatcaccttctgcctggagcgcttcaccaagaagagcaacagcggcttcctgcggggcaagaggctggagaggaccatgaccgtcttcaggaaggcccacgagctgaagctgctgtctgagtgccagtacaagcagctgtctgtgtccctgctgtgctacaacttcctgcgggaggccctggaggtggccgtggccggcacagagctgttccgggacagcggcaccatgtggcagctgaagctgcaggtgctgattgagagcaagagcccagacatcgccatgctgtttgaggaggcctttgtgcacctgaagccccaggtgtgcctgcccctgtggatctcctgggccgagtggagcgagggcgccaagagccaggaggacacagaagctgtgttcaagaaggccctgctggccgtgattggagctgacagcgtgaccctgaagaacaagtacctggactgggcctacagaagtggcggctacaagaaggcccgggctgtgttcaagagcctgcaggagagccggcccttctctgtggacttcttcaggaagatgatccagtttgagaaggagcaggagagctgcaacatggccaacatccgggagtactatgagcgggccctgcgggagtttggcagcgctgacagcgacctgtggatggactacatgaaggaggagctgaaccaccccctgggccggcctgagaactgtggccagatctactggagggccatgaagatgctgcagggcgagagcgctgaggcctttgtggccaagcacgccatgcaccagacaggccacctgtag

SEQ ID NO: 17424 - DNA, 1425 bp, Artificial Sequence
  Description of Artificial Sequence: Synthetic coding sequence
atgatctccttctgcccagactgtgggaagagcatccaggccgccttcaagttctgcccctactgcggcaacagcctgcctgtggaggagcacgtgggcagccagacctttgtgaacccccacgtgagcagcttccagggcagcaagaggggcctgaacagcagctttgagaccagccccaagaaggtgaagtggagcagcacagtgaccagcccccggctgagcctcttcagtgatggagacagcagcgagagcgaggacaccctgagcagcagcgagaggagcaagggcagcggcagccggccccccacccccaagagcagcccccagaagaccaggaagagcccccaggtgacccggggcagcccccagaagaccagctgcagcccccagaagacccggcagagcccccagaccctgaagaggagccgggtgaccaccagcctggaggccctgcccaccggcaccgtgctgacagacaagagcggccggcagtggaagctgaagagcttccagacccgggacaaccagggcatcctgtatgaagctgcccccaccagcaccctgacctgtgacagcggcccccagaagcagaagttcagcctgaagctggatgccaaggatggccgcctcttcaatgagcagaacttcttccagagagctgccaagcccctgcaggtgaacaagtggaagaagctgtacagcacccccctgctggccatccccacctgcatgggctttggagtgcaccaggacaagtaccgcttcctggtgctgcccagcctgggccgcagcctgcagagcgccctggatgtgagccccaagcacgtgctgtctgagaggtctgtgctgcaggtggcctgccgcctgctggatgccctggagttcctgcatgaaaatgaatatgtgcacggcaatgtgacagctgagaacatctttgtggaccctgaggaccagagccaggtgaccctggccggctacggctttgccttccgctactgccccagcggcaagcacgtggcctacgtggagggcagccgcagcccccatgaaggagacctggagttcatctccatggacctgcacaagggctgcggccccagcagaagaagtgacctgcagagcctgggctactgcatgctgaagtggctgtatggcttcctgccctggaccaactgcctgcccaacacagaggacatcatgaagcagaagcagaagtttgtggacaagccaggcccctttgtgggcccctgtggccactggatccggcccagcgagaccctgcagaagtacctgaaggtggtgatggccctgacctatgaggagaagccaccctatgccatgctgaggaacaacctggaggccctgctgcaggacctgcgggtgagcccctatgaccccatcggcctgcccatggtgccctag

SEQ ID NO: 17425 - DNA, 1275 bp, Artificial Sequence
  Description of Artificial Sequence: Synthetic coding sequence
atgatctccttctgcccagactgtgggaagagcatccaggccgccttcaagttctgcccctactgcggcaacagcctgcctgtggaggagcacgtgggcagccagacctttgtgaacccccacgtgagcagcttccagggcagcggcagccggccccccacccccaagagcagcccccagaagaccaggaagagcccccaggtgacccggggcagcccccagaagaccagctgcagcccccagaagacccggcagagcccccagaccctgaagaggagccgggtgaccaccagcctggaggccctgcccaccggcaccgtgctgacagacaagagcggccggcagtggaagctgaagagcttccagacccgggacaaccagggcatcctgtatgaagctgcccccaccagcaccctgacctgtgacagcggcccccagaagcagaagttcagcctgaagctggatgccaaggatggccgcctcttcaatgagcagaacttcttccagagagctgccaagcccctgcaggtgaacaagtggaagaagctgtacagcacccccctgctggccatccccacctgcatgggctttggagtgcaccaggacaagtaccgcttcctggtgctgcccagcctgggccgcagcctgcagagcgccctggatgtgagccccaagcacgtgctgtctgagaggtctgtgctgcaggtggcctgccgcctgctggatgccctggagttcctgcatgaaaatgaatatgtgcacggcaatgtgacagctgagaacatctttgtggaccctgaggaccagagccaggtgaccctggccggctacggctttgccttccgctactgccccagcggcaagcacgtggcctacgtggagggcagccgcagcccccatgaaggagacctggagttcatctccatggacctgcacaagggctgcggccccagcagaagaagtgacctgcagagcctgggctactgcatgctgaagtggctgtatggcttcctgccctggaccaactgcctgcccaacacagaggacatcatgaagcagaagcagaagtttgtggacaagccaggcccctttgtgggcccctgtggccactggatccggcccagcgagaccctgcagaagtacctgaaggtggtgatggccctgacctatgaggagaagccaccctatgccatgctgaggaacaacctggaggccctgctgcaggacctgcgggtgagcccctatgaccccatcggcctgcccatggtgccctag

SEQ ID NO: 17426 - DNA, 855 bp, Artificial Sequence
  Description of Artificial Sequence: Synthetic coding sequence
atgatctccttctgcccagactgtgggaagagcatccaggccgccttcaagttctgcccctactgcggcaacagcctgcctgtggaggagcacgtgggcagccagacctttgtgaacccccacgtgagcagcttccagggcagcaagaggggcctgaacagcagctttgagaccagccccaagaaggtgaagtggagcagcacagtgaccagcccccggctgagcctcttcagtgatggagacagcagcgagagcgaggacaccctgagcagcagcgagaggagcaagggcagcggcagccggccccccacccccaagagcagcccccagaagaccaggaagagcccccaggtgacccggggcagcccccagaagaccagctgcagcccccagaagacccggcagagcccccagaccctgaagaggagccgggtgaccaccagcctggaggccctgcccaccggcaccgtgctgacagacaagagcggccggcagtggaagctgaagagcttccagacccgggacaaccagggcatcctgtatgaagctgcccccaccagcaccctgacctgtgacagcggcccccagaagcagaagttcagcctgaagctgagcaccagcggccgcagctgcacccggccccactgctggcccagcctgcctgcctgggtgtctgtgttcaccaggaccaacacaggctcctggtgctacccagcctggggcggggccttcagccggccctggatgtctgcccagagcatgtgctgccagaggggcctgtgctgccgctggccagctggctgctggatgccctggagcagctccatgaggatgtccatgttcatggagatgtag

SEQ ID NO: 17427 - DNA, 732 bp, Artificial Sequence
  Description of Artificial Sequence: Synthetic coding sequence
atgaagctgcaccccccaccacccagccctgtgacccaggaccacaggagcaagagcagccacagcaactggttcctggtgctgcccagcctgggccgcagcctgcagagcgccctggatgtgagccccaagcacgtgctgtctgagaggtctgtgctgcaggtggcctgccgcctgctggatgccctggagttcctgcatgaaaatgaatatgtgcatggaaatgtgacagctgagaacatctttgtggaccctgaggaccagagccaggtgaccctggccggctacggctttgccttccgctactgccccagcggcaagcacgtggcctacgtggagggcagccgcagcccccatgaaggagacctggagttcatctccatggacctgcacaagggctgcggccccagccgccgcagtgacctgcagagcctgggctactgcatgctgaagtggctgtatggcttcctgccctggaccaactgcctgcccaacacagaggacatcatgaagcagaagcagaagtttgtggacaagccaggcccctttgtgggcccctgtggccactggatccggcccagcgagaccctgcagaagtacctgaaggtggtgatggccctgacctatgaggagaagccaccctatgccatgctgaggaacaacctggaggccctgctgcaggacctgcgggtgagcccctatgaccccatcggcctgcccatggtgccctag

SEQ ID NO: 17428 - DNA, 645 bp, Artificial Sequence
  Description of Artificial Sequence: Synthetic coding sequence
atgagccccaagccccgggccagcggccccccagccaaggccaaggaggccggcaagaggaagagcagcagccagcccagccccagcgaccccaagaagaagaccaccaaggtggccaagaagggcaaggctgtgcggcggggcagaagaggcaagaagggagctgccaccaagatggctgctgtgacagcccctgaggccgagagcggccctgctgcccctggccccagcgaccagcccagccaggagctgccccagcacgagctgcccccagaggagcctgtgtctgaggtggaggagcccctgagccaggagagccaggtggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgagatggaggagcccctgagccaggagagccaggtggaggagcccctgagccaggagagcgagatggaggagcccctgagccaggagagcgagatggaggagctgcccagcgtgtag

SEQ ID NO: 17429 - DNA, 561 bp, Artificial Sequence
  Description of Artificial Sequence: Synthetic coding sequence
atgagccccaagccccgggccagcggccccccagccaaggccaaggaggccggcaagaggaagagcagcagccagcccagccccagcgaccccaagaagaagaccaccaaggtggccaagaagggcaaggctgtgcggcggggcagaagaggcaagaagggagctgccaccaagatggctgctgtgacagcccctgaggccgagagcggccctgctgcccctggccccagcgaccagcccagccaggagctgccccagcacgagctgcccccagaggagcctgtgtctgagggcacccagcacgaccccctgagccaggagagcgagctggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgagatggaggagcccctgagccaggagagccaggtggaggagcccctgagccaggagagcgagatggaggagctgcccagcgtgtag

SEQ ID NO: 17430 - DNA, 651 bp, Artificial Sequence
  Description of Artificial Sequence: Synthetic coding sequence
atgagccccaagccccgggccagcggccccccagccaaggccaaggaggccggcaagaggaagagcagcagccagcccagccccagcgaccccaagaagaagaccaccaaggtggccaagaagggcaaggctgtgcggcggggcagaagaggcaagaagggagctgccaccaagatggctgctgtgacagcccctgaggccgagagcggccctgctgcccctggccccagcgaccagcccagccaggagctgccccagcacgagctgcccccagaggagcctgtgtctgagggcacccagcacgaccccctgagccaggagagcgagctggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgagatggaggagcccctgagccaggagagccaggtggaggagcccctgagccaggagagcgagatggaggagcccctgagccaggagagcgagatggaggagctgcccagcgtgtag

SEQ ID NO: 17431 - DNA, 561 bp, Artificial Sequence
  Description of Artificial Sequence: Synthetic coding sequence
atgagccccaagccccgggccagcggccccccagccaaggccaaggaggccggcaagaggaagagcagcagccagcccagccccagcgaccccaagaagaagaccaccaaggtggccaagaagggcaaggctgtgcggcggggcagaagaggcaagaagggagctgccaccaagatggctgctgtgacagcccctgaggccgagagcggccctgctgcccctggccccagcgaccagcccagccaggagctgccccagcacgagctgcccccagaggagcctgtgtctgagggcacccagcacgaccccctgagccaggagagcgagctggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgaggtggaggagcccctgagccaggagagcgaggtggaggagcccctgagccaggagagcgagatggaggagctgcccagcgtgtag

SEQ ID NO: 17432 - DNA, 777 bp, Artificial Sequence
  Description of Artificial Sequence: Synthetic coding sequence
atgaggctgagcagcagccccccccggggcccccagcagctgagcagctttggatctgtggactggctgagccagagcagctgcagcggccccacccacacccccaggcctgctgacttcagcctgggcagcctgcccggccctggccagaccagcggggcccgggagcccccccaggccgtgtccatcaaggaggccgccggcagcagcaacctgcctgcccctgagaggaccatggccggcctgagcaaggagcccaacaccctgcgggccccccgggtgaggacagccttcaccatggagcaggtgaggaccctggagggcgtcttccagcaccaccagtacctgagccccctggagaggaagaggctggcccgggagatgcagctgtctgaggtgcagatcaagacctggttccagaacagaaggatgaagcacaagaggcagatgcaggacccccagctgcacagccccttcagcggcagcctgcacgcccccccagccttctacagcaccagcagcggcctggccaacggcctgcagctgctgtgcccctgggcccccctgagcggcccccaggccctgatgctgcccccaggcagcttctggggcctgtgccaggtggcccaggaggccctggccagcgctggggccagctgctgcggccagcccctggccagccacccccccaccccaggccggcccagcctgggccctgccctgagcacaggcccccggggcctgtgtgccatgccccagacaggagatgccttctag

SEQ ID NO: 17433 - DNA, 561 bp, Artificial Sequence
  Description of Artificial Sequence: Synthetic coding sequence
atgtttgggaagccagacaagatggatgtgcgctgccacagtgatgctgaggccgcccgggtgtccaagaatgcccacaaggagagccgggagagcaaaggagctgagggcaacctgcctgctgccttcctgaaggagccccagggcgccttcagcgccagcggggctgctgaggactgcaacaagagcaagagcaacagcgctgctgaccctgactactgccgccgcatcctggtgagagatgccaagggcagcatccgggagatcatcctgcccaagggcctggacctggaccggcccaagaggaccaggaccagcttcaccgctgagcagctgtaccgcctggagatggagttccagcgctgccagtatgtggtgggccgggagaggacagagctggcccggcagctgaacctgtctgagacccaggccaacagcgaggagaacaatgaacgcttcaagaggggcatcaagaagcagaagaagaagaggaagaaggagcccgccaatgatgagagccggcggggggacagcggcggccggggctggcagcccctgtag

SEQ ID NO: 17434 - DNA, 1005 bp, Artificial Sequence
  Description of Artificial Sequence: Synthetic coding sequence
atgtttgggaagccagacaagatggatgtgcgctgccacagtgatgctgaggccgcccgggtgtccaagaatgcccacaaggagagccgggagagcaaaggagctgagggcaacctgcctgctgccttcctgaaggagccccagggcgccttcagcgccagcggggctgctgaggactgcaacaagagcaagagcaacagcgctgctgaccctgactactgccgccgcatcctggtgagagatgccaagggcagcatccgggagatcatcctgcccaagggcctggacctggaccggcccaagaggaccaggaccagcttcaccgctgagcagctgtaccgcctggagatggagttccagcgctgccagtatgtggtgggccgggagaggacagagctggcccggcagctgaacctgtctgagacccaggtgaaggtgtggttccagaacagaaggaccaagcagaagaaggaccagggcaaggacagcgagctgcggtctgtggtgtctgaaacagctgccacctgcagcgtgctgcggctgctggagcagggccgcctgctgagccccccaggcctgcctgccctgctgcccccctgtgccaccggggccctgggcagcgccctgcggggccccagcctgcctgccctgggcgctggagctgctgctggcagcgctgctgctgctgctgctgctgcccctggccctgctggagctgccagcccccaccccccagctgtgggcggggcccctggccctggccctgctggccctgggggcctgcatgctggggccccagctgctggccacagcctcttcagcctgcctgtgcccagcctgctgggctctgtggccagccggctgagcagcgcccccctgaccatggccggcagcctggccggcaacctgcaggagctgagcgcccgctacctgagcagcagcgcctttgagccctacagcaggaccaacaacaaggagggcgctgagaagaaggccctggactag

SEQ ID NO: 17435 - DNA, 711 bp, Artificial Sequence
  Description of Artificial Sequence: Synthetic coding sequence
atgacagctgagttcctgagcctgctgtgcctgggcctgtgcctgggctatgaagatgagaagaagaatgagaagccacccaagcccagcctgcacgcctggcccagctctgtggtggaggccgagagcaatgtgaccctgaagtgccaggcccacagccagaatgtgacctttgtgctgaggaaggtgaatgacagcggctacaagcaggagcagagcagcgcagaaaatgaagctgagttccccttcacagacctgaagcccaaggatgctggccgctacttctgtgcctacaagaccacagccagccatgagtggagcgagagcagcgagcacctgcagctggtggtgacagacaagcatgatgagctggaggcccccagcatgaagacagacaccaggaccatctttgtggccatcttcagctgcatcagcatcctgctgctcttcctgagcgtcttcatcatctaccgctgcagccagcacagcagcagcagcgaggagagcaccaagaggaccagccacagcaagctgcctgagcaggaggccgctgaggccgacctgagcaacatggagcgggtgtccctgagcacagctgacccccagggcgtgacctatgcagagctgagcaccagcgccctgtctgaggccgccagtgacaccacccaggagcccccaggcagccatgaatatgctgccctgaaggtgtag

SEQ ID NO: 17436 - DNA, 447 bp, Artificial Sequence
  Description of Artificial Sequence: Synthetic coding sequence
atgaggaagaggatgggccccacccggctgccccggctggagtgcagcggggccatcacagcccactgcagcctggacctgcccggccctgacaagcatgatgagctggaggcccccagcatgaagacagacaccaggaccatctttgtggccatcttcagctgcatcagcatcctgctgctcttcctgagcgtcttcatcatctaccgctgcagccagcacagcagcagcagcgaggagagcaccaagaggaccagccacagcaagctgcctgagcaggaggccgctgaggccgacctgagcaacatggagcgggtgtccctgagcacagctgacccccagggcgtgacctatgcagagctgagcaccagcgccctgtctgaggccgccagtgacaccacccaggagcccccaggcagccatgaatatgctgccctgaaggtgtag

SEQ ID NO: 17437 - DNA, 618 bp, Artificial Sequence
  Description of Artificial Sequence: Synthetic coding sequence
atgacagctgagttcctgagcctgctgtgcctgggcctgtgcctgggctatgaagatgagaagaagaatgagaagccacccaagcccagcctgcacgcctggcccagctctgtggtggaggccgagagcaatgtgaccctgaagtgccaggcccacagccagaatgtgacctttgtgctgaggaaggtgaatgacagcggctacaagcaggagcagagcagcgcagaaaatgaagctgagttccccttcacagacctgaagcccaaggatgctggccgctacttctgtgcctacaagaccacagccagccatgagtggagcgagagcagcgagcacctgcagctggtggtgacagacaagcatgatgagctggaggcccccagcatgaagacaggcagcagcagcgaggagagcaccaagaggaccagccacagcaagctgcctgagcaggaggccgctgaggccgacctgagcaacatggagcgggtgtccctgagcacagctgacccccagggcgtgacctacgccgagctgagcaccagcgccctgtctgaggccgccagtgacaccacccaggagcccccaggcagccatgaatatgctgccctgaaggtgtag

SEQ ID NO: 17438 - DNA, 432 bp, Artificial Sequence
  Description of Artificial Sequence: Synthetic coding sequence
atgacagctgagttcctgagcctgctgtgcctgggcctgtgcctgggctatgaagatgagaagaagaatgagaagccacccaagcccagcctgcacgcctggcccagctctgtggtggaggccgagagcaatgtgaccctgaagtgccaggcccacagccagaatgtgacctttgtgctgaggaaggtgaatgacagcggctacaagcaggagcagagcagcgcagaaaatgaagctgagttccccttcacagacctgaagcccaaggatgctggccgctacttctgtgcctacaagaccacagccagccatgagtggagcgagagcagcgagcacctgcagctggtggtgacagacaagcatgatgagctggaggcccccagcatgaagacagtggcccacgtgtgcaacaccaggaccctgggccgctag

SEQ ID NO: 17439 - DNA, 1272 bp, Artificial Sequence
  Description of Artificial Sequence: Synthetic coding sequence
atggcccagctgcagacccgcttctacacagacaacaagaagtatgctgtggatgatgtgcccttcagcatcccagctgccagcgagattgctgacctgagcaacatcatcaacaagctgctgaaggacaagaatgagttccacaagcacgtggagtttgacttcctgatcaagggccagttcctgaggatgcccctggacaagcacatggagatggagaacatcagcagcgaggaggtggtggagattgaatatgtggagaagtacacagccccccagcctgagcagtgcatgtttcatgatgactggatcagcagcatcaagggagctgaggagtggatcctgaccggcagctatgacaagaccagccgcatctggagcctggagggcaagagcatcatgaccatcgtgggccacacagatgtggtgaaggatgtggcctgggtgaagaaggacagcctgagctgcctgctgctgagcgcctccatggaccagaccatcctgctgtgggagtggaatgtggagaggaacaaggtgaaggccctgcactgctgccggggccatgctggctctgtggacagcattgctgtggatggcagcggcaccaagttctgcagcggctcctgggacaagatgctgaagatctggagcacagtgcccacagatgaggaggatgagatggaggagagcaccaaccggcccaggaagaagcagaagacagagcagctgggcctgaccaggacccccatcgtgaccctgagcggccacatggaggccgtgtcctctgtgctgtggagcgatgctgaggagatctgcagcgcctcctgggaccacaccatccgggtgtgggatgtggagagcggcagcctgaagagcaccctgactggaaacaaggtgttcaactgcatctcctacagccccctgtgcaagaggctggccagcggcagcacagacagacacatccggctgtgggaccccaggaccaaggatggcagcctggtgtccctgagcctgaccagccacacaggctgggtgacctctgtgaagtggagccccacccatgagcagcagctgatcagcggcagcctggacaacatcgtgaagctgtgggacaccaggagctgcaaggcccccctgtatgacctggccgcccacgaggacaaggtgctgtctgtggactggacagacaccggcctgctgctgagcggcggcgctgacaacaagctgtacagctaccgctacagccccaccaccagccacgtgggcgcctag

SEQ ID NO: 17440 - DNA, 2034 bp, Artificial Sequence
  Description of Artificial Sequence: Synthetic coding sequence
atggctgctgggggcggcggcagctgtgaccccctggccccagctggggtgccctgtgccttcagcccccacagccaggcctactttgccctggccagcacagatggccacctgcgggtgtgggagacagccaacaaccggctgcaccaggagtatgtgcccagcgcccacctgagcggcacctgcacctgcctggcctgggccccagcccggctgcaggccaaggagagcccccagaggaagaagaggaagtctgaggccgtgggcatgagcaaccagacagacctgctggccctgggcacagctgtgggcagcatcctgctgtacagcacagtgaagggggagctgcacagcaagctgatcagcggcggccatgacaacagagtgaactgcatccagtggcaccaggacagcggctgcctgtacagctgcagtgatgacaagcacatcgtggagtggaatgtgcagacctgcaaggtgaagtgcaagtggaagggggacaacagctctgtgagcagcctgtgcatcagcccagatggcaagatgctgctgtctgctggccgcaccatcaagctgtgggtgctggagaccaaggaggtgtaccgccacttcaccggccacgccacccctgtgagcagcctgatgttcaccaccatccggcccccaaatgaaagccagccctttgatggcatcaccggcctgtacttcctgagcggggctgtgcatgaccggctgctgaatgtgtggcaggtgcgctctgagaacaaggagaagtctgctgtgatgtccttcaccgtgacagatgagcctgtgtacatcgacctgaccctgtctgagaacaaggaggagcctgtgaagctggccgtggtgtgcagagatggccaggtgcacctgtttgagcacatcctgaatggctactgcaagaagcccctgaccagcaactgcaccatccagatcgccacccctgggaagggcaagaagagcacccccaagcccatccccatcctggccgccggcttctgcagcgacaagatgagcctgctgctggtgtatggctcctggttccagcccaccatcgagcgggtggccctgaacagccgggagccccacatgtgcctggtgcgggacatcagcaactgctgggcccccaaggtggagacagccatcaccaaggtgaggacccctgtgatgaacagcgaggccaaggtgctggtgcccggcatccctggccaccacgccgccatcaagccagccccaccccagacagagcaggtggagagcaagaggaagagcggcggcaatgaggtgtccattgaggagcggctgggcgccatggacatcgacacccacaagaagggcaaggaggacctgcagaccaacagcttccctgtgctgctgacccagggcctggagagcaatgactttgagatgctgaacaaggtgctgcagaccagaaatgtgaacctgatcaagaagacagtgctgaggatgcccctgcacaccatcatccccctgctgcaggagctgaccaagaggctgcagggccaccccaacagcgctgtgctgatggtgcagtggctgaagtgtgtgctgactgtgcacgccagctacctgagcaccctgcctgacctggtgccccagctgggcaccctgtaccagctgatggagagccgggtgaagaccttccagaagctgagccacctgcacggcaagctgatcctgctgatcacccaggtgacagccagcgagaagaccaagggggccaccagccctggccagaaggccaagctggtgtatgaggaggagagcagcgaggaggagagtgatgatgaaattgctgacaaggacagcgaggacaactgggatgaagatgaggaggagagcgagagcgagaaggatgaagatgtggaggaggaggatgaagatgctgagggcaaggatgaagaaaatggagaggaccgggacacagccagcgagaaggagctgaatggagacagcgacctggaccctgaaaatgaaagtgaggaggagtag

SEQ ID NO: 17441 - DNA, 1005 bp, Artificial Sequence
  Description of Artificial Sequence: Synthetic coding sequence
atggccacagaggagaagaagccagagacagaggccgcccgggcccagcccacccccagcagcagcgccacccagagcaagcccacccctgtgaagcccaactatgccctgaagttcaccctggccggccacaccaaggctgtgtcctctgtgaagttcagccccaacggggagtggctggccagcagcagcgctgacaagctgatcaagatctggggcgcctatgatggcaagtttgagaagaccatcagcggccacaagctgggcatcagtgatgtggcctggagcagtgacagcaacctgctggtgtctgccagtgatgacaagaccctgaagatctgggatgtgagcagcggcaagtgcctgaagaccctgaagggccacagcaactacgtgttctgctgcaacttcaacccccagagcaacctgattgtgtctggcagctttgatgagagcgtgcgcatctgggatgtgaagacaggcaagtgcctgaagaccctgcctgcccacagcgaccctgtgtctgctgtgcacttcaacagagatggcagcctcatcgtgagcagcagctatgatggcctgtgccgcatctgggacacagccagcggccagtgcctgaagaccctgattgatgatgacaacccccctgtgtcctttgtgaagttcagccccaacgggaagtacatcctggccgccaccctggacaacaccctgaagctgtgggactacagcaagggcaagtgcctgaagacctacacaggccacaagaatgagaagtactgcatctttgccaacttctctgtgactggaggcaagtggatcgtgtctggcagcgaggacaacctggtgtacatctggaacctgcagaccaaggagatcgtgcagaagctgcagggccacacagatgtggtgatcagcacagcctgccaccccacagagaacatcatcgccagcgctgccctggagaatgacaagaccatcaagctgtggaagagtgactgctag

SEQ ID NO: 17442 - DNA, 1005 bp, Artificial Sequence; identical to SEQ ID NO: 17441
  Description of Artificial Sequence: Synthetic coding sequence

SEQ ID NO: 17443 - DNA, 1158 bp, Artificial Sequence
  Description of Artificial Sequence: Synthetic coding sequence
atggctgctgctgctgcccgctggaaccacgtgtgggtgggcacagaaacaggcatcctgaagggcgtgaacctgcagaggaagcaggccgccaacttcaccgctgggggccagccccggcgggaggaggccgtgtctgccctgtgctggggcaccggcggggagacccagatgctggtgggctgtgccgacagaacagtgaagcacttcagcacagaagatggcatcttccagggccagaggcactgccctggaggagagggcatgttccggggcctggcccaggctgatggcaccctcatcacctgtgtggacagcggcatcctgcgggtgtggcatgacaaggacaaggacaccagcagtgaccccctgctggagctgcgggtgggccctggggtgtgcaggatgaggcaggaccctgcccacccccacgtggtggccaccggcggcaaggaaaatgccctgaagatctgggacctgcagggcagcgaggagcccgtcttccgggccaagaatgtgagaaatgactggctggacctgcgggtgcccatctgggaccaggacatccagttcctgcccggcagccagaagctggtgacctgcaccggctaccaccaggtgcgggtgtatgaccctgccagcccccagaggaggcctgtgctggagaccacctatggagagtaccccctgacagccatgaccctgaccccaggcggcaacagcgtgattgtgggcaacacccacggccagctggccgagattgacctgcggcagggccgcctgctgggctgcctgaagggcctggccggctctgtgcggggcctgcagtgccaccccagcaagcccctgctggccagctgtggcctggacagagtgctgcgcatccaccgcatccagaacccccggggcctggagcacaaggtgtacctgaagagccagctgaactgcctgctgctgagcggccgggacaactgggaggatgagccccaggagccccaggagcccaacaaggtgcccctggaggacacagaaacagatgagctgtgggccagcctggaggccgccgccaagaggaagctgagcggcctggagcagccccagggcgccctgcagaccaggaggaggaagaagaagaggcctggcagcaccagcccctag

SEQ ID NO: 17444 - DNA, 1101 bp, Artificial Sequence
  Description of Artificial Sequence: Synthetic coding sequence
atggctgctgctgctgcccgctggaaccacgtgtgggtgggcacagaaacaggcatcctgaagggcgtgaacctgcagaggaagcaggccgccaacttcaccgctgggggccagccccggcgggaggaggccgtgtctgccctgtgctggggcaccggcggggagacccagatgctggtgggctgtgccgacagaacagtgaagcacttcagcacagaagatggcatcttccagggccagaggcactgccctggaggagagggcatgttccggggcctggcccaggctgatggcaccctcatcacctgtgtggacagcggcatcctgcgggtgtggcatgacaaggacaaggacaccagcagtgaccccctgctggagctgcgggtgggccctggggtgtgcaggatgaggcaggaccctgcccacccccacgtggtggccaccggcggcaaggaaaatgccctgaagatctgggacctgcagggcagcgaggagcccgtcttccgggccaagaatgtgagaaatgactggctggacctgcgggtgcccatctgggaccaggacatccagttcctgcccggcagccagaagctggtgacctgcaccggctaccaccaggtgcgggtgtatgaccctgccagcccccagaggaggcctgtgctggagaccacctatggagagtaccccctgacagccatgaccctgaccccaggcggcaacagcgtgattgtgggcaacacccacggccagctggccgagattgacctgcggcagggccgcctgctgggctgcctgaagggcctggccggctctgtgcggggcctgcagtgccaccccagcaagcccctgctggccagctgtggcctggacagagtgctgcgcatccaccgcatccagaacccccggggcctggagcacaaggatgagccccaggagccccaggagcccaacaaggtgcccctggaggacacagaaacagatgagctgtgggccagcctggaggccgccgccaagaggaagctgagcggcctggagcagccccagggcgccctgcagaccaggaggaggaagaagaagaggcctggcagcaccagcccctag

SEQ ID NO: 17445 - DNA, 1158 bp, Artificial Sequence; identical to SEQ ID NO: 17443
  Description of Artificial Sequence: Synthetic coding sequence

SEQ ID NO: 17446 - DNA, 1158 bp, Artificial Sequence; identical to SEQ ID NO: 17443
  Description of Artificial Sequence: Synthetic coding sequence

SEQ ID NO: 17447 - DNA, 117 bp, Artificial Sequence
  Description of Artificial Sequence: Synthetic coding sequence
tgatgggccagcctggaggccgccgccaagaggaagctgagcggcctggagcagccccagggcgccctgcagaccaggaggaggaagaagaagaggcctggcagcaccagcccctag

SEQ ID NO: 17448 - DNA, 174 bp, Artificial Sequence
  Description of Artificial Sequence: Synthetic coding sequence
atggctgctgctgctgcccgctggaaccacgtgtgggtgggcacagaaacaggcatcctgaagggcgtgaacctgcagaggaagcaggccgccaacttcaccgctgggggccagccccggcgggaggaggccgtgtctgccctgtgctggggcaccggcggggagacccagtag

SEQ ID NO: 17449 - DNA, 2493 bp, Artificial Sequence
  Description of Artificial Sequence: Synthetic coding sequence
atggtggaggaggagaacatccgggtggtgcgctgtggcggcagcgagctgaacttccggcgggctgtgttttctgctgacagcaagtacatcttctgtgtgtctggggactttgtgaaggtgtacagcacagtgacagaggagtgtgtgcacatcctgcacggccacaggaacctggtgacaggcatccagctgaaccccaacaaccacctgcagctgtacagctgcagcctggatggcaccatcaagctgtgggactacattgatggcatcctgatcaagaccttcatcgtgggctgcaagctgcacgccctcttcaccctggcccaggccgaggacagcgtgtttgtgattgtgaacaaggagaagccagacatcttccagctggtgtctgtgaagctgcccaagagcagcagccaggaggtggaggccaaggagctgagctttgtgctggactacatcaaccagagccccaagtgcatcgcctttggaaatgaaggagtgtatgtggccgctgtgcgggagttctacctgtctgtgtacttcttcaagaagaagaccaccagccgcttcaccctgagcagcagcaggaacaagaagcacgccaagaacaacttcacctgtgtggcctgccaccccacagaggactgcatcgccagcggccacatggatggcaagatccggctgtggaggaacttctatgatgacaagaagtacacctacacctgcctgcactggcaccacgacatggtgatggacctggccttctctgtgacaggcaccagcctgctgagcggcggccgggagagcgtgctggtggagtggagagatgccacagagaagaacaaggagttcctgccccggctgggcgccaccatcgagcacatctctgtgtccccagctggggacctcttctgcaccagccacagcgacaacaagatcatcatcatccacaggaacctggaggccagcgctgtgatccagggcctggtgaaggacaggagcatcttcaccggcctgatgattgaccccaggaccaaggccctggtgctgaatggcaagccaggccacctgcagttctacagcctgcagagcgacaagcagctgtacaacctggacatcatccagcaggagtacatcaatgactatggcctcatccagatcgagctgaccaaggccgccttcggctgcttcggcaactggctggccaccgtggagcagaggcaggagaaggagacagagctggagctgcagatgaagctgtggatgtacaacaagaagacccagggcttcatcctgaacaccaagatcaacatgcctcatgaggactgcatcacagccctgtgcttctgcaatgctgagaagtctgagcagcccaccctggtgacagccagcaaggatggctacttcaaggtgtggatcctgacagatgacagcgacatctacaagaaggctgtgggctggacctgtgactttgtgggcagctaccacaagtaccaggccaccaactgctgcttctctgaagatggcagcctgctggccgtgtcctttgaggagatcgtgaccatctgggacagcgtgacctgggagctgaagtgcaccttctgccagagagctgggaagatccgccacctgtgcttcggccgcctgacctgcagcaagtacctgctgggcgccacagaaaatggcatcctgtgctgctggaacctgctgagctgtgccctggagtggaatgccaagctgaatgtgcgggtgatggagccagaccccaacagtgaaaatattgctgccatcagccagagctctgtgggcagtgacctgtttgtgttcaagcccagcgagccccggcccctgtacatccagaagggcatcagccgggagaaggtgcagtggggcgtgtttgtgcccagagatgtgcctgagagcttcaccagcgaggcctaccagtggctgaacagaagccagttctacttcctgaccaagagccagagcctgctgaccttcagcaccaagagccctgaggagaagctgacccccaccagcaagcagctgctggccgaggagagcctgcccaccacccccttctacttcatcctgggcaagcaccggcagcagcaggatgagaagctgaatgagaccctggagaatgagctggtgcagctgcccctgacagagaacatcccagccatcagcgagctgctgcacaccccagcccacgtgctgcccagcgctgccttcctgtgcagcatgtttgtgaacagcctgctgctgagcaaggagaccaagagcgccaaggagatcccagaagatgtggacatggaggaggagaaggagagcgaggacagtgatgaagaaaatgacttcacagagaaggtgcaggacaccagcaacacaggcctgggggaggacatcatccaccagctgagcaagtctgaggagaaggagctgaggaagttcaggaagattgactacagctggattgctgccctgtag

SEQ ID NO: 17450 - DNA, 1155 bp, Artificial Sequence
  Description of Artificial Sequence: Synthetic coding sequence
atggtgaagctgatccacaccctggccgaccatggagatgatgtgaactgctgtgccttctccttcagcctgctggccacctgcagcctggacaagaccatccggctgtacagcctgcgggacttcacagagctgccccacagccccctgaagttccacacctatgctgtgcactgctgctgcttcagccccagcggccacatcctggccagctgcagcacagatggcaccaccgtgctgtggaacacagaaaatggccagatgctggccgtgatggagcagcccagcggcagccctgtgcgggtgtgccagttctccccagacagcacctgcctggccagcggggctgctgatggcaccgtggtgctgtggaatgcccagagctacaagctgtaccgctgtggctctgtgaaggatggcagcctggccgcctgtgccttcagccccaacggcagcttctttgtgacaggcagcagctgtggggacctgactgtgtgggatgacaagatgcgctgcccccacagcgagaaggcccatgacctgggcatcacctgctgtgacttcagcagccagcctgtgtctgatggagagcagggcctgcagttcttccggctggccagctgtggccaggactgccaggtgaagatctggatcgtgtccttcacccacatcctggccaggagaacagagcaccagctgaagcagttcacagaggactggagcgaagaagatgtgtccacctggctgtgtgcccaggacctgaaggacctggtgggcatcttcaagatgaacaacattgatggcaaggagctgctgaacctgaccaaggagagcctggctgatgacctgaagattgagagcctgggcctgcggagcaaggtgctgaggaagattgaggagctgcggaccaaggtgaagagcctgagcagcggcatcccagatgagttcatctgccccatcacccgggagctgatgaaggaccccgtcatcgccagtgatggctacagctatgagaaggaggccatggagaactggatcagcaagaagaagaggaccagccccatgaccaacctggtgctgcccagcgctgtgctgacccccaacagaaccctgaagatggccatcaaccgctggctggagacccaccagaagtag

SEQ ID NO: 17451 - DNA, 1431 bp, Artificial Sequence
  Description of Artificial Sequence: Synthetic coding sequence
atggtgaagctgatccacaccctggccgaccatggagatgatgtgaactgctgtgccttctccttcagcctgctggccacctgcagcctggacaagaccatccggctgtacagcctgcgggacttcacagagctgccccacagccccctgaagttccacacctatgctgtgcactgctgctgcttcagccccagcggccacatcctggccagctgcagcacagatggcaccaccgtgctgtggaacacagaaaatggccagatgctggccgtgatggagcagcccagcggcagccctgtgcgggtgtgccagttctccccagacagcacctgcctggccagcggggctgctgatggcaccgtggtgctgtggaatgcccagagctacaagctgtaccgctgtggctctgtgaaggatggcagcctggccgcctgtgccttcagccccaacggcagcttctttgtgacaggcagcagctgtggggacctgactgtgtgggatgacaagatgcgctgcccccacagcgagaaggcccatgacctgggcatcacctgctgtgacttcagcagccagcctgtgtctgatggagagcagggcctgcagttcttccggctggccagctgtggccaggactgccaggtgaagatctggatcgtgtccttcacccacatcctgggctttgagctgaagtacaagagcaccctgagcggccactgtgcccctgtgctggcctgtgccttcagccatgatggccagatgctggtgtctggctctgtggacaagagcgtcatcgtgtatgacaccaacacagagaacatcctgcacaccctgacccagcacaccaggtatgtgaccacctgtgcctttgcccccaacaccctgctgctggccaccggctccatggacaagacagtgaacatctggcagtttgacctggagaccctgtgccaggccaggagaacagagcaccagctgaagcagttcacagaggactggagcgaagaagatgtgtccacctggctgtgtgcccaggacctgaaggacctggtgggcatcttcaagatgaacaacattgatggcaaggagctgctgaacctgaccaaggagagcctggctgatgacctgaagattgagagcctgggcctgcggagcaaggtgctgaggaagattgaggagctgcggaccaaggtgaagagcctgagcagcggcatcccagatgagttcatctgccccatcacccgggagctgatgaaggaccccgtcatcgccagtgatggctacagctatgagaaggaggccatggagaactggatcagcaagaagaagaggaccagccccatgaccaacctggtgctgcccagcgctgtgctgacccccaacagaaccctgaagatggccatcaaccgctggctggagacccaccagaagtag

SEQ ID NO: 17452 - DNA, 1431 bp, Artificial Sequence; identical to SEQ ID NO: 17451
  Description of Artificial Sequence: Synthetic coding sequence

SEQ ID NO: 17453 - DNA, 1431 bp, Artificial Sequence; identical to SEQ ID NO: 17451
  Description of Artificial Sequence: Synthetic coding sequence

SEQ ID NO: 17454 - DNA, 2385 bp, Artificial Sequence
  Description of Artificial Sequence: Synthetic coding sequence
atggagggcagcctggccggcagcctggccgccccagaccggccccagggccctgagcggctgcccggccctgccccccgggagaacatcgagggcggcgctgaggccgctgagggggagggcggcatcttccgcagcacccgctacctgcctgtgaccaaggagggcccccgggacatcctggatggccggggcggcatctctgtggccaactttgaccccggcaccttcagcctgatgagatgtgacttctgtggggccggctttgacaccagggctggcctgagcagccacgcccgggcccacctgcgggactttggcatcaccaactgggagctgactgtgagccccatcaacatcctgcaggagctgctggccaccagcgctgctgagcagccccccagccccctgggccgggagcccggcggccccccaggcagcttcctgaccagccggcggccccggctgcccctgactgtgcccttcccccccacctgggccgaggaccccggccctgcctatggagatgccagcggccctgagcccgcccgggacatccgctgtgagttctgtggggagttctttgagaacaggaagggcctgagcagccacgcccggagccacctgcggcagatgggcgtgacagagtggtacgtgaatggcagccccatcgacaccctgcgggagatcctgaagaggaggacccagagcaggcctgggggcccccccaaccccccaggccccagccccaaggccctggccaagatgatgggcggggccggccctggcagcagcctggaggcccggagccccagcgacctgcacatcagccccctggccaagaagctgcccccacctcctggcagccccctgggccacagccccacagccagccccccacccacagccaggaagatgtttcctggcctggccgcccccagcctgcccaagaagctgaagccagagcagatccgggtggagatcaagcgggagatgctgcccggggccctgcacggggagctgcaccccagcgagggcccctggggcgccccccgggaggacatgacccccctgaacctgagcagcagagctgagcctgtgcgggacatccgctgtgagttctgtggggagttctttgagaacaggaagggcctgagcagccacgcccggagccacctgcggcagatgggcgtgacagagtggagcgtgaatggcagccccatcgacaccctgcgggagatcctgaagaagaagagcaagccctgcctgatcaagaaggagcccccagctggggacctggccccagccctggctgaagatggcccccccaccgtggcccctggccctgtgcagagccccctgcccctgagccccctggccggccggcctgggaagccaggggccggccctgcccaggtgccccgggagctgagcctgacccccatcactggagccaagcccagcgccaccggctacctgggctctgtggccgccaagaggcccctgcaggaggaccggctgctgcctgctgaggtgaaggccaagacctacatccagacagagctgcccttcaaggccaagaccctgcacgagaagaccagccacagcagcacagaggcctgctgtgagctgtgtggcctgtactttgagaacaggaaggccctggccagccacgcccgggcccacctgcggcagtttggagtgacagagtggtgtgtgaatggcagccccatcgagaccctgtctgagtggatcaagcaccggccccagaaggtgggcgcctaccgcagctacatccagggcggccggcccttcaccaagaagttccgctctgctggccacggccgggacagcgacaagaggcccagcctgggcctggcccctgggggcctggccgtggtgggccgctctgctggaggagagcccggccctgaggccggccgggcagcagatggaggagagcggcccctggccgccagccccccaggcaccgtgaaggccgaggagcaccagaggcagaacatcaacaagtttgagcggcggcaggcccggcccccagatgccagcgctgcccggggaggagaggacaccaatgacctgcagcagaagctggaggaggtgcggcagcccccaccccgggtgcggcctgtgcccagcctggtgccccggcccccccagaccagcctggtgaagtttgtgggcaacatctacaccctgaagtgccgcttctgtgaggtggagttccagggccccctgagcatccaggaggagtgggtgcgccacctgcagaggcacatcctggagatgaacttcagcaaggctgaccccccacctgaggagagccaggccccccaggcccagacagctgctgctgaggccccctag

SEQ ID NO: 17455 - DNA, 4956 bp, Artificial Sequence
  Description of Artificial Sequence: Synthetic coding sequence
atggagggcagcctggccggcagcctggccgccccagaccggccccagggccctgagcggctgcccggccctgccccccgggagaacatcgagggcggcgctgaggccgctgagggggagggcggcatcttccgcagcacccgctacctgcctgtgaccaaggagggcccccgggacatcctggatggccggggcggcatcagcggcaccccagatggccggggcccctgggagcaccccctggtgcaggaggccggggagggcatcctgtctgaaagaagatttgaggacagcgtcatcgtgaggaccatgaagccccacgccgagctggagggcagccgccgcttcctgcaccacagaggagagccccggctgctggagaagcacgcccagggccggcccaggtttgactggctgcaggatgaagatgagcagggcagcccccaggatgctggcctgcacctggacctgcctgcccagcccccacccctggcccccttccggcgggtgtttgtgcctgtggaggacacccccaagaccctggacatggctgtggtgggcggccgggaggacctggaggacctggagggcctggcccagcccagcgagtggggcctgcccaccagcgccagcgaggtggccacccagacctggacagtgaacagcgaggcctctgtggagcggctgcagcccctgctgccccccatcagaacaggcccctacctgtgtgagctgctggaggaggtggccgagggcgtggccagcccagatgaagatgaagatgaggagcctgctgtgttcccctgcattgaatgttccatctacttcaagcagaaggagcacctgctggagcacatgagccagcaccggcgggcccctggccaggagcccccagctgacctggcccccctggcctgtggggagtgtggctgggcctttgctgaccccacagccctggagcagcaccggcagctgcaccaggccagccgggagaagatcatcgaggagatccagaagctgaagcaggtgcctggagatgagggccgggaggcccggctgcagtgccccaagtgtgtgtttggcaccaacagcagccgggcctacgtgcagcacgccaagctgcacatgagggagcccccaggccagaccaccaaggagccctttggaggcagcagcggggccggcagccccagccctgaggccagcgccctgctgtaccagccctatggagctgctgtgggcctgagcgcctgtgtgttctgtggcttccctgcccccagcgagagcctgctgcgggagcacgtgcggctggtgcacgcccacccccactgggaggaggatggagaggcctatgaagaagatcctgccagccagcccggcaccagccaggatgcccacgcctgcttcccagacacagctgtggactactttgggaaggccgagcccagcctggcccccatgtggagggagaacccagctggctatgaccccagcctggcctttggacctggctgccagcagctgagcatccgggacttccccctgagcaagcccctgctgcatggaacaggccagaggcccctgggccgcctggccttccccagcaccctggccagcaccccctacagcctgcagctgggcaggaacaagagcacagtgcacccccagggcctgggggagcggcggcggccctggagcgaggaggaggaggaggaggaggaggaggaggatgtggtgctgaccagcgagatggacttctccccagaaaatggagtcttcagccccctggccacccccagcctcatcccccaggccgccctggagctgaagcaggccttccgggaggccctgcaggccgtggaggccacccagggccagcagcagcagctgcggggcatggtgcccatcgtgctggtggccaagctgggcccccaggtgatggctgctgcccgggtgcccccccggctgcagcctgaggagctgggcctggccggggcccaccccctggacttcctgctgctggatgcccccctgggcggccccctgggcctggacaccctgctggatggagaccctgccatggccctgaagcatgaggagaggaagtgcccctactgcccagaccgcttccacaacggcatcggcctggccaaccacgtgcggggccacctgaacagagtgggcgtgtcctacaacgtgcgccacttcatctctgctgaggaggtgaaggccattgaaagacgcttctccttccagaagaagaagaagaaggtggccaactttgatcctggcaccttcagcctgatgagatgtgacttctgtggggccggctttgacacccgggccggcctgagcagccacgcccgggcccacctgcgggactttggcatcaccaactgggagctgactgtgagccccatcaacatcctgcaggagctgctggccaccagcgctgctgagcagccccccagccccctgggccgggagcccggcggccccccaggcagcttcctgaccagcagaagaccccggctgcccctgactgtgcccttcccccccacctgggccgaggaccccggccctgcctatggagatgcccagagcctgaccacctgtgaggtgtgtggggcctgctttgagaccaggaagggcctgagcagccacgcccggagccacctgcggcagctgggcgtggccgagagcgagagcagcggggcccccatcgacctgctgtatgagctggtgaagcagaagggcctgcctgatgcccacctgggcctgcccccaggcctggccaagaagagcagcagcctgaaggaggtggtggccggggccccccggcccggcctgctgagcctggccaagcccctggatgccccagctgtgaacaaggccatcaagagccccccaggcttcagcgccaagggcctgggccacccccccagcagccccctgctgaagaagacccccctggccctggccggcagccccacccccaagaaccctgaggacaagagcccccagctgagcctgagccccaggcctgccagccccaaggcccagtggccccagagtgaagatgagggccccctgaacctgaccagcggccctgagcccgcccgggacatccgctgtgagttctgtggggagttctttgaaaataggaagggcctgagcagccacgcccggagccacctgcggcagatgggcgtgacagagtggtacgtgaatggcagccccatcgacaccctgcgggagatcctgaagaggaggacccagagcaggcctgggggcccccccaaccccccaggccccagccccaaggccctggccaagatgatgggcggggccggccctggcagcagcctggaggcccggagccccagcgacctgcacatcagccccctggccaagaagctgcccccacctcctggcagccccctgggccacagccccacagccagccccccacccacagccaggaagatgtttcctggcctggccgcccccagcctgcccaagaagctgaagccagagcagatccgggtggagatcaagcgggagatgctgcccggggccctgcatggagagctgcaccccagcgagggcccctggggcgccccccgggaggacatgacccccctgaacctgagcagcagagctgagcctgtgcgggacatccgctgtgagttctgtggggagttctttgaaaataggaagggcctgagcagccacgcccggagccacctgcggcagatgggcgtgacagagtggagcgtgaatggcagccccatcgacaccctgcgggagatcctgaagaagaagagcaagccctgcctgatcaagaaggagcccccagctggggacctggccccagccctggccgaggatggccccccaacagtggcccctggccctgtgcagagccccctgcccctgagccccctggccggccggcctgggaagccaggagctggccctgcccaggtgccccgggagctgagcctgacccccatcaccggggccaagcccagcgccaccggctacctgggctctgtggccgccaagaggcccctgcaggaggaccggctgctgcctgctgaggtgaaggccaagacctacatccagacagagctgcccttcaaggccaagaccctgcacgagaagaccagccacagcagcacagaggcctgctgtgagctgtgtggcctgtactttgaaaataggaaggccctggccagccacgcccgggcccacctgcggcagtttggagtgacagagtggtgtgtgaatggcagccccatcgagaccctgtctgagtggatcaagcaccggccccagaaggtgggcgcctaccgcagctacatccagggcggccggcccttcaccaagaagttccgctctgctggccacggccgggacagcgacaagaggcccagcctgggcctggcccctgggggcctggccgtggtgggccgctctgctggaggagagcccggccctgaggccggccgggctgctgatggaggagagcggcccctggccgccagccccccaggcaccgtgaaggccgaggagcaccagaggcagaacatcaacaagtttgaaagacggcaggcccggcccccagatgccagcgctgcccggggcggggaggacaccaatgacctgcagcagaagctggaggaggtgcggcagcccccaccccgggtgcggcctgtgcccagcctggtgcccaggcctccccagaccagcctggtgaagtttgtgggcaacatctacaccctgaagtgccgcttctgtgaggtggagttccagggccccctgagcatccaggaggagtgggtgcgccacctgcagaggcacatcctggagatgaacttcagcaaggctgaccccccacctgaggagagccaggccccccaggcccagacagctgctgctgaggccccctag

SEQ ID NO: 17456 - DNA, 2508 bp, Artificial Sequence
  Description of Artificial Sequence: Synthetic coding sequence
atggtggccatggacctgggcagccccagcctgcccaagaagagcctgcctgtgcctggggccctggagcaggtggccagccggctgagcagcaaggtggccgctgaggtgccccacggcagcaagcaggagctgcaggacctgaaggcccagagcctgaccacctgtgaggtgtgtggggcctgctttgagaccaggaagggcctgagcagccacgcccggagccacctgcggcagctgggcgtggccgagagcgagagcagcggggcccccatcgacctgctgtatgagctggtgaagcagaagggcctgcctgatgcccacctgggcctgcccccaggcctggccaagaagagcagcagcctgaaggaggtggtggccggggccccccggcccggcctgctgagcctggccaagcccctggatgccccagctgtgaacaaggccatcaagagccccccaggcttcagcgccaagggcctgggccacccccccagcagccccctgctgaagaagacccccctggccctggccggcagccccacccccaagaaccctgaggacaagagcccccagctgagcctgagccccaggcctgccagccccaaggcccagtggccccagagtgaagatgagggccccctgaacctgaccagcggccctgagcccgcccgggacatccgctgtgagttctgtggggagttctttgaaaataggaagggcctgagcagccacgcccggagccacctgcggcagatgggcgtgacagagtggtacgtgaatggcagccccatcgacaccctgcgggagatcctgaagaggaggacccagagcaggcctgggggcccccccaaccccccaggccccagccccaaggccctggccaagatgatgggcggggccggccctggcagcagcctggaggcccggagccccagcgacctgcacatcagccccctggccaagaagctgcccccacctcctggcagccccctgggccacagccccacagccagccccccacccacagccaggaagatgtttcctggcctggccgcccccagcctgcccaagaagctgaagccagagcagatccgggtggagatcaagcgggagatgctgcccggggccctgcatggagagctgcaccccagcgagggcccctggggcgccccccgggaggacatgacccccctgaacctgagcagcagagctgagcctgtgcgggacatccgctgtgagttctgtggggagttctttgaaaataggaagggcctgagcagccacgcccggagccacctgcggcagatgggcgtgacagagtggagcgtgaatggcagccccatcgacaccctgcgggagatcctgaagaagaagagcaagccctgcctgatcaagaaggagcccccagctggggacctggccccagccctggccgaggatggccccccaacagtggcccctggccctgtgcagagccccctgcccctgagccccctggccggccggcctgggaagccaggagctggccctgcccaggtgccccgggagctgagcctgacccccatcaccggggccaagcccagcgccaccggctacctgggctctgtggccgccaagaggcccctgcaggaggaccggctgctgcctgctgaggtgaaggccaagacctacatccagacagagctgcccttcaaggccaagaccctgcacgagaagaccagccacagcagcacagaggcctgctgtgagctgtgtggcctgtactttgaaaataggaaggccctggccagccacgcccgggcccacctgcggcagtttggagtgacagagtggtgtgtgaatggcagccccatcgagaccctgtctgagtggatcaagcaccggccccagaaggtgggcgcctaccgcagctacatccagggcggccggcccttcaccaagaagttccgctctgctggccacggccgggacagcgacaagaggcccagcctgggcctggcccctgggggcctggccgtggtgggccgctctgctggaggagagcccggccctgaggccggccgggctgctgatggaggagagcggcccctggccgccagccccccaggcaccgtgaaggccgaggagcaccagaggcagaacatcaacaagtttgaaagacggcaggcccggcccccagatgccagcgctgcccggggcggggaggacaccaatgacctgcagcagaagctggaggaggtgcggcagcccccaccccgggtgcggcctgtgcccagcctggtgcccaggcctccccagaccagcctggtgaagtttgtgggcaacatctacaccctgaagtgccgcttctgtgaggtggagttccagggccccctgagcatccaggaggagtgggtgcgccacctgcagaggcacatcctggagatgaacttcagcaaggctgaccccccacctgaggagagccaggccccccaggcccagacagctgctgctgaggccccctag

SEQ ID NO: 17457 - DNA, 2898 bp, Artificial Sequence
  Description of Artificial Sequence: Synthetic coding sequence
atggacctgggcagccccagcctgcccaagaagagcctgcctgtgcctggggccctggagcaggtggccagccggctgagcagcaaggtggccgctgaggtgccccacggcagcaagcaggagctgcaggacctgaaggcccagagcctgaccacctgtgaggtgtgtggggcctgctttgagaccaggaagggcctgagcagccacgcccggagccacctgcggcagctgggcgtggccgagagcgagagcagcggggcccccatcgacctgctgtatgagctggtgaagcagaagggcctgcctgatgcccacctgggcctgcccccaggcctggccaagaagagcagcagcctgaaggaggtggtggccggggcccccaggcctggcctgctgagcctggccaagcccctggatgccccagctgtgaacaaggccatcaagagccccccaggcttcagcgccaagggcctgggccacccccccagcagccccctgctgaagaagacccccctggccctggccggcagccccacccccaagaaccctgaggacaagagcccccagctgagcctgagccccaggcctgccagccccaaggcccagtggccccagagtgaagatgagggccccctgaacctgaccctggacagtgatggcggccgggagctggactgccagctgtgtggggcctggtttgagaccaggaagggcctgagcagccacgcccgggcccacctgcggcacctgggcgtgtctgaccctgatgccaagggcagccccattgatgtgctgcacggcctcatcagaagagatggagtgcagatccggctgcccccaagaagaggagccctggcccaccctggccggcccccacccaccagcgctgccctgagcctgctgcccccacctcctccagccaagaaggccaagctgaaggctgctggcatggccagcccctggggcaagcaggacctgtctgctgctgctgctgctggcatcttctgggccagtgatgtggagcccagccccctgaacctgagcagcggccctgagcccgcccgggacatccgctgtgagttctgtggggagttctttgaaaataggaagggcctgagcagccacgcccggagccacctgcggcagatgggcgtgacagagtggtacgtgaatggcagccccatcgacaccctgcgggagatcctgaagaggaggacccagagcaggcctgggggcccccccaaccccccaggccccagccccaaggccctggccaagatgatgggcggggccggccctggcagcagcctggaggcccggagccccagcgacctgcacatcagccccctggccaagaagctgcccccacctcctggcagccccctgggccacagccccacagccagccccccacccacagccaggaagatgtttcctggcctggccgcccccagcctgcccaagaagctgaagccagagcagatccgggtggagatcaagcgggagatgctgcccggggccctgcatggagagctgcaccccagcgagggcccctggggcgccccccgggaggacatgacccccctgaacctgagcagcagagctgagcctgtgcgggacatccgctgtgagttctgtggggagttctttgaaaataggaagggcctgagcagccacgcccggagccacctgcggcagatgggcgtgacagagtggagcgtgaatggcagccccatcgacaccctgcgggagatcctgaagaagaagagcaagccctgcctgatcaagaaggagcccccagctggggacctggccccagccctggccgaggatggccccccaacagtggcccctggccctgtgcagagccccctgcccctgagccccctggccggccggcctgggaagccaggagctggccctgcccaggtgccccgggagctgagcctgacccccatcaccggggccaagcccagcgccaccggctacctgggctctgtggccgccaagaggcccctgcaggaggaccggctgctgcctgctgaggtgaaggccaagacctacatccagacagagctgcccttcaaggccaagaccctgcacgagaagaccagccacagcagcacagaggcctgctgtgagctgtgtggcctgtactttgaaaataggaaggccctggccagccacgcccgggcccacctgcggcagtttggagtgacagagtggtgtgtgaatggcagccccatcgagaccctgtctgagtggatcaagcaccggccccagaaggtgggcgcctaccgcagctacatccagggcggccggcccttcaccaagaagttccgctctgctggccacggccgggacagcgacaagaggcccagcctgggcctggcccctgggggcctggccgtggtgggccgctctgctggaggagagcccggccctgaggccggccgggctgctgatggaggagagcggcccctggccgccagccccccaggcaccgtgaaggccgaggagcaccagaggcagaacatcaacaagtttgaaagacggcaggcccggcccccagatgccagcgctgcccggggcggggaggacaccaatgacctgcagcagaagctggaggaggtgcggcagcccccaccccgggtgcggcctgtgcccagcctggtgcccaggcctccccagaccagcctggtgaagtttgtgggcaacatctacaccctgaagtgccgcttctgtgaggtggagttccagggccccctgagcatccaggaggagtgggtgcgccacctgcagaggcacatcctggagatgaacttcagcaaggctgaccccccacctgaggagagccaggccccccaggcccagacagctgctgctgaggccccctag

SEQ ID NO: 17458 - DNA, 846 bp, Artificial Sequence
  Description of Artificial Sequence: Synthetic coding sequence
atggccagccggggccggcggcctgagcacggcggccccccagagctgttctatgatgaaacagaggccaggaaatatgtgaggaacagcaggatgattgacatccagaccaggatggccggccgggccctggagctgctgtacctgcctgagaacaagccctgctacctgctggacatcggctgcggcaccggcctgagcggcagctacctgagtgatgagggccactactgggtgggcctggacatcagccctgccatgctggatgaagctgtggaccgggagattgaaggagacctgctgctgggggacatgggccagggcatccccttcaagccaggcacctttgatggctgcatcagcatctctgctgtgcagtggctgtgcaatgccaacaagaagtctgagaacccagccaagaggctgtactgcttctttgccagcctcttctctgtgctggtgcggggcagcagagctgtgctgcagctgtacccagagaacagcgagcagctggagctgatcaccacccaggccaccaaggccggcttcagcggcggcatggtggtggactaccccaacagcgccaaggccaagaagttctacctgtgcctcttcagcggccccagcaccttcatccctgagggcctgtctgagaaccaggatgaggtggagccccgggagagcgtcttcaccaatgaacgcttccccctgaggatgagcagaagaggcatggtgaggaagagccgggcctgggtgctggagaagaaggagcggcaccggcggcagggccgggaggtgcggccagacacccagtacacaggcaggaagaggaagccccgcttctag

SEQ ID NO: 17459 - DNA, 372 bp, Artificial Sequence
  Description of Artificial Sequence: Synthetic coding sequence
atggctgacccccagagctgcttcatgacccggcagaagccaggcaacacctttgccagcgagggcagcctgaacacagctggccggcctggggtgggcaagaggcaggtggcccctgtggccggcgtggccaggaagggccgccgcatctggggcagcaggatgattgacatccagaccaggatggccggccgggccctggagctgctgtacctgcctgagaacaagccctgctacctgctggacatcggctgcggcaccggcctgagcggcagctacctgagtgatgagggccactactgggtgggcctggacatcagccctgccatgctgggccctggcatccccagctgcccagctgctgtgccctag

SEQ ID NO: 17460 - DNA, 897 bp, Artificial Sequence
  Description of Artificial Sequence: Synthetic coding sequence
atggccagccggggccggcggcctgagcacggcggccccccagagctgttctatgatgaaacagaggccaggaaatatgtgaggaacagcaggatgattgacatccagaccaggatggccggccgggccctggagctgctgtacctgcctgagaacaagccctgctacctgctggacatcggctgcggcaccggcctgagcggcagctacctgagtgatgagggccactactgggtgggcctggacatcagccctgccatgctggatgaagctgtggaccgggagattgaaggagacctgctgctgggggacatgggccagggcatccccttcaagccaggcacctttgatggctgcatcagcatctctgctgtgcagtggctgtgcaatgccaacaagaagtctgagaacccagccaagaggctgtactgcttctttgccagcctcttctctgtgctggtgcggggcagcagagctgtgctgcagctgtacccagagaacagcgagcagctggagctgatcaccacccaggccaccaaggccggcttcagcggcggcatggtggtggactaccccaacagcgccaaggccaagaagttctacctgtgcctcttcagcggccccagcaccttcatccctgagggcctgtctgagaaccaggatgaggtggagccccgggagagcgtcttcaccaatgaaagagagggcggggcctttgaaagaagaggcatccggggccaccagacccggcgcttccccctgaggatgagccggcggggcatggtgaggaagagccgggcctgggtgctggagaagaaggagcggcaccggcggcagggccgggaggtgcggccagacacccagtacacaggcaggaagaggaagccccgcttctag

SEQ ID NO: 17461 - DNA, 1131 bp, Artificial Sequence
  Description of Artificial Sequence: Synthetic coding sequence
atggctgactactggaagagccagcccaagaagttctgtgactactgcaagtgctggattgctgacaaccggcccagcgtggagttccacgagcggggcaagaaccacaaggaaaatgtggccaagaggatcagcgagatcaagcagaagagcctggacaaggccaaggaggaggagaaggccagcaaggagtttgctgccatggaggccgccgccctgaaggcctaccaggaggacctgaagaggctgggcctggagagcgagatcctggagcccagcatcacccctgtgaccagcaccatcccccccaccagcaccagcaaccagcagaaggagaagaaggagaagaagaagaggaagaaggaccccagcaagggccgctgggtggagggcatcaccagcgagggctaccactactactatgacctgatcagcggggccagccagtgggagaagccagagggcttccagggcgacctgaagaagacagctgtgaagacagtgtgggtggagggcctgtctgaagatggcttcacctactactacaacacagagaccggggagagccgctgggagaagccagatgacttcatcccccacaccagtgacctgcccagcagcaaggtgaatgaaaacagcctgggcaccctggatgagagcaagagcagtgacagccacagcgacagtgatggagagcaggaggccgaggagggcggcgtgtccacagaaacagagaagcccaagatcaagttcaaggagaagaacaagaacagtgatggcggcagtgaccctgagacccagaaggagaagagcatccagaagcagaacagcctgggcagcaatgaggagaagagcaagaccctgaagaagagcaacccctacggggagtggcaggagatcaagcaggaggtggagagccatgaggaggtggacctggagctgcccagcacagaaaatgaatatgtgtccaccagcgaggctgatggcggcggggagcccaaggtggtgttcaaggagaagacagtgaccagcctgggcgtgatggctgatggagtggcccctgtgttcaagaagagaagaacagaaaatggcaagagcaggaacctgcggcagagaggagatgaccagtag

SEQ ID NO: 17462 - DNA, 1068 bp, Artificial Sequence
  Description of Artificial Sequence: Synthetic coding sequence
atggctgactactggaagagccagcccaagaagttctgtgactactgcaagtgctggattgctgacaaccggcccatcaagcagaagagcctggacaaggccaaggaggaggagaaggccagcaaggagtttgctgccatggaggccgccgccctgaaggcctaccaggaggacctgaagaggctgggcctggagagcgagatcctggagcccagcatcacccctgtgaccagcaccatcccccccaccagcaccagcaaccagcagaaggagaagaaggagaagaagaagaggaagaaggaccccagcaagggccgctgggtggagggcatcaccagcgagggctaccactactactatgacctgatcagcggggccagccagtgggagaagccagagggcttccagggcgacctgaagaagacagctgtgaagacagtgtgggtggagggcctgtctgaagatggcttcacctactactacaacacagaaacaggagagagccgctgggagaagccagatgacttcatcccccacaccagtgacctgcccagcagcaaggtgaatgaaaacagcctgggcaccctggatgagagcaagagcagtgacagccacagcgacagtgatggagagcaggaggccgaggagggcggcgtgtccacagaaacagagaagcccaagatcaagttcaaggagaagaacaagaacagtgatggcggcagtgaccctgagacccagaaggagaagagcatccagaagcagaacagcctgggcagcaatgaggagaagagcaagaccctgaagaagagcaacccctatggagagtggcaggagatcaagcaggaggtggagagccatgaggaggtggacctggagctgcccagcacagaaaatgaatatgtgtccaccagcgaggctgatggcggcggggagcccaaggtggtgttcaaggagaagacagtgaccagcctgggcgtgatggctgatggagtggcccctgtgttcaagaagagaagaacagaaaatggcaagagcaggaacctgcggcagagaggagatgaccagtag

SEQ ID NO: 17463 - DNA, 354 bp, Artificial Sequence
  Description of Artificial Sequence: Synthetic coding sequence
atgagcctgaccagtgatgccagcagccccaggagctatgtgagcccccgcatcagcaccccccagaccaacacagtgcccatcaagcccctcatcagcaccccacctgtgagcagccagcccaaggtgtccacccctgtggtgaagcagggccctgtgtcccagagcgccacccagcagcctgtgacagctgacaagagcaaggtgatgaacctgagcctgctggaggtgttttctgcccaggtggcccgggaggtgcaccacctggtgcccatcatcctgctgattgtggtgatgcaccagatgcagcagctgtaccaccgcatcctgctgcctgacccccgggtgcactag

SEQ ID NO: 17464 - DNA, 1635 bp, Artificial Sequence
  Description of Artificial Sequence: Synthetic coding sequence
atggtgatgtatgccaggaagcagcagaggctgagtgatggctgccacgaccggcggggggacagccagccctaccaggccctgaagtacagcagcaagagccaccccagcagcggggaccacagacatgagaagatgagagatgctggggaccccagcccccccaacaagatgctgcggcggagtgacagccctgagaacaagtacagcgacagcacaggccacagcaaggccaagaatgtgcacacccaccgggtgcgggagagagatggcggcaccagctacagcccccaggagaacagccacaaccacagcgccctgcacagcagcaacagccacagcagcaaccccagcaacaaccccagcaagaccagtgatgccccctatgattctgcagatgactggagcgagcacatcagcagcagcggcaagaagtactactacaactgcaggacagaggtgtcccagtgggagaagcccaaggagtggctggagcgggagcagaggcagaaggaggccaacaagatggctgtgaacagcttccccaaggaccgggactaccgccgggaggtgatgcaggccacagccaccagcggctttgccagcggcaagagcaccagcggggacaagcctgtgagccacagctgcaccacccccagcaccagcagcgccagcggcctgaaccccaccagcgccccacccaccagcgccagcgctgtgcctgtgtcccctgtgccccagagccccatcccccccctgctgcaggaccccaacctgctgcggcagctgctgcctgccctgcaggccaccctgcagctgaacaacagcaatgtggacatcagcaagatcaatgaggtgctgacagctgctgtgacccaggccagcctgcagagcatcatccacaagttcctgacagctggccccagcgccttcaacatcaccagcctcatcagccaggccgcccagctgagcacccaggcccagcccagcaaccagagccccatgagcctgaccagtgatgccagcagccccaggagctatgtgagcccccgcatcagcaccccccagaccaacacagtgcccatcaagcccctcatcagcaccccacctgtgagcagccagcccaaggtgtccacccctgtggtgaagcagggccctgtgtcccagagcgccacccagcagcctgtgacagctgacaagcagcagggccacgagcctgtgagccccaggagcctgcagaggagcagcagccagaggagccccagccctggccccaaccacaccagcaacagcagcaatgccagcaatgccaccgtggtgccccagaacagcagcgcccggagcacctgcagcctgaccccagccctggccgcccacttcagcgagaacctgatcaagcacgtgcagggctggccagctgaccacgccgagaagcaggccagccggctgcgggaggaggcccacaacatgggcaccatccacatgtctgagatctgcacagagctgaagaacctgcggagcctggtgcgggtgtgtgagatccaggccaccctgcgggagcagaggatcctcttcctgcggcagcagatcaaggagctggagaagctgaagaaccagaacagcttcatggtgtag

SEQ ID NO: 17465 - DNA, 1944 bp, Artificial Sequence
  Description of Artificial Sequence: Synthetic coding sequence
atggtgatgtatgccaggaagcagcagaggctgagtgatggctgccacgaccggcggggggacagccagccctaccaggccctgaagtacagcagcaagagccaccccagcagcggggaccacagacatgagaagatgagagatgctggggaccccagcccccccaacaagatgctgcggcggagtgacagccctgagaacaagtacagcgacagcacaggccacagcaaggccaagaatgtgcacacccaccgggtgcgggagagagatggcggcaccagctacagcccccaggagaacagccacaaccacagcgccctgcacagcagcaacagccacagcagcaaccccagcaacaaccccagcaagaccagtgatgccccctatgattctgcagatgactggagcgagcacatcagcagcagcggcaagaagtactactacaactgcaggacagaggtgtcccagtgggagaagcccaaggagtggctggagcgggagcagaggcagaaggaggccaacaagatggctgtgaacagcttccccaaggaccgggactaccgccgggaggtgatgcaggccacagccaccagcggctttgccagcggcatggaggacaagcacagcagtgatgccagcagcctgctgccccagaacatcctgagccagaccagccgccacaatgaccgggactaccgcctgcccagggctgagacccacagcagcagcacccctgtgcagcaccccatcaagcctgtggtgcaccccacagccacccccagcacagtgcccagcagccccttcaccctgcagagcgaccaccagcccaagaagagctttgatgccaatggagccagcaccctgagcaagctgcccacccccaccagctctgtgcctgcccagaagacagagaggaaggagagcaccagcggggacaagcctgtgagccacagctgcaccacccccagcaccagcagcgccagcggcctgaaccccaccagcgccccacccaccagcgccagcgctgtgcctgtgtcccctgtgccccagagccccatcccccccctgctgcaggaccccaacctgctgcggcagctgctgcctgccctgcaggccaccctgcagctgaacaacagcaatgtggacatcagcaagatcaatgaggtgctgacagctgctgtgacccaggccagcctgcagagcatcatccacaagttcctgacagctggccccagcgccttcaacatcaccagcctcatcagccaggccgcccagctgagcacccaggcccagcccagcaaccagagccccatgagcctgaccagtgatgccagcagccccaggagctatgtgagcccccgcatcagcaccccccagaccaacacagtgcccatcaagcccctcatcagcaccccacctgtgagcagccagcccaaggtgtccacccctgtggtgaagcagggccctgtgtcccagagcgccacccagcagcctgtgacagctgacaagcagcagggccacgagcctgtgagccccaggagcctgcagaggagcagcagccagaggagccccagccctggccccaaccacaccagcaacagcagcaatgccagcaatgccaccgtggtgccccagaacagcagcgcccggagcacctgcagcctgaccccagccctggccgcccacttctctgaaaatctcatcaagcacgtgcagggctggccagctgaccatgctgagaagcaggccagccggctgcgggaggaggcccacaacatgggcaccatccacatgtctgagatctgcacagagctgaagaacctgcggagcctggtgcgggtgtgtgagatccaggccaccctgcgggagcagaggatcctcttcctgcggcagcagatcaaggagctggagaagctgaagaaccagaacagcttcatggtgtag

SEQ ID NO: 17466 - DNA, 1809 bp, Artificial Sequence
  Description of Artificial Sequence: Synthetic coding sequence
atgagagatgctggggaccccagcccccccaacaagatgctgcggcggagtgacagccctgagaacaagtacagcgacagcacaggccacagcaaggccaagaatgtgcacacccaccgggtgcgggagagagatggcggcaccagctacagcccccaggagaacagccacaaccacagcgccctgcacagcagcaacagccacagcagcaaccccagcaacaaccccagcaagaccagtgatgccccctatgacagcgcagatgactggagcgagcacatcagcagcagcggcaagaagtactactacaactgcaggacagaggtgtcccagtgggagaagcccaaggagtggctggagcgggagcagaggcagaaggaggccaacaagatggctgtgaacagcttccccaaggaccgggactacagaagagaggtgatgcaggccacagccaccagcggctttgccagcggcatggaggacaagcacagcagtgatgccagcagcctgctgccccagaacatcctgagccagaccagccgccacaatgaccgggactaccgcctgcccagggctgagacccacagcagcagcacccctgtgcagcaccccatcaagcctgtggtgcaccccacagccacccccagcacagtgcccagcagccccttcaccctgcagagcgaccaccagcccaagaagagctttgatgccaacggggccagcaccctgagcaagctgcccacccccaccagctctgtgcctgcccagaagacagagaggaaggagagcaccagcggggacaagcctgtgagccacagctgcaccacccccagcaccagcagcgccagcggcctgaaccccaccagcgccccacccaccagcgccagcgctgtgcctgtgtcccctgtgccccagagccccatcccccccctgctgcaggaccccaacctgctgcggcagctgctgcctgccctgcaggccaccctgcagctgaacaacagcaatgtggacatcagcaagatcaatgaggtgctgacagctgctgtgacccaggccagcctgcagagcatcatccacaagttcctgacagctggccccagcgccttcaacatcaccagcctcatcagccaggccgcccagctgagcacccaggcccagcccagcaaccagagccccatgagcctgaccagtgatgccagcagccccaggagctatgtgagcccccgcatcagcaccccccagaccaacacagtgcccatcaagcccctcatcagcaccccacctgtgagcagccagcccaaggtgtccacccctgtggtgaagcagggccctgtgtcccagagcgccacccagcagcctgtgacagctgacaagcagcagggccacgagcctgtgagccccaggagcctgcagaggagcagcagccagaggagccccagccctggccccaaccacaccagcaacagcagcaatgccagcaatgccaccgtggtgccccagaacagcagcgcccggagcacctgcagcctgaccccagccctggccgcccacttcagcgagaacctgatcaagcacgtgcagggctggccagctgaccacgccgagaagcaggccagccggctgcgggaggaggcccacaacatgggcaccatccacatgtctgagatctgcacagagctgaagaacctgcggagcctggtgcgggtgtgtgagatccaggccaccctgcgggagcagaggatcctcttcctgcggcagcagatcaaggagctggagaagctgaagaaccagaacagcttcatggtgtag

SEQ ID NO: 17467 - DNA, 702 bp, Artificial Sequence
  Description of Artificial Sequence: Synthetic coding sequence
atgagagatgctggggaccccagcccccccaacaagatgctgcggcggagtgacagccctgagaacaagtacagcgacagcacaggccacagcaaggccaagaatgtgcacacccaccgggtgcgggagagagatggcggcaccagctacagcccccaggagaacagccacaaccacagcgccctgcacagcagcaacagccacagcagcaaccccagcaacaaccccagcaagaccagtgatgccccctatgacagcgcagatgactggagcgagcacatcagcagcagcggcaagaagtactactacaactgcaggacagaggtgtcccagtgggagaagcccaaggagtggctggagcgggagcagaggcagaaggaggccaacaagatggctgtgaacagcttccccaaggaccgggactacagaagagaggtgatgcaggccacagccaccagcggctttgccagcggcatggaggacaagcacagcagtgatgccagcagcctgctgccccagaacatcctgagccagaccagccgccacaatgaccgggactaccgcctgcccagggctgagacccacagcagcagcacccctgtgcagcaccccatcaagcctgtggtgcaccccacagccacccccagcacagtgcccagcagccccttcaccctgcagagcgaccaccagcccaagaagtag

SEQ ID NO: 17468 - DNA, 615 bp, Artificial Sequence
  Description of Artificial Sequence: Synthetic coding sequence
atgagagatgctggggaccccagcccccccaacaagatgctgcggcggagtgacagccctgagaacaagtacagcgacagcacaggccacagcaaggccaagaatgtgcacacccaccgggtgcgggagagagatggcggcaccagctacagcccccaggagaacagccacaaccacagcgccctgcacagcagcaacagccacagcagcaaccccagcaacaaccccagcaagaccagtgatgccccctatgacagcgcagatgactggagcgagcacatcagcagcagcggcaagaagtactactacaactgcaggacagaggtgtcccagtgggagaagcccaaggagtggctggagcgggagcagaggcagaaggaggccaacaagatggctgtgaacagcttccccaaggaccgggactacagaagagaggtgatgcaggccacagccaccagcggctttgccagcggcatggaggacaagcacagcagtgatgccagcagcctgctgccccagaacatcctgagccagaccagccgccacaatgaccgggactaccgcctgcccagggctgagacccacagcagcagcacccctgtgcagcacccctag

SEQ ID NO: 17469 - DNA, 1044 bp, Artificial Sequence
  Description of Artificial Sequence: Synthetic coding sequence
atgagagatgctggggaccccagcccccccaacaagatgctgcggcggagtgacagccctgagaacaagtacagcgacagcacaggccacagcaaggccaagaatgtgcacacccaccgggtgcgggagagagatggcggcaccagctacagcccccaggagaacagccacaaccacagcgccctgcacagcagcaacagccacagcagcaaccccagcaacaaccccagcaagaccagtgatgccccctatgacagcgcagatgactggagcgagcacatcagcagcagcggcaagaagtactactacaactgcaggacagaggtgtcccagtgggagaagcccaaggagtggctggagcgggagcagaggcagaaggaggccaacaagatggctgtgaacagcttccccaaggaccgggactacagaagagaggtgatgcaggccacagccaccagcggctttgccagcggcatggaggacaagcacagcagtgatgccagcagcctgctgccccagaacatcctgagccagaccagccgccacaatgaccgggactaccgcctgcccagggctgagacccacagcagcagcacccctgtgcagcaccccatcaagcctgtggtgcaccccacagccacccccagcacagtgcccagcagccccttcaccctgcagagcgaccaccagcccaagaagagctttgatgccaacggggccagcaccctgagcaagctgcccacccccaccagctctgtgcctgcccagaagacagagaggaaggagagcaccagcggggacaagcctgtgagccacagctgcaccacccccagcaccagcagcgccagcggcctgaaccccaccagcgccccacccaccagcgccagcgctgtgcctgtgtcccctgtgccccagagccccatcccccccctgctgcaggaccccaacctgctgcggcagctgctgcctgccctgcaggccaccctgcagctgaacaacagcaatgtggacatcagcaagatcaatgaggtgctgacagcctag

SEQ ID NO: 17470 - DNA, 1311 bp, Artificial Sequence
  Description of Artificial Sequence: Synthetic coding sequence
atgagagatgctggggaccccagcccccccaacaagatgctgcggcggagtgacagccctgagaacaagtacagcgacagcacaggccacagcaaggccaagaatgtgcacacccaccgggtgcgggagagagatggcggcaccagctacagcccccaggagaacagccacaaccacagcgccctgcacagcagcaacagccacagcagcaaccccagcaacaaccccagcaagaccagtgatgccccctatgacagcgcagatgactggagcgagcacatcagcagcagcggcaagaagtactactacaactgcaggacagaggtgtcccagtgggagaagcccaaggagtggctggagcgggagcagaggcagaaggaggccaacaagatggctgtgaacagcttccccaaggaccgggactacagaagagaggtgatgcaggccacagccaccagcggctttgccagcggcatggaggacaagcacagcagtgatgccagcagcctgctgccccagaacatcctgagccagaccagccgccacaatgaccgggactaccgcctgcccagggctgagacccacagcagcagcacccctgtgcagcaccccatcaagcctgtggtgcaccccacagccacccccagcacagtgcccagcagccccttcaccctgcagagcgaccaccagcccaagaagagctttgatgccaacggggccagcaccctgagcaagctgcccacccccaccagctctgtgcctgcccagaagacagagaggaaggagagcaccagcggggacaagcctgtgagccacagctgcaccacccccagcaccagcagcgccagcggcctgaaccccaccagcgccccacccaccagcgccagcgctgtgcctgtgtcccctgtgccccagagccccatcccccccctgctgcaggaccccaacctgctgcggcagctgctgcctgccctgcaggccaccctgcagctgaacaacagcaatgtggacatcagcaagatcaatgaggtgctgacagctgctgtgacccaggccagcctgcagagcatcatccacaagttcctgacagctggccccagcgccttcaacatcaccagcctcatcagccaggccgcccagctgagcacccaggacatccccctgcacgagggcatccagatggagcgggacacccacaggagcaagtgggaggtgaagggcagcctgtgccagaaggctgacaagcagcaggagtgcctggtgtggaatggcagcatcatggtgcagaggctgctgcagcccagcggctag

SEQ ID NO: 17471 - DNA, 522 bp, Artificial Sequence
  Description of Artificial Sequence: Synthetic coding sequence
atgagagatgctggggaccccagcccccccaacaagatgctgcggcggagtgacagccctgagaacaagtacagcgacagcacaggccacagcaaggccaagaatgtgcacacccaccgggtgcgggagagagatggcggcaccagctacagcccccaggagaacagccacaaccacagcgccctgcacagcagcaacagccacagcagcaaccccagcaacaaccccagcaagaccagtgatgccccctatgacagcgcagatgactggagcgagcacatcagcagcagcggcaagaagtactactacaactgcaggacagaggtgtcccagtgggagaagcccaaggagtggctggagcgggagcagaggcagaaggaggccaacaagatggctgtgaacagcttccccaaggaccgggactacagaagagaggtgatgcaggccacagccaccagcggctttgccagcggcatggaggacaagcacagcagtgatgccagcagcctgctgccccagtag

SEQ ID NO: 17472 - DNA, 180 bp, Artificial Sequence
  Description of Artificial Sequence: Synthetic coding sequence
atgagagatgctggggaccccagcccccccaacaagatgctgcggcggagtgacagccctgagaacaagtacagcgacagcacaggccacagcaaggccaagaatgtgcacacccaccgggtgcgggagagagatggcggcaccagctacagcccccaggagaacagccacaaccactag

SEQ ID NO: 17473 - DNA, 111 bp, Artificial Sequence
  Description of Artificial Sequence: Synthetic coding sequence
atgagagatgctggggaccccagcccccccaacaagatgctgcggcggagtgacagccctgagaacaagtacagcgacagcacaggccacagcaaggccaagaatgtgtag

SEQ ID NO: 17474 - DNA, 906 bp, Artificial Sequence
  Description of Artificial Sequence: Synthetic coding sequence
atgagagatgctggggaccccagcccccccaacaagatgctgcggcggagtgacagccctgagaacaagtacagcgacagcacaggccacagcaaggccaagaatgtgcacacccaccgggtgcgggagagagatggcggcaccagctacagcccccaggagaacagccacaaccacagcgccctgcacagcagcaacagccacagcagcaaccccagcaacaaccccagcaagaccagtgatgccccctatgacagcgcagatgactggagcgagcacatcagcagcagcggcaagaagtactactacaactgcaggacagaggtgtcccagtgggagaagcccaaggagtggctggagcgggagcagaggcagaaggaggccaacaagatggctgtgaacagcttccccaaggaccgggactacagaagagaggtgatgcaggccacagccaccagcggctttgccagcggcatggaggacaagcacagcagtgatgccagcagcctgctgccccagaacatcctgagccagaccagccgccacaatgaccgggactaccgcctgcccagggctgagacccacagcagcagcacccctgtgcagcaccccatcaagcctgtggtgcaccccacagccacccccagcacagtgcccagcagccccttcaccctgcagagcgaccaccagcccaagaagagctttgatgccaacggggccagcaccctgagcaagctgcccacccccaccagctctgtgcctgcccagaagacagagaggaaggagagcaccagcggggacaagcctgtgagccacagctgcaccacccccagcaccagcagcgccagcggcctgaaccccaccagcgccccacccaccagcgccagcggccccaagagcagctag

SEQ ID NO: 17475 - DNA, 5469 bp, Artificial Sequence
  Description of Artificial Sequence: Synthetic coding sequence
atgtaccccaactggggccgctatggaggcagcagccactacccacctcctcctgtgcccccacctcctcctgtggccctgcctgaggccagccctggccctggctacagcagcagcaccaccccagctgcccccagcagcagcggcttcatgtccttccgggagcagcacctggcccagctgcagcagctgcagcagatgcaccagaagcagatgcagtgtgtgctgcagccccaccacctgcccccaccacccctgcccccacctcctgtgatgcctgggggcggctatggagactggcagcccccacctccacccatgcctcctcctcctggccctgccctgagctaccagaagcagcagcagtacaagcaccagatgctgcaccaccagagagatggccccccaggcctggtgcccatggagctggagagccccccagagagcccccctgtgcccccaggcagctacatgccacccagccagagctacatgcccccaccccagcccccacccagctactacccacccaccagcagccagccctacctgcccccagcccagcccagccccagccagagcccccccagccagagctacctggcccccacccccagctacagcagcagcagcagcagcagccagagctacctgagccacagccagagctacctgcccagcagccaggccagccccagccggcccagccagggccacagcaagagccagctgctggcccctcctcctccttctgcccctcctggcaacaagaccaccgtgcagcaggagcccctggagagcggggccaagaacaagagcacagagcagcagcaggccgcccctgagccagaccccagcaccatgaccccccaggagcagcagcagtactggtaccggcagcacctgctgagcctgcagcagaggaccaaggtgcacctgcccggccacaagaagggccctgtggtggccaaggacaccccagagcctgtgaaggaggaggtgacagtgcctgccaccagccaggtgcctgagagccccagcagcgaggagccccccctgcccccaccaaatgaggaggtgcccccacccctgcccccagaggagccccagagcgaggaccctgaggaggatgcccggctgaagcagctgcaggccgctgctgcccactggcagcagcaccagcagcaccgggtgggcttccagtaccagggcatcatgcagaagcacacccagctgcagcagatcctgcagcagtaccagcagatcatccagcccccaccccacatccaggccaccaccccacctcctggcatccccccacctggggtgccccagggcatccccccccagctgacagctgcccctgtgcccccagccagcagcagccagagcagccaggtgcctgagaagcccaggcctgccctgctgcccacccctgtgtcctttggcagcgccccacccaccacctaccacccccccctgcagagcgctggccccagcgagcaggtgaacagcaaggcccccctgagcaagagcgccctgccctacagcagcttcagcagtgaccagggcctgggggagagcagcgctgcccccagccagcccatcacagctgtgaaggacatgcctgtgcgcagcggcggcctgctgcctgaccccccaagaagcagctacctggagagcccccggggccccaggtttgatggccccaggagatttgaggacctgggcagccgctgtgagggcccccggcccaagggccccaggtttgagggcaacagaccagatggcccccggcccaggtatgagggccaccctgctgagggcaccaagagcaagtggggcatgatcccccggggccctgccagccagttctacatcacccccagcaccagcctgagcccccggcagagcggcccccagtggaagggccccaagccagccttcggccagcagcaccagcagcagcccaagagccaggccgagcccctgagcggcaacaaggagcccctggccgacaccagcagcaaccagcagaagaacttcaagatgcagagcgctgccttcagcattgctgctgatgtgaaggatgtgaaggccgcccagagcaatgaaaacctgagtgacagccagcaggagccccccaagtctgaggtgtctgagggccctgtggagcccagcaactgggaccagaatgtgcagagcatggagacccagattgacaaggcccaggccgtgacccagcctgtgcccctggccaacaagcctgtgcctgcccagagcaccttccccagcaagacaggaggcatggagggcggcacagctgtggccaccagcagcctgacagctgacaatgacttcaagcctgtgggcatcggcctgccccacagcgagaacaaccaggacaagggcctgcccaggccagacaacagagacaaccggctggagggcaacagaggcaacagcagcagctaccggggccctggccagagcaggatggaggacacccgggacaagggcctggtgaacagaggccggggccaggccatcagccggggccctggcctggtgaagcaggaggacttccgggacaagatgatgggcagaagagaggacagccgggagaagatgaacagaggagagggcagccgggaccggggcctggtgcggcccggcagcagccgggagaaggtgcctgggggcctgcagggcagccaggacagaggagctgctggcagccgggagcggggccccccccggcgggccggcagccaggagcggggccccctgcggcgggccggcagccgggagcgcatccccccccggcgggccggcagccgggagcggggccccccccggggccctggcagccgggagcggggcctgggccgcagtgactttggccgggaccggggccccttccggcctgagcctggagatggaggagagaagatgtacccctaccacagagatgagcccccccgggccccctggaaccacggggaggagcggggccacgaggagttccccctggatggaagaaatgcccccatggagcgggagcggctggatgactgggaccgggagcgctactggagagaatgtgagcgggactaccaggatgacaccctggagctgtacaaccgggaggaccgcttcagcgccccacccagccgcagccatgatggagacagaagaggcccctggtgggatgactgggagcgggaccaggacatggatgaggactacaaccgggagatggagcgggacatggacagagatgtggaccgcatcagccggcccatggacatgtatgacaggagcctggacaatgagtgggaccgggactatggccggcccctggatgagcaggagagccagttccgggagcgggacatccccagcctgccccccctgccccccctgccccccctgccccccctggaccgctacagagatgaccgctggagggaggagaggaaccgggagcacggctatgaccgggacttccgggacagaggagagctgcgcatccgggagtacccagagcggggggacacctggagggagaagagggactatgtgcctgacaggatggactgggagcgggagcggctgagtgaccgctggtaccccagtgatgtggacagacacagccccatggccgagcacatgcccagcagccaccacagcagcgagatgatgggcagtgatgccagcctggacagcgaccagggcctgggcggcgtgatggtgctgagccagaggcagcacgagatcatcctgaaggccgcccaggagctgaagatgctgcgggagcagaaggagcagctgcagaagatgaaggactttggcagcgagccccagatggctgaccacctgcccccccaggagagccggctgcagaacaccagcagccggcccggcatgtacccacctcctggcagctacagacctcctccacccatgggcaagcccccaggcagcatcgtgcggcccagcgcccccccagcccggagctctgtgcctgtgaccaggcctcctgtgcccatccccccacctcctcctcctccacccctgcccccacctcctcctgtgatcaagccccagaccagcgctgtggagcaggagcgctgggatgaagattccttctacggcctgtgggacaccaatgatgagcagggcctgaacagcgagttcaagtcagaaacagctgccatccccagcgcccctgtgctgcccccacctcctgtgcacagcagcatccccccacctggccctgtgcccatgggcatgccacccatgagcaagcccccacctgtgcagcagacagtggactatggccacggccgggacatcagcaccaacaaggtggagcagatcccctatggagagcgcatcaccctgcggccagaccccctgcctgagaggagcacctttgaaacagagcacgccggccagagggacagatatgaccgggagcgggaccgggagccctactttgaccggcagagcaatgtgattgctgaccaccgggacttcaagagggaccgggagacccaccgggaccgggaccgggacagaggagtgattgattatgaccgggacagatttgaccgggagcggcggcccagagatgaccgggcccagagctacagagacaagaaggaccacagcagcagccggcggggcggctttgaccggcccagctatgacaggaagagtgacaggcctgtgtatgagggccccagcatgtttggaggagagaggaggacctacccagaggagaggatgcccctgcctgcccccagcctgagccaccagcccccaccagccccccgggtggagaagaagccagagagcaagaatgtggatgacatcctgaagcccccaggccgggagagcaggcctgagcgcatcgtggtgatcatgaggggcctgcccggcagcggcaagacccacgtggccaagctgatccgggtgatggagtatgaatatgaggccgagatggaggagacctaccgcacctccatgttcaagaccttcaagaagaccctggatgatggcttcttccccttcatcatcctggatgccatcaatgacagagtgcgccactttgaccagttctggagcgctgccaagaccaagggctttgaggtgtacctggccgagatgtctgctgacaaccagacctgtgggaagaggaacatccacggcaggaagctgaaggagatcaacaagatggctgaccactgggagacagcccccaggcacatgatgaggctggacatccgcagcctgctgcaggatgctgccatcgaggaggtggagatggaggactttgatgccaacatcgaggagcagaaggaggagaagaaggatgctgaggaggaggagagcgagctggtgggggaccggcccaccaccctgaacagcgtgtccctgctgaagttcctgaagaaggtgtag

SEQ ID NO: 17476 - DNA, 6441 bp, Artificial Sequence
  Description of Artificial Sequence: Synthetic coding sequence
atgtaccccaactggggccgctatggaggcagcagccactacccacctcctcctgtgcccccacctcctcctgtggccctgcctgaggccagccctggccctggctacagcagcagcaccaccccagctgcccccagcagcagcggcttcatgtccttccgggagcagcacctggcccagctgcagcagctgcagcagatgcaccagaagcagatgcagtgtgtgctgcagccccaccacctgcccccaccacccctgcccccacctcctgtgatgcctgggggcggctatggagactggcagcccccacctccacccatgcctcctcctcctggccctgccctgagctaccagaagcagcagcagtacaagcaccagatgctgcaccaccagagagatggccccccaggcctggtgcccatggagctggagagccccccagagagcccccctgtgcccccaggcagctacatgccacccagccagagctacatgcccccaccccagcccccacccagctactacccacccaccagcagccagccctacctgcccccagcccagcccagccccagccagagcccccccagccagagctacctggcccccacccccagctacagcagcagcagcagcagcagccagagctacctgagccacagccagagctacctgcccagcagccaggccagccccagccggcccagccagggccacagcaagagccagctgctggcccctcctcctccttctgcccctcctggcaacaagaccaccgtgcagcaggagcccctggagagcggggccaagaacaagagcacagagcagcagcaggccgcccctgagccagaccccagcaccatgaccccccaggagcagcagcagtactggtaccggcagcacctgctgagcctgcagcagaggaccaaggtgcacctgcccggccacaagaagggccctgtggtggccaaggacaccccagagcctgtgaaggaggaggtgacagtgcctgccaccagccaggtgcctgagagccccagcagcgaggagccccccctgcccccaccaaatgaggaggtgcccccacccctgcccccagaggagccccagagcgaggaccctgaggaggatgcccggctgaagcagctgcaggccgctgctgcccactggcagcagcaccagcagcaccgggtgggcttccagtaccagggcatcatgcagaagcacacccagctgcagcagatcctgcagcagtaccagcagatcatccagcccccaccccacatccagaccatgtctgtggacatgcagctgcggcactatgagatgcagcagcagcagttccagcacctgtaccaggagtgggagcgggagttccagctgtgggaggagcagctgcacagctacccccacaaggaccagctgcaggagtatgagaagcagtggaagacctggcagggccacatgaaggccacccagagctacctgcaggagaaggtgaacagcttccagaacatgaagaaccagtacatgggcaacatgtccatgcccccaccatttgtgccctacagccagatgcccccacccctgcccaccatgcctcctcctgtgctgccccccagcctgcccccacctgtgatgcccccagccctgcctgccaccgtgcccccacctggcatgcctcctcctgtgatgccacccagcctgcccacctctgtgcccccacctggcatgccacccagcctgagcagcgctggccccccacctgtgctgcccccacccagcctgagcagcgctggccccccacctgtgctgcccccacccagcctgagcagcacagcccctcctcctgtgatgcccctgccccccctgagcagcgccaccccacctcctggcatccccccacctggggtgccccagggcatccccccccagctgacagctgcccctgtgcccccagccagcagcagccagagcagccaggtgcctgagaagcccaggcctgccctgctgcccacccctgtgtcctttggaagtgccccacccaccacctaccacccccccctgcagagcgctggccccagcgagcaggtgaacagcaaggcccccctgagcaagagcgccctgccctacagcagcttcagcagtgaccagggcctgggggagagcagcgctgcccccagccagcccatcacagctgtgaaggacatgcctgtgcgcagcggcggcctgctgcctgacccccccaggagcagctacctggagagcccccggggccccaggtttgatggccccaggagatttgaggacctgggcagccgctgtgagggcccccggcccaagggccccaggtttgagggcaacagaccagatggcccccggcccaggtatgagggccaccctgctgagggcaccaagagcaagtggggcatgatcccccggggccctgccagccagttctacatcacccccagcaccagcctgagcccccggcagagcggcccccagtggaagggccccaagccagccttcggccagcagcaccagcagcagcccaagagccaggccgagcccctgagcggcaacaaggagcccctggccgacaccagcagcaaccagcagaagaacttcaagatgcagagcgctgccttcagcattgctgctgatgtgaaggatgtgaaggccgcccagagcaatgaaaacctgagtgacagccagcaggagccccccaagtctgaggtgtctgagggccctgtggagcccagcaactgggaccagaatgtgcagagcatggagacccagattgacaaggcccaggccgtgacccagcctgtgcccctggccaacaagcctgtgcctgcccagagcaccttccccagcaagacaggaggcatggagggcggcacagctgtggccaccagcagcctgacagctgacaatgacttcaagcctgtgggcatcggcctgccccacagcgagaacaaccaggacaagggcctgcccaggccagacaacagagacaaccggctggagggcaacagaggcaacagcagcagctaccggggccctggccagagcaggatggaggacacccgggacaagggcctggtgaacagaggccggggccaggccatcagccggggccctggcctggtgaagcaggaggacttccgggacaagatgatgggccggcgggaggacagccgggagaagatgaacagaggagagggcagccgggaccggggcctggtgcggcccggcagcagccgggagaaggtgcctgggggcctgcagggcagccaggacagaggagctgctggcagccgggagcggggccccccaagaagagctggcagccaggagcggggccccctgcggcgggccggcagccgggagcgcatccccccaagaagagctggcagccgggagcggggccccccccggggccctggcagccgggagcggggcctgggccgcagtgactttggccgggaccggggccccttccggcctgagcctggagatggaggagagaagatgtacccctaccacagagatgagcccccccgggccccctggaaccacggggaggagcggggccacgaggagttccccctggatggaagaaatgcccccatggagcgggagcggctggatgactgggaccgggagcgctactggagagaatgtgagcgggactaccaggatgacaccctggagctgtacaacagagaagatcgcttcagcgccccacccagccgcagccatgatggagaccggcggggcccctggtgggatgactgggagcgggaccaggacatggatgaggactacaaccgggagatggagcgggacatggacagagatgtggaccgcatcagccggcccatggacatgtatgacaggagcctggacaatgagtgggaccgggactatggccggcccctggatgagcaggagagccagttccgggagcgggacatccccagcctgccccccctgccccccctgccccccctgccccccctggaccgctacagagatgaccgctggagggaggagaggaaccgggagcacggctatgaccgggacttccgggacagaggagagctgcgcatccgggagtacccagagcggggggacacctggagggagaagagggactatgtgcctgacaggatggactgggagcgggagcggctgagtgaccgctggtaccccagtgatgtggacagacacagccccatggccgagcacatgcccagcagccaccacagcagcgagatgatgggcagtgatgccagcctggacagcgaccagggcctgggcggcgtgatggtgctgagccagaggcagcacgagatcatcctgaaggccgcccaggagctgaagatgctgcgggagcagaaggagcagctgcagaagatgaaggactttggaagtgagccccagatggctgaccacctgcccccccaggagagccggctgcagaacaccagcagcaggcctggcatgtacccacctcctggcagctaccggcccccaccacccatgggcaagcccccaggcagcatcgtgcggcccagcgcccccccagcccggagctctgtgcctgtgacccggccccctgtgcccatccccccacctcctcctcctccacccctgcccccacctcctcctgtgatcaagccccagaccagcgctgtggagcaggagcgctgggatgaggacagcttctacggcctgtgggacaccaatgatgagcagggcctgaacagcgagttcaagtcagaaacagctgccatccccagcgcccctgtgctgcccccacctcctgtgcacagcagcatccccccacctggccctgtgcccatgggcatgccacccatgagcaagcccccacctgtgcagcagacagtggactatggccacggccgggacatcagcaccaacaaggtggagcagatcccctacggggagcgcatcaccctgcggccagaccccctgcctgagaggagcacctttgaaacagaacatgctggccagagggacagatatgaccgggagcgggaccgggagccctactttgaccggcagagcaatgtgattgctgaccaccgggacttcaagagggaccgggagacccaccgggaccgggaccgggaccggggcgtcatcgactatgaccgggacagatttgaccgggagcggcggcccagagatgaccgggcccagagctacagagacaagaaggaccacagcagcagcagaagaggaggctttgaccggcccagctatgacaggaagagtgacaggcctgtgtatgagggccccagcatgtttggaggagagaggaggacctacccagaggagaggatgcccctgcctgcccccagcctgagccaccagcccccaccagccccccgggtggagaagaagccagagagcaagaatgtggatgacatcctgaagcccccaggccgggagagcaggcctgagagaattgtggtgatcatgaggggcctgcccggcagcggcaagacccacgtggccaagctgatccgggacaaggaggtggagtttggaggccctgccccccgggtgctgagcctggatgactacttcatcacagaggtggagaaggaggagaaggaccctgacagcggcaagaaggtgaagaagaaggtgatggagtatgaatatgaagctgagatggaggagacctaccgcacctccatgttcaagaccttcaagaagaccctggatgatggcttcttccccttcatcatcctggatgccatcaatgacagagtgcgccactttgaccagttctggagcgctgccaagaccaagggctttgaggtgtacctggccgagatgtctgctgacaaccagacctgtgggaagaggaacatccacggcaggaagctgaaggagatcaacaagatggctgaccactgggagacagcccccaggcacatgatgaggctggacatccgcagcctgctgcaggatgctgccatcgaggaggtggagatggaggactttgatgccaacatcgaggagcagaaggaggagaagaaggatgctgaggaggaggagagcgagctgggctacatccccaagagcaagtgggagatggacaccagcgaggccaagctggacaagctggatggcctgaggacaggcaccaagaggaagagggactgggaggccatcgccagcaggatggaggactacctgcagctgcctgatgattatgacacccgggccagcgagcccgggaagaagagggtgcgctgggccgacctggaggagaagaaggatgctgacaggaagagggccatcggctttgtggtgggccagacagactgggagaagatcacagatgagagcggccacctggccgagaaggccctgaacagaaccaagtacatctag

SEQ ID NO: 17477 - DNA, 5565 bp, Artificial Sequence
  Description of Artificial Sequence: Synthetic coding sequence
atgaccccccaggagcagcagcagtactggtaccggcagcacctgctgagcctgcagcagaggaccaaggtgcacctgcccggccacaagaagggccctgtggtggccaaggacaccccagagcctgtgaaggaggaggtgacagtgcctgccaccagccaggtgcctgagagccccagcagcgaggagccccccctgcccccaccaaatgaggaggtgcccccacccctgcccccagaggagccccagagtgaagatcctgaagaagatgcccggctgaagcagctgcaggccgccgccgcccactggcagcagcaccagcagcaccgggtgggcttccagtaccagggcatcatgcagaagcacacccagctgcagcagatcctgcagcagtaccagcagatcatccagcccccaccccacatccagaccatgtctgtggacatgcagctgcggcactatgagatgcagcagcagcagttccagcacctgtaccaggagtgggagcgggagttccagctgtgggaggagcagctgcacagctacccccacaaggaccagctgcaggagtatgagaagcagtggaagacctggcagggccacatgaaggccacccagagctacctgcaggagaaggtgaacagcttccagaacatgaagaaccagtacatgggcaacatgtccatgcctcctccatttgtgccctacagccagatgcccccacccctgcccaccatgcctcctcctgtgctgccccccagcctgcccccacctgtgatgcccccagccctgcctgccaccgtgcccccacctggcatgcctcctcctgtgatgccacccagcctgcccacctctgtgcccccacctggcatgccacccagcctgagcagcgctggccccccacctgtgctgcccccacccagcctgagcagcgctggccccccacctgtgctgcccccacccagcctgagcagcacagcccctcctcctgtgatgcccctgccccccctgagcagcgccaccccacctcctggcatccccccacctggggtgccccagggcatccccccccagctgacagctgcccctgtgcccccagccagcagcagccagagcagccaggtgcctgagaagcccaggcctgccctgctgcccacccctgtgtcctttggcagcgccccacccaccacctaccacccccccctgcagagcgctggccccagcgagcaggtgaacagcaaggcccccctgagcaagagcgccctgccctacagcagcttcagcagtgaccagggcctgggggagagcagcgctgcccccagccagcccatcacagctgtgaaggacatgcctgtgcgcagcggcggcctgctgcctgaccccccaagaagcagctacctggagagcccccggggccccaggtttgatggccccaggagatttgaggacctgggcagccgctgtgagggcccccggcccaagggccccaggtttgagggcaacagaccagatggcccccggcccaggtatgagggccaccctgctgagggcaccaagagcaagtggggcatgatcccccggggccctgccagccagttctacatcacccccagcaccagcctgagcccccggcagagcggcccccagtggaagggccccaagccagccttcggccagcagcaccagcagcagcccaagagccaggccgagcccctgagcggcaacaaggagcccctggccgacaccagcagcaaccagcagaagaacttcaagatgcagagcgctgccttcagcattgctgctgatgtgaaggatgtgaaggccgcccagagcaatgaaaacctgagtgacagccagcaggagccccccaagtctgaggtgtctgagggccctgtggagcccagcaactgggaccagaatgtgcagagcatggagacccagattgacaaggcccaggccgtgacccagcctgtgcccctggccaacaagcctgtgcctgcccagagcaccttccccagcaagacaggaggcatggagggcggcacagctgtggccaccagcagcctgacagctgacaatgacttcaagcctgtgggcatcggcctgccccacagcgagaacaaccaggacaagggcctgcccaggccagacaacagagacaaccggctggagggcaacagaggcaacagcagcagctaccggggccctggccagagcaggatggaggacacccgggacaagggcctggtgaacagaggccggggccaggccatcagccggggccctggcctggtgaagcaggaggacttccgggacaagatgatgggcagaagagaggacagccgggagaagatgaacagaggagagggcagccgggaccggggcctggtgcggcccggcagcagccgggagaaggtgcctgggggcctgcagggcagccaggacagaggagctgctggcagccgggagcggggccccccccggcgggccggcagccaggagcggggccccctgcggcgggccggcagccgggagcgcatccccccccggcgggccggcagccgggagcggggccccccccggggccctggcagccgggagcggggcctgggccgcagtgactttggccgggaccggggccccttccggcctgagcctggagatggaggagagaagatgtacccctaccacagagatgagcccccccgggccccctggaaccacggggaggagcggggccacgaggagttccccctggatggaagaaatgcccccatggagcgggagcggctggatgactgggaccgggagcgctactggagagaatgtgagcgggactaccaggatgacaccctggagctgtacaaccgggaggaccgcttcagcgccccacccagccgcagccatgatggagacagaagaggcccctggtgggatgactgggagcgggaccaggacatggatgaggactacaaccgggagatggagcgggacatggacagagatgtggaccgcatcagccggcccatggacatgtatgacaggagcctggacaatgagtgggaccgggactatggccggcccctggatgagcaggagagccagttccgggagcgggacatccccagcctgccccccctgccccccctgccccccctgccccccctggaccgctacagagatgaccgctggagggaggagaggaaccgggagcacggctatgaccgggacttccgggacagaggagagctgcgcatccgggagtacccagagcggggggacacctggagggagaagagggactatgtgcctgacaggatggactgggagcgggagcggctgagtgaccgctggtaccccagtgatgtggacagacacagccccatggccgagcacatgcccagcagccaccacagcagcgagatgatgggcagtgatgccagcctggacagcgaccagggcctgggcggcgtgatggtgctgagccagaggcagcacgagatcatcctgaaggccgcccaggagctgaagatgctgcgggagcagaaggagcagctgcagaagatgaaggactttggcagcgagccccagatggctgaccacctgcccccccaggagagccggctgcagaacaccagcagccggcccggcatgtacccacctcctggcagctacagacctcctccacccatgggcaagcccccaggcagcatcgtgcggcccagcgcccccccagcccggagctctgtgcctgtgaccaggcctcctgtgcccatccccccacctcctcctcctccacccctgcccccacctcctcctgtgatcaagccccagaccagcgctgtggagcaggagcgctgggatgaagattccttctacggcctgtgggacaccaatgatgagcagggcctgaacagcgagttcaagtcagaaacagctgccatccccagcgcccctgtgctgcccccacctcctgtgcacagcagcatccccccacctggccctgtgcccatgggcatgccacccatgagcaagcccccacctgtgcagcagacagtggactatggccacggccgggacatcagcaccaacaaggtggagcagatcccctatggagagcgcatcaccctgcggccagaccccctgcctgagaggagcacctttgaaacagagcacgccggccagagggacagatatgaccgggagcgggaccgggagccctactttgaccggcagagcaatgtgattgctgaccaccgggacttcaagagggaccgggagacccaccgggaccgggaccgggacagaggagtgattgattatgaccgggacagatttgaccgggagcggcggcccagagatgaccgggcccagagctacagagacaagaaggaccacagcagcagccggcggggcggctttgaccggcccagctatgacaggaagagtgacaggcctgtgtatgagggccccagcatgtttggaggagagaggaggacctacccagaggagaggatgcccctgcctgcccccagcctgagccaccagcccccaccagccccccgggtggagaagaagccagagagcaagaatgtggatgacatcctgaagcccccaggccgggagagcaggcctgagcgcatcgtggtgatcatgaggggcctgcccggcagcggcaagacccacgtggccaagctgatccgggacaaggaggtggagtttggaggccctgccccccgggtgctgagcctggatgactacttcatcacagaggtggagaaggaggagaaggaccctgattctgggaagaaggtgaagaagaaggtgatggagtatgaatatgaggccgagatggaggagacctaccgcacctccatgttcaagaccttcaagaagaccctggatgatggcttcttccccttcatcatcctggatgccatcaatgacagagtgcgccactttgaccagttctggagcgctgccaagaccaagggctttgaggtgtacctggccgagatgtctgctgacaaccagacctgtgggaagaggaacatccacggcaggaagctgaaggagatcaacaagatggctgaccactgggagacagcccccaggcacatgatgaggctggacatccgcagcctgctgcaggatgctgccatcgaggaggtggagatggaggactttgatgccaacatcgaggagcagaaggaggagaagaaggatgctgaggaggaggagagcgagctgggctacatccccaagagcaagtgggagatggacaccagcgaggccaagctggacaagctggatggcctgaggacaggcaccaagaggaagagggactgggaggccatcgccagcaggatggaggactacctgcagctgcctgatgattatgacacccgggccagcgagcccccccggcccaggggggccagcctgtgtgtgaccctgctgccccgcttcagcagctgctttgtgtccacagccctggtgttcttcaaggtgctgcagtgcccccaggaggtgctggagagctgctgcacccaggcccggaggtag

SEQ ID NO: 17478 - DNA, 2184 bp, Artificial Sequence
  Description of Artificial Sequence: Synthetic coding sequence
atggctgctgacagccgggaggagaaggatggagagctgaatgtgctggatgacatcctgacagaggtgcctgagcaggatgatgagctgtacaaccctgagagcgagcaggacaagaatgagaagaagggcagcaagaggaagagtgacaggatggagagcacagacaccaagaggcagaagcccagcgtgcacagccggcagctggtgtccaagcccctgagcagctctgtgagcaacaacaagagaattgtgtccaccaagggcaagagcgccacagagtacaagaatgaggagtaccagaggagtgaaagaaacaagaggctggatgctgacaggaagatccggctgagcagcagcgccagccgggagccctacaagaaccagcctgagaagacctgtgtgaggaagagggaccctgagcggcgggccaagagccccaccccagatggcagcgagagaattggcctggaggtggacagaagagccagccgcagcagccagagcagcaaggaggaggtgaacagcgaggagtatggcagtgaccatgaaacaggcagcagcggcagcagtgatgagcagggcaacaacacagaaaatgaggaggagggcgtggaggaggatgtggaggaggatgaggaggtggaggaggatgctgaagaagatgaggaggtggatgaagatggagaggaggaggaggaggaggaggaggaggaggaggaggaggaggaggaggaggaggaggagtatgagcaggatgagcgggaccagaaggaggagggcaatgactatgacaccaggtctgaggccagtgacagcggcagcgagagcgtgtccttcacagatggctctgtgcgcagcggcagcggcacagatggcagtgatgagaagaagaaggagaggaagagggcccggggcatcagccccatcgtgtttgacagaagtggcagcagcgccagcgagagctatgccggcagcgagaagaagcatgagaagctgagcagctctgtgcgggctgtgaggaaggaccagaccagcaagctgaagtatgtgctgcaggatgcccgcttcttcctgatcaagagcaacaaccatgaaaatgtgtccctggccaaggccaagggcgtgtggagcaccctgcctgtgaatgagaagaagctgaacctggccttccgcagcgcccggagcgtcatcctgatcttctctgtgcgggagagcggcaagttccagggctttgcccggctgagcagcgagagccaccacggcggcagccccatccactgggtgctgcctgctggcatgtctgccaagatgctgggcggcgtcttcaagattgactggatctgccggcgggagctgcccttcaccaagagcgcccacctgaccaacccctggaatgagcacaagcctgtgaagattggaagagatggccaggagattgagctggagtgtggcacccagctgtgcctgctcttccccccagatgagagcattgacctgtaccaggtgatccacaagatgaggcacaagaggaggatgcacagccagcccaggagccggggccggcccagcagaagagagcctgtgagagatgtgggcagaagaagacctgaggactatgacatccacaacagcaggaagaagcccagaattgactacccacctgagttccaccagaggcctggctacctgaaggacccccgctaccaggaggtggaccggcgcttctctggagtgagaagagatgtgttcctgaatggcagctacaatgactatgtgcgggagttccacaacatgggccccccaccaccctggcagggcatgccaccctacccaggcatggagcagcccccccaccacccctactaccagcaccacgcccccccaccccaggcccaccccccctacagcggccaccaccctgtgccccatgaggcccgctacagagacaagagggtgcatgactatgacatgagggtggatgacttcctgcggaggacccaggccgtggtgtctggccgccgcagccggccccgggagcgggaccgggagcgggagcgggaccggccccgggacaacagaagagaccgggagcgggaccggggccgggaccgggagcgggagcgggagcggctgtgtgaccgggaccgggacagaggagagcggggccgctacagaagatag

SEQ ID NO: 17479 - DNA, 2130 bp, Artificial Sequence
  Description of Artificial Sequence: Synthetic coding sequence
atggctgctgacagccgggaggagaaggatggagagctgaatgtgctggatgacatcctgacagaggtgcctgagcaggatgatgagctgtacaaccctgagagcgagcaggacaagaatgagaagaagggcagcaagaggaagagtgacaggatggagagcacagacaccaagaggcagaagcccagcgtgcacagccggcagctggtgtccaagcccctgagcagctctgtgagcaacaacaagagaattgtgtccaccaagggcaagagcgccacagagtacaagaatgaggagtaccagaggagtgaaagaaacaagaggctggatgctgacaggaagatccggctgagcagcagcgccagccgggagccctacaagaaccagcctgagaagacctgtgtgaggaagagggaccctgagcggcgggccaagagccccaccccagatggcagcgagagaattggcctggaggtggacagaagagccagccgcagcagccagagcagcaaggaggaggtgaacagcgaggagtatggcagtgaccatgaaacaggcagcagcggcagcagtgatgagcagggcaacaacacagaaaatgaggaggagggcgtggaggaggatgtggaggaggatgaggaggtggaggaggatgctgaagaagatgaggaggtggatgaagatggagaggaggaggaggaggaggaggaggaggaggaggaggaggaggaggaggaggaggaggagtatgagcaggatgagcgggaccagaaggaggagggcaatgactatgacaccaggtctgaggccagtgacagcggcagcgagagcgtgtccttcacagatggctctgtgcgcagcggcagcggcacagatggcagtgatgagaagaagaaggagaggaagagggcccggggcatcagccccatcgtgtttgacagaagtggcagcagcgccagcgagagctatgctgaccagaccagcaagctgaagtatgtgctgcaggatgcccgcttcttcctgatcaagagcaacaaccatgaaaatgtgtccctggccaaggccaagggcgtgtggagcaccctgcctgtgaatgagaagaagctgaacctggccttccgcagcgcccggagcgtcatcctgatcttctctgtgcgggagagcggcaagttccagggctttgcccggctgagcagcgagagccaccacggcggcagccccatccactgggtgctgcctgctggcatgtctgccaagatgctgggcggcgtcttcaagattgactggatctgccggcgggagctgcccttcaccaagagcgcccacctgaccaacccctggaatgagcacaagcctgtgaagattggaagagatggccaggagattgagctggagtgtggcacccagctgtgcctgctcttccccccagatgagagcattgacctgtaccaggtgatccacaagatgaggcacaagaggaggatgcacagccagcccaggagccggggccggcccagcagaagagagcctgtgagagatgtgggcagaagaagacctgaggactatgacatccacaacagcaggaagaagcccagaattgactacccacctgagttccaccagaggcctggctacctgaaggacccccgctaccaggaggtggaccggcgcttctctggagtgagaagagatgtgttcctgaatggcagctacaatgactatgtgcgggagttccacaacatgggccccccaccaccctggcagggcatgccaccctacccaggcatggagcagcccccccaccacccctactaccagcaccacgcccccccaccccaggcccaccccccctacagcggccaccaccctgtgccccatgaggcccgctacagagacaagagggtgcatgactatgacatgagggtggatgacttcctgcggaggacccaggccgtggtgtctggccgccgcagccggccccgggagcgggaccgggagcgggagcgggaccggccccgggacaacagaagagaccgggagcgggaccggggccgggaccgggagcgggagcgggagcggctgtgtgaccgggaccgggacagaggagagcggggccgctacagaagatag

SEQ ID NO: 17480 - DNA, 2130 bp, Artificial Sequence; identical to SEQ ID NO: 17479
  Description of Artificial Sequence: Synthetic coding sequence

SEQ ID NO: 17481 - DNA, 2184 bp, Artificial Sequence; identical to SEQ ID NO: 17478
  Description of Artificial Sequence: Synthetic coding sequence

SEQ ID NO: 17482 - DNA, 1992 bp, Artificial Sequence
  Description of Artificial Sequence: Synthetic coding sequence
atgttcctgaaggccggccggggcaacaaggtgccccctgtgcgggtgtatggccctgactgtgtggtgctgatggagccccccctgagcaagaggaaccccccagccctgcggctggccgacctggccacagcccaggtgcagcccctgcagaacatgacaggcttccctgccctggccggccccccagcccacagccagctgcgggctgctgtggcccacctgcggctgcgggacctgggcgctgaccccggggtggccaccacccccctgggccctgagcacatggcccaggccagcaccctgggcctgagcccccccagccaggccttccctgcccaccctgaggccccagctgctgctgcccgggctgctgccctggtggcccaccctggagctggcagctacccctgtggcggcggcagcagcggggcccagcccagcgcccctcctcctccagccccacccctgccccccacccccagccccccacctcctcctcctcctcctcctcctccagccctgagcggctacaccaccaccaacagcggcggcggcggcagcagcggcaagggccacagccgggactttgtgctgcggcgggacctgagcgccacagccccagctgctgccatgcatggagcccccctgggcggggagcagaggtctggaacaggcagcccccagcacccagcccccccaccccacagcgctggcatgttcatcagcgccagcggcacctacgccggcccagatggcagcggcggccctgccctcttccctgccctgcatgacacccctggggcccctgggggccacccccaccccctgaatggccagatgaggctgggcctggccgctgctgctgctgctgctgctgctgagctgtatggccgggcagagcccccatttgcccccaggtctggagatgcccactatggagctgtggccgctgctgctgctgctgccctgcacggctatggagctgtgaacctgaacctgaacctggccgctgctgctgctgctgctgctgctggccctggcccccacctgcagcaccacgcccctcctccagcccctcctcctcctccagccccagcccagcacccccaccagcaccacccccacctgcccggggctgctggggccttcctgcgctacatgaggcagcccatcaagcaggagctgatctgcaagtggattgatcctgatgagctggccggcctgcccccacctcctcctcctcctcctcctcctcctcctcctcctcctgctggaggagccaagccctgcagcaagaccttcggcaccatgcatgagctggtgaaccacgtgacagtggagcacgtgggcggccctgagcagagcagccacgtgtgcttctgggaggactgcccccgggagggcaagcccttcaaggccaagtacaagctgatcaaccacatccgggtgcacactggagagaagcccttcccctgccccttccctggctgtgggaaggtgtttgcccggtctgagaacctgaagatccacaagaggacccacactggagagaagcccttcaagtgtgaatttgatggctgtgacaggaagtttgccaacagcagtgacaggaagaagcacagccacgtgcacaccagtgacaagccctactactgcaagatccggggctgtgacaagagctacacccaccccagcagcctgaggaagcacatgaagatccactgcaagagccccccacccagccctggccccctgggctacagctctgtgggcacccctgtgggcgcccccctgagccctgtgctggaccctgcccggagccacagcagcaccctgagcccccaggtgaccaacctgaatgagtggtacgtgtgccaggccagcggggcccccagccacctgcacacccccagcagcaatggcaccaccagcgagacagaagatgaggagatctacggcaaccctgaggtggtgaggaccatccactag

SEQ ID NO: 17483 - DNA, 654 bp, Artificial Sequence
  Description of Artificial Sequence: Synthetic coding sequence
gctgctgctgccctgcacggctacggggctgtgaacctgaacctgaacctggccgctgctgctgctgctgcccacccccaccagcaccacccccacctgcccggggctgctggggccttcctgcgctacatgaggcagcccatcaagcaggagctgatctgcaagtggattgatcctgatgagctggccggccgggccaagccctgcagcaagaccttcggcaccatgcatgagctggtgaaccacgtgacagtggagcacgtgggcggccctgagcagagcagccacgtgtgcttctgggaggactgcccccgggagggcaagcccttcaaggccaagtacaagctgatcaaccacatccgggtgcacactggagagaagcccttcccctgccccttccctggctgtgggaaggtgtttgcccggtctgagaacctgaagatccacaagaggacccacactggagagaagcccttcaagtgtgaatttgatggctgtgacaggaagtttgccaacagcagtgacaggaagaagcacagccacgtgcacaccagtgacaagccctactactgcaagatccggggctgtgacaagagctacacccaccccagcagcctgaggaagcacatgaagatccactgcaagagcccctag

SEQ ID NO: 17484 - DNA, 3696 bp, Artificial Sequence
  Description of Artificial Sequence: Synthetic coding sequence
atgtgcaagtgctgcaacctcttcagccccaaccagagcgagctgctgagccacgtgtctgagaagcacatggaggagggcgtgaatgtggatgagatcatcatccccctgcggcccctgagcaccccagagccccccaacagcagcaagacaggagatgagttcctggtgatgaagaggaagaggggccggcccaagggcagcaccaagaagagcagcacagaggaggagctggccgagaacatcgtgagccccacagaggacagccccctggcccctgaggagggcaacagcctgccccccagcagcctggagtgcagcaagtgctgcaggaagttcagcaacacccggcagctgaggaagcacatctgcatcatcgtgctgaacctgggggaggaggagggggaggccggaaatgaaagtgacctggagctggagaagaagtgcaaggaggatgaccgggagaaggccagcaagaggcccaggagccagaagacagagaaggtgcagaagatcagcggcaaggaggcccggcagctgagcggggccaagaagcccatcatctctgtggtgctgacagcccacgaggccatccctggggccaccaagatcgtgcctgtggaggccggccccccagagaccggggccaccaacagcgagaccaccagcgctgacctggtgccccggcggggctaccaggagtatgccatccagcagaccccctatgagcagcccatgaagagcagccggctgggccccacccagctgaagatcttcacctgtgagtactgcaacaaggtgttcaagttcaagcacagcctgcaggcccacctgcgcatccacaccaatgagaagccctacaagtgcccccagtgcagctatgccagcgccatcaaggccaacctgaatgtgcacctgaggaagcacactggagagaagtttgcctgtgactactgcagcttcacctgcctgagcaagggccacctgaaggtgcacatcgagcgggtgcacaagaagatcaagcagcactgccgcttctgcaagaagaagtacagtgatgtgaagaacctgatcaagcacatcagagatgcccatgacccccaggacaagaaggtgaaggaggccctggatgagctgtgcctgatgacccgggagggcaagaggcagctgctgtatgactgccacatctgtgagaggaagttcaagaatgagctggaccgggacagacacatgctggtgcacggggacaagtggccctttgcctgtgagctgtgtggccatggagccaccaagtaccaggccctggagctgcacgtgaggaagcacccctttgtgtatgtgtgtgctgtgtgcaggaagaagtttgtgagcagcatccggctgcggacccacatcaaggaggtgcatggagctgcccaggaggccctggtgttcaccagcagcatcaaccagagcttctgcctgctggagcctggaggagacatccagcaggaggccctgggggaccagctgcagctggtggaggaggagtttgccctgcagggcgtgaatgccctgaaggaggaggcctgccctggggacacccagctggaggagggcaggaaggagcctgaggcccctggagagatgcctgccccagctgtgcacctggccagcccccaggccgagagcacagccctgcccccctgtgagctggagaccaccgtggtgagcagcagtgacctgcacagccaggaggtggtgtctgatgacttcctgctgaagaatgacaccagcagcgctgaggcccacgccgcccctgagaagcccccagacatgcagcacaggagctctgtgcagacccagggcgaggtgatcaccctgctgctgagcaaggcccagagcgctggcagtgaccaggagagccacggggcccagagccccctgggggagggccagaacatggctgtgctgtctgctggggaccctgaccccagccgctgcctgcggagcaacccagctgaggccagtgacctgctgccccctgtggccggcggcggggacaccatcacccaccagcctgacagctgcaaggccgcccctgagcacaggagcggcatcacagccttcatgaaggtgctgaacagcctgcagaagaagcagatgaacaccagcctgtgtgagcgcatcaggaaggtgtatggagacctggagtgtgagtactgcggcaagctgttctggtaccaggtgcactttgacatgcacgtgaggacccacacccgggagcacctgtactactgcagccagtgccactacagcagcatcaccaagaactgcctgaagagacatgtgatccagaagcacagcaacatcctgctgaagtgccccacagatggctgtgactacagcaccccagacaagtacaagctgcaggcccacctgaaggtgcacacagccctggacaagaggagctacagctgccctgtgtgtgagaagagcttctctgaagatagactcatcaagagccacatcaagaccaaccaccctgaggtgtccatgagcaccatcagcgaggtgctgggcagaagagtgcagctgaagggcctgattggcaagagggccatgaagtgcccctactgtgacttctacttcatgaagaatggaagtgacctgcagaggcacatctgggcccatgaaggagtgaagcccttcaagtgcagcctgtgtgaatatgccaccaggagcaagagcaacctgaaggcccacatgaacagacacagcacagagaagacccacctgtgtgacatgtgtgggaagaagttcaagagcaagggcaccctgaagagccacaagctgctgcacacagcagatggcaagcagttcaagtgcaccgtgtgtgactacacagctgcccagaagccccagctgctgcggcacatggagcagcacgtgtccttcaagcccttccgctgtgcccactgccactacagctgcaacatcagcggcagcctgaagaggcactacaacaggaagcaccccaatgaggagtatgccaacgtgggcactggagagctggccgctgaggtgctgatccagcagggcggcctgaagtgccctgtgtgcagctttgtgtatggcaccaagtgggagttcaacagacacctgaagaacaagcacggcctgaaggtggtggagattgatggagaccccaagtgggagacagccacagaggcccctgaggagcccagcacccagtacctgcacatcacagaagcagaagaagatgtgcagggcacccaggccgctgtggccgccctgcaggacctgcgctacaccagcgagagcggggaccggctggaccccacagctgtgaacatcctgcagcagatcatcgagctgggcgctgagacccatgatgccacagccctggcctctgtggtggccatggcccctggcaccgtgacagtggtgaagcaggtgacagaggaggagcccagcagcaaccacacagtgatgatccaggagaccgtgcagcaggcctctgtggagctggccgagcagcaccacctggtggtgtccagtgatgatgtggagggcattgaaacagtgacagtgtacacccagggcggggaggccagcgagttcatcgtgtatgtgcaggaggccatgcagcctgtggaggagcaggccgtggagcagcctgcccaggagctgtag

SEQ ID NO: 17485 - DNA, 1935 bp, Artificial Sequence
  Description of Artificial Sequence: Synthetic coding sequence
atggccaagcccagccacagcagctatgtgctgcagcagctgaacaaccagcgggagtggggcttcctgtgtgactgctgcatcgccattgatgacatctacttccaggcccacaaggctgtgctggccgcctgcagcagctacttcaggatgttcttcatgaaccaccagcacagcacagcccagctgaacctgagcaacatgaagatctctgcagaatgttttgacctgatcctgcagttcatgtacctgggcaagatcatgacagcccccagcagctttgagcagttcaaggtggccatgaactacctgcagctgtacaacgtgcctgactgcctggaggacatccaggatgctgactgcagcagcagcaagtgcagcagcagcgccagcagcaagcagaacagcaagatgatcttcggcgtgaggatgtatgaggacacagtggccagaaatggaaatgaggccaaccgctggtgtgccgagcccagcagcacagtgaacaccccccacaaccgggaggctgatgaggagagcctgcagctgggcaacttccctgagcccctgtttgatgtgtgcaagaagagctctgtgtccaagctgagcacccccaaggagcgggtgagccgccgcttcggccgctccttcacctgtgacagctgtggcttcggcttcagctgtgagaagctgctggatgagcacgtgctgacctgcaccaacagacacctgtaccagaacaccaggagctaccacagaattgtggacatcagagatggcaaggacagcaacatcaaggccgagtttggagagaaggacagcagcaagaccttcagcgcccagacagacaagtacagaggagacaccagccaggccgcagatgattctgccagcaccaccggcagcaggaagagcagcacagtggagagcgagatcgccagcgaggagaagagcagagctgctgagaggaagaggatcatcatcaagatggagcctgaggacatccccacagatgagctgaaggacttcaacatcatcaaggtgacagacaaggactgcaatgaaagcacagacaatgatgagctggaggatgagcctgaggagcccttctaccgctactacgtggaggaggatgtgtccatcaagaagagcggcaggaagaccctgaagcccaggatgtctgtgtctgcagatgagcggggcggcctggagaacatgaggcctcccaacaacagcagccctgtgcaggaggatgctgaaaatgccagctgtgagctgtgtggcctgaccatcacagaggaggacctgagcagccactacctggccaagcacatcgagaacatctgtgcctgtgggaaatgtggccagatcctggtgaagggccggcagctgcaggagcacgcccagagatgtggggagccccaggacctgaccatgaatggcctgggcaacacagaggagaagatggacctggaggagaacccagatgagcagagcgagatccgggacatgtttgtggagatgctggatgacttccgggacaaccactaccagatcaacagcatccagaagaagcagctgttcaagcacagcgcctgccccttccgctgccccaactgtggccagagatttgaaacagagaacctggtggtggagcacatgagcagctgcctggaccaggacatgttcaagagcgccatcatggaggagaatgaaagagaccacaggaggaagcacttctgcaacctgtgtgggaagggcttctaccagcgctgccacctgcgggagcactacacagtgcacaccaaggagaagcagtttgtgtgccagacctgtgggaagcagttcctgcgggagcggcagctgcggctgcacaatgacatgcacaagggcatggccagcggggagatcggccccagcaagcctgtggagaagtag

SEQ ID NO: 17486 - DNA, 2142 bp, Artificial Sequence
  Description of Artificial Sequence: Synthetic coding sequence
atggccaagcccagccacagcagctatgtgctgcagcagctgaacaaccagcgggagtggggcttcctgtgtgactgctgcatcgccattgatgacatctacttccaggcccacaaggctgtgctggccgcctgcagcagctacttcaggatgttcttcatgaaccaccagcacagcacagcccagctgaacctgagcaacatgaagatctctgcagaatgttttgacctgatcctgcagttcatgtacctgggcaagatcatgacagcccccagcagctttgagcagttcaaggtggccatgaactacctgcagctgtacaacgtgcctgactgcctggaggacatccaggatgctgactgcagcagcagcaagtgcagcagcagcgccagcagcaagcagaacagcaagatgatcttcggcgtgaggatgtatgaggacacagtggccagaaatggaaatgaggccaaccgctggtgtgccgagcccagcagcacagtgaacaccccccacaaccgggaggctgatgaggagagcctgcagctgggcaacttccctgagcccctgtttgatgtgtgcaagaagagctctgtgtccaagctgagcacccccaaggagcgggtgagccgccgcttcggccgctccttcacctgtgacagctgtggcttcggcttcagctgtgagaagctgctggatgagcacgtgctgacctgcaccaacagacacctgtaccagaacaccaggagctaccacagaattgtggacatcagagatggcaaggacagcaacatcaaggccgagtttggagagaaggacagcagcaagaccttcagcgcccagacagacaagtacagaggagacaccagccaggccgcagatgattctgccagcaccaccggcagcaggaagagcagcacagtggagagcgagatcgccagcgaggagaagagcagagctgctgagaggaagaggatcatcatcaagatggagcctgaggacatccccacagatgagctgaaggacttcaacatcatcaaggtgacagacaaggactgcaatgaaagcacagacaatgatgagctggaggatgagcctgaggagcccttctaccgctactacgtggaggaggatgtgtccatcaagaagagcggcaggaagaccctgaagcccaggatgtctgtgtctgcagatgagcggggcggcctggagaacatgaggcctcccaacaacagcagccctgtgcaggaggatgctgaaaatgccagctgtgagctgtgtggcctgaccatcacagaggaggacctgagcagccactacctggccaagcacatcgagaacatctgtgcctgtgggaaatgtggccagatcctggtgaagggccggcagctgcaggagcacgcccagagatgtggggagccccaggacctgaccatgaatggcctgggcaacacagaggagaagatggacctggaggagaacccagatgagcagagcgagatccgggacatgtttgtggagatgctggatgacttccgggacaaccactaccagatcaacagcatccagaagaagcagctgttcaagcacagcgcctgccccttccgctgccccaactgtggccagagatttgaaacagagaacctggtggtggagcacatgagcagctgcctggaccaggacatgttcaagagcgccatcatggaggagaatgaaagagaccacaggaggaagcacttctgcaacctgtgtgggaagggcttctaccagcgctgccacctgcgggagcactacacagtgcacaccaaggagaagcagtttgtgtgccagacctgtgggaagcagttcctgcgggagcggcagctgcggctgcacaatgacatgcacaagggcatggcccgctacgtgtgcagcatctgtgaccagggcaacttcaggaagcatgaccacgtgcgccacatgatcagccacctgtctgctggggagaccatctgccaggtgtgcttccagatcttccccaacaatgagcagctggagcagcacatggatgtgcacctgtacacctgtggcatctgtggggccaagttcaacctgaggaaggacatgaggagccactacaatgccaagcacctgaagaggacatag

SEQ ID NO: 17487 - DNA, 468 bp, Artificial Sequence
  Description of Artificial Sequence: Synthetic coding sequence
atggccaagcccagccacagcagctatgtgctgcagcagctgaacaaccagcgggagtggggcttcctgtgtgactgctgcatcgccattgatgacatctacttccaggcccacaaggctgtgctggccgcctgcagcagctacttcaggatgttcttcatgaaccaccagcacagcacagcccagctgaacctgagcaacatgaagatctctgcagaatgttttgacctgatcctgcagttcatgtacctgggcaagatcatgacagcccccagcagctttgagcagttcaaggtggccatgaactacctgcagctgtacaacgtgcctgactgcctggaggacatccaggatgctgactgcagcagcagcaagtgcagcagcagcgccagcagcaagcagaacagcaagatgatcttcggcgtgaggatgtatgaggacacagtggccagaaatggaaatgaatag

SEQ ID NO: 17488 - DNA, 2142 bp, Artificial Sequence; identical to SEQ ID NO: 17486
  Description of Artificial Sequence: Synthetic coding sequence

SEQ ID NO: 17489 - DNA, 105 bp, Artificial Sequence
  Description of Artificial Sequence: Synthetic coding sequence
atggccaagcccagccacagcagctatgtgctgcagcagctgaacaaccagcgggagtggggcttcctgtgtgactgctgcatcgccattgatgacatctactag

SEQ ID NO: 17490 - DNA, 393 bp, Artificial Sequence
  Description of Artificial Sequence: Synthetic coding sequence
atggccaagcccagccacagcagctatgtgctgcagcagctgaacaaccagcgggagtggggcttcctgtgtgactgctgcatcgccattgatgacatctacttccaggcccacaaggctgtgctggccgcctgcagcagctacttcaggatgttcttcatgaaccaccagcacagcacagcccagctgaacctgagcaacatgaagatctctgcagaatgttttgacctgatcctgcagttcatgtacctgggcaagatcatgacagcccccagcagctttgagcagttcaaggtggccatgaactacctgcagctgtacaacgtgcctgactgcctggaggacatccaggatgctgactgcagcagcagcaagtgcagcagcagcgcctag

SEQ ID NO: 17491 - DNA, 1740 bp, Artificial Sequence
  Description of Artificial Sequence: Synthetic coding sequence
atgacccggctggagaggagcagccacaggacagtcatctgcaaggtgcctggagagctggtggcccgggagggcaaatgtgccagccgggcccgggagagcgagatccccagcgaggagggctactgtgacttcaacagccggcccaatgaaaattcctactgctaccagctgctgcggcagctgaatgagcagaggaagaagggcatcctgtgtgatgtgtccatcgtggtgtctgggaagatcttcaaggcccacaagaacatcctggtggccggcagccgcttcttcaagaccctgtactgcttcagcaacaaggagagccccaaccagaacaacaccacccacctggacattgctgctgtgcagggcttcagcgtcatcctggacttcctgtacagcggcaacctggtgctgaccagccagaatgccatcgaggtgatgacagtggccagctacctgcagatgtctgaggtggtgcagacctgcaggaacttcatcaaggatgccctgaacatcagcatcaagtctgaggcccctgagagcgtggtggtggactacaacaacaggaagcctgtgaacagagatggcctgagcagcagccgggaccagaagatcgccagcttctgggccaccaggaacctgaccaacctggccagcaatgtgaagattgaaaatgatggctgcaatgtggatgagggccagatcgagaactaccagatgaatgacagctcctgggtgcaggacggcagccctgagatggccgagaatgaaagtgagggccagaccaaggtgttcatctggaacaacatgggcagccagggcatccaggagaccgggaagaccaggaggaagaaccagaccaccaagcgcttcatctacaacatcccccccaacaatgagaccaacctggaggactgcagcgtgatgcagccccctgtggcctacccagaggagaacaccctgctgatcaaggaggagccagacctggatggagccctgctgagcggcccagatggagacagaaatgtgaatgccaacctgctggccgaggccggcaccagccaggatggaggagatgctggcaccagccatgacttcaagtatggcctgatgcctggccccagcaatgacttcaagtatggcctcatccctggcaccagcaatgacttcaagtatggcctcatccctggggccagcaatgacttcaagtatggcctgctgcctgagagctggcccaagcaggagacctgggagaatggagagagcagcctcatcatgaacaagctgaagtgcccccactgcagctatgtggccaagtacagaaggaccctgaagaggcacctgctgatccacactggagtgcgctccttcagctgtgacatctgtgggaagctgttcacccggcgggagcacgtgaagaggcacagcctggtgcacaagaaggacaagaagtacaagtgcatggtgtgcaagaagatcttcatgctggccgcctctgtgggcatcagacatggcagccgccgctatggagtgtgtgtggactgtgccgacaagagccagcccggcggccaggagggcgtggaccagggccaggacacagagttccccagagatgaggagtatgaggagaatgaggtgggggaggctgatgaggagctggtggatgatggagaggaccagaatgaccccagccgctgggatgagagcggggaggtgtgcatgagcctggatgactag

SEQ ID NO: 17492 - DNA, 2616 bp, Artificial Sequence
  Description of Artificial Sequence: Synthetic coding sequence
atgtccttcagcgagatgaacagaaggaccctggccttccggggcggcggcctggtgacagccagcggcggcggcagcaccaacaacaatgccggcggggaggccagcgcctggccaccccagccccagccccggcagcccccacctccagcccccccagccctgcagcccccaaatggaagaggagcagatgaggaggtggagctggagggcctggagccccaggacctggaggccagcgctggccctgctgctggagctgctgaggaggccaaggagctgctgctgccccaggatgctgggggccccaccagcctgggcggcggggccggcggccccctgctggccgagaggaacagaaggaccctggccttccggggcggcggcggcggcggcctgggcaacaacggcagcagccggggccggcctgagacctctgtgtggcccctgcggcacttcaacggccggggccctgccaccgtggacctggagctggatgccctggagggcaaggagctgatgcaggatggagccagcctgagtgacagcacagaagatgaggaggagggcgccagcctgggagatggcagcggggctgagggcggcagctgcagcagcagccgccgctctggaggagatggaggagatgaggtggagggcagcggcgtgggcgctggggagggggagaccgtgcagcacttccccctggcccggcccaagagcctgatgcagaagctgcagtgcagcttccagacctcctggctgaaggacttcccctggctgcgctacagcaaggacaccggcctgatgagctgtggctggtgccagaagaccccagcagatggcggctctgtggacctgccccctgtgggccatgatgagctgagccggggcaccaggaactacaagaagaccctgctgctgcggcaccacgtgtccacagagcacaagctgcacgaggccaatgcccaggagagcgagatccccagcgaggagggctactgtgacttcaacagccggcccaatgaaaattcctactgctaccagctgctgcggcagctgaatgagcagaggaagaagggcatcctgtgtgatgtgtccatcgtggtgtctgggaagatcttcaaggcccacaagaacatcctggtggccggcagccgcttcttcaagaccctgtactgcttcagcaacaaggagagccccaaccagaacaacaccacccacctggacattgctgctgtgcagggcttcagcgtcatcctggacttcctgtacagcggcaacctggtgctgaccagccagaatgccatcgaggtgatgacagtggccagctacctgcagatgtctgaggtggtgcagacctgcaggaacttcatcaaggatgccctgaacatcagcatcaagtctgaggcccctgagagcgtggtggtggactacaacaacaggaagcctgtgaacagagatggcctgagcagcagccgggaccagaagatcgccagcttctgggccaccaggaacctgaccaacctggccagcaatgtgaagattgaaaatgatggctgcaatgtggatgagggccagatcgagaactaccagatgaatgacagctcctgggtgcaggacggcagccctgagatggccgagaatgaaagtgagggccagaccaaggtgttcatctggaacaacatgggcagccagggcatccaggagaccgggaagaccaggaggaagaaccagaccaccaagcgcttcatctacaacatcccccccaacaatgagaccaacctggaggactgcagcgtgatgcagccccctgtggcctacccagaggagaacaccctgctgatcaaggaggagccagacctggatggagccctgctgagcggcccagatggagacagaaatgtgaatgccaacctgctggccgaggccggcaccagccaggatggaggagatgctggcaccagccatgacttcaagtatggcctgatgcctggccccagcaatgacttcaagtatggcctcatccctggcaccagcaatgacttcaagtatggcctcatccctggggccagcaatgacttcaagtatggcctgctgcctgagagctggcccaagcaggagacctgggagaatggagagagcagcctcatcatgaacaagctgaagtgcccccactgcagctatgtggccaagtacagaaggaccctgaagaggcacctgctgatccacactggagtgcgctccttcagctgtgacatctgtgggaagctgttcacccggcgggagcacgtgaagaggcacagcctggtgcacaagaaggacaagaagtacaagtgcatggtgtgcaagaagatcttcatgctggccgcctctgtgggcatcagacatggcagccgccgctatggagtgtgtgtggactgtgccgacaagagccagcccggcggccaggagggcgtggaccagggccaggacacagagttccccagagatgaggagtatgaggagaatgaggtgggggaggctgatgaggagctggtggatgatggagaggaccagaatgaccccagccgctgggatgagagcggggaggtgtgcatgagcctggatgactag

SEQ ID NO: 17493 - DNA, 2616 bp, Artificial Sequence; identical to SEQ ID NO: 17492
  Description of Artificial Sequence: Synthetic coding sequence

SEQ ID NO: 17494 - DNA, 2544 bp, Artificial Sequence
  Description of Artificial Sequence: Synthetic coding sequence
atgtccttcagcgagatgaacagaaggaccctggccttccggggcggcggcctggtgacagccagcggcggcggcagcaccaacaacaatgccggcggggaggccagcgcctggccaccccagccccagccccggcagcccccacctccagcccccccagccctgcagcccccaaatggaagaggagcagatgaggaggtggagctggagggcctggagccccaggacctggaggccagcgctggccctgctgctggagctgctgaggaggccaaggagctgctgctgccccaggatgctgggggccccaccagcctgggcggcggggccggcggccccctgctggccgagaggaacagaaggaccctggccttccggggcggcggcggcggcggcctgggcaacaacggcagcagccggggccggcctgagacctctgtgtggcccctgcggcacttcaacggccggggccctgccaccgtggacctggagctggatgccctggagggcaaggagctgatgcaggatggagccagcctgagtgacagcacagaagatgaggaggagggcgccagcctgggagatggcagcggggctgagggcggcagctgcagcagcagccgccgctctggaggagatggaggagatgaggtggagggcagcggcgtgggcgctggggagggggagaccgtgcagcacttccccctggcccggcccaagagcctgatgcagaagctgcagtgcagcttccagacctcctggctgaaggacttcccctggctgcgctacagcaaggacaccggcctgatgagctgtggctggtgccagaagaccccagcagatggcggctctgtggacctgccccctgtgggccatgatgagctgagccggggcaccaggaactacaagaagaccctgctgctgcggcaccacgtgtccacagagcacaagctgcacgaggccaatgcccaggagagcgagatccccagcgaggagggctactgtgacttcaacagccggcccaatgaaaattcctactgctaccagctgctgcggcagctgaatgagcagaggaagaagggcatcctgtgtgatgtgtccatcgtggtgtctgggaagatcttcaaggcccacaagaacatcctggtggccggcagccgcttcttcaagaccctgtactgcttcagcaacaaggagagccccaaccagaacaacaccacccacctggacattgctgctgtgcagggcttcagcgtcatcctggacttcctgtacagcggcaacctggtgctgaccagccagaatgccatcgaggtgatgacagtggccagctacctgcagatgtctgaggtggtgcagacctgcaggaacttcatcaaggatgccctgaacatcagcatcaagtctgaggcccctgagagcgtggtggtggactacaacaacaggaagcctgtgaacagagatggcctgagcagcagccgggaccagaagatcgccagcttctgggccaccaggaacctgaccaacctggccagcaatgtgaagattgaaaatgatggctgcaatgtggatgagggccagatcgagaactaccagatgaatgacagctcctgggtgcaggacggcagccctgagatggccgagaatgaaagtgagggccagaccaaggtgttcatctggaacaacatgggcagccagggcatccaggagaccgggaagaccaggaggaagaaccagaccaccaagcgcttcatctacaacatcccccccaacaatgagaccaacctggaggactgcagcgtgatgcagccccctgtggcctacccagaggagaacaccctgctgatcaaggaggagccagacctggatggagccctgctgagcggcccagatggagacagaaatgtgaatgccaacctgctggccgaggccggcaccagccaggatggaggagatgctggcaccagccatgacttcaagtatggcctgatgcctggggccagcaatgacttcaagtatggcctgctgcctgagagctggcccaagcaggagacctgggagaatggagagagcagcctcatcatgaacaagctgaagtgcccccactgcagctatgtggccaagtacagaaggaccctgaagaggcacctgctgatccacactggagtgcgctccttcagctgtgacatctgtgggaagctgttcacccggcgggagcacgtgaagaggcacagcctggtgcacaagaaggacaagaagtacaagtgcatggtgtgcaagaagatcttcatgctggccgcctctgtgggcatcagacatggcagccgccgctatggagtgtgtgtggactgtgccgacaagagccagcccggcggccaggagggcgtggaccagggccaggacacagagttccccagagatgaggagtatgaggagaatgaggtgggggaggctgatgaggagctggtggatgatggagaggaccagaatgaccccagccgctgggatgagagcggggaggtgtgcatgagcctggatgactag

SEQ ID NO: 17495 - DNA, 3162 bp, Artificial Sequence
  Description of Artificial Sequence: Synthetic coding sequence
atgagcagcgaggagagctaccgggccatcctgcgctacctgaccaatgaaagagagccctatgcccctggaacagagggcaatgtgaagaggaagatcaggaaggctgctgcctgctacgtggtgcggggcggcaccctgtactaccagaggcggcagaggcacaggaagacctttgctgagctggaggtggtgctgcagcctgagaggagaagagacctgattgaagctgcccacctgggccctgggggcacccaccacaccaggcaccagacctggcactacctgagcaagacctactggtggaggggcatcctgaagcaggtgaaggactacatcaagcagtgcagcaagtgccaggagaagctggacaggagccggcccatcagtgatgtgtctgagatgctggaggagctgggcctggacctggagagcggggaggagagcaatgaaagtgaagatgacctgagcaacttcaccagcagccccaccacagccagcaagccagccaagaagaagcctgtgtccaagcatgagctggtgtttgtggacaccaagggcgtggtgaagaggagcagccccaagcactgccaggccgtgctgaagcagctgaatgagcagaggctgagcaaccagttctgtgatgtgaccctgctgattgaaggagaggagtacaaggcccacaagtctgtgctgagcgccaacagcgagtacttccgggacctcttcatcgagaagggagctgtgagcagccatgaggccgtggtggacctgagcggcttctgcaaggccagcttcctgcccctgctggagtttgcctacacctctgtgctgagctttgacttctgcagcatggctgatgtggccatcctggcccggcacctgttcatgtctgaggtgctggagatctgtgagagcgtgcacaagctgatggaggagaagcagctgactgtgtacaagaagggggaggtgcagacagtggccagcacccaggacctgcgggtgcagaatggaggaacagcccctcctgtggccagcagcgagggcaccaccaccagcctgcccacagagctgggggactgtgaaattgtgctgctggtgaatggagagctgcctgaggccgagcagaatggagaggtgggccggcagcctgagccccaggtgagcagcgaggccgagagcgccctgagctctgtgggctgcatcgctgacagccaccctgagatggagagcgtggacctgatcaccaagaacaaccagacagagctggagaccagcaacaaccgggagaacaacacagtgagcaacatccaccccaagctgagcaaagaaaatgtcatcagcagcagccctgaggacagcggcatgggaaatgacatctctgctgaggacatctgtgccgaggacatccccaagcaccggcagaaggtggaccagcccctgaaggaccaggagaacctggtggccagcacagccaagacagactttggaccagatgatgacacctaccgcagccggctgcggcagaggtctgtgaatgaaggagcctacatccggctgcacaagggcatggagaagaagctgcagaagaggaaggctgtgcccaagtctgctgtgcagcaggtggcccagaagctggtgcagaggggcaagaagatgaagcagcccaagagagatgccaaggagaacacagaggaggccagccacaagtgtggagaatgtggcatggtgttccagaggagatatgccctgatcatgcacaagctgaagcatgagcgggcccgggactacaagtgccccctgtgcaagaagcagttccagtacagcgccagcctgcgggcccacctgatccgccacaccaggaaggatgcccccagcagcagcagcagcaacagcaccagcaatgaggccagcggcaccagcagcgagaagggccgcaccaagcgggagttcatctgcagcatctgtggccgcaccctgcccaagctgtacagcctgcgcatccacatgctgaagcacactggagtgaagccccacgcctgccaggtgtgtgggaagaccttcatctacaagcacggcctgaagctgcaccagagcctgcaccagagccagaagcagttccagtgtgagctgtgtgtgaagagctttgtgaccaagaggagcctgcaggagcacatgagcatccacactggagagagcaagtacctgtgcagcgtgtgtgggaagagcttccaccggggcagcggcctgagcaagcacttcaagaagcaccagcccaagccagaggtgcggggctaccactgcacccagtgtgagaagagcttctttgaggcccgggacctgcggcagcacatgaacaagcacctgggcgtgaagcccttccagtgccagttctgtgacaagtgctacagctggaagaaggactggtacagccacgtgaagagccacagcgtgacagagccctaccgctgcaacatctgtgggaaggagttctatgagaaggccctcttccgccgccacgtgaagaaggccacccacggcaagaagggccgggccaagcagaacctggagcgggtgtgtgagaagtgtggcaggaagttcacccagctgcgggagtaccgccgccacatgaacaaccacgagggcgtgaagccctttgaatgtctgacctgtggggtggcctgggcagatgcccggagcctgaagagacatgtgaggacccacactggagagcggccctacgtgtgccctgtgtgcagcgaggcctacattgatgcccggaccctgaggaagcacatgaccaagttccaccgggactatgtgccctgcaagatcatgctggagaaggacaccctgcagttccacaaccagggcacccaggtggcccatgctgtgtccatcctgacagctggcatgcaggagcaggagagcagcggcccccaggagctggagaccgtggtggtgactggagagaccatggaggccctggaggccgtggccgccacagaggagtaccccagcgtgtccaccctgagtgaccagagcatcatgcaggtggtgaactacgtgctggcccagcagcagggccagaagctgtctgaggtggccgaggccatccagacagtgaaggtggaggtggcccacatcagcggcggggagtag

SEQ ID NO: 17496 - DNA, 1380 bp, Artificial Sequence
  Description of Artificial Sequence: Synthetic coding sequence
atggccagcggcgtggaggtgctgcgcttccagctgcccggccatgaagctgccaccctgaggaacatgaaccagctgcgggcagaggagcgcttctgtgatgtgaccatcgtggccgacagcctgaagttccggggccacaaggtgatcctggccgcctgcagccccttcctgcgggaccagttcctgctgaaccccagcagcgagctgcaggtgtccctgatgcacagcgcccgcatcgtggccgacctgctgctgagctgctacaccggggccctggagtttgctgtgcgggacatcgtgaactacctgacagctgccagctacctgcagatggagcacgtggtggagaagtgcagaaatgccctgagccagttcatcgagcccaagattggcctgaaggaggatggagtgtctgaggccagcctggtgagcagcatcagcgccaccaagagcctgctgcccccagcccggacccccaagccagcccccaagcccccacctcctccacccctgcccccacccctgctgcggcctgtgaagctggagttccccctggatgaggacctggagctgaaggccgaggaggaggatgaagatgaagatgaagatgtgtctgacatctgcatcgtgaaggtggagagcgccctggaggtggcccaccggctgaagcccccaggcggcctgggcggcggcctgggcattggaggctctgtgggcggccacctgggggagctggcccagagctctgtgccccccagcacagtggccccaccccagggcgtggtgaaggcctgctacagcctgtctgaagatgctgagggggagggcctgctgctgatccctgggggccgggcctctgtgggcgccaccagcggcctggtggaggccgctgctgtggccatggccgcccggggagctgggggcagcctgggcgccggcggcagccggggccccctgcccggcggcttcagcggcggcaaccccctgaagaacatcaagtgcaccaagtgcccagaggtgttccagggcgtggagaagctggtgttccacatgagggcccagcacttcatcttcatgtgcccccgctgtgggaagcagttcaaccacagcagcaacctgaacagacacatgaatgtgcacagaggagtgaagagccacagctgtggcatctgtgggaagtgcttcacccagaagagcaccctgcatgaccacctgaacctgcacagcggggcccggccctaccgctgcagctactgtgatgtgcgctttgcccacaagccagccatcagaagacacctgaaggagcagcacggcaagaccacagcagaaaatgtgctggaggcctctgtggccgagatcaacgtgctgatcagatag

SEQ ID NO: 17497 - DNA, 1380 bp, Artificial Sequence; identical to SEQ ID NO: 17496
  Description of Artificial Sequence: Synthetic coding sequence

SEQ ID NO: 17498 - DNA, 1380 bp, Artificial Sequence; identical to SEQ ID NO: 17496
  Description of Artificial Sequence: Synthetic coding sequence

SEQ ID NO: 17499 - DNA, 1380 bp, Artificial Sequence; identical to SEQ ID NO: 17496
  Description of Artificial Sequence: Synthetic coding sequence

SEQ ID NO: 17500 - DNA, 1380 bp, Artificial Sequence; identical to SEQ ID NO: 17496
  Description of Artificial Sequence: Synthetic coding sequence

SEQ ID NO: 17501 - DNA, 1545 bp, Artificial Sequence
  Description of Artificial Sequence: Synthetic coding sequence
atggacctggccaaccacggcctcatcctgctgcagcagctgaatgcccagcgggagtttggcttcctgtgtgactgcaccgtggccatcggagatgtgtacttcaaggcccacaagtctgtgctggccagcttcagcaactacttcaagatgctgtttgtgcaccagaccagtgaatgtgtgcggctgaagcccacagacatccagcctgacatcttctcctacctgctgcacctgatgtacaccgggaagatggccccccagctgattgatcctgtgcggctggagcagggcatcaagttcctgcacgcctaccccctcatccaggaggccagcctggccagccagggcgccttcagccacccagaccaggtgttccccctggccagcagcctgtatggcatccagattgctgaccaccagctgcggcaggccaccaagatcgccagcgcccctgagaagctgggccgggacccccggccccagaccagccgcatcagccaggagcaggtgcctgaggccagccagctgagccagctgaccagcaacctggcccaggtgaacagaaccaacatgacccccagcgaccccctgcagaccagcctgagccctgagctggtgtccacccctgtgcccccacctcctcctggagaggagaccaacctggaggccagcagcagtgatgagcagcctgccagcctgaccatcgcccacgtgaagcccagcatcatgaagagaaatggcagcttccccaagtactatgcctgccacctgtgtggccgccgcttcaccctgcggagcagcctgcgggagcacctgcagatccacactggagtgcccttcaccagcagccagcagggcgagagccgggtgcccctgaccctgtgcagcaatgctgctgacctgggcaaggatgccatggaggtgcctgaggccggcatgatcagtgacagcgagctgcagcacatcagtgacagccccatcattgatggccagcagcagagcgagaccccacctccaagtgacattgctgacatcgacaacctggagcaggccgaccaggagcgggaggtgaagaggaggaaatatgagtgcaccatctgtggcaggaagttcatccagaagagccactggagggagcacatgtacatccacacaggcaagcccttcaagtgcagcacctgtgacaagagcttctgccgggccaaccaggccgcccggcacgtgtgcctgaaccagagcattgacacctacaccatggtggacaagcagaccctggagctgtgcacctttgaggagggcagccagatggacaacatgctggtgcagaccaacaagccctacaagtgcaacctgtgtgacaagaccttcagcaccccaaatgaggtggtgaagcacagctgccagaaccagaacagtgatgtgtttgccctggatgagggccgcagcatcctgctgggcagcggggacagcgaggtgacagagccagaccaccctgtgctggccagcatcaagaaggagcaggagaccgtgctgctggactag

SEQ ID NO: 17502 - DNA, 1905 bp, Artificial Sequence
  Description of Artificial Sequence: Synthetic coding sequence
atggagcccagccccctgagccccagcggggccgccctgcccctgcccctgagcctggcccccccacccctgcccctgcctgctgctgctgtggtgcacgtgtccttccctgaggtgaccagcgccctgctggagagcctgaaccagcagaggctgcagggccagctgtgtgatgtgtccatccgggtgcagggccgggagttccgggcccacagagctgtgctggccgccagcagcccctacttccatgaccaggtgctgctgaagggcatgaccagcatcagcctgcccagcgtgatggaccccggggcctttgaaacagtgctggccagcgcctacacaggccgcctgtccatggctgctgctgacatcgtgaacttcctgactgtgggctctgtgctgcagatgtggcacatcgtggacaagtgcacagagctgctgcgggagggccgggccagcgccaccaccaccatcaccacagctgctgccacctctgtgacagtgcctggagctggggtgcccagcggcagcggcggcaccgtggccccagccaccatgggcagcgcccggagccacgccagcagccgggccagcgagaaccagagccccagcagcagcaactacttcagcccccgggagagcacagacttcagcagcagcagccaggaggcctttgctgccagcgctgtgggcagcggggagaggagaggaggcggccctgtgtttcctgcccctgtggtgggcagcggcggggccaccagcggcaagctgctgctggaggctgatgagctgtgtgatgatggaggagatggccgcggggctgtggtgcctggagctggcctgcggcggcccacctacaccccacccagcatcatgccccagaagcactgggtgtatgtgaagagaggaggcaactgcccagcccccacccccctggtgccccaggaccctgacctggaggaggaggaggaggaggaggacctggtgctgacctgtgaagatgatgaagatgaggagctgggcggcagcagccgggtgcctgtgggcggcggccctgaggccaccctgagcatcagtgatgtgaggaccctgtctgagcccccagacaagggggaggagcaggtgaacttctgtgagagcagcaatgactttggcccctatgaaggaggcggccctgtggccggcctggatgattctgggggccccacccccagcagctatgcccccagccaccccccccggcccctgctgcccctggacatgcagggcaaccagatcctggtgttccccagcagcagcagcagcagcagcagccaggcccctggccagcccccaggcaaccaggccgagcacggggctgtgacagtgggcggcacctctgtgggcagcctgggcgtgcccggctctgtgggcggcgtgcctgggggcactggaagtggagatggcaacaagatcttcctgtgccactgtgggaaggccttcagccacaagtccatgagggacagacatgtgaacatgcacctgaacctgcggccctttgactgccctgtgtgcaacaagaagttcaagatgaagcaccacctgacagagcacatgaagacccacacaggcctgaagccctatgaatgtggggtgtgtgccaagaagttcatgtggagggacagcttcatgaggcaccggggccactgtgaaagaagacaccggctgggcggcgtgggcgctgtgcccggccctggcacccccaccggccccagcctgcccagcaagcgggagagccctggggtgggcggcggcagcggagatgaggccagcgctgccaccccacccagcagccggcgggtgtggagccccccccgggtgcacaaggtggagatgggctttggaggcggcggcggggccaactag

SEQ ID NO: 17503 - DNA, 1905 bp, Artificial Sequence; identical to SEQ ID NO: 17502
  Description of Artificial Sequence: Synthetic coding sequence

SEQ ID NO: 17504 - DNA, 450 bp, Artificial Sequence
  Description of Artificial Sequence: Synthetic coding sequence
atggagcccagccccctgagccccagcggggccgccctgcccctgcccctgagcctggcccccccacccctgcccctgcctgctgctgctgtggtgcacgtgtccttccctgaggtgaccagcgccctgctggagagcctgaaccagcagaggctgcagggccagctgtgtgatgtgtccatccgggtgcagggccgggagttccgggcccacagagctgtgctggccgccagcagcccctacttccatgaccaggtgctgctgaagggcatgaccagcatcagcctgcccagcgtgatggaccccggggcctttgaaacagtgctggccagcgcctacacaggccgcctgtccatggctgctgctgacatcgtgaacttcctgactgtgggctctgtgctgcagatgtggcacatcgtggacaagtgcacagagctgctgcgggagtag

SEQ ID NO: 17505 - DNA, 450 bp, Artificial Sequence; identical to SEQ ID NO: 17504
  Description of Artificial Sequence: Synthetic coding sequence

SEQ ID NO: 17506 - DNA, 1905 bp, Artificial Sequence; identical to SEQ ID NO: 17502
  Description of Artificial Sequence: Synthetic coding sequence

SEQ ID NO: 17507 - DNA, 1905 bp, Artificial Sequence; identical to SEQ ID NO: 17502
  Description of Artificial Sequence: Synthetic coding sequence

SEQ ID NO: 17508 - DNA, 1326 bp, Artificial Sequence
  Description of Artificial Sequence: Synthetic coding sequence
atgtctgagaggagtgacctgctgcacttcaagtttgaaaattatggagacagcatgctgcagaagatgaacaagctgcgggaggagaacaagttctgtgatgtgacagtgctgattgatgacatcgaggtgcagggccacaagatcgtgtttgctgctggcagccccttcctgcgggaccagttcctgctgaatgacagccgggaggtgaagatcagcatcctgcagagcagcgaggtgggccggcagctgctgctgagctgctacagcggcgtgctggagttccctgagatggagctggtgaactacctgacagctgccagcttcctgcagatgagccacatcgtggagcgctgcacccaggccctgtggaagttcatcaagcccaagcagcccatggacagcaaggagggctgtgagccccagagcgccagcccccagagcaaggagcagcagggagatgcccggggcagccccaagcaggacagcccctgcatccaccccagcgaggacagcatggacatggaggacagcgacatccagatcgtgaaggtggagagcattggagatgtgtctgaggtgcgcagcaagaaggaccagaaccagttcatcagcagcgagcccacagccctgcacagcagcgagccccagcacagcctcatcaacagcacagtggagaacagagtgtctgaaattgagcagaaccacctgcacaactatgccctgagctacacaggcagtgacaacatcatcatggccagcaaggatgtgtttggccccaacatccggggcgtggacaagggcctgcagtggcaccaccagtgccccaagtgcaccagggtcttccgccacctggagaactatgccaaccacctgaagatgcacaagctgttcatgtgcctgctgtgtgggaagaccttcacccagaagggcaacctgcaccgccacatgagggtgcatgctggcatcaagcccttccagtgcaagatctgtgggaagaccttcagccagaagtgcagcctgcaggaccacctgaacctgcacagcggggacaagccccacaagtgcaactactgtgacatggtgtttgcccacaagcctgtgctgaggaagcacctgaagcagctgcacggcaagaacagctttgacaatgccaatgaaagaaatgtgcaggacctgactgtggactttgacagctttgcctgcaccaccgtgacagacagcaagggctgccagccccagccagatgccacccaggtgctggatgctgggaagctggcccaggccgtgctgaacctgagaaatgacagcacctgtgtgaactag

SEQ ID NO: 17509 - DNA, 1326 bp, Artificial Sequence; identical to SEQ ID NO: 17508
  Description of Artificial Sequence: Synthetic coding sequence

SEQ ID NO: 17510 - DNA, 1725 bp, Artificial Sequence
  Description of Artificial Sequence: Synthetic coding sequence
atgctgcgggagttcagcaagtggggcgtggaggccagccctgggaaggcctgggagaggaagaggagcctgctgcggggagctgtgggccgctacagaggagccaccggcggggacctcttctgggcccccttccccagctggggcaccatggagttccctgagcacagccagcagctgctgcagagcctgcgggagcagaggagccagggcttcctgtgtgactgcaccgtgatggtgggcagcacccagttcctggcccacagagctgtgctggccagctgcagccccttcttccagctgttctacaaggagcgggagctggacaagagggacctggtgtgcatccacaatgagatcgtgacagccccagccttcggcctgctgctggacttcatgtatgccggccagctgaccctgcggggggacacccctgtggaggatgtgctggccgccgccagctacctgcacatgaatgacatcgtgaaggtgtgcaagaggcggctgcaggcccgggccctggccgaggccgacagcaccaagaaggaggaggagaccaacagccagctgcccagcctggagttcctgagcagcaccagccggggcacccagcccagcctggccagcgctgagaccagcggccactggggcaagggggagtggaagggcagcgctgcccccagccccaccgtgcggcccccagatgagccccccatgagcagtggagctgacaccacccagcccggcatggaggtggatgccccccacctgcgggccccccacccccctgtggctgatgtgtccctggccagccccagcagcagcacagagaccatccccaccaactacttcagcagcggcatctctgctgtgtccctggagcccctgcccagcctggatgtgggccctgagagcctgcgggtggtggagcccaaggaccccggcggccccctgcagggcttctaccccccagccagcgcccccaccagcgccccagcccctgtgtctgcccctgtgcccagccaggccccagccccagctgaggccgagctggtgcaggtgaaggtggaggccatcgtcatcagtgatgaggagacagatgtgtctgatgagcagccccagggccctgagcgggccttccccagcggcggcgctgtgtatggagcccagcccagccagcctgaggcctttgaggaccccggggctgctggcctggaggaggtgggccccagcgaccacttcctgcccacagacccccacctgccctaccacctgctgcctggagctggccagtaccaccggggcctggtgaccagccccctgcctgccccagccagcctgcacgagcccctgtacctgagcagtgaatatgaagctgcccctggcagctttggagtcttcacagaagatgtgcccacctgcaagacctgtgggaagaccttcagctgcagctacaccctgcggagacatgccaccgtgcacacccgggagcggccctatgaatgtcgctactgcctgcggagctacacccagagcggggacctgtaccgccacatcaggaaggcccacaatgaagacctggccaagaggagcaagccagaccctgaggtgggccccctgctgggcgtgcagcccctgcccggcagccccacagctgaccggcagagcagcagcggcggcggcccccccaaggactttgtgctggcccccaagaccaacatctag

SEQ ID NO: 17511 - DNA, 1512 bp, Artificial Sequence
  Description of Artificial Sequence: Synthetic coding sequence
atggagaagggcggcaacatccagctggagatcccagacttcagcaacagcgtgctgagccacctgaaccagctgaggatgcagggccgcctgtgtgacatcgtggtgaatgtgcagggccaggccttccgggcccacaaggtggtgctggccgccagcagcccctacttccgggaccacatgagcctgaatgagatgagcacagtgtccatcagcgtcatcaagaaccccaccgtgtttgagcagctgctgtccttctgctacacaggccgcatctgcctgcagctggccgacatcatctcctacctgacagctgccagcttcctgcagatgcagcacatcatcgacaagtgcacccagatcctggagggcatccacttcaagatcaacgtggccgaggtggaggccgagctgagccagaccaggaccaagcaccaggagaggcctcctgagagccaccgggtgacccccaacctgaacagaagcctgagccccaggcacaacacccccaagggcaacagaagaggccaggtgtctgctgtgctggacatccgggagctgagccccccagaggagagcaccagcccccagatcatcgagcccagcagtgatgtggagagccgggagcccatcctgcgcatcaacagagctggccagtggtacgtggagaccggggtggccgaccggggcggccgcagtgatgatgaggtgcgggtgctgggcgctgtgcacatcaagacagagaacctggaggagtggctgggccctgagaaccagcccagcggagaagatggcagcagcgctgaggaggtgacagccatggtgattgacaccactggacatggctctgtgggccaggagaactacaccctgggcagcagcggggccaaggtggcccggcccaccagcagcgaggtggaccgcttcagccccagcggctctgtggtgcccctgacagagcggcaccgggcccggtctgagagccctggccgcatggatgagcccaagcagcccagcagccaggtggaggagagcgccatgatgggcgtgtctggctacgtggagtacctgcgggagcaggaggtgtctgagcgctggttccgctacaacccccggctgacctgcatctactgtgccaagagcttcaaccagaagggcagcctggacagacacatgaggctgcacatgggcatcaccccatttgtgtgcaggatgtgtgggaagaagtacaccaggaaggaccagctggagtaccacatcaggaagcacacaggcaacaagcccttccactgccacgtgtgtgggaagagcttccccttccaggccatcctgaaccagcacttcaggaagaaccaccctggctgcatccccctggagggcccccacagcatcagccctgagaccaccgtgaccagccggggccaggccgaggaggagagccccagccaggaggagaccgtggcccctggagaggccgtgcagggctctgtgtccaccaccggccctgactag

SEQ ID NO: 17512 - DNA, 1236 bp, Artificial Sequence
  Description of Artificial Sequence: Synthetic coding sequence
atgcctgccaccggccgctaccaccagctgcccaacagctgccagttcagcgccaatgctgcctactaccggcagatgtacacagaccccggcggccacagcttcaagatcaacgtggccgaggtggaggccgagctgagccagaccaggaccaagcaccaggagaggcctcctgagagccaccgggtgacccccaacctgaacagaagcctgagccccaggcacaacacccccaagggcaacagaagaggccaggtgtctgctgtgctggacatccgggagctgagccccccagaggagagcaccagcccccagatcatcgagcccagcagtgatgtggagagccgggagcccatcctgcgcatcaacagagctggccagtggtacgtggagaccggggtggccgaccggggcggccgcagtgatgatgaggtgcgggtgctgggcgctgtgcacatcaagacagagaacctggaggagtggctgggccctgagaaccagcccagcggagaagatggcagcagcgctgaggaggtgacagccatggtgattgacaccactggacatggctctgtgggccaggagaactacaccctgggcagcagcggggccaaggtggcccggcccaccagcagcgaggtggaccgcttcagccccagcggctctgtggtgcccctgacagagcggcaccgggcccggtctgagagccctggccgcatggatgagcccaagcagcccagcagccaggtggaggagagcgccatgatgggcgtgtctggctacgtggagtacctgcgggagcaggaggtgtctgagcgctggttccgctacaacccccggctgacctgcatctactgtgccaagagcttcaaccagaagggcagcctggacagacacatgaggctgcacatgggcatcaccccatttgtgtgcaggatgtgtgggaagaagtacaccaggaaggaccagctggagtaccacatcaggaagcacacaggcaacaagcccttccactgccacgtgtgtgggaagagcttccccttccaggccatcctgaaccagcacttcaggaagaaccaccctggctgcatccccctggagggcccccacagcatcagccctgagaccaccgtgaccagccggggccaggccgaggaggagagccccagccaggaggagaccgtggcccctggagaggccgtgcagggctctgtgtccaccaccggccctgactag

SEQ ID NO: 17513 - DNA, 927 bp, Artificial Sequence
  Description of Artificial Sequence: Synthetic coding sequence
atggagaagggcggcaacatccagctggagatcccagacttcagcaacagcgtgctgagccacctgaaccagctgaggatgcagggccgcctgtgtgacatcgtggtgaatgtgcagggccaggccttccgggcccacaaggtggtgctggccgccagcagcccctacttccgggaccacatgagcctgaatgagatgagcacagtgtccatcagcgtcatcaagaaccccaccgtgtttgagcagctgctgtccttctgctacacaggccgcatctgcctgcagctggccgacatcatctcctacctgacagctgccagcttcctgcagatgcagcacatcatcgacaagtgcacccagatcctggagggcatccacttcaagatcaacgtggccgaggtggaggccgagctgagccagaccaggaccaagcaccaggagaggcctcctgagagccaccgggtgacccccaacctgaacagaagcctgagccccaggcacaacacccccaagggcaacagaagaggccaggtgtctgctgtgctggacatccgggagctgagccccccagaggagagcaccagcccccagatcatcgagcccagcagtgatgtggagagccgggagcccatcctgcgcatcaacagagctggccagtggtacgtggagaccggggtggccgaccggggcggccgcagtgatgatgaggtgcgggtgctgggcgctgtgcacatcaagacagagaacctggaggagtggctgggccctgagaaccagcccagcggagaagatggcagcagcgctgaggaggtgacagccatggtgattgacaccactggacatggctctgtgggccaggagaactacaccctgggcagcagcggggccaaggtggcccggcccaccagcagcgaggtggacagatag

SEQ ID NO: 17514 - DNA, 1512 bp, Artificial Sequence; identical to SEQ ID NO: 17511
  Description of Artificial Sequence: Synthetic coding sequence

SEQ ID NO: 17515 - DNA, 1086 bp, Artificial Sequence
  Description of Artificial Sequence: Synthetic coding sequence
atggagaagggcggcaacatccagctggagatcccagacttcagcaacagcgtgctgagccacctgaaccagctgaggatgcagggccgcctgtgtgacatcgtggtgaatgtgcagggccaggccttccgggcccacaaggtggtgctggccgccagcagcccctacttccgggaccacatgagcctgaatgagatgagcacagtgtccatcagcgtcatcaagaaccccaccgtgtttgagcagctgctgtccttctgctacacaggccgcatctgcctgcagctggccgacatcatctcctacctgacagctgccagcttcctgcagatgcagcacatcatcgacaagtgcacccagatcctggagggcatccacttcaagatcaacgtggccgaggtggaggccgagctgagccagaccaggaccaagcaccaggagaggcctcctgagagccaccgggtgacccccaacctgaacagaagcctgagccccaggcacaacacccccaagggcaacagaagaggccaggtgtctgctgtgctggacatccgggagctgagccccccagaggagagcaccagcccccagatcatcgagcccagcagtgatgtggagagccgggagcccatcctgcgcatcaacagagctggccagtggtacgtggagaccggggtggccgaccggggcggccgcagtgatgatgaggtgcgggtgctgggcgctgtgcacatcaagacagagaacctggaggagtggctgggccctgagaaccagcccagcggagaagatggcagcagcgctgaggaggtgacagccatggtgattgacaccactggacatggctctgtgggccaggagaactacaccctgggcagcagcggggccaaggtggcccggcccaccagcagcgaggtggaccgcttcagccccagcggctctgtggtgcccctgacagagcggcaccgggcccggtctgagagccctggccgcatggatgagcccaagcagcccagcagccaggtgtggagctgtggcttcagaacagccctggtggtgggcggcatcgccaccgtgtatgaatag

SEQ ID NO: 17516 - DNA, 1512 bp, Artificial Sequence; identical to SEQ ID NO: 17511
  Description of Artificial Sequence: Synthetic coding sequence

SEQ ID NO: 17517 - DNA, 2139 bp, Artificial Sequence
  Description of Artificial Sequence: Synthetic coding sequence
atgggcatgaggatcaagctgcagagcaccaaccaccccaacaacctgctgaaggagctgaacaagtgccgcctgtctgagaccatgtgtgatgtgaccatcgtggtgggcagccgctccttccctgcccacaaggctgtgctggcctgtgccgccggctacttccagaacctcttcctgaacacaggcctggatgctgcccggacctacgtggtggacttcatcaccccagccaactttgagaaggtgctgagctttgtgtacaccagcgagctgttcacagacctgatcaacgtgggcgtcatctatgaggtggccgagcggctgggcatggaggacctgctgcaggcctgccacagcaccttcccagacctggagagcacagcccgggccaagcccctgaccagcaccagcgagagccacagcggcaccctgagctgccccagcgctgagcccgcccaccccctgggggagctgcggggcggcggggactacctgggcgctgacaggaactacgtgctgcccagtgatgctgggggcagctacaaggaggaggagaagaatgtggccagtgatgccaaccacagcctgcacctgccccagcccccacctcctccacccaagacagaggaccatgacaccccagcccccttcaccagcatccccagcatgatgacccagcccctgctgggcaccgtgtccacaggcatccagaccagcaccagcagctgccagccctacaaggtgcagagcaatggagacttcagcaagaacagcttcctgaccccagacaatgctgtggacatcaccaccggcaccaacagctgcctgagcaacagcgagcacagcaaggaccccggcttcggccagatggatgagctgcagctggaggacctgggagatgatgacctgcagtttgaagatcctgcagaagatattggcaccacagaggaggtgattgagctgagtgatgacagtgaagatgagctggccttcggggagaatgacaaccgggagaacaaggccatgccctgccaggtgtgcaagaaggtgctggagcccaacatccagctgatccggcagcacgcccgggaccacgtggacctgctgactggaaactgcaaggtgtgtgagacccacttccaggacaggaacagccgggtgacccacgtgctgagccacatcggcatcttcctgttcagctgtgacatgtgtgagaccaagttcttcacccagtggcagctgaccctgcacagaagagatggcatctttgagaacaacatcatcgtgcaccccaatgaccccctgcccgggaagctgggcctcttcagcggggccgccagccctgagctgaagtgtgccgcctgtgggaaggtgctggccaaggacttccacgtggtgcggggccacatcctggaccacctgaacctgaagggccaggcctgcagcgtgtgtgaccagaggcacctgaacctgtgcagcctgatgtggcacaccctgagccacctgggcatcagcgtcttcagctgcagcgtgtgtgccaacagctttgtggactggcacctgctggagaagcacatggctgtgcaccagagcctggaggatgccctcttccactgccgcctgtgcagccagagcttcaagtctgaggccgcctaccgctaccacgtgtcccagcacaagtgcaacagcggcctggatgcccggcccggcttcggcctgcagcacccagccctgcagaagaggaagctgcctgctgaggagttcctgggggaggagctggccctgcagggccagcccggcaacagcaagtacagctgcaaggtgtgtgggaagagatttgcccacaccagcgagttcaactaccaccggcgcatccacactggagagaagccctaccagtgcaaggtgtgccacaagttcttccggggccgcagcaccatcaagtgccacctgaagacccacagcggggccctgatgtaccgctgcaccgtgtgtggccactacagcagcaccctgaacctgatgagcaagcacgtgggcgtgcacaagggcagcctgcccccagacttcaccatcgagcagaccttcatgtacatcatccacagcaaggaggccgacaagaacccagacagctag

SEQ ID NO: 17518 - DNA, 2730 bp, Artificial Sequence
  Description of Artificial Sequence: Synthetic coding sequence
atgaagaagaggaggaaggtgaccagcaacctggagaagatccacctgggctaccacaaggacagcagcgagggcaatgtggccgtggagtgtgaccaggtgacctacacccacagcgctggccggcccaccccagaggccctgcactgctaccaggagctgccccccagcccagaccagaggaagctgctgagcagcctgcagtacaacaagaacctgctgaagtacctgaatgatgaccggcagaagcagcccagcttctgtgacctgctgatcatcgtggagggcaaggagttcagcgcccacaaggtggtggtggccgtgggcagcagctacttccacgcctgcctgagcaagaaccccagcacagatgtggtgaccctggaccacgtgacccacagcgtcttccagcacctgctggagttcctgtacaccagcgagttctttgtgtacaagtatgagatccccctggtgctggaggccgccaagttcctggacatcattgatgctgtgaagctgctgaacaatgaaaatgtggcccccttccacagcgagctgacagagaagagcagccctgaggagaccctgaatgagctgaccggccgcctgagcaacaaccaccagtgcaagttctgcagccgccacttctgctacaagaagagcctggagaaccacctggccaagacccacaggagcctgctgctgggcaagaagcacggcctgaagatgctggagaggagcttcagcgcccggcgcagcaagaggaacaggaagtgccctgtgaagtttgatgacaccagtgatgatgagcaggagagcggagatggcagtgacaacctgaaccaggagaactttgacaaggagaagagtgacagaaatgattctgaggaccccggcagcgagtacaatgctgaggaggatgagctggaggaggagatgtctgatgagtacagcgacatcgaggagcagagcgagaaggaccacaatgatgctgaggaggagcctgaggccggggacagcgtgggcaatgtgcatgagggcctgacccctgtggtgatccagaacagcaacaagaagatcctgcagtgccccaagtgtgacaagacctttgacagaattggcaagtatgagagccacaccagggtgcacactggagagaagccctttgaatgtgacatctgccaccagcgctacagcaccaagagcaacctgactgtgcacaggaagaagcacagcaatgaaacagagttccacaagaaggagcacaagtgcccctactgcaacaagctgcacgccagcaagaagaccctggccaagcacgtgaagcgcttccacccagaaaatgcccaggagttcatcagcatcaagaagaccaagtctgagagctggaagtgtgacatctgcaagaagagcttcacccggcggccccacctggaggagcacatgatcctgcacagccaggacaagcccttcaagtgcacctactgtgaggagcacttcaagagcagatttgcccggctgaagcaccaggagaagttccacctgggccccttcccctgtgacatctgtggccggcagttcaatgacaccggcaacctgaagaggcacatcgagtgcacccatggaggcaagaggaagtggacctgcttcatctgtgggaagtctgtgcgggagaggaccaccctgaaggagcacctgcgcatccacagcggggagaagccccacctgtgcagcatctgtggccagagcttccgccacggcagcagctaccgcctgcacctgcgggtgcaccatgatgacaagagatatgaatgtgatgaatgtgggaagaccttcatcagacatgaccacctgaccaagcacaagaagatccacagcggggagaaggcccaccagtgtgaagaatgtgggaagtgcttcggccggcgggaccacctgactgtgcactacaagtctgtgcacctgggggagaaggtgtggcagaagtacaaggccaccttccaccagtgtgatgtgtgcaagaagatcttcaagggcaagagcagcctggagatgcacttccgcacccacagcggggagaagccctacaagtgccagatctgcaaccagagcttccgcatcaagaagaccctgaccaagcacctggtgatccacagtgatgcccggcccttcaactgccagcactgcaatgccaccttcaagaggaaggacaagctgaagtaccacatcgaccacgtgcatgagatcaagagcccagatgaccccctgagcaccagcgaggagaagctggtgtccctgcctgtggagtacagcagtgatgacaagatcttccagacagagaccaagcagtacatggaccagcccaaggtgtaccagagcgaggccaagaccatgctgcagaatgtgtctgctgaggtgtgtgtgcctgtgaccctggtgcctgtgcagatgccagacacccccagcgacctggtgcgccacaccaccaccctgccccccagcagccatgagatcctgagcccccagccccagagcacagactaccccagggctgctgacctggccttcctggagaagtacaccctgaccccccagcctgccaacatcgtgcaccctgtgcggcctgagcagatgctggacccccgggagcagagctacctgggcaccctgctgggcctggacagcaccactggagtgcagaacatcagcaccaatgagcaccacagctag

SEQ ID NO: 17519 - DNA, 1404 bp, Artificial Sequence
  Description of Artificial Sequence: Synthetic coding sequence
atggagcccggcaccaacagcttccgggtggagttcccagacttcagcagcaccatcctgcagaagctgaaccagcagaggcagcagggccagctgtgtgatgtgtccatcgtggtgcagggccacatcttccgggcccacaaggctgtgctggccgccagcagcccctacttctgtgaccaggtgctgctgaagaacagccgccgcatcgtgctgcctgatgtgatgaacccccgggtgtttgagaacatcctgctgagcagctacacaggccgcctggtgatgcctgcccctgagatcgtgtcctacctgacagctgccagcttcctgcagatgtggcacgtggtggacaagtgcacagaggtgctggagggcaaccccaccgtgctgtgccagaagctgaaccacggcagtgaccaccagagccccagcagcagcagctacaacggcctggtggagagctttgagctgggcagcggcggccacacagacttccccaaggcccaggagctgagagatggagaaaatgaggaggagagcaccaaggatgagctgagcagccagctgacagagcacgagtacctgcccagcaacagcagcacagaacatgaccggctgagcacagagatggccagccaggatggagaggagggcgccagtgacagcgctgagttccactacacccggcccatgtacagcaagcccagcatcatggcccacaagcgctggattcatgtgaagccagagcggctggagcaggcctgtgagggcatggatgtgcacgccacctatgatgagcaccaggtgacagagagcatcaacacagtgcagacagagcacacagtgcagcccagcggcgtggaggaggacttccacatcggggagaagaaggtggaggccgagtttgatgagcaggctgatgagagcaactatgatgagcaggtggacttctacggcagctccatggaggagttcagcggggagaggagtgatggcaacctgattggccaccggcaggaggccgccctggccgccggctacagtgaaaatattgagatggtgacaggcatcaaggaggaggccagccacctgggcttcagcgccacagacaagctgtacccctgccagtgtgggaagagcttcacccacaagagccagagggacagacacatgtccatgcacctgggcctgcggccctacggctgcggcgtgtgtgggaagaagttcaagatgaagcaccacctggtgggccacatgaagatccacacaggcatcaagccctatgagtgcaacatctgtgccaagcgcttcatgtggagggacagcttccaccgccacgtgaccagctgcaccaagagctatgaggccgccaaggccgagcagaacaccacagaggccaactag

SEQ ID NO: 17520 - DNA, 1404 bp, Artificial Sequence; identical to SEQ ID NO: 17519
  Description of Artificial Sequence: Synthetic coding sequence

SEQ ID NO: 17521 - DNA, 1404 bp, Artificial Sequence; identical to SEQ ID NO: 17519
  Description of Artificial Sequence: Synthetic coding sequence

SEQ ID NO: 17522 - DNA, 591 bp, Artificial Sequence
  Description of Artificial Sequence: Synthetic coding sequence
atggagcccggcaccaacagcttccgggtggagttcccagacttcagcagcaccatcctgcagaagctgaaccagcagaggcagcagggccagctgtgtgatgtgtccatcgtggtgcagggccacatcttccgggcccacaaggctgtgctggccgccagcagcccctacttctgtgaccaggtgctgctgaagaacagccgccgcatcgtgctgcctgatgtgatgaacccccgggtgtttgagaacatcctgctgagcagctacacaggccgcctggtgatgcctgcccctgagatcgtgtcctacctgacagctgccagcttcctgcagatgtggcacgtggtggacaagtgcacagaggtgctggagggcaaccccaccgtgctgtgccagaagctgaaccacggcagtgaccaccagagccccagcagcagcagctacaacggcctggtggagagctttgagctgggcagcggcggccacacagacttccccaaggcccaggagctgagagatggagaaaatgaggaggagagcaccaaggatgagctgagcagccagctgacagagcacgagtacctgccctag

SEQ ID NO: 17523 - DNA, 1536 bp, Artificial Sequence
  Description of Artificial Sequence: Synthetic coding sequence
atggctgctgctgaggccgtgcaccacatccacctgcagaacttcagccgcagcctgctggagaccctgaatggccagaggctgggcggccacttctgtgatgtgacagtgcgcatccgggaggccagcctgcgggcccaccgctgtgtgctggccgccggcagccccttcttccaggacaagctgctgctgggccacagcgagatccgggtgccccctgtggtgcctgcccagacagtgcggcagctggtggagttcctgtacagcggcagcctggtggtggcccagggcgaggccctgcaggtgctgacagctgcctctgtgctgcgcatccagacagtgattgatgaatgtacccagatcatcgcccgggcccgggcccctggcaccagcgcccccacccccctgcccacccctgtgcccccacccctggccccagcccagctgcggcaccggctgcggcacctgctggccgcccggcccccaggccaccctggagctgcccacagcaggaagcagaggcagcctgcccggctgcagctgcctgccccacccaccccagccaaggccgagggcccagatgctgaccccagcctgtctgctgccccagatgacagaggagatgaagatgatgaggagagtgatgatgaaacagatggagaagatggagagggcggcggccctggagagggccaggccccacccagcttcccagactgtgccgccggcttcctgacagctgctgctgacagcgcctgtgaggagcccccagcccccaccggcctggccgactacagcggggccggccgggacttcctgcggggggccggcagcgcagaagatgtgtttcctgacagctatgtgtccacctggcatgatgaagatggagctgtgcctgagggctgccccacagagacccctgtgcagcctgactgcatcctgagcggcagcaggcctcctggggtgaagaccccaggcccccctgtggccctcttccccttccacctgggcgcccctggccccccagcccctcctccttctgcccccagcggccctgccccagcccctcctccagccttctaccccaccctgcagcctgaggccgcccccagcacccagctgggggaggtgcctgcccccagcgctgcccccaccacagcccccagcggcaccccagcccggaccccaggagctgagccccccacctatgagtgcagccactgcaggaagaccttcagcagcaggaagaactacaccaagcacatgttcatccacagcggggagaagccccaccagtgtgctgtgtgctggaggagcttcagcctgcgggactacctgctgaagcacatggtgacccacactggagtgcgggccttccagtgtgctgtgtgtgccaagcgcttcacccagaagagcagcctgaatgtgcacatgaggacccacaggcctgagcgggccccctgcccagcctgtgggaaggtgttcagccaccgggccctgctggagcggcacctggccgcccacccagccccctag

SEQ ID NO: 17524 - DNA, 1770 bp, Artificial Sequence
  Description of Artificial Sequence: Synthetic coding sequence
atgaacaacaggaaggaggacatggagatcaccagccactaccgccacctgctgcgggagctgaatgagcagaggcagcacggcgtgctgtgtgatgtgtgtgtggtggtggagggcaaggtgttcaaggcccacaagaatgtgctgctgggcagcagccgctacttcaagaccctgtactgccaggtgcagaagaccagcgagcaggccaccgtgacccacctggacatcgtgacagcccagggcttcaaggccatcatcgacttcatgtacagcgcccacctggccctgaccagcagaaatgtgattgaggtgatgtctgctgccagcttcctgcagatgacagacatcgtgcaggcctgccacgacttcatcaaggccgccctggacatcagcatcaagagtgatgccagtgatgagctggccgagtttgagatcggggccagcagcagcagcagcacagaggccctgatctctgctgtgatggccggccgcagcatcagcccctggctggcccggaggaccagccctgccaacagcagcggggacagcgccatcgccagctgccatgatggcggcagcagctatggcaaggaggaccaggagcccaaggcagatggcccagatgatgtgagcagccagcccctgtggccaggagatgtgggctacggccccctgcgcatcaaggaggagcaggtgagccccagccagtatggaggcagcgagctgcccagcgccaaggatggagctgtgcagaacagcttcagcgagcagagcgctggagatgcctggcagcccactggaagaaggaagaacaggaagaacaaggagaccgtgcgccacatcacccagcaggtggaggatgacagccgggccagcagccctgtgcccagcttcctgcccaccagcggctggcccttcagcagccgggacagcaatgctgacctgtctgtgacagaggccagcagcagtgacagcagaggagagagagctgagctgtatgcccaggtggaggagggcctgctgggcggggaggccagctacctgggcccccccctgaccccagagaaggatgatgccctgcaccaggccacagctgtggccaacctgcgggccgccctgatgagcaagaacagcctgctgagcctgaaggcagatgtgctgggagatgatggcagcctgctgtttgagtacctgcccaggggggcccacagcctgagcctgaatgagttcaccgtcatcaggaagaagttcaagtgcccctactgcagcttcagcgccatgcaccagtgcatcctgaagaggcacatgaggagccacactggagagcggccctacccctgtgagatctgtgggaagaagttcacccggcgggagcacatgaagaggcacaccctggtgcacagcaaggacaagaagtatgtgtgcaaggtgtgcagcagggtcttcatgtctgctgcctctgtgggcatcagacatggcagcagaagacatggagtgtgcacagactgtgccggccggggcatggccggccccctggaccatggaggcggcggcggggagggcagccctgaggccctcttccctggagatggcccctacctggaggaccctgaggaccccagaggagaggccgaggagctgggggaggatgatgagggcctggccccagaagatgccctgctggctgatgacaaggatgaggaggacagcccccggcccaggagccccccaggcggccctgacaaggactttgcctggctgtcctag

SEQ ID NO: 17525 - DNA, 1770 bp, Artificial Sequence; identical to SEQ ID NO: 17524
  Description of Artificial Sequence: Synthetic coding sequence

SEQ ID NO: 17526 - DNA, 1770 bp, Artificial Sequence; identical to SEQ ID NO: 17524
  Description of Artificial Sequence: Synthetic coding sequence

SEQ ID NO: 17527 - DNA, 342 bp, Artificial Sequence
  Description of Artificial Sequence: Synthetic coding sequence
atgagcaccatccagaacctgcagagctttgacccctttgctgatgccaccaagggagatgacctgctgcctgctggaacagaggactacatccacatccgcatccagcagagaaatggaaggaagaccctgaccaccgtgcagggcattgctgatgattatgacaagaagaagctggtgaaggccttcaagaagaagtttgcctgcaatggcaccgtcatcgagcacccagaatatggagaggtgatccagctgcagggcgaccagaggaagaacatctgccagttcctgctggaggtgggcatcgtgaaggaggagcagctgaaggtgcacggcttctag

SEQ ID NO: 17528 - DNA, 1116 bp, Artificial Sequence
  Description of Artificial Sequence: Synthetic coding sequence
atggccaccaggagcagagaaaatgccaggagaagaggcaccccagagcctgaggaggccggccggcggggcggcaagaggcccaagcccccacctggggtggccagcgccagcgcccggggccccccagccacagatggcctgggcgccaaggtgaagctggaggagaagcagcaccacccctgccagaagtgccccagggtcttcaacaaccgctggtacctggagaagcacatgaatgtgacccacagcaggatgcagatctgtgaccagtgtgggaagcgcttcctgctggagagcgagctgctgctgcaccggcagacagactgtgagaggaacatccagtgtgtgacctgtgggaaggccttcaagaagctgtggagcctgcacgagcacaacaagatcgtgcacggctacgccgagaagaagttcagctgtgagatctgtgagaagaagttctacaccatggcccacgtgaggaagcacatggtggcccacaccaaggacatgcccttcacctgtgagacctgtgggaagagcttcaagaggtccatgagcctgaaggtgcacagcctgcagcacagcggggagaagcccttccgctgtgagaactgcaatgaacgcttccagtacaagtaccagctgcggagccacatgagcatccacatcggccacaagcagttcatgtgccagtggtgtgggaaggacttcaacatgaagcagtactttgatgagcacatgaagacccacactggagagaagccctacatctgtgagatctgtgggaagagcttcaccagccggcccaacatgaagaggcacaggaggacccacactggagagaagccctacccctgtgatgtgtgtggccagcgcttccgcttcagcaacatgctgaaggcccacaaggagaagtgcttccgggtgagccacaccctggccggagatggagtgcctgctgcccctggcctgccccccacccagccccaggcccacgccctgcccctgctgcccggcctgccccagaccctgcccccaccaccccacctgcccccacctccacccctcttccccaccacagccagccctgggggccgcatgaatgccaacaactag

SEQ ID NO: 17529 - DNA, 1941 bp, Artificial Sequence
  Description of Artificial Sequence: Synthetic coding sequence
atgggccgcctgaatgagcagaggctcttccagcctgacctgtgtgatgtggacctggtgctggtgccccagaggagcgtcttccctgcccacaagggcgtgctggccgcctacagccagttcttccacagcctcttcacccagaacaagcagctgcagagggtggagctgagcctggaggccctggcccctgggggcctgcagcagatcctgaacttcatctacaccagcaagctgctggtgaatgctgccaacgtgcatgaggtgctgtctgctgccagcctgctgcagatggctgacattgctgccagctgccaggagctgctggatgcccggagcctgggccccccaggccctggcaccgtggccctggcccagcctgctgccagctgcaccccagctgccccaccctactactgtgacatcaagcaggaggccgacaccccaggcctgcccaagatctatgcccgggagggccctgacccctacagcgtgcgggtggaggatggagctggaacagctgggggcaccgtgcctgccaccatcggccctgcccagcccttcttcaaggaggagaaggagggcggcgtggaggaggccggcggccccccagccagcctgtgcaagctggagggcggggaggagctggaggaggagctgggcggcagcggcacctacagccggcgggagcagagccagatcatcgtggaggtgaacctgaacaaccagaccctgcacgtgtccactggacctgagggcaagccaggagctggccccagccctgccaccgtggtgctgggcagagaagatggcctgcagaggcacagtgatgaggaggaggaggatgatgaggaggaggaggaggaggaggaggaggaggagggcggcggcagcggccgggaggaggaggaggaggaggagggcggcagccagggcgaggaggaggaggaggaggaggatggccacagcgagcaggaggaggaggaggaggagaagcagcaccacccctgccagaagtgccccagggtcttcaacaaccgctggtacctggagaagcacatgaatgtgacccacagcaggatgcagatctgtgaccagtgtgggaagcgcttcctgctggagagcgagctgctgctgcaccggcagacagactgtgaaagaaacatccagtgtgtgacctgtgggaaggccttcaagaagctgtggagcctgcacgagcacaacaagatcgtgcacggctatgcagagaagaagttcagctgtgagatctgtgagaagaagttctacaccatggcccacgtgaggaagcacatggtggcccacaccaaggacatgcccttcacctgtgagacctgtgggaagagcttcaagaggtccatgagcctgaaggtgcacagcctgcagcacagcggggagaagcccttccgctgtgagaactgcaatgaacgcttccagtacaagtaccagctgcggagccacatgagcatccacatcggccacaagcagttcatgtgccagtggtgtgggaaggacttcaacatgaagcagtactttgatgagcacatgaagacccacactggagagaagccctacatctgtgagatctgtgggaagagcttcaccagccggcccaacatgaagaggcacaggaggacccacactggagagaagccctacccctgtgatgtgtgtggccagcgcttccgcttcagcaacatgctgaaggcccacaaggagaagtgcttccgggtgagccacaccctggccggagatggagtgcctgctgcccctggcctgccccccacccagccccaggcccacgccctgcccctgctgcccggcctgccccagaccctgcccccaccaccccacctgcccccacctcctcctctcttccccaccacagccagccctgggggccgcatgaatgccaacaactag

SEQ ID NO: 17530 - DNA, 2298 bp, Artificial Sequence
  Description of Artificial Sequence: Synthetic coding sequence
atggaccctgtggccacccacagctgccacctgctgcagcagctgcacgagcagaggatccagggcctgctgtgtgactgcatgctggtggtgaagggcgtgtgcttcaaggcccacaagaatgtgctggccgccttcagccagtacttccgcagcctcttccagaacagcagcagccagaagaatgatgtgttccacctggatgtgaagaatgtgtctggaattggccagatcctggacttcatgtacaccagccacctggacctgaaccaggacaacatccaggtgatgctggacacagcccagtgcctgcaggtgcagaatgtgctgagcctgtgccacaccttcctgaagagcgccaccgtggtgcagcccccaggcatgccctgcaacagcaccctgagcctgcagagcaccctgaccccagatgccacctgtgtgatcagcgagaactacccaccccacctgctgcaggagtgcagcgcagatgcccagcagaacaagaccctggatgagagccacccccacgccagccccagcgtgaacagacaccacagcgctggggagatcagcaagcaggccccagacaccagtgatggcagctgcacagagctgcccttcaagcagcccaactactactacaagctgaggaacttctacagcaagcagtaccacaagcacgccgccggccccagccaggagcgggtggtggagcagccctttgccttcagcaccagcacagacctgaccaccgtggagagccagccctgtgctgtgagccacagcgagtgcatcctggagagccctgagcacctgcccagcaacttcctggcccagcctgtgaatgacagcgccccccaccctgagagtgatgccacctgccagcagcctgtgaagcagatgaggctgaagaaggccatccacctgaagaagctgaacttcctgaagagccagaagtatgcagagcaggtgtctgagcccaagagtgatgatggcctgaccaagaggctggagagcgccagcaagaacaccctggagaaggccagcagccagagcgctgaggagaaggagagcgaggaggtggtgtcctgtgagaacttcaactgcatcagcgagacagagaggccagaagatcctgctgccctggaggaccagagccagaccctgcagagccagaggcagtatgcctgtgagctgtgtgggaagcccttcaagcaccccagcaacctggagctgcacaagaggagccacactggagagaagccctttgagtgcaacatctgtgggaagcacttcagccaggccggcaacctgcagacccacctgcggcggcacagcggggagaagccctacatctgtgagatctgtgggaagagatttgctgccagcggagatgtgcagaggcacatcatcatccacagcggggagaagccccacctgtgtgacatctgtggccggggcttcagcaacttcagcaacctgaaggagcacaagaagacccacacagctgacaaggtgttcacctgtgatgaatgtgggaagagcttcaacatgcagaggaagctggtgaagcaccgcatccgccacactggagagcggccctacagctgcagcgcctgtgggaagtgcttcggcggcagcggggacctgcggagacatgtgaggacccacactggagagaagccctacacctgtgagatctgcaacaagtgcttcaccaggtctgctgtgctgcggcggcacaagaagatgcactgcaaggctggagatgagagcccagatgtgctggaggagctgagccaggccatcgagaccagtgacctggagaagagccagagcagtgacagcttcagccaggacacctctgtgaccctgatgcctgtgtctgtgaagctgcctgtgcaccctgtggagaacagcgtggccgagtttgacagccacagcggcggcagctactgcaagctgcgctccatgatccagccccacggcgtgtctgaccaggagaagctgagcctggaccccgggaagctggccaagccccagatgcagcagacccagccccaggcctatgcctacagtgatgtggacaccccagctggaggagagcccctgcaggctgatggcatggccatgatccgcagcagcctggccgccctggacaaccacggcggggaccccctgggcagccgggccagcagcaccacctacagaaattctgagggccagttcttcagctccatgaccctgtggggcctggccatgaagaccctgcagaatgaaaatgagctggaccagtag

SEQ ID NO: 17531 - DNA, 1932 bp, Artificial Sequence
  Description of Artificial Sequence: Synthetic coding sequence
atggaccctgtggccacccacagctgccacctgctgcagcagctgcacgagcagaggatccagggcctgctgtgtgactgcatgctggtggtgaagggcgtgtgcttcaaggcccacaagaatgtgctggccgccttcagccagtacttccgcagcctcttccagaacagcagcagccagaagaatgatgtgttccacctggatgtgaagaatgtgtctggaattggccagatcctggacttcatgtacaccagccacctggacctgaaccaggacaacatccaggtgatgctggacacagcccagtgcctgcaggtgcagaatgtgctgagcctgtgccacaccttcctgaagagcgccaccgtggtgcagcccccaggcatgccctgcaacagcaccctgagcctgcagagcaccctgaccccagatgccacctgtgtgatcagcgagaactacccaccccacctgctgcaggagtgcagcgcagatgcccagcagaacaagaccctggatgagagccacccccacgccagccccagcgtgaacagacaccacagcgctggggagatcagcaagcaggccccagacaccagtgatggcagctgcacagagctgcccttcaagcagcccaactactactacaagctgaggaacttctacagcaagcagtaccacaagcacgccgccggccccagccaggagcgggtggtggagcagccctttgccttcagcaccagcacagacctgaccaccgtggagagccagccctgtgctgtgagccacagcgagtgcatcctggagagccctgagcacctgcccagcaacttcctggcccagcctgtgaatgacagcgccccccaccctgagagtgatgccacctgccagcagcctgtgaagcagatgaggctgaagaaggccatccacctgaagaagctgaacttcctgaagagccagaagtatgcagagcaggtgtctgagcccaagagtgatgatggcctgaccaagaggctggagagcgccagcaagaacaccctggagaaggccagcagccagagcgctgaggagaaggagagcgaggaggtggtgtcctgtgagaacttcaactgcatcagcgagacagagaggccagaagatcctgctgccctggaggaccagagccagaccctgcagagccagaggcagtatgcctgtgagctgtgtgggaagcccttcaagcaccccagcaacctggagctgcacaagaggagccacacaggcaagtgcttcggcggcagcggggacctgcggagacatgtgaggacccacactggagagaagccctacacctgtgagatctgcaacaagtgcttcaccaggtctgctgtgctgcggcggcacaagaagatgcactgcaaggctggagatgagagcccagatgtgctggaggagctgagccaggccatcgagaccagtgacctggagaagagccagagcagtgacagcttcagccaggacacctctgtgaccctgatgcctgtgtctgtgaagctgcctgtgcaccctgtggagaacagcgtggccgagtttgacagccacagcggcggcagctactgcaagctgcgctccatgatccagccccacggcgtgtctgaccaggagaagctgagcctggaccccgggaagctggccaagccccagatgcagcagacccagccccaggcctatgcctacagtgatgtggacaccccagctggaggagagcccctgcaggctgatggcatggccatgatccgcagcagcctggccgccctggacaaccacggcggggaccccctgggcagccgggccagcagcaccacctacagaaattctgagggccagttcttcagctccatgaccctgtggggcctggccatgaagaccctgcagaatgaaaatgagctggaccagtag

SEQ ID NO: 17532 - DNA, 441 bp, Artificial Sequence
  Description of Artificial Sequence: Synthetic coding sequence
atggaccctgtggccacccacagctgccacctgctgcagcagctgcacgagcagaggatccagggcctgctgtgtgactgcatgctggtggtgaagggcgtgtgcttcaaggcccacaagaatgtgctggccgccttcagccagtacttccgcagcctcttccagaacagcagcagccagaagaatgatgtgttccacctggatgtgaagaatgtgtctggaattggccagatcctggacttcatgtacaccagccacctggacctgaaccaggacaacatccaggtgatgctggacacagcccagtgcctgcaggtgcagaatgtgctgagcctgtgccacaccttcctgaagagcgccaccgtggtgcagcccccaggcatgccctgcaacagcaccctgagcctgcagagcaccctgaccccagatgccacctgctag

SEQ ID NO: 17533 - DNA, 747 bp, Artificial Sequence
  Description of Artificial Sequence: Synthetic coding sequence
atgcagaggaagctggtgaagcaccgcatccgccacactggagagcggccctacagctgcagcgcctgtgggaaatgttttggaggcagcggggacctgcggcggcacgtgaggacccacactggagagaagccctacacctgtgagatctgcaacaagtgcttcaccaggtctgctgtgctgcggcggcacaagaagatgcactgcaaggctggagatgagagcccagatgtgctggaggagctgagccaggccatcgagaccagtgacctggagaagagccagagcagtgacagcttcagccaggacacctctgtgaccctgatgcctgtgtctgtgaagctgcctgtgcaccctgtggagaacagcgtggccgagtttgacagccacagcggcggcagctactgcaagctgcgctccatgatccagccccatggagtgtctgaccaggagaagctgagcctggaccccgggaagctggccaagccccagatgcagcagacccagccccaggcctatgcctacagtgatgtggacaccccagctggaggagagcccctgcaggctgatggcatggccatgatccgcagcagcctggccgccctggacaaccacggcggggaccccctgggcagccgggccagcagcaccacctacagaaacagcgagggccagttcttcagctccatgaccctgtggggcctggccatgaagaccctgcagaatgaaaatgagctggaccagtag

SEQ ID NO: 17534 - DNA, 2034 bp, Artificial Sequence
  Description of Artificial Sequence: Synthetic coding sequence
atggacttccctggccactttgagcagatcttccagcagctgaactaccagaggctgcacggccagctgtgtgactgtgtgattgtggtgggcaacagacacttcaaggcccacaggtctgtgctggccgcctgcagcacccacttccgggccctcttctctgtggccgagggggaccagaccatgaacatgatccagctggacagcgaggtggtgacagctgaggcctttgctgccctgattgacatgatgtacaccagcaccctgatgctgggggagagcaatgtgatggatgtgctgctggccgccagccacctgcacctgaacagcgtggtgaaggcctgcaagcactacctgaccaccaggaccctgcccatgagcccccccagcgagcgggtgcaggagcagagcgccaggatgcagaggagcttcatgctgcagcagctgggcctgagcatcgtgagcagcgccctgaacagcagccagaatggagaggagcagcctgcccccatgagcagctccatgaggagcaacctggaccagaggacccccttccccatgaggcggctgcacaagaggaagcagagcgctgaggagcgggcccggcagaggctgcggcccagcattgatgagagcgccatcagtgatgtgaccccagaaaatggccccagcggcgtgcacagccgggaggagttcttctccccagacagcctgaagatcgtggacaaccccaaggcagatggcatgacagacaaccaggaggacagcgccatcatgtttgaccagagctttggcacccaggaggatgcccaggtgcccagccagagcgacaacagcgctggcaacatggcccagctgtccatggccagccgggccacccaggtggagaccagctttgaccaggaggccgcccctgagaagagcagcttccagtgtgaaaatcctgaggtgggcctgggggagaaggagcacatgagggtggtggtgaagtctgagcccctgagcagccctgagccccaggatgaggtgtctgatgtgaccagccaggccgagggcagcgagagcgtggaggtggagggcgtggtggtgtctgctgagaagattgacctgagccctgagagcagtgacaggagcttcagtgacccccagagcagcacagacagagtgggggacatccacatcctggaggtgaccaacaacctggagcacaagagcaccttcagcatcagcaacttcctgaacaagagccggggcaacaacttcaccgccaaccagaacaatgatgacaacatccccaacaccaccagtgactgccgcctggagagcgaggccccctacctgctgagccctgaggccggccctgctgggggccccagcagcgcccctggcagccacgtggagaaccccttcagcgagcctgctgacagccactttgtgcggcccatgcaggaggtgatgggcctgccctgtgtgcagaccagcggctaccagggcggggagcagtttggcatggacttcagccgcagcggcctgggcctgcacagcagcttcagccgggtgatgattggcagcccccggggcggggccagcaacttcccctactaccgccgcatcgcccccaagatgcctgtggtgacctctgtgcgcagcagccagatccctgagaacagcaccagcagccagctgatgatgaatggagccaccagcagctttgaaaatggccaccccagccagcccggccccccccagctgacccgggccagcgcagatgtgctgagcaagtgcaagaaggccctgtctgagcacaacgtgctggtggtggagggcgccaggaaatatgcctgcaagatctgctgcaagaccttcctgaccctgacagactgcaagaagcacatccgggtgcacactggagagaagccctatgcctgcctgaagtgtgggaagcgcttcagccagagcagccacctgtacaagcacagcaagaccacctgcctgcgctggcagagcagcaacctgcccagcaccctgctgtag

SEQ ID NO: 17535 - DNA, 1275 bp, Artificial Sequence
  Description of Artificial Sequence: Synthetic coding sequence
atggctgctgagagtgatgtgctgcacttccagtttgagcagcagggagatgtggtgctgcagaagatgaacctgctgcggcagcagaacctcttctgtgatgtgtccatctacatcaatgacacagagttccagggccacaaggtgatcctggccgcctgcagcaccttcatgagggaccagttcctgctgacccagagcaagcacgtgcgcatcaccatcctgcagagcgctgaggtgggcaggaagctgctgctgagctgctacaccggggccctggaggtgaagaggaaggagctgctgaagtacctgacagctgccagctacctgcagatggtgcacatcgtggagaagtgcacagaggccctgagcaagtacctggagattgacctgtccatgaagaacaacaaccagcacacagacctgtgccagagcagtgaccctgatgtgaagaatgaagatgaaaattctgacaaggactgtgagatcatcgagatcagcgaggacagccctgtgaacatcgacttccacgtgaaggaggaggagagcaatgccctgcagagcacagtggagagcctgaccagcgagaggaaggagatgaagagccctgagctgagcacagtggacatcggcttcaaggacaatgagatctgcatcctgcacgtggagagcatcagcacagctggggtggagaatggccagttcagccagccctgcaccagcagcaaggcctccatgtacttcagcgagacccagcacagcctcatcaacagcacagtggagagccgggtggccgaggtgcccggcaaccaggaccagggcctcttctgtgagaacacagagggcagctatggcaccgtgtctgagatccagaacctggaggagggctacagcctgcggcaccagtgcccccgctgcccccggggcttcctgcacgtggagaactacctgcggcacctgaagatgcacaagctgttcctgtgcctgcagtgtgggaagaccttcacccagaagaagaacctgaacagacacatccggggccacatgggcatccggcccttccagtgcaccgtgtgcctgaagaccttcaccgccaagagcaccctgcaggaccacctgaacatccacagcggggaccggccctacaagtgccactgctgtgacatggacttcaagcacaagagcgccctgaagaagcacctgacctctgtgcacggccgcagcagtggagagaagctgagcaggccagacctgaagaggcagagcctgctgtag

SEQ ID NO: 17536 - DNA, 1755 bp, Artificial Sequence
  Description of Artificial Sequence: Synthetic coding sequence
atggccggcggcgtggatggccccatcggcatccccttcccagaccacagcagtgacatcctgagcggcctgaatgagcagaggacccagggcctgctgtgtgatgtggtgatcctggtggagggccgggagttccccacccacaggtctgtgctggccgcctgcagccagtacttcaagaagctgttcaccagcggggctgtggtggaccagcagaatgtgtatgaaattgactttgtgtctgctgaggccctgacagccctgatggactttgcctacacagccaccctgactgtgtccacagccaacgtgggggacatcctgtctgctgcccggctgctggagatcccagctgtgagccacgtgtgtgccgacctgctggaccggcagatcctggccgcagatgctggagcagatgctggccagctggacctggtggaccagattgaccagaggaacctgctgcgggccaaggagtacctggagttcttccagagcaaccccatgaacagcctgcccccagctgctgctgctgctgctgccagcttcccctggagcgccttcggggccagtgatgatgacctggatgccaccaaggaggccgtggccgctgctgtggccgctgtggccgccggggactgcaatggcctggacttctacggccctggccccccagctgagcggcccccaactggagatggagatgaaggagacagcaaccctggcctgtggccagagagagatgaagatgcccccactggaggcctcttccccccacctgtggcccctcctgctgccacccagaatggccactacggccggggcggggaggaggaggccgccagcctgtctgaggccgcccctgagcccggggacagccctggcttcctgagcggggctgctgagggggaggatggagatggcccagatgtggatggcctggccgccagcaccctgctgcagcagatgatgagctctgtgggccgggccggggctgctgctggggacagtgatgaggagagcagagcagatgacaagggcgtgatggactactacctgaagtacttcagcggggcccatgatggagatgtgtacccagcctggagccagaaggtggagaagaagatccgggccaaggccttccagaagtgccccatctgtgagaaggtgatccagggcgctgggaagctgcccaggcacatccgcacccacactggagagaagccctatgagtgcaacatctgcaaggtgcgcttcacccggcaggacaagctgaaggtgcacatgaggaagcacactggagagaagccctacctgtgccagcagtgtggggccgcctttgcccacaactatgacctgaagaaccacatgagggtgcacacaggcctgcggccctaccagtgtgacagctgctgcaagacctttgtgcggagtgaccacctgcaccgccacctgaagaaggatggctgcaatggagtgcccagccggcggggcaggaagccccgggtgcggggcggggccccagaccccagccctggggccacagccacccctggggccccagcccagcccagcagcccagatgccaggagaaatggccaggagaagcacttcaaggatgaagatgaagatgaagatgtggccagcccagatggcctgggccgcctgaatgtggccggggccggcggcggcggggacagcggcggcggccctggagctgccacagatggcaacttcaccgctggcctggcctag

SEQ ID NO: 17537 - DNA, 1620 bp, Artificial Sequence
  Description of Artificial Sequence: Synthetic coding sequence
atgggcagcccagaagatgacctgattggcatccccttcccagaccacagcagcgagctgctgagctgcctgaatgagcagaggcagctgggccacctgtgtgacctgaccatccgcacccagggcctggagtaccgcacccacagagctgtgctggccgcctgcagccactacttcaagaagctgttcacagagggcggcggcggcgctgtgatgggcgctgggggcagcggcacagccactggaggagctggggccggcgtgtgtgagctggactttgtgggccctgaggccctgggcgccctgctggagtttgcctacacagccaccctgaccaccagcagcgccaacatgcctgctgtgctgcaggccgcccggctgctggagatcccctgtgtgattgctgcctgcatggagatcctgcagggcagcggcctggaggcccccagcccagatgaagatgactgtgagcgggcccggcagtacctggaggcctttgccacagccacagccagcggcgtgcccaacggggaggacagccccccccaggtgcccctgcccccacctcctcctcctccacccaggcctgtggcccggcgcagcaggaagcccaggaaggccttcctgcagaccaagggggcccgggccaaccacctggtgcctgaggtgcccaccgtgcctgcccaccccctgacctatgaggaggaggaggtggccggccgggtgggcagcagcggcggcagcggccctggggacagctacagcccccccaccggcacagccagccccccagagggcccccagagctatgagccctatgaaggagaggaggaggaggaggagctggtgtaccccccagcctacggcctggcccagggcggcggcccccccctgagccctgaggagctgggcagtgatgaagatgccatcgaccctgacctgatggcctacctgagcagcctgcaccaggacaacctggcccctggcctggacagccaggacaagctggtgaggaagaggaggagccagatgccccaggagtgccctgtgtgccacaagatcatccacggggccggcaagctgcccaggcacatgaggacccacactggagagaagccctttgcctgtgaggtgtgtggggtgcgcttcaccagaaatgacaagctgaagatccacatgaggaagcacactggagagcggccctacagctgcccccactgcccagcccgcttcctgcacagctatgacctgaagaaccacatgcacctgcacactggagaccggccctatgagtgccacctgtgccacaaggcctttgccaaggaggaccacctgcagaggcacctgaagggccagaactgcctggaggtgaggaccaggagaagaaggaaggatgatgccccaccccactaccccccacccagcacagctgctgccagccctgctggcctggacctgagcaatggccacctggacaccttccggctgagcctggcccgcttctgggagcagagcgcccccaccggcccccctgtgtccaccccaggccccccagatgatgatgaggaggagggcgcccccaccaccccccaggccgagggcgccatggagagcagctag

SEQ ID NO: 17538 - DNA, 1620 bp, Artificial Sequence; identical to SEQ ID NO: 17537
  Description of Artificial Sequence: Synthetic coding sequence

SEQ ID NO: 17539 - DNA, 1722 bp, Artificial Sequence
  Description of Artificial Sequence: Synthetic coding sequence
atgctgcagcccggcccccacccccccagcccccaggccgccgcccctggagaggcctggccaggccccagccaggccccctggcagagcctggaggagaagatgggcagcccagaagatgacctgattggcatccccttcccagaccacagcagcgagctgctgagctgcctgaatgagcagaggcagctgggccacctgtgtgacctgaccatccgcacccagggcctggagtaccgcacccacagagctgtgctggccgcctgcagccactacttcaagaagctgttcacagagggcggcggcggcgctgtgatgggcgctgggggcagcggcacagccactggaggagctggggccggcgtgtgtgagctggactttgtgggccctgaggccctgggcgccctgctggagtttgcctacacagccaccctgaccaccagcagcgccaacatgcctgctgtgctgcaggccgcccggctgctggagatcccctgtgtgattgctgcctgcatggagatcctgcagggcagcggcctggaggcccccagcccagatgaagatgactgtgagcgggcccggcagtacctggaggcctttgccacagccacagccagcggcgtgcccaacggggaggacagccccccccaggtgcccctgcccccacctcctcctcctccacccaggcctgtggcccggcgcagcaggaagcccaggaaggccttcctgcagaccaagggggcccgggccaaccacctggtgcctgaggtgcccaccgtgcctgcccaccccctgacctatgaggaggaggaggtggccggccgggtgggcagcagcggcggcagcggccctggggacagctacagcccccccaccggcacagccagccccccagagggcccccagagctatgagccctatgaaggagaggaggaggaggaggagctggtgtaccccccagcctacggcctggcccagggcggcggcccccccctgagccctgaggagctgggcagtgatgaagatgccatcgaccctgacctgatggcctacctgagcagcctgcaccaggacaacctggcccctggcctggacagccaggacaagctggtgaggaagaggaggagccagatgccccaggagtgccctgtgtgccacaagatcatccacggggccggcaagctgcccaggcacatgaggacccacactggagagaagccctttgcctgtgaggtgtgtggggtgcgcttcaccagaaatgacaagctgaagatccacatgaggaagcacactggagagcggccctacagctgcccccactgcccagcccgcttcctgcacagctatgacctgaagaaccacatgcacctgcacactggagaccggccctatgagtgccacctgtgccacaaggcctttgccaaggaggaccacctgcagaggcacctgaagggccagaactgcctggaggtgaggaccaggagaagaaggaaggatgatgccccaccccactaccccccacccagcacagctgctgccagccctgctggcctggacctgagcaatggccacctggacaccttccggctgagcctggcccgcttctgggagcagagcgcccccaccggcccccctgtgtccaccccaggccccccagatgatgatgaggaggagggcgcccccaccaccccccaggccgagggcgccatggagagcagctag

SEQ ID NO: 17540 - DNA, 1620 bp, Artificial Sequence; identical to SEQ ID NO: 17537
  Description of Artificial Sequence: Synthetic coding sequence

SEQ ID NO: 17541 - DNA, 1023 bp, Artificial Sequence
  Description of Artificial Sequence: Synthetic coding sequence
atggagatcagcagccaccagagccacctgctgcagcagctgaatgagcagaggcggcaggatgtgttctgtgactgcagcatcctggtggagggcaaggtgttcaaggcccacagaaatgtgctgtttgccagcagcggctacttcaagatgctgctgagccagaacagcaaggagaccagccagcccaccacagccaccttccaggccttctccccagacaccttcaccgtcatcctggactttgtgtacagcggcaagctgagcctgaccggccagaatgtcatcgaggtgatgtctgctgccagcttcctgcagatgacagatgtgatctctgtgtgcaagaccttcatcaagagcagcctggacatcagcgagaaggagaaggaccgctacttcagcctgagtgacaaggatgccaacagcaatggagtggagaggagcagcttctacagcggcggctggcaggagggcagcagcagccccaggagccacctgagccctgagcagggcaccggcatcatcagcggcaagtcctggaacaagtacaactaccacccagccagccagaagaacacccagcagcccctggccaagcatgagcccaggaaggagagcatcaagaagaccaagcacctgcggctgagccagcccagcgaggtgacccactacaagagcagcaagcgggaggtgaggaccagtgacagcagcagccacgtgtcccagagcgaggagcaggcccagattgatgctgagatggacagcacccctgtgggctaccagtatggccagggcagtgatgtgaccagcaagagcttcccagatgacctgcccaggatgaggttcaagtgcccctactgcacccacgtggtgaagaggaaggctgacctgaagaggcacctgcgctgccacactggagagcggccctacccctgccaggcctgtgggaagcgcttcagccggctggaccacctgagcagccacttccgcaccatggagatccgcatcccagatggcacctag

SEQ ID NO: 17542 - DNA, 1326 bp, Artificial Sequence
  Description of Artificial Sequence: Synthetic coding sequence
atggagatcagcagccaccagagccacctgctgcagcagctgaatgagcagaggcggcaggatgtgttctgtgactgcagcatcctggtggagggcaaggtgttcaaggcccacagaaatgtgctgtttgccagcagcggctacttcaagatgctgctgagccagaacagcaaggagaccagccagcccaccacagccaccttccaggccttctccccagacaccttcaccgtcatcctggactttgtgtacagcggcaagctgagcctgaccggccagaatgtcatcgaggtgatgtctgctgccagcttcctgcagatgacagatgtgatctctgtgtgcaagaccttcatcaagagcagcctggacatcagcgagaaggagaaggaccgctacttcagcctgagtgacaaggatgccaacagcaatggagtggagaggagcagcttctacagcggcggctggcaggagggcagcagcagccccaggagccacctgagccctgagcagggcaccggcatcatcagcggcaagtcctggaacaagtacaactaccacccagccagccagaagaacacccagcagcccctggccaagcatgagcccaggaaggagagcatcaagaagaccaagcacctgcggctgagccagcccagcgaggtgacccactacaagagcagcaagcgggaggtgaggaccagtgacagcagcagccacgtgtcccagagcgaggagcaggcccagattgatgctgagatggacagcacccctgtgggctaccagtatggccagggcagtgatgtgaccagcaagagcttcccagatgacctgcccaggatgaggttcaagtgcccctactgcacccacgtggtgaagaggaaggctgacctgaagaggcacctgcgctgccacactggagagcggccctacccctgccaggcctgtgggaagcgcttcagccggctggaccacctgagcagccacttccgcaccatccaccaggcctgcaagctgatctgcaggaagtgcaagagacatgtgacagacctgaccggccaggtggtgcaggagggcacccggcgctaccgcctgtgcaatgaatgtctggccgagtttggcatcgacagcctgcccatcgacctggaggccgagcagcacctgatgagccccagtgatggagacaaggacagccgctggcacctgtctgaagatgaaaatagaagctatgtggagatcgtggaggatggcagcggggacctggtgatccagcaggtggatgacagcgaggaggaggaggagaaggagatcaagcccaacatcagatag

SEQ ID NO: 17543 - DNA, 1488 bp, Artificial Sequence
  Description of Artificial Sequence: Synthetic coding sequence
atggagatgcagagctactatgccaagctgctgggggagctgaatgagcagaggaagagggacttcttctgtgactgcagcatcatcgtggagggccgcatcttcaaggcccacaggaacatcctgtttgccaacagcggctacttccgggccctgctgatccactacatccaggacagcggccgccacagcacagccagcctggacatcgtgaccagtgatgccttcagcatcatcctggacttcctgtacagcggcaagctggacctgtgtggagaaaatgtcatcgaggtgatgtctgctgccagctacctgcagatgaatgatgtggtgaacttctgcaagacctacatccgcagcagcctggacatctgcaggaagatggagaaggaggccgctgtggccgctgctgtggccgctgctgctgctgctgctgctgctgctgctgctgctgctgcccaccaggtggacagcgagagccccagcagcggccgggagggcaccagctgtggcaccaagagcctggtgagcagccctgctgagggggagaagtctgtggagtgcctgcgggagagcccctgtggggactgtggggactgccaccccctggagctggtggtgcgggacagcctgggcggcggcagcgctgacagcaacctgagcaccccacccaagagaattgagcccaaggtggagtttgatgctgatgaggtggaggtggatgtgggggagcagctgcagcagtatgctgcccccctgaacctggcccacgtggaggaggccctgcccagcggccaggccgtggacctggcctacagcaactaccacgtgaagcagttcctggaggccctgctgaggaacagcgctgcccccagcaaggatgatgctgaccaccacttcagccgcagcctggagggccggcctgagggcgccggcgtggccatgagctccatgatggatgtgcaggccgactggtacggggaggacagcggagatgtgctggtggtgcccatcaagctgcacaagtgccccttctgcccctacacagccaagcagaagggcatcctgaagaggcacatccgcagccacactggagagcggccctacccctgtgagacctgtgggaagcgcttcacccggcaggagcacctgcggagccacgccctgtctgtgcacaggagcaaccggcccatcatctgcaagggctgcaggaggaccttcaccagccacctgagccagggcctgcggcgcttcggcctgtgtgacagctgcacctgtgtgacagacaccccagatgatgatgatgacctgatgcccatcaacctgagcctggtggaggccagcagcgagagccaggagaagagtgacacagacaatgactggcccatctacgtggagagcggggaggagaatgaccctgctggagatgacagtgatgacaagccccagatccagcccaacctgagtgaccgggagaccctgacctag

SEQ ID NO: 17544 - DNA, 1422 bp, Artificial Sequence
  Description of Artificial Sequence: Synthetic coding sequence
atggagacccccacccccctgccccctgtgcctgccagccccacctgcaacccagcccccaggaccatccagatcgagttcccccagcacagcagcagcctgctggagagcctgaacagacaccggctggagggcaagttctgtgatgtgtccctgctggtgcagggccgggagctgcgggcccacaaggctgtgctggccgccgccagcccctacttccatgacaagctgctgctgggagatgccccccggctgaccctgcccagcgtgattgaagcagatgcctttgagggcctgctgcagctgatctacagcggccgcctgcggctgcccctggatgccctgcctgcccacctgctggtggccagcggcctgcagatgtggcaggtggtggaccagtgcagcgagatcctgcgggagctggagaccagcggcggcggcatcagcgcccggggcggcaacagctaccacgccctgctgagcaccaccagcagcactggaggctggtgcatccgcagcagccccttccagacccctgtgcagagcagcgccagcacagagagccctgccagcacagagagccctgtgggcggggagggcagcgagctgggggaggtgctgcagatccaggtggaggaggaggaggaggaggaggaggatgatgatgatgaggaccagggcagcgccaccctgagccagaccccccagccccagagggtgtctggagtcttcccccggccccacggcccccaccccctgcccatgacagccacccccaggaagctgcctgagggggagagcgcccccctggagctgcctgcccccccagccctgccccccaagatcttctacatcaagcaggagccctttgagcccaaggaggagatcagcggcagcggcacccagcctggaggagccaaggaggagaccaaggtgttcagcggcggggacacagagggcaatggagagctgggcttcctgctgcccagcggccctggccccaccagcggcggcggcggccccagctggaagcctgtggacctgcatggaaatgagatcctgagcggcggcggcggccctgggggcgccggccaggccgtgcacggccctgtgaagctgggcggcaccccaccagcagatggcaagcgcttcggctgcctgtgtgggaagagatttgctgtgaagcccaagagggacagacacatcatgctgaccttcagcctgcggcccttcggctgcggcatctgcaacaagcgcttcaagctgaagcaccacctgacagagcacatgaagacccacgccggggccctgcacgcctgcccccactgcggccgccgcttccgggtgcacgcctgcttcctgcggcaccgggacctgtgcaagggccagggctgggccacagcccactggacctacaagtag

SEQ ID NO: 17545 - DNA, 1422 bp, Artificial Sequence; identical to SEQ ID NO: 17544
  Description of Artificial Sequence: Synthetic coding sequence

SEQ ID NO: 17546 - DNA, 1227 bp, Artificial Sequence
  Description of Artificial Sequence: Synthetic coding sequence
atgctgccccggcccaaggccccagccagcccccggcggccccagacccccacccccagcgagcaggatgctgaccccggccctgccagcccccgggacacagaggcccagaggctgcgcttccggcagttccagtaccacgtggccagcggcccccacctggccctgggccagctgtggaccctgtgccggcagtggctgcggcctgaggcccggagcaaggagcagatgctggagctgctggtgctggagcagttcctgggcgccctgcccagcaagatgaggacctgggtgcagagccagggccccaggagctgccgggaggccgccagcctggtggaggacctgacccagatgtgccagcaggaggtgctggtgtccctggacagcgtggagccccaggactggagctttggagaggaggaggatggcaagagccccaggagccagaaggagcccagccaggccagcgagctgatcctggatgctgtggccgccgccccagccctgcctgaggagagcgagtggctggagaccacccagctgcagcagagcctgcacaccagggctgaggccgaggccccccgggcccctggcctgctgggcagccgggcccggctgcccctgaagcccagcatctgggatgagcctgaggacctgctggccggccccagcagtgacctgcgggcagagggcaccgtcatcagcagccccaagggccccagcgcccagaggatcagccccaggagaagaaacagaaacacagaccagagcggccgccaccagcccagcctgaagcacaccaagggcggcacccaggaggccgtggccggcatctctgtggtgccccggggcccccggggcggccggcccttccagtgtgccgactgtggcatggtgttcacctgggtgacccacttcatcgagcaccagaagacccaccgggaggagggccccttcccctgcccagaatgtgggaaggtgttcctgcacaacagcgtgctgacagagcacggcaagatccacctgctggagccccccaggaagaaggcccccaggagcaagggcccccgggagagcgtgcccccaagagatggagcccagggccctgtggcccccaggagccccaagaggcccttccagtgcagcgtgtgtgggaaggccttcccctggatggtgcacctgattgaccaccagaagctgcacacagcccacggccacatgtag

SEQ ID NO: 17547 - DNA, 537 bp, Artificial Sequence
  Description of Artificial Sequence: Synthetic coding sequence
atgctgccccggcccaaggccccagccagcccccggcggccccagacccccacccccagcgagcaggatgctgaccccggccctgccagcccccgggacacagaggcccagaggctgcgcttccggcagttccagtaccacgtggccagcggcccccacctggccctgggccagctgtggaccctgtgccggcagtggctgcggcctgaggcccggagcaaggagcagatgctggagctgctggtgctggagcagttcctgggcgccctgcccagcaagatgaggacctgggtgcagagccagggccccaggagctgccgggaggccgccagcctggtggaggacctgacccagatgtgccagcaggagggggagcggcggcggctgcctgcccctggccgggcccggggcccagatgtgtctgaggacagaacagccctgctgcctgcccacatcgcccccaccccagcccggcccctgcccaccagcaagcccctgctgccccggggctgtgtgttcaactacttctacatctag

SEQ ID NO: 17548 - DNA, 2178 bp, Artificial Sequence
  Description of Artificial Sequence: Synthetic coding sequence
atgggcccccgggccagcctgagccggctgcgggagctgtgtggccactggctgcggcctgccctgcacaccaagaagcagatcctggagctgctggtgctggagcagttcctgtctgtgctgcccccccacctgctgggccgcctgcagggccagcccctgagagatggagaggaggtggtgctgctgctggagggcatccaccgggagcccagccacgccggccccctggacttcagctgcaatgccggcaagagctgccccagggcagatgtgaccctggaggagaagggctgtgccagccaggtgcccagccacagccccaagaaggagctgcctgctgaggagcccagcgtgctgggccccagtgatgagcccccccggccccagcccagggctgcccagcctgctgagcccggccagtggaggctgccccccagcagcaagcagcccctgagccctggcccccagaagaccttccaggccctgcaggagagcagcccccagggccccagcccctggccagaggagagcagccgggaccaggagctggccgctgtgctggagtgcctgacctttgaagatgtgcctgagaacaaggcctggccagcccaccccctgggcttcggcagcaggaccccagacaaggaggagttcaagcaggaggagcccaagggagctgcctggcccacccccatcctggccgagagccaggccgacagccctggggtgcctggagagccctgtgcccagagcctgggcagaggagctgctgccagcggccctggagaagatggcagcctgctgggcagcagcgagatcctggaggtgaaggtggccgagggcgtgcctgagcccaaccctgagctgcagttcatctgtgccgactgtggggtgtccttcccccagctgagccggctgaaggcccaccagctgcggagccaccctgctggccgctccttcctgtgcctgtgctgcggcaagagctttggccgcagcagcatcctgaagctgcacatgaggacccacacagatgagcggccccacgcctgccacctgtgtggccaccgcttccggcagagcagccacctgagcaagcacctgctgacccacagcagcgagcccgccttcctgtgtgctgaatgtggccggggcttccagaggcgggccagcctggtgcagcacctgctggcccacgcccaggaccagaagccaccctgtgcccctgagagcaaggccgaggccccacccctgacagatgtgctgtgcagccactgcggccagagcttccagaggaggagcagcctgaagaggcacctgcgcatccacgcccgggacaaggacagaagaagcagcgagggcagcggcagcagaagaagagacagcgaccggcggccctttgtgtgcagcgactgtgggaaggccttcagaagaagtgagcacctggtggcccaccggcgggtgcacactggagagcggcccttcagctgccaggcctgtggccgctccttcacccagagcagccagctggtgagccaccagagggtgcacactggagagaagccctatgcctgcccccagtgtgggaagagatttgtgcggcgggccagcctggcccggcacctgctgacccatggaggcccccggccccaccactgcacccagtgtgggaagagctttggccagacccaggacctggcccggcaccagaggagccacactggagagaagccctgccgctgcagtgaatgtggggagggcttcagccagagcgcccacctggcccggcaccagaggatccacactggagagaagccccacgcctgtgacacctgtggccaccgcttcaggaacagcagcaacctggcccggcaccggcgcagccacactggagagcggccctacagctgccagacctgtggccgctccttcagaagaaatgcccacctgcggcggcacctggccacccacgccgagcccggccaggagcaggccgagcccccccaggagtgtgtggagtgtgggaagagcttcagccgcagctgcaacctgctgcggcacctgctggtgcacactggagcccggccctacagctgcacccagtgtggccgctccttcagcaggaacagccacctgctgcggcacctgcggacccacgcccgggagaccctgtactag

SEQ ID NO: 17549 - DNA, 1977 bp, Artificial Sequence
  Description of Artificial Sequence: Synthetic coding sequence
accagggtgcaggccgaggcccggggcggcagccctgctgtgcagatgctgcctgtgtctgggggccatggagccaccggggtgcctgagcccgcccctggggccctgcggcccctggccgccgccggcagcgcccaccaggagacagatcctggagctgctggggccggggctgtgcctgaatgtgccgccagcgcccctcctggccccccagctggagctgctgcccagggctggggcggcggcggcgctgctgcccggggccaccccccaggggcccagcccagaggagctgctggcccccagggccccagcccctggccagaggagagcagccgggaccaggagctggccgctgtgctggagtgcctgacctttgaagatgtgcctgagaacaaggcctggccagcccaccccctgggcttcggcagcaggaccccagacaaggaggagttcaagcaggaggagcccaagggggccgcctggcccacccccatcctggccgagagccaggccgacagccctggggtgcctggagagccctgtgcccagagcctgggccgcggggctgctgccagcggccctggagaagatggcagcctgctgggcagcagcgagatcctggaggtgaaggtggccgagggcgtgcctgagcccaaccctgagctgcagttcatctgtgccgactgtggggtgtccttcccccagctgagccggctgaaggcccaccagctgcggagccaccctgctggccgctccttcctgtgcctgtgctgcggcaagagctttggccgcagcagcatcctgaagctgcacatgaggacccacacagatgagcggccccacgcctgccacctgtgtggccaccgcttccggcagagcagccacctgagcaagcacctgctgacccacagcagcgagcccgccttcctgtgtgccgagtgtggccggggcttccagaggcgggccagcctggtgcagcacctgctggcccacgcccaggaccagaagccaccctgtgcccctgagagcaaggccgaggccccacccctgacagatgtgctgtgcagccactgcggccagagcttccagaggaggagcagcctgaagaggcacctgcgcatccacgcccgggacaaggaccggcgcagcagcgagggcagcggcagcagaagaagagacagcgacagaagaccatttgtgtgcagcgactgtgggaaggccttccgccgctctgagcacctggtggcccacagaagagtgcacactggagagcggcccttcagctgccaggcctgtggccgctccttcacccagagcagccagctggtgagccaccagagggtgcacactggagagaagccctatgcctgcccccagtgtgggaagagatttgtgagaagagccagcctggcccggcacctgctgacccacggcggcccccggccccaccactgcacccagtgtgggaagagctttggccagacccaggacctggcccggcaccagaggagccacactggagagaagccctgccgctgcagtgaatgtggggagggcttcagccagagcgcccacctggcccggcaccagaggatccacactggagagaagccccacgcctgtgacacctgtggccaccgcttcaggaacagcagcaacctggcccggcacagaagaagccacactggagagcggccctacagctgccagacctgtggccgctccttcagaagaaatgcccacctgcggcggcacctggccacccatgctgagcccggccaggagcaggccgagcccccccaggagtgtgtggagtgtgggaagagcttcagccgcagctgcaacctgctgcggcacctgctggtgcacactggagcccggccctacagctgcacccagtgtggccgctccttcagcaggaacagccacctgctgcggcacctgcggacccacgcccgggagaccctgtactag

SEQ ID NO: 17550 - DNA, 1047 bp, Artificial Sequence
  Description of Artificial Sequence: Synthetic coding sequence
atgaccacagccctggagcctgaggaccagaagggcctgctgatcatcaaggccgaggaccactactggggccaggacagcagcagccagaagtgcagcccccaccggcgggagctgtaccggcagcacttcaggaagctgtgctaccaggatgcccctggcccccgggaggccctgacccagctgtgggagctgtgccggcagtggctgcggcctgagtgccacaccaaggagcagatcctggacctgctggtgctggagcagttcctgagcatcctgcccaaggacctgcaggcctgggtgcgggcccaccaccctgagaccggggaggaggccgtgacagtgctggaggacctggagcgggagctggatgagcccgggaagcaggtgcccggcaacagcgagcggcgggacatcctgatggacaagctggcccccctgggccggccctatgagagcctgactgtgcagctgcaccccaagaagacccagctggagcaggaggccggcaagccccagagaaatggagacaagaccaggaccaagaatgaggagctgttccagaaggaggacatgcccaaggacaaggagttcctgggggagatcaatgaccggctgaacaaggacaccccccagcaccccaagagcaaggacatcattgaaaatgaaggccgctctgagtggcagcagcgggagcggcggcgctacaagtgtgatgaatgtgggaagagcttcagccacagcagtgacctgagcaagcacaggaggacccacactggagagaagccctacaagtgtgatgaatgtgggaaggccttcatccagaggagccacctgattggccaccaccgggtgcacactggagtgaagccctacaagtgcaaggaatgtgggaaggacttcagcggccgcacaggcctcatccagcaccagaggatccacactggagagaagccctatgaatgtgatgaatgtggccggcccttccgggtgtcctctgccctgatccgccaccagaggatccacacagccaacaagctgtactag

SEQ ID NO: 17551 - DNA, 1533 bp, Artificial Sequence
  Description of Artificial Sequence: Synthetic coding sequence
atgctgcccctggagaaggcctttgccagccccaggagcagccctgcccccccagacctgcccaccccaggcagcgctgctggggtgcagcaggaggagcctgagaccatccctgagaggaccccagctgacctggagttcagccggctgcgcttccgggagtttgtgtaccaggaggccgccggcccccaccagaccctggcccggctgcacgagctgtgccggcagtggctgatgcctgaggcccggagcaaggagcagatgctggagctgctggtgctggagcagttcctgggcatcctgcctgacaaggtgcggccctgggtggtggcccagtacccagagagctgcaagaaggccgccagcctggtggagggcctggctgatgtgctggaggagcccggcatgctgctgggcagccctgctggcagcagcagcatcctgagtgatggagtgtatgagcggcacatggaccccctgctgctgcctggagagctggccagccccagccaggccctgggcgctggggagatcccagcccccagcgagaccccctggctgagcccagaccccctcttcctggagcagaggagagtgcgggaggccaagacagaggaggatggccctgccaacacagagcagaagctgaagagcttccctgaggacccccagcacctgggggagtggggccacctggaccctgctgaggagaacctgaagagctacaggaagctgctgctgtggggctaccagctgagccagccagatgctgccagccggctggacacagaggagctgcggctggtggagcgggacccccagggcagcagcctgcctgagggcggccggcggcaggagagcgctggctgtgcctgtgaggaggccgccccagctggggtgctgcctgagctgcccacagaggcccctcctggagatgccctggccgaccccccatctggcaccacagaggaggaggaggagcagcccgggaaggccccagacccccaggacccccaggatgctgagagtgacagcgccaccggcagccagaggcagagcgtcatccagcagcctgccccagaccggggcacagccaagctgggcaccaagaggccccacccagaagatggagatggccagagcctggagggcgtgagcagcagcggggacagcgctggcctggaggccggccagggccctggagcagatgagcccggcctgagccggggcaagccctatgcctgtggagaatgtggggaggcctttgcctggctgagccacctgatggagcaccacagcagccatggaggcaggaagagatatgcctgccagggctgctggaagaccttccacttcagcctggccctggccgagcaccagaagacccatgagaaggagaagagctatgccctgggcggggcccggggcccccagcccagcacccgggaggcccaggccggggcccgggccggcggccccccagagagcgtggagggggaggcccccccagcccctcctgaggcccagaggtag

SEQ ID NO: 17552 - DNA, 1125 bp, Artificial Sequence
  Description of Artificial Sequence: Synthetic coding sequence
atgctgctgggcagccctgctggcagcagcagcatcctgagtgatggagtgtatgaaagacacatggaccccctgctgctgcccggggagctggccagccccagccaggccctgggcgctggggagatcccagcccccagcgagaccccctggctgagcccagaccccctcttcctggagcagaggagagtgcgggaggccaagacagaagaagatggccctgccaacacagagcagaagctgaagagcttccctgaggacccccagcacctgggggagtggggccacctggaccctgctgaggagaacctgaagagctacaggaagctgctgctgtggggctaccagctgagccagccagatgctgccagccggctggacacagaggagctgcggctggtggagcgggacccccagggcagcagcctgcccggcggccggcggcaggagagcgctggctgtgcctgtgaggaggccgccccagctggggtgctgcctgagctgcccacagaggcccctcctggagatgccctggccgaccccccatctggcaccacagaggaggaggaggagcagcccgggaaggccccagacccccaggacccccaggatgctgagagtgacagcgccaccggcagccagaggcagagcgtcatccagcagcctgccccagaccggggcacagccaagctgggcaccaagaggccccacccagaagatggagatggccagagcctggagggcgtgagcagcagcggggacagcgctggcctggaggccggccagggccctggagcagatgagcccggcctgagccggggcaagccctatgcctgtggagaatgtggggaggcctttgcctggctgagccacctgatggagcaccacagcagccatggaggcaggaagagatatgcctgccagggctgctggaagaccttccacttcagcctggccctggccgagcaccagaagacccatgagaaggagaagagctatgccctgggcggggcccggggcccccagcccagcacccgggaggcccaggccggggcccgggccggcggccccccagagagcgtggagggggaggcccccccagcccctcctgaggcccagaggtag

SEQ ID NO: 17553 - DNA, 1701 bp, Artificial Sequence
  Description of Artificial Sequence: Synthetic coding sequence
atgagaagagtgggcggccgggcagatgaagatgccacagctgctggcagcctgtgggtgctggcccctcctgagcccaccggccacctggtgattcctggcaccagccccctggagcccccctgcccctggctggacagccacatcttccagtgccgctttgggaagatgctgcccctggagaaggcctttgccagccccaggagcagccctgcccccccagacctgcccaccccaggcagcgctgctggggtgcagcaggaggagcctgagaccatccctgagaggaccccagctgacctggagttcagccggctgcgcttccgggagtttgtgtaccaggaggccgccggcccccaccagaccctggcccggctgcacgagctgtgccggcagtggctgatgcctgaggcccggagcaaggagcagatgctggagctgctggtgctggagcagttcctgggcatcctgcctgacaaggtgcggccctgggtggtggcccagtacccagagagctgcaagaaggccgccagcctggtggagggcctggctgatgtgctggaggagcccggcatgctgctgggcagccctgctggcagcagcagcatcctgagtgatggagtgtatgagcggcacatggaccccctgctgctgcctggagagctggccagccccagccaggccctgggcgctggggagatcccagcccccagcgagaccccctggctgagcccagaccccctcttcctggagcagaggagagtgcgggaggccaagacagaggaggatggccctgccaacacagagcagaagctgaagagcttccctgaggacccccagcacctgggggagtggggccacctggaccctgctgaggagaacctgaagagctacaggaagctgctgctgtggggctaccagctgagccagccagatgctgccagccggctggacacagaggagctgcggctggtggagcgggacccccagggcagcagcctgcctgagggcggccggcggcaggagagcgctggctgtgcctgtgaggaggccgccccagctggggtgctgcctgagctgcccacagaggcccctcctggagatgccctggccgaccccccatctggcaccacagaggaggaggaggagcagcccgggaaggccccagacccccaggacccccaggatgctgagagtgacagcgccaccggcagccagaggcagagcgtcatccagcagcctgccccagaccggggcacagccaagctgggcaccaagaggccccacccagaagatggagatggccagagcctggagggcgtgagcagcagcggggacagcgctggcctggaggccggccagggccctggagcagatgagcccggcctgagccggggcaagccctatgcctgtggagaatgtggggaggcctttgcctggctgagccacctgatggagcaccacagcagccatggaggcaggaagagatatgcctgccagggctgctggaagaccttccacttcagcctggccctggccgagcaccagaagacccatgagaaggagaagagctatgccctgggcggggcccggggcccccagcccagcacccgggaggcccaggccggggcccgggccggcggccccccagagagcgtggagggggaggcccccccagcccctcctgaggcccagaggtag

SEQ ID NO: 17554 - DNA, 1701 bp, Artificial Sequence; identical to SEQ ID NO: 17553
  Description of Artificial Sequence: Synthetic coding sequence

SEQ ID NO: 17555 - DNA, 453 bp, Artificial Sequence
  Description of Artificial Sequence: Synthetic coding sequence
atgatggctgctgacatcccccgggtgaccacccccctgagcagcctggtgcaggtgccccaggaggaggaccggcaggaggaggaggtgaccaccatgatcctggaggatgacagctgggtgcaggaggccgtgctgcaggaggatggccctgagagcgagcccttcccccagagcgctgggaagggcggcccccaggaggaggtgacccggggcccccagggcgccctgggccgcctgcgggagctgtgccgccgctggctgcggcctgaggtgcacaccaaggagcagatgctgaccatgctgcccaaggagatccaggcctggctgcaggagcacaggcctgagagcagcgaggaggccgccgccctggtggaggacctgacccagaccctgcaggacagcgctgtggccgtggtggccagcctgcctgtggaggtgaccagcctgtag

SEQ ID NO: 17556 - DNA, 1788 bp, Artificial Sequence
  Description of Artificial Sequence: Synthetic coding sequence
atgatggctgctgacatcccccgggtgaccacccccctgagcagcctggtgcaggtgccccaggaggaggaccggcaggaggaggaggtgaccaccatgatcctggaggatgacagctgggtgcaggaggccgtgctgcaggaggaggtgacccggggcccccagggcgccctgggccgcctgcgggagctgtgccgccgctggctgcggcctgaggtgcacaccaaggagcagatgctgaccatgctgcccaaggagatccaggcctggctgcaggagcacaggcctgagagcagcgaggaggccgccgccctggtggaggacctgacccagaccctgcaggacagcgactttgagatccagagtgaaaatggagagaactgcaaccaggacatgtttgaaaatgaaagcaggaagatcttcagcgagatgcctgagggggagagcgcccagcacagtgatggagagagtgactttgaaagagatgctggcatccagaggctgcagggccacagccctggagaagatcatggagaggtggtgtcccaggaccgggaggtgggccagctgattggcctgcagggcacctacctgggggagaagccctatgagtgcccccagtgtgggaagaccttcagcaggaagagccacctgatcacccatgagaggacccacactggagagaagtactacaagtgtgatgaatgtgggaagagcttcagtgatggcagcaacttcagccgccaccagaccacccacactggagagaagccctacaagtgccgggactgtgggaagagcttcagccgcagcgccaacctgatcacccaccagaggatccacactggagagaagcccttccagtgtgctgaatgtgggaagagcttcagccgcagccccaacctgattgcccaccagaggacccacactggagagaagccctacagctgcccagaatgtgggaagagctttggaaacagaagcagcctgaacacccaccagggcatccacactggagagaagccctatgagtgcaaggaatgtggggagagcttctcctacaacagcaacctgatccgccaccagaggatccacactggagagaagccctacaagtgcacagactgtggccagcgcttcagccagagcagcgccctgatcacccacaggaggacccacactggagagaagccctaccagtgcagtgaatgtgggaagagcttcagccgcagcagcaacctggccacccacaggaggacccacatggtggagaagccctacaagtgtggggtgtgtgggaagagcttcagccagagcagcagcctgattgcccaccagggcatgcacactggagagaagccctatgagtgcctgacctgtggggagagcttctcctggagcagcaacctgctgaagcaccagaggatccacactggagagaagccctacaagtgcagtgaatgtgggaagtgcttcagccagaggagccagctggtggtgcaccagaggacccacactggagagaagccctacaagtgcctgatgtgtgggaagagcttcagccggggcagcatcctggtgatgcaccagagggcccacctgggggacaagccctaccgctgcccagaatgtgggaagggcttctcctggaacagcgtgctgatcatccaccagaggatccacactggagagaagccctacaagtgcccagaatgtgggaagggcttcagcaacagcagcaacttcatcacccaccagaggacccacatgaaggagaagctgtactag

SEQ ID NO: 17557 - DNA, 441 bp, Artificial Sequence
  Description of Artificial Sequence: Synthetic coding sequence
atgatggctgctgacatcccccgggtgaccacccccctgagcagcctggtgcaggtgccccaggaggaggaccggcaggaggaggaggtgaccaccatgatcctggaggatgacagctgggtgcaggaggccgtgctgcaggaggatggccctgagagcgagcccttcccccagagcgctgggaagggcggcccccaggaggaggtgacccggggcccccagggcgccctgggccgcctgcgggagctgtgccgccgctggctgcggcctgaggtgcacaccaaggagcagatgctgaccatgctgcccaaggagatccaggcctggctgcaggagcacaggcctgagagcagcgaggaggccgccgccctggtggaggacctgacccagaccctgcaggacagcgagacagccagctgtgtgcacggctgccctgtgtag

SEQ ID NO: 17558 - DNA, 99 bp, Artificial Sequence
  Description of Artificial Sequence: Synthetic coding sequence
atgatggctgctgacatcccccgggtgaccacccccctgagcagcctggtgcaggtgccccaggaggaggaccggcaggaggaggaggtgaccacctag

SEQ ID NO: 17559 - DNA, 1845 bp, Artificial Sequence
  Description of Artificial Sequence: Synthetic coding sequence
atgatggctgctgacatcccccgggtgaccacccccctgagcagcctggtgcaggtgccccaggaggaggaccggcaggaggaggaggtgaccaccatgatcctggaggatgacagctgggtgcaggaggccgtgctgcaggaggatggccctgagagcgagcccttcccccagagcgctgggaagggcggcccccaggaggaggtgacccggggcccccagggcgccctgggccgcctgcgggagctgtgccgccgctggctgcggcctgaggtgcacaccaaggagcagatgctgaccatgctgcccaaggagatccaggcctggctgcaggagcacaggcctgagagcagcgaggaggccgccgccctggtggaggacctgacccagaccctgcaggacagcgactttgagatccagagtgaaaatggagagaactgcaaccaggacatgtttgaaaatgaaagcaggaagatcttcagcgagatgcctgagggggagagcgcccagcacagtgatggagagagtgactttgaaagagatgctggcatccagaggctgcagggccacagccctggagaggaccacggggaggtggtgtcccaggaccgggaggtgggccagctgattggcctgcagggcacctacctgggggagaagccctatgaatgtccccagtgtgggaagaccttcagcaggaagagccacctgatcacccatgagaggacccacactggagagaagtactacaagtgtgatgaatgtgggaagagcttcagtgatggcagcaacttcagccgccaccagaccacccacactggagagaagccctacaagtgccgggactgtgggaagagcttcagccgcagcgccaacctgatcacccaccagaggatccacactggagagaagcccttccagtgtgccgagtgtgggaagagcttcagccgcagccccaacctgattgcccaccagaggacccacactggagagaagccctacagctgcccagaatgtgggaagagctttggaaacagaagcagcctgaacacccaccagggcatccacactggagagaagccctatgagtgcaaggaatgtggggagagcttctcctacaacagcaacctgatccgccaccagaggatccacactggagagaagccctacaagtgcacagactgtggccagcgcttcagccagagcagcgccctgatcacccacaggaggacccacactggagagaagccctaccagtgcagtgaatgtgggaagagcttcagccgcagcagcaacctggccacccacaggaggacccacatggtggagaagccctacaagtgtggggtgtgtgggaagagcttcagccagagcagcagcctcatcgcccaccagggcatgcacactggagagaagccctatgaatgtctgacctgtggggagagcttctcctggagcagcaacctgctgaagcaccagaggatccacactggagagaagccctacaagtgcagtgaatgtgggaagtgcttcagccagaggagccagctggtggtgcaccagaggacccacactggagagaagccctacaagtgcctgatgtgtgggaagagcttcagccggggcagcatcctggtgatgcaccagagggcccacctgggggacaagccctaccgctgcccagaatgtgggaagggcttctcctggaacagcgtgctgatcatccaccagaggatccacactggagagaagccctacaagtgcccagaatgtgggaagggcttcagcaacagcagcaacttcatcacccaccagaggacccacatgaaggagaagctgtactag

SEQ ID NO: 17560 - DNA, 84 bp, Artificial Sequence
  Description of Artificial Sequence: Synthetic coding sequence
atgatggctgctgacatcccccgggtgaccacccccctgagcagcctggtgcaggtgccccaggaggaggaccggcaggagtag

SEQ ID NO: 17561 - DNA, 1845 bp, Artificial Sequence; identical to SEQ ID NO: 17559
  Description of Artificial Sequence: Synthetic coding sequence

SEQ ID NO: 17562 - DNA, 1845 bp, Artificial Sequence; identical to SEQ ID NO: 17559
  Description of Artificial Sequence: Synthetic coding sequence

SEQ ID NO: 17563 - DNA, 162 bp, Artificial Sequence
  Description of Artificial Sequence: Synthetic coding sequence
atgatggctgctgacatcccccgggtgaccacccccctgagcagcctggtgcaggtgccccaggaggaggaccggcaggaggaggaggtgaccaccatgatcctggaggatgacagctgggtgcaggaggccgtgctgcaggaggatggccctgagagctag

SEQ ID NO: 17564 - DNA, 1422 bp, Artificial Sequence
  Description of Artificial Sequence: Synthetic coding sequence
atgatgaccaaggtgctgggcatggcccctgtgctgggcccccggcccccccaggagcaggtgggccccctgatggtgaaggtggaggagaaggaggagaagggcaagtacctgcccagcctggagatgttccggcagcgcttccggcagtttggctaccatgacaccccaggcccccgggaggccctgagccagctgcgggtgctgtgctgtgagtggctgcggcctgagatccacaccaaggagcagatcctggagctgctggtgctggagcagttcctgaccatcctgccccaggagctgcaggcctgggtgcaggagcactgcccagagagcgctgaggaggccgtgaccctgctggaggacctggagcgggagctggatgagcccggccaccaggtgtccaccccaccaaatgagcagaagcctgtgtgggagaagatcagcagcagcggcacagccaaggagagccccagctccatgcagccccagcccctggagaccagccacaagtatgagagctggggccccctgtacatccaggagagcggggaggagcaggagtttgcccaggaccccaggaaggtgcgggactgccgcctgagcacccagcacgaggagagcgcagatgagcagaagggcagcgaggccgagggcctgaagggggacatcatcagcgtcatcatcgccaacaagccagaggccagcctggagcggcagtgtgtgaacctggagaatgagaagggcaccaagccacccctgcaggaggccggcagcaagaagggccgggagagcgtgcccaccaagcccaccccaggagagcggcgctacatctgtgctgaatgtgggaaggccttcagcaacagcagcaacctgaccaagcacaggaggacccacactggagagaagccctacgtgtgcaccaagtgtgggaaggccttcagccacagcagcaacctgaccctgcactaccgcacccacctggtggaccggccctatgactgcaagtgtgggaaggccttcggccagagcagtgacctgctgaagcaccagaggatgcacacagaggaggccccctaccagtgcaaggactgtgggaaggccttcagcggcaagggcagcctcatccgccactaccgcatccacactggagagaagccctaccagtgcaatgaatgtgggaagagcttcagccagcacgccggcctgagcagccaccagaggctgcacactggagagaagccctacaagtgcaaggaatgtgggaaggccttcaaccacagcagcaacttcaacaagcaccaccgcatccacactggagagaagccctactggtgccaccactgcggcaagaccttctgcagcaagagcaacctgagcaagcaccagagggtgcacactggagagggggaggccccctag

SEQ ID NO: 17565 - DNA, 1347 bp, Artificial Sequence
  Description of Artificial Sequence: Synthetic coding sequence
atgatgaccaaggtgctgggcatggcccctgtgctgggcccccggcccccccaggagcaggtgggccccctgatggtgaaggtggaggagaaggaggagaagggcaagtacctgcccagcctggagatgttccggcagcgcttccggcagtttggctaccatgacaccccaggcccccgggaggccctgagccagctgcgggtgctgtgctgtgagtggctgcggcctgagatccacaccaaggagcactgcccagagagcgctgaggaggccgtgaccctgctggaggacctggagcgggagctggatgagcccggccaccaggtgtccaccccaccaaatgagcagaagcctgtgtgggagaagatcagcagcagcggcacagccaaggagagccccagctccatgcagccccagcccctggagaccagccacaagtatgaatcctggggccccctgtacatccaggagagcggggaggagcaggagtttgcccaggaccccaggaaggtgcgggactgccgcctgagcacccagcacgaggagagcgcagatgagcagaagggcagcgaggccgagggcctgaagggggacatcatcagcgtcatcatcgccaacaagccagaggccagcctggagcggcagtgtgtgaacctggagaatgagaagggcaccaagccacccctgcaggaggccggcagcaagaagggccgggagagcgtgcccaccaagcccaccccaggagagcggcgctacatctgtgccgagtgtgggaaggccttcagcaacagcagcaacctgaccaagcacaggaggacccacactggagagaagccctacgtgtgcaccaagtgtgggaaggccttcagccacagcagcaacctgaccctgcactaccgcacccacctggtggaccggccctatgactgcaagtgtgggaaggccttcggccagagcagtgacctgctgaagcaccagaggatgcacacagaggaggccccctaccagtgcaaggactgtgggaaggccttcagcggcaagggcagcctcatccgccactaccgcatccacactggagagaagccctaccagtgcaatgaatgtgggaagagcttcagccagcacgccggcctgagcagccaccagaggctgcacactggagagaagccctacaagtgcaaggaatgtgggaaggccttcaaccacagcagcaacttcaacaagcaccaccgcatccacactggagagaagccctactggtgccaccactgtgggaagaccttctgcagcaagagcaacctgagcaagcaccagagggtgcacactggagagggggaggccccctag

SEQ ID NO: 17566 - DNA, 546 bp, Artificial Sequence
  Description of Artificial Sequence: Synthetic coding sequence
atgatgaccaaggtgctgggcatggcccctgtgctgggcccccggcccccccaggagcaggtgggccccctgatggtgaaggtggaggagaaggaggagaagggcaagtacctgcccagcctggagatgttccggcagcgcttccggcagtttggctaccatgacaccccaggcccccgggaggccctgagccagctgcgggtgctgtgctgtgagtggctgcggcctgagatccacaccaaggagcagatcctggagctgctggtgctggagcagttcctgaccatcctgccccaggagctgcaggcctgggtgcaggagcactgcccagagagcgctgaggaggccgtgaccctgctggaggacctggagcgggagctggatgagcccggccaccaggtgtccaccccaccaaatgagcagaagcctgtgtgggagaagatcagcagcagcggcacagccaaggagagccccagctccatgcagccccagcccctggagaccagccacaagtatgagagctggggccccctgtacatccagtag

SEQ ID NO: 17567 - DNA, 1353 bp, Artificial Sequence
  Description of Artificial Sequence: Synthetic coding sequence
atgatgaccaaggtgctgggcatggcccctgtgctgggcccccggcccccccaggagcaggtgggccccctgatggtgaaggtggaggagaaggaggagaagggcaagtacctgcccagcctggagatgttccggcagcgcttccggcagtttggctaccatgacaccccaggcccccgggaggccctgagccagctgcgggtgctgtgctgtgagtggctgcggcctgagatccacaccaaggagcagatcctggagctgctggtgctggagcagttcctgaccatcctgccccaggagctgcaggcctgggtgcaggagcactgcccagagagcgctgaggaggccgtgaccctgctggaggacctggagcgggagctggatgagcccggccaccaggtgtccaccccaccaaatgagcagaagcctgtgtgggagaagatcagcagcagcggcacagccaaggagagccccagctccatgcagccccagcccctggagaccagccacaagtatgagagctggggccccctgtacatccaggagagcggggaggagcaggagtttgcccaggaccccaggaaggtgcgggactgccgcctgagcacccagcacgaggagagcgcagatgagcagaagggcagcgaggccgagggcctgaagggggacatcatcagcgtcatcatcgccaacaagccagaggccagcctggagcggcagtgtgtgaacctggagaatgagaagggcaccaagccacccctgcaggaggccggcagcaagaagggggagcacaccctgggcaggaacctgacctgtgcccccagcgtgggcaagctgagcgccacagcccagaccagccccagcaccacagagcacacctggtggacaggccccatgacagtgtctgtggagaagctgctgggccgggcccagaccttcctgaacatccgggagtgcacccagaagagaagacacatcagcgccaagatcgtggcccggctgtctgctgggaaggccgccagctttgtgaccatcggcagcaccctgggccgcagcctcatctctgtgaccaacgtgggccgggcctctgtgtccatgagggccagcgcccccacccgggacagcaccccagagaggagccacatctctgtgcgctctgtgggcaagcccagcaccacagcccccaccagcatcaacaccacagagagcaccccaggcaagagccccaccggggtcatcaccgtggagcggcccagcgtggccagccccatcttccccaacatcagcgagagcaccctggagcgggagaagcacaggaacttccaggccctgctgctgctgagcctcttctag

SEQ ID NO: 17568 - DNA, 1170 bp, Artificial Sequence
  Description of Artificial Sequence: Synthetic coding sequence
atggccatcaccctgaccctgcagacagctgagatgcaggagggcctgctggccgtgaaggtgaaggaggaggaggaggagcacagctgtggccctgagagcggcctgagcaggaacaacccccacacccgggagatcttcagaagacgcttccggcagttctgctaccaggagagccctggcccccgggaggccctgcagaggctgcaggagctgtgccaccagtggctgcggcctgagatgcacaccaaggagcagatcctggagctgctggtgctggagcagttcctgaccatcctgcctgaggagctgcaggcctgggtgcggcagcacaggcctgtgtctggagaggaggccgtgacagtgctggaggacctggagcgggagctggatgatcctggagagcaggtgctgagccacgcccacgagcaggaggagtttgtgaaggagaaggccacccctggggccgcccaggagagcagcaatgaccagttccagaccctggaggagcagctgggctacaacctgcgggaggtgtgccctgtgcaggagattgatggcaaggccggcacctggaatgtggagctggcccccaagcgggagatcagccaggaggtgaagagcctcatccaggtgctgggcaagcagaatggaaacatcacccagatcccagaatatggagacacctgtgaccgggagggccgcctggagaagcagagggtgagcagctctgtggagcggccctacatctgcagtgaatgtgggaagagcttcacccagaacagcatcctgattgagcaccagaggacccacactggagagaagccctatgaatgtgatgaatgtggccgggccttcagccagaggagcggcctcttccagcaccagaggctgcacactggagagaagcgctaccagtgcagcgtgtgtgggaaggccttcagccagaatgccggcctcttccaccacctgcgcatccacactggagagaagccctaccagtgcaaccagtgcaacaagagcttcagccgccgctctgtgctgatcaagcaccagaggatccacactggagagcggccctatgaatgtgaagaatgtgggaagaacttcatctaccactgcaacctgatccagcacaggaaggtgcaccctgtggccgagagcagctag

SEQ ID NO: 17569 - DNA, 1392 bp, Artificial Sequence
  Description of Artificial Sequence: Synthetic coding sequence
atgatggccaagagcgccctgagagaaaatggcaccaacagcgagaccttccggcagcgcttccgccgcttccactaccaggaggtggccggcccccgggaggccttcagccagctgtgggagctgtgctgccgctggctgcggcctgaggtgaggaccaaggagcagatcgtggagctgctggtgctggagcagttcctgactgtgctgcctggagagatccagaactgggtgcaggagcagtgcccagaaaatggagaggaggccgtgaccctggtggaggacctggagcgggagcccggccggcccaggagctctgtgacagtgtctgtgaagggccaggaggtgcggctggagaagatgaccccacccaagagcagccaggagctgctgtctgtgcggcaggagagcgtggagccccagccccggggcgtgcccaagaaggagcgggcccggagcccagacctgggcccccaggagcagatgaaccccaaggagaagctgaagcccttccagaggagcggctttgaggccggctttgaaaatgaagacaacagcaagagggacatcagcgaggaggtgcagctgcacaggaccctgctggcccggtctgagaggaagatcccccgctacctgcaccagggcaaaggaaatgaaagtgactgccgcagcggccggcagtgggccaagaccagcggggagaagaggggcaagctgaccctgcctgagaagagcctgtctgaggtgctgagccagcagaggccctgcctgggggagcggccctacaagtacctgaagtacagcaagagctttggccccaacagcctgctgatgcaccaggtgagccaccaggtggagaacccctacaagtgtgccgactgtgggaagagcttcagccgcagcgcccggctcatccgccaccggcgcatccacactggagagaagccctacaagtgcctggactgtgggaagagcttccgggacagcagcaacttcatcacccaccggcgcatccacactggagagaagccctaccagtgtggagaatgtgggaagtgcttcaaccagagcagcagcctcatcatccaccagaggacccacactggagagaagccctaccagtgtgaagaatgtgggaagagcttcaacaacagcagccacttcagcgcccaccggcgcatccacactggagagcggccccacgtgtgcccagactgtgggaagagcttcagcaagagcagtgacctgcgggcccaccacaggacccacactggagagaagccctacggctgccacgactgtgggaagtgcttcagcaagagcagcgccctgaacaagcatggagagatccacgcccgggagaagctgctgacccagagcgcccccaagtag

SEQ ID NO: 17570 - DNA, 2559 bp, Artificial Sequence
  Description of Artificial Sequence: Synthetic coding sequence
atgatggccaagagcgccctgagagaaaatggcaccaacagcgagaccttccggcagcgcttccgccgcttccactaccaggaggtggccggcccccgggaggccttcagccagctgtgggagctgtgctgccgctggctgcggcctgaggtgaggaccaaggagcagatcgtggagctgctggtgctggagcagttcctgactgtgctgcctggagagatccagaactgggtgcaggagcagtgcccagaaaatggagaggaggccgtgaccctggtggaggacctggagcgggagcccggccggcccaggagctctgtgacagtgtctgtgaagggccaggaggtgcggctggagaagatgaccccacccaagagcagccaggagctgctgtctgtgcggcaggagagcgtggagccccagccccggggcgtgcccaagaaggagcgggcccggagcccagacctgggcccccaggagcagatgaaccccaaggagaagctgaagcccttccagaggagcggcctgcccttccccaagtctggagtggtgtcccggctggagcagggcgagccctggatcccagacctgctgggcagcaaggagaaggagctgcccagcggcagccacatcggggaccggcgggtgcacgccgacctgctgcccagcaagaaggacagaagatcctgggtggagcaggaccactggagctttgaagatgagaaggtggccggcgtgcactggggctatgaggagaccaggaccctgctggccatcctgagccagacagagttctatgaggccctgaggaactgccacaggaacagccaggtgtatggagctgtggccgagcggctgcgggagtatggcttcctgcggaccctggagcagtgcaggaccaagttcaagggcctgcagaagagctacaggaaggtgaagagcggccaccccccagagacctgccccttctttgaggagatggaggccctgatgtctgcccaggtgattgccctgcccagcaatggcctggaggccgccgccagccacagcggcctggtgggcagtgatgctgagacagaggagcccggccagaggggctggcagcacgaggagggcgctgaggaggccgtggcccaggagagtgacagtgatgacatggacctggaggccaccccccaggaccccaacagcgctgcccctgtggtgttccgcagccctgggggcgtgcactggggctatgaggagaccaagacctacctggccatcctgtctgagacccagttctatgaggccctgaggaactgccacaggaacagccagctgtatggagctgtggccgagcggctgtgggagtatggcttcctgcggaccccagagcagtgcaggaccaagttcaagagcctgcagaccagctacaggaaggtgaagaatggccaggcccctgagacctgccccttctttgaggagatggatgccctggtgtctgtgcgggtggccgcccccccaaatgatggccaggaggagacagccagctgccctgtgcagggcaccagcgaggccgaggcccagaagcaggccgaggaggctgatgaggccacagaagaagattctgatgatgatgaggaggacacagagatccccccaggggccgtcatcacccgggcccctgtgctcttccagagcccccggggctttgaagctggctttgaaaatgaagacaacagcaagagggacatcagcgaggaggtgcagctgcacaggaccctgctggcccggtctgagaggaagatcccccgctacctgcaccagggcaaaggaaatgaaagtgactgccgcagcggccggcagtgggccaagaccagcggggagaagaggggcaagctgaccctgcctgagaagagcctgtctgaggtgctgagccagcagaggccctgcctgggggagcggccctacaagtacctgaagtacagcaagagctttggccccaacagcctgctgatgcaccaggtgagccaccaggtggagaacccctacaagtgtgccgactgtgggaagagcttcagccgcagcgcccggctcatccgccaccggcgcatccacactggagagaagccctacaagtgcctggactgtgggaagagcttccgggacagcagcaacttcatcacccaccggcgcatccacactggagagaagccctaccagtgtggggagtgtgggaagtgcttcaaccagagcagcagcctcatcatccaccagaggacccacactggagagaagccctaccagtgtgaggagtgtgggaagagcttcaacaacagcagccacttcagcgcccaccggcgcatccacactggagagcggccccacgtgtgcccagactgtgggaagagcttcagcaagagcagtgacctgcgggcccaccacaggacccacactggagagaagccctacggctgccacgactgtgggaagtgcttcagcaagagcagcgccctgaacaagcacggggagatccacgcccgggagaagctgctgacccagagcgcccccaagtag

SEQ ID NO: 17571 - DNA, 1485 bp, Artificial Sequence
  Description of Artificial Sequence: Synthetic coding sequence
atgtctggagaggccaccgtgctggcctaccacgcccctgaggagcaggagggcctgctggtggtgaaggtggaggaggagaactacgtgctggaccaggactttggcctgcaggagaacccctggagccaggaggtgttccggcagaagttccggcagttctcctacagcgacagcacaggcccccgggaggccctgagccggctgcgggagctgtgctgccagtggctgcggcctgaggtgcacagcaaggagcagatcctggagctgctgatgctggagcagttcctggccatcctgcctgaggagctgcaggcctggctgcgggagcacaggccagaaaatggagaggaggccgtgaccatgctggaggagctggagaaggagctggaggagccccggcagcaggacaccacccacggccaggagatgttctggcaggagatgaccagcactggagccctgaagagcctgagcctgaacagccctgtgcagcccctggagaaccagtgcaagacagagacccaggagagccaggccttccaggagagagatggccgcatggtggccggcaaggtgctgatggccaagcaggagatcgtggagtgtgtggccagcgctgccatgatcagccctgggaagctgcccggggagacccacagccagagaattgctgaggaggccctgggcggcctggacaacagcaagaagcagaagggaaatgctgctggcaacaagatcagccagctgcccagccaggacagacacttcagcctggccaccttcaacagacgcatccccacagagcacagcgtgctggagagccatgagagcgagggcagcttctccatgaacagcaatgacatcacccagcagagcgtggacacccgggagaagctgtatgagtgctttgactgtgggaaggccttctgccagagcagcaagctgatccgccaccagaggatccacactggagagcggccctatgcctgcaaggaatgtgggaaggccttcagcctgagcagtgacctggtgcgccaccagaggatccacagcggggagaagccctatgagtgctgtgaatgtgggaaggccttccggggcagcagcgagctgatccgccaccggcgcatccacactggagagaagccctatgaatgtggagaatgtgggaaggccttcagccgcagcagcgccctgatccagcacaagaagatccacactggagacaagagctatgagtgcatcgcctgtgggaaggccttcggccgcagcagcatcctgattgagcaccagaggatccacactggagagaagccctatgagtgcaatgaatgtgggaagagcttcaaccagagcagcgccctgacccagcaccagaggatccacactggagagaagccctatgagtgcagtgaatgtaggaagaccttccgccacaggagcggcctgatgcagcaccagaggacccacaccagggtgtag

SEQ ID NO: 17572 - DNA, 1284 bp, Artificial Sequence
  Description of Artificial Sequence: Synthetic coding sequence
caggaggtgttccggcagaagttccggcagttctcctacagcgacagcacaggcccccgggaggccctgagccggctgcgggagctgtgctgccagtggctgcggcctgaggtgcacagcaaggagcagatcctggagctgctgatgctggagcagttcctggccatcctgcctgaggagctgcaggcctggctgcgggagcacaggccagaaaatggagaggaggccgtgaccatgctggaggagctggagaaggagctggaggagccccggcagcaggtgcgcagcaagcacttcttctgtgtgcctgccaccaccgtgtcctctgtgatgggcagcaagatcctgaccctgagcatccacatcttccgctggcaggacggcggctggcagagcgtggatggcaaggccaggaacagcagcgctgccatgatcagccctgggaagctgcctggagagacccacagccagagaattgctgaggaggccctgggcggcctggacaacagcaagaagcagaagggaaatgctgctggcaacaagatcagccagctgcccagccaggacagacacttcagcctggccaccttcaacagacgcatccccacagagcacagcgtgctggagagccatgaaagtgagggcagcttctccatgaacagcaatgacatcacccagcagagcgtggacacccgggagaagctgtatgaatgttttgactgtgggaaggccttctgccagagcagcaagctgatccgccaccagaggatccacactggagagcggccctatgcctgcaaggaatgtgggaaggccttcagcctgagcagtgacctggtgcgccaccagaggatccacagcggggagaagccctatgagtgctgtgaatgtgggaaggccttccggggcagcagcgagctgatccgccaccggcgcatccacactggagagaagccctatgaatgtggggagtgtgggaaggccttcagccgcagcagcgccctgatccagcacaagaagatccacactggagacaagagctatgaatgtattgcctgtgggaaggccttcggccgcagcagcatcctgattgagcaccagaggatccacactggagagaagccctatgaatgtaatgaatgtgggaagagcttcaaccagagcagcgccctgacccagcaccagaggatccacactggagagaagccctatgaatgttctgagtgcaggaagaccttccgccacaggagcggcctgatgcagcaccagaggacccacacctag

SEQ ID NO: 17573 - DNA, 666 bp, Artificial Sequence
  Description of Artificial Sequence: Synthetic coding sequence
atgtctggagaggccaccgtgctggcctaccacgcccctgaggagcaggagggcctgctggtggtgaaggtggaggaggagaactacgtgctggaccaggactttggcctgcaggagaacccctggagccaggaggtgttccggcagaagttccggcagttctcctacagcgacagcacaggcccccgggaggccctgagccggctgcgggagctgtgctgccagtggctgcggcctgaggtgcacagcaaggagcagatcctggagctgctgatgctggagcagttcctggccatcctgcctgaggagctgcaggcctggctgcgggagcacaggccagaaaatggagaggaggccgtgaccatgctggaggagctggagaaggagctggaggagccccggcagcaggacaccacccacggccaggagatgttctggcaggagatgaccagcactggagccctgaagagcctgagcctgaacagccctgtgcagcccctggagaaccagtgcaagacagagacccaggagagccaggccttccaggagagagatggagtgtccctgtaccaccctggctggagcgctgtggtgcagccccagctgacagctgctgccctgaacccctgggtgaaggtgatcctgctgccccagcccccagagtag

SEQ ID NO: 17574 - DNA, 1485 bp, Artificial Sequence; identical to SEQ ID NO: 17571
  Description of Artificial Sequence: Synthetic coding sequence

SEQ ID NO: 17575 - DNA, 1140 bp, Artificial Sequence
  Description of Artificial Sequence: Synthetic coding sequence
atgattgtgcggcccccccagccccgggagacctctgtggtgaccttccacggcaaggagtacatcgtgcaggacagcgacatcgagatggccgaggcccccagctctgtgagagatgacctgaaggatgtgagcagccagagggccagctctgtgaaccagatgaggcctggagagggccaggcccaccgggagctgcagatcctgccccgggtgcctgccctgagccggcggcagggcgaggacttcctgctgcacaagagcattgatgtgactggagaccccaagagcctgcggcccaagcagaccctggagaaggacctgaaggagaaccgggaggagaaccctggcctgaccagccctgagccccagctgcccaagagccccacagacctggtgcgggccaaggagggcaaggacccccccaagatcgcctctgtggagaatgtggatgctgacacccccagcgcctgtgtggtggagcgggaggccagcacccacagcggcaacagaggagatgccctgaacctgagcagccccaagaggagcaagccagatgccagcagcatcagccaggaggagccccagggcgaggccacccctgtgggcaaccgggagagccctggccaggccggcatgaacagcatccacagccctggccctgccagccctgtgagccacccagatggccaggaggccaaggccctgcccccatttgcctgtgatgtgtgtgagaagcgcttcacctgcaacagcaagctggtgatccacaagaggagccacactggagagcggctcttccagtgcaacctgtgtgggaagcgcttcatgcagctgatcagcctgcagttccaccagaggacccacactggagagcggccctacacctgtgatgtgtgccagaagcagttcacccagaagagctacctgaagtgccacaagaggagccacactggagagaagccctttgagtgcaaggactgcaagaaggtgttcacctaccggggcagcctgaaggagcaccagaggatccacagcggggagaagccctacaagtgcagcaaatgtccccgggccttcagccggctgaagctgctgcggcggcaccagaagacccaccctgaggccaccagccagtag

SEQ ID NO: 17576 - DNA, 1491 bp, Artificial Sequence
  Description of Artificial Sequence: Synthetic coding sequence
atggccgccaactgcaccagctcctggagcctgggggagagctgcaaccggcccggcctggagctgcccaggtccatggccagcagcgagacccagctgggcaaccatgatgtggaccctgagatcagccacgtgaacttcaggatgttcagctgccccaaggagagtgaccccatccaggccctgaggaagctgacagagctgtgccacctgtggctgcggccagacctgcacaccaaggagcagatcctggacatgctggtgatggagcagttcatgatctccatgccccaggagctgcaggtgctggtgatgatgaatggagtgcagagctgcaaggacctggaggacctgctgaggaacaacagaagacccaagaagtggagcgtggtgaccttccacggcaaggagtacatcgtgcaggacagcgacatcgagatggccgaggcccccagctctgtgagagatgacctgaaggatgtgagcagccagagggccagctctgtgaaccagatgaggcctggagagggccaggcccaccgggagctgcagatcctgccccgggtgcctgccctgagccggcggcagggcgaggacttcctgctgcacaagagcattgatgtgactggagaccccaagagcctgcggcccaagcagaccctggagaaggacctgaaggaaaatcgggaggagaaccctggcctgaccagccctgagccccagctgcccaagagccccacagacctggtgcgggccaaggagggcaaggacccccccaagatcgcctctgtggagaatgtggatgctgacaccccatctgcctgtgtggtggagcgggaggccagcacccacagcggcaacagaggagatgccctgaacctgagcagccccaagaggagcaagccagatgccagcagcatcagccaggaggagccccagggcgaggccacccctgtgggcaaccgggagagccctggccaggccggcatgaacagcatccacagccctggccctgccagccctgtgagccacccagatggccaggaggccaaggccctgcccccatttgcctgtgatgtgtgtgagaagcgcttcacctgcaacagcaagctggtgatccacaagaggagccacactggagagcggctcttccagtgcaacctgtgtgggaagcgcttcatgcagctgatcagcctgcagttccaccagaggacccacactggagagcggccctacacctgtgatgtgtgccagaagcagttcacccagaagagctacctgaagtgccacaagaggagccacactggagagaagccctttgagtgcaaggactgcaagaaggtgttcacctaccggggcagcctgaaggagcaccagaggatccacagcggggagaagccctacaagtgcagcaagtgcccccgggccttcagccggctgaagctgctgcggcggcaccagaagacccaccctgaggccaccagccagtag

SEQ ID NO: 17577 - DNA, 2274 bp, Artificial Sequence
  Description of Artificial Sequence: Synthetic coding sequence
atggatgtggccgagagccctgagcgggacccccacagcccagaagatgaggagcagccccagggcctgagtgatgatgacatcctgcgggacagcggcagtgaccaggacctggatggagctggggtgcgggccagtgacctggaggatgaggagagcgctgcccggggccccagccaggaggaggaggacaaccacagtgatgaggaggaccgggccagcgagcccaagagccaggaccaggacagcgaggtgaatgagctgagccggggccccaccagcagcccctgtgaggaggagggagatgaaggagaggaggacaggaccagtgacctgagagatgaggccagctctgtgacccgggagctggatgagcacgagctggactatgatgaggaggtgcctgaggagcccgccccagctgtgcaggaggatgaagctgagaaggccggggctgaagatgatgaggagaagggggagggcaccccccgggaggagggcaaggccggcgtgcagagcgtgggggagaaggagagcctggaggccgccaaggagaagaagaaggaggatgatgatggagaaattgatgatggagaaattgatgatgatgacctggaggagggggaggtgaaggaccccagcgacaggaaggtgcggccccggcccacctgccgcttcttcatgaaggatgtggtgacccccctgagcaccctgctgccccccatcagcaacagcatccccttccggggccaggtgaagggcaactgcacctggggcatgaactgccgcttcatccaccctggggtgaatgacaagggcaactacagcctcatcaccaaggctgaccccttccccccaaatggagccccacccctgggcccccaccccctgatgcctgccaacccctggggcggccctgtggtggatgagatcctgcccccacctcctcctgagcccccaacagaaagtgcctgggagcggggcctgcggcatgccaaggaggtgctgaagaaggccaccatcaggaaggagcaggagccagactttgaggagaagcgcttcaccgtgaccatcggggaggatgagcgggagtttgacaaggaaaatgaggtgttccgggactggaacagccgcatccccagagatgtgcgggacacagtgctggagccctatgctgacccctactatgactatgaaattgagcgcttctggaggggcggccagtatgagaacttccgggtgcagtacacagaaacagagccctaccacaactaccgggagcgggagcgggagcgggagcgggagcgggaccgggaccgggagaaggagcgggagaaggagaagggcaagcccaagcccaggagcccccagccccccagccggcaggccgagccccccaagaaggaggccgccaccaccggcccccaggtgaagagagcagatgagtggaaggacccctggaggaggagcaagagccccaagaagaagctgggcgtgtctgtgagccccagccgggccaggagaagaaggaagaccagcgccagcagcgccagcgccagcaacagcagccgcagcagcagccgcagcagcagctacagcggcagcggcagcagccgcagccgcagccgcagcagcagctacagcagctacagcagccgcagcagccgccacagcagcttcagcggcagccgcagccgcagccgctccttcagcagcagccccagccccagccccacccccagcccccaccggcccagcatccgcaccaagggggagcccgcccctcctcctgggaaggccggggagaagtctgtgaagaagccagcccctcctccagccccaccccaggccaccaagaccacagcccctgtgcctgagcccaccaagccaggggacccccgggaggcccggaggaaggagaggcctgcccggaccccacccaggagaagactcatcaaggaggccggcagcgccatgaaccaccagaccaggacaggccgggccctgctgcagcccagcggccccacccacccccagacagaggtgctgggcaccggcagccaggtgggggactgggcccccaggagccagagcggccgggaggcccggacccccaagcccctgcagccccggctgactggaagtgccagctgccaccccagcccccgggccccagcccggagccgggcctgcccagccaagccccgcatcccagcccccccagcccccaaccagggccggcctgcccgctgcctgggcggccgcagctgctag

SEQ ID NO: 17578 - DNA, 2862 bp, Artificial Sequence
  Description of Artificial Sequence: Synthetic coding sequence
atggatgtggccgagagccctgagcgggacccccacagcccagaagatgaggagcagccccagggcctgagtgatgatgacatcctgcgggacagcggcagtgaccaggacctggatggagctggggtgcgggccagtgacctggaggatgaggagagcgctgcccggggccccagccaggaggaggaggacaaccacagtgatgaggaggaccgggccagcgagcccaagagccaggaccaggacagcgaggtgaatgagctgagccggggccccaccagcagcccctgtgaggaggagggagatgaaggagaggaggacaggaccagtgacctgagagatgaggccagctctgtgacccgggagctggatgagcacgagctggactatgatgaggaggtgcctgaggagcccgccccagctgtgcaggaggatgaagctgagaaggccggggctgaagatgatgaggagaagggggagggcaccccccgggaggagggcaaggccggcgtgcagagcgtgggggagaaggagagcctggaggccgccaaggagaagaagaaggaggatgatgatggagaaattgatgatggagaaattgatgatgatgacctggaggagggggaggtgaaggaccccagcgacaggaaggtgcggccccggcccacctgccgcttcttcatgaagggcaactgcacctggggcatgaactgccgcttcatccaccctggggtgaatgacaagggcaactacagcctcatcaccaaggctgaccccttccccccaaatggagccccacccctgggcccccaccccctgatgcctgccaacccctggggcggccctgtggtggatgagatcctgcccccacctcctcctgagcccccaacagaaagtgcctgggagcggggcctgcggcatgccaaggaggtgctgaagaaggccaccatcaggaaggagcaggagccagactttgaggagaagcgcttcaccgtgaccatcggggaggatgagcgggagtttgacaaggaaaatgaggtgttccgggactggaacagccgcatccccagagatgtgcgggacacagtgctggagccctatgctgacccctactatgactatgaaattgagcgcttctggaggggcggccagtatgagaacttccgggtgcagtacacagaaacagagccctaccacaactaccgggagcgggagcgggagcgggagagagaaaatcggcagcgggagcgggagcgggagcgggagcgggaccgggagcgggagcggcggcagcgggagcgggagcgggagcgggagcgggagcgggacaaggagcggcagaggaggaaggaggagtgggagcgggagcgggccaagagagatgagaaggaccggcagcaccgggaccgggaccgggagaaggagcgggagaaggagaagggcaagcccaagcccaggagcccccagccccccagccggcaggccgagccccccaagaaggaggccgccaccaccggcccccaggtgaagagagcagatgagtggaaggacccctggaggaggagcaagagccccaagaagaagctgggcgtgtctgtgagccccagccgggccaggagaagaaggaagaccagcgccagcagcgccagcgccagcaacagcagccgcagcagcagccgcagcagcagctacagcggcagcggcagcagccgcagccgcagccgcagcagcagctacagcagctacagcagccgcagcagccgccacagcagcttcagcggcagccgcagccgcagccgctccttcagcagcagccccagccccagccccacccccagcccccaccggcccagcatccgcaccaagggggagcccgcccctcctcctgggaaggccggggagaagtctgtgaagaagccagcccctcctccagccccaccccaggccaccaagaccacagcccctgtgcctgagcccaccaagccaggggacccccgggaggcccggaggaaggagaggcctgcccggaccccacccaggaggaggaccctgagcggcagcggcagcggcagcggcagcagctacagcggcagcagcagccgcagccgcagcctgtctgtgtcctctgtgtcctctgtgtcctctgccaccagcagcagcagcagcgcccacagcgtggacagcgaggacatgtatgctgacctggccagccctgtgtcctctgccagcagccgcagccctgccccagcccagaccaggaaggagaagggcaagagcaagaaggaggatggagtgaaggaggagaagaggaagagggacagcagcacccagccccccaagagcgccaagcccccagctgggggcaagagcagccagcagcccagcaccccccagcaggcccctcctggccagccccagcagggcacctttgtggcccacaaggagatcaagctgaccctgctgaacaaggctgctgacaagggcagcaggaagagatatgagcccagcgacaaggaccggcagagccccccaccagccaagaggcccaacaccagcccagaccggggcagccgggacaggaagagcggcggccgcctgggcagccccaagccagagcggcagaggggccagaacagcaaggccccagctgccccagctgacaggaagaggcagctgagcccccagagcaagagcagcagcaaggtgacctctgtgcctgggaaggccagtgaccccggggccgccagcaccaagagcggcaaggccagcaccctgagcagaagagaggagctgctgaagcagctgaaggctgtggaggatgccatcgccaggaagagggccaagatccctgggaaggcctag

SEQ ID NO: 17579 - DNA, 2934 bp, Artificial Sequence
  Description of Artificial Sequence: Synthetic coding sequence
atggatgtggccgagagccctgagcgggacccccacagcccagaagatgaggagcagccccagggcctgagtgatgatgacatcctgcgggacagcggcagtgaccaggacctggatggagctggggtgcgggccagtgacctggaggatgaggagagcgctgcccggggccccagccaggaggaggaggacaaccacagtgatgaggaggaccgggccagcgagcccaagagccaggaccaggacagcgaggtgaatgagctgagccggggccccaccagcagcccctgtgaggaggagggagatgaaggagaggaggacaggaccagtgacctgagagatgaggccagctctgtgacccgggagctggatgagcacgagctggactatgatgaggaggtgcctgaggagcccgccccagctgtgcaggaggatgaagctgagaaggccggggctgaagatgatgaggagaagggggagggcaccccccgggaggagggcaaggccggcgtgcagagcgtgggggagaaggagagcctggaggccgccaaggagaagaagaaggaggatgatgatggagaaattgatgatggagaaattgatgatgatgacctggaggagggggaggtgaaggaccccagcgacaggaaggtgcggccccggcccacctgccgcttcttcatgaaggatgtggtgacccccctgagcaccctgctgccccccatcagcaacagcatccccttccggggccaggtgaagggcaactgcacctggggcatgaactgccgcttcatccaccctggggtgaatgacaagggcaactacagcctcatcaccaaggctgaccccttccccccaaatggagccccacccctgggcccccaccccctgatgcctgccaacccctggggcggccctgtggtggatgagatcctgcccccacctcctcctgagcccccaacagaaagtgcctgggagcggggcctgcggcatgccaaggaggtgctgaagaaggccaccatcaggaaggagcaggagccagactttgaggagaagcgcttcaccgtgaccatcggggaggatgagcgggagtttgacaaggaaaatgaggtgttccgggactggaacagccgcatccccagagatgtgcgggacacagtgctggagccctatgctgacccctactatgactatgaaattgagcgcttctggaggggcggccagtatgagaacttccgggtgcagtacacagaaacagagccctaccacaactaccgggagcgggagcgggagcgggagagagaaaatcggcagcgggagcgggagcgggagcgggagcgggaccgggagcgggagcggcggcagcgggagcgggagcgggagcgggagcgggagcgggacaaggagcggcagaggaggaaggaggagtgggagcgggagcgggccaagagagatgagaaggaccggcagcaccgggaccgggaccgggagaaggagcgggagaaggagaagggcaagcccaagcccaggagcccccagccccccagccggcaggccgagccccccaagaaggaggccgccaccaccggcccccaggtgaagagagcagatgagtggaaggacccctggaggaggagcaagagccccaagaagaagctgggcgtgtctgtgagccccagccgggccaggagaagaaggaagaccagcgccagcagcgccagcgccagcaacagcagccgcagcagcagccgcagcagcagctacagcggcagcggcagcagccgcagccgcagccgcagcagcagctacagcagctacagcagccgcagcagccgccacagcagcttcagcggcagccgcagccgcagccgctccttcagcagcagccccagccccagccccacccccagcccccaccggcccagcatccgcaccaagggggagcccgcccctcctcctgggaaggccggggagaagtctgtgaagaagccagcccctcctccagccccaccccaggccaccaagaccacagcccctgtgcctgagcccaccaagccaggggacccccgggaggcccggaggaaggagaggcctgcccggaccccacccaggaggaggaccctgagcggcagcggcagcggcagcggcagcagctacagcggcagcagcagccgcagccgcagcctgtctgtgtcctctgtgtcctctgtgtcctctgccaccagcagcagcagcagcgcccacagcgtggacagcgaggacatgtatgctgacctggccagccctgtgtcctctgccagcagccgcagccctgccccagcccagaccaggaaggagaagggcaagagcaagaaggaggatggagtgaaggaggagaagaggaagagggacagcagcacccagccccccaagagcgccaagcccccagctgggggcaagagcagccagcagcccagcaccccccagcaggcccctcctggccagccccagcagggcacctttgtggcccacaaggagatcaagctgaccctgctgaacaaggctgctgacaagggcagcaggaagagatatgagcccagcgacaaggaccggcagagccccccaccagccaagaggcccaacaccagcccagaccggggcagccgggacaggaagagcggcggccgcctgggcagccccaagccagagcggcagaggggccagaacagcaaggccccagctgccccagctgacaggaagaggcagctgagcccccagagcaagagcagcagcaaggtgacctctgtgcctgggaaggccagtgaccccggggccgccagcaccaagagcggcaaggccagcaccctgagcagaagagaggagctgctgaagcagctgaaggctgtggaggatgccatcgccaggaagagggccaagatccctgggaaggcctag

SEQ ID NO: 17580 - DNA, 999 bp, Artificial Sequence
  Description of Artificial Sequence: Synthetic coding sequence
atggatgtggccgagagccctgagcgggacccccacagcccagaagatgaggagcagccccagggcctgagtgatgatgacatcctgcgggacagcggcagtgaccaggacctggatggagctggggtgcgggccagtgacctggaggatgaggagagcgctgcccggggccccagccaggaggaggaggacaaccacagtgatgaggaggaccgggccagcgagcccaagagccaggaccaggacagtgaagatgatgacctggaggagggggaggtgaaggaccccagcgacaggaaggtgcggccccggcccacctgccgcttcttcatgaagggcaactgcacctggggcatgaactgccgcttcatccaccctggggtgaatgacaagggcaactacagcctcatcaccaaggctgaccccttcccccccaacggggccccacccctgggcccccaccccctgatgcctgccaacccctggggcggccctgtggtggatgagatcctgcccccacctcctcctgagcccccaacagagagcgcctgggagcggggcctgcggcatgccaaggaggtgctgaagaaggccaccatcaggaaggagcaggagccagactttgaggagaagcgcttcaccgtgaccatcggagaagatgagcgggagtttgacaaggaaaatgaggtgttccgggactggaacagccgcatccccagagatgtgcgggacacagtgctggagccctatgctgacccctactatgactatgaaattgagcgcttctggaggggcggccagtatgagaacttccgggtgcagtacacagaaacagagccctaccacaactaccgggagcgggagcgggagcgggagcgggagaaccggcagcgggagcgggacaaggagcggcagaggaggaaggaggagtgggagcgggagcgggccgccaagctgagccaccagaggcggcggctgcccccccggggcagaagatag

SEQ ID NO: 17581 - DNA, 2847 bp, Artificial Sequence
  Description of Artificial Sequence: Synthetic coding sequence
atggaggagaaggagatcctgcggcggcagatccggctgctgcagggcctgattgatgactacaagaccctgcatggaaatgccccagcccctggcaccccagctgccagcggctggcagccccccacctaccacagcggccgggccttcagcgcccgctacccccggcccagcagaagaggctacagcagccaccacggccccagctggaggaagaagtacagcctggtgaaccggcccccaggccccagcgaccccccagctgaccatgctgtgcggcccctgcacggggcccggggcggccagccccctgtgccccagcagcacgtgctggagcggcaggtgcagctgagccagggccagaatgtggtgatcaaggtgaagccacccagcaagagcggcagcgccagcgccagcggggcccagaggggcagcctggaggagtttgaggagaccccctggagcgaccagaggccccgggagggggagggggagcccccccggggccagctgcagcccagccggcccacccgggcccggggcacctgcagcgtggaggaccccctgctggtgtgccagaaggagcccgggaagcccaggatggtgaagtctgtgggctctgtgggggacagcccccgggagcccaggagaacagtgtctgagagcgtgattgctgtgaaggccagcttccccagcagcgccctgccccccaggactggagtggccctgggcaggaagctgggcagccacagcgtggccagctgtgccccccagctgctgggggacagaagagtggatgctggccacacagaccagcctgtgcccagcggctctgtgggcggccctgcccggcctgccagcggcccccggcaggcccgggaggccagcctggtggtgacctgcaggaccaacaagttcaggaagaacaactacaagtgggtggccgccagcagcaagagcccccgggtggcccggcgggccctgagcccccgggtggccgcagaaaatgtgtgcaaggccagcgctggcatggccaacaaggtggagaagccccagctgattgctgaccctgagcccaagcccaggaagccagccaccagcagcaagccaggcagcgcccccagcaagtacaagtggaaggccagcagccccagcgccagcagcagcagcagcttccgctggcagagcgaggccagcagcaaggaccacgccagccagctgagccctgtgctgagccgcagccccagcggggacaggcctgctgtgggccacagcggcctgaagcccctgtctggagagacccccctgagcgcctacaaggtgaagagcaggaccaagatcatcagaagaagaagcagcaccagcctgcccggggacaagaagagcggcaccagccctgctgccacagccaagagccacctgagcctgcggcggcggcaggccctgcggggcaagagcagccctgtgctgaagaagacccccaacaagggcctggtgcaggtgaccacccaccggctgtgccgcctgccccccagccgggcccacctgcccaccaaggaggccagcagcctgcatgctgtgaggacagcccccaccagcaaggtgatcaagacccgctaccgcatcgtgaagaagaccccagccagccccctgagcgccccacccttccccctgagcctgcccagctggagggcccggcggctgagcctgagccgcagcctggtgctgaaccggctgcggcctgtggccagcggcggcggcaaggcccagcccggcagcccctggtggaggagcaagggctaccgctgcatcggcggcgtgctgtacaaggtgtctgccaacaagctgagcaagaccagcggccagcccagtgatgctggcagccggcccctgctgaggacaggccgcctggaccctgctggcagctgcagccgcagcctggccagcagagctgtgcagaggagcctggccatcatccggcaggcccggcagaggcgggagaagaggaaggagtactgcatgtactacaacagatttggccgctgcaacagaggagagcgctgcccctacatccatgaccctgagaaggtggccgtgtgcaccaggtttgtgcggggcacctgcaagaagacagatggcacctgccccttcagccaccacgtgtccaaggagaagatgcctgtgtgcagctacttcctgaagggcatctgcagcaacagcaactgcccctacagccacgtgtatgtgtccaggaaggccgaggtgtgcagcgacttcctgaagggctactgccccctgggcgccaagtgcaagaagaagcacaccctgctgtgcccagactttgccaggagaggagcctgccccaggggggcccagtgccagctgctgcacaggacccagaagaggcacagcagaagagctgccaccagccctgcccctggccccagtgatgccacagcccggagccgggtgtctgccagccacggccccaggaagcccagcgccagccagaggcccacccggcagacccccagcagcgctgccctgacagctgctgctgtggccgccccaccccactgccctgggggcagcgccagccccagcagcagcaaggccagcagcagcagcagcagcagcagcagccccccagccagcctggaccacgaggcccccagcctgcaggaggccgccctggccgccgcctgcagcaaccggctgtgcaagctgcccagcttcatcagcctgcagagcagccccagccctggggcccagccccgggtgcgggccccccgggcccccctgaccaaggacagcggcaagcccctgcacatcaagccccggctgtag

SEQ ID NO: 17582 - DNA, 2916 bp, Artificial Sequence
  Description of Artificial Sequence: Synthetic coding sequence
atgagcaatgtgtctgaggagaggaggaagaggcagcagaacatcaaggagggcctgcagttcatccagagccccctgagctacccaggcacccaggagcagtatgctgtgtacctgcgggccctggtgaggaacctcttcaatgaaggaaatgatgtgtaccgggagcatgactggaacaacagcatcagccagtacacagaggccctgaacattgctgactatgccaagtctgaggagatcctgatccccaaggagatcatcgagaagctgtacatcaaccgcatcgcctgctacagcaacatgggcttccatgacaaggtgctggaggactgcaacatcgtgctgagcctgaatgccagcaactgcaaggccctgtacaggaagagcaaggccctgagtgacctgggccgctacaagaaggcctatgatgctgtggccaagtgcagcctggccgtgccccaggatgagcacgtgatcaagctgacccaggagctggcccagaagctgggcttcaagatcaggaaggcctacgtgcgggcagagctgagcctgaagtctgtgcctggagatggagccaccaaggccctgaaccacagcgtggaggacatcgagccagacctgctgaccccccggcaggaggccgtgcctgtggtgtccctgcctgcccccagcttcagccatgaggtgggcagcgagctggcctctgtgcctgtgatgcccctgaccagcatcctgcccctgcaggtggaggagagcgccctgcccagcgctgtgctggccaacggcggcaagatgcccttcaccatgcctgaggccttcctggatgatggagacatggtgctgggagatgagctggatgacctgctggacagcgcccctgagaccaatgaaacagtgatgcccagcgccctggtgcggggccccctgcagacagcctctgtgagccccagcatgcccttcagcgccagcctgctgggcaccctgcccatcggggcccgctatgcccccccacccagcttcagcgagttctacccacccctgaccagcagcctggaggacttctgcagcagcctgaacagcttctccatgtctgagagcaagagggacctgagcaccagcaccagccgggagggcacccccctgaacaacagcaacagcagcctgctgctgatgaatggacctggcagcctgtttgccagcgagaacttcctgggcatcagcagccagcccagaaatgactttggaaacttctttggatctgctgtgaccaagcccagcagctctgtgacccccaggcaccccctggagggcacccatgagctgcggcaggcctgccagatctgctttgtgaagagcggccccaagctgatggacttcacctaccacgccaacatcgaccacaagtgcaagaaggacatcctgattggccgcatcaagaatgtggaggacaagtcctggaagaagatccggccccggcccaccaagaccaactatgagggcccctactacatctgcaaggatgtggccgctgaggaggagtgccgctacagcggccactgcacctttgcctactgccaggaggagattgatgtgtggaccctggagaggaagggggccttcagccgggaggccttctttggaggaaatggcaagatcaacctgaccgtcttcaagctgctgcaggagcacctgggggagttcatcttcctgtgtgagaagtgctttgaccacaagcccaggatgatcagcaagaggaacaaggacaacagcacagcctgcagccaccctgtgaccaagcatgaatttgaggacaacaagtgcctggtgcacatcctgcgggagaccaccgtgaagtacagcaagatccgctccttccacggccagtgccagctggacctgtgcagacatgaggtgcgctatggctgcctgcgggaggatgagtgcttctacgcccacagcctggtggagctgaaggtgtggatcatgcagaatgaaacaggcatcagccatgatgccatcgcccaggagagcaagcgctactggcagaacctggaggccaacgtgcctggggcccaggtgctgggcaaccagatcatgcctggcttcctgaacatgaagatcaagtttgtgtgtgcccagtgcctgagaaatggccaggtgattgaaccagacaagaacaggaagtactgcagcgccaaggcccggcacagctggaccaaggacagaagagccatgagggtgatgagcattgaaaggaagaagtggatgaacatccggcccctgcccaccaagaagcagatgcccctgcagtttgacctgtgcaaccacatcgccagcggcaagaagtgccagtatgtgggcaactgcagctttgcccacagccctgaggagcgggaggtgtggacctacatgaaggaaaatggcatccaggacatggagcagttctatgagctgtggctgaagagccagaagaatgagaagtctgaggacatcgccagccagagcaacaaggaaaatggcaagcagatccacatgcccacagattatgcagaggtgacagtggacttccactgctggatgtgtgggaagaactgcaacagcgagaagcagtggcagggccacatcagcagcgagaagcacaaggagaaggtgttccacacagaagatgaccagtactgctggcagcaccgcttccccaccggctacttcagcatctgtgaccgctacatgaatggcacctgcccagagggcaacagctgcaagtttgcccatggaaatgctgagctgcacgagtgggaggagaggagagatgccctgaagatgaagctgaacaaggccaggaaggaccacctgattggccccaatgacaatgactttgggaagtacagcttcctgttcaaggacctgaactag

SEQ ID NO: 17583 - DNA, 2916 bp, Artificial Sequence; identical to SEQ ID NO: 17582
  Description of Artificial Sequence: Synthetic coding sequence

SEQ ID NO: 17584 - DNA, 2934 bp, Artificial Sequence
  Description of Artificial Sequence: Synthetic coding sequence
atggagcggcagaagaggaaggctgacatcgagaagggcctgcagttcatccagagcaccctgcccctgaagcaggaggagtatgaggccttcctgctgaagctggtgcagaacctgtttgctgagggcaatgacctcttccgggagaaggactacaagcaggccctggtgcagtacatggagggcctgaatgtggccgactatgctgccagtgaccaggtggccctgccccgggagctgctgtgcaagctgcacgtgaacagagctgcctgctacttcaccatgggcctgtatgagaaggccctggaggacagcgagaaggccctgggcctggacagcgagagcatccgggccctcttcaggaaggcccgggccctgaatgagctgggccgccacaaggaggcctatgaatgtagcagccgctgcagcctggccctgccccatgatgaatctgtgacccagctgggccaggagctggcccagaagctgggcctgcgggtgaggaaggcctacaagaggccccaggagctggagaccttcagcctgctgagcaatggaacagctgctggggtggccgaccagggcaccagcaatggcctgggcagcattgatgacatcgagacagactgctacgtggacccccggggcagccctgccctgctgcccagcacccccaccatgcccctcttcccccacgtgctggacctgctggcccccctggacagcagcaggaccctgcccagcacagacagcctggatgacttcagtgatggagatgtgtttggacctgagctggacaccctgctggacagcctgagcctggtgcagggcggcctgagcggcagcggcgtgcccagcgagctgccccagctgatccctgtgtttcctgggggcacccccctgctgccccctgtggtgggcggcagcatccctgtgagcagccccctgcccccagccagctttggcctggtgatggaccccagcaagaagctggccgcctctgtgctggatgccctggaccccccaggccccaccctggaccccctggacctgctgccctacagcgagacccggctggatgccctggacagctttggcagcacccggggcagcctggacaagccagacagcttcatggaggagaccaacagccaggaccacaggcctccttctggggcccagaagccagcccccagccctgagccctgcatgcccaacacagccctgctgatcaagaaccccctggccgccacccatgagttcaagcaggcctgccagctgtgctaccccaagacaggcccccgggccggggactacacctaccgggagggcctggagcacaagtgcaagagggacatcctgctgggccgcctgcggagcagcgaggaccagacctggaagaggatccggccccggcccaccaagaccagctttgtgggcagctactacctgtgcaaggacatgatcaacaagcaggactgcaagtacggggacaactgcacctttgcctaccaccaggaggagattgatgtgtggacagaggagaggaagggcaccctgaacagagacctgctgtttgaccccctgggcggcgtgaagaggggcagcctgaccatcgccaagctgctgaaggagcaccagggcatcttcaccttcctgtgtgagatctgctttgacagcaagccccgcatcatcagcaagggcaccaaggacagccccagcgtgtgcagcaacctggccgccaagcacagcttctacaacaacaagtgcctggtgcacatcgtgcgcagcaccagcctgaagtacagcaagatccggcagttccaggagcacttccagtttgatgtgtgcagacatgaggtgcgctatggctgcctgcgggaggacagctgccactttgcccacagcttcatcgagctgaaggtgtggctgctgcagcagtacagcggcatgacccatgaggacatcgtgcaggagagcaagaagtactggcagcagatggaggcccatgctgggaaggccagcagctccatgggcgcccccaggacccacggccccagcacctttgacctgcagatgaagtttgtgtgtggccagtgctggagaaatggccaggtggtggagccagacaaggacctgaagtactgcagcgccaaggcccggcactgctggaccaaggagcggcgggtgctgctggtgatgagcaaggccaagaggaagtgggtgtctgtgcggcccctgcccagcatccggaacttcccccagcagtatgacctgtgcatccacgcccagaatggaaggaagtgccagtatgtgggcaactgcagctttgcccacagccctgaggagcgggacatgtggaccttcatgaaggagaacaagatcctggacatgcagcagacctatgacatgtggctgaagaagcacaaccctgggaagccaggagagggcacccccatcagcagccgggagggggagaagcagatccagatgcccacagattatgctgacatcatgatgggctaccactgctggctgtgtgggaagaacagcaacagcaagaagcagtggcagcagcacatccagagcgagaagcacaaggagaaggtgttcaccagtgacagtgatgccagcggctgggccttccgcttccccatgggagagttccggctgtgtgaccggctgcagaagggcaaggcctgcccagatggagacaagtgccgctgtgcccacggccaggaggagctgaatgagtggctggaccggcgggaggtgctgaagcagaagctggccaaggccaggaaggacatgctgctgtgccccagagatgatgactttgggaagtacaacttcctgctgcaggaggatggagacctggccggggccaccccagaggccccagctgctgctgccacagccaccactggagagtag

SEQ ID NO: 17585 - DNA, 2934 bp, Artificial Sequence; identical to SEQ ID NO: 17584
  Description of Artificial Sequence: Synthetic coding sequence

SEQ ID NO: 17586 - DNA, 876 bp, Artificial Sequence
  Description of Artificial Sequence: Synthetic coding sequence
atggactttgagaacctcttcagcaagccacccaacccagccctgggcaagacagccacagacagtgatgaaagaattgatgatgaaattgacacagaggtggaggagacccaggaggagaagatcaagctggagtgtgagcagatccccaagaagttccgccacagcgccatcagccccaagagcagcctgcacaggaagagccgcagcaaggactatgatgtgtacagcgacaatgacatctgcagccaggagagcgaggacaactttgccaaggagctgcagcagtacatccaggcccgggagatggccaatgctgcccagcctgaggagagcaccaagaaggagggcgtgaaggacaccccccaggccgccaagcagaagaacaagaacctgaaggccggccacaagaatggcaagcagaagaagatgaagaggaagtggccaggccctggcaacaagggcagcaatgccctgctgagaaattctggcagccaggaggaggatggcaagcccaaggagaagcagcagcacctgagccaggccttcatcaaccagcacacagtggagaggaagggcaagcagatctgcaagtacttcctggagaggaagtgcatcaagggggaccagtgcaagtttgaccatgatgctgagattgagaagaagaaggagatgtgcaagttctacgtgcagggctactgcaccagaggagagaactgcctgtacctgcacaatgagtacccctgcaagttctaccacacaggcaccaagtgctaccagggcgagtactgcaagttcagccacgcccccctgaccccagagacccaggagctgctggccaaggtgctggacacagagaagaagagctgcaagtag

SEQ ID NO: 17587 - DNA, 876 bp, Artificial Sequence; identical to SEQ ID NO: 17586
  Description of Artificial Sequence: Synthetic coding sequence

SEQ ID NO: 17588 - DNA, 846 bp, Artificial Sequence
  Description of Artificial Sequence: Synthetic coding sequence
atggccgaggccgccccagcccgggaccctgagacagacaagcacacagaggaccagagccccagcacccccctgccccagcctgctgctgagaagaacagctacctgtacagcacagagatcaccctgtggacagtggtggccgccatccaggccctggagaagaaggtggacagctgcctgacccggctgctgaccctggagggccgcactggaacagctgagaagaagctggccgactgtgagaagacagctgtggagtttggaaaccagctggagggcaagtgggccgtgctgggcaccctgctgcaggagtatggcctgctgcagaggcggctggagaatgtggagaacctgctgaggaacagaaacttctggatcctgcggctgcccccaggcagcaaaggagaggcccccaaggtgcctgtgacctttgatgatgtggccgtgtacttcagcgagctggagtggggcaagctggaggactggcagaaggagctgtacaagcacgtgatgaggggcaactatgagaccctggtgtccctggactatgccatcagcaagccagacatcctgaccagaattgagcggggggaggagccctgcctggaccgctggggccaggagaagggaaatgaggtggaggtgggccggcccaggatgatgggcaccggcctgcccccctacccagagcacctgaccagccccctgagccctgcccaggaggagctgaaggagggccaggcccccaagcagcagcaggacagcgaggcccgggtggccccagctggccctgaggccggcctggccctgaggacagacctgcagggcgaggcccagatctag

SEQ ID NO: 17589 - DNA, 540 bp, Artificial Sequence
  Description of Artificial Sequence: Synthetic coding sequence
atggccgaggccgccgcccccccagactggcactgcggcctgaccagccgggagcggcccaggagtgacctgcagaggagccccttccggctgtcctggctgctcttccgctggtggaggcggcgctggaacccccggctgcccggctaccgggcctggagagatgcctgtggccagcccaggaggtcctggctgacagcccggcgctggctgtggagcagcggcacctcctggagggccctggtgaatggaggagccagcctggtgtgtggcagccaggtgggcctggtgtcctctgagtggctgtgccagaagggcctggtgtatgacagaaatgccggccagctggagcggccccaggccttctgccccggcagcagcaagaggaagggccaggtgggcggggccagccgggcccacagaagacccctgtggcacacctgtgcccaggtgagacatgctggcccctgcctgctgcggcctgtgtccctgggcctgcggagacatggagtgccctggggcgccagccagaggctgtag

SEQ ID NO: 17590 - DNA, 1641 bp, Artificial Sequence
  Description of Artificial Sequence: Synthetic coding sequence
atggccgaggccgccccagcccgggaccctgagacagacaagcacacagaggaccagagccccagcacccccctgccccagcctgctgctgagaagaacagctacctgtacagcacagagatcaccctgtggacagtggtggccgccatccaggccctggagaagaaggtggacagctgcctgacccggctgctgaccctggagggccgcactggaacagctgagaagaagctggccgactgtgagaagacagctgtggagtttggaaaccagctggagggcaagtgggccgtgctgggcaccctgctgcaggagtatggcctgctgcagaggcggctggagaatgtggagaacctgctgaggaacagaaacttctggatcctgcggctgcccccaggcagcaaaggagaggcccccaaggtgcctgtgacctttgatgatgtggccgtgtacttcagcgagctggagtggggcaagctggaggactggcagaaggagctgtacaagcacgtgatgaggggcaactatgagaccctggtgtccctggactatgccatcagcaagccagacatcctgaccagaattgagcggggggaggagccctgcctggaccgctggggccaggagaagggaaatgaggtggaggtgggccggcccaggatgatgggcaccggcctgcccccctacccagagcacctgaccagccccctgagccctgcccaggaggagctgaaggagggccaggcccccaagcagcagcaggacagcgaggcccgggtggccccagctggccctgaggccggcggcggcgtggccatcaagacagaggcccagagtgaagatgagatgaccccagagcggctcttcctgggcgtgtcccggggccagacagagtgccgcatcccccggggccccaggaacagacctgggggccccagccgccaccaggcccagggcatgccccgggtgcgggccggggagccccggcccccaggggccagcggggagaccccccgggtgctgagcagaagacggcagagggccttcccctgcccagactgtggccagagcttccggctgaagatcaacctgaccatccaccagaggacccacgtggaggagggccggcaggaggcccctggccgcagccccaccagctgtggggacagccaggccatgctggagcccggggaggtggtggtgcccggccctgtgatccgctggctgcctgaggagcctgagggccgccgctctgtggccggcggccgggccctggtgggccggcggcctgctgccagcaagatgtaccactgcagcgagtgcctgcgcttcttccagcagaggaagagcctgctgctgcaccagaggctgcacactggaaatggccagggctggccagcctgcccctactgcggcaaggccttccggcggcccagcgacctcttccgccaccagaggatccacactggagagcggccctaccagtgcccccagtgtggccgcaccttcaacagaaaccaccacctggccgtgcacatgcagacccacgcccggggccaggtgggcccccacttccctgctgccccagcccggcacggcagcctgcccctgccctggcccagcaggaaggaggagggctag

SEQ ID NO: 17591 - DNA, 846 bp, Artificial Sequence; identical to SEQ ID NO: 17588
  Description of Artificial Sequence: Synthetic coding sequence

SEQ ID NO: 17592 - DNA, 2589 bp, Artificial Sequence
  Description of Artificial Sequence: Synthetic coding sequence
atggccaccctgaacagcgccagcaccaccggcaccacccccagccctggccacaatgcccccagcctgcccagcgacaccttcagcagcagcacccccagcgaccctgtgaccaaggaccccccagctgccagcagcaccagcgagaacatgaggagcagcgagcccggcggccagctgctggagagcggctgcggcctggtgccccccaaggagattggagagccccaggagggccctgactgtggccacttccccccaaatgaccccggggtggagaaggacaaggagcaggaggaggaggaggagggcctgccccccatggacctgagcaaccacctgttcttcaccgctggaggagaggcctacctggtggccaagctgagcctgcccggcggcagcgagctgctgctgcccaagggcttcccctggggcgaggccggcatcaaggaggagcccagcctgcccttcctggcctaccccccacccagccacctgacagccctgcacatccagcacggctttgaccccatccagggcttcagcagcagtgaccagatcctgagccatgacaccagcgcccccagccctgctgcctgtgaggagcggcacggggccttctggagctaccagctggcccccaaccccccaggggaccccaaggatggccccatgggcaacagcggcggcaaccacgtggccgtgttctggctgtgcctgctgtgccgcctgggcttcagcaagccccaggccttcatggaccacacccagagccatggagtgaagctgaccccagcccagtaccagggcctgagcggcagccctgctgtgctgcaggagggagatgagggctgcaaggccctgatctccttcctggagcccaagctgcctgcccggcccagcagtgacatccccctggacaacagcagcacagtgaacatggaggccaacgtggcccagacagaagatggccccccagaggccgaggtgcaggccctgatcctgctggatgaggaggtgatggccctgagcccccccagccccccaacagccacctgggaccccagccccacccaggccaaggagagccctgtggccgccggggaggccggccctgactggttccctgagggccaggaggaggatggcggcctgtgcccccccctgaaccagagcagccccaccagcaaggagggcggcaccctgcctgcccctgtgggcagccctgaggaccccagcgaccccccccagccctaccgcctggctgatgactacaccccagccccagctgccttccagggcctgagcctgagcagccacatgagcctgctgcacagcaggaacagctgcaagaccctgaagtgccccaagtgcaactggcactacaagtaccagcagaccctggatgtgcacatgagggagaagcaccctgagagcaacagccactgcagctactgcagcgctgggggcgcccacccccggctggcccggggggagagctacaactgtggctacaagccctaccgctgtgatgtgtgcaactacagcaccaccaccaagggcaacctgagcatccacatgcagagcgacaagcacctggccaacctgcagggcttccaggccggccctgggggccagggcagccccccagaggccagcctgcccccatctgctggggacaaggagcccaagaccaagagctcctggcagtgcaaggtgtgcagctatgagaccaacatcagcaggaacctgcgcatccacatgaccagcgagaagcacatgcagaatgtgctgatgctgcaccagggcctgcccctgggcctgcccccaggcctgatgggccctggccccccacctcctcctggggccacccccaccagccccccagagctgttccagtacttcggcccccaggccctgggccagccccagacccccctggccggccctggcctgcggccagacaagcccctggaggcccagctgctgctgaatggcttccaccacgtgggcgccccagccaggaagttccccaccagcgcccctggcagcctgagcccagatgcccacctgccccccagccagctgctgggcagcagcagtgacagcctgcccaccagccccccaccagatgacagcctgagcctgaaggtgttccgctgcctggtgtgccaggccttcagcacagacagcctggagctgctgctgtaccactgcagcatcggccgcagcctgcctgaggccgagtggaaggaggtggccggggacacccaccgctgcaagctgtgctgctacggcacccagctgaaggccaacttccagctgcacctgaagacagacaagcacgcccagaagtaccagctggccgcccacctgcgggagggcggcggggccatgggcacccccagccctgccagcctgggagatggagccccctacggctctgtgagccccctgcacctgcgctgcaacatctgtgactttgagagcaacagcaaggagaagatgcagctgcacgcccggggagctgcccacgaggagaacagccagatctacaagaggactggaacaggcctgctgatcaagtag

SEQ ID NO: 17593 - DNA, 303 bp, Artificial Sequence
  Description of Artificial Sequence: Synthetic coding sequence
atggccaccctgaacagcgccagcaccaccggcaccacccccagccctggccacaatgcccccagcctgcccagcgacaccttcagcagcagcacccccagcgaccctgtgaccaaggaccccccagctgccagcagcaccagcgagaacatgaggagcagcgagcccggcggccagctgctggagagcggctgcggcctggtgccccccaaggagattggagagccccaggagggccctgactgtggccacttccccccaaatgaccccggggtggagaaggacaaggagcaggaggagtag

SEQ ID NO: 17594 - DNA, 7719 bp, Artificial Sequence
  Description of Artificial Sequence: Synthetic coding sequence
atggccaccctgaacagcgccagcaccaccggcaccacccccagccctggccacaatgcccccagcctgcccagcgacaccttcagcagcagcacccccagcgaccctgtgaccaaggaccccccagctgccagcagcaccagcgagaacatgaggagcagcgagcccggcggccagctgctggagagcggctgcggcctggtgccccccaaggagattggagagccccaggagggccctgactgtggccacttccccccaaatgaccccggggtggagaaggacaaggagcaggaggaggaggaggagggcctgccccccatggacctgagcaaccacctgttcttcaccgctggaggagaggcctacctggtggccaagctgagcctgcccggcggcagcgagctgctgctgcccaagggcttcccctggggcgaggccggcatcaaggaggagcccagcctgcccttcctggcctaccccccacccagccacctgacagccctgcacatccagcacggctttgaccccatccagggcttcagcagcagtgaccagatcctgagccatgacaccagcgcccccagccctgctgcctgtgaggagcggcacggggccttctggagctaccagctggcccccaaccccccaggggaccccaaggatggccccatgggcaacagcggcggcaaccacgtggccgtgttctggctgtgcctgctgtgccgcctgggcttcagcaagccccaggccttcatggaccacacccagagccatggagtgaagctgaccccagcccagtaccagggcctgagcggcagccctgctgtgctgcaggagggagatgagggctgcaaggccctgatctccttcctggagcccaagctgcctgcccggcccagcagtgacatccccctggacaacagcagcacagtgaacatggaggccaacgtggcccagacagaagatggccccccagaggccgaggtgcaggccctgatcctgctggatgaggaggtgatggccctgagcccccccagccccccaacagccacctgggaccccagccccacccaggccaaggagagccctgtggccgccggggaggccggccctgactggttccctgagggccaggaggaggatggcggcctgtgcccccccctgaaccagagcagccccaccagcaaggagggcggcaccctgcctgcccctgtgggcagccctgaggaccccagcgaccccccccagccctaccgcctggctgatgactacaccccagccccagctgccttccagggcctgagcctgagcagccacatgagcctgctgcacagcaggaacagctgcaagaccctgaagtgccccaagtgcaactggcactacaagtaccagcagaccctggatgtgcacatgagggagaagcaccctgagagcaacagccactgcagctactgcagcgctgggggcgcccacccccggctggcccggggggagagctacaactgtggctacaagccctaccgctgtgatgtgtgcaactacagcaccaccaccaagggcaacctgagcatccacatgcagagcgacaagcacctggccaacctgcagggcttccaggccggccctgggggccagggcagccccccagaggccagcctgcccccatctgctggggacaaggagcccaagaccaagagctcctggcagtgcaaggtgtgcagctatgagaccaacatcagcaggaacctgcgcatccacatgaccagcgagaagcacatgcagaatgtgctgatgctgcaccagggcctgcccctgggcctgcccccaggcctgatgggccctggccccccacctcctcctggggccacccccaccagccccccagagctgttccagtacttcggcccccaggccctgggccagccccagacccccctggccggccctggcctgcggccagacaagcccctggaggcccagctgctgctgaatggcttccaccacgtgggcgccccagccaggaagttccccaccagcgcccctggcagcctgagcccagatgcccacctgccccccagccagctgctgggcagcagcagtgacagcctgcccaccagccccccaccagatgacagcctgagcctgaaggtgttccgctgcctggtgtgccaggccttcagcacagacagcctggagctgctgctgtaccactgcagcatcggccgcagcctgcctgaggccgagtggaaggaggtggccggggacacccaccgctgcaagctgtgctgctacggcacccagctgaaggccaacttccagctgcacctgaagacagacaagcacgcccagaagtaccagctggccgcccacctgcgggagggcggcggggccatgggcacccccagccctgccagcctgggagatggagccccctacggctctgtgagccccctgcacctgcgctgcaacatctgtgactttgagagcaacagcaaggagaagatgcagctgcacgcccggggagctgcccacgaggagaacagccagatctacaagttcctgctggacatggagggcgctgaggccggggctgagctgggcctgtaccactgcctgctgtgtgcctgggagacccccagccggctggccgtgctgcagcacctgcggaccccagcccacagagatgcccaggcccagaggcggctgcagctgctgcagaatggccccaccacagaggagggcctggccgccctgcagagcatcctgtccttcagccacggccagctgcggaccccaggcaaggcccctgtgacccccctggccgagccccccaccccagagaaggatgcccagaacaagacagagcagctggccagcgaggagacagagaacaagacaggccccagccgggacagcgccaaccagaccaccgtgtactgctgcccctactgcagcttcctgagccctgagagcagccaggtgcgggcccacaccctgagccagcacgctgtgcagcccaagtaccgctgccccctgtgccaggagcagctggtgggccggcctgccctgcacttccacctgagccacctgcacaacgtggtgcctgaatgtgtggagaagctgctgctggtggccaccaccgtggagatgaccttcaccaccaaggtgctgagcgcccccaccctgagccccctggacaatggccaggagccccccacccacggccctgagcccacccccagccgggaccaggccgctgagggccccaacctgaccccagaggccagcccagaccccctgcctgagccccccctggcctctgtggaggtgcctgacaagcccagcggcagccctggccagccccccagccctgcccccagccctgtgcctgagccagatgcccaggccgaggatgtggcccccccacccaccatggccgaggaggaggagggcaccaccggggagctgcggtctgctgagcccgccccagctgacagccgccaccccctgacctacaggaagaccaccaactttgccctggacaagttcctggaccctgcccggccctacaagtgcaccgtgtgcaaggagagcttcacccagaagaacatcctgctggtgcactacaacagcgtgagccacctgcacaagatgaagaaggccgccatcgaccccagcgccccagcccggggggaggccggggccccacccaccaccacagctgccacagacaagcccttcaagtgcaccgtgtgccgggtgtcctacaaccagagcagcaccctggagatccacatgaggtctgtgctgcaccagaccaggagccggggcaccaagacagacagcaagattgagggccctgagaggagccaggaggagcccaaggagggggagacagaaggagaggtgggcacagagaagaagggccctgacaccagcggcttcatcagcggcctgcccttcctgagccccccacctccacccctggacctgcaccgcttccctgcccccctcttcaccccacctgtgctgccccccttccccctggtgcctgagagcctgctgaagctgcagcagcagcagctgctgctgcccttctacctgcatgacctgaaggtgggccccaagctgaccctggccggccctgcccctgtgctgagcctgcctgctgccaccccacctcctccaccccagccccccaaggccgagctggccgagcgggagtgggagaggcctcccatggccaaggagggcaatgaggccggccccagcagccccccagaccccctgcccaatgaagctgccaggacagctgccaaggccctgctggagaactttggatttgagctggtgatccagtacaatgaaggcaagcaggccgtgcccccaccacccaccccacctcctcctgaggccctgggcggcggggacaagctggcctgtggggcctgtgggaagctgttcagcaacatgctgatcctgaagacccatgaggagcacgtgcaccggcgcttcctgccctttgaggccctgagccgctatgctgcccagttcaggaagagctatgacagcctgtacccacccctggccgagccccccaagcccccagatggcagcctggacagccctgtgccccacctgggcccccccttcctggtgcctgagcctgaggccggcggcacccgggcccctgaggagaggagcagagctgggggccactggcccatcgaggaggaggagagcagccggggcaacctgccccccctggtgcctgctggaagacgcttcagcaggaccaagttcacagagttccagacccaggccctgcagagcttctttgagaccagcgcctaccccaaggatggagaggtggagcggctggccagcctgctgggcctggccagccgggtggtggtggtgtggttccagaatgcccggcagaaggccaggaagaatgcctgtgagggcggctccatgcccaccggcggcggcaccggcggggccagcggctgccgccgctgccacgccaccttcagctgtgtgtttgagctggtgcgccacctgaagaagtgctatgatgaccagaccctggaggaggaggaggaggaggccgagcggggggaggaggaggaggaggtggaggaggaggaggtggaggaggagcagggcctggagcccccagctggccctgagggccccctgcctgagcccccagatggagaggagctgagccaggccgaggccaccaaggccggcggcaaggagcctgaggagaaggccacccccagccccagccctgcccacacctgtgaccagtgtgccatctccttcagcagccaggacctgctgaccagccaccggcggctgcacttcctgcccagcctgcagcccagcgccccaccccagctgctggacctgcccctgctggtgtttggagagaggaaccccctggtggccgccaccagccccatgcctggcccccccctgaagaggaagcatgaagatggcagcctgagccccaccggcagcgaggccggcggcggcggggagggggagcccccccgggacaagaggctgcggaccaccatcctgcctgagcagctggagatcctgtaccgctggtacatgcaggacagcaaccccaccaggaagatgctggactgcatcagcgaggaggtgggcctgaagaagagggtggtgcaggtgtggttccagaacacccgggcccgggagaggaagggccagttccgcagcaccccaggaggagtgcccagccctgctgtgaagcccccagccacagccaccccagccagcctgcccaagttcaacctgctgctgggcaaggtggatgatggcaccggccgggaggcccccaagcgggaggccccagccttcccctaccccacagccaccctggccagcggcccccagcccttcctgcccccaggcaaggaggccaccacccccaccccagagccccccctgcccctgctgcccccacctcctccttctgaggaggagggccctgaggagccccccaaggccagccctgagagcgaggcctgcagcctgtctgctggggacctgagtgacagcagcgccagcagcctggccgagcctgagagccctggggccggcggcaccagcggcggccctgggggcggcactggagtgcctgatggcatgggccagaggcgctaccgcacccagatgagcagcctgcagctgaagatcatgaaggcctgctatgaggcctaccgcacccccaccatgcaggagtgtgaggtgctgggggaggagatcggcctgcccaagagggtcatccaggtgtggttccagaatgcccgggccaaggagaagaaggccaagctgcagggcacagctgctggcagcactggaggcagcagcgagggcctgctggccgcccagaggacagactgcccctactgtgatgtgaagtatgacttctacgtgtcctgccggggccacctgttcagccggcagcacctggccaagctgaaggaggccgtgcgggcccagctgaagtctgagagcaaatgttatgacctggccccagcccctgaggcccccccagccctgaaggcccccccagccaccaccccagcctccatgcccctgggcgccgcccccaccctgccccggctggcccctgtgctgctgagcggccctgccctggcccagccccccctgggcaacctggcccccttcaacagcggccctgctgccagcagcggcctgctgggcctggccacctctgtgctgcccaccaccaccgtggtgcagacagctggccctggccggcccctgccccagaggcccatgccagaccagaccaacaccagcacagctggcaccacagatcctgtgcccggccccccaacagagcccctgggggacaaggtgtcctctgagaggaagcctgtggccggccccaccagcagcagcaatgatgccctgaagaacctgaaggccctgaagaccaccgtgcctgccctgctgggcggccagttcctgcccttccccctgcccccagctgggggcacagcccccccagctgtgtttggcccccagctgcagggcgcctacttccagcagctgtatggcatgaagaagggcctcttccccatgaaccccatgatcccccagaccctgattggcctgctgcccaatgccctgctgcagcccccaccccagcccccagagcccacagccacagccccacccaagcccccagagctgcctgcccctggagagggggaggccggggaggtggatgagctgctgaccggcagcacaggcatcagcacagtggatgtgacccaccgctacctgtgccggcagtgcaagatggcctttgatggagaggccccagccacagcccaccagaggagcttctgcttcttcggccggggcagcggcggctccatgcccccacccctgcgggtgcccatctgcacctaccactgcctggcctgtgaggtgctgctgagcggccgggaggccctggccagccacctgcggagcagcgcccacaggaggaaggccgccccaccccagggcggcccccccatcagcatcaccaatgctgccacagctgccagcgctgctgtggcctttgccaaggaggaggcccggctgccccacacagacagcaaccccaagaccaccaccaccagcaccctgctggccctgtag

SEQ ID NO: 17595 - DNA, 1227 bp, Artificial Sequence
  Description of Artificial Sequence: Synthetic coding sequence
atggccaccctgaacagcgccagcaccaccggcaccacccccagccctggccacaatgcccccagcctgcccagcgacaccttcagcagcagcacccccagcgaccctgtgaccaaggaccccccagctgccagcagcaccagcgagaacatgaggagcagcgagcccggcggccagctgctggagagcggctgcggcctggtgccccccaaggagattggagagccccaggagggccctgactgtggccacttccccccaaatgaccccggggtggagaaggacaaggagcaggaggaggaggaggagggcctgccccccatggacctgagcaaccacctgttcttcaccgctggaggagaggcctacctggtggccaagctgagcctgcccggcggcagcgagctgctgctgcccaagggcttcccctggggcgaggccggcatcaaggaggagcccagcctgcccttcctggcctaccccccacccagccacctgacagccctgcacatccagcacggctttgaccccatccagggcttcagcagcagtgaccagatcctgagccatgacaccagcgcccccagccctgctgcctgtgaggagcggcacggggccttctggagctaccagctggcccccaaccccccaggggaccccaaggatggccccatgggcaacagcggcggcaaccacgtggccgtgttctggctgtgcctgctgtgccgcctgggcttcagcaagccccaggccttcatggaccacacccagagccatggagtgaagctgaccccagcccagtaccagggcctgagcggcagccctgctgtgctgcaggagggagatgagggctgcaaggccctgatctccttcctggagcccaagctgcctgcccggcccagcagtgacatccccctggacaacagcagcacagtgaacatggaggccaacgtggcccagacagaagatggccccccagaggccgaggtgcaggccctgatcctgctggatgaggaggtgatggccctgagcccccccagccccccaacagccacctggggctacaccacagcctgctgcgtgcggggccgccaccccccagcctggctgtgctgcaacacctgtgcccacctgcccacagccatgccccggccccggggcgtgtgcagctgctacaggatggcccagcccctgaggaaggacagccagctgttccgggccagctag

SEQ ID NO: 17596 - DNA, 741 bp, Artificial Sequence
  Description of Artificial Sequence: Synthetic coding sequence
atggccaccctgaacagcgccagcaccaccggcaccacccccagccctggccacaatgcccccagcctgcccagcgacaccttcagcagcagcacccccagcgaccctgtgaccaaggaccccccagctgccagcagcaccagcgagaacatgaggagcagcgagcccggcggccagctgctggagagcggctgcggcctggtgccccccaaggagattggagagccccaggagggccctgactgtggccacttccccccaaatgaccccggggtggagaaggacaaggagcaggaggaggaggaggagggcctgccccccatggacctgagcaaccacctgttcttcaccgctggaggagaggcctacctggtggccaagctgagcctgcccggcggcagcgagctgctgctgcccaagggcttcccctggggcgaggccggcatcaaggaggagcccagcctgcccttcctggcctaccccccacccagccacctgacagccctgcacatccagcacggctttgaccccatccagggcttcagcagcagtgaccagatcctgagccatgacaccagcgcccccagccctgctgcctgtgaggagcggcacggggccttctggagctaccagctggcccccaaccccccaggggaccccaaggatggccccatgggcaacagcggcggcaaccacgtggccgtgttctggctgtgcctgctgtgccgcctgggcttctag

SEQ ID NO: 17597 - DNA, 1563 bp, Artificial Sequence
  Description of Artificial Sequence: Synthetic coding sequence
atgagccagctgagcctgtcctggctgggcctgtggcctgtggccgccagcccctggctgctgctgctgctggtgggcgcctcctggctgctggcccacgtgctggcctggacctacgccttctatgacaactgccggcggctgcgctgcttcccccagccccccaggaggaactggttctggggccaccagggcatggtgaaccccacagaggagggcatgagggtgctgacccagctggtggccacctacccccagggcttcaaggtgtggatgggccccatcagccccctgctgagcctgtgccacccagacatcatccgcagcgtcatcaatgccagcgctgccatcgcccccaaggacaagttcttctacagcttcctggagccctggctgggagatggcctgctgctgtctgctggggacaagtggagccgccacaggaggatgctgaccccagccttccacttcaacatcctgaagccctacatgaagatcttcaatgaatctgtgaacatcatgcacgccaagtggcagctgctggccagcgagggcagcgcctgcctggacatgtttgagcacatcagcctgatgaccctggacagcctgcagaagtgtgtgttctcctttgacagccactgccaggagaagcccagcgagtacatcgccgccatcctggagctgagcgccctggtgtccaagaggcaccacgagatcctgctgcacatcgacttcctgtactacctgaccccagatggccagcgcttcagaagagcctgccgcctggtgcatgacttcacagatgctgtgatccaggagaggaggaggaccctgcccagccagggcgtggatgacttcctgcaggccaaggccaagagcaagaccctggacttcattgatgtgctgctgctgagcaaggatgaagatggcaagaagctgagtgatgaggacatccgggcagaggccgacaccttcatgtttgagggccatgacaccacagccagcggcctgtcctgggtgctgtaccacctggccaagcaccctgagtaccaggagcgctgccggcaggaggtgcaggagctgctgaaggaccgggagcccaaggagattgagtgggatgacctggcccacctgcccttcctgaccatgtgcatgaaggagagcctgcggctgcacccccctgtgcctgtgatcagcagacatgtgacccaggacatcgtgctgcctgatggccgggtcatccccaagggcatcatctgcctgatctctgtgtttggcacccaccacaacccagctgtgtggccagaccctgaggtgtatgaccccttccgctttgatcctgagaacatcaaggagaggagccccctggccttcatccccttctctgctggccccaggaactgcatcggccagacctttgccatggccgagatgaaggtggtgctggccctgaccctgctgcgcttccgggtgctgcctgaccacacagagcccaggaggaagccagagctggtgctgcgggcagagggcggcctgtggctgcgggtggagcccctgtcctag

SEQ ID NO: 17598 - DNA, 1584 bp, Artificial Sequence
  Description of Artificial Sequence: Synthetic coding sequence
atgtaccagccagaagatgacaacaacagtgatgtgaccagtgatgatgacatgaccaggaacagaagagagagcagccccccccacagcgtgcacagcttcagcggggaccgggactgggaccggcggggccgcagccgggacatggagccccgggaccgctggagccacaccaggaaccccaggagcaggatgccaccccgggacctgagcctgcctgtggtggccaagaccagctttgagatggacagagaagatgaccgggacagccgggcctatgagagccgcagccaggatgctgagagctaccagaatgtggtggacctggccgaggacaggaagccccacaacaccatccaggacaacatggagaactacaggaagctgctgagcctgggcttcctggcccaggacagcgtgcctgctgagaagaggaacacagagatgctggacaacctgcccagcgctggcagccagttcccagacttcaagcacctgggcaccttcctggtgtttgaggagctggtgacctttgaagatgtgctggtggacttcagccctgaggagctgagcagcctgtctgctgcccagaggaacctgtaccgggaggtgatgctggagaactacagaaacctggtgtccctgggccaccagttcagcaagccagacatcatcagccggctggaggaggaggagagctatgccatggagacagacagccgccacacagtcatctgccagggcgagagccatgatgaccccctggagccccaccagggcaaccaggagaagctgctgacccccatcaccatgaatgaccccaagaccctgaccccagagaggagctatggcagtgatgaatttgagaggagcagcaacctgagcaagcagagcaaggaccccctgggcaaggacccccaggagggcacagcccctggcatctgcaccagcccccagagcgccagccaggagaacaagcacaacagatgtgagttctgcaagaggaccttcagcacccaggtggccctgcggagacatgagcgcatccacacaggcaagaagccctatgagtgcaagcagtgtgccgaggccttctacctgatgccccacctgaacagacaccagaagacccacagcggcaggaagaccagcggctgcaatgaaggaaggaagcccagcgtgcagtgtgccaacctgtgtgagcgggtgcgcatccacagccaggaggactactttgagtgcttccagtgtgggaaggccttcctgcagaatgtgcacctgctgcagcacctgaaggcccacgaggccgcccgggtgctgcccccaggcctgagccacagcaagacctacctgatccgctaccagaggaagcatgactatgtgggggagcgggcctgccagtgctgtgactgtggccgggtcttcagcagaaattcctacctgatccagcactaccgcacccacacccaggagcggccctaccagtgccagctgtgtgggaaatgttttggccggcccagctacctgacccagcactaccagctgcacagccaggagaagacagtggagtgtgaccactgctag

SEQ ID NO: 17599 - DNA, 1584 bp, Artificial Sequence; identical to SEQ ID NO: 17598
  Description of Artificial Sequence: Synthetic coding sequence

SEQ ID NO: 17600 - DNA, 1584 bp, Artificial Sequence; identical to SEQ ID NO: 17598
  Description of Artificial Sequence: Synthetic coding sequence

SEQ ID NO: 17601 - DNA, 1584 bp, Artificial Sequence; identical to SEQ ID NO: 17598
  Description of Artificial Sequence: Synthetic coding sequence

SEQ ID NO: 17602 - DNA, 1707 bp, Artificial Sequence
  Description of Artificial Sequence: Synthetic coding sequence
atggcccggctgaccaagaggcggcaggccgacaccaaggccatccagcacctgtgggccgccatcgagatcatccggaaccagaagcagatcgccaacatcgaccgcatcaccaagtacatgagccgggtgcacggcatgcaccccaaggagaccacccggcagctgagcctggccgtgaaggatggcctgattgtggagaccctgactgtgggctgcaagggcagcaaggccggcatcgagcaggagggctactggctgcctggagatgaaattgactgggagacagaaaatcatgactggtactgctttgagtgccacctgcctggagaggtgctgatctgtgacctgtgcttccgggtgtaccacagcaagtgcctgagtgatgagttccggctgcgggacagcagcagcccctggcagtgccctgtgtgccgcagcatcaagaagaagaacaccaacaagcaggagatgggcacctacctgcgcttcatcgtgtccaggatgaaggagcgggccatcgacctgaacaagaagggcaaggacaacaagcaccccatgtacagaaggctggtgcacagcgctgtggatgtgcccaccatccaggagaaggtgaatgaaggcaagtaccgctcctatgaggagttcaaggcagatgcccagctgctgctgcacaacacagtcatcttctatggagctgacagcgagcaggccgacatcgccaggatgctgtacaaggacacctgccacgagctggatgagctgcagctgtgcaagaactgcttctacctgagcaatgcccggccagacaactggttctgctacccctgcatccccaaccacgagctggtgtgggccaagatgaagggcttcggcttctggccagccaaggtgatgcagaaggaggacaaccaggtggatgtgcgcttcttcggccaccaccaccagagggcctggatccccagcgagaacatccaggacatcaccgtgaacatccaccggctgcacgtgaagaggtccatgggctggaagaaggcctgtgatgagctggagctgcaccagcgcttcctgcgggagggccgcttctggaagagcaagaatgaagatagaggagaggaggaggccgagagcagcatcagcagcaccagcaatgagcagctgaaggtgacccaggagccccgggccaagaagggcagaagaaaccagagcgtggagcccaagaaggaggagcctgagcctgagacagaagctgtgagcagcagccaggagatccccaccatgccccagcccatcgagaaggtgtctgtgtccacccagaccaagaagctgagcgccagcagccccaggatgctgcacaggagcacccagaccaccaatgatggagtgtgccagagcatgtgccacgacaagtacaccaagatcttcaatgacttcaaggacaggatgaagagtgaccacaagcgggagacagagcgggtggtgcgggaggccctggagaagctgcggtctgagatggaggaggagaagaggcaggccgtgaacaaggctgtggccaacatgcagggcgagatggacaggaagtgcaagcaggtgaaggagaagtgcaaggaggagtttgtggaggagatcaagaagctggccacccagcacaagcagctgatcagccagaccaagaagaagcagtgggtgaacaccagcctcttctag

SEQ ID NO: 17603 - DNA, 1224 bp, Artificial Sequence
  Description of Artificial Sequence: Synthetic coding sequence
atgaacaagagccagggctctgtgtccttcacagatgtgacagtggacttcacccaggaggagtgggagcagctggaccccagccagaggatcctgtacatggatgtgatgctggagaactacagcaacctgctgtctgtggaggtgtggaaggcagatgaccagatggagcgggaccacagaaatccagatgagcaggcccggcagttcctgatcctgaagaaccagacccccatcgaggagcggggggacctgtttgggaaggccctgaacctgaacacagactttgtgtccctgcggcaggtgccctacaagtatgacctgtatgagaagaccctgaagtacaacagcgacctgctgaacagcaacagaagctatgccggcaagcagacagatgaatgtaatgaatttgggaaggccctgctgtacctgaagcaggagaagacccacagcggcgtggagtacagcgagtacaacaagagcggcaaggccctgagccacaaggccgccatcttcaagcaccagaagatcaagaacctggtgcagcccttcatctgcacctactgtgacaaggccttctccttcaagagcctgctgatcagccacaagaggatccacactggagagaagccctatgaatgtaatgtgtgcaagaagaccttcagccacaaggccaacctgatcaagcaccagaggatccacactggagagaagccctttgaatgtccagaatgtgggaaggccttcacccaccagagcaacctgattgtgcaccagagggcccacatggagaagaagccctatgaatgttctgaatgtgggaagacctttgcccagaagtttgagctgaccacccaccagaggatccacactggagagcggccctatgaatgtaatgaatgtgccaagaccttcttcaagaagagcaacctgatcatccaccagaagatccacactggagagaagagatatgaatgttctgaatgtgggaagagcttcatccagaacagccagctgatcatccacatgaggacccacactggagagaagccctatgaatgtacagaatgtgggaagaccttcagccagaggagcaccctgcggctgcacctgcgcatccacactggagagaagccctatgaatgttctgaatgtgggaaggccttcagcaggaagagccggctgtctgtgcaccagagggtgcacatcggggagaagccctag

SEQ ID NO: 17604 - DNA, 1224 bp, Artificial Sequence; identical to SEQ ID NO: 17603
  Description of Artificial Sequence: Synthetic coding sequence

SEQ ID NO: 17605 - DNA, 1602 bp, Artificial Sequence
  Description of Artificial Sequence: Synthetic coding sequence
atggcccacggctctgtgaccttcagagatgtggccatcgacttcagccaggaggagtgggagttcctggaccctgcccagagggacctgtacagagatgtgatgtgggagaactacagcaacttcatcagcctgggccccagcatcagcaagccagatgtgatcaccctgctggatgaggagaggaaggagcccggcatggtggtgcgggagggcacccggcgctactgcccagacctggagagccgctaccgcaccaacaccctgagccctgagaaggacatctatgagatctacagcttccagtgggacatcatggagcgcatcaagagctacagcctgcagggcagcatcttcagaaatgactgggagtgcaagagcaagattgaaggagagaaggagcagcaggagggctacttcggccaggtgaagatcaccagcgagaagatgaccacctacaagaggcacaacttcctgacagagtaccagatcgtgcacaatggagagaaggtgtatgagtgcaaggagtgcaggaagaccttcatcagaagaagcaccctgagccagcacctgcgcatccacactggagagaagccctacaagtgcaaggaatgtggccaggccttccggcagagggcccacctgatccgccaccacaagctgcacactggagagaagccctatgagtgcaaggaatgtgggaaggccttcaccgtgctgcaggagctgacccagcaccagaggctgcacactggagagaagccctatgagtgcaaggaatgtgggaaggccttccgggtgcaccagcagctggcccggcaccagaggatccacactggagagaagccctatgagtgcaaggactgtgggaagaccttccggcagtgcacccacctgaccaggcaccagaggctgcacacagctgagaagctgtatgagtgcaaggaatgtgggaaggcctttgtgtgtggccctgacctgcgggtgcaccagaagatccactttggagagaagccctatgagtgcaaggaatgtgggaaggccttccgcatctgccagcagctgactgtgcaccagagcatccacactggagagaagccctatgagtgcaaggaatgtgggaagaccttccggctgcggcagcagctggtgcgccaccagaggatccacacccgggagaagccctatgagtgcatggagtgctggaagaccttcagcagctacagccagctgatcagccaccagagcatccacatcggggagcggccctatgaatgtgaggagtgtgggaaggccttccggctgctgagccagctgacccagcaccagagcatccacactggagagaagccctatgagtgcaaggagtgcaggaagcccttccggctgctgagccagctgacccagcaccagagcatccacactggagagaagccctatgagtgcaaggaatgtgggaaggccttccggctgtacagcttcctgacccagcaccagaggatccacactggagagaagccctacaagtgcaaggagtgcaagaaggccttccggcagcacagccacctgacccagcaccagaagatccacaacggcatctag

SEQ ID NO: 17606 - DNA, 1602 bp, Artificial Sequence
  Description of Artificial Sequence: Synthetic coding sequence
gtggcccacggctctgtgaccttcagagatgtggccatcgacttcagccaggaggagtgggagttcctggaccctgcccagagggacctgtacagagatgtgatgtgggagaactacagcaacttcatcagcctgggccccagcatcagcaagccagatgtgatcaccctgctggatgaggagaggaaggagcccggcatggtggtgcgggagggcacccggcgctactgcccagacctggagagccgctaccgcaccaacaccctgagccctgagaaggacatctatgagatctacagcttccagtgggacatcatggagcgcatcaagagctacagcctgcagggcagcatcttcagaaatgactgggagtgcaagagcaagattgaaggagagaaggagcagcaggagggctacttcggccaggtgaagatcaccagcgagaagatgaccacctacaagaggcacaacttcctgacagagtaccagatcgtgcacaatggagagaaggtgtatgagtgcaaggagtgcaggaagaccttcatcagaagaagcaccctgagccagcacctgcgcatccacactggagagaagccctacaagtgcaaggaatgtggccaggccttccggcagagggcccacctgatccgccaccacaagctgcacactggagagaagccctatgagtgcaaggaatgtgggaaggccttcaccgtgctgcaggagctgacccagcaccagaggctgcacactggagagaagccctatgagtgcaaggaatgtgggaaggccttccgggtgcaccagcagctggcccggcaccagaggatccacactggagagaagccctatgagtgcaaggactgtgggaagaccttccggcagtgcacccacctgaccaggcaccagaggctgcacacagctgagaagctgtatgagtgcaaggaatgtgggaaggcctttgtgtgtggccctgacctgcgggtgcaccagaagatccactttggagagaagccctatgagtgcaaggaatgtgggaaggccttccgcatctgccagcagctgactgtgcaccagagcatccacactggagagaagccctatgagtgcaaggaatgtgggaagaccttccggctgcggcagcagctggtgcgccaccagaggatccacacccgggagaagccctatgagtgcatggagtgctggaagaccttcagcagctacagccagctgatcagccaccagagcatccacatcggggagcggccctatgaatgtgaggagtgtgggaaggccttccggctgctgagccagctgacccagcaccagagcatccacactggagagaagccctatgagtgcaaggagtgcaggaagcccttccggctgctgagccagctgacccagcaccagagcatccacactggagagaagccctatgagtgcaaggaatgtgggaaggccttccggctgtacagcttcctgacccagcaccagaggatccacactggagagaagccctacaagtgcaaggagtgcaagaaggccttccggcagcacagccacctgacccagcaccagaagatccacaacggcatctag

SEQ ID NO: 17607 - DNA, 2265 bp, Artificial Sequence
  Description of Artificial Sequence: Synthetic coding sequence
atgaccacagctggccggggcaacctgggcctcatccccaggagcacagccttccagaagcaggagggccgcctgactgtgaagcaggagcccgccaaccagacctggggccagggcagcagcctgcagaagaactacccacctgtgtgtgagatcttccggctgcacttccggcagctgtgctaccacgagatgagcggcccccaggaggccctgagccggctgcgggagctgtgccgctggtggctgatgcctgaggtgcacaccaaggagcagatcctggagctgctggtgctggagcagttcctgagcatcctgcctggagagctgcggacctgggtgcagctgcaccaccctgagagcggggaggaggccgtggccgtggtggaggacttccagaggcacctgagcggcagcgaggaggtgtctgccccagcccagaagcaggagatgcactttgaggagaccacagccctgggcaccaccaaggagagcccccccaccagccccctgagcggcggcagcgcccctggggcccacctggagcccccctatgaccccggcacccaccacctgcccagcggggactttgcccagtgcaccagccctgtgcccaccctgccccaggtgggcaacagcggggaccaggccggggccaccgtgctgaggatggtgcggccccaggacacagtggcctatgaggacctgtctgtggactacacccagaagaagtggaagagcctgaccctgagccagagggccctgcagtggaacatgatgcctgagaaccaccacagcatggccagcctggccggggagaacatgatgaagggcagcgagctgacccccaagcaggagttcttcaagggcagcgagagcagcaacagaaccagcggcggcctgtttggagtggtgcctggagctgctgagactggagatgtgtgtgaggacaccttcaaggagctggagggccagaccagtgatgaggagggcagccggctggagaatgacttcctggagatcacagatgaggacaagaagaagagcaccaaggacagatatgacaagtacaaggaggtgggggagcacccccccctgagcagcagccctgtggagcatgaaggagtgctgaagggccagaagagctaccgctgtgatgaatgtgggaaggccttcaacagaagcagccacctgattggccaccagaggatccacactggagagaagccctatgagtgcaatgaatgtgggaagaccttccggcagaccagccagctgattgtgcacctgcggacccacactggagagaagccctatgagtgcagtgaatgtgggaaggcctaccgccacagcagccacctgatccagcaccagaggctgcacaacggggagaagccctacaagtgcaatgaatgtgccaaggccttcacccagagcagccggctgacagaccaccagaggacccacactggagagaagccctatgagtgcaatgaatgtggggaggccttcatccgcagcaagagcctggcccggcaccaggtgctgcacacaggcaagaagccctacaagtgcaatgaatgtggccgggccttctgcagcaacagaaacctgattgaccaccagaggatccacactggagagaagccctatgagtgcagtgaatgtgggaaggccttcagccgcagcaagtgcctgatccgccaccagagcctgcacactggagagaagccctacaagtgcagtgaatgtgggaaggccttcaaccagaacagccagctgattgaacatgagcgcatccacactggagagaagccctttgagtgcagtgaatgtgggaaggccttcggcctgagcaagtgcctgatccgccaccagaggctgcacactggagagaagccctacaagtgcaatgaatgtgggaagagcttcaaccagaacagccacctgatcatccaccagaggatccacactggagagaagccctatgagtgcaatgaatgtgggaaggtgttctcctacagcagcagcctgatggtgcaccagaggacccacactggagagaagccctacaagtgcaatgactgtgggaaggccttcagtgacagcagccagctgattgtgcaccagagggtgcacactggagagaagccctatgagtgcagtgaatgtgggaaggccttcagccagaggagcaccttcaaccaccaccagaggacccacactggagagaagagcagcggcctggcctggagcgtgtcctag

SEQ ID NO: 17608 - DNA, 612 bp, Artificial Sequence
  Description of Artificial Sequence: Synthetic coding sequence
agcaagtgcctgatccgccaccagagcctgcacactggagagaagccctacaagtgcagtgaatgtgggaaggccttcaaccagaacagccagctgattgaacatgagcgcatccacactggagagaagccctttgagtgcagtgaatgtgggaaggccttcggcctgagcaagtgcctgatccgccaccagaggctgcacactggagagaagccctacaagtgcaatgaatgtgggaagagcttcaaccagaacagccacctgatcatccaccagaggatccacactggagagaagccctatgagtgcaatgaatgtgggaaggtgttctcctacagcagcagcctgatggtgcaccagaggacccacactggagagaagccctacaagtgcaatgactgtgggaaggccttcagtgacagcagccagctgattgtgcaccagagggtgcacactggagagaagccctatgagtgcagtgaatgtgggaaggccttcagccagaggagcaccttcaaccaccaccagaggacccacactggagaggtgctgcggagcggcctggtgtccttcctgcgctatggcagcgagacagagagcaatgacctgtag

SEQ ID NO: 17609 - DNA, 831 bp, Artificial Sequence
  Description of Artificial Sequence: Synthetic coding sequence
atgaccacagctggccggggcaacctgggcctcatccccaggagcacagccttccagaagcaggagggccgcctgactgtgaagcaggagcccgccaaccagacctggggccagggcagcagcctgcagaagaactacccacctgtgtgtgagatcttccggctgcacttccggcagctgtgctaccacgagatgagcggcccccaggaggccctgagccggctgcgggagctgtgccgctggtggctgatgcctgaggtgcacaccaaggagcagatcctggagctgctggtgctggagcagttcctgagcatcctgcctggagagctgcggacctgggtgcagctgcaccaccctgagagcggggaggaggccgtggccgtggtggaggacttccagaggcacctgagcggcagcgaggaggtgtctgccccagcccagaagcaggagatgcactttgaggagaccacagccctgggcaccaccaaggagagcccccccaccagccccctgagcggcggcagcgcccctggggcccacctggagcccccctatgaccccggcacccaccacctgcccagcggggactttgcccagtgcaccagccctgtgcccaccctgccccaggtgggcaacagcggggaccaggccggggccaccgtgctgaggatggtgcggccccaggacacagtggcctatgaggacctgtctgtggactacacccagaagaagtggaagagcctgaccctgagccagagggccctgcagtggaacatgatgcctgagaaccaccacagcatggccagcctgggctggagcaccatggcctag

SEQ ID NO: 17610 - DNA, 2265 bp, Artificial Sequence; identical to SEQ ID NO: 17607
  Description of Artificial Sequence: Synthetic coding sequence

SEQ ID NO: 17611 - DNA, 831 bp, Artificial Sequence; identical to SEQ ID NO: 17609
  Description of Artificial Sequence: Synthetic coding sequence

SEQ ID NO: 17612 - DNA, 1989 bp, Artificial Sequence
  Description of Artificial Sequence: Synthetic coding sequence
atgaacctgacagaggactacatggtgtttgaagatgtggccatccacttcagccaggaggagtggggcatcctgaatgatgtgcagaggcacctgcacagtgatgtgatgctggagaactttgccctgctgagctctgtgggctgctggcatggagccaaggatgaggaggcccccagcaagcagtgtgtgtctgtgggcgtgtcccaggtgaccaccctgaagccagccctgagcacccagaaggcccagccctgtgagacctgcagcagcctgctgaaggacatcctgcacctggccgagcatgatggcacccaccccaagaggacagccaagctgtacctgcaccagaaggagcacctgcgggagaagctgaccaggagtgatgagggccggcccagctttgtgaatgattctgtgcacctggccaagaggaacctgacctgcatgcagggcggcaaggacttcaccggggacagcgacctgcagcagcaggccctgcacagcggctggaagccccaccgggacacccacggcgtggaggccttccagagcggccagaacaactacagctgcacccagtgtgggaaggacttctgccaccagcacaccctgtttgagcaccagaagatccacacagaggagcggccctatgaatgttctgaatgtgggaagctgttccgctacaacagcgacctgatcaagcaccagaggaaccacactggagagcggccctacaagtgcagtgaatgtgggaaggccttcagcctgaagtacaacgtggtgcagcaccagaagatccacactggagagcggccctatgaatgttctgaatgtgggaaggccttcctgaggaagagccacctgctgcagcaccagaggatccacacccggccccggccctacgtgtgcagtgaatgtgggaaggccttcctgacccaggcccacctggtgggccaccagaagatccacactggagagcggccctacggctgcaatgaatgtgggaagtacttcatgtacagcagcgccctgatccgccaccagaaggtgcacactggagagcggcccttctactgctgtgaatgtgggaagttcttcatggacagctgcaccctcatcatccaccagagggtgcacactggagagaagccctatgaatgtaatgaatgtgggaagttcttccgctaccgcagcaccctcatccgccaccagaaggtgcacactggagagaagccctatgaatgttctgaatgtgggaagttcttcatggacaccagcaccctcatcatccaccagagggtgcacactggagagaagccctatgagtgcaacaagtgtgggaagttcttccgctactgcttcaccctgaacagacaccagagggtgcacagcggggagcggccctatgaatgttctgaatgtgggaagttctttgtggacagctgcaccctgaagagccaccagagggtgcacactggagagcggccctttgaatgttccatctgtgggaagagcttccgctgccgcagcaccctggacacccaccagaggatccacactggagagcggccctatgaatgttctgaatgtgggaagttcttccgccacaacagcaaccacatccgccacagaagaaaccactttggagagaggagctttgaatgtacagaatgtggccgggtcttcagccagaacagccacctgatccgccaccagaaggtgcacacccgggagaggacctacaagtgcagcaaatgtgggaagttcttcatggacagcagcaccctcatcagccatgagcgggtgcacactggagagaagccctatgaatgttctgaatgtgggaaggtgttccgctacaacagcagcctcatcaagcaccggcgcatccacactggagagcggccctaccagtgcagtgaatgtggccgggtcttcaaccagaacagccacctgatccagcaccagaaggtgcacaccaggtag

SEQ ID NO: 17613 - DNA, 1989 bp, Artificial Sequence; identical to SEQ ID NO: 17612
  Description of Artificial Sequence: Synthetic coding sequence

SEQ ID NO: 17614 - DNA, 3090 bp, Artificial Sequence
  Description of Artificial Sequence: Synthetic coding sequence
atgacccgggagaatgtggcccacaatgccctgcggcaggagggcctggtgaagggcaaggatgacacctggaagtggggcaccagcttccagggcagcagcagctctgtgtgggagaccagccacctgcacttccggcagctgcgctaccacgagaccagcggcccccaggaggccctgagccggctgcgggagctgtgccgccgctggctgcggcctgaggcccggaccaaggcccagatcctggagctgctggtgctggagcagttcctgagcatcctgcctggagagatccgcacctgggtgcagctgcaccaccctggcagcggggaggaggccgtggccctggtggaggagctgcagaaggacctggatggccctgccatccaggtgcctgtgctggtgaaggaccaggacaccctgcagaaggtggtgtctgcccctggcaccaccctgccccctgtgctgcccggcagccacatcgctgctgagatctgcccccaccccccaacagacctggtggccttcaacctgcaggacccccagcacgacagccctgcccctgaggccagcgccctgagccaggaggagaaccccaggaaccagctgatggccctgatgctgctgacagcccagccccaggagctggtgatgtttgaggaggtgtctgtgtgcttcaccagcgaggagtgggcctgcctgggccccatccagagggccctgtactgggatgtgatgctggagaactatggaaatgtgaccagcctggagtgggagaccatgacagaaaatgaggaggtgaccagcaagcccagcagcagccagagagctgacagccacaagggcaccagcaagaggctgcagggctctgtgccccaggtgctggactttgaggaggagtgtgagtggcaggtgctggccagccagtggggcaatgaaacagatgaaagagctgacacagtgaagaaggtgtccctgtgtgagcgggacaagaagaagaggaccccacctgagaagcagggccagaagtggaaggagctgggggacagcctgacctttggaagtgccatcagcgagagcctcatcggcacagagggcaagaagttctacaagtgtgacatgtgctgcaagcacttcaacaagatcagccacctgatcaaccaccggcgcatccacactggagagaagccccacaagtgcaaggaatgtgggaagggcttcatccagaggagcagcctgctgatgcacctgaggaaccacagcggggagaagccctacaagtgcaatgaatgtgggaaggccttcagccagagcgcctacctgctgaaccaccagaggatccacactggagagaagccctacaagtgcaaggaatgtgggaagggcttctaccgccacagcggcctcatcatccacctgcggcggcacagcggggagcggccctacaagtgcaatgaatgtgggaaggtgttcagccagaatgcctacctgattgaccaccagaggctgcacaagggggaggagccctacaagtgcaacaagtgccagaaggccttcatcctgaagaagagcctcatcctgcaccagaggatccacagcggggagaagccctacaagtgtgatgaatgtgggaagacctttgcccagaccacctacctgattgaccaccagaggctgcacagcgctgagaacccctacaagtgcaaggaatgtgggaaggtgttcatccgcagcaagagcctgctgctgcaccagagggtgcacacagagaagaagaccttcggctgcaagaagtgtgggaagatcttcagcagcaagagcaacttcatcgaccacaagaggatgcacagccgggagaagccctacaagtgcacagaatgtgggaaggccttcacccagagcgcctacctgtttgaccaccagaggctgcacaatggagagaagccctatgaatgtaatgaatgtgggaaggtgttcatcctgaagaagagcctcatcctgcaccagcgcttccacactggagagaacctgtatgagtgcaaggactgtgggaaggtgtttggcagcaacagaaacctgattgaccacgagcggctgcacaatggagagaagccctatgaatgtcgggagtgtgggaagaccttcatcatgagcaagagcttcatggtgcaccagaagctgcacacccaggagaaggcctacaagtgtgaggactgtgggaaggccttctcctacaacagcagcctgctggtgcaccggcgcatccacactggagagaagccctttgaatgttctgaatgtggccgggccttcagcagcaacagaaacctgattgagcacaagaggatccacagcggggagaagccctatgaatgtgatgaatgtgggaagtgcttcatcctgaagaagagcctcatcggccaccagaggatccacacccgggagaagagctacaagtgcaatgactgtgggaaggtgttctcctaccgcagcaacctgattgcccaccagaggatccacactggagagaagccctatgcctgcagtgaatgtgggaagggcttcacctacaacagaaacctgattgagcaccagaggatccacagcggggagaagacctatgaatgtcatgtgtgcaggaaggtgctgaccagcagcaggaacctgatggtgcaccagaggatccacactggagagaagccctacaagtgcaatgaatgtgggaaggacttcagccagaacaagaacctggtggtgcaccagaggatgcacactggagagaagccctatgaatgtgacaagtgcaggaagagcttcaccagcaagaggaacctggtgggccaccagaggatccacactggagagaagccctacggctgcaatgactgcagcaaggtgttccggcagaggaagaacctgactgtgcaccagaagatccacacagatgagaagccctgtgaatgtgatgtgtctgagaaggagttcagccagaccagcaacctgcacctgcagcagaagatccacaccatcgaggagttctcctggctgcagaacaccaatgaaagcaagattgagatccagaagatctag

SEQ ID NO: 17615 - DNA, 804 bp, Artificial Sequence
  Description of Artificial Sequence: Synthetic coding sequence
atgacccgggagaatgtggcccacaatgccctgcggcaggagggcctggtgaagggcaaggatgacacctggaagtggggcaccagcttccagggcagcagcagctctgtgtgggagaccagccacctgcacttccggcagctgcgctaccacgagaccagcggcccccaggaggccctgagccggctgcgggagctgtgccgccgctggctgcggcctgaggcccggaccaaggcccagatcctggagctgctggtgctggagcagttcctgagcatcctgcctggagagatccgcacctgggtgcagctgcaccaccctggcagcggggaggaggccgtggccctggtggaggagctgcagaaggacctggatggccctgccatccaggtgcctgtgctggtgaaggaccaggacaccctgcagaaggtggtgtctgcccctggcaccaccctgccccctgtgctgcccggcagccacatcgctgctgagatctgcccccaccccccaacagacctggtggccttcaacctgcaggacccccagcacgacagccctgcccctgaggccagcgccctgagccaggaggagaaccccaggaaccagctgatggccctgatgctgctgacagcccagccccaggagctggtgatgtttgaggaggtgtctgtgtgcttcaccagcgaggagtgggcctgcctgggccccatccagagggccctgtactgggatgtgatgctggagaactatggaaatgtgaccagcctgggctacaggaagtaccgccggcagaggaacaagtag

SEQ ID NO: 17616 - DNA, 804 bp, Artificial Sequence; identical to SEQ ID NO: 17615
  Description of Artificial Sequence: Synthetic coding sequence

SEQ ID NO: 17617 - DNA, 3090 bp, Artificial Sequence; identical to SEQ ID NO: 17614
  Description of Artificial Sequence: Synthetic coding sequence

SEQ ID NO: 17618 - DNA, 240 bp, Artificial Sequence
  Description of Artificial Sequence: Synthetic coding sequence
atgacccgggagaatgtggcccacaatgccctgcggcaggagggcctggtgaagggcaaggatgacacctggaagtggggcaccagcttccagggcagcagcagctctgtgtgggagaccagccacctgcacttccggcagctgcgctaccacgagaccagcggcccccaggaggccctgagccggctgcgggagctgtgccgccgctggctgcggcctgaggcccggaccaaggcctag

SEQ ID NO: 17619 - DNA, 966 bp, Artificial Sequence
  Description of Artificial Sequence: Synthetic coding sequence
atgacccgggagaatgtggcccacaatgccctgcggcaggagggcctggtgaagggcaaggatgacacctggaagtggggcaccagcttccagggcagcagcagctctgtgtgggagaccagccacctgcacttccggcagctgcgctaccacgagaccagcggcccccaggaggccctgagccggctgcgggagctgtgccgccgctggctgcggcctgaggcccggaccaaggcccagatcctggagctgctggtgctggagcagttcctgagcatcctgcctggagagatccgcacctgggtgcagctgcaccaccctggcagcggggaggaggccgtggccctggtggaggagctgcagaaggacctggatggccctgccatccaggtgcctgtgctggtgaaggaccaggacaccctgcagaaggtggtgtctgcccctggcaccaccctgccccctgtgctgcccggcagccacatcgctgctgagatctgcccccaccccccaacagacctggtggccttcaacctgcaggacccccagcacgacagccctgcccctgaggccagcgccctgagccaggaggagaaccccaggaaccagctgatggccctgatgctgctgacagcccagccccaggagctggtgatgtttgaggaggtgtctgtgtgcttcaccagcgaggagtgggcctgcctgggccccatccagagggccctgtactgggatgtgatgctggagaactatggaaatgtgaccagcctggagtgggagaccatgacagaaaatgaggaggtgaccagcaagcccagcagcagccagagagctgacagccacaagggcaccagcaagaggctgcagggctctgtgccccaggtgctggactttgaggaggagtgtgagtggcaggtgctggccagccagtggggcaatgaaacagatgaaagagctgacacagtgtag

SEQ ID NO: 17620 - DNA, 1386 bp, Artificial Sequence
  Description of Artificial Sequence: Synthetic coding sequence
atggagcgggagggcatctggcacagcaccctgggggagacctgggagcccaacaactggctggagggccagcaggacagccacctgagccaggtgggcgtgacccacaaggagaccttcacagagatgagggtgtgtggcggcaatgaatttgagcgctgcagcagccaggacagcatcctggacacccagcagagcatccccatggtgaagaggccccacaactgcaacagccatggagaagatgccacccagaacagcgagctgatcaagacccagaggatgtttgtgggcaagaagatctatgagtgcaaccagtgcagcaagaccttcagccagagcagcagcctgctgaagcaccagaggatccacactggagagaagccctacaagtgcaatgtgtgtgggaagcacttcatcgagaggagcagcctgactgtgcaccagaggatccacactggagagaagccctacaagtgcaatgaatgtgggaaggccttcagccagagcatgaacctgactgtgcaccagaggacccacactggagagaagccctaccagtgcaaggaatgtgggaaggccttccacaagaacagcagcctcatccagcacgagcgcatccacactggagagaagccctacaagtgcaatgaatgtgggaaggccttcacccagagcatgaacctgactgtgcaccagaggacccacactggagagaagccctatgaatgtaatgaatgtgggaaggccttcagccagagcatgcacctgattgtgcaccagaggagccacactggagagaagccctatgaatgttcccagtgtgggaaggccttcagcaagagcagcaccctgaccctgcaccagaggaaccacactggagagaagccctacaagtgcaacaagtgtgggaagagcttcagccagagcacctacctgattgagcaccagaggctgcacagcggcgtgaagccctttgaatgtaatgaatgtgggaaggccttcagcaagaacagcagcctgacccagcaccggcgcatccacactggagagaagccctatgagtgcatggtgtgtgggaagcacttcaccggccgcagcagcctgactgtgcaccaggtgatccacactggagagaagccctatgaatgtaatgaatgtgggaaggccttcagccagagcgcctacctgattgagcaccagaggatccacactggagagaagccctatgaatgtgaccagtgtgggaaggccttcatcaagaacagcagcctgactgtgcaccagaggacccacactggagagaagccctaccagtgcaatgaatgtgggaaggccttcagccgcagcaccaacctgaccaggcaccagaggacccacacctag

SEQ ID NO: 17621 - DNA, 1386 bp, Artificial Sequence; identical to SEQ ID NO: 17620
  Description of Artificial Sequence: Synthetic coding sequence

SEQ ID NO: 17622 - DNA, 1386 bp, Artificial Sequence; identical to SEQ ID NO: 17620
  Description of Artificial Sequence: Synthetic coding sequence

SEQ ID NO: 17623 - DNA, 72 bp, Artificial Sequence
  Description of Artificial Sequence: Synthetic coding sequence
atggagcgggagggcatctggcacagcaccctgggggagacctgggagcccaacaactggctggagggctag

SEQ ID NO: 17624 - DNA, 30 bp, Artificial Sequence
  Description of Artificial Sequence: Synthetic coding sequence
atggagcgggagggcatctggcacagctag

SEQ ID NO: 17625 - DNA, 1386 bp, Artificial Sequence; identical to SEQ ID NO: 17620
  Description of Artificial Sequence: Synthetic coding sequence

SEQ ID NO: 17626 - DNA, 1734 bp, Artificial Sequence
  Description of Artificial Sequence: Synthetic coding sequence
atgctgggcttccccccaggccggccccagctgcctgtgcagctgcggccccagaccaggatggccacagccctgcgggaccctgcctctgtgcccatcgccacagaggtgctcttcaagctgacccagggctctgtgacctttgaagatgtggccgtgtacttctcctgggaggagtgggacctgctggatgaggcccagaagcacctgtactttgatgtgatgctggagaactttgccctgaccagcagcctgggctgctggtgtggggtggagcacgaggagacccccagcgagcagaggatctctggagagcgggtgccccagttccgcaccagcaaggagggcagcagcagccagaatgctgacagctgtgagatctgctgcctggtgctgcgggacatcctgcacctggccgagcaccagggcaccaactgtggccagaagctgcacacctgtgggaagcagttctacatcagcgccaacctgcagcagcaccagaggcagcacatcacagaggcccccttccgctcctatgtggacacagccagcttcacccagagctgcatcgtgcacgtgtctgagaagcccttcacctgccgggagatcaggaaggacttcctggccaacatgaggttcctgcaccaggatgccacccagacaggagagaagcccaacaacagcaacaagtgtgctgtggccttctacagcggcaagagccaccacaactggggcaagtgcagcaaggccttcagccacatcgacaccctggtgcaggaccagaggatcctgacccgggagggcctgtttgaatgttccaaatgtgggaaggcctgcacccggcgctgcaacctgatccagcaccagaaggtgcacagcgaggagcggccctatgaatgtaatgaatgtgggaagttcttcacctactacagcagcttcatcatccaccagagggtgcacactggagagcggccctatgcctgcccagaatgtgggaagagcttcagccagatctacagcctgaacagccacaggaaggtgcacactggagagcggccctatgaatgtggggagtgtgggaagagcttcagccagaggagcaacctgatgcagcacagaagagtgcacactggagagcggccctatgaatgttctgaatgtgggaagagcttcagccagaacttcagcctcatctaccaccagagggtgcacactggagagcggccccatgaatgtaatgaatgtgggaagagcttcagccgcagcagcagcctcatccaccaccggcggctgcacactggagagcggccctatgaatgttccaaatgtgggaagagcttcaagcagagcagcagcttcagcagccacaggaaggtgcacactggagagcggccctacgtgtgtggggagtgtgggaagagcttcagccacagcagcaacctgaagaaccaccagagggtgcacactggagagaggcctgtggagtgcagcgagtgcagcaagagcttcagctgcaagagcaacctgatcaagcacctgcgggtgcacactggagagcggccctatgaatgttctgaatgtgggaagagcttcagccagagcagcagcctcatccagcacagaagagtgcacacaggcaagaggccctaccagtgcagccagtgtgggaagagctttggctgcaagtctgtgctgatccagcaccagagggtgcacatcggggagaagccctag

SEQ ID NO: 17627 - DNA, 1668 bp, Artificial Sequence
  Description of Artificial Sequence: Synthetic coding sequence
atgctggagaactttgccctgaccagcagcctgggcctcatcagctcctggagccacgtggtggcccagctgggcctgggggaggtgcccagcgtgctgcacaggatgttcatgaccccagccagcgcccgctgggaccagaggggccctggcctgcacgagtggcacctgggcaagggcatgagcagcggctgctggtgtggggtggagcacgaggagacccccagcgagcagaggatctctggagagcgggtgccccagttccgcaccagcaaggagggcagcagcagccagaatgctgacagctgtgagatctgctgcctggtgctgcgggacatcctgcacctggccgagcaccagggcaccaactgtggccagaagctgcacacctgtgggaagcagttctacatcagcgccaacctgcagcagcaccagaggcagcacatcacagaggcccccttccgctcctatgtggacacagccagcttcacccagagctgcatcgtgcacgtgtctgagaagcccttcacctgccgggagatcaggaaggacttcctggccaacatgaggttcctgcaccaggatgccacccagacaggagagaagcccaacaacagcaacaagtgtgctgtggccttctacagcggcaagagccaccacaactggggcaagtgcagcaaggccttcagccacatcgacaccctggtgcaggaccagaggatcctgacccgggagggcctgtttgaatgttccaaatgtgggaaggcctgcacccggcgctgcaacctgatccagcaccagaaggtgcacagcgaggagcggccctatgaatgtaatgaatgtgggaagttcttcacctactacagcagcttcatcatccaccagagggtgcacactggagagcggccctatgcctgcccagaatgtgggaagagcttcagccagatctacagcctgaacagccacaggaaggtgcacactggagagcggccctatgaatgtggggagtgtgggaagagcttcagccagaggagcaacctgatgcagcacagaagagtgcacactggagagcggccctatgaatgttctgaatgtgggaagagcttcagccagaacttcagcctcatctaccaccagagggtgcacactggagagcggccccatgaatgtaatgaatgtgggaagagcttcagccgcagcagcagcctcatccaccaccggcggctgcacactggagagcggccctatgaatgttccaaatgtgggaagagcttcaagcagagcagcagcttcagcagccacaggaaggtgcacactggagagcggccctacgtgtgtggggagtgtgggaagagcttcagccacagcagcaacctgaagaaccaccagagggtgcacactggagagaggcctgtggagtgcagcgagtgcagcaagagcttcagctgcaagagcaacctgatcaagcacctgcgggtgcacactggagagcggccctatgaatgttctgaatgtgggaagagcttcagccagagcagcagcctcatccagcacagaagagtgcacacaggcaagaggccctaccagtgcagccagtgtgggaagagctttggctgcaagtctgtgctgatccagcaccagagggtgcacatcggggagaagccctag

SEQ ID NO: 17628 - DNA, 1695 bp, Artificial Sequence
  Description of Artificial Sequence: Synthetic coding sequence
atgctgggcttccccccaggccggccccagctgcctgtgcagctgcggccccagaccaggatggccacagccctgcgggaccctgccagcggctctgtgacctttgaagatgtggccgtgtacttctcctgggaggagtgggacctgctggatgaggcccagaagcacctgtactttgatgtgatgctggagaactttgccctgaccagcagcctgggctgctggtgtggggtggagcacgaggagaccccatctgagcagaggatcagcggggagcgggtgccccagttccgcaccagcaaggagggcagcagcagccagaatgctgacagctgtgagatctgctgcctggtgctgcgggacatcctgcacctggccgagcaccagggcaccaactgtggccagaagctgcacacctgtgggaagcagttctacatcagcgccaacctgcagcagcaccagaggcagcacatcacagaggcccccttccgctcctatgtggacacagccagcttcacccagagctgcatcgtgcacgtgtctgagaagcccttcacctgccgggagatcaggaaggacttcctggccaacatgaggttcctgcaccaggatgccacccagacaggagagaagcccaacaacagcaacaagtgtgctgtggccttctacagcggcaagagccaccacaactggggcaagtgcagcaaggccttcagccacatcgacaccctggtgcaggaccagaggatcctgacccgggagggcctgtttgagtgcagcaaatgtgggaaggcctgcacccggcgctgcaacctgatccagcaccagaaggtgcacagcgaggagcggccctatgagtgcaatgaatgtgggaagttcttcacctactacagcagcttcatcatccaccagagggtgcacactggagagcggccctatgcctgcccagaatgtgggaagagcttcagccagatctacagcctgaacagccacaggaaggtgcacactggagagcggccctatgaatgtggagaatgtgggaagagcttcagccagaggagcaacctgatgcagcaccggcgggtgcacactggagagcggccctatgagtgcagtgaatgtgggaagagcttcagccagaacttcagcctcatctaccaccagagggtgcacactggagagcggccccatgagtgcaatgaatgtgggaagagcttcagccgcagcagcagcctcatccaccaccggcggctgcacactggagagcggccctatgagtgcagcaaatgtgggaagagcttcaagcagagcagcagcttcagcagccacaggaaggtgcacactggagagcggccctacgtgtgtggagaatgtgggaagagcttcagccacagcagcaacctgaagaaccaccagagggtgcacactggagagaggcctgtggagtgcagtgaatgttccaagagcttcagctgcaagagcaacctgatcaagcacctgcgggtgcacactggagagcggccctatgagtgcagtgaatgtgggaagagcttcagccagagcagcagcctcatccagcaccggcgggtgcacacaggcaagaggccctaccagtgcagccagtgtgggaagagctttggctgcaagtctgtgctgatccagcaccagagggtgcacatcggggagaagccctag

SEQ ID NO: 17629 - DNA, 1512 bp, Artificial Sequence
  Description of Artificial Sequence: Synthetic coding sequence
atgctggagaactttgccctgaccagcagcctgggctgctggtgtggggtggagcacgaggagacccccagcgagcagaggatctctggagagcgggtgccccagttccgcaccagcaaggagggcagcagcagccagaatgctgacagctgtgagatctgctgcctggtgctgcgggacatcctgcacctggccgagcaccagggcaccaactgtggccagaagctgcacacctgtgggaagcagttctacatcagcgccaacctgcagcagcaccagaggcagcacatcacagaggcccccttccgctcctatgtggacacagccagcttcacccagagctgcatcgtgcacgtgtctgagaagcccttcacctgccgggagatcaggaaggacttcctggccaacatgaggttcctgcaccaggatgccacccagacaggagagaagcccaacaacagcaacaagtgtgctgtggccttctacagcggcaagagccaccacaactggggcaagtgcagcaaggccttcagccacatcgacaccctggtgcaggaccagaggatcctgacccgggagggcctgtttgaatgttccaaatgtgggaaggcctgcacccggcgctgcaacctgatccagcaccagaaggtgcacagcgaggagcggccctatgaatgtaatgaatgtgggaagttcttcacctactacagcagcttcatcatccaccagagggtgcacactggagagcggccctatgcctgcccagaatgtgggaagagcttcagccagatctacagcctgaacagccacaggaaggtgcacactggagagcggccctatgaatgtggggagtgtgggaagagcttcagccagaggagcaacctgatgcagcacagaagagtgcacactggagagcggccctatgaatgttctgaatgtgggaagagcttcagccagaacttcagcctcatctaccaccagagggtgcacactggagagcggccccatgaatgtaatgaatgtgggaagagcttcagccgcagcagcagcctcatccaccaccggcggctgcacactggagagcggccctatgaatgttccaaatgtgggaagagcttcaagcagagcagcagcttcagcagccacaggaaggtgcacactggagagcggccctacgtgtgtggggagtgtgggaagagcttcagccacagcagcaacctgaagaaccaccagagggtgcacactggagagaggcctgtggagtgcagcgagtgcagcaagagcttcagctgcaagagcaacctgatcaagcacctgcgggtgcacactggagagcggccctatgaatgttctgaatgtgggaagagcttcagccagagcagcagcctcatccagcacagaagagtgcacacaggcaagaggccctaccagtgcagccagtgtgggaagagctttggctgcaagtctgtgctgatccagcaccagagggtgcacatcggggagaagccctag

SEQ ID NO: 17630 - DNA, 1707 bp, Artificial Sequence
  Description of Artificial Sequence: Synthetic coding sequence
atgatcagcgcctactgcaacctgcacctgctgggcagcagtgacagccctgccagcgccagccaggtggccggcaccaccggcatgaggcaccacgcccagggctctgtgacctttgaagatgtggccgtgtacttctcctgggaggagtgggacctgctggatgaggcccagaagcacctgtactttgatgtgatgctggagaactttgccctgaccagcagcctgggctgctggtgtggggtggagcacgaggagaccccatctgagcagaggatcagcggggagcgggtgccccagttccgcaccagcaaggagggcagcagcagccagaatgctgacagctgtgagatctgctgcctggtgctgcgggacatcctgcacctggccgagcaccagggcaccaactgtggccagaagctgcacacctgtgggaagcagttctacatcagcgccaacctgcagcagcaccagaggcagcacatcacagaggcccccttccgctcctatgtggacacagccagcttcacccagagctgcatcgtgcacgtgtctgagaagcccttcacctgccgggagatcaggaaggacttcctggccaacatgaggttcctgcaccaggatgccacccagacaggagagaagcccaacaacagcaacaagtgtgctgtggccttctacagcggcaagagccaccacaactggggcaagtgcagcaaggccttcagccacatcgacaccctggtgcaggaccagaggatcctgacccgggagggcctgtttgagtgcagcaaatgtgggaaggcctgcacccggcgctgcaacctgatccagcaccagaaggtgcacagcgaggagcggccctatgagtgcaatgaatgtgggaagttcttcacctactacagcagcttcatcatccaccagagggtgcacactggagagcggccctatgcctgcccagaatgtgggaagagcttcagccagatctacagcctgaacagccacaggaaggtgcacactggagagcggccctatgaatgtggagaatgtgggaagagcttcagccagaggagcaacctgatgcagcaccggcgggtgcacactggagagcggccctatgagtgcagtgaatgtgggaagagcttcagccagaacttcagcctcatctaccaccagagggtgcacactggagagcggccccatgagtgcaatgaatgtgggaagagcttcagccgcagcagcagcctcatccaccaccggcggctgcacactggagagcggccctatgagtgcagcaaatgtgggaagagcttcaagcagagcagcagcttcagcagccacaggaaggtgcacactggagagcggccctacgtgtgtggagaatgtgggaagagcttcagccacagcagcaacctgaagaaccaccagagggtgcacactggagagaggcctgtggagtgcagtgaatgttccaagagcttcagctgcaagagcaacctgatcaagcacctgcgggtgcacactggagagcggccctatgagtgcagtgaatgtgggaagagcttcagccagagcagcagcctcatccagcaccggcgggtgcacacaggcaagaggccctaccagtgcagccagtgtgggaagagctttggctgcaagtctgtgctgatccagcaccagagggtgcacatcggggagaagccctag

SEQ ID NO: 17631 - DNA, 1668 bp, Artificial Sequence; identical to SEQ ID NO: 17627
  Description of Artificial Sequence: Synthetic coding sequence

SEQ ID NO: 17632 - DNA, 1731 bp, Artificial Sequence
  Description of Artificial Sequence: Synthetic coding sequence
atgaggaccctgcggcagcgggaggtggagtacttcagcaaggccacccagctggtgcggggcagcaccaaggacagaggagcccaggtgcccatcgccacagaggtgctcttcaagctgacccagggctctgtgacctttgaagatgtggccgtgtacttctcctgggaggagtgggacctgctggatgaggcccagaagcacctgtactttgatgtgatgctggagaactttgccctgaccagcagcctgggctgctggtgtggggtggagcacgaggagaccccatctgagcagaggatcagcggggagcgggtgccccagttccgcaccagcaaggagggcagcagcagccagaatgctgacagctgtgagatctgctgcctggtgctgcgggacatcctgcacctggccgagcaccagggcaccaactgtggccagaagctgcacacctgtgggaagcagttctacatcagcgccaacctgcagcagcaccagaggcagcacatcacagaggcccccttccgctcctatgtggacacagccagcttcacccagagctgcatcgtgcacgtgtctgagaagcccttcacctgccgggagatcaggaaggacttcctggccaacatgaggttcctgcaccaggatgccacccagacaggagagaagcccaacaacagcaacaagtgtgctgtggccttctacagcggcaagagccaccacaactggggcaagtgcagcaaggccttcagccacatcgacaccctggtgcaggaccagaggatcctgacccgggagggcctgtttgagtgcagcaaatgtgggaaggcctgcacccggcgctgcaacctgatccagcaccagaaggtgcacagcgaggagcggccctatgagtgcaatgaatgtgggaagttcttcacctactacagcagcttcatcatccaccagagggtgcacactggagagcggccctatgcctgcccagaatgtgggaagagcttcagccagatctacagcctgaacagccacaggaaggtgcacactggagagcggccctatgaatgtggagaatgtgggaagagcttcagccagaggagcaacctgatgcagcaccggcgggtgcacactggagagcggccctatgagtgcagtgaatgtgggaagagcttcagccagaacttcagcctcatctaccaccagagggtgcacactggagagcggccccatgagtgcaatgaatgtgggaagagcttcagccgcagcagcagcctcatccaccaccggcggctgcacactggagagcggccctatgagtgcagcaaatgtgggaagagcttcaagcagagcagcagcttcagcagccacaggaaggtgcacactggagagcggccctacgtgtgtggagaatgtgggaagagcttcagccacagcagcaacctgaagaaccaccagagggtgcacactggagagaggcctgtggagtgcagtgaatgttccaagagcttcagctgcaagagcaacctgatcaagcacctgcgggtgcacactggagagcggccctatgagtgcagtgaatgtgggaagagcttcagccagagcagcagcctcatccagcaccggcgggtgcacacaggcaagaggccctaccagtgcagccagtgtgggaagagctttggctgcaagtctgtgctgatccagcaccagagggtgcacatcggggagaagccctag

SEQ ID NO: 17633 - DNA, 1890 bp, Artificial Sequence
  Description of Artificial Sequence: Synthetic coding sequence
atgctgggcttccccccaggccggccccagctgcctgtgcagctgcggccccagaccaggatggccacagccctgcgggaccctgcctctgtgcccatcgccacagaggtgctcttcaagctgacccagggctctgtgacctttgaagatgtggccgtgtacttctcctgggaggagtgggacctgctggatgaggcccagaagcacctgtactttgatgtgatgctggagaactttgccctgaccagcagcctgggcctcatcagctcctggagccacgtggtggcccagctgggcctgggggaggtgcccagcgtgctgcacaggatgttcatgaccccagccagcgcccgctgggaccagaggggccctggcctgcacgagtggcacctgggcaagggcatgagcagcggctgctggtgtggggtggagcacgaggagacccccagcgagcagaggatctctggagagcgggtgccccagttccgcaccagcaaggagggcagcagcagccagaatgctgacagctgtgagatctgctgcctggtgctgcgggacatcctgcacctggccgagcaccagggcaccaactgtggccagaagctgcacacctgtgggaagcagttctacatcagcgccaacctgcagcagcaccagaggcagcacatcacagaggcccccttccgctcctatgtggacacagccagcttcacccagagctgcatcgtgcacgtgtctgagaagcccttcacctgccgggagatcaggaaggacttcctggccaacatgaggttcctgcaccaggatgccacccagacaggagagaagcccaacaacagcaacaagtgtgctgtggccttctacagcggcaagagccaccacaactggggcaagtgcagcaaggccttcagccacatcgacaccctggtgcaggaccagaggatcctgacccgggagggcctgtttgaatgttccaaatgtgggaaggcctgcacccggcgctgcaacctgatccagcaccagaaggtgcacagcgaggagcggccctatgaatgtaatgaatgtgggaagttcttcacctactacagcagcttcatcatccaccagagggtgcacactggagagcggccctatgcctgcccagaatgtgggaagagcttcagccagatctacagcctgaacagccacaggaaggtgcacactggagagcggccctatgaatgtggggagtgtgggaagagcttcagccagaggagcaacctgatgcagcacagaagagtgcacactggagagcggccctatgaatgttctgaatgtgggaagagcttcagccagaacttcagcctcatctaccaccagagggtgcacactggagagcggccccatgaatgtaatgaatgtgggaagagcttcagccgcagcagcagcctcatccaccaccggcggctgcacactggagagcggccctatgaatgttccaaatgtgggaagagcttcaagcagagcagcagcttcagcagccacaggaaggtgcacactggagagcggccctacgtgtgtggggagtgtgggaagagcttcagccacagcagcaacctgaagaaccaccagagggtgcacactggagagaggcctgtggagtgcagcgagtgcagcaagagcttcagctgcaagagcaacctgatcaagcacctgcgggtgcacactggagagcggccctatgaatgttctgaatgtgggaagagcttcagccagagcagcagcctcatccagcacagaagagtgcacacaggcaagaggccctaccagtgcagccagtgtgggaagagctttggctgcaagtctgtgctgatccagcaccagagggtgcacatcggggagaagccctag

SEQ ID NO: 17634 - DNA, 117 bp, Artificial Sequence
  Description of Artificial Sequence: Synthetic coding sequence
atgctgggcttccccccaggccggccccagctgcctgtgcagctgcggccccagaccaggatggccacagccctgcgggaccctgccagcgctgtgcagtggaagaagaggctgtag

SEQ ID NO: 17635 - DNA, 1854 bp, Artificial Sequence
  Description of Artificial Sequence: Synthetic coding sequence
atgatcagccccagcctggagctgctgcacagcggcctgtgcaagtttcctgaggtggagggcaagatgaccaccttcaaggaggccgtgaccttcaaggatgtggccgtggtgttcacagaggaggagctgggcctgctggaccctgcccagaggaagctgtacagagatgtgatgctggagaacttcaggaacctgctgtctgtgggcaaccagcccttccaccaggacaccttccacttcctgggcaaggagaagttctggaagatgaagaccaccagccagcgggagggcaacagcggcggcaagatccagatcgagatggagaccgtgcctgaggccggcccccatgaggagtggagctgccagcagatctgggagcagatcgccagtgacctgaccaggagccagaacagcatccggaacagcagccagttcttcaaggagggagatgtgccctgccagatcgaggcccggctgagcatcagccacgtgcagcagaagccctaccgctgcaatgaatgcaagcagagcttcagtgatgtgtctgtgtttgacctgcaccagcagagccacagcggggagaagagccacacctgtggggagtgtgggaagagcttctgctacagccctgccctgcacatccaccagagggtgcacatgggagagaagtgctacaagtgtgatgtgtgtgggaaggagttcaaccagagcagccacctgcagacccaccagagggtgcacactggagagaagcccttcaagtgtggccagtgtgggaagggcttccacagccgcagcgccctgaatgtgcactgcaagctgcacactggagagaagccctacaactgtgaggagtgtgggaaggccttcatccatgacagccagctgcaggagcaccagaggatccacactggagagaagcccttcaagtgtgacatctgtgggaagagcttccgggtgcgcagccggctgaacagacacagcatggtgcacactggagagaaggccttccgctgtgacacctgtgggaagaacttccggcagaggtctgccctgaacagccacagcatggtgcacatcgaggagaagccctacaagtgtgagcagtgtgggaagggcttcatctgccggcgggacttctgcaagcaccagatggtgcacactggagagaagccctacaactgcaaggaatgtgggaagaccttccgctggagcagctgcctgctgaaccaccagcaggtgcacagcggccagaagagcttcaagtgtgaggagtgtgggaagggcttctacaccaacagccgccgcagcagccaccagaggagccacaatggagagaagccctacaactgtgaggagtgtgggaaggactacaagaggcggctggacctggagttccaccagagggtgcacactggagagcggccctacaactgcaaggaatgtgggaagagctttggctgggccagctgcctgctgaagcaccagaggctgcacagcggggagaagcccttcaagtgtgaggagtgtgggaagcgcttcacccagagcagccagctgcacagccaccagacctgccacactggagagaagctgtacaagtgtgagcagtgtgagaagggctacaacagcaagttcaacctggacatgcaccagagggtgcacggcggggagcggccctacaactgcaaggaatgtgggaagagctttggctgggccagctgcctgctgaagcaccagaggctgcacagcggggagaagcccctgaagagcggcgtgtgggaggagatctacagcgagttcaccgccagcttcacctctgtgtccctgtgtggcaggaaggccatctag

SEQ ID NO: 17636 - DNA, 144 bp, Artificial Sequence
  Description of Artificial Sequence: Synthetic coding sequence
atgaccaccttcaaggaggccgtgaccttcaaggatgtggccgtggtgttcacagaggaggagctgggcctgctggaccctgcccagaggaagctgtacagagatgtgatgctggagaacttcaggaacctgctgtctgtgtag

SEQ ID NO: 17637 - DNA, 1356 bp, Artificial Sequence
  Description of Artificial Sequence: Synthetic coding sequence
atggccaagctgtatgaagctgtgaccttcaaggatgtggccgtcatcttcacagaggaggagctgggcctgctggaccctgcccagaggaagctgtacagagatgtgatgctggagaacttcaggaacctgctgtctgtgggcggcaagatccagacagagatggagaccgtgcctgaggccggcacccatgaggagttcagctgcaagcagatctgggagcagatcgccagtgacctgaccaggagccaggacaccaccatcagcaacagccagctgtttgagcaggatgacaaccccagccagatcaaggcccggctgagcacagtgcacacccgggagaagcccttccagggcgagaactgcaagcagttcttcagtgatgtgtccttctttgacctgccccagcagctgtacagcggggagaagagccacacctgtgatgaatgtgggaagagcttctgctacatcagcgccctgcacatccaccagagggtgcacatgggcgtgaagtgctacaagtgtgatgtgtgtgggaaggagttcagccagagcagccggctgcagacccaccagagggtgcacactggagagaagcccttcaagtgtgagcagtgtgggaagggcttccgctgccgcagcgccctgaaggtgcactgcaagctgcacatgagggagaagccctacaactgtgagaagtgtgggaaggccttcatgcacaacttccagctgcagaagcaccaccgcatccacactggagagaagcccttcaagtgtgagatctgtgggaagagcttctgcctgcggagcagcctgaacagacactgcatggtgcacacagctgagaagctgtacaagtctgagaagtatggccggggcttcatcgaccggctggacctgcacaagcaccagatgatccacatgggccagaagccctacaactgcaaggaatgtgggaagagcttcaagtggagcagctacctgctggtgcaccagagggtgcacactggagagaagccctacaagtgtgaagaatgtgggaagggctacatcagcaagagcggcctggacttccaccacaggacccacactggagagaggagctacaactgtgacaactgtgggaagagcttcagacatgccagcagcatcctgaaccacaagaagctgcactgccagaggaagcccctgaagtgtgaggactgtgggaagaggctggtgtgccgcagctactgcaaggaccagcagagggaccacagcggggagaaccccagcaaatgtgaggactgtgggaagcgctacaagaggcggctgaacctggacatcatcctgagcctcttcctgaatgacatctag

SEQ ID NO: 17638 - DNA, 1194 bp, Artificial Sequence
  Description of Artificial Sequence: Synthetic coding sequence
atggagaccgtgcctgaggccggcacccatgaggagttcagctgcaagcagatctgggagcagatcgccagtgacctgaccaggagccaggacaccaccatcagcaacagccagctgtttgagcaggatgacaaccccagccagatcaaggcccggctgagcacagtgcacacccgggagaagcccttccagggcgagaactgcaagcagttcttcagtgatgtgtccttctttgacctgccccagcagctgtacagcggggagaagagccacacctgtgatgaatgtgggaagagcttctgctacatcagcgccctgcacatccaccagagggtgcacatgggcgtgaagtgctacaagtgtgatgtgtgtgggaaggagttcagccagagcagccggctgcagacccaccagagggtgcacactggagagaagcccttcaagtgtgagcagtgtgggaagggcttccgctgccgcagcgccctgaaggtgcactgcaagctgcacatgagggagaagccctacaactgtgagaagtgtgggaaggccttcatgcacaacttccagctgcagaagcaccaccgcatccacactggagagaagcccttcaagtgtgagatctgtgggaagagcttctgcctgcggagcagcctgaacagacactgcatggtgcacacagctgagaagctgtacaagtctgagaagtatggccggggcttcatcgaccggctggacctgcacaagcaccagatgatccacatgggccagaagccctacaactgcaaggaatgtgggaagagcttcaagtggagcagctacctgctggtgcaccagagggtgcacactggagagaagccctacaagtgtgaagaatgtgggaagggctacatcagcaagagcggcctggacttccaccacaggacccacactggagagaggagctacaactgtgacaactgtgggaagagcttcagacatgccagcagcatcctgaaccacaagaagctgcactgccagaggaagcccctgaagtgtgaggactgtgggaagaggctggtgtgccgcagctactgcaaggaccagcagagggaccacagcggggagaaccccagcaaatgtgaggactgtgggaagcgctacaagaggcggctgaacctggacatcatcctgagcctcttcctgaatgacatctag

SEQ ID NO: 17639 - DNA, 1476 bp, Artificial Sequence
  Description of Artificial Sequence: Synthetic coding sequence
atgattgacagcggggagaagaagccaggaagaagagctgaggaggccgtgaccttcaaggatgtggccgtcatcttcacagaggaggagctgggcctgctggaccctgcccagaggaagctgtacagagatgtgatgctggagaacttcaggaacctgctgtctgtgggccaccagcccttccacggggacaccttccacttcctgcgggaggagaagttctgggtgatgggcaccaccagccagcgggagggcaacctgggcggcaagatccagacagagatggagaccgtgcctgaggccggcacccatgaggagttcagctgcaagcagatctgggagcagatcgccagtgacctgaccaggagccaggacaccaccatcagcaacagccagctgtttgagcaggatgacaaccccagccagatcaaggcccggctgagcacagtgcacacccgggagaagcccttccagggcgagaactgcaagcagttcttcagtgatgtgtccttctttgacctgccccagcagctgtacagcggggagaagagccacacctgtgatgaatgtgggaagagcttctgctacatcagcgccctgcacatccaccagagggtgcacatgggcgtgaagtgctacaagtgtgatgtgtgtgggaaggagttcagccagagcagccggctgcagacccaccagagggtgcacactggagagaagcccttcaagtgtgagcagtgtgggaagggcttccgctgccgcagcgccctgaaggtgcactgcaagctgcacatgagggagaagccctacaactgtgagaagtgtgggaaggccttcatgcacaacttccagctgcagaagcaccaccgcatccacactggagagaagcccttcaagtgtgagatctgtgggaagagcttctgcctgcggagcagcctgaacagacactgcatggtgcacacagctgagaagctgtacaagtctgagaagtatggccggggcttcatcgaccggctggacctgcacaagcaccagatgatccacatgggccagaagccctacaactgcaaggaatgtgggaagagcttcaagtggagcagctacctgctggtgcaccagagggtgcacactggagagaagccctacaagtgtgaagaatgtgggaagggctacatcagcaagagcggcctggacttccaccacaggacccacactggagagaggagctacaactgtgacaactgtgggaagagcttcagacatgccagcagcatcctgaaccacaagaagctgcactgccagaggaagcccctgaagtgtgaggactgtgggaagaggctggtgtgccgcagctactgcaaggaccagcagagggaccacagcggggagaaccccagcaaatgtgaggactgtgggaagcgctacaagaggcggctgaacctggacatcatcctgagcctcttcctgaatgacatctag

SEQ ID NO: 17640 - DNA, 1449 bp, Artificial Sequence
  Description of Artificial Sequence: Synthetic coding sequence
atgaccatgagcaaggaggccgtgaccttcaaggatgtggccgtggtgttcacagaggaggagctgggcctgctggacctggcccagaggaagctgtacagagatgtgatgctggagaacttcaggaacctgctgtctgtgggccaccagcccttccaccgggacaccttccacttcctgcgggaggagaagttctggatgatggacatcgccacccagcgggagggcaacagcggcggcaagatccagcctgagatgaagaccttccctgaggccggcccccatgagggctggagctgccagcagatctgggaggagatcgccagtgacctgacccggccccaggacagcaccatcaagagcagccagttctttgagcagggagatgcccacagccaggtggaggagggcctgagcatcatgcacacaggccagaagcccagcaactgtgggaagtgcaagcagagcttcagtgacatgagcatctttgacctgccccagcagatccgctctgctgagaagagccacagctgtgatgaatgtgggaagagcttctgctacatcagcgccctgcacatccaccagagggtgcacctgggggagaagctgttcaagtgtgatgtgtgtgggaaggagttcagccagagcctgcacctgcagacccaccagagggtgcacactggagagaagcccttcaagtgtgagcagtgtggccggggcttccgctgccgcagcgccctgactgtgcactgcaagctgcacatgggagagaagcactacaactgtgaggcctgtggccgggccttcatccatgacttccagctgcagaagcaccagaggatccacactggagagaagcccttcaagtgtgagatctgcagcgtgtccttccggctgcggagcagcctgaacagacactgtgtggtgcacacaggcaagaagcccaacagcactggagaatatggcaagggcttcatccggcggctggacctgtgcaagcaccagaccatccacactggagagaagccctacaactgcaaggaatgtgggaagagcttccgccgcagcagctacctgctgatccaccagagggtgcacactggagagaagccctacaagtgtgacaagtgtgggaagagctacatcaccaagagcggcctggacctgcaccaccgggcccacactggagagcggccctacaactgtgatgactgtgggaagagcttccggcaggccagcagcatcctgaaccacaagaggctgcactgcaggaagaagcccttcaagtgtgaggactgtgggaagaagctggtgtaccgcagctacaggaaggaccagcagaagaaccacagcggggagaaccccagcaaatgtgaggactgtgggaagcgctacaagaggcggctgaacctggacatcatcctgagcctcttcctgaatgacacctag

SEQ ID NO: 17641 - DNA, 2121 bp, Artificial Sequence
  Description of Artificial Sequence: Synthetic coding sequence
atgaccaccctgaaggaggccgtgaccttcaaggatgtggccgtggtgttcacagaggaggagctgcggctgctggacctggcccagaggaagctgtaccgggaggtgatgctggagaacttcaggaacctgctgtctgtgggccaccagagcctgcaccgggacaccttccacttcctgaaggaggagaagttctggatgatggagacagccacccagcgggagggcaacctgggcggcaagatccagatggagatggagaccgtgtctgagagcggcacccatgagggcctcttcagccaccagacctgggagcagatcagcagtgacctgacccgcttccaggacagcatggtgaacagcttccagttcagcaagcaggatgacatgccctgccaggtggatgctggcctgagcatcatccacgtgcggcagaagcccagcgagggccgcacctgcaagaagagcttcagtgatgtgtctgtgctggacctgcaccagcagctgcagagccgggagaagagccacacctgtgatgaatgtgggaagagcttctgctacagcagcgccctgcgcatccaccagagggtgcacatgggagagaagctgtacaactgtgatgtgtgtgggaaggagttcaaccagagcagccacctgcagatccaccagaggatccacactggagagaagcccttcaagtgtgagcagtgtgggaagggcttcagcagaagaagtggcctgtatgtgcacaggaagctgcacactggagtgaagccccacatctgtgagaagtgtgggaaggccttcatccatgacagccagctgcaggagcaccagaggatccacactggagagaagcccttcaagtgtgacatctgctgcaagagcttccgcagccgggccaacctgaacagacacagcatggtgcacatgagggagaagcccttccgctgtgacacctgtgggaagagctttggcctgaagagcgccctgaacagccacaggatggtgcacactggagagaagcgctacaagtgtgaggagtgtgggaagcgcttcatctaccggcaggacctgtacaagcaccagattgaccacactggagagaagccctacaactgcaaggaatgtgggaagagcttccgctgggccagcggcctgagccgccacgtgcgggtgcacagcggggagaccaccttcaagtgtgaggagtgtgggaagggcttctacaccaacagccagcgctacagccaccagagggcccacagcggggagaagccctaccgctgtgaggagtgtgggaagggctacaagaggcggctggacctggacttccaccagagggtgcacagaggagagaagccctacaactgcaaggaatgtgggaagagctttggctgggccagctgcctgctgaaccaccagaggatccacagcggggagaagcccttcaagtgtgaggagtgtgggaagcgcttcacccagaacagccagctgtacacccacagaagagtgcacagcggggagaagcccttcaagtgtgaggagtgtgggaagcgcttcacccagaacagccagctgtacagccacagaagagtgcacactggagtgaagccctacaagtgtgaggagtgtgggaagggcttcaacagcaagttcaacctggacatgcaccagagggtgcacactggagagcggccctacaactgcaaggaatgtgggaagagcttcagccgggccagcagcatcctgaaccacaagaggctgcatggagatgagaagcccttcaagtgtgaggagtgtgggaagcgcttcacagagaacagccagctgcacagccaccagagggtgcacactggagagaagccctacaagtgtgagaagtgtgggaagagcttccgctgggccagcacccacctgacccaccagaggctgcacagccgggagaagctgctgcagtgtgaggactgtgggaagagcatcgtgcacagcagctgcctgaaggaccagcagagggaccagagcggggagaagaccagcaaatgtgaggactgtgggaagcgctacaagaggcggctgaacctggacaccctgctgagcctcttcctgaatgacacctag

SEQ ID NO: 17642 - DNA, 2013 bp, Artificial Sequence
  Description of Artificial Sequence: Synthetic coding sequence
atgctggagaacttcaggaacctgctgtctgtgggccaccagagcctgcaccgggacaccttccacttcctgaaggaggagaagttctggatgatggagacagccacccagcgggagggcaacctgggcggcaagatccagatggagatggagaccgtgtctgagagcggcacccatgagggcctcttcagccaccagacctgggagcagatcagcagtgacctgacccgcttccaggacagcatggtgaacagcttccagttcagcaagcaggatgacatgccctgccaggtggatgctggcctgagcatcatccacgtgcggcagaagcccagcgagggccgcacctgcaagaagagcttcagtgatgtgtctgtgctggacctgcaccagcagctgcagagccgggagaagagccacacctgtgatgaatgtgggaagagcttctgctacagcagcgccctgcgcatccaccagagggtgcacatgggagagaagctgtacaactgtgatgtgtgtgggaaggagttcaaccagagcagccacctgcagatccaccagaggatccacactggagagaagcccttcaagtgtgagcagtgtgggaagggcttcagcagaagaagtggcctgtatgtgcacaggaagctgcacactggagtgaagccccacatctgtgagaagtgtgggaaggccttcatccatgacagccagctgcaggagcaccagaggatccacactggagagaagcccttcaagtgtgacatctgctgcaagagcttccgcagccgggccaacctgaacagacacagcatggtgcacatgagggagaagcccttccgctgtgacacctgtgggaagagctttggcctgaagagcgccctgaacagccacaggatggtgcacactggagagaagcgctacaagtgtgaggagtgtgggaagcgcttcatctaccggcaggacctgtacaagcaccagattgaccacactggagagaagccctacaactgcaaggaatgtgggaagagcttccgctgggccagcggcctgagccgccacgtgcgggtgcacagcggggagaccaccttcaagtgtgaggagtgtgggaagggcttctacaccaacagccagcgctacagccaccagagggcccacagcggggagaagccctaccgctgtgaggagtgtgggaagggctacaagaggcggctggacctggacttccaccagagggtgcacagaggagagaagccctacaactgcaaggaatgtgggaagagctttggctgggccagctgcctgctgaaccaccagaggatccacagcggggagaagcccttcaagtgtgaggagtgtgggaagcgcttcacccagaacagccagctgtacacccacagaagagtgcacagcggggagaagcccttcaagtgtgaggagtgtgggaagcgcttcacccagaacagccagctgtacagccacagaagagtgcacactggagtgaagccctacaagtgtgaggagtgtgggaagggcttcaacagcaagttcaacctggacatgcaccagagggtgcacactggagagcggccctacaactgcaaggaatgtgggaagagcttcagccgggccagcagcatcctgaaccacaagaggctgcatggagatgagaagcccttcaagtgtgaggagtgtgggaagcgcttcacagagaacagccagctgcacagccaccagagggtgcacactggagagaagccctacaagtgtgagaagtgtgggaagagcttccgctgggccagcacccacctgacccaccagaggctgcacagccgggagaagctgctgcagtgtgaggactgtgggaagagcatcgtgcacagcagctgcctgaaggaccagcagagggaccagagcggggagaagaccagcaaatgtgaggactgtgggaagcgctacaagaggcggctgaacctggacaccctgctgagcctcttcctgaatgacacctag

SEQ ID NO: 17643 - DNA, 285 bp, Artificial Sequence
  Description of Artificial Sequence: Synthetic coding sequence
atgaacatgttcaaggaggccgtgaccttcaaggatgtggccgtggccttcacagaggaggagctgggcctgctgggccctgcccagaggaagctgtacagagatgtgatggtggagaacttcaggaacctgctgtctgtgggccacccccccttcaagcaggatgtgagccccattgaaagaaatgagcagctgtggatcatgaccacagccacccggcggcagggcaacctggacaccctgctggtgaaggccctgctgctgtatgacctggcccagacctag

SEQ ID NO: 17644 - DNA, 2412 bp, Artificial Sequence
  Description of Artificial Sequence: Synthetic coding sequence
atgaacatgttcaaggaggccgtgaccttcaaggatgtggccgtggccttcacagaggaggagctgggcctgctgggccctgcccagaggaagctgtacagagatgtgatggtggagaacttcaggaacctgctgtctgtgggccacccccccttcaagcaggatgtgagccccattgaaagaaatgagcagctgtggatcatgaccacagccacccggcggcagggcaacctgggggagaagaaccagagcaagctgatcaccgtgcaggaccgggagagcgaggaggagctgagctgctggcagatctggcagcagatcgccaatgacctgacccgctgccaggacagcatgatcaacaacagccagtgccacaagcagggcgacttcccctaccaggtgggcacagagctgagcatccagatcagtgaagatgagaactacatcgtgaacaaggcagatggccccaacaacacaggcaaccctgagttccccatcctgcggacccaggacagctggaggaagaccttcctgacagagagccagaggctgaacagagaccagcagatcagcatcaagaacaagctgtgccagtgcaagaagggcgtggaccccatcggctggatcagccaccatgatggccaccgggtgcacaagtctgagaagagctaccggcccaatgactatgagaaggacaacatgaagatcctgacctttgaccacaacagcatgatccacacaggccagaagagctaccagtgcaatgaatgcaagaagcccttcagtgacctgagcagctttgacctgcaccagcagctgcagagcggggagaagagcctgacctgtgtggagcggggcaagggcttctgctacagccctgtgctgcctgtgcaccagaaggtgcacgtgggggagaagctgaagtgtgatgaatgtgggaaggagttcagccagggcgcccacctgcagacccaccagaaggtgcacgtgattgagaagccctacaagtgcaagcagtgtgggaagggcttcagccgccgcagcgccctgaatgtgcactgcaaggtgcacacagctgagaagccctacaactgtgaagaatgtggccgggccttcagccaggccagccacctgcaggaccaccagaggctgcacactggagagaagcccttcaagtgtgatgcctgtgggaagagcttcagcaggaacagccacctgcagagccaccagagggtgcacactggagagaagccctacaagtgtgaagaatgtgggaagggcttcatctgcagcagcaacctgtacatccaccagagggtgcacactggagagaagccctacaagtgtgaagaatgtgggaagggcttcagccggcccagcagcctgcaggcccaccagggcgtgcacactggagagaagagctacatctgcaccgtgtgtgggaagggcttcaccctgagcagcaacctgcaggcccaccagagggtgcacactggagagaagccctacaagtgcaatgaatgtgggaagagcttcagaagaaacagccactaccaggtgcacctggtggtgcacactggagagaagccctacaagtgtgagatctgtgggaagggcttcagccagagcagctacctgcagatccaccagaaggcccacagcattgagaagcccttcaagtgtgaagaatgtggccagggcttcaaccagagcagccggctgcagatccaccagctgatccacactggagagaagccctacaagtgtgaagaatgtgggaagggcttcagccggcgggctgacctgaagatccactgccgcatccacactggagagaagccctacaactgtgaagaatgtgggaaggtgttccggcaggccagcaacctgctggcccaccagagggtgcacagcggggagaagcccttcaagtgtgaagaatgtgggaagagctttggccgcagcgcccacctgcaggcccaccagaaggtgcacactggagacaagccctacaagtgtgatgaatgtgggaagggcttcaagtggagcctgaacctggacatgcaccagagggtgcacactggagagaagccctacaagtgtggagaatgtgggaagtacttcagccaggccagcagcctgcagctgcaccagagcgtgcacactggagagaagccctacaagtgtgatgtgtgtgggaaggtgttcagccgcagcagccagctgcagagccaccagagggtgcacactggagagaagccctacaagtgtgagatctgtgggaagagcttctcctggaggagcaacctgactgtgcaccaccgcatccacgtgggggacaagagctacaagagcaacagaggaggcaagaacatccgggagagcacccaggagaagaagagcatcaagtag

SEQ ID NO: 17645 - DNA, 285 bp, Artificial Sequence; identical to SEQ ID NO: 17643
  Description of Artificial Sequence: Synthetic coding sequence

SEQ ID NO: 17646 - DNA, 2103 bp, Artificial Sequence
  Description of Artificial Sequence: Synthetic coding sequence
atgaccaccttcaaggagggcctgaccttcaaggatgtggccgtggtgttcacagaggaggagctgggcctgctggaccctgtgcagaggaacctgtaccaggatgtgatgctggagaacttcaggaacctgctgtctgtgggccaccaccccttcaagcatgatgtgttcctgctggagaaggagaagaagctggacatcatgaagacagccacccagaggaagggcaagtctgctgacaagatccagagcgaggtggagaccgtgcctgaggccggcagacatgaggagctgtactggggccagatctggaagcagatcgccagtgacctgatcaagtatgaagattccatgatcagcatcagccgcttcccccggcagggcgacctgagctgccaggtgcgggccggcctgtacaccacccacacaggccagaagttctaccagtgtgatgagtacaagaagagcttcacagatgtgttcaactttgacctgcaccagcagctgcacagcggggagaagagccacacctgtgatgaatgtgggaagagcttctgctacatcagcgccctgcacatccaccagagggtgcacatgggagagaagtgctacaagtgtgatgtgtgtgggaaggagttcagccagagcagccacctgcagacccaccagagggtgcacacagtggagaagcccttcaagtgtgtggagtgtgggaagggcttcagcagaagaagcaccctgactgtgcactgcaagctgcacagcggggagaagccctacaactgtgaggagtgtggccgggccttcatccacgccagccacctgcaggagcaccagaggatccacactggagagaagcccttcaagtgtgacacctgtgggaagaacttcagaagaagaagtgccctgaacaaccactgcatggtgcacactggagagaagccctacaagtgtgaggactgtgggaagtgcttcacctgcagcagcaacctgcgcatccaccagagggtgcacactggagagaagccctacaagtgtgaggagtgtgggaagtgcttcatccagcccagccagttccaggcccaccggcgcatccacactggagagaagccctacgtgtgcaaggtgtgtgggaagggcttcatctacagcagcagcttccaggcccaccagggcgtgcacactggagagaagccctacaagtgcaatgaatgtgggaagagcttcaggatgaagatccactaccaggtgcacctggtggtgcacactggagagaagccctacaagtgtgaggtgtgtgggaaggccttccggcagagcagctacctgaagatccacctgaaggcccacagcgtgcagaagcccttcaagtgtgaggagtgtggccagggcttcaaccagagcagccggctgcagatccaccagctgatccacactggagagaagccctacaagtgtgaggagtgtgggaagggcttcagcagaagagctgacctgaagatccactgccgcatccacactggagagaagccctacaactgtgaggagtgtgggaaggtgttcagccaggccagccacctgctgacccaccagagggtgcacagcggggagaagcccttcaagtgtgaggagtgtgggaagagcttcagccgcagcgcccacctgcaggcccaccagaaggtgcacactggagagaagccctacaagtgtggggagtgtgggaagggcttcaagtggagcctgaacctggacatgcaccagagggtgcacactggagagaagccctacacctgtggggagtgtgggaagcacttcagccaggccagcagcctgcagctgcaccagagcgtgcacactggagagaagccctacaagtgtgatgtgtgtgggaaggtgttcagccgcagcagccagctgcagtaccacagaagagtgcacactggagagaagccctacaagtgtgagatctgtgggaagcgcttctcctggaggagcaacctggtgagccaccacaagatccatgctgctggcaccttctatgaaaatgatgagaacagcaagaacatccgggagctgtctgagggcggcagcagcaccaggtag

SEQ ID NO: 17647 - DNA, 2412 bp, Artificial Sequence; identical to SEQ ID NO: 17644
  Description of Artificial Sequence: Synthetic coding sequence

SEQ ID NO: 17648 - DNA, 207 bp, Artificial Sequence
  Description of Artificial Sequence: Synthetic coding sequence
ctgaagagccccaccagcagcgagctgcacgtgggggagaagctgaagtgtgatgaatgtgggaaggagttcagccagggcgcccacctgcagacccaccagaaggtgcacgtgattgagaagccctacaagtgcaagcagtgtgggaagggcttcagccgccgcagcgccctgaatgtgcactgcaaggtgcacacagctgagtag

SEQ ID NO: 17649 - DNA, 207 bp, Artificial Sequence
  Description of Artificial Sequence: Synthetic coding sequence
cacagcggggagaagagccacacctgtgatgagtgcaaggcctctgtgaccagccagcccttcatccaccagagggtgcacatgggagagaagtgctacaagtgtgatgtgtgtgggaaggagttcagccagagcagccacctgcagacccaccagagggtgcacacagtggagaagcccttcaagtgtgtggagtgtgggaagtag

SEQ ID NO: 17650 - DNA, 2400 bp, Artificial Sequence
  Description of Artificial Sequence: Synthetic coding sequence
atgcccagccagaactatgacctgccccagaagaagcaggagaagatgaccaagttccaggaggccgtgaccttcaaggatgtggccgtggtgttcagccgggaggagctgcggctgctggacctgacccagaggaagctgtacagagatgtgatggtggagaacttcaagaacctggtggccgtgggccacctgcccttccagcctgacatggtgtcccagctggaggccgaggagaagctgtggatgatggagacagagacccagaggagcagcaagcaccagaacaagatggagaccctgcagaagtttgccctgaagtacctgagcaaccaggagctgagctgctggcagatctggaagcaggtggccagcgagctgacccgctgcctgcagggcaagagcagccagctgctgcagggcgacagcatccaggtgtctgaaaatgaaaacaacatcatgaaccccaagggggacagcagcatctacatcgagaaccaggagttccccttctggaggacccagcacagctgtggcaacacctacctgtctgagagccagatccagagccggggcaagcagattgatgtgaagaacaacctgcagatccacgaggacttcatgaagaagagccccttccacgagcacatcaagacagacacagagcccaagccctgcaagggaaatgaatatggcaagatcatcagtgatggcagcaaccagaagctgcccctgggggagaagccccacccctgtggggagtgtggccggggcttctcctacagcccccggctgcccctgcaccccaacgtgcacactggagagaagtgcttcagccagagcagccacctgcggacccaccagaggatccaccctggagagaagctgaaccgctgccacgagagcggggactgcttcaacaagagcagcttccacagctaccagagcaaccacactggagagaagagctaccgctgtgacagctgtgggaagggcttcagcagcagcacaggcctcatcatccactaccgcacccacactggagagaagccctacaagtgtgaggagtgtgggaagtgcttcagccagagcagcaacttccagtgccaccagagggtgcacacagaggagaagccctacaagtgtgaggagtgtgggaaaggatttggctggagcgtgaacctgcgggtgcaccagagggtgcacagaggagagaagccctacaagtgtgaggagtgtgggaagggcttcacccaggccgcccacttccacatccaccagagggtgcacactggagagaagccctacaagtgtgatgtgtgtgggaagggcttcagccacaacagccccctcatctgccacagaagagtgcacactggagagaagccctacaagtgtgaggcctgtgggaagggcttcaccaggaacacagacctgcacatccacttccgggtgcacactggagagaagccctacaagtgcaaggaatgtgggaagggcttcagccaggccagcaacctgcaggtgcaccagaatgtgcacactggagagaagcgcttcaagtgtgagacctgtgggaagggcttcagccagagcagcaagctgcagacccaccagagggtgcacactggagagaagccctaccgctgtgatgtgtgtgggaaggacttctcctacagcagcaacctgaagctgcaccaggtgatccacactggagagaagccctacaagtgtgaggagtgtgggaagggcttctcctggaggagcaacctgcacgcccaccagagggtgcacagcggggagaagccctacaagtgtgagcagtgtgacaagagcttcagccaggccatcgacttccgggtgcaccagagggtgcacactggagagaagccctacaagtgtggggtgtgtgggaagggcttcagccagagcagcggcctgcagagccaccagagggtgcacactggagagaagccctacaagtgtgatgtgtgtgggaagggcttccgctacagcagccagttcatctaccaccagaggggccacactggagagaagccctacaagtgtgaggagtgtgggaaaggatttggccgcagcctgaacctgcggcaccaccagagggtgcacactggagagaagccccacatctgtgaggagtgtgggaaggccttcagcctgcccagcaacctgcgggtgcacctgggcgtgcacacccgggagaagctgttcaagtgtgaggagtgtgggaagggcttcagccagagcgcccggctggaggcccaccagagggtgcacactggagagaagccctacaagtgtgacatctgtgacaaggacttccgccacaggagccggctgacctaccaccagaaggtgcacacaggcaagaagctgtag

SEQ ID NO: 17651 - DNA, 2271 bp, Artificial Sequence
  Description of Artificial Sequence: Synthetic coding sequence
atgaccaagttccaggaggccgtgaccttcaaggatgtggccgtggtgttcagccgggaggagctgcggctgctggacctgacccagaggaagctgtacagagatgtgatggtggagaacttcaagaacctggtggccgtgggcagcaagcaccagaacaagatggagaccctgcagaagtttgccctgaagtacctgagcaaccaggagctgagctgctggcagatctggaagcaggtggccagcgagctgacccgctgcctgcagggcaagagcagccagctgctgcagggcgacagcatccaggtgtctgaaaatgaaaacaacatcatgaaccccaagggggacagcagcatctacatcgagaaccaggagttccccttctggaggacccagcacagctgtggcaacacctacctgtctgagagccagatccagagccggggcaagcagattgatgtgaagaacaacctgcagatccacgaggacttcatgaagaagagccccttccacgagcacatcaagacagacacagagcccaagccctgcaagggaaatgaatatggcaagatcatcagtgatggcagcaaccagaagctgcccctgggggagaagccccacccctgtggagaatgtggccggggcttctcctacagcccccggctgcccctgcaccccaacgtgcacactggagagaagtgcttcagccagagcagccacctgcggacccaccagaggatccaccctggagagaagctgaaccgctgccatgaaagtggggactgcttcaacaagagcagcttccacagctaccagagcaaccacactggagagaagagctaccgctgtgacagctgtgggaagggcttcagcagcagcacaggcctcatcatccactaccgcacccacactggagagaagccctacaagtgtgaagaatgtgggaagtgcttcagccagagcagcaacttccagtgccaccagagggtgcacacagaggagaagccctacaagtgtgaagaatgtgggaagggcttcggctggagcgtgaacctgcgggtgcaccagagggtgcacagaggagagaagccctacaagtgtgaagaatgtgggaagggcttcacccaggccgcccacttccacatccaccagagggtgcacactggagagaagccctacaagtgtgatgtgtgtgggaagggcttcagccacaacagccccctcatctgccaccggcgggtgcacactggagagaagccctacaagtgtgaggcctgtgggaagggcttcaccaggaacacagacctgcacatccacttccgggtgcacactggagagaagccctacaagtgcaaggaatgtgggaagggcttcagccaggccagcaacctgcaggtgcaccagaatgtgcacactggagagaagcgcttcaagtgtgagacctgtgggaagggcttcagccagagcagcaagctgcagacccaccagagggtgcacactggagagaagccctaccgctgtgatgtgtgtgggaaggacttctcctacagcagcaacctgaagctgcaccaggtgatccacactggagagaagccctacaagtgtgaagaatgtgggaagggcttctcctggaggagcaacctgcacgcccaccagagggtgcacagcggggagaagccctacaagtgtgagcagtgtgacaagagcttcagccaggccatcgacttccgggtgcaccagagggtgcacactggagagaagccctacaagtgtggggtgtgtgggaagggcttcagccagagcagcggcctgcagagccaccagagggtgcacactggagagaagccctacaagtgtgatgtgtgtgggaagggcttccgctacagcagccagttcatctaccaccagaggggccacactggagagaagccctacaagtgtgaagaatgtgggaagggcttcggccgcagcctgaacctgcggcaccaccagagggtgcacactggagagaagccccacatctgtgaagaatgtgggaaggccttcagcctgcccagcaacctgcgggtgcacctgggcgtgcacacccgggagaagctgttcaagtgtgaagaatgtgggaagggcttcagccagagcgcccggctggaggcccaccagagggtgcacactggagagaagccctacaagtgtgacatctgtgacaaggacttccgccacaggagccggctgacctaccaccagaaggtgcacacaggcaagaagctgtag

SEQ ID NO: 17652 - DNA, 1317 bp, Artificial Sequence
  Description of Artificial Sequence: Synthetic coding sequence
catgaaagtggggactgcttcaacaagagcagcttccacagctaccagagcaaccacactggagagaagagctaccgctgtgacagctgtgggaagggcttcagcagcagcacaggcctcatcatccactaccgcacccacactggagagaagccctacaagtgtgaagaatgtgggaagtgcttcagccagagcagcaacttccagtgccaccagagggtgcacacagaggagaagccctacaagtgtgaagaatgtgggaagggcttcggctggagcgtgaacctgcgggtgcaccagagggtgcacagaggagagaagccctacaagtgtgaagaatgtgggaagggcttcacccaggccgcccacttccacatccaccagagggtgcacactggagagaagccctacaagtgtgatgtgtgtgggaagggcttcagccacaacagccccctcatctgccaccggcgggtgcacactggagagaagccctacaagtgtgaggcctgtgggaagggcttcaccaggaacacagacctgcacatccacttccgggtgcacactggagagaagccctacaagtgcaaggaatgtgggaagggcttcagccaggccagcaacctgcaggtgcaccagaatgtgcacactggagagaagcgcttcaagtgtgagacctgtgggaagggcttcagccagagcagcaagctgcagacccgggagaagccctacaagtgtgagcagtgtgacaagagcttcagccaggccatcgacttccgggtgcaccagagggtgcacactggagagaagccctacaagtgtggggtgtgtgggaagggcttcagccagagcagcggcctgcagagccaccagagggtgcacactggagagaagccctacaagtgtgatgtgtgtgggaagggcttccgctacagcagccagttcatctaccaccagaggggccacactggagagaagccctacaagtgtgaagaatgtgggaagggcttcggccgcagcctgaacctgcggcaccaccagagggtgcacactggagagaagccccacatctgtgaagaatgtgggaaggccttcagcctgcccagcaacctgcgggtgcacctgggcgtgcacacccgggagaagctgttcaagtgtgaagaatgtgggaagggcttcagccagagcgcccggctggaggcccaccagagggtgcacactggagagaagccctacaagtgtgacatctgtgacaaggacttccgccacaggagccggctgacctaccaccagaaggtgcacacaggcaagaagctgtag

SEQ ID NO: 17653 - DNA, 2247 bp, Artificial Sequence
  Description of Artificial Sequence: Synthetic coding sequence
atggtggagaacttcaagaacctggtggccgtgggccacctgcccttccagcctgacatggtgtcccagctggaggccgaggagaagctgtggatgatggagacagagacccagaggagcagcaagcaccagaacaagatggagaccctgcagaagtttgccctgaagtacctgagcaaccaggagctgagctgctggcagatctggaagcaggtggccagcgagctgacccgctgcctgcagggcaagagcagccagctgctgcagggcgacagcatccaggtgtctgaaaatgaaaacaacatcatgaaccccaagggggacagcagcatctacatcgagaaccaggagttccccttctggaggacccagcacagctgtggcaacacctacctgtctgagagccagatccagagccggggcaagcagattgatgtgaagaacaacctgcagatccacgaggacttcatgaagaagagccccttccacgagcacatcaagacagacacagagcccaagccctgcaagggaaatgaatatggcaagatcatcagtgatggcagcaaccagaagctgcccctgggggagaagccccacccctgtggagaatgtggccggggcttctcctacagcccccggctgcccctgcaccccaacgtgcacactggagagaagtgcttcagccagagcagccacctgcggacccaccagaggatccaccctggagagaagctgaaccgctgccatgaaagtggggactgcttcaacaagagcagcttccacagctaccagagcaaccacactggagagaagagctaccgctgtgacagctgtgggaagggcttcagcagcagcacaggcctcatcatccactaccgcacccacactggagagaagccctacaagtgtgaagaatgtgggaagtgcttcagccagagcagcaacttccagtgccaccagagggtgcacacagaggagaagccctacaagtgtgaagaatgtgggaagggcttcggctggagcgtgaacctgcgggtgcaccagagggtgcacagaggagagaagccctacaagtgtgaagaatgtgggaagggcttcacccaggccgcccacttccacatccaccagagggtgcacactggagagaagccctacaagtgtgatgtgtgtgggaagggcttcagccacaacagccccctcatctgccaccggcgggtgcacactggagagaagccctacaagtgtgaggcctgtgggaagggcttcaccaggaacacagacctgcacatccacttccgggtgcacactggagagaagccctacaagtgcaaggaatgtgggaagggcttcagccaggccagcaacctgcaggtgcaccagaatgtgcacactggagagaagcgcttcaagtgtgagacctgtgggaagggcttcagccagagcagcaagctgcagacccaccagagggtgcacactggagagaagccctaccgctgtgatgtgtgtgggaaggacttctcctacagcagcaacctgaagctgcaccaggtgatccacactggagagaagccctacaagtgtgaagaatgtgggaagggcttctcctggaggagcaacctgcacgcccaccagagggtgcacagcggggagaagccctacaagtgtgagcagtgtgacaagagcttcagccaggccatcgacttccgggtgcaccagagggtgcacactggagagaagccctacaagtgtggggtgtgtgggaagggcttcagccagagcagcggcctgcagagccaccagagggtgcacactggagagaagccctacaagtgtgatgtgtgtgggaagggcttccgctacagcagccagttcatctaccaccagaggggccacactggagagaagccctacaagtgtgaagaatgtgggaagggcttcggccgcagcctgaacctgcggcaccaccagagggtgcacactggagagaagccccacatctgtgaagaatgtgggaaggccttcagcctgcccagcaacctgcgggtgcacctgggcgtgcacacccgggagaagctgttcaagtgtgaagaatgtgggaagggcttcagccagagcgcccggctggaggcccaccagagggtgcacactggagagaagccctacaagtgtgacatctgtgacaaggacttccgccacaggagccggctgacctaccaccagaaggtgcacacaggcaagaagctgtag

SEQ ID NO: 17654 - DNA, 2337 bp, Artificial Sequence
  Description of Artificial Sequence: Synthetic coding sequence
aaggtgacccagctgcaggaggccgtgaccttcaaggatgtggccgtggtgttcagccgggaggagctgcggctgctggacctgacccagaggaagctgtacagagatgtgatggtggagaacttcaagaacctggtggccgtggacatggtgtcccagctggaggccgaggagaagctgtggatgatggagacagagacccagaggagcagcaagcaccagaacaagatggagaccctgcagaagtttgccctgaagtacctgagcaaccaggagctgagctgctggcagatctggaagcaggtggccagcgagctgacccgctgcctgcagggcaagagcagccagctgctgcagggcgacagcatccaggtgtctgaaaatgaaaacaacatcatgaaccccaagggggacagcagcatctacatcgagaaccaggagttccccttctggaggacccagcacagctgtggcaacacctacctgtctgagagccagatccagagccggggcaagcagattgatgtgaagaacaacctgcagatccacgaggacttcatgaagaagagccccttccacgagcacatcaagacagacacagagcccaagccctgcaagggaaatgaatatggcaagatcatcagtgatggcagcaaccagaagctgcccctgggggagaagccccacccctgtggagaatgtggccggggcttctcctacagcccccggctgcccctgcaccccaacgtgcacactggagagaagtgcttcagccagagcagccacctgcggacccaccagaggatccaccctggagagaagctgaaccgctgccatgaaagtggggactgcttcaacaagagcagcttccacagctaccagagcaaccacactggagagaagagctaccgctgtgacagctgtgggaagggcttcagcagcagcacaggcctcatcatccactaccgcacccacactggagagaagccctacaagtgtgaagaatgtgggaagtgcttcagccagagcagcaacttccagtgccaccagagggtgcacacagaggagaagccctacaagtgtgaagaatgtgggaagggcttcggctggagcgtgaacctgcgggtgcaccagagggtgcacagaggagagaagccctacaagtgtgaagaatgtgggaagggcttcacccaggccgcccacttccacatccaccagagggtgcacactggagagaagccctacaagtgtgatgtgtgtgggaagggcttcagccacaacagccccctcatctgccaccggcgggtgcacactggagagaagccctacaagtgtgaggcctgtgggaagggcttcaccaggaacacagacctgcacatccacttccgggtgcacactggagagaagccctacaagtgcaaggaatgtgggaagggcttcagccaggccagcaacctgcaggtgcaccagaatgtgcacactggagagaagcgcttcaagtgtgagacctgtgggaagggcttcagccagagcagcaagctgcagacccaccagagggtgcacactggagagaagccctaccgctgtgatgtgtgtgggaaggacttctcctacagcagcaacctgaagctgcaccaggtgatccacactggagagaagccctacaagtgtgaagaatgtgggaagggcttctcctggaggagcaacctgcacgcccaccagagggtgcacagcggggagaagccctacaagtgtgagcagtgtgacaagagcttcagccaggccatcgacttccgggtgcaccagagggtgcacactggagagaagccctacaagtgtggggtgtgtgggaagggcttcagccagagcagcggcctgcagagccaccagagggtgcacactggagagaagccctacaagtgtgatgtgtgtgggaagggcttccgctacagcagccagttcatctaccaccagaggggccacactggagagaagccctacaagtgtgaagaatgtgggaagggcttcggccgcagcctgaacctgcggcaccaccagagggtgcacactggagagaagccccacatctgtgaagaatgtgggaaggccttcagcctgcccagcaacctgcgggtgcacctgggcgtgcacacccgggagaagctgttcaagtgtgaagaatgtgggaagggcttcagccagagcgcccggctggaggcccaccagagggtgcacactggagagaagccctacaagtgtgacatctgtgacaaggacttccgccacaggagccggctgacctaccaccagaaggtgcacacaggcaagaagctgtag

SEQ ID NO: 17655 - DNA, 2478 bp, Artificial Sequence
  Description of Artificial Sequence: Synthetic coding sequence
atggagaccctgaccagcagacatgagaagagggccctgcacagccaggccagcgccatcagccaggaccgggaggagaagatcatgagccaggagcccctgtccttcaaggatgtggccgtggtgttcacagaggaggagctggagctgctggacagcacccagaggcagctgtaccaggatgtgatgcaggagaacttcaggaacctgctgtctgtgggggagaggaaccccctgggggacaagaatggcaaggacacagagtacatccaggatgaggagctgcgcttcttcagccacaaggagctgagcagctgcaagatctgggaggaggtggccggggagctgcccggcagccaggactgccgggtgaacctgcagggcaaggacttccagttctctgaagatgctgccccccaccagggctgggagggcgccagcaccccctgcttccccatcgagaacagcctggacagcctgcagggagatggcctcatcggcctggagaaccagcagtttcctgcctggagggccatccggcccatccccatccagggctcctgggccaaggcctttgtgaaccagctgggagatgtgcaggagcgctgcaagaacctggacacagaagatactgtgtacaagtgcaactgggatgatgacagcttctgctggatcagctgccacgtggaccaccgcttccctgagattgacaagccctgtggctgcaacaagtgcaggaaggactgcatcaagaacagcgtgctgcaccgcatcaaccctggagaaaatggcctgaagagcaatgagtacagaaatggcttcagagatgatgctgacctgcccccccacccccgggtgcccctgaaggagaagctgtgccagtatgatgagttcagcgagggcctgcggcacagcgcccacctgaacagacaccagagggtgcccaccggggagaagtctgtgaagagcctggagcggggccggggcgtgcggcagaacacccacatccggaaccacccccgggcccctgtgggggacatgccctaccgctgtgatgtgtgtgggaagggcttccgctacaagtctgtgctgctgatccaccagggcgtgcacacaggccggcggccctacaagtgtgaagaatgtgggaaggccttcggccgcagcagcaacctgctggtgcaccagagggtgcacactggagagaagccctacaagtgcagtgaatgtgggaagggcttctcctacagctctgtgctgcaggtgcaccagaggctgcacactggagagaagccctacacctgcagtgaatgtgggaagggcttctgtgccaagagcgccctgcacaagcaccagcacatccaccctggagagaagccctacagctgtggagaatgtgggaagggcttcagctgcagcagccacctgagcagccaccagaagacccacactggagagcggccctaccagtgtgacaagtgtgggaagggcttcagccacaacagctacctgcaggcccaccagagggtgcacatgggccagcacctgtacaagtgcaatgtgtgtgggaagagcttctcctacagcagcggcctgctgatgcaccagaggctgcacactggagagaagccctacaagtgtgaatgtgggaagagctttggccgcagcagtgacctgcacatccaccagagggtgcacactggagagaagccctacaagtgcagtgaatgtgggaagggcttcagaagaaacagcgacctgcacagccaccagagggtgcacactggagagcggccctacgtgtgtgatgtgtgtgggaagggcttcatctacagcagtgacctgctgatccaccagagggtgcacactggagagaagccctacaagtgtgccgagtgtgggaagggcttctcctacagcagcggcctgctgatccaccagagggtgcacactggagagaagccctaccgctgccaggagtgtgggaagggcttccgctgcaccagcagcctgcacaagcaccagagggtgcacacaggcaagaagccctacacctgtgaccagtgtgggaagggcttctcctatggcagcaacctgcggacccaccagaggctgcacactggagagaagccctacacctgctgtgaatgtgggaagggcttccgctatggcagcggcctgctgagccacaagagggtgcacactggagagaagccctaccgctgccacgtgtgtgggaagggctacagccagagcagccacctgcagggccaccagagggtgcacactggagagaagccctacaagtgtgaggagtgtgggaaaggatttggaagaaacagctgcctgcacgtgcaccagagggtgcacactggagagaagccctacacctgtggggtgtgtgggaagggcttctcctacaccagcggcctgaggaaccaccagagggtgcacctgggggagaacccctacaagtag

SEQ ID NO: 17656 - DNA, 2478 bp, Artificial Sequence; identical to SEQ ID NO: 17655
  Description of Artificial Sequence: Synthetic coding sequence

SEQ ID NO: 17657 - DNA, 1425 bp, Artificial Sequence
  Description of Artificial Sequence: Synthetic coding sequence
atgaccaccttcaaggaggccgtgaccttcaaggatgtggccgtgttcttcacagaggaggagctgggcctgctggaccctgcccagaggaagctgtaccaggatgtgatgctggagaacttcaccaacctgctgtctgtgggccaccagcccttccaccccttccacttcctgcgggaggagaagttctggatgatggagacagccacccagcgggagggcaacagcggcggcaagaccatcgccgaggccggcccccatgaggactgcccctgccagcagatctgggagcagacagccagtgacctgacccagagccaggacagcatcatcaacaacagccacttctttgagcagggagatgtgcccagccaggtggaggccggcctgagcatcatccacacaggccagaagcccagccagaatggcaagtgcaagcagagcttcagtgatgtggccatctttgatcctccccagcagttccacagcggggagaagagccacacctgcaatgaatgtgggaagagcttctgctacatcagcgccctgcgcatccaccagagggtgcacctgcgggagaagctgagcaaatgtgacatgaggggcaaggagttcagccagagcagctgcctgcagacccgggagcgggtgcacactggagagaagcccttcaagtgtgagcagtgtgggaagggcttccgctgccgggccatcctgcaggtgcactgcaagctgcacactggagagaagccctacatctgtgagaagtgtggccgggccttcatccatgacttccagctgcagaagcaccagatcatccacactggagagaagcccttcaagtgtgagatctgtgggaagagcttctgcctgcggagcagcctgaacagacactgcatggtgcacacagctgagaagctgtacaagtctgaggagtgtgggaagggcttcacagacagcctggacctgcacaagcaccagatcatccacacaggccagaagccctacaactgcaaggaatgtgggaagagcttccgctggagcagctacctgctgatccaccagaggatccacagcggggagaagccctaccgctgtgaggagtgtgggaagggctacatcagcaagagcggcctgaacctgcaccagagggtgcacactggagagcggccctacaactgcaaggaatgtgggaagagcttcagccgggccagcagcatcctgaaccacaagaagctgcactgcaggaagaagcccttcaagtgtgaggactgtgggaagaggctggtgcaccgctccttctgcaaggaccagcagggcgaccacaatggagagaacagcagcaaatgtgaggactgtgggaagcgctacaagaggcggctgaacctggacatcatcctgagcctcttcctgaatgacatgtag

SEQ ID NO: 17658 - DNA, 1335 bp, Artificial Sequence
  Description of Artificial Sequence: Synthetic coding sequence
atggagcccccaggccctgtgcggggccccctgcaggacagctcctggtatgagcccagcgctgagctggtgcagaccaggatggctgtgtccctgacagctgctgagaccctggccctgcagggcacccagggccaggagaagatgatgatgatgggccccaaggaggaggagcagagctgtgaatatgagacccggctgcccggcaaccacagcaccagccaggagatcttccggcagcgcttccgccacctgcgctaccaggagaccccaggcccccgggaggccctgagccagctgcgggtgctgtgctgtgagtggctgcggcctgagaagcacaccaaggagcagatcctggagttcctggtgctggagcagttcctgaccatcctgcctgaggagctgcagagctgggtgcggggccaccaccccaagagcggggaggaggccgtgacagtgctggaggacctggagaagggcctggagcctgagccccaggtgcccggccctgcccacggccctgcccaggaggagccctgggagaagaaggagagcctgggcgccgcccaggaggccctgagcatccagctgcagcccaaggagacccagcccttccccaagtctgagcaggtgtacctgcacttcctgtctgtggtgacagaagatggccctgagcccaaggacaagggcagcctgccccagccccccatcacagaggtggagagccaggtgttcagcgagaagctggccacagacaccagcacctttgaggccaccagcgagggcaccctggagctgcagcagaggaaccccaaggccgagcggctgcgctggagccctgcccaggaggagagcttccggcagatggtggtgatccacaaggagatccccaccgggaagaaggaccacgagtgcagtgaatgtgggaagaccttcatctacaacagccacctggtggtgcaccagagggtgcacagcggggagaagccctacaagtgcagcgactgtgggaagaccttcaagcagagcagcaacctgggccagcaccagaggatccacactggagagaagccctttgagtgcaatgaatgtgggaaggccttccgctggggcgcccacctggtgcagcaccagaggatccacagcggggagaagccctatgagtgcaatgaatgtgggaaggccttcagccagagcagctacctgagccagcaccggcgcatccacagcggggagaagcccttcatctgcaaggaatgtgggaaggcctacggctggtgcagcgagctgatccgccaccggcgggtgcacgccaggaaggagcccagccactag

SEQ ID NO: 17659 - DNA, 579 bp, Artificial Sequence
  Description of Artificial Sequence: Synthetic coding sequence
atggctgtgtccctgacagctgctgagaccctggccctgcagggcacccagggccaggagaagatgatgatgatgggccccaaggaggaggagcagagctgtgaatatgagacccggctgcccggcaaccacagcaccagccaggagatcttccggcagcgcttccgccacctgcgctaccaggagaccccaggcccccgggaggccctgagccagctgcgggtgctgtgctgtgagtggctgcggcctgagaagcacaccaaggagcagatcctggagttcctggtgctggagcagttcctgaccatcctgcctgaggagctgcagagctgggtgcggggccaccaccccaagtctggagaggaggccgtgacagtgctggaggacctggagaagggcctggagcctgagccccaggtgggccggggcatctggagcgtgatgggcgcccggctgatgaccttccggctggacagaggagctgctgtgggcggcggggccaagttcaagcccctgctgggccaggtggagcagctggtgtgtgtgtctgtgtctgtgttcagcgccctggagccctag

SEQ ID NO: 17660 - DNA, 1704 bp, Artificial Sequence
  Description of Artificial Sequence: Synthetic coding sequence
ggccacaagaaccagaatgaaattgacaccctgcaggaggtgcggctgcgcttcctgtcctatgaggacctgatctgctggcagatctgggagcagttcaccagcaagctgaccagcaaccaggacctgatcatcaacctgcagggcaagaggagcaagctgctgaagcagggcgacagcccctgccaggtgtggacaggagagagcagccaggtgtctgaagatgagaactacgtgatcaagctgcagggcgagagcagcaacagcatcaagaaccaggagctgcccctgcggaccacctgggacttctggaggaagatgtacctgcgggagccccagaactaccagagccgctgccagcagattgatgtgaagaacaagctgtgcaagtgtgaccactgtgtgcggcagagaattgcccaccagcatgatgaccacggcgtgcacaagcgggagaaggccttcagccacaacaactgtgggaaggactgtgtgaaggagagcagccagcacagcatcatccagagcggggagcagaccagtgatgaaaatggcaagggcctgtctgtgggcagcaacctggagctgcaccagcagctgcacctgcgggacaagccccacgtgaatgtggagtatggcaagggcatcggctacagcagcggcctgcccaggcaccagtgcttccacatcggggagaagtgctacagaaatggagacagcggggagggcttcagccagggcagccacctgcagccccaccagagggtgtccactggagagaacctgtaccgctgccaggtgtatgcccggagcagcaaccagaacagctgcctgcccagccatgagctgacccaccctggagagaagctgtgcacctgtggccgctgtgggaagggcttccaccacagcctggactttgacatccactgtgtggacagcgctggggagcgggcctgcaagtgtgatgtgtatgacaagggcttcagccagaccagccagctgcaggcccaccagagggtgcacactggagagaagccctacaagtgtgaggtgtgtgacaagggcttcagcaaggccagcaacctgcaggcccaccagaggatccacactggagagaagccctacaagtgtgatgtgtgtgacaagaacttcagcaggaacagccacctgcaggcccaccagagggtgcacactggagagaagccctacaagtgtgacacctgtgggaaggacttcagccagatcagccacctgcaggcccaccagagggtgcacaagggggagaagccctacaagtgtgagacctgtgggaagggcttcagccagagcagccacctgcaggaccaccagcaggtgcacactggagagaacccctacaagtgtgatgtgtgtgggaagggcttctcctggagcagccacctgcaggcccaccagagggtgcacactggagagaagccctacaagtgtgaagaatgtaggaagggcttcatctggaacagctacctgcacgtgcaccagaggatccacactggagagaagccctacaagtgtggcatgtgtgggaagagcttcagccagaccagccacctgcaggcccaccagagggtgcacactggagagaagccctacaagtgctttgtgtgtgggaagggcttcagcaagagcagcctgcagatccaccagagggtgcatgatggagactag

SEQ ID NO: 17661 - DNA, 1959 bp, Artificial Sequence
  Description of Artificial Sequence: Synthetic coding sequence
atggtgaagaggtccatgcagcaggaggagctgaccatcctgaacatctatgcccccaacacaggagccccccgcttcatccgggctgtggcctgcttccgcagcggcatcctgggctctgtggtgcagaagcccctgcagccctgtgtgctgcccctgcaggagggggaggccgctgtgatctaccccctgtgggaggtgtcccagaggggcaccagcgccagcacagccagcttccctggcctgggcgtgggcctggccgtgctgcccagccaggaccctgccctgccccagaaggagcaggagaagatgaccaagttccagctgctggccatccggctgcggctgcacctgctggatgtggtgggagatggagacatccagggctgcggctgcggcctgcaccagggcggggccggcgtggccggcccctgcccagagaaggctgtgccccgctgtgatgctggggagctgcaggagcctgctgtgtctggcctgagcaccctgcagacccgctgtgacatcaccgtgggcaagaggcggcaggccagtgatgatggagacaggaacccccggcgctgggtgttccggcagagaattgcccaccagcatgatgaccatggagtgcacaagcgggagaaggccttcagccacaacaactgtgggaaggactgtgtgaaggagagcagccagcacagcatcatccagagcggggagcagaccagtgatgaaaatggcaagggcctgtctgtgggcagcaacctggagctgcaccagcagctgcacctgcgggacaagccccacgtgaatgtggagtatggaaaaggaattggctacagcagcggcctgcccaggcaccagtgcttccacatcggggagaagtgctacagaaatggagacagcggggagggcttcagccagggcagccacctgcagccccaccagagggtgtccactggagaaaatctctaccgctgccaggtgtatgcccggagcagcaaccagaacagctgcctgcccagccatgagctgacccaccctggagagaagctgtgcacctgtggccgctgtgggaagggcttccaccacagcctggactttgacatccactgtgtggacagcgctggggagcgggcctgcaagtgtgatgtgtatgacaagggcttcagccagaccagccagctgcaggcccaccagaggggccacagccgggacaagacctacaagtgggaggtgtctgaccgcatcttcaacagaaattctggcctgcaccagagggtgcacactggagagaagccctacaagtgtgaggtgtgtgacaagggcttcagcaaggccagcaacctgcaggcccaccagaggatccacactggagagaagccctacaagtgtgatgtgtgtgacaagaacttcagcaggaacagccacctgcaggcccaccagagggtgcacactggagagaagccctacaagtgtgacacctgtgggaaggacttcagccagatcagccacctgcaggcccaccagagggtgcacaagggggagaagccctacaagtgtgagacctgtgggaagggcttcagccagagcagccacctgcaggaccaccagcaggtgcacactggagagaacccctacaagtgtgatgtgtgtgggaagggcttctcctggagcagccacctgcaggcccaccagagggtgcacactggagagaagccctacaagtgtgaggagtgcaggaagggcttcatctggaacagctacctgcacgtgcaccagaggatccacactggagagaagccctacaagtgtggcatgtgtgggaagagcttcagccagaccagccacctgcaggcccaccagagggtgcacactggagagaagccctacaagtgctttgtgtgtgggaagggcttcagcaagagcagcctgagcagtgacagcagcgagagcccctag

SEQ ID NO: 17662 - DNA, 2013 bp, Artificial Sequence
  Description of Artificial Sequence: Synthetic coding sequence
atgaccaagttccaggagatggtgaccttcaaggatgtggccgtggtgttcacccgggaggagctgggcctgctggacctggcccagaggaagctgtaccaggatgtgatgctggagaacttcaggaacctgctgtctgtgggctaccagcccttcaagctggatgtgatcctgcagctgggcaaggaggacaagctgaggatgatggagacagagatccagggagatggctgcagcggccacaagaaccagaatgaaattgacaccctgcaggaggtgcggctgcgcttcctgtcctatgaagatctcatctgctggcagatctgggagcagttcaccagcaagctgaccagcaaccaggacctgatcatcaacctgcagggcaagaggagcaagctgctgaagcagggcgacagcccctgccaggtgtggacaggagagagcagccaggtgtctgaagatgaaaattatgtgatcaagctgcagggcgagagcagcaacagcatcaagaaccaggagctgcccctgcggaccacctgggacttctggaggaagatgtacctgcgggagccccagaactaccagagccgctgccagcagattgatgtgaagaacaagctgtgcaagtgtgaccactgtgtgcggcagagaattgcccaccagcatgatgaccatggagtgcacaagcgggagaaggccttcagccacaacaactgtgggaaggactgtgtgaaggagagcagccagcacagcatcatccagagcggggagcagaccagtgatgaaaatggcaagggcctgtctgtgggcagcaacctggagctgcaccagcagctgcacctgcgggacaagccccacgtgaatgtggagtatggaaaaggaattggctacagcagcggcctgcccaggcaccagtgcttccacatcggggagaagtgctacagaaatggagacagcggggagggcttcagccagggcagccacctgcagccccaccagagggtgtccactggagaaaatctctaccgctgccaggtgtatgcccggagcagcaaccagaacagctgcctgcccagccatgagctgacccaccctggagagaagctgtgcacctgtggccgctgtgggaagggcttccaccacagcctggactttgacatccactgtgtggacagcgctggggagcgggcctgcaagtgtgatgtgtatgacaagggcttcagccagaccagccagctgcaggcccaccagaggggccacagccgggacaagacctacaagtgggaggtgtctgaccgcatcttcaacagaaattctggcctgcaccagagggtgcacactggagagaagccctacaagtgtgaggtgtgtgacaagggcttcagcaaggccagcaacctgcaggcccaccagaggatccacactggagagaagccctacaagtgtgatgtgtgtgacaagaacttcagcaggaacagccacctgcaggcccaccagagggtgcacactggagagaagccctacaagtgtgacacctgtgggaaggacttcagccagatcagccacctgcaggcccaccagagggtgcacaagggggagaagccctacaagtgtgagacctgtgggaagggcttcagccagagcagccacctgcaggaccaccagcaggtgcacactggagagaacccctacaagtgtgatgtgtgtgggaagggcttctcctggagcagccacctgcaggcccaccagagggtgcacactggagagaagccctacaagtgtgaggagtgcaggaagggcttcatctggaacagctacctgcacgtgcaccagaggatccacactggagagaagccctacaagtgtggcatgtgtgggaagagcttcagccagaccagccacctgcaggcccaccagagggtgcacactggagagaagccctacaagtgctttgtgtgtgggaagggcttcagcaagagcagcctgagcagtgacagcagcgagagcccctag

SEQ ID NO: 17663 - DNA, 321 bp, Artificial Sequence
  Description of Artificial Sequence: Synthetic coding sequence
ggccacaagaaccagaatgaaattgacaccctgcaggaggtgcggctgcgcttcctgtcctatgaggacctgatctgctggcagatctgggagcagttcaccagcaagctgaccagcaaccaggacctgatcatcaacctgcagggcaagaggagcaagctgctgaagcagggcgacagcccctgccaggtgtggacaggagagagcagccaggtgtctgaagatgagaactacgtgatcaagctgcagggcgagagcagcaacagcatcaagaaccaggagctgcccagccagaagaagaagaagaagaagaagaagtag

SEQ ID NO: 17664 - DNA, 2217 bp, Artificial Sequence
  Description of Artificial Sequence: Synthetic coding sequence
atgaccaagttccaggaggccgtgaccttcaaggatgtggccgtggccttcacagaggaggagctgggcctgctggacagcgcccagaggaagctgtacagagatgtgatgctggagaacttcaggaacctggtgtctgtgggccaccagagcttcaagccagacatgatcagccagctggagcgggaggagaagctgtggatgaaggagctgcagacccagaggggcaagcacagcggggacaggaaccagaatgagatggccaccctgcacaaggccggcctgcgctgcttcagcctgggggagctgagctgctggcagatcaagaggcacatcgccagcaagctggcccggagccaggacagcatgatcaacatcgagggcaagagcagccagttccccaagcaccacgacagcccctgccaggtgggcgctggggagagcatccaggcctctgtggatgacaactgcctggtgaaccacatcggggaccacagcagcatcatcgagaaccaggagttccccaccgggaaggtgcccaacagctggagcaagatctacctgaatgagacccagaactaccagaggagctgcaagcagacccagatgaagaacaagctgtgcatctttgccccctacgtggacatcttcagctgcatcagccaccaccatgatgacaacatcgtgcacaagagggacaaggtgcacagcaacagcgactgtgggaaggacaccctgaaggtgagccccctgacccagaggagcatccacacaggccagaagacctaccagggcaatgaatgtgaggaggccttcaatgacagcagcagcctggagctgcacaagcaggtgcacctgggcaagaagagccctgcctgcagcacccatgagaaggacaccagctacagcagcggcatccctgtgcagcagagcgtgaggacaggcaagaagcgctactggtgccatgaatgtgggaagggcttcagccagagcagcaacctgcagacccaccagagggtgcacactggagagaagccctacacctgccatgaatgtgggaagagcttcaaccagagcagccacctgtatgcccacctgcccatccacactggagagaagccctaccgctgtgacagctgtgggaagggcttcagccgcagcacagacctgaacatccactgccgggtgcacactggagagaagccctacaagtgtgaggtgtgtgggaagggcttcacccagaggagccacctgcaggcccacgagcgcatccacactggagagaagccctacaagtgtggggactgtgggaagcgcttcagctgcagcagcaacctgcacacccaccagagggtgcacacagaggagaagccctacaagtgtgatgaatgtgggaagtgcttcagcctgtccttcaacctgcacagccaccagagggtgcacactggagagaagccctacaagtgtgaagaatgtgggaagggcttcagcagcgccagcagcttccagagccaccagagggtgcacactggagagaagcccttccgctgcaatgtgtgtgggaagggcttcagccagagcagctacttccaggcccaccagagggtgcacactggagagaagccctacaagtgtgaggtgtgtgggaagcgcttcaactggagcctgaacctgcacaaccaccagagggtgcacactggagagaagccctacaagtgtgaagaatgtgggaagggcttcagccaggccagcaacctgcaggcccaccagagcgtgcacactggagagaagcccttcaagtgtgatgcctgccagaagcgcttcagccaggccagccacctgcaggcccaccagagggtgcacactggagagaagccctacaagtgtgacacctgtgggaaggccttcagccagaggagcaacctgcaggtgcaccagatcatccacactggagagaagcccttcaagtgtgaagaatgtgggaaggagttctcctggagcgctggcctgagcgcccaccagagggtgcacactggagagaagccctacacctgccagcagtgtgggaagggcttcagccaggccagccacttccacacccaccagagggtgcacactggagagcggccctacatctgtgatgtgtgctgcaagggcttcagccagaggagccacctgatctaccaccagagggtgcacactggaggcaacctgtag

SEQ ID NO: 17665 - DNA, 1767 bp, Artificial Sequence
  Description of Artificial Sequence: Synthetic coding sequence
tctggggacaggaaccagaatgagatggccaccctgcacaaggccggcctgcgctgcttcagcctgggggagctgagctgctggcagatcaagaggcacatcgccagcaagctggcccggagccaggacagcatgatcaacatcgagggcaagagcagccagttccccaagcaccacgacagcccctgccaggtgggcgctggggagagcatccaggcctctgtggatgacaactgcctggtgaaccacatcggggaccacagcagcatcatcgagaaccaggagttccccaccgggaaggtgcccaacagctggagcaagatctacctgaatgagacccagaactaccagaggagctgcaagcagacccagatgaagaacaagctgtgcatctttgccccctacgtggacatcttcagctgcatcagccaccaccatgatgacaacatcgtgcacaagagggacaaggtgcacagcaacagcgactgtgggaaggacaccctgaaggtgagccccctgacccagaggagcatccacacaggccagaagacctaccagggcaatgaatgtgaggaggccttcaatgacagcagcagcctggagctgcacaagcaggtgcacctgggcaagaagagccctgcctgcagcacccatgagaaggacaccagctacagcagcggcatccctgtgcagcagagcgtgaggacaggcaagaagcgctactggtgccatgaatgtgggaagggcttcagccagagcagcaacctgcagacccaccagagggtgcacactggagagaagccctacacctgccatgaatgtgggaagagcttcaaccagagcagccacctgtatgcccacctgcccatccacactggagagaagccctaccgctgtgacagctgtgggaagggcttcagccgcagcacagacctgaacatccactgccgggtgcacactggagagaagccctacaagtgtgaggtgtgtgggaagggcttcacccagaggagccacctgcaggcccacgagcgcatccacactggagagaagccctacaagagccagatcttcatccccatccgggacttcaacctgcacagccaccagagggtgcacactggagagaagccctacaagtgtgaagaatgtgggaagggcttcagcagcgccagcagcttccagagccaccagagggtgcacactggagagaagcccttccgctgcaatgtgtgtgggaagggcttcagccagagcagctacttccaggcccaccagagggtgcacactggagagaagccctacaagtgtgaggtgtgtgggaagcgcttcaactggagcctgaacctgcacaaccaccagagggtgcacactggagagaagccctacaagtgtgaagaatgtgggaagggcttcagccaggccagcaacctgcaggcccaccagagcgtgcacactggagagaagcccttcaagtgtgatgcctgccagaagcgcttcagccaggccagccacctgcaggcccaccagagggtgcacactggagagaagccctacaagtgtgacacctgtgggaaggccttcagccagaggagcaacctgcaggtgcaccagatcatccacactggagagaagcccttcaagtgtgaagaatgtgggaaggagttctcctggagcgctggcctgagcgcccaccagagggtgcacactggagagaagccctacacctgccagcagtgtgggaagggcttcagccaggccagctag

SEQ ID NO: 17666 - DNA, 2217 bp, Artificial Sequence
  Description of Artificial Sequence: Synthetic coding sequence
atgggccgcatccaggaggccgtgaccttcaaggatgtggccgtggccttcacagaggaggagctgggcctgctggacagcgcccagaggaagctgtacagagatgtgatgctggagaacttcaggaacctggtgtctgtgggccaccagagcttcaagccagacatgatcagccagctggagcgggaggagaagctgtggatgaaggagctgcagacccagaggggcaagcacagcggggacaggaaccagaatgagatggccaccctgcacaaggccggcctgcgctgcttcagcctgggggagctgagctgctggcagatcaagaggcacatcgccagcaagctggcccggagccaggacagcatgatcaacatcgagggcaagagcagccagttccccaagcaccacgacagcccctgccaggtgggcgctggggagagcatccaggcctctgtggatgacaactgcctggtgaaccacatcggggaccacagcagcatcatcgagaaccaggagttccccaccgggaaggtgcccaacagctggagcaagatctacctgaatgagacccagaactaccagaggagctgcaagcagacccagatgaagaacaagctgtgcatctttgccccctacgtggacatcttcagctgcatcagccaccaccatgatgacaacatcgtgcacaagagggacaaggtgcacagcaacagcgactgtgggaaggacaccctgaaggtgagccccctgacccagaggagcatccacacaggccagaagacctaccagggcaatgaatgtgaggaggccttcaatgacagcagcagcctggagctgcacaagcaggtgcacctgggcaagaagagccctgcctgcagcacccatgagaaggacaccagctacagcagcggcatccctgtgcagcagagcgtgaggacaggcaagaagcgctactggtgccatgaatgtgggaagggcttcagccagagcagcaacctgcagacccaccagagggtgcacactggagagaagccctacacctgccatgaatgtgggaagagcttcaaccagagcagccacctgtatgcccacctgcccatccacactggagagaagccctaccgctgtgacagctgtgggaagggcttcagccgcagcacagacctgaacatccactgccgggtgcacactggagagaagccctacaagtgtgaggtgtgtgggaagggcttcacccagaggagccacctgcaggcccacgagcgcatccacactggagagaagccctacaagtgtggggactgtgggaagcgcttcagctgcagcagcaacctgcacacccaccagagggtgcacacagaggagaagccctacaagtgtgatgaatgtgggaagtgcttcagcctgtccttcaacctgcacagccaccagagggtgcacactggagagaagccctacaagtgtgaagaatgtgggaagggcttcagcagcgccagcagcttccagagccaccagagggtgcacactggagagaagcccttccgctgcaatgtgtgtgggaagggcttcagccagagcagctacttccaggcccaccagagggtgcacactggagagaagccctacaagtgtgaggtgtgtgggaagcgcttcaactggagcctgaacctgcacaaccaccagagggtgcacactggagagaagccctacaagtgtgaagaatgtgggaagggcttcagccaggccagcaacctgcaggcccaccagagcgtgcacactggagagaagcccttcaagtgtgatgcctgccagaagcgcttcagccaggccagccacctgcaggcccaccagagggtgcacactggagagaagccctacaagtgtgacacctgtgggaaggccttcagccagaggagcaacctgcaggtgcaccagatcatccacactggagagaagcccttcaagtgtgaagaatgtgggaaggagttctcctggagcgctggcctgagcgcccaccagagggtgcacactggagagaagccctacacctgccagcagtgtgggaagggcttcagccaggccagccacttccacacccaccagagggtgcacactggagagcggccctacatctgtgatgtgtgctgcaagggcttcagccagaggagccacctgatctaccaccagagggtgcacactggaggcaacctgtag

SEQ ID NO: 17667 - DNA, 546 bp, Artificial Sequence
  Description of Artificial Sequence: Synthetic coding sequence
atgggccgcatccaggaggccgtgaccttcaaggatgtggccgtggccttcacagaggaggagctgggcctgctggacagcgcccagaggaagctgtacagagatgtgatgctggagaacttcaggaacctggtgtctgtgggccaccagagcttcaagccagacatgatcagccagctggagcgggaggagaagctgtggatgaaggagctgcagacccagagaggagacaggaaccagaatgagatggccaccctgcacaaggccggcctgcgctgcttcagcctgggggagctgagctgctggcagatcaagaggcacatcgccagcaagctggcccggagccaggacagcatgatcaacatcgagggcaagagcagccagttccccaagcaccacgacagcccctgccaggtgggcgctggggagagcatccaggcctctgtggatgacaactgcctggtgaaccacatcggggaccacagcagcatcatcgagaaccaggagttccccaccgggaagaagaagaagaagaagaagcagtag

SEQ ID NO: 17668 - DNA, 1740 bp, Artificial Sequence
  Description of Artificial Sequence: Synthetic coding sequence
atgaacaagagccaggagcaggtgtccttcaaggatgtgtgtgtggacttcacccaggaggagtggtacctgctggaccctgcccagaagatcctgtacagagatgtgatcctggagaactacagcaacctggtgtctgtgggctactgcatcaccaagccagaggtgatcttcaagattgagcagggcgaggagccctggatcctggagaagggcttccccagccagtgccaccctgagaggaagtggaaggtggatgatgtgctggagagcagccaggagaatgaagatgaccacttctgggagctgctcttccacaacaacaagacagtgtctgtggagaatggagaccggggcagcaagaccttcaacctgggcacagatcctgtgtccctgaggaactacccctacaagatctgtgacagctgtgagatgaacctgaagaacatcagcggcctcatcatcagcaagaagaactgcagcaggaagaagccagatgagttcaacgtgtgtgagaagctgctgctggacatcagacatgagaagatccccatcggggagaagagctacaagtatgaccagaagagaaatgccatcaactaccaccaggacctgagccagcccagctttggccagagctttgagtacagcaagaatggccagggcttccatgatgaagctgccttcttcaccaacaagaggagccagattggagagaccgtgtgcaagtacaatgaatgtggccgcaccttcatcgagagcctgaagctgaacatcagccagaggccccacctggagatggagccctacggctgcagcatctgtgggaagagcttctgcatgaacctgcgcttcggccaccagagggccctgaccaaggacaacccctatgagtacaatgaatatggagagatcttctgtgacaacagcgccttcatcatccaccagggcgcctacaccaggaagatcctgcgggagtacaaggtgtctgacaagacctgggagaagagcgccctgctgaagcaccagatcgtgcacatgggcggcaagagctatgactacaatgaaaatggcagcaacttcagcaagaagagccacctgacccagctgcggcgggcccacactggagagaagacctttgaatgtggggagtgtgggaagaccttctgggagaagagcaacctgacccagcaccagaggacccacactggagagaagccctatgaatgtacagaatgtgggaaggccttctgccagaagccccacctgaccaaccaccagaggacccacactggagagaagccctatgagtgcaagcagtgtgggaagaccttctgtgtgaagagcaacctgacagagcaccagaggacccacactggagagaagccctatgaatgtaatgcctgtgggaagagcttctgccacaggtctgccctgactgtgcaccagaggacccacactggagagaagcccttcatctgcaatgaatgtgggaagagcttctgtgtgaagagcaacctgattgtgcaccagaggacccacactggagagaagccctacaagtgcaatgaatgtgggaagaccttctgtgagaagagcgccctgaccaagcaccagaggacccacactggagagaagccctatgaatgtaatgcctgtgggaagaccttcagccagaggtctgtgctgaccaagcaccagaggatccacaccagggtgaaggccctgagcaccagctag

SEQ ID NO: 17669 - DNA, 360 bp, Artificial Sequence
  Description of Artificial Sequence: Synthetic coding sequence
atgaacaagagccaggagcaggtgtccttcaaggatgtgtgtgtggacttcacccaggaggagtggtacctgctggaccctgcccagaagatcctgtacagagatgtgatcctggagaactacagcaacctggtgtctgtgggctactgcatcaccaagccagaggtgatcttcaagattgagcagggcgaggagccctggatcctggagaagggcttccccagccagtgccaccctgagaggaagtggaaggtggatgatgtgctggagagcagccaggagaatgaagatgaccacttctgggagctgctcttccacaacaacaagacctggaacctgaagctgatcaaggtggagtag

SEQ ID NO: 17670 - DNA, 1740 bp, Artificial Sequence; identical to SEQ ID NO: 17668
  Description of Artificial Sequence: Synthetic coding sequence

SEQ ID NO: 17671 - DNA, 303 bp, Artificial Sequence
  Description of Artificial Sequence: Synthetic coding sequence
atgaacaagagccaggagcaggtgtccttcaaggatgtgtgtgtggacttcacccaggaggagtggtacctgctggaccctgcccagaagatcctgtacagagatgtgatcctggagaactacagcaacctggtgtctgtgggctactgcatcaccaagccagaggtgatcttcaagattgagcagggcgaggagccctggatcctggagaagggcttccccagccagtgccaccctgagaggaagtggaaggtggatgatgtgctggagagcagccaggagaatgaagatgaccacttctag

SEQ ID NO: 17672 - DNA, 210 bp, Artificial Sequence
  Description of Artificial Sequence: Synthetic coding sequence
atgaacaagagccaggagcaggtgtccttcaaggatgtgtgtgtggacttcacccaggaggagtggtacctgctggaccctgcccagaagatcctgtacagagatgtgatcctggagaactacagcaacctggtgtctgtgggctactgcatcaccaagccagaggtgatcttcaagattgagcagggcgaggagccctggatcctgtag

SEQ ID NO: 17673 - DNA, 1683 bp, Artificial Sequence
  Description of Artificial Sequence: Synthetic coding sequence
atggctgctgcccggctgctgcctgtgcctgctggcccccagcccctgtccttccaggccaagctgacctttgaagatgtggccgtgctgctgagccaggatgagtgggaccggctgtgcccagcccagaggggcctgtacagaaatgtgatgatggagacctatggaaatgtggtgtccctgggcctgcccggcagcaagccagacatcatcagccagctggagcggggggaggacccctgggtgctggacaggaagggggccaagaagagccagggcctgtggagcgactacagcgacaacctgaagtatgaccacaccacagcctgcacccagcaggacagcctgagctgcccctgggagtgtgagaccaagggggagagccagaacacagacctgagccccaagcccctcatcagcgagcagaccgtcatcctgggcaagacccccctgggcagaattgaccaggagaacaatgagaccaagcagagcttctgcctgagccccaacagcgtggaccaccgggaggtgcaggtgctgagccagagcatgcccctgaccccccaccaggccgtgcccagcggggagcggccctacatgtgtgtggagtgtgggaagtgcttcggccgcagcagccacctgctgcagcaccagaggatccacactggagagaagccctacgtgtgcagcgtgtgtgggaaggccttcagccagagctctgtgctgagcaagcaccggcgcatccacactggagagaagccctatgagtgcaatgaatgtgggaaggccttccgggtgtccagtgacctggcccagcaccacaagatccacactggagagaagccccatgagtgcctggagtgcaggaaggccttcacccagctgagccacctgatccagcaccagaggatccacactggagagcggccctacgtgtgccccctgtgtgggaaggccttcaaccacagcacagtgctgcggagccaccagagggtgcacactggagagaagccccaccgctgcaatgaatgtgggaagaccttctctgtgaagaggaccctgctgcagcaccagaggatccacactggagagaagccctacacctgcagtgaatgtgggaaggccttcagtgacagatctgtgctgatccagcaccacaacgtgcacactggagagaagccctatgagtgcagtgaatgtgggaagaccttcagccacaggagcaccctgatgaaccacgagcgcatccacacagaggagaagccctatgcctgctatgaatgtgggaaggcctttgtgcagcacagccacctgatccagcaccagagggtgcacactggagagaagccctacgtgtgtggagaatgtggccacgccttcagcgcccggcgcagcctcatccagcacgagcgcatccacactggagagaagcccttccagtgcacagaatgtgggaaggccttcagcctgaaggccaccctgattgtgcacctgcggacccacactggagagaagccctatgagtgcaacagctgtgggaaggccttcagccagtacagcgtgctgatccagcaccagaggatccacactggagagaagccctatgaatgtggagaatgtggccgggccttcaaccagcacggccacctgatccagcaccagaaggtgcacaggaagctgtag

SEQ ID NO: 17674 - DNA, 369 bp, Artificial Sequence
  Description of Artificial Sequence: Synthetic coding sequence
atggctgctgcccggctgctgcctgtgcctgctggcccccaggccaagctgacctttgaagatgtggccgtgctgctgagccaggatgagtgggaccggctgtgcccagcccagaggggcctgtacagaaatgtgatgatggagacctatggaaatgtggtgtccctgggcctgcccggcagcaagccagacatcatcagccagctggagagaggagaggacccctgggtgctggacagaaaaggagccaagaagagccagggcctgtggagcgactacagcgacaacctgaagtatgaccacaccacagcctgcacccagcaggacagcctgagctgcccctgggaccctgtgccccagaagccctag

SEQ ID NO: 17675 - DNA, 1332 bp, Artificial Sequence
  Description of Artificial Sequence: Synthetic coding sequence
atggctgctgcccggctgctgcctgtgcctgctggcccccaggccaagctgacctttgaagatgtggccgtgctgctgagccaggatgagtgggaccggctgtgcccagcccagaggggcctgtacagaaatgtgatgatggagacctatggaaatgtggtgtccctgggcctgcccggcagcaagccagacatcatcagccagctggagagaggagaggacccctgggtgctggacagaaaaggagccaagaagagccagggcctgtggagcgactacagcgacaacctgaagtatgaccacaccacagcctgcacccagcaggacagcctgagctgcccctgggagtgtgagaccaagggggagagccagaacacagacctgagccccaagcccctcatcagcgagcagaccgtcatcctgggcaagacccccctgggcagaattgaccaggagaacaatgagaccaagcagagcttctgcctgagccccaacagcgtggaccaccgggaggtgcaggtgctgagccagagcatgcccctgaccccccaccaggccgtgcccagcggggagcggccctacatgtgtgtggagtgtgggaaatgttttggccgcagcagccacctgctgcagcaccagaggatccacactggagagaagccctacgtgtgcagcgtgtgtgggaaggccttcagccagagctctgtgctgagcaagcaccggcgcatccacactggagagaagccctatgaatgtaatgaatgtgggaaggccttccgggtgtccagtgacctggcccagcaccacaagatccacactggagagaagccccatgaatgtctggagtgcaggaaggccttcacccagctgagccacctgatccagcaccagaggatccacactggagagcggccctacgtgtgccccctgtgtgggaaggccttcaaccacagcacagtgctgcggagccaccagagggtgcacactggagagaagccccaccgctgcaatgaatgtgggaagaccttctctgtgaagaggaccctgctgcagcaccagaggatccacactggagagaagcccttccagtgcacagaatgtgggaaggccttcagcctgaaggccaccctcatcgtgcacctgcggacccacactggagagaagccctatgagtgcaacagctgtgggaaggccttcagccagtacagcgtgctgatccagcaccagaggatccacactggagagaagccctatgaatgtggggagtgtggccgggccttcaaccagcacggccacctgatccagcaccagaaggtgcacaggaagctgtag

SEQ ID NO: 17676 - DNA, 1668 bp, Artificial Sequence
  Description of Artificial Sequence: Synthetic coding sequence
atggctgctgcccggctgctgcctgtgcctgctggcccccaggccaagctgacctttgaagatgtggccgtgctgctgagccaggatgagtgggaccggctgtgcccagcccagaggggcctgtacagaaatgtgatgatggagacctatggaaatgtggtgtccctgggcctgcccggcagcaagccagacatcatcagccagctggagagaggagaggacccctgggtgctggacagaaaaggagccaagaagagccagggcctgtggagcgactacagcgacaacctgaagtatgaccacaccacagcctgcacccagcaggacagcctgagctgcccctgggagtgtgagaccaagggggagagccagaacacagacctgagccccaagcccctcatcagcgagcagaccgtcatcctgggcaagacccccctgggcagaattgaccaggagaacaatgagaccaagcagagcttctgcctgagccccaacagcgtggaccaccgggaggtgcaggtgctgagccagagcatgcccctgaccccccaccaggccgtgcccagcggggagcggccctacatgtgtgtggagtgtgggaaatgttttggccgcagcagccacctgctgcagcaccagaggatccacactggagagaagccctacgtgtgcagcgtgtgtgggaaggccttcagccagagctctgtgctgagcaagcaccggcgcatccacactggagagaagccctatgaatgtaatgaatgtgggaaggccttccgggtgtccagtgacctggcccagcaccacaagatccacactggagagaagccccatgaatgtctggagtgcaggaaggccttcacccagctgagccacctgatccagcaccagaggatccacactggagagcggccctacgtgtgccccctgtgtgggaaggccttcaaccacagcacagtgctgcggagccaccagagggtgcacactggagagaagccccaccgctgcaatgaatgtgggaagaccttctctgtgaagaggaccctgctgcagcaccagaggatccacactggagagaagccctacacctgcagtgaatgtgggaaggccttcagtgacagatctgtgctgatccagcaccacaacgtgcacactggagagaagccctatgaatgttctgaatgtgggaagaccttcagccacaggagcaccctgatgaaccacgagcgcatccacacagaggagaagccctatgcctgctatgaatgtgggaaggcctttgtgcagcacagccacctgatccagcaccagagggtgcacactggagagaagccctacgtgtgtggggagtgtggccacgccttcagcgcccggcgcagcctcatccagcacgagcgcatccacactggagagaagcccttccagtgcacagaatgtgggaaggccttcagcctgaaggccaccctcatcgtgcacctgcggacccacactggagagaagccctatgagtgcaacagctgtgggaaggccttcagccagtacagcgtgctgatccagcaccagaggatccacactggagagaagccctatgaatgtggggagtgtggccgggccttcaaccagcacggccacctgatccagcaccagaaggtgcacaggaagctgtag

SEQ ID NO: 17677 - DNA, 369 bp, Artificial Sequence; identical to SEQ ID NO: 17674
  Description of Artificial Sequence: Synthetic coding sequence

SEQ ID NO: 17678 - DNA, 384 bp, Artificial Sequence
  Description of Artificial Sequence: Synthetic coding sequence
atggctgctgcccggctgctgcctgtgcctgctggcccccagcccctgtccttccaggccaagctgacctttgaagatgtggccgtgctgctgagccaggatgagtgggaccggctgtgcccagcccagaggggcctgtacagaaatgtgatgatggagacctatggaaatgtggtgtccctgggcctgcccggcagcaagccagacatcatcagccagctggagcggggggaggacccctgggtgctggacaggaagggggccaagaagagccagggcctgtggagcgactacagcgacaacctgaagtatgaccacaccacagcctgcacccagcaggacagcctgagctgcccctgggaccctgtgccccagaagccctag

SEQ ID NO: 17679 - DNA, 2016 bp, Artificial Sequence
  Description of Artificial Sequence: Synthetic coding sequence
atggccgccaccttccagctgcccggccaccaggagatgcccctgaccttccaggatgtggccgtgtacttcagccaggccgagggccggcagctgggcccccagcagagggccctgtacagagatgtgatgctggagaactatggaaatgtggccagcctgggcttccctgtgcccaagccagagctgatcagccagctggagcagggcaaggagctgtgggtgctgaacctgctgggcgctgaggagccagacatcctgaagagctgccagaaggacagcgaggtgggcaccaagaaggagctgagcatcctgaaccagaagttcagcgaggaggtgaagaccccagagtttgtgtcccggcggctgctgcgggacaatgcccaggccgctgagttccgggaggcctggggccgggagggcaagctgaaggagcgggtgggcaacagcgctggccagagcctgaacaagcccaacatccacaagagggtgctgacagaggccaccgtgggccgggagaggagcctgggggagaggacccaggagtgcagcgcctttgacaggaacctgaacctggaccagaatgtggtgcggctgcagaggaacaagacaggagagagggtcttcaagtgtgacatctgcagcaagaccttcaagtacaacagcgacctgagccgccaccagaggagccacactggagagaagccctatgaatgtggccgctgtggccgggccttcacccacagcagcaacctggtgctgcaccaccacatccacacaggcaacaagcccttcaagtgtgatgaatgtgggaagaccttcggcctgaacagccacctgcggctgcaccggcgcatccacactggagagaagcccttcggctgtggagaatgtgggaaggccttcagccgcagcagcaccctcatccagcaccgcatcatccacactggagagaagccctacaagtgcaatgaatgtggccggggcttcagccagagcccccagctgacccagcaccagaggatccacactggagagaagccccatgagtgcagccactgtgggaaggccttcagccgcagcagcagcctcatccagcacgagcgcatccacactggagagaagccccacaagtgcaaccagtgtgggaaggccttcagccagagcagcagcctcttcctgcaccaccgggtgcacactggagagaagccctacgtgtgcaatgaatgtggccgggccttcggcttcaacagccacctgacagaacatgtgcgcatccacactggagagaagccctacgtgtgcaatgaatgtgggaaggccttcagaagaagcagcaccctggtgcagcaccggcgggtgcacactggagagaagccctaccagtgtgtggagtgtgggaaggccttcagccagagcagccagctgaccctgcaccagagggtgcacactggagagaagccctatgactgtggggactgtgggaaggccttcagccgccgcagcaccctcatccagcaccagaaggtgcacagcggggagaccaggaaatgtaggaagcacggccctgcctttgtgcacggcagcagcctgacagcagatggccagatccccactggagagaagcacggccgggccttcaaccacggggccaacctgatcctgcgctggacagtgcacactggagagaagagctttggctgcaatgaatatggcaaggccttcagccccaccagccggcccacagaggaccagatcatgcatgctggggagaagccctacaagtgccaggagtgtggaaatgccttcagcggcaagagcaccctcatccagcaccaggtgacccacacaggccagaagccctgccactgcagcgtgtatggcaaggccttcagccagagcagccagctgaccccaccccagcagaccagggtgggggagaagccagccctgaatgatggcagcaagcgctacttcatccacatcaagaagatcttccaggagcggcacttctag

SEQ ID NO: 17680 - DNA, 1602 bp, Artificial Sequence
  Description of Artificial Sequence: Synthetic coding sequence
atggccaccagcttcagaacagccagctgctggggcctgctgtccttcaaggacatctccatggagttcacctgggatgagtggcagctgctggacagcacccagaagtacctgtacagagatgtgatcctggagaactaccacaacctgatctctgtgggctaccacggcaccaagccagacctgatcttcaagctggagcagggcgaggacccctggatcatcaatgccaagatcagccggcagagctgcccagatggctgggaggagtggtaccagaacaaccaggatgagctggagagcattgaaagaagctatgcctgcagcgtgctgggccgcctgaacctgagcaagacccatgacagcagccggcagaggctgtacaacacccggggcaagagcctgacccagaacagcgcccccagccgcagctacctgaggaagaacccagacaagttccacggctatgaggagccctacttcctgaagcaccagagggcccacagcattgagaagaactgtgtgtgcagtgaatgtgggaaggccttccgctgcaagagccagctgattgtgcacctgcgcatccacactggagagcggccctatgaatgttccaaatgtgagcgggccttcagcgccaagagcaacctgaatgcccaccagagggtgcacactggagagaagccctacagctgcagtgaatgtgagaaggtgttctccttccgcagccagctgattgtgcaccaggagatccacactggaggcaagccctacggctgcagtgaatgtgggaaggcctacagctggaagagccagctgctgctgcaccagaggagccacactggagtgaagccctatgaatgttctgaatgtgggaaggccttcagcctgaagagcccctttgtggtgcaccagaggacccacactggagtgaagccccacaagtgcagtgaatgtgggaaggccttccgcagcaagagctacctgctggtgcacatccgcatgcacactggagagaagccctaccagtgcagcgactgtgggaaggccttcaacatgaagacccagctgattgtgcaccagggcgtgcacactggaaacaacccctaccagtgtggggagtgtgggaaggcctttggaaggaaggagcagctgacagcccacctgcgggcccatgctggggagaagccctacggctgcagtgaatgtgggaaggccttcagcagcaagagctacctggtgatccacaggaggacccacactggagagcggccctatgaatgttccctgtgtgagcgggccttctgtgggaagagccagctgatcatccaccagaggacccacagcacagagaagccctatgaatgtaatgaatgtgagaaggcctaccccaggaaggccagcctgcagatccaccagaagacccacagcggggagaagcccttcaagtgcagtgaatgtgggaaggccttcacccagaagagcagcctgtctgagcaccagagggtgcacactggagagaagccctggaagtgcagtgaatgtgggaagagcttctgctggaacagcggcctgcgcatccacaggaagacccacaagtag

SEQ ID NO: 17681 - DNA, 939 bp, Artificial Sequence
  Description of Artificial Sequence: Synthetic coding sequence
atgtgcagcccccaggagagcggcatgacagccctgagcgccaggatgctgaccaggagccgcagcctgggccctggagctggcccccggggctgccgggaggagcccggccccctgcggcggcgggaggccgctgctgaggccaggaagagccacagccctgtgaagaggcccaggaaggcccagaggctgcgggtggcctatgagggcagtgacagcgagaagggggagggcgctgagcccctgaaggtgcctgtgtgggagccccaggactggcagcagcagctggtgaacatccgggccatgaggaacaagaaggatgcccctgtggaccacctgggcacagagcactgctatgacagcagcgccccacccaaggtgcggcgctaccaggtgctgctgagcctgatgctgagcagccagaccaaggaccaggtgacagctggggccatgcagaggctgcgggcccggggcctgactgtggacagcatcctgcagacagatgatgccaccctgggcaagctgatctaccctgtgggcttctggaggagcaaggtgaagtacatcaagcagaccagcgccatcctgcagcagcactacggcggggacatcccagcctctgtggccgagctggtggccctgcccggggtgggccccaagatggcccacctggccatggctgtggcctggggcaccgtgtctggaattgctgtggacacccacgtgcacagaattgccaaccggctgcgctggaccaagaaggccaccaagagccctgaggagacccgggccgccctggaggagtggctgccccgggagctgtggcatgagatcaatggcctgctggtgggcttcggccagcagacctgcctgcctgtgcacccccgctgccacgcctgcctgaaccaggccctgtgcccagctgcccagggcctgtag

SEQ ID NO: 17682 - DNA, 996 bp, Artificial Sequence
  Description of Artificial Sequence: Synthetic coding sequence
atggagcaggccctggccggggccagcagcggccgggagctgggccggcccaaggagctgcagcccaagaagctgcacctgtgccccctgtgtgggaagaacttcagcaacaacagcaacctgatccgccaccagagaattcatgctgctgagcggctgtgcatgggcgtggactgcacagagatctttggaggcaacccccgcttcctgagcctgcaccgggcccacctgggggaggaggcccacaagtgcctggagtgtgggaagtgcttcagccagaacacccacctgaccaggcaccagaggacccacactggagagaagccctaccagtgcaacatctgtgggaagtgcttcagctgcaacagcaacctgcaccgccaccagaggacccacactggagagaagccctacaagtgcccagaatgtggggagatctttgcccacagcagcaacctgctgcggcaccagaggatccacactggagagcggccctacaagtgcccagaatgtgggaagagcttcagccgcagcagccacctggtgatccacgagaggacccatgagcgggagcggctgtaccccttctctgaatgtggggaggccgtgtctgacagcacccccttcctgaccaaccacggggcccacaaggccgagaagaagctgtttgagtgcctgacctgtgggaagagcttccggcagggcatgcacctgaccaggcaccagaggacccacactggagagaagccctacaagtgcaccctgtgtggggagaacttcagccacaggagcaacctgatccgccaccagaggatccacactggagagaagccctacacctgccatgaatgtggggacagcttcagccacagcagcaaccgcatccgccacctgcggacccacactggagagcggccctacaagtgcagtgaatgtggggagagcttcagccgcagcagccggctgatgagccaccagaggacccacactggatag

SEQ ID NO: 17683 - DNA, 1515 bp, Artificial Sequence
  Description of Artificial Sequence: Synthetic coding sequence
atgctggacaactacagaaacctggtgttcctgggcattgctgtgtccaagccagacctgatcacctgcctggagcagggcaaggagccctgcaacatgaagagacatgccatggtggccaagccccctgtggtgtgcagccactttgcccaggacctgtggcccaagcagggcctgaaggacagcttccagaaggtgatcctgcggcgctatggcaagtatggccacgagaacctgcagctgaggaagggctgcaagtctgcagatgagcacaaggtgcacaagaggggctacaacggcctgaaccagtgcctgaccaccacccagagcaagatcttccagtgtgacaagtatgtgaaggtgctgcacaagttcagcaacagcaacatccacaagaagaggcagacaggcaagaagcccttcaagtgcaaggaatgtgggaagagctgctgcatcctgagccagctgacccagcacaagaagacagccaccagggtgaacttctacaagtgcaagacctgtgggaaggccttcaaccagttcagcaacctgaccaagcacaagatcatccaccctgaggtgaacccctacaagtgtgaagaatgtgggaaggccttcaaccagagcctgaccctgaccaagcacaagaagatccacacagaggagaagccctacaagtgtgaggactgtgggaaggtgttttctgtgttttctgtgctgaccaagcacaagatcatccacacaggcaccaagccctacaactgtgaagaatgtgggaagggcttcagcatcttcagcaccctgaccaagcacaagatcatccacactggagagaagccctacaagtgcaatgaatgtgggaaggccttcaactggagcagcaccctgaccaagcacaagaggatccacactggagagaagccctacaagtgtgaagaatgtgggaaggccttcaaccagagcagcaccctgaccaggcacaagatcgtgcacactggagagaagccctacaagtgtgaagaatgtgggaaggccttcaagaggagcaccaccctgaccaagcacaagaggatctacaccaaggagaagccctacaagtgtgaagaatgtgggaaggccttctctgtgttcagcaccctgaccaagcacaagatcatccacactggagccaagccctacaagtgtgaagaatgtggcagcgccttccgggccttcagcaccctgacagagcacaagagggtgcacactggagagaagccctacaagtgcaatgaatgtgggaaggccttcaactggagcagcaccctgaccaagcacaagaggatccacactggagagaagccctacaagtgtgaagaatgtgggaaggccttcaacagaagcagcaacctgaccaggcacaagaagatccacactggagagaagccctacaagcccaagagatgtgacagcgcctttgacaacacccccaacttcagccgccacaagaggaaccacatgggagagaagagctag

SEQ ID NO: 17684 - DNA, 1710 bp, Artificial Sequence
  Description of Artificial Sequence: Synthetic coding sequence
atgagcagcgccccccggggcccccccagcgtggcccccctgcctgctggcatcggccgcagcacagccaagaccccaggcctgcccggcagcctggagatgggccccctgaccttcagagatgtggccatcgagttcagcctggaggagtggcagtgcctggacaccagccagcagaacctgtacagaaatgtgatgctggacaactacagaaacctggtgttcctgggcattgctgtgtccaagccagacctgatcacctgcctggagcagggcaaggagccctgcaacatgaagagacatgccatggtggccaagccccctgtggtgtgcagccactttgcccaggacctgtggcccaagcagggcctgaaggacagcttccagaaggtgatcctgcggcgctatggcaagtatggccacgagaacctgcagctgaggaagggctgcaagtctgcagatgagcacaaggtgcacaagaggggctacaacggcctgaaccagtgcctgaccaccacccagagcaagatcttccagtgtgacaagtatgtgaaggtgctgcacaagttcagcaacagcaacatccacaagaagaggcagacaggcaagaagcccttcaagtgcaaggaatgtgggaagagctgctgcatcctgagccagctgacccagcacaagaagacagccaccagggtgaacttctacaagtgcaagacctgtgggaaggccttcaaccagttcagcaacctgaccaagcacaagatcatccaccctgaggtgaacccctacaagtgtgaggagtgtgggaaggccttcaaccagagcctgaccctgaccaagcacaagaagatccacacagaggagaagccctacaagtgtgaggactgtgggaaggtgttcagcgtcttctctgtgctgaccaagcacaagatcatccacacaggcaccaagccctacaactgtgaggagtgtgggaagggcttcagcatcttcagcaccctgaccaagcacaagatcatccacactggagagaagccctacaagtgcaatgaatgtgggaaggccttcaactggagcagcaccctgaccaagcacaagaggatccacactggagagaagccctacaagtgtgaggagtgtgggaaggccttcaaccagagcagcaccctgaccaggcacaagatcgtgcacactggagagaagccctacaagtgtgaggagtgtgggaaggccttcaagaggagcaccaccctgaccaagcacaagaggatctacaccaaggagaagccctacaagtgtgaggagtgtgggaaggccttcagcgtcttcagcaccctgaccaagcacaagatcatccacactggagccaagccctacaagtgtgaggagtgtggcagcgccttccgggccttcagcaccctgacagagcacaagagggtgcacactggagagaagccctacaagtgcaatgaatgtgggaaggccttcaactggagcagcaccctgaccaagcacaagaggatccacactggagagaagccctacaagtgtgaggagtgtgggaaggccttcaacagaagcagcaacctgaccaggcacaagaagatccacactggagagaagccctacaagcccaagagatgtgacagcgcctttgacaacacccccaacttcagccgccacaagaggaaccacatgggagagaagagctag

SEQ ID NO: 17685 - DNA, 246 bp, Artificial Sequence
  Description of Artificial Sequence: Synthetic coding sequence
atgggccccctgaccttcagagatgtggccatcgagttcagcctggaggagtggcagtgcctggacaccagccagcagaacctgtacagaaatgtgatgctggacaactacagaaacctggtgttcctgggcattgctgtgtccaagccagacctgatcacctgcctggagcagggcaaggagccctgcaacatgaagagacatgccatggtggccaagcccccaggctggagcgctgtggcctag

SEQ ID NO: 17686 - DNA, 1131 bp, Artificial Sequence
  Description of Artificial Sequence: Synthetic coding sequence
atgaagggggaggatgcccagccccaggagatggccagcaccagcttcccccgggccagcggccccagccctgagttccggcagcacggggacagtgatggcaagaggggcagcccccagaacctgcccatcgagcaccactttgcctgcaaggaatgtggggacaccttccggctgaaggtgctgctggtgcagcaccagagggtgcacagcgaggagaagggctgggagtgtggggactgtgggaaggtgttccggggcgtggccgagttcaatgagcacaggaagagccacgtggccgctgagccccagcccggccccagccgggccctggagaatgctgctgagaagcgggagcagatggagcgggaggccaagccctttgaatgtgaggagtgtgggaagcgcttcaagaagaatgccggcctgagccagcacctgcgggtgcacagccgggagaagccctttgactgtgaggagtgtggccgctccttcaaggtgaacacccacctgttccgccaccagaagctgcacaccagcgagaagccctttgcctgcaaggcctgcagccgggacttcctggaccggcaggagctgctgaagcaccagaggatgcacacaggccacctgccctttgactgtgatgactgtgggaagagcttccggggcgtgaatggcctggccgagcaccagaggatccacagcggggccaagccctacggctgcccccactgcggcaagctgttccgccgcagcagcgagctgaccaagcaccggcgcatccacactggagagaagccctatgcctgtggccagtgtgggaaggccttccggcagagcagcagcctgctggagcacgcccgcatccacagcggggagcggccctatgcctgtggggagtgtgggaaggccttccggggccccagcgacctgatcaagcaccggcgcatccacagcggcctgaagccctatgaatgtgacaagtgtgggaaggccttccgccgcagcagcggcctgagccgccaccggcgcatccacagcggggcccggcgctgtgaatgttcccagtgtggccgggtcttcaagagaagaagtgccctgcagaagcaccagcccacccaccatgaatag

SEQ ID NO: 17687 - DNA, 990 bp, Artificial Sequence
  Description of Artificial Sequence: Synthetic coding sequence
atgatgagccacccctgtgtgtccctgctgggcgtgcctgtgctgaacccagccctggtgccccacctggcccagggccaggtgctgctggtgtctgaccccagccccaacacagatcctgccaagtacagcgagagcaccagcgccaccaggcaccagatgaagggagaagatgcccagccccaggagatggccagcaccagcttcccccgggccagcggccccagccctgagttccggcagcacggggacagtgatggcaagaggggcagcccccagaacctgcccatcgagcaccactttgcctgcaaggaatgtggggacaccttccggctgaaggtgctgctggtgcagcaccagagggtgcacagcgaggagaagggctgggagtgtggggactgtgggaaggtgttccggggcgtggccgagttcaatgagcacaggaagagccacgtggccgctgagccccagcccggccccagccgggccctggagaatgctgctgagaagcgggagcagatggagcgggaggccaagccctttgaatgtgaagaatgtgggaagcgcttcaagaagaatgccggcctgagccagcacctgcgggtgcacagccgggagaagccctttgactgtgaagaatgtggccgctccttcaaggtgaacacccacctgttccgccaccagaagctgcacaccagcgagaagccctttgcctgcaaggcctgcagccgggacttcctggaccggcaggagctgctgaagcaccagaggatgcacacaggccacctgccctttgactgtgatgactgtgggaagagcttccggggcgtgaatggcctggccgagcaccagaggatccacagcggggccaagccctacggctgcccccactgtgggaagctgttcagaagaagcagcgagctgaccaagcaccggcgcatccacactggagagaagccctatgcctgtggcctgccctgggccctgtag

SEQ ID NO: 17688 - DNA, 1290 bp, Artificial Sequence
  Description of Artificial Sequence: Synthetic coding sequence
atgatgagccacccctgtgtgtccctgctgggcgtgcctgtgctgaacccagccctggtgccccacctggcccagggccaggtgctgctggtgtctgaccccagccccaacacagatcctgccaagtacagcgagagcaccagcgccaccaggcaccagatgaagggagaagatgcccagccccaggagatggccagcaccagcttcccccgggccagcggccccagccctgagttccggcagcacggggacagtgatggcaagaggggcagcccccagaacctgcccatcgagcaccactttgcctgcaaggaatgtggggacaccttccggctgaaggtgctgctggtgcagcaccagagggtgcacagcgaggagaagggctgggagtgtggggactgtgggaaggtgttccggggcgtggccgagttcaatgagcacaggaagagccacgtggccgctgagccccagcccggccccagccgggccctggagaatgctgctgagaagcgggagcagatggagcgggaggccaagccctttgaatgtgaagaatgtgggaagcgcttcaagaagaatgccggcctgagccagcacctgcgggtgcacagccgggagaagccctttgactgtgaagaatgtggccgctccttcaaggtgaacacccacctgttccgccaccagaagctgcacaccagcgagaagccctttgcctgcaaggcctgcagccgggacttcctggaccggcaggagctgctgaagcaccagaggatgcacacaggccacctgccctttgactgtgatgactgtgggaagagcttccggggcgtgaatggcctggccgagcaccagaggatccacagcggggccaagccctacggctgcccccactgtgggaagctgttcagaagaagcagcgagctgaccaagcaccggcgcatccacactggagagaagccctatgcctgtggccagtgtgggaaggccttccggcagagcagcagcctgctggagcacgcccgcatccacagcggggagcggccctatgcctgtggagaatgtgggaaggccttccggggccccagcgacctgatcaagcaccggcgcatccacagcggcctgaagccctatgaatgtgacaagtgtgggaaggccttcagaagaagcagcggcctgagccgccaccggcgcatccacagcggggcccggcgctgtgagtgcagccagtgtggccgggtcttcaagagaagaagtgccctgcagaagcaccagcccacccaccacgagtag

SEQ ID NO: 17689 - DNA, 1380 bp, Artificial Sequence
  Description of Artificial Sequence: Synthetic coding sequence
atgcctgaggacctggtgacctttgatgatgtggcctggtacctgaccacccgggagtggttcaagctggaccctgagcagagggccctggagtactatggaaatgtgacctctgtggccggcgtgcctgtgctgaacccagccctggtgccccacctggcccagggccaggtgctgctggtgtctgaccccagccccaacacagatcctgccaagtacagcgagagcaccagcgccaccaggcaccagatgaagggagaagatgcccagccccaggagatggccagcaccagcttcccccgggccagcggccccagccctgagttccggcagcacggggacagtgatggcaagaggggcagcccccagaacctgcccatcgagcaccactttgcctgcaaggaatgtggggacaccttccggctgaaggtgctgctggtgcagcaccagagggtgcacagcgaggagaagggctgggagtgtggggactgtgggaaggtgttccggggcgtggccgagttcaatgagcacaggaagagccacgtggccgctgagccccagcccggccccagccgggccctggagaatgctgctgagaagcgggagcagatggagcgggaggccaagccctttgaatgtgaagaatgtgggaagcgcttcaagaagaatgccggcctgagccagcacctgcgggtgcacagccgggagaagccctttgactgtgaagaatgtggccgctccttcaaggtgaacacccacctgttccgccaccagaagctgcacaccagcgagaagccctttgcctgcaaggcctgcagccgggacttcctggaccggcaggagctgctgaagcaccagaggatgcacacaggccacctgccctttgactgtgatgactgtgggaagagcttccggggcgtgaatggcctggccgagcaccagaggatccacagcggggccaagccctacggctgcccccactgtgggaagctgttcagaagaagcagcgagctgaccaagcaccggcgcatccacactggagagaagccctatgcctgtggccagtgtgggaaggccttccggcagagcagcagcctgctggagcacgcccgcatccacagcggggagcggccctatgcctgtggagaatgtgggaaggccttccggggccccagcgacctgatcaagcaccggcgcatccacagcggcctgaagccctatgaatgtgacaagtgtgggaaggccttcagaagaagcagcggcctgagccgccaccggcgcatccacagcggggcccggcgctgtgagtgcagccagtgtggccgggtcttcaagagaagaagtgccctgcagaagcaccagcccacccaccacgagtag

SEQ ID NO: 17690 - DNA, 1620 bp, Artificial Sequence
  Description of Artificial Sequence: Synthetic coding sequence
atgggccactgccgcctgtgccacggcaagttcagcagccgcagcctgcggagcatcagcgagcgggcccctggggcctccatggagcggcccagcgctgaggagcgggtgctggtgcgggacttccagaggctgctgggcgtggccgtgcggcaggaccccaccctgagcccctttgtgtgcaagagctgccacgcccagttctaccagtgccacagcctgctgaagagcttcctgcagagggtgaatgccagccctgctggaagaaggaagccctgtgccaaggtgggcgcccagccccccaccggggctgaggagggcgcctgcctggtggacctgatcaccagcagcccccagtgcctgcacggcctggtgggctgggtgcacggccacgccgccagctgtggggccctgccccacctgcagaggaccctgagcagcgagtactgtggggtcatccaggtggtgtggggctgtgaccagggccatgactacaccatggacaccagcagcagctgcaaggccttcctgctggacagcgccctggccgtgaagtggccctgggacaaggagacagccccccggctgccccagcaccggggctggaaccctggagatgccccccagaccagccagggccggggcaccggcacccctgtgggcgctgagaccaagaccctgcccagcacagatgtggcccagcccccaagtgacagtgatgctgtgggccccaggagcggcttccccccccagcccagcctgcccctgtgccgggcccctggccagctgggggagaagcagctgcccagcagcaccagtgatgacagagtgaaggatgagttcagtgacctgtctgaaggagatgtgctgtctgaagatgaaaatgacaagaagcagaatgcccagagcagtgatgagagctttgagccctacccagagaggaaggtgtctgggaagaagtctgagagcaaggaggccaagaagtctgaggagccccgcatcaggaagaagccaggccccaagccaggctggaagaagaagctgcgctgtgagcgggaggagctgcccaccatctacaagtgcccctaccagggctgcacagctgtgtacagaggagcagatggcatgaagaagcacatcaaggagcaccacgaggaggtgcgggagcggccctgcccccaccctggctgcaacaaggtgttcatgattgaccgctacctgcagagacatgtgaagctgatccacacagaggtgaggaactacatctgtgatgaatgtggccagaccttcaagcagaggaagcacctgctggtgcaccagatgaggcacagcggggccaagcccctgcagtgtgaggtgtgtggcttccagtgccggcagagggccagcctgaagtaccacatgaccaagcacaaggccgagacagagctggactttgcctgtgaccagtgtggccgccgctttgagaaggcccacaacctgaatgtgcacatgtccatggtgcaccccctgacccagacccaggacaaggccctgcccctggaggccgagcccccacctggcccccccagccccagcgtgaccacagagggccaggccgtgaagccagagcccacctag

SEQ ID NO: 17691 - DNA, 1845 bp, Artificial Sequence
  Description of Artificial Sequence: Synthetic coding sequence
atgaagagggaccggctgggccgcttcctgagccctggcagcagccggcagtgtggggccagtgatggcggcggcggcgtgtccaggacccggggccggcccagcctgagcggcggcccccgggtggatggagccacagcccggcgggcctggggccctgtgggcagctgtggagatgctggggaggatggagcagatgaggccggggccggccgggccctggccatgggccactgccgcctgtgccacggcaagttcagcagccgcagcctgcggagcatcagcgagcgggcccctggggcctccatggagcggcccagcgctgaggagcgggtgctggtgcgggacttccagaggctgctgggcgtggccgtgcggcaggaccccaccctgagcccctttgtgtgcaagagctgccacgcccagttctaccagtgccacagcctgctgaagagcttcctgcagagggtgaatgccagccctgctggccgcaggaagccctgtgccaaggtgggcgcccagcccccaactggagctgaggagggcgcctgcctggtggacctgatcaccagcagcccccagtgcctgcacggcctggtgggctgggtgcacggccatgctgccagctgtggggccctgccccacctgcagaggaccctgagcagcgagtactgtggggtcatccaggtggtgtggggctgtgaccagggccatgactacaccatggacaccagcagcagctgcaaggccttcctgctggacagcgccctggccgtgaagtggccctgggacaaggagacagccccccggctgccccagcaccggggctggaaccctggagatgccccccagaccagccagggccggggcaccggcacccctgtgggcgctgagaccaagaccctgcccagcacagatgtggcccagccccccagcgacagtgatgctgtgggccccaggagcggcttccccccccagcccagcctgcccctgtgccgggcccctggccagctgggggagaagcagctgcccagcagcaccagtgatgacagagtgaaggatgagttcagtgacctgtctgaaggagatgtgctgtctgaagatgaaaatgacaagaagcagaatgcccagagcagtgatgagagctttgagccctacccagagaggaaggtgtctgggaagaagtctgagagcaaggaggccaagaagtctgaggagccccgcatcaggaagaagccaggccccaagccaggctggaagaagaagctgcgctgtgagcgggaggagctgcccaccatctacaagtgcccctaccagggctgcacagctgtgtacagaggagcagatggcatgaagaagcacatcaaggagcaccacgaggaggtgcgggagcggccctgcccccaccctggctgcaacaaggtgttcatgattgaccgctacctgcagagacatgtgaagctgatccacacagaggtgaggaactacatctgtgatgaatgtggccagaccttcaagcagaggaagcacctgctggtgcaccagatgaggcacagcggggccaagcccctgcagtgtgaggtgtgtggcttccagtgccggcagagggccagcctgaagtaccacatgaccaagcacaaggccgagacagagctggactttgcctgtgaccagtgtggcagaagatttgagaaggcccacaacctgaatgtgcacatgtccatggtgcaccccctgacccagacccaggacaaggccctgcccctggaggccgagcccccacctggcccccccagccccagcgtgaccacagagggccaggccgtgaagccagagcccacctag

SEQ ID NO: 17692 - DNA, 1203 bp, Artificial Sequence
  Description of Artificial Sequence: Synthetic coding sequence
atggacatgaggcctgctgctggcccctgccccaccttccggggccactgcccccccagcacagctgccagcagccgcagctgtggggccgccacccgggccaccaccaccccctggatcccagccccagctgcccggcccagctgctggacagtgcgctggcagagcagcggccacggcaccaagagaagaagacatggctgccccagcacagaaggaggcaccctgggcatgcccctgcggcccccccgggtggagggccagggcccccagctgggcctgcggccccggccctgcccagccaggatgtggcccagcctgctgaggacagccacccgctggggccctggccgggccagccacctgagccaggcctgcccctttgctggcccccagggctcctgggtgcgcagcagcttccacctgcagcccaggatgattggagatgtgctgtctgaagatgaaaatgacaagaagcagaatgcccagagcagtgatgagagctttgagccctacccagagaggaaggtgtctgggaagaagtctgagagcaaggaggccaagaagtctgaggagccccgcatcaggaagaagccaggccccaagccaggctggaagaagaagctgcgctgtgagcgggaggagctgcccaccatctacaagtgcccctaccagggctgcacagctgtgtacagaggagcagatggcatgaagaagcacatcaaggagcaccacgaggaggtgcgggagcggccctgcccccaccctggctgcaacaaggtgttcatgattgaccgctacctgcagagacatgtgaagctgatccacacagaggtgaggaactacatctgtgatgaatgtggccagaccttcaagcagaggaagcacctgctggtgcaccagatgaggcacagcggggccaagcccctgcagtgtgaggtgtgtggcttccagtgccggcagagggccagcctgaagtaccacatgaccaagcacaaggccgagacagagctggactttgcctgtgaccagtgtggcagaagatttgagaaggcccacaacctgaatgtgcacatgtccatggtgcaccccctgacccagacccaggacaaggccctgcccctggaggccgagcccccacctggcccccccagccccagcgtgaccacagagggccaggccgtgaagccagagcccacctag

SEQ ID NO: 17693 - DNA, 1998 bp, Artificial Sequence
  Description of Artificial Sequence: Synthetic coding sequence
atgatgaagaccttcttcagcacaggccagggcaacacagaggccttccacacaggcaccctgcagaggcaggccagccaccacatcggggacttctgcttccagaagattgagaaggacatccacggcttccagttccagtggaaggaggatgagaccaatgaccatgctgcccccatgacagagatcaaggagctgaccggcagcacaggccagcacgaccagagacatgctggcaacaagcacatcaaggaccagctgggcctgtccttccacagccacctgcctgagctgcacatcttccagcctgagggcaagattggcaaccaggtggagaagagcatcaacaatgccagctctgtgtccaccagccagaggatctgctgccggcccaagacccacatcagcaacaagtatggcaacaacagcctgcacagcagcctgctgacccagaagagaaatgtgcacatgagggagaagagcttccagtgcattgaaagtggcaagagcttcaactgcagcagcctgctgaagaagcaccagatcacccacctggaggagaagcagtgcaagtgtgatgtgtatggcaaggtgttcaaccagaagcgctacctggcctgccacagaagaagccacattgatgagaagccctacaagtgcaatgaatgtgggaagatcttcggccacaacaccagcctcttcctgcacaaggccctgcacacagctgacaagccctatgaatgtgaggagtgtgacaaggtgttcagcaggaagagccacctggagacccacaagatcatctacacaggaggcaagccctacaagtgcaaggtgtgtgacaaggccttcacctgcaacagctacctggccaagcacaccatcatccacactggagagaagccctacaagtgcaatgaatgtgggaaggtgttcaaccggctgagcaccctggcccggcaccggcggctgcacactggagagaagccctatgaatgtgaggagtgtgagaaggtgttcagcaggaagagccacctggagcggcacaagaggatccacactggagagaagccctacaagtgcaaggtgtgtgacaaggcctttgcctacaacagctacctggccaagcacagcatcatccacactggagagaagccctacaagtgcaatgaatgtgggaaggtgttcaaccagcagagcaccctggcccggcaccaccggctgcacacagctgagaagccctacaagtgtgaggagtgtgacaaggtgttccgctgcaagagccacctggagcggcaccggcgcatccacactggagagaagccctacaagtgcaaggtgtgtgacaaggccttcagaagtgacagctgcctgacagagcaccagagggtgcacactggagagaagccctacatgtgcaatgaatgtgggaaggtgttcagcaccaaggccaacctggcctgccaccacaagctgcacacagctgagaagccctacaagtgtgaggagtgtgagaaggtgttcagcaggaagagccacatggagcggcaccggcgcatccacactggagagaagccctacaagtgcaaggtgtgtgacaaggccttccggcgggacagccacctggcccagcaccagagggtgcacactggagagaagccctacaagtgcaatgaatgtgggaagaccttccggcagaccagcagcctcatcatccaccggcggctgcacactggagagaagccctacaagtgcaatgaatgtgggaagaccttcagccagatgagcagcctggtgtaccaccaccggctgcacagcggggagaagccctacaagtgcaatgaatgtgggaaggtgttcaaccagcaggcccacctggcccagcaccagagggtgcacactggagagaagccctacaagtgcaatgaatgtgggaagaccttcagccagatgagcaacctggtgtaccaccaccggctgcacagcggggagaagccctag

SEQ ID NO: 17694 - DNA, 1998 bp, Artificial Sequence; identical to SEQ ID NO: 17693
  Description of Artificial Sequence: Synthetic coding sequence

SEQ ID NO: 17695 - DNA, 2157 bp, Artificial Sequence
  Description of Artificial Sequence: Synthetic coding sequence
atggccctgccccagggcctgctgaccttcagagatgtggccatcgagttcagccaggaggagtggaagtgcctggaccctgcccagaggaccctgtacagagatgtgatgctggagaactacagaaacctggtgtccctggacatcagcagcaagtgcatgatgaagaccttcttcagcacaggccagggcaacacagaggccttccacacaggcaccctgcagaggcaggccagccaccacatcggggacttctgcttccagaagattgagaaggacatccacggcttccagttccagtggaaggaggatgagaccaatgaccacgccgcccccatgacagagatcaaggagctgaccggcagcacaggccagcacgaccagagacatgctggcaacaagcacatcaaggaccagctgggcctgtccttccacagccacctgcctgagctgcacatcttccagcctgagggcaagattggcaaccaggtggagaagagcatcaacaatgccagctctgtgtccaccagccagaggatctgctgccggcccaagacccacatcagcaacaagtatggcaacaacagcctgcacagcagcctgctgacccagaagagaaatgtgcacatgagggagaagagcttccagtgcatcgagagcggcaagagcttcaactgcagcagcctgctgaagaagcaccagatcacccacctggaggagaagcagtgcaagtgtgatgtgtatggcaaggtgttcaaccagaagcgctacctggcctgccaccggcgcagccacattgatgagaagccctacaagtgcaatgaatgtgggaagatcttcggccacaacaccagcctcttcctgcacaaggccctgcacacagctgacaagccctatgaatgtgaagaatgtgacaaggtgttcagcaggaagagccacctggagacccacaagatcatctacacaggaggcaagccctacaagtgcaaggtgtgtgacaaggccttcacctgcaacagctacctggccaagcacaccatcatccacactggagagaagccctacaagtgcaatgaatgtgggaaggtgttcaaccggctgagcaccctggcccggcaccggcggctgcacactggagagaagccctatgaatgtgaagaatgtgagaaggtgttcagcaggaagagccacctggagcggcacaagaggatccacactggagagaagccctacaagtgcaaggtgtgtgacaaggcctttgcctacaacagctacctggccaagcacagcatcatccacactggagagaagccctacaagtgcaatgaatgtgggaaggtgttcaaccagcagagcaccctggcccggcaccaccggctgcacacagctgagaagccctacaagtgtgaagaatgtgacaaggtgttccgctgcaagagccacctggagcggcaccggcgcatccacactggagagaagccctacaagtgcaaggtgtgtgacaaggccttcagaagtgacagctgcctgacagagcaccagagggtgcacactggagagaagccctacatgtgcaatgaatgtgggaaggtgttcagcaccaaggccaacctggcctgccaccacaagctgcacacagctgagaagccctacaagtgtgaagaatgtgagaaggtgttcagcaggaagagccacatggagcggcaccggcgcatccacactggagagaagccctacaagtgcaaggtgtgtgacaaggccttcagaagagacagccacctggcccagcaccagagggtgcacactggagagaagccctacaagtgcaatgaatgtgggaagaccttccggcagaccagcagcctcatcatccaccggcggctgcacactggagagaagccctacaagtgcaatgaatgtgggaagaccttcagccagatgagcagcctggtgtaccaccaccggctgcacagcggggagaagccctacaagtgcaatgaatgtgggaaggtgttcaaccagcaggcccacctggcccagcaccagagggtgcacactggagagaagccctacaagtgcaatgaatgtgggaagaccttcagccagatgagcaacctggtgtaccaccaccggctgcacagcggggagaagccctag

SEQ ID NO: 17696 - DNA, 2607 bp, Artificial Sequence
  Description of Artificial Sequence: Synthetic coding sequence
atgagaggagctgccagcgcctctgtgcgggagcccacccccctgcccggccgcggggcccccaggaccaagcccagggctggccggggccccaccgtgggcaccccagccaccctggccctgcctgcccggggccggcccaggagcagaaatggcctggccagcaagggccagagaggagctgcccccaccggccctggccaccgggccctgcccagccgggacacagccctgccccaggagaggaacaagaagctggaggccgtgggcactggaattgagcccaaggccatgagccagggcctggtgacctttggagatgtggccgtggacttcagccaggaggagtgggagtggctgaaccccatccagaggaacctgtacaggaaggtgatgctggagaactacagaaacctggccagcctgggcctgtgtgtgtccaagccagatgtgatcagcagcctggagcagggcaaggagccctggacagtgaagaggaagatgacccgggcctggtgcccagacctgaaggctgtgtggaagatcaaggagctgcccctgaagaaggacttctgtgagggcaagctgagccaggccgtcatcacagagcggctgaccagctacaacctggagtacagcctgctgggggagcactgggactatgatgccctgtttgagacccagcccggcctggtgaccatcaagaacctggccgtggacttccggcagcagctgcacccagcccagaagaacttctgcaagaatggcatctgggagaacaacagcgacctgggcagcgctggccactgtgtggccaagccagacctggtgtccctgctggagcaggagaaggagccctggatggtgaagcgggagctgaccggcagcctcttcagcggccagaggtctgtgcatgagacccaggagctgttccccaagcaggacagctatgcagagggcgtgacagacaggaccagcaacaccaagctggactgcagcagcttccgggagaactgggacagcgactatgtgtttggaaggaagctggccgtgggccaggagacccagttccggcaggagcccatcacccacaacaagaccctgagcaaggagcgggagaggacctacaacaagagcggccgctggttctacctggatgacagcgaggagaaggtgcacaacagagacagcatcaagaacttccagaagagctctgtggtgatcaagcagacaggcatctatgccggcaagaagctgttcaagtgcaatgaatgcaagaagaccttcacccagagcagcagcctgactgtgcaccagaggatccacactggagagaagccctacaagtgcaatgaatgtgggaaggccttcagtgatggcagcagctttgcccggcaccagcgctgccacacaggcaagaagccctatgaatgtattgaatgtgggaaggccttcatccagaacaccagcctcatccgccactggagatactaccacactggagagaagccctttgactgcatcgactgtgggaaggccttcagtgaccacatcggcctgaaccagcaccggcgcatccacactggagagaagccctacaagtgtgatgtgtgccacaagagcttccgctatggcagcagcctgactgtgcaccagaggatccacactggagagaagccctatgaatgtgatgtgtgcaggaaggccttcagccaccacgccagcctgacccagcaccagagggtgcacagcggggagaagcccttcaagtgcaaggaatgtgggaaggccttccggcagaacatccacctggccagccacctgcgcatccacactggagagaagccctttgaatgtgctgaatgtgggaagagcttcagcatcagcagccagctggccacccaccagaggatccacactggagagaagccctatgagtgcaaggtgtgcagcaaggccttcacccagaaggcccacctggcccagcaccagaagacccacactggagagaagccctatgagtgcaaggaatgtgggaaggccttcagccagaccacccacctgatccagcaccagagggtgcacactggagagaagccctacaagtgcatggagtgtgggaaggccttcggggacaacagcagctgcacccagcaccagaggctgcacacaggccagaggccctatgagtgcattgaatgtgggaaggccttcaagaccaagagcagcctcatctgccaccggcgcagccacactggagagaagccctatgagtgcagcgtgtgtgggaaggccttcagccaccggcagagcctgtctgtgcaccagaggatccacagcggcaagaagccctatgagtgcaaggaatgtaggaagaccttcatccagatcggccacctgaaccagcacaagagggtgcacactggagagaggagctacaactacaagaagagcaggaaggtgttccggcagacagcccacctggcccaccaccagaggatccacactggagagagcagcacctgccccagcctgcccagcaccagcaaccctgtggacctcttccccaagttcctgtggaaccccagcagcctgcccagcccctag

SEQ ID NO: 17697 - DNA, 1629 bp, Artificial Sequence
  Description of Artificial Sequence: Synthetic coding sequence
atgggagacatcttcctgtgcaagaaggtggagagccccaagaagaacctgcgggagagcaagcagcgggaggaggatgatgaggaccctgacctgatctacgtgggcgtggagcacgtgcacagagatgctgaggtgctgtttgtgggcatgatcagcaacagcaagcctgtggtgagcaacatcctgaacagagtgaccccaggcagcaagagcaggaggaagaagggccacttccggcagtacccagcccacgtgtcccagcctgccaaccacgtgacctccatggccaaggccatcatgcctgtgtccctgtctgagggccgcagcacagacagccctgtgaccatgaagagcagcagcgagcccggctacaagatgagcagcccccaggtggtgagccccaactacagcgacagcctgcccccaggcacccagtgcctggtgggcgccatggtgtctgggggcggcagaaatgaaagcagcccagacagcaagaggctgagcaccagtgacatcaacagccgggacagcaagagggtgaagctgagagatggcatccctggggtgcccagcctggccgtggtgcccagcgacatgagcagcaccatcagcaccaacacccccagccagggcatctgcaacagcagcaaccacgtgcagaatggagtgaccttcccctggccagatgccaacgggaaggcccacttcaacctgacagatcctgagcgggccaatgaaagtggcctggccatgacagacatcagcagcctggccagccagaacaagacctttgaccccaagaaggagaaccccatcgtgctgctgagcaacttctactacggccagcacaagggagatggccagcctgagcagaagacccacaccaccttcaagtgcctgagctgtgtgaaggtgctgaagaacatcaagttcatgaaccacatgaagcaccacctggagtttgagaagcagagaaatgacagctgggaggaccacaccacctgccagcactgccaccggcagttccccacccccttccagctgcagtgccacattgattctgtgcacatcgccatgggccccagcgctgtgtgcaagatctgtgagctgagctttgaaacagaccaggtgctgctgcagcacatgaaggaccaccacaagccaggagagatgccctacgtgtgccaggtgtgccactaccgcagctctgtgtttgctgatgtggagacccacttccgcacctgccacgagaacaccaagaacctgctgtgcctcttctgcctgaagctgttcaagacagccatcccctacatgaaccactgctggaggcacagcagaagaagagtgctgcagtgcagcaaatgtcggctgcagttcctgaccctgaaggaggagattgagcacaagaccaaggaccaccagaccttcaagaagccagagcagctgcagggcttcccccgggagaccaaggtgatcatccagacctctgtgcagcccggcagcagcggcatggcctctgtgattgtgagcaacacagacccccagagcagccctgtgaagaccaagaagaagacagccatgaacacccgggacagccggctgccctgcagcaaggacagcagctag

SEQ ID NO: 17698 - DNA, 1632 bp, Artificial Sequence
  Description of Artificial Sequence: Synthetic coding sequence
atggagcagagctgtgaggaggagaaggagcctgagccccagaagaacatccaggagaccaagcaggtggatgatgaagatgctgagctgatctttgtgggcgtggagcacgtgaatgaagatgctgagctgatctttgtgggcgtgaccagcaacagcaagcctgtggtgagcaacatcctgaacagagtgaccccaggctcctggagcaggaggaagaagtatgaccacctgaggaaggacacagccaggaagctgcagcccaagagccatgaaacagtgaccagcgaggccgtgacagtgctgcctgccagccagctggagagccgcagcacagacagccccatcatcatcgagcccctgagcaagccagactacagaaacagcagcccccaggtggtgcccaacaacagcagcgagctgcccagccccctcatcaccttcacagacagcctgcaccaccctgtgtccacagccctgtctgtgggcggcatcaatgaaagcccccgggtgtccaagcagctgagcacctttgaggtgaacagcatcaaccccaagagggccaagctgagagatggcatcatcgagggcaacagcagcgccagcttccccagcgacaccttccacaccatgaacacccagcagagcacccccagcaacaacgtgcacaccagcctgagccacgtgcagaatggagcccccttccctgctgccttccccaaggacaacatccacttcaagcccatcaacaccaacctggaccgggagaatgagctggccaagacagacatcctgagcctgaccagccagaacaagacctttgaccccaagaaggagaaccccatcgtgctgctgagtgacttctactacggccagcacaagggggagggccagcctgagcagaagacccacaccaccttcaagtgcctgagctgtgtgaaggtgctgaagaatgtgaagttcatgaaccacgtgaagcaccacctggagtttgagaagcagagaaatgacagctgggagaaccacaccacctgccagcactgccaccggcagttccccacccccttccagctgcagtgccacattgaaaatgtgcacacagcccaggagcccagcacagtgtgcaagatctgtgagctgagctttgaaacagaccaggtgctgctgcagcacatgaaggaccaccacaagccaggagagatgccctacgtgtgccaggtgtgccactaccgcagctctgtgtttgctgatgtggagacccacttccgcacctgccacgagaacaccaagaacctgctgtgccccttctgcctgaagatcttcaagacagccaccccctacatgtgccactaccggggccactggggcaagagcgcccaccagtgcagcaagtgccgcctgcagttcctgaccttcaaggagaagatggagcacaagacccagtgccaccagatgttcaagaagcccaagcagctggagggcctgcccccagagaccaaggtgaccatccaggtgtccctggagcccctgcagcccggctctgtggatgtggccagcatcaccgtgtccaccagtgacagcgagcccagcctgcccaggagcaagagcaagatcagcaagaagagccactag

SEQ ID NO: 17699 - DNA, 1632 bp, Artificial Sequence; identical to SEQ ID NO: 17698
  Description of Artificial Sequence: Synthetic coding sequence

SEQ ID NO: 17700 - DNA, 1833 bp, Artificial Sequence
  Description of Artificial Sequence: Synthetic coding sequence
atggatgatgacaagcccttccagcccaagaacatcagcaagatggccgagctgttcatggagtgtgaggaggaggagctggagccctggcagaagaaggtggaggagacccaggatgaagatgatgatgagctgatctttgtgggggagatcagcagcagcaagccagccatcagcaacatcctgaacagaggccacagcagcagcagcagcaagggcatcaagtctgagccccacagccctggcatccctgagatcttcagaacagccagccagcgctgccgggacccccccagcaaccctgtggccgccagcccccgcttccacctggtgtccaagagcagccagagctctgtgacagtggagaatgccagcaagccagacttcaccaagaacagccaggtgggcagtgacaacagcagcatcctgctgtttgacagcacccaggagagcctgccccccagccaggacatcccagccatcttccgggagggcatgaagaacaccagctatgtgctgaagcaccccagcaccagcaaggtgaacagcgtgacccccaagaagcccaagaccagtgaagatgtgccccagatcaaccccagcaccagcctgcccctgattggcagcccccctgtgaccagcagccaggtgatgctgagcaagggcaccaacaccagcagcccctatgatgctggagctgactacctgcgggcctgccccaagtgcaatgtgcagttcaacctgctggaccccctgaagtaccacatgaagcactgctgcccagacatgatcaccaagttcctgggcgtgattgtgaagtctgagcggccctgtgatgaggacaagacagattctgaaacaggcaagctgatcatgctggtgaatgagttctactacggcagacatgagggcgtgacagagaaggagcccaagacctacaccaccttcaagtgcttcagctgcagcaaggtgctgaagaacaacatccgcttcatgaaccacatgaagcaccacctggagctggagaagcagaacaatgaatcctgggagaaccacaccacctgccagcactgctaccggcagtaccccacccccttccagctgcagtgccacatcgagagcacccacacccctcatgagttcagcaccatctgcaagatctgtgagctgagctttgaaacagagcacatcctgctgcagcacatgaaggacacccacaagccaggagagatgccctacgtgtgccagaagaagggcgtgcaccgctgccccaagtgccgcctgcagttcctgaccagcaaggagaaggccgagcacaaggcccagcacaggaccttcatcaagcccaaggagctggagggcctgcccccaggggccaaggtgaccatccgggccagcctgggccccctgcagagcaagctgcccacagcccccttcggctgtgcccctggcaccagcttcctgcaggtgaccccacccaccagccagaacaccacagccaggaaccccaggaagagcaatgccagccgcagcaagaccagcaagctgcacgccaccaccagcacagccagcaaggtgaacaccagcaagccccggggcagaattgccaagagcaaggccaagcccagctacaagcagaagaggcagaggaacaggaagaacaagatgagcctggccctgaagaacatccgctgccggcggggcatccacaagtgcatcgagtgccacagcaagatcaaggactttgccagccacttcagcatctacatccactgcagcttctgcaagtacaacaccaactgcaacaaggcctttgtgaaccacatgatgtag

SEQ ID NO: 17701 - DNA, 2214 bp, Artificial Sequence
  Description of Artificial Sequence: Synthetic coding sequence
atggatgatgacaagcccttccagcccaagaacatcagcaagatggccgagctgttcatggagtgtgaggaggaggagctggagccctggcagaagaaggtggaggagacccaggatgaagatgatgatgagctgatctttgtgggggagatcagcagcagcaagccagccatcagcaacatcctgaacagaggccacagcagcagcagcagcaagggcatcaagtctgagccccacagccctggcatccctgagatcttcagaacagccagccagcgctgccgggacccccccagcaaccctgtggccgccagcccccgcttccacctggtgtccaagagcagccagagctctgtgacagtggagaatgccagcaagccagacttcaccaagaacagccaggtgggcagtgacaacagcagcatcctgctgtttgacagcacccaggagagcctgccccccagccaggacatcccagccatcttccgggagggcatgaagaacaccagctatgtgctgaagcaccccagcaccagcaaggtgaacagcgtgacccccaagaagcccaagaccagtgaagatgtgccccagatcaaccccagcaccagcctgcccctgattggcagcccccctgtgaccagcagccaggtgatgctgagcaagggcaccaacaccagcagcccctatgatgctggagctgactacctgcgggcctgccccaagtgcaatgtgcagttcaacctgctggaccccctgaagtaccacatgaagcactgctgcccagacatgatcaccaagttcctgggcgtgattgtgaagtctgagcggccctgtgatgaggacaagacagattctgaaacaggcaagctgatcatgctggtgaatgagttctactacggcagacatgagggcgtgacagagaaggagcccaagacctacaccaccttcaagtgcttcagctgcagcaaggtgctgaagaacaacatccgcttcatgaaccacatgaagcaccacctggagctggagaagcagaacaatgaatcctgggagaaccacaccacctgccagcactgctaccggcagtaccccacccccttccagctgcagtgccacatcgagagcacccacacccctcatgagttcagcaccatctgcaagatctgtgagctgagctttgaaacagagcacatcctgctgcagcacatgaaggacacccacaagccaggagagatgccctacgtgtgccaggtgtgccagttccgcagcagcaccttcagtgatgtggaggcccacttccgggccgcccacgagaacaccaagaacctgctgtgccccttctgcctgaaggtgtccaagatggccaccccctacatgaaccactacatgaagcaccagaagaagggcgtgcaccgctgccccaagtgccgcctgcagttcctgaccagcaaggagaaggccgagcacaaggcccagcacaggaccttcatcaagcccaaggagctggagggcctgcccccaggggccaaggtgaccatccgggccagcctgggccccctgcagagcaagctgcccacagcccccttcggctgtgcccctggcaccagcttcctgcaggtgaccccacccaccagccagaacaccacagccaggaaccccaggaagagcaatgccagccgcagcaagaccagcaagctgcacgccaccaccagcacagccagcaaggtgaacaccagcaagccccggggccgcatcgccaagagcaaggccaagcccagctacaagcagaagaggcagaggaacaggaagaacaagatgagcctggccctgaagaacatccgctgcagaagaggcatccacaagtgcatcgagtgccacagcaagatcaaggactttgccagccacttcagcatctacatccactgcagcttctgcaagtacaacaccaactgcaacaaggcctttgtgaaccacatgatgagcagccacagcaaccaccctgggaagcgcttctgcatcttcaagaagcacagcggcaccctgcggggcatcaccctggtgtgcctgaagtgtgacttcctggccgacagcagcggcctggacaggatggccaagcacctgagccagaggaagacccacacctgccaggtgatcattgaaaatgtgtccaagagcaccagcaccagcgagcccaccaccggctgcagcctgaagtag

SEQ ID NO: 17702 - DNA, 1833 bp, Artificial Sequence; identical to SEQ ID NO: 17700
  Description of Artificial Sequence: Synthetic coding sequence

SEQ ID NO: 17703 - DNA, 909 bp, Artificial Sequence
  Description of Artificial Sequence: Synthetic coding sequence
atggccggcatgtctgagagcagcttcctgagcaagaggcccagcaccagcgaggtgaacaacgtgaaccccaagaagcccaagcccagcgagagcgtgtctggggccaacagcagcgctgtgctgcccagcgtgaagagccccagcgtgaccagcagccaggccatgctggccaagggcaccaacaccagcagcaaccagagcaagaatggcacccccttcccccgggcctgccccaagtgcaacatccacttcaacctgctggaccccctgaagaaccacatgaagtactgctgcccagacatgatcaacaacttcctgggcctggccaagacagagttcagcagcacagtgaacaagaacaccaccatcgacagcgagaagggcaagctgatcatgctggtgaatgacttctactacggcaagcatgaaggagatgtgcaggaggagcagaagacccacaccaccttcaagtgcttcagctgcctgaagatcctgaagaacaacatccgcttcatgaaccacatgaagcaccacctggagctggagaagcagagcagcgagagctgggagaaccacaccacctgccagcactgctaccggcagttccccacccccttccagctgcagtgccacatcgagagcacccacacccctcatgagttcagcaccatctgcaagatctgtgagctgagctttgaaacagaacatgtgctgctgcagcacatgaaggacaaccacaagccaggagagatgccctacgtgtgccaggtgtgcaactaccgcagcagcagcttcagtgatgtggagacccacttccgcaccagccatgagaacaccaagacctgctacgccaggtttgccagcaagctgctgaagctgcagcaccacatctgcatcatcatctag

SEQ ID NO: 17704 - DNA, 2940 bp, Artificial Sequence
  Description of Artificial Sequence: Synthetic coding sequence
atgggagacaaccccttccagcccaagagcaacagcaagatggccgagctgttcatggagtgtgaggaggaggagctggagccctggcagaagaaggtgaaggaggtggaggatgatgatgatgatgagcccatctttgtgggggagatcagcagcagcaagccagccatcagcaacatcctgaacagagtgaaccccagcagctacagccggggcctgaagaatggagccctgagccggggcatcacagctgccttcaagcccaccagccagcactacaccaaccccaccagcaaccctgtgcctgccagccccatcaacttccaccctgagagccgcagcagtgacagcagcgtcatcgtgcagcccttcagcaagccaggctacatcaccaacagcagccgggtggtgagcaacaagagcagcgagctgctgtttgacctgacccaggacaccggcctgagccactaccagggcggccccaccctgtccatggccggcatgtctgagagcagcttcctgagcaagaggcccagcaccagcgaggtgaacaacgtgaaccccaagaagcccaagcccagcgagagcgtgtctggggccaacagcagcgctgtgctgcccagcgtgaagagccccagcgtgaccagcagccaggccatgctggccaagggcaccaacaccagcagcaaccagagcaagaatggcacccccttcccccgggcctgccccaagtgcaacatccacttcaacctgctggaccccctgaagaaccacatgaagtactgctgcccagacatgatcaacaacttcctgggcctggccaagacagagttcagcagcacagtgaacaagaacaccaccatcgacagcgagaagggcaagctgatcatgctggtgaatgacttctactacggcaagcatgaaggagatgtgcaggaggagcagaagacccacaccaccttcaagtgcttcagctgcctgaagatcctgaagaacaacatccgcttcatgaaccacatgaagcaccacctggagctggagaagcagagcagcgagagctgggagaaccacaccacctgccagcactgctaccggcagttccccacccccttccagctgcagtgccacatcgagagcacccacacccctcatgagttcagcaccatctgcaagatctgtgagctgagctttgaaacagaacatgtgctgctgcagcacatgaaggacaaccacaagccaggagagatgccctacgtgtgccaggtgtgcaactaccgcagcagcagcttcagtgatgtggagacccacttccgcaccagccatgagaacaccaagaacctgctgtgccccttctgcctgaaggtgatcaagatcgccaccccctacatgcaccactacatgaagcaccagaagaagggcatccaccgctgcaccaagtgccgcctgcagttcctgacctgcaaggagaagatggaccacaagacccagcaccacaggaccttcatcaagcccaagcagctggagggcctgcccccaggcaccaaggtgaccatccgggcctctgtgggccccctgcagagcggggccagccccacccccagcatcagcgccagcgccagcaccctgcagctgagcccccccaggaccaagaacatcacagccaagaacccagccaagagcaacaccagcaagcccaacacagtgaagagcaatgccagcaagcccaacaccagcaagcccaacggcagcaagagcaagtacaagcccaagatcagcaacatgcagaagaagcagagcaccctggccagcagcaacaagaagagcaaggtgaacacagccctgaggaacctgcgctaccgccggggcatccacaagtgcatcgagtgctgcagcgagatcaaggactttgccaaccacttccccacctacgtgcactgcagcttctgccgctacaacaccagctgcagcaaggcctacgtgaaccacatgatgtccttccacagcaaccggcccagcaagcgcttctgcatcttcaagaagcacagcgagaacctgcggggcatcaccctggtgtgcctgaactgtgacttcctgagtgatgtgtctggcctggacaacatggccacccacctgagccagcacaagacccacacctgccaggtggtgatgcagaaggtgtctgtgtgcatccccaccagcgagcacctgtctgagctgaagaaggaggccccagccaaggagcaggagcctgtgtccaaggagatcgcccggcccaacatggccgagcgggagacagagaccagcaacagcgagagcaagcaggacaaggccgccagcagcaaggagaagaatggctgcaatgccaacagctttgagggcagcagcaccaccaagtctgaggagagcatcaccgtgtctgacaaggaaaatgagacctgcctggccgaccaggagaccggcagcaagaacatcgtgtcctgtgacagcaacattggagctgacaaggtggagaagaagaagcagatccagcacgtgtgccaggagatggagctgaagatgtgccagagcagcgagaacatcatcctgagtgaccagatcaaggaccacaacagcagcgaggcccgcttcagcagcaagaacatcaaggacctgcggctggccagtgacaacgtgtccattgaccagttcctgaggaagagacatgagcctgagagcgtgtccagtgatgtgtctgagcagggcagcatccacctggagcccctgacccccagcgaggtgctggagtatgaggccacagagatcctgcagaagggcagcggggaccccagcgccaagacagatgaggtggtgtctgaccagacagatgacatccctgggggcaacaaccccagcaccacagaggccaccgtggacctggaggatgagaaggagaggagctag

SEQ ID NO: 17705 - DNA, 1266 bp, Artificial Sequence
  Description of Artificial Sequence: Synthetic coding sequence
atgctggtgaatgacttctactacggcaagcatgaaggagatgtgcaggaggagcagaagacccacaccaccttcaagtgcttcagctgcctgaagatcctgaagaacaacatccgcttcatgaaccacatgaagcaccacctggagctggagaagcagagcagcgagagctgggagaaccacaccacctgccagcactgctaccggcagttccccacccccttccagctgcagtgccacatcgagagcacccacacccctcatgagttcagcaccatctgcaagatctgtgagctgagctttgaaacagaacatgtgctgctgcagcacatgaaggacaaccacaagccaggagagatgccctacgtgtgccaggtgtgcaactaccgcagcagcagcttcagtgatgtggagacccacttccgcaccagccatgagaacaccaagaacctgctgtgccccttctgcctgaaggtgatcaagatcgccaccccctacatgcaccactacatgaagcaccagaagaagggcatccaccgctgcaccaagtgccgcctgcagttcctgacctgcaaggagaagatggaccacaagacccagcaccacaggaccttcatcaagcccaagcagctggagggcctgcccccaggcaccaaggtgaccatccgggcctctgtgggccccctgcagagcggggccagccccacccccagcatcagcgccagcgccagcaccctgcagctgagcccccccaggaccaagaacatcacagccaagaacccagccaagagcaacaccagcaagcccaacacagtgaagagcaatgccagcaagcccaacaccagcaagcccaacggcagcaagagcaagtacaagcccaagatcagcaacatgcagaagaagcagagcaccctggccagcagcaacaagaagagcaaggtgaacacagccctgaggaacctgcgctaccgccggggcatccacaagtgcatcgagtgctgcagcgagatcaaggactttgccaaccacttccccacctacgtgcactgcagcttctgccgctacaacaccagctgcagcaaggcctacgtgaaccacatgatgtccttccacagcaaccggcccagcaagcgcttctgcatcttcaagaagcacagcgagaacctgcgctgtgtgggcggccagattgaatgtgacctgcccaagctgcacaagctggtggtggagccccggctgaccctgggcctgctgacccccaacttctag

SEQ ID NO: 17706 - DNA, 2901 bp, Artificial Sequence
  Description of Artificial Sequence: Synthetic coding sequence
atggccgagctgttcatggagtgtgaggaggaggagctggagccctggcagaagaaggtgaaggaggtggaggatgatgatgatgatgagcccatctttgtgggggagatcagcagcagcaagccagccatcagcaacatcctgaacagagtgaaccccagcagctacagccggggcctgaagaatggagccctgagccggggcatcacagctgccttcaagcccaccagccagcactacaccaaccccaccagcaaccctgtgcctgccagccccatcaacttccaccctgagagccgcagcagtgacagctctgtgattgtgcagcccttcagcaagccaggctacatcaccaacagcagccgggtggtgagcaacaagagcagcgagctgctgtttgacctgacccaggacaccggcctgagccactaccagggcggccccaccctgtccatggccggcatgtctgagagcagcttcctgagcaagaggcccagcaccagcgaggtgaacaacgtgaaccccaagaagcccaagcccagcgagagcgtgtctggggccaacagcagcgctgtgctgcccagcgtgaagagccccagcgtgaccagcagccaggccatgctggccaagggcaccaacaccagcagcaaccagagcaagaatggcacccccttcccccgggcctgccccaagtgcaacatccacttcaacctgctggaccccctgaagaaccacatgaagtactgctgcccagacatgatcaacaacttcctgggcctggccaagacagagttcagcagcacagtgaacaagaacaccaccattgattctgagaagggcaagctgatcatgctggtgaatgacttctactacggcaagcatgaaggagatgtgcaggaggagcagaagacccacaccaccttcaagtgcttcagctgcctgaagatcctgaagaacaacatccgcttcatgaaccacatgaagcaccacctggagctggagaagcagagcagcgagagctgggagaaccacaccacctgccagcactgctaccggcagttccccacccccttccagctgcagtgccacatcgagagcacccacacccctcatgagttcagcaccatctgcaagatctgtgagctgagctttgaaacagagcacgtgctgctgcagcacatgaaggacaaccacaagccaggagagatgccctacgtgtgccaggtgtgcaactaccgcagcagcagcttcagtgatgtggagacccacttccgcaccagccatgagaacaccaagaacctgctgtgccccttctgcctgaaggtgatcaagatcgccaccccctacatgcaccactacatgaagcaccagaagaagggcatccaccgctgcaccaagtgccgcctgcagttcctgacctgcaaggagaagatggaccacaagacccagcaccacaggaccttcatcaagcccaagcagctggagggcctgcccccaggcaccaaggtgaccatccgggcctctgtgggccccctgcagagcggggccagccccacccccagcatcagcgccagcgccagcaccctgcagctgagcccccccaggaccaagaacatcacagccaagaacccagccaagagcaacaccagcaagcccaacacagtgaagagcaatgccagcaagcccaacaccagcaagcccaacggcagcaagagcaagtacaagcccaagatcagcaacatgcagaagaagcagagcaccctggccagcagcaacaagaagagcaaggtgaacacagccctgaggaacctgcgctacagaagaggcatccacaagtgcatcgagtgctgcagcgagatcaaggactttgccaaccacttccccacctacgtgcactgcagcttctgccgctacaacaccagctgcagcaaggcctacgtgaaccacatgatgtccttccacagcaaccggcccagcaagcgcttctgcatcttcaagaagcacagcgagaacctgcggggcatcaccctggtgtgcctgaactgtgacttcctgagtgatgtgtctggcctggacaacatggccacccacctgagccagcacaagacccacacctgccaggtggtgatgcagaaggtgtctgtgtgcatccccaccagcgagcacctgtctgagctgaagaaggaggccccagccaaggagcaggagcctgtgtccaaggagatcgcccggcccaacatggccgagcgggagacagagaccagcaacagcgagagcaagcaggacaaggccgccagcagcaaggagaagaatggctgcaatgccaacagctttgagggcagcagcaccaccaagtctgaggagagcatcaccgtgtctgacaaggaaaatgagacctgcctggccgaccaggagaccggcagcaagaacatcgtgtcctgtgacagcaacatcggggctgacaaggtggagaagaagaagcagatccagcacgtgtgccaggagatggagctgaagatgtgccagagcagcgagaacatcatcctgagtgaccagatcaaggaccacaacagcagcgaggcccgcttcagcagcaagaacatcaaggacctgcggctggccagtgacaacgtgtccattgaccagttcctgaggaagagacatgagcctgagagcgtgtccagtgatgtgtctgagcagggcagcatccacctggagcccctgaccccatctgaggtgctggagtatgaggccacagagatcctgcagaagggcagcggggaccccagcgccaagacagatgaggtggtgtctgaccagacagatgacatccctgggggcaacaaccccagcaccacagaggccaccgtggacctggaggatgagaaggagaggagctag

SEQ ID NO: 17707 - DNA, 2244 bp, Artificial Sequence
  Description of Artificial Sequence: Synthetic coding sequence
atggccgagctgttcatggagtgtgaggaggaggagctggagccctggcagaagaaggtgaaggaggtggaggatgatgatgatgatgagcccatctttgtgggggagatcagcagcagcaagccagccatcagcaacatcctgaacagagtgaaccccagcagctacagccggggcctgaagaatggagccctgagccggggcatcacagctgccttcaagcccaccagccagcactacaccaaccccaccagcaaccctgtgcctgccagccccatcaacttccaccctgagagccgcagcagtgacagctctgtgattgtgcagcccttcagcaagccaggctacatcaccaacagcagccgggtggtgagcaacaagagcagcgagctgctgtttgacctgacccaggacaccggcctgagccactaccagggcggccccaccctgtccatggccggcatgtctgagagcagcttcctgagcaagaggcccagcaccagcgaggtgaacaacgtgaaccccaagaagcccaagcccagcgagagcgtgtctggggccaacagcagcgctgtgctgcccagcgtgaagagccccagcgtgaccagcagccaggccatgctggccaagggcaccaacaccagcagcaaccagagcaagaatggcacccccttcccccgggcctgccccaagtgcaacatccacttcaacctgctggaccccctgaagaaccacatgaagtactgctgcccagacatgatcaacaacttcctgggcctggccaagacagagttcagcagcacagtgaacaagaacaccaccattgattctgagaagggcaagctgatcatgctggtgaatgacttctactacggcaagcatgaaggagatgtgcaggaggagcagaagacccacaccaccttcaagtgcttcagctgcctgaagatcctgaagaacaacatccgcttcatgaaccacatgaagcaccacctggagctggagaagcagagcagcgagagctgggagaaccacaccacctgccagcactgctaccggcagttccccacccccttccagctgcagtgccacatcgagagcacccacacccctcatgagttcagcaccatctgcaagatctgtgagctgagctttgaaacagagcacgtgctgctgcagcacatgaaggacaaccacaagccaggagagatgccctacgtgtgccaggtgtgcaactaccgcagcagcagcttcagtgatgtggagacccacttccgcaccagccatgagaacaccaagaacctgctgtgccccttctgcctgaaggtgatcaagatcgccaccccctacatgcaccactacatgaagcaccagaagaagggcatccaccgctgcaccaagtgccgcctgcagttcctgacctgcaaggagaagatggaccacaagacccagcaccacaggaccttcatcaagcccaagcagctggagggcctgcccccaggcaccaaggtgaccatccgggcctctgtgggccccctgcagagcggggccagccccacccccagcatcagcgccagcgccagcaccctgcagctgagcccccccaggaccaagaacatcacagccaagaacccagccaagagcaacaccagcaagcccaacacagtgaagagcaatgccagcaagcccaacaccagcaagcccaacggcagcaagagcaagtacaagcccaagatcagcaacatgcagaagaagcagagcaccctggccagcagcaacaagaagagcaaggtgaacacagccctgaggaacctgcgctacagaagaggcatccacaagtgcatcgagtgctgcagcgagatcaaggactttgccaaccacttccccacctacgtgcactgcagcttctgccgctacaacaccagctgcagcaaggcctacgtgaaccacatgatgtccttccacagcaaccggcccagcaagcgcttctgcatcttcaagaagcacagcgagaacctgcggggcatcaccctggtgtgcctgaactgtgacttcctgagtgatgtgtctggcctggacaacatggccacccacctgagccagcacaagacccacacctgccaggtggtgatgcagaaggatgctgaggccgcccagcgcttccagaagatcagccgggtgtacctggacagcgtgcccctgcgctggacccagctgatgcctgtgctgtccttccagggcatgtag

SEQ ID NO: 17708 - DNA, 243 bp, Artificial Sequence
  Description of Artificial Sequence: Synthetic coding sequence
atgggagacaaccccttccagcccaagagcaacagcaagatggccgagctgttcatggagtgtgaggaggaggagctggagccctggcagaagaaggtgaaggaggtggaggatgatgatgatgatgagcccatctttgtgggggagatcagcagcagcaagccagccatcagcaacatcctgaacagagtgaaccccagcagctacagccggggcctgaagaatggagccctgagcaggtag

SEQ ID NO: 17709 - DNA, 477 bp, Artificial Sequence
  Description of Artificial Sequence: Synthetic coding sequence
atgggagacaaccccttccagcccaagagcaacagcaagatggccgagctgttcatggagtgtgaggaggaggagctggagccctggcagaagaaggtgaaggaggtggaggatgatgatgatgatgagcccatctttgtgggggagatcagcagcagcaagccagccatcagcaacatcctgaacagagtgaaccccagcagctacagccggggcctgaagaatggagccctgagccggggcatcacagctgccttcaagcccaccagccagcactacaccaaccccaccagcaaccctgtgcctgccagccccatcaacttccaccctgagagccgcagcagtgacagcagcgtcatcgtgcagcccttcagcaagcctgtgtctgtgtccaagaccatccggcctgcccagggcagcatcggctgctgcctgagcatcagcacagtgcccagctacaacagcggcctgtcctag

SEQ ID NO: 17710 - DNA, 2901 bp, Artificial Sequence; identical to SEQ ID NO: 17706
  Description of Artificial Sequence: Synthetic coding sequence

SEQ ID NO: 17711 - DNA, 2688 bp, Artificial Sequence
  Description of Artificial Sequence: Synthetic coding sequence
atgaagattggcagcggcttcctgagcggcggcggcggcaccggcagcagcggcggcagcggcagcggcggcggcggcagcggcggcggcggcggcggcggcagcagcggccggcgggcagagatggagcccaccttcccccagggcatggtgatgttcaaccaccggctgccccctgtgaccagcttcaccaggcctgctggcagcgctgcccccccaccccagtgtgtgctgagcagcagcaccagcgctgccccagctgctgagcccccacctcctccagccccagacatgaccttcaagaaggagcctgctgccagcgctgctgccttccccagccagaggacctcctggggcttcctgcagagcctggtgtccatcaagcaggagaagccagctgaccctgaggagcagcagagccaccaccaccaccaccaccaccactatggaggcctgtttgctggagctgaggagaggagccctggcctgggcggcggggagggcggcagccatggagtcatccaggacctgagcatcctgcaccagcacgtgcagcagcagcctgcccagcaccacagagatgtgctgctgagcagcagcagcaggacagatgaccaccacggcacagaggagcccaagcaggacaccaacgtgaagaaggccaagaggcccaagccagagagccagggcatcaaggccaagaggaagcccagcgccagcagcaagcccagcctggtgggagatggagagggcgccatcctgagccccagccagaagccccacatctgtgaccactgcagcgctgccttccgcagcagctaccacctgcggagacatgtgctgatccacactggagagcggcccttccagtgcagccagtgcagcatgggcttcatccagaagtacctgctgcagagacatgagaagatccacagccgggagaagcccttcggctgtgaccagtgcagcatgaagttcatccagaagtaccacatggagcggcacaagaggacccacagcggggagaagccctacaagtgtgacacctgccagcagtacttcagcaggacagaccggctgctgaagcacaggaggacctgtggggaggtgattgtgaagggggccaccagcgctgagcccggcagcagcaaccacaccaacatgggcaacctggccgtgctgagccagggcaacaccagcagcagcaggaggaagaccaagagcaagagcatcgccatcgagaacaaggagcagaagacaggcaagaccaatgaaagccagatcagcaacaacatcaacatgcagagctacagcgtggagatgcccaccgtgagcagcagcggcggcatcattggaactggaattgatgagctgcagaagagggtgcccaagctgatcttcaagaagggcagcaggaagaacacagacaagaactacctgaactttgtgagccccctgcctgacatcgtgggccagaagagcctgagcggcaagcccagcggcagcctgggcatcgtgagcaacaacagcgtggagaccatcggcctgctgcagagcaccagcggcaagcagggccagatcagcagcaactatgatgatgccatgcagttcagcaagaagaggcgctacctgcccacagccagcagcaacagcgccttcagcatcaacgtgggccacatggtgtcccagcagagcgtcatccagagcgctggggtgtctgtgctggacaatgaggcccccctgagcctgattgacagcagcgccctgaatgctgagatcaagagctgccacgacaagagcggcatcccagatgaggtgctgcagagcatcctggaccagtacagcaacaagtctgagagccagaaggaggaccccttcaacattgctgagccccgggtggacctgcacaccagcggggagcacagcgagctggtgcaggaggagaacctgagccctggcacccagacccccagcaatgacaaggcctccatgctgcaggagtacagcaagtacctgcagcaggcctttgagaagagcaccaatgccagcttcaccctgggccacggcttccagtttgtgtccctgagcagccccctgcacaaccacaccctcttccctgagaagcagatctacaccaccagccccctggagtgtggcttcggccagagcgtgacctctgtgctgcccagcagcctgcccaagcccccatttggcatgctgtttggcagccagcccggcctgtacctgagcgccctggatgccacccaccagcagctgacccccagccaggagctggatgacctgattgacagccagaagaacctggagaccagcagcgccttccagagcagcagccagaagctgaccagccagaaggagcagaagaacctggagagcagcacaggcttccagatccccagccaggagctggccagccagattgacccccagaaggacatcgagcccaggaccacctaccagattgaaaattttgcccaggccttcggcagccagttcaagagcggcagccgggtgcccatgaccttcatcaccaacagcaatggagaggtggaccaccgggtgaggacctctgtgtctgacttcagcggctacaccaacatgatgtctgatgtgtctgagccctgcagcaccagggtgaagacccccaccagccagagctacagatag

SEQ ID NO: 17712 - DNA, 2580 bp, Artificial Sequence
  Description of Artificial Sequence: Synthetic coding sequence
atgaagattggcagcggcttcctgagcggcggcggcggcaccggcagcagcggcggcagcggcagcggcggcggcggcagcggcggcggcggcggcggcggcagcagcggccggcgggcagagatggagcccaccttcccccaggccccagctgctgagcccccacctcctccagccccagacatgaccttcaagaaggagcctgctgccagcgctgctgccttccccagccagaggacctcctggggcttcctgcagagcctggtgtccatcaagcaggagaagccagctgaccctgaggagcagcagagccaccaccaccaccaccaccaccactatggaggcctgtttgctggagctgaggagaggagccctggcctgggcggcggggagggcggcagccatggagtcatccaggacctgagcatcctgcaccagcacgtgcagcagcagcctgcccagcaccacagagatgtgctgctgagcagcagcagcaggacagatgaccaccacggcacagaggagcccaagcaggacaccaacgtgaagaaggccaagaggcccaagccagagagccagggcatcaaggccaagaggaagcccagcgccagcagcaagcccagcctggtgggagatggagagggcgccatcctgagccccagccagaagccccacatctgtgaccactgcagcgctgccttccgcagcagctaccacctgcggagacatgtgctgatccacactggagagcggcccttccagtgcagccagtgcagcatgggcttcatccagaagtacctgctgcagagacatgagaagatccacagccgggagaagcccttcggctgtgaccagtgcagcatgaagttcatccagaagtaccacatggagcggcacaagaggacccacagcggggagaagccctacaagtgtgacacctgccagcagtacttcagcaggacagaccggctgctgaagcacaggaggacctgtggggaggtgattgtgaagggggccaccagcgctgagcccggcagcagcaaccacaccaacatgggcaacctggccgtgctgagccagggcaacaccagcagcagcaggaggaagaccaagagcaagagcatcgccatcgagaacaaggagcagaagacaggcaagaccaatgaaagccagatcagcaacaacatcaacatgcagagctacagcgtggagatgcccaccgtgagcagcagcggcggcatcattggaactggaattgatgagctgcagaagagggtgcccaagctgatcttcaagaagggcagcaggaagaacacagacaagaactacctgaactttgtgagccccctgcctgacatcgtgggccagaagagcctgagcggcaagcccagcggcagcctgggcatcgtgagcaacaacagcgtggagaccatcggcctgctgcagagcaccagcggcaagcagggccagatcagcagcaactatgatgatgccatgcagttcagcaagaagaggcgctacctgcccacagccagcagcaacagcgccttcagcatcaacgtgggccacatggtgtcccagcagagcgtcatccagagcgctggggtgtctgtgctggacaatgaggcccccctgagcctgattgacagcagcgccctgaatgctgagatcaagagctgccacgacaagagcggcatcccagatgaggtgctgcagagcatcctggaccagtacagcaacaagtctgagagccagaaggaggaccccttcaacattgctgagccccgggtggacctgcacaccagcggggagcacagcgagctggtgcaggaggagaacctgagccctggcacccagacccccagcaatgacaaggcctccatgctgcaggagtacagcaagtacctgcagcaggcctttgagaagagcaccaatgccagcttcaccctgggccacggcttccagtttgtgtccctgagcagccccctgcacaaccacaccctcttccctgagaagcagatctacaccaccagccccctggagtgtggcttcggccagagcgtgacctctgtgctgcccagcagcctgcccaagcccccatttggcatgctgtttggcagccagcccggcctgtacctgagcgccctggatgccacccaccagcagctgacccccagccaggagctggatgacctgattgacagccagaagaacctggagaccagcagcgccttccagagcagcagccagaagctgaccagccagaaggagcagaagaacctggagagcagcacaggcttccagatccccagccaggagctggccagccagattgacccccagaaggacatcgagcccaggaccacctaccagattgaaaattttgcccaggccttcggcagccagttcaagagcggcagccgggtgcccatgaccttcatcaccaacagcaatggagaggtggaccaccgggtgaggacctctgtgtctgacttcagcggctacaccaacatgatgtctgatgtgtctgagccctgcagcaccagggtgaagacccccaccagccagagctacagatag

SEQ ID NO: 17713 - DNA, 2688 bp, Artificial Sequence; identical to SEQ ID NO: 17711
  Description of Artificial Sequence: Synthetic coding sequence

SEQ ID NO: 17714 - DNA, 1803 bp, Artificial Sequence
  Description of Artificial Sequence: Synthetic coding sequence
atgggcttcatccagaagtacctgctgcagagacatgagaagatccacagccgggagaagcccttcggctgtgaccagtgcagcatgaagttcatccagaagtaccacatggagcggcacaagaggacccacagcggggagaagccctacaagtgtgacacctgccagcagtacttcagcaggacagaccggctgctgaagcacaggaggacctgtggggaggtgattgtgaagggggccaccagcgctgagcccggcagcagcaaccacaccaacatgggcaacctggccgtgctgagccagggcaacaccagcagcagcaggaggaagaccaagagcaagagcatcgccatcgagaacaaggagcagaagacaggcaagaccaatgaaagccagatcagcaacaacatcaacatgcagagctacagcgtggagatgcccaccgtgagcagcagcggcggcatcatcggcaccggcattgatgagctgcagaagagggtgcccaagctgatcttcaagaagggcagcaggaagaacacagacaagaactacctgaactttgtgagccccctgcctgacatcgtgggccagaagagcctgagcggcaagcccagcggcagcctgggcatcgtgagcaacaacagcgtggagaccatcggcctgctgcagagcaccagcggcaagcagggccagatcagcagcaactatgatgatgccatgcagttcagcaagaagaggcgctacctgcccacagccagcagcaacagcgccttcagcatcaacgtgggccacatggtgtcccagcagagcgtcatccagagcgctggggtgtctgtgctggacaatgaggcccccctgagcctgattgacagcagcgccctgaatgctgagatcaagagctgccacgacaagagcggcatcccagatgaggtgctgcagagcatcctggaccagtacagcaacaagtctgagagccagaaggaggaccccttcaacattgctgagccccgggtggacctgcacaccagcggggagcacagcgagctggtgcaggaggagaacctgagccctggcacccagacccccagcaatgacaaggcctccatgctgcaggagtacagcaagtacctgcagcaggcctttgagaagagcaccaatgccagcttcaccctgggccacggcttccagtttgtgtccctgagcagccccctgcacaaccacaccctcttccctgagaagcagatctacaccaccagccccctggagtgtggcttcggccagagcgtgacctctgtgctgcccagcagcctgcccaagccacccttcggcatgctgtttggcagccagcccggcctgtacctgagcgccctggatgccacccaccagcagctgacccccagccaggagctggatgacctgattgacagccagaagaacctggagaccagcagcgccttccagagcagcagccagaagctgaccagccagaaggagcagaagaacctggagagcagcacaggcttccagatccccagccaggagctggccagccagattgacccccagaaggacatcgagcccaggaccacctaccagatcgagaactttgcccaggccttcggcagccagttcaagagcggcagccgggtgcccatgaccttcatcaccaacagcaatggagaggtggaccaccgggtgaggacctctgtgtctgacttcagcggctacaccaacatgatgtctgatgtgtctgagccctgcagcaccagggtgaagacccccaccagccagagctacagatag

SEQ ID NO: 17715 - DNA, 2016 bp, Artificial Sequence
  Description of Artificial Sequence: Synthetic coding sequence
atgcagtttgtgtccacccggccccagccccagcagctgggcatccagggcctgggcctggacagcggctcctggagctgggcccaggccctgcccccagaggaggtgtgccaccaggagcccgccctgcggggggagatggccgagggcatgccacccatgcaggcccaggagtgggacatggatgcccggcggcccatgcccttccagttcccccccttcccagaccgggcccctgtgtttcctgacaggatgatgagggagccccagctgcccacagctgagatcagcctgtggacagtggtggccgccatccaggccgtggagaggaaggtggatgcccaggccagccagctgctgaacctggagggccgcactggaacagctgagaagaagctggccgactgtgagaagacagctgtggagtttggaaaccacatggagagcaagtgggccgtgctgggcaccctgctgcaggagtatggcctgctgcagaggcggctggagaacctggagaacctgctgaggaacagaaacttctgggtgctgcggctgcccccaggcagcaagggggaggcccccaaggtgcctgtgacctttgtggacattgctgtgtacttctctgaagatgagtggaagaacctggatgagtggcagaaggagctgtacaacaacctggtgaaggagaactacaagaccctgatgagcctggatgctgagggctctgtgcccaagccagatgcccctgtgcaggccgagccccgggaggagccctgtgtgtgggagcagaggcaccctgaggagcgggagatccccatggaccctgaggccggggctgagcccctggtgcctgcccaggatgccagcagccaggtgaagcgggaggacaccctgtgtgtgcggggccagaggggcctggaggagcgggccatccccacagagagcatcacagacagccccatcagcgcccaggacctgctgagccgcatcaagcaggaggagcaccagtgtgtgtgggaccagcaggacctggccgaccgggacatccccacagaccccaacagcgagagcctcatcagcgcccatgacatcctgtcctggatcaagcaggaggagcagccctacccctggggcccccgggacagcatggatggagagctgggcctggacagcggccccagcgacagcctgctgatggtgaagaaccccccaccagccccaccccagccccagccccagccccagcccccccagccccagctgcagagccagccccagccccagagcctgccccccatcgctgtggctgaaaatcctgggggcccccccagccggggcctgctggatgatggcttccaggtgctgcccggggagcggggcagcggggaggcccctcctggaggagacaggagcactggaggcggcggcggagatggcggcggcggcggcggcggcgctgaggccggcaccggggccggcggcggctgcggcagctgctgccctgggggcctgcggcgcagcctgctgctgcatggagcccggagcaagccctacagctgcccagaatgtgggaagagctttggagtgaggaagagcctcatcatccaccacaggagccacaccaaggagcggccctatgaatgtgccgagtgtgagaagagcttcaactgccacagcggcctcatccgccaccagatgacccacagaggagagcggccctacaagtgcagtgaatgtgagaagacctacagcaggaaggagcacctgcagaaccaccagaggctgcacactggagagcggcccttccagtgtgccctgtgtgggaagagcttcatcaggaagcagaacctgctgaagcaccagaggatccacactggagagcggccctacacctgtggggagtgtgggaagagcttccgctacaaggagagcctgaaggaccacctgcgggtgcacagcggcggccctggccctggggccccccggcagctgcccccacctcctgagcgggactag

SEQ ID NO: 17716 - DNA, 975 bp, Artificial Sequence
  Description of Artificial Sequence: Synthetic coding sequence
atgagggagccccagctgcccacagctgagatcagcctgtggacagtggtggccgccatccaggccgtggagaggaaggtggatgcccaggccagccagctgctgaacctggagggccgcactggaacagctgagaagaagctggccgactgtgagaagacagctgtggagtttggaaaccacatggagagcaagtgggccgtgctgggcaccctgctgcaggagtatggcctgctgcagaggcggctggagaacctggagaacctgctgaggaacagaaacttctgggtgctgcggctgcccccaggcagcaaaggagaggcccccaaggtgcctgtgacctttgtggacattgctgtgtacttctctgaagatgagtggaagaacctggatgagtggcagaaggagctgtacaacaacctggtgaaggagaactacaagaccctgatgagcctggatgctgagggctctgtgcccaagccagatgcccctgtgcaggccgagcccagctacagctgcccagaatgtgggaagagctttggagtgaggaagagcctcatcatccaccacaggagccacaccaaggagcggccctatgaatgtgctgaatgtgagaagagcttcaactgccacagcggcctcatccgccaccagatgacccacagaggagagcggccctacaagtgcagtgaatgtgagaagacctacagcaggaaggagcacctgcagaaccaccagaggctgcacactggagagcggcccttccagtgtgccctgtgtgggaagagcttcatcaggaagcagaacctgctgaagcaccagaggatccacactggagagcggccctacacctgtggagaatgtgggaagagcttccgctacaaggagagcctgaaggaccacctgcgggtgcacagcggcggccctggccctggggccccccggcagctgcccccacctcctgagcgggactag

SEQ ID NO: 17717 - DNA, 1392 bp, Artificial Sequence
  Description of Artificial Sequence: Synthetic coding sequence
atgcagtttgtgtccacccggccccagccccagcagctgggcatccagggcctgggcctggacagcggctcctggagctgggcccaggccctgcccccagaggaggtgtgccaccaggagcccgccctgcggggggagatggccgagggcatgccacccatgcaggcccaggagtgggacatggatgcccggcggcccatgcccttccagttcccccccttcccagaccgggcccctgtgtttcctgacaggatgatgagggagccccagctgcccacagctgagatcagcctgtggacagtggtggccgccatccaggccgtggagaggaaggtggatgcccaggccagccagctgctgaacctggagggccgcactggaacagctgagaagaagctggccgactgtgagaagacagctgtggagtttggaaaccacatggagagcaagtgggccgtgctgggcaccctgctgcaggagtatggcctgctgcagaggcggctggagaacctggagaacctgctgaggaacagaaacttctgggtgctgcggctgcccccaggcagcaagggggaggcccccaaggtgcctgtgacctttgtggacattgctgtgtacttctctgaagatgagtggaagaacctggatgagtggcagaaggagctgtacaacaacctggtgaaggagaactacaagaccctgatgagcctggatgctgagggctctgtgcccaagccagatgcccctgtgcaggccgagccccgggaggagccctgtgtgtgggagcagaggcaccctgaggagcgggagatccccatggaccctgaggccggggctgagcccctggtgcctgcccaggatgccagcagccaggtgaagcgggaggacaccctgtgtgtgcggggccagaggggcctggaggagcgggccatccccacagagagcatcacagacagccccatcagcgcccaggacctgctgagccgcatcaagcaggaggagcaccagtgtgtgtgggaccagcaggacctggccgaccgggacatccccacagaccccaacagcgagagcctcatcagcgcccatgacatcctgtcctggatcaagcaggaggagcagccctacccctggggcccccgggacagcatggatggagagctgggcctggacagcggccccagcgacagcctgctgatggtgaagaaccccccaccagccccaccccagccccagccccagccccagcccccccagccccagctgcagagccagccccagccccagagcctgccccccatcgctgtggctgaaaatcctgggggcccccccagccggggcctgctggatgatggcttccagccccaccagggcgccgccctgcgggtgaggtag

SEQ ID NO: 17718 - DNA, 252 bp, Artificial Sequence
  Description of Artificial Sequence: Synthetic coding sequence
atgtttgagagctgcagcggcttcagcggcttctgtgccagccccatcgaggagagccacggggccctgatcagcagctgcaacagcaggaccatgacagatggcctggtgaccttcagagatgtggccatcgacttcagccaggaggagtgggagtgcctggaccctgcccagagggacctgtatgtggatgtgatgctggagaactacagcaacctggtgtccctgggcaaggtgatctgcctgaagtag

SEQ ID NO: 17719 - DNA, 2040 bp, Artificial Sequence
  Description of Artificial Sequence: Synthetic coding sequence
atggagagccgctctgtggcccaggccggcgtgcagtggtgtgacctgggcagcctgcaggcccctcctcctggcttcaccctcttcagctgcctgagcctgctgagctcctgggactacagcagcggcttcagcggcttctgtgccagccccatcgaggagagccacggggccctgatcagcagctgcaacagcaggaccatgacagatggcctggtgaccttcagagatgtggccatcgacttcagccaggaggagtgggagtgcctggaccctgcccagagggacctgtatgtggatgtgatgctggagaactacagcaacctggtgtccctggacctggagagcaagacctatgagaccaagaagatcttctctgaaaatgacatctttgagatcaacttcagccagtgggagatgaaggacaagagcaagaccctgggcctggaggccagcatcttcaggaacaactggaagtgcaagagcatctttgagggcctgaagggccaccaggagggctacttcagccagatgatcatctcctatgagaagatccccagctacaggaagagcaagagcctgaccccccaccagaggatccacaacacagagaagagctatgtgtgcaaggaatgtgggaaggcctgcagccacggcagcaagctggtgcagcacgagaggacccacacagctgagaagcactttgagtgcaaggaatgtgggaagaactacctgagcgcctaccagctgaatgtgcaccagcgcttccacactggagagaagccctatgagtgcaaggaatgtgggaagaccttctcctggggcagcagcctggtgaagcatgagcgcatccacactggagagaagccctatgagtgcaaggaatgtgggaaggccttcagccggggctaccacctgacccagcaccagaagatccacactggagtgaagagctacaagtgcaaggaatgtgggaaggccttcttctggggcagcagcctggccaagcatgagatcatccacactggagagaagccctacaagtgcaaggaatgtgggaaggccttcagccggggctaccagctgacccagcaccagaagatccacacaggcaagaagccctatgagtgcaagatctgtgggaaggccttctgctggggctaccagctgaccaggcaccagatcttccacactggagagaagccctatgagtgcaaggaatgtgggaaggccttcaactgtggcagcagcctcatccagcacgagcgcatccacactggagagaagccctatgagtgcaaggaatgtgggaaggccttcagccggggctaccacctgagccagcaccagaagatccacactggagagaagccctttgagtgcaaggaatgtgggaaggccttctcctggggcagcagcctggtgaagcatgagcgggtgcacactggagagaagagccatgagtgcaaggaatgtgggaagaccttctgcagcggctaccagctgaccaggcaccaggtgttccacactggagagaagccctatgagtgcaaggaatgtgggaaggccttcaactgtggcagcagcctggtgcagcacgagcgcatccacactggagagaagccctatgagtgcaaggaatgtgggaaggccttcagccggggctaccacctgacccagcaccagaagatccacactggagagaagcccttcaagtgcaaggaatgtgggaaggccttctcctggggcagcagcctggtgaagcatgagcgggtgcacaccaatgagaagagctatgagtgcaaggactgtgggaaggccttcggcagcggctaccagctgtctgtgcaccagcgcttccacactggagagaagctgtaccagaggaaggagtttgggaagaccttcacctgtggcagcaagctggtgcatgagaggacccacagcaatgacaagccctacaagtacaatgaatgtggggaggccttcctgtggaccacctacagcaatgagaagattgacacagatgagaccctgtag

SEQ ID NO: 17720 - DNA, 1782 bp, Artificial Sequence
  Description of Artificial Sequence: Synthetic coding sequence
atgaccatgttcaaggaggccgtgaccttcaaggatgtggccgtggtgttcacagaggaggagctgggcctgctggatgtgtcccagaggaagctgtacagagatgtgatgctggagaacttcaggaacctgctgtctgtgggccaccagctgagccaccgggacaccttccacttccagcgggaggagaagttctggatcatggagacagccacccagcgggagggcaacagcggcggcaagatccagacagagctggagagcgtgcctgagaccggcccccatgaggagtggagctgccagcagatctgggagcagacagccagcgagctgacccggccccaggacagcatcagcagcagccagttcagcacccagggagatgtgcccagccaggtggatgctggcctgagcatcatccacatcggggagaccccatctgaacatggcaagtgcaagaagttcttcagtgatgtgtccatcctggacctgcaccagcagctgcacagcggcaagatcagccacacctgcaatgagtacaggaagcgcttctgctacagcagcgccctgtgcctgcaccagaaggtgcacatgggagagaagcgctacaagtgtgatgtgtgcagcaaggccttcagccagaacagccagctgcagacccaccagaggatccacactggagagaagcccttcaagtgtgagcagtgtgggaagagcttcagccgccgcagcggcatgtatgtgcactgcaagctgcacactggagagaagccccacatctgtgaagaatgtgggaaggccttcatccacaacagccagctgcgggagcaccagaggatccacactggagagaagcccttcaagtgctacatctgtgggaagagcttccacagccgcagcaacctgaacagacacagcatggtgcacatgcaggagaagagcttccgctgtgacacctgcagcaacagctttggccagaggtctgccctgaacagccactgcatggaccacaccaaggagaagctgtacaagtgtgaagaatgtggccgctccttcacctgccggcaggacctgtgcaagcaccagatggaccacactggagacaagccctacaactgcaatgtgtgtgggaagggcttccgctggagcagctgcctgagccgccaccagagggtgcacaacggggagaccaccttcaagtgtgatggctgtgggaagcgcttctacatgaacagccagggccacagccaccagagggcctaccgggaggaggagctgtacaagtgccagaagtgtgggaagggctacatcagcaagttcaacctggacctgcaccagagggtgcacactggagagcggccctacaactgcaaggaatgtgggaagagcttccgctgggccagcggcatcctgcggcacaagaggctgcacactggagagaagcccttcaagtgtgaagaatgtgggaagcgcttcacagagaacagcaagctgcgcttccaccagaggatccacactggagagaagccctacaagtgtgaagaatgtgggaagggcttccgctgggccagcacccacctgacccaccagaggctgcacagccgggagaagctgttccagtgtgaggactgtgggaagagcagcgagcacagcagctgcctgcaggaccagcagagcgaccacagcggggagaagaccagcaaatgtgaggactgtgggaagagatatgaaagaaggctgaacctggacatgatcctgagcctcttcctgaatgacatctag

SEQ ID NO: 17721 - DNA, 2739 bp, Artificial Sequence
  Description of Artificial Sequence: Synthetic coding sequence
atgatcaagttccagatggtgaccttcaaggatgtggccgtggtgttcacagaggaggagctgggcctgctggacagcgtgcagaggaagctgtacagagatgtgatgctggagaacttcaggaacctgctgctggtggcccaccagcccttcaagccagacctgatcagccagctggagcgggaggagaagctgctgatggtggagacagagaccccaagagatggctgcagcggcaggaagaaccagcagaagatggagagcatccaggaggtgacagtgtcctacttcagccccaaggagctgagcagccggcagacctggcagcagagcgctgggggcctcatccgctgccaggacttcctgaaggtgttccagggcaagaacagccagctgcaggagcagggcaacagcctgggccaggtgtgggccggcatccctgtgcagatcagcgaggacaagaactacatcttcacccacatcggaaatggcagcaactacatcaagagccagggctaccccagctggagggcccaccacagctggaggaagatgtacctgaaggagagccacaactaccagtgccgctgccagcagatctccatgaagaaccacttctgcaagtgtgacagcgtgtcctggctgagccaccacaatgacaagctggaggtgcacaggaaggagaactacagctgccacgactgtggggaggacatcatgaaggtgtccctgctgaaccaggagagcatccagacagaggagaagccctacccctgcaccggctacaggaaggccttcagcaatgacagcagcagcgaggtgcaccagcagttccacctggagggcaagccctacacctacagcagctgtgggaagggctgcaactacagcagcctgctgcacatccaccagaacatcgagagagaagatgacatcgagaacagccacctgaagagctaccagagggtgcacacagaggagaagccctgcaagtgtggggagtatggagagaacttcaaccactgcagccccctgaacacctatgagctgatccacactggagagatgagctaccgccacaacatctatgagaaggccttcagccacagcctggacctgaacagcatcttccgggtgcacaccagagatgagccccatgaatatgaggagaatgaaaatgtgttcaaccagagcagctgcctgcaggtgcaccagaagatccacacagaggagaagctgtacacagacattgaatatggcaagagcttcatctgcagcagcaacctggacatccagcaccgggtgcacatggaggagaacagctacaacagcgaggagtgtggaaatggcttcagcctggccagccacttccaggacctgcagatcgtgcacaccaaggagcagccctacaagagatatgtgtgcagcaacagcttcagccacaacctgtacctgcagggccaccccaagatccacatcggggagaagcccaggaaggagcacggcaatggcttcaactggagcagcaagctgaaggaccaccagagggtgcacacaggccagaagccctacaagtgcaacatctgtgggaagggcttcaaccacaggtctgtgctgaatgtgcaccagagggtgcacactggagagaagccctacaagtgtgaggagtgtgacaagggcttcagccgcagcagctacctgcaggcccaccagagggtgcacactggagagaagccctacaagtgtgaggagtgtgggaagggcttcagcagaaattcctacctgcagggccaccagagggtgcacactggagagaagccctacaagtgtgaggagtgtgggaagggcttcagccgcagcagccacctgcagggccaccagagggtgcacactggagagaagcccttcaagtgtgaggagtgtgggaagggcttctcctggagcttcaacctgcagatccaccagagggtgcacactggagagaagccctacaagtgtgaggagtgtgggaagggcttcagcaaggccagcaccctgctggcccaccagagggtgcacactggagagaagccctaccagtgtgatgaatgtgggaagagcttcagccagaggagctacctgcagagccaccagagcgtgcacagcggggagcggccctacatctgtgaggtgtgtgggaagggcttcagccagagggcctacctgcagggccaccagagggtgcacaccagggtgaagccctacaagtgtgagatgtgtgggaagggcttcagccagagcagccggctggaggcccacagaagagtgcacactggaggcaagccctacaagtgtgaggtgtgcaccaagggcttcagcgagagcagccggctgcaggcccaccagagggtgcacgtggagggccggccctacaagtgtgagcagtgtgggaagggcttcagcggctacagcagcctgcaggcccaccaccgggtgcacactggagagaagccctacaagtgtgaggtgtgtgggaagggcttcagccagaggagcaacctgcaggcccaccagagggtgcacactggagagaagccctacaagtgtgatgcctgtgggaagggcttccgctggagcagcggcctgctgatccaccagagggtgcacagcagtgacaagttctacaagtcagaagattatggcaaggactaccccagcagcgagaacctgcacagaaatgaagattctgtgctcttctag

SEQ ID NO: 17722 - DNA, 1773 bp, Artificial Sequence
  Description of Artificial Sequence: Synthetic coding sequence
atgatcaagttccaggagcgggtgaccttcaaggatgtggccgtggtgttcaccaaggaggagctggccctgctggacaaggcccagatcaacctgtaccaggatgtgatgctggagaacttcaggaacctgatgctggtgagagatggcatcaagaacaacatcctgaacctgcaggccaagggcctgagctacctgagccaggaggtgctgcactgctggcagatctggaagcagaggatccgggacctgactgtgtcccaggactacatcgtgaacctgcaggaggagtgcagcccccacctggaggatgtgtccctgtctgaggagtgggccggcatcagcctgcagatcagtgaaaatgaaaactacgtggtgaatgccatcatcaagaaccaggacatcacagcctggcagagcctgacccaggtgctgaccccagagagctggaggaaggccaacatcatgacagagccccagaacagccagggccgctacaagggcatctacatggaggagaagctgtacagaagagcccagcatgatgacagcctgtcctggaccagctgtgaccaccacgagagccaggagtgcaagggagaagatcctggccgccaccccaactgtgggaagaacctgggcatgaagagcacagtggagaagagaaatgctgcccacgtgctgccccagcccttcccctgcaacaactgtggggtggcctttgctgatgacacagacccccacgtgcaccacagcacccacctgggggagaagagctacaagtgtgaccagtatggcaagaacttcagccagagccaggacctgattgtgcactgcaagacccacagcggcaagaccccctatgagttccacgagtggcccatgggctgcaagcagagcagtgacctgccccgctaccagaaggtgtcctctggggacaagccctacaagtgcaaggaatgtgggaagggcttccgccgcagcagcagcctgcacaaccaccaccgggtgcacactggagagatgccctacaagtgtgatgaatgtgggaaaggatttggcttccgcagcctgctgtgcatccaccagggcgtgcacacaggcaagaagccctacaagtgtgaggagtgtgggaaaggatttgaccagagcagcaacctgctggtgcaccagagggtgcacactggagagaagccctacaagtgcagtgaatgtgggaagtgcttcagcagcagctctgtgctgcaggtgcactggaggttccacactggagagaagccctaccgctgtggggagtgtgggaagggcttcagccagtgcacccacctgcacatccaccagagggtgcacactggagagaagccctacaagtgcaatgtgtgtgggaaggactttgcctacagctctgtgctgcacacccaccagagggtgcacactggagagaagccctacaagtgtgaggtgtgtgggaagtgcttctcctacagcagctacttccacctgcaccagagggaccacatccgggagaagccctacaagtgtgatgaatgtgggaagggcttcagcaggaacagcgacctgaatgtgcacctgcgggtgcacacccgggagcggccctacaagtgcaaggcctgtgggaagggcttcagcagaaattcctacctgctggcccaccagagggtgcacattgatgagacccagtacacccactgtgagcggggcaaggacctgctgacccaccagaggctgcacgagcagcgggagaccctgtag

SEQ ID NO: 17723 - DNA, 2742 bp, Artificial Sequence
  Description of Artificial Sequence: Synthetic coding sequence
atgaccaagttccaggagatggtgaccttcaaggatgtggccgtggtgttcacagaggaggagctgggcctgctggacagcgtgcagaggaagctgtacagagatgtgatgctggagaacttcaggaacctgctgctggtggcccaccagcccttcaagccagacctgatcagccagctggagcgggaggagaagctgctgatggtggagacagagaccccaagagatggctgcagcggcaggaagaaccagcagaagatggagagcatccaggaggtgacagtgtcctacttcagccccaaggagctgagcagccggcagacctggcagcagagcgctgggggcctcatccgctgccaggacttcctgaaggtgttccagggcaagaacagccagctgcaggagcagggcaacagcctgggccaggtgtgggccggcatccctgtgcagatcagcgaggacaagaactacatcttcacccacatcggaaatggcagcaactacatcaagagccagggctaccccagctggagggcccaccacagctggaggaagatgtacctgaaggagagccacaactaccagtgccgctgccagcagatctccatgaagaaccacttctgcaagtgtgacagcgtgtcctggctgagccaccacaatgacaagctggaggtgcacaggaaagaaaactacagctgccacgactgtggggaggacatcatgaaggtgtccctgctgaaccaggagagcatccagacagaggagaagccctacccctgcaccggctacaggaaggccttcagcaatgacagcagcagcgaggtgcaccagcagttccacctggagggcaagccctacacctacagcagctgtgggaagggctgcaactacagcagcctgctgcacatccaccagaacatcgagcgggaggatgacatcgagaacagccacctgaagagctaccagagggtgcacacagaggagaagccctgcaagtgtggggagtatggagagaacttcaaccactgcagccccctgaacacctatgagctgatccacactggagagatgagctaccgccacaacatctatgagaaggccttcagccacagcctggacctgaacagcatcttccgggtgcacaccagagatgagccccatgaatatgaagaaaatgaaaatgtgttcaaccagagcagctgcctgcaggtgcaccagaagatccacacagaggagaagctgtacacagacatcgagtatggcaagagcttcatctgcagcagcaacctggacatccagcaccgggtgcacatggaggagaacagctacaacagtgaagaatgtggaaatggcttcagcctggccagccacttccaggacctgcagatcgtgcacaccaaggagcagccctacaagcgctacgtgtgcagcaacagcttcagccacaacctgtacctgcagggccaccccaagatccacatcggggagaagcccaggaaggagcacggcaatggcttcaactggagcagcaagctgaaggaccaccagagggtgcacacaggccagaagccctacaagtgcaacatctgtgggaagggcttcaaccacaggtctgtgctgaatgtgcaccagagggtgcacactggagagaagccctacaagtgtgaagaatgtgacaagggcttcagccgcagcagctacctgcaggcccaccagagggtgcacactggagagaagccctacaagtgtgaagaatgtgggaagggcttcagcaggaacagctacctgcagggccaccagagggtgcacactggagagaagccctacaagtgtgaagaatgtgggaagggcttcagccgcagcagccacctgcagggccaccagagggtgcacactggagagaagcccttcaagtgtgaagaatgtgggaagggcttctcctggagcttcaacctgcagatccaccagagggtgcacactggagagaagccctacaagtgtgaagaatgtgggaagggcttcagcaaggccagcaccctgctggcccaccagagggtgcacactggagagaagccctaccagtgtgatgaatgtgggaagagcttcagccagaggagctacctgcagagccaccagagcgtgcacagcggggagcggccctacatctgtgaggtgtgtgggaagggcttcagccagagggcctacctgcagggccaccagagggtgcacaccagggtgaagccctacaagtgtgagatgtgtgggaagggcttcagccagagcagccggctggaggcccaccggcgggtgcacactggaggcaagccctacaagtgtgaggtgtgcaccaagggcttcagcgagagcagccggctgcaggcccaccagagggtgcacgtggagggccggccctacaagtgtgagcagtgtgggaagggcttcagcggctacagcagcctgcaggcccaccaccgggtgcacactggagagaagccctacaagtgtgaggtgtgtgggaagggcttcagccagaggagcaacctgcaggcccaccagagggtgcacactggagagaagccctacaagtgtgatgcctgtgggaagggcttccgctggagcagcggcctgctgatccaccagagggtgcacagcagtgacaagttctacaagtctgaggactatggcaaggactaccccagcagcgagaacctgcacagaaatgaagacagcgtgctcttctag

SEQ ID NO: 17724 - DNA, 2724 bp, Artificial Sequence
  Description of Artificial Sequence: Synthetic coding sequence
atggtgaccttcaaggatgtggccgtggtgttcacagaggaggagctgggcctgctggacagcgtgcagaggaagctgtacagagatgtgatgctggagaacttcaggaacctgctgctggtggcccaccagcccttcaagccagacctgatcagccagctggagcgggaggagaagctgctgatggtggagacagagaccccaagagatggctgcagcggcaggaagaaccagcagaagatggagagcatccaggaggtgacagtgtcctacttcagccccaaggagctgagcagccggcagacctggcagcagagcgctgggggcctcatccgctgccaggacttcctgaaggtgttccagggcaagaacagccagctgcaggagcagggcaacagcctgggccaggtgtgggccggcatccctgtgcagatcagcgaggacaagaactacatcttcacccacatcggaaatggcagcaactacatcaagagccagggctaccccagctggagggcccaccacagctggaggaagatgtacctgaaggagagccacaactaccagtgccgctgccagcagatctccatgaagaaccacttctgcaagtgtgacagcgtgtcctggctgagccaccacaatgacaagctggaggtgcacaggaaagaaaactacagctgccacgactgtggggaggacatcatgaaggtgtccctgctgaaccaggagagcatccagacagaggagaagccctacccctgcaccggctacaggaaggccttcagcaatgacagcagcagcgaggtgcaccagcagttccacctggagggcaagccctacacctacagcagctgtgggaagggctgcaactacagcagcctgctgcacatccaccagaacatcgagcgggaggatgacatcgagaacagccacctgaagagctaccagagggtgcacacagaggagaagccctgcaagtgtggggagtatggagagaacttcaaccactgcagccccctgaacacctatgagctgatccacactggagagatgagctaccgccacaacatctatgagaaggccttcagccacagcctggacctgaacagcatcttccgggtgcacaccagagatgagccccatgaatatgaagaaaatgaaaatgtgttcaaccagagcagctgcctgcaggtgcaccagaagatccacacagaggagaagctgtacacagacatcgagtatggcaagagcttcatctgcagcagcaacctggacatccagcaccgggtgcacatggaggagaacagctacaacagtgaagaatgtggaaatggcttcagcctggccagccacttccaggacctgcagatcgtgcacaccaaggagcagccctacaagcgctacgtgtgcagcaacagcttcagccacaacctgtacctgcagggccaccccaagatccacatcggggagaagcccaggaaggagcacggcaatggcttcaactggagcagcaagctgaaggaccaccagagggtgcacacaggccagaagccctacaagtgcaacatctgtgggaagggcttcaaccacaggtctgtgctgaatgtgcaccagagggtgcacactggagagaagccctacaagtgtgaagaatgtgacaagggcttcagccgcagcagctacctgcaggcccaccagagggtgcacactggagagaagccctacaagtgtgaagaatgtgggaagggcttcagcaggaacagctacctgcagggccaccagagggtgcacactggagagaagccctacaagtgtgaagaatgtgggaagggcttcagccgcagcagccacctgcagggccaccagagggtgcacactggagagaagcccttcaagtgtgaagaatgtgggaagggcttctcctggagcttcaacctgcagatccaccagagggtgcacactggagagaagccctacaagtgtgaagaatgtgggaagggcttcagcaaggccagcaccctgctggcccaccagagggtgcacactggagagaagccctaccagtgtgatgaatgtgggaagagcttcagccagaggagctacctgcagagccaccagagcgtgcacagcggggagcggccctacatctgtgaggtgtgtgggaagggcttcagccagagggcctacctgcagggccaccagagggtgcacaccagggtgaagccctacaagtgtgagatgtgtgggaagggcttcagccagagcagccggctggaggcccaccggcgggtgcacactggaggcaagccctacaagtgtgaggtgtgcaccaagggcttcagcgagagcagccggctgcaggcccaccagagggtgcacgtggagggccggccctacaagtgtgagcagtgtgggaagggcttcagcggctacagcagcctgcaggcccaccaccgggtgcacactggagagaagccctacaagtgtgaggtgtgtgggaagggcttcagccagaggagcaacctgcaggcccaccagagggtgcacactggagagaagccctacaagtgtgatgcctgtgggaagggcttccgctggagcagcggcctgctgatccaccagagggtgcacagcagtgacaagttctacaagtctgaggactatggcaaggactaccccagcagcgagaacctgcacagaaatgaagacagcgtgctcttctag

SEQ ID NO: 17725 - DNA, 2742 bp, Artificial Sequence
  Description of Artificial Sequence: Synthetic coding sequence
ctgactgtgtgccaggagatggtgaccttcaaggatgtggccgtggtgttcacagaggaggagctgggcctgctggacagcgtgcagaggaagctgtacagagatgtgatgctggagaacttcaggaacctgctgctggtggcccaccagcccttcaagccagacctgatcagccagctggagcgggaggagaagctgctgatggtggagacagagaccccaagagatggctgcagcggcaggaagaaccagcagaagatggagagcatccaggaggtgacagtgtcctacttcagccccaaggagctgagcagccggcagacctggcagcagagcgctgggggcctcatccgctgccaggacttcctgaaggtgttccagggcaagaacagccagctgcaggagcagggcaacagcctgggccaggtgtgggccggcatccctgtgcagatcagcgaggacaagaactacatcttcacccacatcggaaatggcagcaactacatcaagagccagggctaccccagctggagggcccaccacagctggaggaagatgtacctgaaggagagccacaactaccagtgccgctgccagcagatctccatgaagaaccacttctgcaagtgtgacagcgtgtcctggctgagccaccacaatgacaagctggaggtgcacaggaaagaaaactacagctgccacgactgtggggaggacatcatgaaggtgtccctgctgaaccaggagagcatccagacagaggagaagccctacccctgcaccggctacaggaaggccttcagcaatgacagcagcagcgaggtgcaccagcagttccacctggagggcaagccctacacctacagcagctgtgggaagggctgcaactacagcagcctgctgcacatccaccagaacatcgagcgggaggatgacatcgagaacagccacctgaagagctaccagagggtgcacacagaggagaagccctgcaagtgtggggagtatggagagaacttcaaccactgcagccccctgaacacctatgagctgatccacactggagagatgagctaccgccacaacatctatgagaaggccttcagccacagcctggacctgaacagcatcttccgggtgcacaccagagatgagccccatgaatatgaagaaaatgaaaatgtgttcaaccagagcagctgcctgcaggtgcaccagaagatccacacagaggagaagctgtacacagacatcgagtatggcaagagcttcatctgcagcagcaacctggacatccagcaccgggtgcacatggaggagaacagctacaacagtgaagaatgtggaaatggcttcagcctggccagccacttccaggacctgcagatcgtgcacaccaaggagcagccctacaagcgctacgtgtgcagcaacagcttcagccacaacctgtacctgcagggccaccccaagatccacatcggggagaagcccaggaaggagcacggcaatggcttcaactggagcagcaagctgaaggaccaccagagggtgcacacaggccagaagccctacaagtgcaacatctgtgggaagggcttcaaccacaggtctgtgctgaatgtgcaccagagggtgcacactggagagaagccctacaagtgtgaagaatgtgacaagggcttcagccgcagcagctacctgcaggcccaccagagggtgcacactggagagaagccctacaagtgtgaagaatgtgggaagggcttcagcaggaacagctacctgcagggccaccagagggtgcacactggagagaagccctacaagtgtgaagaatgtgggaagggcttcagccgcagcagccacctgcagggccaccagagggtgcacactggagagaagcccttcaagtgtgaagaatgtgggaagggcttctcctggagcttcaacctgcagatccaccagagggtgcacactggagagaagccctacaagtgtgaagaatgtgggaagggcttcagcaaggccagcaccctgctggcccaccagagggtgcacactggagagaagccctaccagtgtgatgaatgtgggaagagcttcagccagaggagctacctgcagagccaccagagcgtgcacagcggggagcggccctacatctgtgaggtgtgtgggaagggcttcagccagagggcctacctgcagggccaccagagggtgcacaccagggtgaagccctacaagtgtgagatgtgtgggaagggcttcagccagagcagccggctggaggcccaccggcgggtgcacactggaggcaagccctacaagtgtgaggtgtgcaccaagggcttcagcgagagcagccggctgcaggcccaccagagggtgcacgtggagggccggccctacaagtgtgagcagtgtgggaagggcttcagcggctacagcagcctgcaggcccaccaccgggtgcacactggagagaagccctacaagtgtgaggtgtgtgggaagggcttcagccagaggagcaacctgcaggcccaccagagggtgcacactggagagaagccctacaagtgtgatgcctgtgggaagggcttccgctggagcagcggcctgctgatccaccagagggtgcacagcagtgacaagttctacaagtctgaggactatggcaaggactaccccagcagcgagaacctgcacagaaatgaagacagcgtgctcttctag

SEQ ID NO: 17726 - DNA, 2793 bp, Artificial Sequence
  Description of Artificial Sequence: Synthetic coding sequence
atgggcctgggccccaggagcctgcccttcagcaggaagaggaagaggaagatgaccaagttccaggagatggtgaccttcaaggatgtggccgtggtgttcacagaggaggagctgggcctgctggacagcgtgcagaggaagctgtacagagatgtgatgctggagaacttcaggaacctgctgctggtggcccaccagcccttcaagccagacctgatcagccagctggagcgggaggagaagctgctgatggtggagacagagaccccaagagatggctgcagcggcaggaagaaccagcagaagatggagagcatccaggaggtgacagtgtcctacttcagccccaaggagctgagcagccggcagacctggcagcagagcgctgggggcctcatccgctgccaggacttcctgaaggtgttccagggcaagaacagccagctgcaggagcagggcaacagcctgggccaggtgtgggccggcatccctgtgcagatcagcgaggacaagaactacatcttcacccacatcggaaatggcagcaactacatcaagagccagggctaccccagctggagggcccaccacagctggaggaagatgtacctgaaggagagccacaactaccagtgccgctgccagcagatctccatgaagaaccacttctgcaagtgtgacagcgtgtcctggctgagccaccacaatgacaagctggaggtgcacaggaaggagaactacagctgccacgactgtggggaggacatcatgaaggtgtccctgctgaaccaggagagcatccagacagaggagaagccctacccctgcaccggctacaggaaggccttcagcaatgacagcagcagcgaggtgcaccagcagttccacctggagggcaagccctacacctacagcagctgtgggaagggctgcaactacagcagcctgctgcacatccaccagaacatcgagagagaagatgacatcgagaacagccacctgaagagctaccagagggtgcacacagaggagaagccctgcaagtgtggggagtatggagagaacttcaaccactgcagccccctgaacacctatgagctgatccacactggagagatgagctaccgccacaacatctatgagaaggccttcagccacagcctggacctgaacagcatcttccgggtgcacaccagagatgagccccatgaatatgaggagaatgaaaatgtgttcaaccagagcagctgcctgcaggtgcaccagaagatccacacagaggagaagctgtacacagacattgaatatggcaagagcttcatctgcagcagcaacctggacatccagcaccgggtgcacatggaggagaacagctacaacagcgaggagtgtggaaatggcttcagcctggccagccacttccaggacctgcagatcgtgcacaccaaggagcagccctacaagagatatgtgtgcagcaacagcttcagccacaacctgtacctgcagggccaccccaagatccacatcggggagaagcccaggaaggagcacggcaatggcttcaactggagcagcaagctgaaggaccaccagagggtgcacacaggccagaagccctacaagtgcaacatctgtgggaagggcttcaaccacaggtctgtgctgaatgtgcaccagagggtgcacactggagagaagccctacaagtgtgaggagtgtgacaagggcttcagccgcagcagctacctgcaggcccaccagagggtgcacactggagagaagccctacaagtgtgaggagtgtgggaagggcttcagcagaaattcctacctgcagggccaccagagggtgcacactggagagaagccctacaagtgtgaggagtgtgggaagggcttcagccgcagcagccacctgcagggccaccagagggtgcacactggagagaagcccttcaagtgtgaggagtgtgggaagggcttctcctggagcttcaacctgcagatccaccagagggtgcacactggagagaagccctacaagtgtgaggagtgtgggaagggcttcagcaaggccagcaccctgctggcccaccagagggtgcacactggagagaagccctaccagtgtgatgaatgtgggaagagcttcagccagaggagctacctgcagagccaccagagcgtgcacagcggggagcggccctacatctgtgaggtgtgtgggaagggcttcagccagagggcctacctgcagggccaccagagggtgcacaccagggtgaagccctacaagtgtgagatgtgtgggaagggcttcagccagagcagccggctggaggcccacagaagagtgcacactggaggcaagccctacaagtgtgaggtgtgcaccaagggcttcagcgagagcagccggctgcaggcccaccagagggtgcacgtggagggccggccctacaagtgtgagcagtgtgggaagggcttcagcggctacagcagcctgcaggcccaccaccgggtgcacactggagagaagccctacaagtgtgaggtgtgtgggaagggcttcagccagaggagcaacctgcaggcccaccagagggtgcacactggagagaagccctacaagtgtgatgcctgtgggaagggcttccgctggagcagcggcctgctgatccaccagagggtgcacagcagtgacaagttctacaagtcagaagattatggcaaggactaccccagcagcgagaacctgcacagaaatgaagattctgtgctcttctag

SEQ ID NO: 17727 - DNA, 1842 bp, Artificial Sequence
  Description of Artificial Sequence: Synthetic coding sequence
tgcagcagcgccttccctgagagctgccccttccagaaggaggatggcatgatcaagttccaggtgcggctgagcaacctgcaggagcgggtgaccttcaaggatgtggccgtggtgttcaccaaggaggagctggccctgctggacaaggcccagatcaacctgtaccaggatgtgatgctggagaacttcaggaacctgatgctggtgagagatggcatcaagaacaacatcctgaacctgcaggccaagggcctgagctacctgagccaggaggtgctgcactgctggcagatctggaagcagaggatccgggacctgactgtgtcccaggactacatcgtgaacctgcaggaggagtgcagcccccacctggaggatgtgtccctgtctgaggagtgggccggcatcagcctgcagatcagtgaaaatgaaaattatgtggtgaatgccatcatcaagaaccaggacatcacagcctggcagagcctgacccaggtgctgaccccagagagctggaggaaggccaacatcatgacagagccccagaacagccagggccgctacaagggcatctacatggaggagaagctgtaccgccgggcccagcatgatgacagcctgtcctggaccagctgtgaccaccacgagagccaggagtgcaagggggaggaccccggccgccaccccaactgtgggaagaacctgggcatgaagagcacagtggagaagagaaatgctgcccacgtgctgccccagcccttcccctgcaacaactgtggggtggcctttgctgatgacacagacccccacgtgcaccacagcacccacctgggggagaagagctacaagtgtgaccagtatggcaagaacttcagccagagccaggacctgattgtgcactgcaagacccacagcggcaagaccccctatgagttccacgagtggcccatgggctgcaagcagagcagtgacctgccccgctaccagaaggtgagcagcggggacaagccctacaagtgcaaggaatgtgggaagggcttcagaagaagcagcagcctgcacaaccaccaccgggtgcacactggagagatgccctacaagtgtgatgaatgtgggaagggcttcggcttccgcagcctgctgtgcatccaccagggcgtgcacacaggcaagaagccctacaagtgtgaagaatgtgggaagggctttgaccagagcagcaacctgctggtgcaccagagggtgcacactggagagaagccctacaagtgcagtgaatgtgggaagtgcttcagcagcagctctgtgctgcaggtgcactggaggttccacactggagagaagccctaccgctgtggagaatgtgggaagggcttcagccagtgcacccacctgcacatccaccagagggtgcacactggagagaagccctacaagtgcaatgtgtgtgggaaggactttgcctacagctctgtgctgcacacccaccagagggtgcacactggagagaagccctacaagtgtgaggtgtgtgggaagtgcttctcctacagcagctacttccacctgcaccagagggaccacatccgggagaagccctacaagtgtgatgaatgtgggaagggcttcagcaggaacagcgacctgaatgtgcacctgcgggtgcacacccgggagcggccctacaagtgcaaggcctgtgggaagggcttcagcaggaacagctacctgctggcccaccagagggtgcacattgatgagacccagtacacccactgtgagcggggcaaggacctgctgacccaccagaggctgcacgagcagcgggagaccctgtag

SEQ ID NO: 17728 - DNA, 426 bp, Artificial Sequence
  Description of Artificial Sequence: Synthetic coding sequence
atggagacagacctggccgagatgcctgagaagggggccctgagcagccaggacagcccccacttccaggagaagagcacagaggagggggaggtggccgccctgcggctgacagcccggagccaggagaccgtgaccttcaaggatgtggccatggacttcaccccagaggagtggggcaagctggaccctgcccagagagatgtgatgctggagaactacagaaacctggtgtccctgtggctgcctgtgtccaagccagagagctacaacctggagaatggcaaggagcccctgaagctggagaggaaggcccccaagagcagctacagcgctgtggccgtcatcatcctcttcctgatcccctacgtgcacctggagagctggttccgggagatcaccggccgccgcatcagccgctcctag

SEQ ID NO: 17729 - DNA, 1566 bp, Artificial Sequence
  Description of Artificial Sequence: Synthetic coding sequence
atggagacagacctggccgagatgcctgagaagggggccctgagcagccaggacagcccccacttccaggagaagagcacagaggagggggaggtggccgccctgcggctgacagcccggagccaggagaccgtgaccttcaaggatgtggccatggacttcaccccagaggagtggggcaagctggaccctgcccagagagatgtgatgctggagaactacagaaacctggtgtccctgtggctgcctgtgtccaagccagagagctacaacctggagaatggcaaggagcccctgaagctggagaggaaggcccccaagagcagctacagcgacatggagacccggccccagagcaaggacagcacctctgtgcaggacttcagcaaggccgagagctgcaaggtggccatcatcgaccggctgaccaggaacagcgtgtatgacagcaacctggaggccgccctggagtgtgagaactggctggagaaccagcagggcaaccaggagcggcacctgcgggagatgttcacccacatgaacagcctgtctgaggagacagaccacaagcatgatgtgtactggaagagcttcaaccagaagtctgtgctgatcacagaagatagagtgcccaagggcagctatgccttccacaccctggagaagagcctgaagcagaagagcaacctgatgaagaagcagaggacctacaaggagaagaagccccacaagtgcaatgactgtggggagctgttcacctaccacagcgtgctgatccgccaccagagggtgcacactggagagaagccctacacctgcaatgaatgtgggaagagcttcagccaccgggccaacctgaccaagcaccagaggacccacacccgcatcctgtttgaatgttctgagtgcaagaagaccttcacagagagcagcagcctggccacccaccagaggatccacgtgggggagcggccctatgaatgtaatgaatgtgggaagggcttcaacagaagcacccacctggtgcagcaccagctgatccacactggagtgaagccctatgaatgtaatgaatgtgacaaggccttcatccacagcagcgccctgatcaagcaccagaggacccacactggagagaagccctacaagtgccaggagtgtgggaaggccttcagccactgcagcagcctgaccaagcaccagagggtgcacactggagagaagccctatgaatgttctgaatgtgggaagaccttcagccagagcacccacctggtgcagcaccagaggatccacactggagagaagccctatgaatgtaatgaatgtgggaagaccttcagccgcagcagcaactttgccaagcaccagaggatccacatcggcaagaagccctacaagtgcagtgaatgtgggaaggccttcatccacagcagcgccctgatccagcaccagaggacccacactggagagaagcccttccgctgcaatgaatgtgggaagagcttcaagtgcagcagcagcctcatccgccaccagagggtgcacacagaggagcagccctag

SEQ ID NO: 17730 - DNA, 1536 bp, Artificial Sequence
  Description of Artificial Sequence: Synthetic coding sequence
atgggcgccctgagcagccaggacagcccccacttccaggagaagagcacagaggagggggaggtggccgccctgcggctgacagcccggagccaggagaccgtgaccttcaaggatgtggccatggacttcaccccagaggagtggggcaagctggaccctgcccagagagatgtgatgctggagaactacagaaacctggtgtccctgtggctgcctgtgtccaagccagagagctacaacctggagaatggcaaggagcccctgaagctggagaggaaggcccccaagagcagctacagcgacatggagacccggccccagagcaaggacagcacctctgtgcaggacttcagcaaggccgagagctgcaaggtggccatcatcgaccggctgaccaggaacagcgtgtatgacagcaacctggaggccgccctggagtgtgagaactggctggagaaccagcagggcaaccaggagcggcacctgcgggagatgttcacccacatgaacagcctgtctgaggagacagaccacaagcatgatgtgtactggaagagcttcaaccagaagtctgtgctgatcacagaagatagagtgcccaagggcagctatgccttccacaccctggagaagagcctgaagcagaagagcaacctgatgaagaagcagaggacctacaaggagaagaagccccacaagtgcaatgactgtggggagctgttcacctaccacagcgtgctgatccgccaccagagggtgcacactggagagaagccctacacctgcaatgaatgtgggaagagcttcagccaccgggccaacctgaccaagcaccagaggacccacacccgcatcctgtttgaatgttctgagtgcaagaagaccttcacagagagcagcagcctggccacccaccagaggatccacgtgggggagcggccctatgaatgtaatgaatgtgggaagggcttcaacagaagcacccacctggtgcagcaccagctgatccacactggagtgaagccctatgaatgtaatgaatgtgacaaggccttcatccacagcagcgccctgatcaagcaccagaggacccacactggagagaagccctacaagtgccaggagtgtgggaaggccttcagccactgcagcagcctgaccaagcaccagagggtgcacactggagagaagccctatgaatgttctgaatgtgggaagaccttcagccagagcacccacctggtgcagcaccagaggatccacactggagagaagccctatgaatgtaatgaatgtgggaagaccttcagccgcagcagcaactttgccaagcaccagaggatccacatcggcaagaagccctacaagtgcagtgaatgtgggaaggccttcatccacagcagcgccctgatccagcaccagaggacccacactggagagaagcccttccgctgcaatgaatgtgggaagagcttcaagtgcagcagcagcctcatccgccaccagagggtgcacacagaggagcagccctag

SEQ ID NO: 17731 - DNA, 1566 bp, Artificial Sequence; identical to SEQ ID NO: 17729
  Description of Artificial Sequence: Synthetic coding sequence

SEQ ID NO: 17732 - DNA, 1566 bp, Artificial Sequence; identical to SEQ ID NO: 17729
  Description of Artificial Sequence: Synthetic coding sequence

SEQ ID NO: 17733 - DNA, 1569 bp, Artificial Sequence
  Description of Artificial Sequence: Synthetic coding sequence
atggagacagacctggccgagatgcctgagaagggcgtgctgagcagccaggacagcccccacttccaggagaagagcacagaggagggggaggtggccgccctgcggctgacagcccggagccaggccgctgctgctgctgctgcccctggcagccgcagcctgcggggcgtgcacgtgcccccacccctgcacccagccccagcccgggaggagatcaagagcacctgcagcctgaaggcctgcttcagcctgagcctgaccctgacctactacagaacagccttcctgctgagcacagaaaatgaaggcaacctgcacttccagtgccccagtgatgtggagacccggccccagagcaaggacagcacctctgtgcaggacttcagcaaggccgagagctgcaaggtggccatcatcgaccggctgaccagaaattctgtgtatgacagcaacctggaggccgccctggagtgtgagaactggctggagaagcagcagggcaaccaggagcggcacctgcgggagatgttcacccacatgaacagcctgtctgaggagacagaccacgagcatgatgtgtactggaagagcttcaaccagaagtctgtgctgatcacagaggacagagtgcccaagggcagctatgccttccacaccctggagaagagcctgaagcagaagagcaacctgatgaagaagcagaggacctacaaggagaagaagccccacaagtgcaatgactgtggggagctgttcacctgccacagcgtgcacatccagcaccagagggtgcacactggagagaagccctacacctgcaatgaatgtgggaagagcttcagccaccgggccaacctgaccaagcaccagaggacccacacccgcatcctgtttgagtgccgggagtgcaagaagaccttcacagagagcagcagcctggccacccaccagagaattcatgtgggggagcggccctatgagtgcaatgaatgtgggaagggcttcaacagaagcacccacctggtgcagcaccagctgatccacactggagtgcggccctatgagtgcaatgaatgtgacaaggccttcatccacagcagcgccctgatcaagcaccagaggacccacactggagagaagccctacaagtgccaggagtgtgggaaggccttcagccactgcagcagcctgaccaagcaccagagggtgcacactggagagaagccctatgagtgcagtgaatgtgggaagaccttcagccagagcacccacctggtgcagcaccagaggatccacactggagagaagccctatgagtgcagtgaatgtgggaagaccttcagccagagcagcaactttgccaagcaccagaggatccacatcggcaagaagccctacaagtgcagtgaatgtgggaaggccttcatccacagcagcgccctgatccagcaccagaggacccacactggagagaagcccttccgctgcaatgaatgtgggaagagcttcaagtgcagcagcagcctcatccgccaccagagggtgcacacagaggagcagccctag

SEQ ID NO: 17734 - DNA, 2286 bp, Artificial Sequence
  Description of Artificial Sequence: Synthetic coding sequence
atgctggccagcagcaagaggatgaacagcagcagccgcagccagatcctgctgcgctggaagagtgacaaggcccagagcggcccctacaacgtggagaaggagatcctgaccagccgcttcctgcgggacacagagacctgccggcagaacttcaggaacttcccctacccagacctggccggccccaggaaggccctgagccagctgcgggagctgtgcctgaagtggctgcggcctgagatccacagcaaggagcagatcctggagctgctggtgctggagcagttcctgaccatcctgcccggggaggtgaggacctgggtgaagagccagtacccagagagcagcgaggaggccgtgaccctggtggaggacctgacccagatcctggaggaggaggccccccagaacagcaccctgagccaggacaccccagaggaggacccccggggcaagcacgccttccagacaggctggctgaatgacctggtgaccaaggagagcatgaccttcaaggatgtggccgtggacatcacccaggaggactgggagctgatgaggcctgtgcagaaggagctgtacaagacagtgaccctgcagaactactggaacatggtgtccctgggcctgactgtgtaccggcccaccgtcatccccatcctggaggagccctggatggtgatcaaggagatcctggagggccccagccctgagtgggagaccaaggcccaggcctgcacccctgtggaggacatgagcaagctgaccaaggaggagacccacaccatcaagctggaggacagctatgactatgatgaccggctggagcggcggggcaaaggaggcttctggaagatccacacagatgagcggggcttcagcctgaagtctgtgctgagccaggagtatgaccccacagaagaatgtctgagcaaatatgacatctacagaaacaactttgagaagcacagcaacctgattgtgcagtttgacacccagctggacaacaagacctctgtgtacaatgaaggccgggccaccttcaaccacgtgtcctatggcatcgtgcacaggaagatcctgcctggagagaagccctacaagtgcaatgtgtgtgggaagaagttcaggaagtaccccagcctgctgaagcaccagagcacccacgccaaggagaagagctatgaatgtgaggagtgtgggaaggagttccgccacatcagcagcctcatcgcccaccagaggatgcacactggagagaagccctatgagtgccaccagtgtgggaaggccttcagccagagggcccacctgaccatccaccagaggatccacactggagagaagccctacaagtgtgatgactgtgggaaggacttcagccagagggcccacctgaccatccaccagaggacccacactggagagaagccctacaagtgcctggagtgtgggaagaccttcagccacagcagcagcctcatcaaccaccagagggtgcacactggagagaagccctacatctgcaatgaatgtgggaagaccttcagccagagcacccacctgctgcagcaccagaagatccacacaggcaagaagccctacaagtgcaatgaatgctggaaggtgttcagccagagcacctacctgatccgccaccagaggatccacagcggggagaagtgctacaagtgcaatgaatgtgggaaggcctttgcccacagcagcaccctcatccagcaccagaccacccacactggagagaagagctacatctgcaacatctgtgggaaggccttcagccagagcgccaacctgacccagcaccacaggacccacactggagagaagccctacaagtgcagcgtgtgtgggaaggccttcagccagagcgtgcacctgacccagcaccagaggatccacaatggagagaagcccttcaagtgcaacatctgtgggaaggcctaccggcagggcgccaacctgacccagcaccagaggatccacactggagagaagccctacaagtgcaatgaatgtgggaaggccttcatctacagcagcagcctgaaccagcaccagaggacccacactggagagcggccctacaagtgcaatgaatgtgacaaggacttcagccagaggacctgcctgatccagcaccagaggatccacactggagagaagccctatgcctgccgcatctgtgggaagaccttcacccagagcaccaacctgatccagcaccagagggtgcacactggagccaagcacaggaactag

SEQ ID NO: 17735 - DNA, 2286 bp, Artificial Sequence; identical to SEQ ID NO: 17734
  Description of Artificial Sequence: Synthetic coding sequence

SEQ ID NO: 17736 - DNA, 174 bp, Artificial Sequence
  Description of Artificial Sequence: Synthetic coding sequence
atgctggccagcagcaagaggatgaacagcagcagccgcagccagatcctgctgcgctggaagagtgacaaggcccagagcggcccctacaacgtggagaaggagatcctgaccagccgcttcctgcgggacacagagacctgccggcagaacttcaggaacttcccctactag

SEQ ID NO: 17737 - DNA, 8157 bp, Artificial Sequence
  Description of Artificial Sequence: Synthetic coding sequence
atggctgatgaggaggccgagcaggagcggctgagctgtggggagggcggctgtgtggccgagctgcagaggctgggggagcggctgcaggagctggagctgcagctgcgggagagccgggtgcctgctgtggaggccgccacagactactgccagcagctgtgccagaccctgctggagtatgcagagaagtggaagaccagcgaggaccccctgcccctgctggaggtgtacacagtggccatccagagctatgtgaaggcccggccctacctgaccagtgaatgtgaaaatgtggccctggtgctggagcggctggccctgagctgtgtggagctgctgctgtgcctgcctgtggagctgagtgacaagcagtgggagcagttccagaccctggtgcaggtggcccacgagaagctgatggagaatggcagctgtgagctgcacttcctggccaccctggcccaggagaccggggtgtggaagaaccctgtgctgtgcaccatcctgagccaggagcccctggacaaggacaaggcctttgagggccccatcctgctggacatgaggatcaagcacctgatcaagaccaaccagctgagccaggccacagccctggccaagctgtgcagcgaccaccctgagatcggcatcaagggcagcttcaagcagacctacctggtgtgcctgtgcaccagcagccccaacgggaagctgattgaggagatcagcgaggtggactgcaaggatgccctggagatgatctgcaacctggagagtgaaggagatgagaagagcgccctggtgctgtgcacagccttcctgagccggcagctgcagcagggcgacatgtactgtgcctgggagctgaccctcttctggagcaagctgcagcagagggtggagcccagcatccaggtgtacctggagcgctgccggcagctgagcctgctgaccaagacagtgtaccacatcttcttcctgatcaaggtgatcaacagcgagacagagggcgccggcctggccacctgcatcgagctgtgtgtgaaggccctgcggctggagagcacagagaacacagaggtgaagatcagcatctgcaagaccatcagctgcctgctgcctgatgacctggaggtgaagagggcctgccagctgtctgagttcctgattgagcccaccgtggatgcctactatgctgtggagatgctgtacaaccagcctgaccagaagtatgatgaggagaacctgcccatccccaacagcctgcgctgtgagctgctgctggtgctgaagacccagtggccctttgatcctgagttctgggactggaagaccctgaagaggcagtgcctggccctgatgggagaggaggccagcatcgtgagcagcattgatgagctgaatgattctgaggtgtatgagaaggtggtggactaccaggaggagagcaaggagacctccatgaatggcctgtctggaggagtgggcgccaacagcggcctgctgaaggacattggagatgagaagcagaagaagcgggagatcaagcagctgcgggagcggggcttcatcagcgcccgcttcaggaactggcaggcctacatgcagtactgtgtgctgtgtgacaaggagttcctgggccacagaattgtgagacatgcccagaagcactacaaggatggcatctacagctgccccatctgtgccaagaacttcaacagcaaggagacctttgtgccccacgtgaccctgcacgtgaagcagagcagcaaggagcggctggccgccatgaagcccctgcggcggctgggccggccccccaagatcaccaccaccaatgaaaaccagaagaccaacacagtggccaagcaggagcagaggcccatcaagaagaacagcctgtacagcacagacttcatcgtgttcaatgacaatgatggcagtgatgatgaaaatgatgacaaggacaagagctatgagcctgaggtgattcctgtgcagaagcctgtgcctgtgaatgagttcaactgccctgtgaccttctgcaagaagggcttcaagtacttcaagaacctgattgcccacgtgaagggccacaaggacaatgaagatgccaagcgcttcctggagatgcagagcaagaaggtgatctgccagtactgcagaagacactttgtgtctgtgacccacctgaatgaccacctgcagatgcactgcggcagcaagccctacatctgcatccagatgaagtgcaaggccggcttcaacagctatgcagagctgctgacccacaggaaggagcaccaggtgttccgggccaagtgcatgttccccaagtgtggccgcatcttcagcgaggcctacctgctgtatgaccacgaggcccagcactacaacacctacacctgcaagttcaccggctgcggcaaggtgtaccgcagccagggcgagctggagaagcacctggatgaccacagcaccccacctgagaaggtgctgcccccagaggcccagctgaacagcagcggggacagcatccagcccagcgaggtgaaccagaacacagctgagaacatcgagaaggagaggtccatgctgcccagcgagaacaacatcgagaacagcctgctggccgacagaagtgatgcctgggacaagagcaaggccgagagcgctgtgaccaagcaggaccagatcagcgccagcgagctgcggcaggccaacggccccctgagcaatggcctggagaacccagccaccacccccctgctgcagagcagcgaggtggccgtgtccatcaaggtgtccctgaaccagggcatcgaggacaactttgggaagcaggagaacagcacagtggagggcagcggggaggccctggtgacagacctgcacacccctgtggaggacacctgcaatgacctgtgccaccctggcttccaggagaggaaggagcaggactgcttcaatgatgcccacgtgacccagaacagcctggtgaacagcgagaccctgaagatcggggacctgaccccccagaacctggagcggcaggtgaacaacctgatgaccttctctgtgcagaaccaggccgccttccagaacaacctgcccaccagcaagtttgaatgtggggacaacgtgaagaccagcagcaacctgtacaacctgcccctgaagaccctggagagcatcgcctttgtgcccccccagagcgacctgagcaacagcctgggcaccccatctgtgccccccaaggcccctgtgcagaagttcagctgccaggtggagggctgcaccaggacctacaacagcagccagagcatcggcaagcacatgaagacagcccacccagaccagtatgctgccttcaagatgcagaggaagagcaagaagggccagaaggccaacaacctgaacacccccaacaacgggaagtttgtgtacttcctgcccagccctgtgaacagcagcaaccccttcttcaccagccagaccaaggccaacggcaacccagcctgcagcgcccagctgcagcacgtgagcccccccatcttccctgcccacctggcctctgtgtccacccccctgctgagctccatggagagcgtcatcaaccccaacatcaccagccaggacaagaatgagcagggcggcatgctgtgcagccagatggagaacctgcccagcacagccctgcctgcccagatggaggacctgaccaagacagtgctgcccctgaacatcgacagcggcagtgaccccttcctgcccctgcctgctgagagcagctccatgagcctcttccccagccctgctgacagcggcaccaacagcgtcttcagccagctggagaacaacaccaaccactacagcagccagatcgagggcaacaccaacagcagcttcctgaagggcggcaatggagaaaatgctgtgttccccagccaggtgaatgtggccaacaacttcagcagcaccaatgcccagcagagcgcccctgagaaggtgaagaaggaccggggccggggccccaacgggaaggagaggaagcccaagcacaacaagagggccaagtggccagccatcatcagagatggcaagttcatctgcagccgctgctaccgggccttcaccaaccccaggagcctgggcggccacctgagcaagaggagctactgcaagcccctggatggagctgagatcgcccaggagctgctgcagagcaatggccagcccagcctgctggcctccatgatcctgagcaccaatgctgtgaacctgcagcagccccagcagagcaccttcaaccctgaggcctgcttcaaggaccccagcttcctgcagctgctggccgagaacagaagccctgccttcctgcccaacaccttccccaggtctggagtgaccaacttcaacacctctgtgtcccaggagggcagcgagatcatcaagcaggccctggagacagctggcatccccagcacctttgagggcgctgagatgctgagccacgtgtccacaggctgtgtgtctgatgccagccaggtgaatgccaccgtgatgcccaaccccaccgtgccccccctgctgcacacagtgtgccaccccaacaccctgctgaccaaccagaacagaaccagcaacagcaagaccagcagcattgaggagtgcagcagcctgcctgtgttccccaccaatgacctgctgctgaagacagtggagaatggcctgtgcagcagcagcttccccaacagcggcggccccagccagaacttcaccagcaacagcagccgggtgtctgtcatcagcggcccccagaacaccaggagcagccacctgaacaagaagggcaacagcgccagcaagaggaggaagaaggtggcccctcctctcatcgccccaaatgccagccagaacctggtgaccagtgacctgaccaccatgggcctgattgccaagtctgtggagatccccaccaccaacctgcacagcaatgtcatccccacctgtgagccccagagcctggtggagaacctgacccagaagctgaacaacgtgaacaaccagctgttcatgacagatgtgaaggagaacttcaagaccagcctggagagccacacagtgctggcccccctgaccctgaagacagaaaatggagacagccagatgatggccctgaacagctgcaccaccagcatcaacagcgacctgcagatcagtgaagataatgtcatccagaactttgagaagaccctggagatcatcaagacagccatgaacagccagatcctggaggtgaagagcggcagccagggcgctggggagaccagccagaatgcccagatcaactacaacatccagctgcccagcgtgaacacagtgcagaacaacaagctgcctgacagcagccccttcagcagcttcatctctgtgatgcccaccaagagcaacatcccccagagcgaggtgagccacaaggaggaccagatccaggagatcctggagggcctgcagaagctgaagctggagaatgacctgagcaccccagccagccagtgtgtgctgatcaacacctctgtgaccctgacccccacccctgtgaagagcacagctgacatcaccgtcatccagcctgtgtctgagatgatcaacatccagttcaatgacaaggtgaacaagccctttgtgtgccagaaccagggctgcaactacagcgccatgaccaaggatgccctcttcaagcactacggcaagatccaccagtacaccccagagatgatcctggagatcaagaagaaccagctgaagtttgcccccttcaagtgtgtggtgcccacctgcaccaagaccttcaccaggaacagcaacctgcgggcccactgccagctggtgcaccacttcaccacagaggagatggtgaagctgaagatcaagaggccctacggcaggaagagccagagtgaaaatgtgcctgccagccgcagcacccaggtgaagaagcagctggccatgacagaggagaacaagaaggagagccagcctgccctggagctgcgggcagagacccagaacacccacagcaatgtggccgtcatccctgagaagcagctggtggagaagaagagcccagacaagacagagagcagcctgcaggtgatcaccgtgaccagcgagcagtgcaacaccaatgccctgaccaacacccagaccaagggcaggaagatccgccgccacaagaaggagaaggaggagaagaagaggaagaagcctgtgtcccagagcctggagttccccacccgctacagcccctaccggccctaccgctgtgtgcaccagggctgctttgctgccttcaccatccagcagaacctgatcctgcactaccaggccgtgcacaagagtgacctgcctgccttctctgctgaggtggaggaggagagcgaggccggcaaggagagcgaggagacagagaccaagcagaccctgaaggagttccgctgccaggtgtctgactgcagccgcatcttccaggccatcaccggcctcatccagcactacatgaagctgcacgagatgaccccagaggagattgaatccatgacagcctctgtggatgtgggcaagttcccctgtgaccagctggagtgcaagagcagcttcaccacctacctgaactacgtggtgcacctggaggccgaccacggcatcggcctgcgggccagcaagacagaagaagatggagtgtacaagtgtgactgtgagggctgtgaccgcatctatgccaccaggagcaacctgctgcggcacatcttcaacaagcacaatgacaagcacaaggcccacctgatccggccccggcggctgaccccaggccaggagaacatgagcagcaaggccaaccaggagaagagcaagagcaagcaccggggcaccaagcacagccgctgtgggaaggagggcatcaagatgcccaagaccaagaggaagaagaagaacaacctggagaacaagaatgccaagatcgtgcagatcgaggagaacaagccctacagcctgaagaggggcaagcacgtgtacagcatcaaggccagaaatgatgccctgtctgagtgcaccagcagatttgtgacccagtacccctgcatgatcaagggctgcacctctgtggtgaccagcgagagcaacatcatccgccactacaagtgccacaagctgagcaaggccttcaccagccagcacaggaacctgctgattgtgttcaagcgctgctgcaacagccaggtgaaggagaccagcgagcaggagggcgccaagaatgatgtgaaggacagcgacacctgtgtgtctgagagcaatgacaacagcaggaccacagccaccgtgtcccagaaggaggtggagaagaatgagaaggatgagatggatgagctgacagagctgttcatcaccaagctgatcaatgaagacagcacctctgtggagacccaggccaacaccagcagcaatgtgtccaatgacttccaggaggacaacctgtgccagagcgagcggcagaaggccagcaacctgaagagggtgaacaaggagaagaatgtgtcccagaacaagaagaggaaggtggagaaggccgagcccgccagcgctgctgagctgagctctgtgaggaaggaggaggagacagctgtggccatccagaccatcgaggagcacccagccagctttgactggagcagcttcaagcccatgggctttgaggtgtccttcctgaagttcctggaggagagcgctgtgaagcagaagaagaacacagacaaggaccaccccaacacaggcaacaagaagggcagccacagcaacagcaggaagaacatcgacaagacagctgtgaccagcggcaaccacgtgtgcccctgcaaggagagcgagacctttgtgcagtttgccaaccccagccagctgcagtgcagcgacaacgtgaagatcgtgctggacaagaacctgaaggactgcacagagctggtgctgaagcagctgcaggagatgaagcccaccgtgtccctgaagaagctggaggtgcacagcaatgaccctgacatgtctgtgatgaaggacatcagcatcggcaaggccaccggccggggccagtactag

SEQ ID NO: 17738 - DNA, 8172 bp, Artificial Sequence
  Description of Artificial Sequence: Synthetic coding sequence
atggctgatgaggaggccgagcaggagcggctgagctgtggggagggcggctgtgtggccgagctgcagaggctgggggagcggctgcaggagctggagctgcagctgcgggagagccgggtgcctgctgtggaggccgccacagactactgccagcagctgtgccagaccctgctggagtatgcagagaagtggaagaccagcgaggaccccctgcccctgctggaggtgtacacagtggccatccagagctatgtgaaggcccggccctacctgaccagtgaatgtgaaaatgtggccctggtgctggagcggctggccctgagctgtgtggagctgctgctgtgcctgcctgtggagctgagtgacaagcagtgggagcagttccagaccctggtgcaggtggcccacgagaagctgatggagaatggcagctgtgagctgcacttcctggccaccctggcccaggagaccggggtgtggaagaaccctgtgctgtgcaccatcctgagccaggagcccctggacaaggacaaggtgaatgagttcctggcctttgagggccccatcctgctggacatgaggatcaagcacctgatcaagaccaaccagctgagccaggccacagccctggccaagctgtgcagcgaccaccctgagatcggcatcaagggcagcttcaagcagacctacctggtgtgcctgtgcaccagcagccccaacgggaagctgattgaggagatcagcgaggtggactgcaaggatgccctggagatgatctgcaacctggagagtgaaggagatgagaagagcgccctggtgctgtgcacagccttcctgagccggcagctgcagcagggcgacatgtactgtgcctgggagctgaccctcttctggagcaagctgcagcagagggtggagcccagcatccaggtgtacctggagcgctgccggcagctgagcctgctgaccaagacagtgtaccacatcttcttcctgatcaaggtgatcaacagcgagacagaaggagctggcctggccacctgcatcgagctgtgtgtgaaggccctgcggctggagagcacagaaaatacagaggtgaagatcagcatctgcaagaccatcagctgcctgctgcctgatgacctggaggtgaagagggcctgccagctgtctgagttcctgattgagcccaccgtggatgcctactatgctgtggagatgctgtacaaccagcctgaccagaagtatgatgaggagaacctgcccatccccaacagcctgcgctgtgagctgctgctggtgctgaagacccagtggccctttgatcctgagttctgggactggaagaccctgaagaggcagtgcctggccctgatgggagaggaggccagcatcgtgagcagcattgatgagctgaatgacagcgaggtgtatgagaaggtggtggactaccaggaggagagcaaggagacctccatgaatggcctgagcggcggcgtgggcgccaacagcggcctgctgaaggacattggagatgagaagcagaagaagcgggagatcaagcagctgcgggagcggggcttcatcagcgcccgcttcaggaactggcaggcctacatgcagtactgtgtgctgtgtgacaaggagttcctgggccaccgcatcgtgagacatgcccagaagcactacaaggatggcatctacagctgccccatctgtgccaagaacttcaacagcaaggagacctttgtgccccacgtgaccctgcacgtgaagcagagcagcaaggagcggctggccgccatgaagcccctgcggcggctgggccggccccccaagatcaccaccaccaatgaaaaccagaagaccaacacagtggccaagcaggagcagaggcccatcaagaagaacagcctgtacagcacagacttcatcgtgttcaatgacaatgatggcagtgatgatgaaaatgatgacaaggacaagagctatgagcctgaggtgattcctgtgcagaagcctgtgcctgtgaatgagttcaactgccctgtgaccttctgcaagaagggcttcaagtacttcaagaacctgattgcccacgtgaagggccacaaggacaatgaagatgccaagcgcttcctggagatgcagagcaagaaggtgatctgccagtactgccgccgccactttgtgtctgtgacccacctgaatgaccacctgcagatgcactgcggcagcaagccctacatctgcatccagatgaagtgcaaggccggcttcaacagctatgcagagctgctgacccacaggaaggagcaccaggtgttccgggccaagtgcatgttccccaagtgtggccgcatcttcagcgaggcctacctgctgtatgaccacgaggcccagcactacaacacctacacctgcaagttcaccggctgtgggaaggtgtaccgcagccagggcgagctggagaagcacctggatgaccacagcaccccacctgagaaggtgctgcccccagaggcccagctgaacagcagcggggacagcatccagcccagcgaggtgaaccagaacacagcagaaaatattgagaaggagaggtccatgctgcccagcgagaacaacatcgagaacagcctgctggccgacagaagtgatgcctgggacaagagcaaggccgagagcgctgtgaccaagcaggaccagatcagcgccagcgagctgcggcaggccaacggccccctgagcaatggcctggagaacccagccaccacccccctgctgcagagcagcgaggtggccgtgtccatcaaggtgtccctgaaccagggcatcgaggacaactttgggaagcaggagaacagcacagtggagggcagcggggaggccctggtgacagacctgcacacccctgtggaggacacctgcaatgacctgtgccaccctggcttccaggagaggaaggagcaggactgcttcaatgatgcccacgtgacccagaacagcctggtgaacagcgagaccctgaagattggagacctgaccccccagaacctggagcggcaggtgaacaacctgatgaccttctctgtgcagaaccaggccgccttccagaacaacctgcccaccagcaagtttgaatgtggggacaacgtgaagaccagcagcaacctgtacaacctgcccctgaagaccctggagagcatcgcctttgtgcccccccagagcgacctgagcaacagcctgggcacccccagcgtgccccccaaggcccctgtgcagaagttcagctgccaggtggagggctgcaccaggacctacaacagcagccagagcatcggcaagcacatgaagacagcccacccagaccagtatgctgccttcaagatgcagaggaagagcaagaagggccagaaggccaacaacctgaacacccccaacaacgggaagtttgtgtacttcctgcccagccctgtgaacagcagcaaccccttcttcaccagccagaccaaggccaatggaaatcctgcctgcagcgcccagctgcagcacgtgtccccacccatcttccctgcccacctggcctctgtgtccacccccctgctgagctccatggagagcgtcatcaaccccaacatcaccagccaggacaagaatgagcagggcggcatgctgtgcagccagatggagaacctgcccagcacagccctgcctgcccagatggaggacctgaccaagacagtgctgcccctgaacattgattctggcagtgaccccttcctgcccctgcctgctgagagcagctccatgagcctcttccccagccctgctgacagcggcaccaacagcgtcttcagccagctggagaacaacaccaaccactacagcagccagatcgagggcaacaccaacagcagcttcctgaagggcggcaatggagaaaatgctgtgttccccagccaggtgaatgtggccaacaacttcagcagcaccaatgcccagcagagcgcccctgagaaggtgaagaaggaccggggccggggccccaacgggaaggagaggaagcccaagcacaacaagagggccaagtggccagccatcatcagagatggcaagttcatctgcagccgctgctaccgggccttcaccaaccccaggagcctgggcggccacctgagcaagaggagctactgcaagcccctggatggagctgagatcgcccaggagctgctgcagagcaatggccagcccagcctgctggcctccatgatcctgagcaccaatgctgtgaacctgcagcagccccagcagagcaccttcaaccctgaggcctgcttcaaggaccccagcttcctgcagctgctggctgaaaatagaagccctgccttcctgcccaacaccttccccaggtctggagtgaccaacttcaacacctctgtgtcccaggagggcagcgagatcatcaagcaggccctggagacagctggcatccccagcacctttgaaggagctgagatgctgagccacgtgtccacaggctgtgtgtctgatgccagccaggtgaatgccaccgtgatgcccaaccccaccgtgccccccctgctgcacacagtgtgccaccccaacaccctgctgaccaaccagaacagaaccagcaacagcaagaccagcagcattgaagaatgtagcagcctgcccgtcttccccaccaatgacctgctgctgaagacagtggagaatggcctgtgcagcagcagcttccccaacagcggcggccccagccagaacttcaccagcaacagcagccgggtgtctgtcatcagcggcccccagaacaccaggagcagccacctgaacaagaagggcaacagcgccagcaagaggaggaagaaggtggccccacccctgattgccccaaatgccagccagaacctggtgaccagtgacctgaccaccatgggcctcatcgccaagtctgtggagatccccaccaccaacctgcacagcaatgtcatccccacctgtgagccccagagcctggtggagaacctgacccagaagctgaacaacgtgaacaaccagctgttcatgacagatgtgaaggagaacttcaagaccagcctggagagccacacagtgctggcccccctgaccctgaagacagaaaatggagacagccagatgatggccctgaacagctgcaccaccagcatcaacagcgacctgcagatcagcgaggacaacgtcatccagaactttgagaagaccctggagatcatcaagacagccatgaacagccagatcctggaggtgaagagcggcagccagggcgctggggagaccagccagaatgcccagatcaactacaacatccagctgcccagcgtgaacacagtgcagaacaacaagctgcctgacagcagccccttcagcagcttcatctctgtgatgcccaccaagagcaacatcccccagagcgaggtgagccacaaggaggaccagatccaggagatcctggagggcctgcagaagctgaagctggagaatgacctgagcaccccagccagccagtgtgtgctgatcaacacctctgtgaccctgacccccacccctgtgaagagcacagctgacatcaccgtcatccagcctgtgtctgagatgatcaacatccagttcaatgacaaggtgaacaagccctttgtgtgccagaaccagggctgcaactacagcgccatgaccaaggatgccctcttcaagcactacggcaagatccaccagtacaccccagagatgatcctggagatcaagaagaaccagctgaagtttgcccccttcaagtgtgtggtgcccacctgcaccaagaccttcaccaggaacagcaacctgcgggcccactgccagctggtgcaccacttcaccacagaggagatggtgaagctgaagatcaagaggccctacggcaggaagagccagagtgaaaatgtgcctgccagccgcagcacccaggtgaagaagcagctggccatgacagaggagaacaagaaggagagccagcctgccctggagctgcgggcagagacccagaacacccacagcaatgtggccgtcatccctgagaagcagctggtggagaagaagagcccagacaagacagagagcagcctgcaggtgatcaccgtgaccagcgagcagtgcaacaccaatgccctgaccaacacccagaccaagggcaggaagatcagaagacacaagaaggagaaggaggagaagaagaggaagaagcctgtgtcccagagcctggagttccccacccgctacagcccctaccggccctaccgctgtgtgcaccagggctgctttgctgccttcaccatccagcagaacctgatcctgcactaccaggccgtgcacaagagtgacctgcctgccttctctgctgaggtggaggaggagagcgaggccggcaaggagagcgaggagacagagaccaagcagaccctgaaggagttccgctgccaggtgtctgactgcagccgcatcttccaggccatcaccggcctcatccagcactacatgaagctgcacgagatgaccccagaggagattgagagcatgacagcctctgtggatgtgggcaagttcccctgtgaccagctggagtgcaagagcagcttcaccacctacctgaactacgtggtgcacctggaggccgaccatggaattggcctgcgggccagcaagacagaggaggatggagtgtacaagtgtgactgtgagggctgtgaccgcatctatgccaccaggagcaacctgctgcggcacatcttcaacaagcacaatgacaagcacaaggcccacctgatccggccccggcggctgaccccaggccaggagaacatgagcagcaaggccaaccaggagaagagcaagagcaagcaccggggcaccaagcacagccgctgtgggaaggagggcatcaagatgcccaagaccaagaggaagaagaagaacaacctggagaacaagaatgccaagatcgtgcagatcgaggagaacaagccctacagcctgaagaggggcaagcacgtgtacagcatcaaggccagaaatgatgccctgtctgaatgtaccagcagatttgtgacccagtacccctgcatgatcaagggctgcacctctgtggtgaccagcgagagcaacatcatccgccactacaagtgccacaagctgagcaaggccttcaccagccagcacaggaacctgctgattgtgttcaagcgctgctgcaacagccaggtgaaggagaccagcgagcaggagggcgccaagaatgatgtgaaggacagcgacacctgtgtgtctgagagcaatgacaacagcaggaccacagccaccgtgtcccagaaggaggtggagaagaatgagaaggatgagatggatgagctgacagagctgttcatcaccaagctgatcaatgaagacagcacctctgtggagacccaggccaacaccagcagcaatgtgtccaatgacttccaggaggacaacctgtgccagagcgagcggcagaaggccagcaacctgaagagggtgaacaaggagaagaatgtgtcccagaacaagaagaggaaggtggagaaggccgagcccgccagcgctgctgagctgagctctgtgaggaaggaggaggagacagctgtggccatccagaccatcgaggagcacccagccagctttgactggagcagcttcaagcccatgggctttgaggtgtccttcctgaagttcctggaggagagcgctgtgaagcagaagaagaacacagacaaggaccaccccaacacaggcaacaagaagggcagccacagcaacagcaggaagaacatcgacaagacagctgtgaccagcggcaaccacgtgtgcccctgcaaggagagcgagacctttgtgcagtttgccaaccccagccagctgcagtgcagcgacaacgtgaagatcgtgctggacaagaacctgaaggactgcacagagctggtgctgaagcagctgcaggagatgaagcccaccgtgtccctgaagaagctggaggtgcacagcaatgaccctgacatgtctgtgatgaaggacatcagcatcggcaaggccaccggccggggccagtactag

SEQ ID NO: 17739 - DNA, 3201 bp, Artificial Sequence
  Description of Artificial Sequence: Synthetic coding sequence
atggagggcctgctgcactacatcaacccagcccacgccatcagcctgctgagcgccctgaatgaggagcggctgaagggccagctgtgtgatgtgctgctgattgtgggggaccagaagttccgggcccacaagaatgtgctggccgccagcagcgagtacttccagagcctcttcaccaacaaggaaaatgaaagccagaccgtcttccagctggacttctgtgagccagatgcctttgacaacgtgctgaactacatctacagcagcagcctgtttgtggagaagagcagcctggccgctgtgcaggagctgggctacagcctgggcatctccttcctgaccaacatcgtgtccaagaccccccaggcccccttccccacctgccccaacaggaagaaggtgtttgtggaggatgatgagaacagcagccagaagaggagcgtcatcgtgtgccagagcagaaatgaggcccagggcaagacagtgtcccagaaccagccagatgtgagccacaccagccggcccagccccagcattgctgtgaaggccaacaccaacaagccccacgtgcccaagcccatcgagcccctgcacaacctgagcctgacagagaagtcctggcccaaggacagctctgtggtgtatgccaagagcctggagcacagcggcagcctggatgaccccaaccgcatcagcctggtgaagagaaatgctgtgctgcccagcaagcccctgcaggaccgggaggccatggatgacaagccaggagtgtctggccagctgcccaagggcaaggccctggagctggccctgaagaggcccaggcctcctgtgctgtctgtgtgcagcagcagcgagaccccctacctgctgaaggagaccaacaagggaaatggccagggagaagatagaaacctgctgtactacagcaagctgggcctggtgatccccagcagcggcagcggcagcggcaaccagagcattgacaggagcggccccctggtgaagagcctgctgcggcgcagcctgtccatggacagccaggtgcctgtgtacagccccagcattgacctgaagagcagccagggcagcagctctgtgtccagtgatgcccctggaaatgtgctgtgtgccctgagccagaagagcagcctgaaggactgcagcgagaagacagccctggatgaccggccccaggtgctgcagccccaccggctgcgctccttcagcgccagccagagcacagaccgggagggcgccagccctgtgacagaggtgcgcatcaagacagagcccagcagccccctgagtgaccccagcgacatcatccgggtgacagtgggagatgctgccaccacagctgctgccagcagcagctctgtgacccgggacctgagcctgaagacagaagatgaccagaaggacatgagccggctgcctgccaagaggcgcttccaggccgaccggcggctgcccttcaagaagctgaaggtgaatgagcacggcagccctgtgtctgaggacaactttgaggagggcagcagccccaccctgctggatgctgacttcccagacagcgacctgaacaaggatgaatttggagagctggagggcacccggcccaacaagaagttcaagtgcaagcactgcctgaagatcttccgcagcacagctggcctgcaccgccacgtgaacatgtaccacaaccctgagaagccctatgcctgtgacatctgccacaagcgcttccacaccaacttcaaggtgtggacccactgccagacccagcacggcatcgtgaagaaccccagccctgccagcagcagccatgctgtgctggatgagaagttccagaggaagctgattgatattgtgcgggagcgggagatcaagaaggccctgatcatcaagctgcggcggggcaagccaggcttccagggccagagcagcagccaggcccagcaggtgatcaagaggaacctgcggagccgggccaagggggcctacatctgcacctactgcggcaaggcctaccgcttcctgagccagttcaagcagcacatcaagatgcaccctggagagaagcccctgggcgtgaacaaggtggccaagcccaaggagcacgcccccctggccagccctgtggagaacaaggaggtgtaccagtgccgcctgtgcaatgccaagctgagcagcctgctggagcagggcagccatgagcggctgtgcagaaatgctgctgtgtgcccctactgcagcctgcgcttcttcagccctgagctgaagcaggagcacgagagcaaatgtgagtacaagaagctgacctgcctggagtgcatgaggaccttcaagagcagcttcagcatctggaggcaccaggtggaggtgcacaaccagaacaacatggcccccacagagaacttcagcctgcctgtgctggaccacaatggagatgtgacaggcagcagccggccccagagccagcctgagcccaacaaggtgaaccacatcgtgaccaccaaggatgacaacgtgttcagtgacagcagcgagcaggtgaactttgacagcgaggacagcagctgcctgcctgaggacctgagcctgagcaagcagctgaagatccaggtgaaggaggagcctgtggaggaggccgaggaggaggcccctgaggccagcacagcccccaaggaggccggccccagcaaggaggccagcctgtggccctgtgagaagtgtgggaagatgttcaccgtgcacaagcagctggagcggcaccaggagctgctgtgcagcgtgaagcccttcatctgccacgtgtgcaacaaggccttccgcaccaacttccggctgtggagccacttccagagccacatgagccaggccagcgaggagagcgcccacaaggagagcgaggtgtgccctgtgcccaccaacagccccagccccccacccctgcccccacctccacccctgcccaagatccagcccctggagccagacagccccaccggcctgtctgagaaccccaccccagccacagagaagctgtttgtgccccaggagagtgacaccctcttctaccacgccccacccctgagcgccatcaccttcaagaggcagttcatgtgcaagctgtgccacaggaccttcaagacagccttcagcctgtggagccatgagcagacccacaactag

SEQ ID NO: 17740 - DNA, 150 bp, Artificial Sequence
  Description of Artificial Sequence: Synthetic coding sequence
atggagggcctgctgcactacatcaacccagcccacgccatcagcctgctgagcgccctgaatgaggagcggctgaagggccagctgtgtgatgtgctgctgattgtgggggaccagaagttccgggcccacaagaatgtgctggcctag

SEQ ID NO: 17741 - DNA, 3201 bp, Artificial Sequence; identical to SEQ ID NO: 17739
  Description of Artificial Sequence: Synthetic coding sequence

SEQ ID NO: 17742 - DNA, 2598 bp, Artificial Sequence
  Description of Artificial Sequence: Synthetic coding sequence
atggagggcctgctgcactacatcaacccagcccacgccatcagcctgctgagcgccctgaatgaggagcggctgaagggccagctgtgtgatgtgctgctgattgtgggggaccagaagttccgggcccacaagaatgtgctggccgccagcagcgagtacttccagagcctcttcaccaacaaggaaaatgaaagccagaccgtcttccagctggacttctgtgagccagatgcctttgacaacgtgctgaactacatctacagcagcagcctgtttgtggagaagagcagcctggccgctgtgcaggagctgggctacagcctgggcatctccttcctgaccaacatcgtgtccaagaccccccaggcccccttccccacctgccccaacaggaagaaggtgtttgtggaggatgatgagaacagcagccagaagaggagcgtcatcgtgtgccagagcagaaatgaggcccagggcaagacagtgtcccagaaccagccagatgtgagccacaccagccggcccagccccagcattgctgtgaaggccaacaccaacaagccccacgtgcccaagcccatcgagcccctgcacaacctgagcctgacagagaagtcctggcccaaggacagctctgtggtgtatgccaagagcctggagcacagcggcagcctggatgaccccaaccgcatcagcctggtgaagagaaatgctgtgctgcccagcaagcccctgcaggaccgggaggccatggatgacaagccaggagtgtctggccagctgcccaagggcaaggccctggagctggccctgaagaggcccaggcctcctgtgctgtctgtgtgcagcagcagcgagaccccctacctgctgaaggagaccaacaagggaaatggccagggagaagatagaaacctgctgtactacagcaagctgggcctggtgatccccagcagcggcagcggcagcggcaaccagagcattgacaggagcggccccctggtgaagagcctgctgcggcgcagcctgtccatggacagccaggtgcctgtgtacagccccagcattgacctgaagagcagccagggcagcagctctgtgtccagtgatgcccctggaaatgtgctgtgtgccctgagccagaagagcagcctgaaggactgcagcgagaagacagccctggatgaccggccccaggtgctgcagccccaccggctgcgctccttcagcgccagccagagcacagaccgggagggcgccagccctgtgacagaggtgcgcatcaagacagagcccagcagccccctgagtgaccccagcgacatcatccgggtgacagtgggagatgctgccaccacagctgctgccagcagcagctctgtgacccgggacctgagcctgaagacagaagatgaccagaaggacatgagccggctgcctgccaagaggcgcttccaggccgaccggcggctgcccttcaagaagctgaaggtgaatgagcacggcagccctgtgtctgaggacaactttgaggagggcagcagccccaccctgctggatgctgacttcccagacagcgacctgaacaaggatgaatttgagcagggcagccatgagcggctgtgcagaaatgctgctgtgtgcccctactgcagcctgcgcttcttcagccctgagctgaagcaggagcacgagagcaaatgtgagtacaagaagctgacctgcctggagtgcatgaggaccttcaagagcagcttcagcatctggaggcaccaggtggaggtgcacaaccagaacaacatggcccccacagagaacttcagcctgcctgtgctggaccacaatggagatgtgacaggcagcagccggccccagagccagcctgagcccaacaaggtgaaccacatcgtgaccaccaaggatgacaacgtgttcagtgacagcagcgagcaggtgaactttgattctgaggacagcagctgcctgcctgaggacctgagcctgagcaagcagctgaagatccaggtgaaggaggagcctgtggaggaggccgaggaggaggcccctgaggccagcacagcccccaaggaggccggccccagcaaggaggccagcctgtggccctgtgagaagtgtgggaagatgttcaccgtgcacaagcagctggagcggcaccaggagctgctgtgcagcgtgaagcccttcatctgccacgtgtgcaacaaggccttccgcaccaacttccggctgtggagccacttccagagccacatgagccaggccagcgaggagagcgcccacaaggagagcgaggtgtgccctgtgcccaccaacagccccagccccccacccctgcccccacctccacccctgcccaagatccagcccctggagccagacagccccaccggcctgtctgagaaccccaccccagccacagagaagctgtttgtgccccaggagagtgacaccctcttctaccacgccccacccctgagcgccatcaccttcaagaggcagttcatgtgcaagctgtgccacaggaccttcaagacagccttcagcctgtggagccatgagcagacccacaactag

SEQ ID NO: 17743 - DNA, 3201 bp, Artificial Sequence; identical to SEQ ID NO: 17739
  Description of Artificial Sequence: Synthetic coding sequence

SEQ ID NO: 17744 - DNA, 360 bp, Artificial Sequence
  Description of Artificial Sequence: Synthetic coding sequence
atggagggcctgctgcactacatcaacccagcccacgccatcagcctgctgagcgccctgaatgaggagcggctgaagggccagctgtgtgatgtgctgctgattgtgggggaccagaagttccgggcccacaagaatgtgctggccgccagcagcgagtacttccagagcctcttcaccaacaaggaaaatgaaagccagaccgtcttccagctggacttctgtgagccagatgcctttgacaacgtgctgaactacatctacagcagcagcctgtttgtggagaagagcagcctggccgctgtgcaggagctgggctacagcctgggcatctccttcctgaccaacatcgtgtcctag

SEQ ID NO: 17745 - DNA, 150 bp, Artificial Sequence; identical to SEQ ID NO: 17740
  Description of Artificial Sequence: Synthetic coding sequence

SEQ ID NO: 17746 - DNA, 1872 bp, Artificial Sequence
  Description of Artificial Sequence: Synthetic coding sequence
atggcccacaagtatgtgggcctgcagtaccacggctctgtgacctttgaagatgtggccatcgccttcagccagcaggagtgggagagcctggacagcagccagaggggcctgtacagagatgtgatgctggagaactacagaaacctggtgtccatgggccacagccgcagcaagccccacgtgattgccctgctggagcagtggaaggagcctgaggtgacagtgaggaaggatggaagacgctggtgcacagacctgcagctggaggatgacaccatcggctgcaaggagatgcccaccagcgagaactgccccagctttgccctgcaccagaagatcagccggcagaagccccgggagtgccaggagtatggcaagaccctgtgccaggacagcaagcctgtgcagcacgagcgcatccacagcagcgagaagcccaaccgctgcaaggaatgtgggaagaacttcagcaatggccaccagctgaccatccaccagaggctgcacgtgggggagaagccctacaagtatgagaagtgtgggaaggccttcatcagcggcagcgcctttgtgaagcacggccgcatccacactggagagaagcccctgaagtgcaagcagtgtgggaagaccatcagcggcagctaccagctgactgtgcacaagagcatccacacaggcaagaagccctatgaatgtggggagtgtgggaaggccttcctggtgtatggcaagctgaccaggcaccagagcacccacactggagagaagcccttcggctgtgaggagtgtgggaaggccttcagcaccttctcctacctggtgcagcaccagaggatccacaccagcgagaagccctatgagtgcaaggaatgtgggaaggccttcagcaccagcagccccctggccaagcaccagaggatccacactggagagaagccctatgagtgcaaggaatgtgggaagagcttcaccgtgtatggccagctgaccaggcaccagagcatccacactggagagaagccctttgagtgcaaggaatgtgggaaggccttccggctgagcagcttcctgcacgcccaccagagaattcatgctgagatcaagccctacggctgcaaggaatgtggccgcaccttcagccgggccagctacctggtgcagcacggccgcctgcacactggagagaagccctatgagtgcaaggaatgtgggaaggccttcagcacaggcagctacctggtgcagcaccagaggatccacactggagagaagccctatgagtgcaaggaatgtgggaaggccttcatcagccgccaccagctgactgtgcaccagagggtgcacactggagagaagccctatgagtgcaaggaatgtgggaaggccttccgggtgcacgtgcacctgacccagcacaggaagatccacacagatgtgaagccctatgagtgcaaggaatgtgggaagaccttcagccgggccagctacctggtgcagcacagccgcatccacacaggcaagaagccctatgagtgcaaggaatgtgggaaggccttcagcagcggcagctacctggtgcagcaccagaggatccacactggagagaagccctatgagtgcaacaagtgtgggaaggccttcaccgtgtatggccagctgattggccaccagagcgtgcacactggagagaagccctttgagtgcaaggaatgtgggaaggccttccggctgaacagcttcctgacagagcaccagagggtgcacactggagagaagcccttcaagtgcaagaagtgtgggaagaccttccgctacagcagcgccctgaaggtgcacctgaggaagcacatgtctgtcatcccctag

SEQ ID NO: 17747 - DNA, 945 bp, Artificial Sequence
  Description of Artificial Sequence: Synthetic coding sequence
gaatgtgggaaggccttcagcaccttctcctacctggtgcagcaccagaggatccacaccagcgagaagccctatgagtgcaaggaatgtgggaaggccttcagcaccagcagccccctggccaagcaccagaggatccacactggagagaagccctatgagtgcaaggaatgtgggaagagcttcaccgtgtatggccagctgaccaggcaccagagcatccacactggagagaagccctttgagtgcaaggaatgtggccgcaccttcagccgggccagctacctggtgcagcacggccgcctgcacactggagagaagccctatgagtgcaaggaatgtgggaaggccttcagcacaggcagctacctggtgcagcaccagaggatccacactggagagaagccctatgagtgcaaggaatgtgggaaggccttcatcagccgccaccagctgactgtgcaccagagggtgcacactggagagaagccctatgagtgcaaggaatgtgggaaggccttccgggtgcacgtgcacctgacccagcacaggaagatccacacagatgtgaagccctatgagtgcaaggaatgtgggaagaccttcagccgggccagctacctggtgcagcacagccgcatccacacaggcaagaagccctatgagtgcaaggaatgtgggaaggccttcagcagcggcagctacctggtgcagcaccagaggatccacactggagagaagccctatgagtgcaacaagtgtgggaaggccttcaccgtgtatggccagctgattggccaccagagcgtgcacactggagagaagccctttgagtgcaaggaatgtgggaaggccttccggctgaacagcttcctgacagagcaccagagggtgcacactggagagaagcccttcaagtgcaagaagtgtgggaagaccttctag

SEQ ID NO: 17748 - DNA, 1629 bp, Artificial Sequence
  Description of Artificial Sequence: Synthetic coding sequence
atggagcccaaggacctgcagctggaggatgacaccatcggctgcaaggagatgcccaccagcgagaactgccccagctttgccctgcaccagaagatcagccggcagaagccccgggagtgccaggagtatggcaagaccctgtgccaggacagcaagcctgtgcagcacgagcgcatccacagcagcgagaagcccaaccgctgcaaggaatgtgggaagaacttcagcaatggccaccagctgaccatccaccagaggctgcacgtgggggagaagccctacaagtatgaaaaatgtgggaaggccttcatcagcggcagcgcctttgtgaagcacggccgcatccacactggagagaagcccctgaagtgcaagcagtgtgggaagaccatcagcggcagctaccagctgactgtgcacaagagcatccacacaggcaagaagccctatgaatgtggagaatgtgggaaggccttcctggtgtatggcaagctgaccaggcaccagagcacccacactggagagaagcccttcggctgtgaagaatgtgggaaggccttcagcaccttctcctacctggtgcagcaccagaggatccacaccagcgagaagccctatgagtgcaaggaatgtgggaaggccttcagcaccagcagccccctggccaagcaccagaggatccacactggagagaagccctatgagtgcaaggaatgtgggaagagcttcaccgtgtatggccagctgaccaggcaccagagcatccacactggagagaagccctttgagtgcaaggaatgtgggaaggccttccggctgagcagcttcctgcacgcccaccagagaattcatgctgagatcaagccctacggctgcaaggaatgtggccgcaccttcagccgggccagctacctggtgcagcacggccgcctgcacactggagagaagccctatgagtgcaaggaatgtgggaaggccttcagcacaggcagctacctggtgcagcaccagaggatccacactggagagaagccctatgagtgcaaggaatgtgggaaggccttcatcagccgccaccagctgactgtgcaccagagggtgcacactggagagaagccctatgagtgcaaggaatgtgggaaggccttccgggtgcacgtgcacctgacccagcacaggaagatccacacagatgtgaagccctatgagtgcaaggaatgtgggaagaccttcagccgggccagctacctggtgcagcacagccgcatccacacaggcaagaagccctatgagtgcaaggaatgtgggaaggccttcagcagcggcagctacctggtgcagcaccagaggatccacactggagagaagccctatgagtgcaacaagtgtgggaaggccttcaccgtgtatggccagctgattggccaccagagcgtgcacactggagagaagccctttgagtgcaaggaatgtgggaaggccttccggctgaacagcttcctgacagagcaccagagggtgcacactggagagaagcccttcaagtgcaagaagtgtgggaagaccttccgctacagcagcgccctgaaggtgcacctgaggaagcacatgtctgtcatcccctag

SEQ ID NO: 17749 - DNA, 1875 bp, Artificial Sequence
  Description of Artificial Sequence: Synthetic coding sequence
atggcccacaagtatgtgggcctgcagtaccacggctctgtgacctttgaagatgtggccatcgccttcagccagcaggagtgggagagcctggacagcagccagaggggcctgtacagagatgtgatgctggagaactacagaaacctggtgtccatggccggccacagccgcagcaagccccacgtgattgccctgctggagcagtggaaggagcctgaggtgacagtgaggaaggatggccgccgctggtgcacagacctgcagctggaggatgacaccatcggctgcaaggagatgcccaccagcgagaactgccccagctttgccctgcaccagaagatcagccggcagaagccccgggagtgccaggagtatggcaagaccctgtgccaggacagcaagcctgtgcagcacgagcgcatccacagcagcgagaagcccaaccgctgcaaggaatgtgggaagaacttcagcaatggccaccagctgaccatccaccagaggctgcacgtgggggagaagccctacaagtatgaaaaatgtgggaaggccttcatcagcggcagcgcctttgtgaagcacggccgcatccacactggagagaagcccctgaagtgcaagcagtgtgggaagaccatcagcggcagctaccagctgactgtgcacaagagcatccacacaggcaagaagccctatgaatgtggagaatgtgggaaggccttcctggtgtatggcaagctgaccaggcaccagagcacccacactggagagaagcccttcggctgtgaagaatgtgggaaggccttcagcaccttctcctacctggtgcagcaccagaggatccacaccagcgagaagccctatgagtgcaaggaatgtgggaaggccttcagcaccagcagccccctggccaagcaccagaggatccacactggagagaagccctatgagtgcaaggaatgtgggaagagcttcaccgtgtatggccagctgaccaggcaccagagcatccacactggagagaagccctttgagtgcaaggaatgtgggaaggccttccggctgagcagcttcctgcacgcccaccagagaattcatgctgagatcaagccctacggctgcaaggaatgtggccgcaccttcagccgggccagctacctggtgcagcacggccgcctgcacactggagagaagccctatgagtgcaaggaatgtgggaaggccttcagcacaggcagctacctggtgcagcaccagaggatccacactggagagaagccctatgagtgcaaggaatgtgggaaggccttcatcagccgccaccagctgactgtgcaccagagggtgcacactggagagaagccctatgagtgcaaggaatgtgggaaggccttccgggtgcacgtgcacctgacccagcacaggaagatccacacagatgtgaagccctatgagtgcaaggaatgtgggaagaccttcagccgggccagctacctggtgcagcacagccgcatccacacaggcaagaagccctatgagtgcaaggaatgtgggaaggccttcagcagcggcagctacctggtgcagcaccagaggatccacactggagagaagccctatgagtgcaacaagtgtgggaaggccttcaccgtgtatggccagctgattggccaccagagcgtgcacactggagagaagccctttgagtgcaaggaatgtgggaaggccttccggctgaacagcttcctgacagagcaccagagggtgcacactggagagaagcccttcaagtgcaagaagtgtgggaagaccttccgctacagcagcgccctgaaggtgcacctgaggaagcacatgtctgtcatcccctag

SEQ ID NO: 17750 - DNA, 1872 bp, Artificial Sequence; identical to SEQ ID NO: 17746
  Description of Artificial Sequence: Synthetic coding sequence

SEQ ID NO: 17751 - DNA, 1560 bp, Artificial Sequence
  Description of Artificial Sequence: Synthetic coding sequence
atggcccgggacctggtgatgttcagagatgtggccgtggacttcagccaggaggagtgggagtgcctgaacagctaccagaggaacctgtacagagatgtgatcctggagaactacagcaacctggtgtccctggccggctgcagcatcagcaagccagatgtgatcaccctgctggagcagggcaaggagccctggatggtggtgagagatgagaagaggcgctggaccctggacctggagagccgctatgacaccaagaagctgttccagggcaaggacatctatgagatgaacctgagccagtggaaggtgatggagcgcatcaagagctgtggcctggaggagcaggagagcccccatgaggtgtgcttccggcaggtgaccaagaccaccagcgagaagatgcccacctacaggaagctgaccagcctgcccctgtaccagaagagccacaaccgggagaagccctatgaatgtggggagtgtgggaaggccttccgggtgcggcagcagctgaccttccaccagaggatccacactggagagaagccctatgagtgcaaggaatgtgggaaggccttccggcagtgtgcccacctgagccgccaccagaggatccacaccagtgacaagctgtatgagtgcaagaagtgtgggaagatcttcacctgtggcagtgacctgcgggtgcaccagaggatccacatcggggagaagccctatgagtgcaaggaatgtgggaaggccttccgggtgcggggccagctgaacctgcaccagaggatccacactggagagaagccctatgagtgcaaggaatgtgggaaggccttccggcagtatgcccacctgaccaggcaccagaggctgaacattgctgagaagtgctatgagtgcaaggaatgtggccaggccttcctgtgcagcacaggcctgcggctgcaccacaagctgcacactggagagaagccctatgagtgcaaggaatgtgggaaggccttccgggtgcggcagcagctgaccctgcaccagaggatccacactggagagaagccctatgactgcaaggaatgtgggaagaccttcagccggggctaccacctgaccctgcaccagaggatccacactggagagaagccctatgagtgcaaggagtgccagaagttcttccgccgctacagcgagctgatcagccaccagggcatccacatcggggagaagccctatgagtgcaaggaatgtgggaaggccttccgcctcttcagccagctgacccagcaccagagcatccactttggagagaagcccttcaagtgcaaggaatgtgagaagaccttccggctgctgagccagctgacccagcaccagagcatccacactggagagaagccctatgactgcaaggaatgtgggaaggccttccggctgcacagcagcctcatccagcaccagaggatccacagcggggagaagccctacaagtgcaaggagtgcaagaaggccttccggcagcacagccacctgacctaccaccagaggatccacaacgtgacctag

SEQ ID NO: 17752 - DNA, 1560 bp, Artificial Sequence; identical to SEQ ID NO: 17751
  Description of Artificial Sequence: Synthetic coding sequence

SEQ ID NO: 17753 - DNA, 1305 bp, Artificial Sequence
  Description of Artificial Sequence: Synthetic coding sequence
atggcccgggacctggtgatgttcagagatgtggccgtggacttcagccaggaggagtgggagtgcctgaacagctaccagaggaacctgtacagagatgtgatcctggagaactacagcaacctggtgtccctgggctgcagcatcagcaagccagatgtgatcaccctgctggagcagggcaaggagccctggatggtggtgagagatgagaagaggcgctggaccctggacctggagagccgctatgacaccaagaagctgttccagggcaaggacatctatgagatgaacctgagccagtggaaggtgatggagcgcatcaagagctgtggcctggaggagcaggagagcccccatgaggtgtgcttccggcaggtgaccaagaccaccagcgagaagatgcccacctacaggaagctgaccagcctgcccctgtaccagaagagccacaaccgggagaagccctatgaatgtggagaatgtgggaaggccttccgggtgcggcagcagctgaccttccaccagaggatccacactggagagaagccctatgagtgcaaggaatgtgggaaggccttccggcagtgtgcccacctgagccgccaccagaggatccacaccagtgacaagctgtatgagtgcaagaagtgtgggaagatcttcacctgtggcagtgacctgcggctgcaccacaagctgcacactggagagaagccctatgagtgcaaggaatgtgggaaggccttccgggtgcggcagcagctgaccctgcaccagaggatccacactggagagaagccctatgactgcaaggaatgtgggaagaccttcagccggggctaccacctgaccctgcaccagaggatccacactggagagaagccctatgagtgcaaggagtgccagaagttcttccgccgctacagcgagctgatcagccaccagggcatccacatcggggagaagccctatgagtgcaaggaatgtgggaaggccttccgcctcttcagccagctgacccagcaccagagcatccactttggagagaagcccttcaagtgcaaggaatgtgagaagaccttccggctgctgagccagctgacccagcaccagagcatccacactggagagaagccctatgactgcaaggaatgtgggaaggccttccggctgcacagcagcctcatccagcaccagaggatccacagcggggagaagccctacaagtgcaaggagtgcaagaaggccttccggcagcacagccacctgacctaccaccagaggatccacaacgtgacctag

SEQ ID NO: 17754 - DNA, 1560 bp, Artificial Sequence; identical to SEQ ID NO: 17751
  Description of Artificial Sequence: Synthetic coding sequence

SEQ ID NO: 17755 - DNA, 2001 bp, Artificial Sequence
  Description of Artificial Sequence: Synthetic coding sequence
atgcaggaggtggtgctgctggatgagagcagcggcccccccagccagctgctgtggacccggcaggacacccagctgccccaggagagcgccctgctgcctgccccctacccagccttcaccaaggatggcagccagggcaacctgccccaggccgacatcaccctgatgagccaggcccaggagagcgtgacctttgaagatgtggccgtgaacttcaccaaccgggagtggcagtgcctgacctacgcccagaggcacctgtacaaggatgtgatgctggagaactacggcaacatggtgtccctgggcttccccttccccaagccacccctcatcagccacctggagcgggaggtggacccctgtgtgcaggacccccaggaccgggagagcctgagctgcagctaccctgtgtctgctgacaagatgtggccagaaaatgagaaggccagcagccagcaggagatctttgaaaatggagaggcctactggatgaagttcaacagcctgctgaaggtggacagccgggaccccaaggtgcgggaggtgtgtgtgcaggatgtgaagctggagaaccagtgggagaccagcatccgggagaagctgcgggaggagaaggagggcagcgaggaggtgacctgcaagaagggcaagaaccagaaggtgctgagcaagaacctgaaccccaacagcaagcacagccagtgcaacaaggtgctgattgcccagaagctgcatgaatgtgcccgctgtgggaagaacttctcctggcacagcgacctgatcctgcacgagcagatccacagcggggagaagccccacgtgtgcaatgaatgtgggaaggccttcaagaccaggaaccagctgtccatgcaccgcatcatccacactggagagaagcccttcaactgcacccagtgtgggaaggccttcaacagccgcagcgccctgtgccgccacaagaagacccacagcggggagaagccccatgagtgccgggactgtgggaaggccttcaagaccaggaaccggctgtgcatgcaccagctgatccacactggagagaagccctacaagtgcaactgctgcggcaaggccttccagttcaagcacagcctgaccatccacggccgcatccacactggagagaagccctatgaatgtgaagaatgtgggaaggccttcagcggcagcagtgacctgaccaagcacatccgcatccacactggagagcggccctatgagtgcagcaaatgtggccgggccttcagccgcagcagtgacctgagcaagcacaagaggatccacacccgggagaagcactacggctgcccccagtgtgggaaggacttcagcatcaaggccgagctgaccaagcaccggcgcatccacacagaggagaagcgctaccgctgtgaagaatgtgggaaggccttccgccacaactgcaagaggcgggcccacgagcgggagcacactggagagaagccctaccagtgccgggactgtgggaagaccttccaggacaagcactgcctgaccatccaccagaggatccacactggagagaagccctacaagtgcctggagtgtgggaaggccttcagcggcaagagcaacctgaccaaccaccggcgcatccacactggagagaagccccacaagtgtgaggtgtgtggcatggccttccaccacagctctgtgctgcggcagcacaagaggatccacactggagagaagccctacacctgcagtgaatgtggcaccagcttccggcagggcagcgccctgattggccacaagagggtgcacactggagagaagccctatgaatgtgaagaatgtgggaaggccttccgggtgagcagcaacctgaccggccacaagaagaggaagcaccaggtgtggagcacccatgagctggatggcagcaggaagagcctgagccctgtgacagtgtcccagacctctgtggtgtccatcctgaccagcgcctag

SEQ ID NO: 17756 - DNA, 2001 bp, Artificial Sequence; identical to SEQ ID NO: 17755
  Description of Artificial Sequence: Synthetic coding sequence

SEQ ID NO: 17757 - DNA, 2001 bp, Artificial Sequence; identical to SEQ ID NO: 17755
  Description of Artificial Sequence: Synthetic coding sequence

SEQ ID NO: 17758 - DNA, 2001 bp, Artificial Sequence; identical to SEQ ID NO: 17755
  Description of Artificial Sequence: Synthetic coding sequence

SEQ ID NO: 17759 - DNA, 2001 bp, Artificial Sequence; identical to SEQ ID NO: 17755
  Description of Artificial Sequence: Synthetic coding sequence

SEQ ID NO: 17760 - DNA, 2001 bp, Artificial Sequence; identical to SEQ ID NO: 17755
  Description of Artificial Sequence: Synthetic coding sequence

SEQ ID NO: 17761 - DNA, 1725 bp, Artificial Sequence
  Description of Artificial Sequence: Synthetic coding sequence
atgctggagaactacggcaacatggtgtccctgggcttccccttccccaagccacccctcatcagccacctggagcgggaggtggacccctgtgtgcaggacccccaggaccgggagagcctgagctgcagctaccctgtgtctgctgacaagatgtggccagaaaatgagaaggccagcagccagcaggagatctttgaaaatggagaggcctactggatgaagttcaacagcctgctgaaggtggacagccgggaccccaaggtgcgggaggtgtgtgtgcaggatgtgaagctggagaaccagtgggagaccagcatccgggagaagctgcgggaggagaaggagggcagcgaggaggtgacctgcaagaagggcaagaaccagaaggtgctgagcaagaacctgaaccccaacagcaagcacagccagtgcaacaaggtgctgattgcccagaagctgcatgaatgtgcccgctgtgggaagaacttctcctggcacagcgacctgatcctgcacgagcagatccacagcggggagaagccccacgtgtgcaatgaatgtgggaaggccttcaagaccaggaaccagctgtccatgcaccgcatcatccacactggagagaagcccttcaactgcacccagtgtgggaaggccttcaacagccgcagcgccctgtgccgccacaagaagacccacagcggggagaagccccatgagtgccgggactgtgggaaggccttcaagaccaggaaccggctgtgcatgcaccagctgatccacactggagagaagccctacaagtgcaactgctgcggcaaggccttccagttcaagcacagcctgaccatccacggccgcatccacactggagagaagccctatgaatgtgaagaatgtgggaaggccttcagcggcagcagtgacctgaccaagcacatccgcatccacactggagagcggccctatgagtgcagcaaatgtggccgggccttcagccgcagcagtgacctgagcaagcacaagaggatccacacccgggagaagcactacggctgcccccagtgtgggaaggacttcagcatcaaggccgagctgaccaagcaccggcgcatccacacagaggagaagcgctaccgctgtgaagaatgtgggaaggccttccgccacaactgcaagaggcgggcccacgagcgggagcacactggagagaagccctaccagtgccgggactgtgggaagaccttccaggacaagcactgcctgaccatccaccagaggatccacactggagagaagccctacaagtgcctggagtgtgggaaggccttcagcggcaagagcaacctgaccaaccaccggcgcatccacactggagagaagccccacaagtgtgaggtgtgtggcatggccttccaccacagctctgtgctgcggcagcacaagaggatccacactggagagaagccctacacctgcagtgaatgtggcaccagcttccggcagggcagcgccctgattggccacaagagggtgcacactggagagaagccctatgaatgtgaagaatgtgggaaggccttccgggtgagcagcaacctgaccggccacaagaagaggaagcaccaggtgtggagcacccatgagctggatggcagcaggaagagcctgagccctgtgacagtgtcccagacctctgtggtgtccatcctgaccagcgcctag

SEQ ID NO: 17762 - DNA, 1725 bp, Artificial Sequence; identical to SEQ ID NO: 17761
  Description of Artificial Sequence: Synthetic coding sequence

SEQ ID NO: 17763 - DNA, 1725 bp, Artificial Sequence; identical to SEQ ID NO: 17761
  Description of Artificial Sequence: Synthetic coding sequence

SEQ ID NO: 17764 - DNA, 1725 bp, Artificial Sequence; identical to SEQ ID NO: 17761
  Description of Artificial Sequence: Synthetic coding sequence

SEQ ID NO: 17765 - DNA, 1725 bp, Artificial Sequence; identical to SEQ ID NO: 17761
  Description of Artificial Sequence: Synthetic coding sequence

SEQ ID NO: 17766 - DNA, 1725 bp, Artificial Sequence; identical to SEQ ID NO: 17761
  Description of Artificial Sequence: Synthetic coding sequence

SEQ ID NO: 17767 - DNA, 1749 bp, Artificial Sequence
  Description of Artificial Sequence: Synthetic coding sequence
atgtctgagagctggcagcagcccccccagacccagccccagcagccccagcccccccagccccagcaccacgccgagcccccaccagccctggccgagcacaccctgcccccaggcacagctgagaaccccctgggctgtgctgtgtatggcatcctgctgcagcctgaccccggcctgcagcccccccagcacgcccccctgcaggccgccggggagcccggccccaagtgtggggtgtgtggccatgacctggcccacctgagcagcccccatgagcaccagtgcctggccggccatgaccgctccttccagtgcacccagtgcctgaagatcttccaccaggccacagacctgctggagcaccagtgtgtgcaggccgagcagaagccctttgtgtgtggggtgtgcaagatgggcttcagcctgctgaccagcctggcccagcaccacagcagccacagcggcctggtgaagtgcagcatctgtgagaagacctacaagccagctgaggccgctgagcccgccaccacagctgcccccagcctgcctgctgccccagcccccagcacagtgaccccagctgagcaggccgacaagccctacagctgccccatctgccagaagcccttcaagcacctgtctgagctgagcagacatgagcgcatccacactggagagaagccctacaagtgcaccctgtgtgacaagagcttcagccagagcagccacctggtgcaccacaagaggacccacagcagcgagcggccctacaagtgtgctgtgtgtgagaagaccttcaagcacaggagccacctggtgcgccacatgtatgcccacagcggggagcaccacctgttccgctgcaatgtgtgtgagctgcacttcaaggagagcagcgagctgctgcagcacccctgcacccccagcggggagcggcccttccgctgtggggagtgccagaaggccttcaagaggcccagcgacctgcggcagcacgagaggacccacagcgctgagcggcccttcaagtgtgacctgtgccccatgggcttcaagcagcagtatgccctgatgaggcacaggaggacccacaagacagaggagcccttcaagtgtggcctgtgtgagaagggcttcggccagcccagccacctgctgtaccaccagcacgtgcacaccctggagaccctcttcaagtgccctgtgtgccagaagggctttgaccagagcgctgagctgctgcggcacaagtgcctgcctggagctgctgagcggcccttcaagtgccctgtgtgcaacaaggcctacaagagggccagcgccctgcagaagcaccagctggcccactgtgccgctgctgagaagcccctgcgctgcaccctgtgtgaaagacgcttcttcagcagcagcgagtttgtgcagcaccgctgtgaccctgcccgggagaagcccctgaagtgcccagactgtgagaagcgcttcaagtatgccagtgacctgcagaggcacagaagagtgcacactggagagaagccctacaagtgccccaactgtgacaaggccttcaagcagcgggagcacctgaacaagcaccagggcgtgcacgcccgggagcagcagttcaagtgtgtgtggtgtggggagcgcttcctggatgtggccctgctgcaggagcacagcgcccagcacagcgctgctgctgctgctgctgagggcgcctaccaggtggccgcctgcctgccctag

SEQ ID NO: 17768 - DNA, 1209 bp, Artificial Sequence
  Description of Artificial Sequence: Synthetic coding sequence
atgtacaccagcgaggagaagtgcaaccagaggacccagaagaggaagatctacaacgtgtgccccaggaagggcaagaagatcttcatccacatgcatgagatcatccagattgatggccacatctaccagtgcctggagtgcaagcagaacctgtgtgagaacctggccctgatcatgtgtgagaggacccacactggagagaagccctacaagtgtgacatgtgtgagaagacctttgtgcagagcagtgacctgaccagccaccagaggatccacaactatgagaagccctacaagtgcagcaaatgtgagaagagcttctggcaccacctggtgctgagcggccaccagaggacccacgccggcaagaagttctacacctgtgacatctgtgggaagaactttggccagagcagtgacctgctggtgcaccagaggagccacactggagagaagccctacctgtgcagtgaatgtgacaagtgcttcagccgcagcaccaacctgatccgccacaggaggacccacactggagagaagcccttcaagtgcctggagtgtgagaaggccttcagcggcaagagtgacctgatcagccaccagaggacccacactggagagcggccctacaagtgcaacaagtgtgagaagagctaccgccacaggtctgccttcatcgtgcacaagagggtgcacactggagagaagccctacaagtgtggggcctgtgagaagtgcttcggccagaagagtgacctgattgtgcaccagagggtgcacactggagagaagccctacaagtgcctggagtgcatgaggagcttcaccaggtctgccaacctgatccgccaccaggccacccacacccacaccttcaagtgcctggagtatgagaagagcttcaactgcagcagtgacctgattgtgcaccagaggatccacatggaggagaagccccaccagtggagcgcctgtgagagcggcttcctgctgggcatggactttgtggcccagcagaagatgaggacccagacagaggagctgcactacaagtacacagtgtgtgacaagagcttccaccagagcagcgccctgctgcagcaccagacagtgcgcatcggggagaagccctttgtgtgcaatgtgtctgagaagggcctggagctgagccccccccacgccagcgaggccagccagatgtcctag

SEQ ID NO: 17769 - DNA, 1662 bp, Artificial Sequence
  Description of Artificial Sequence: Synthetic coding sequence
atggcctttgaagatgtggccgtgtacttcagccaggaggagtggggcctgctggacacagcccagagggccctgtacagaagagtgatgctggacaactttgccctggtggccagcctgggcctgagcaccagccggccccgggtggtgatccagctggagcggggggaggagccctgggtgcccagcggcacagacaccaccctgagcaggaccacctacagaagaagaaatcctggctcctggagcctgacagaggacagagatgtgtctggagagtggccccgggccttcccagacaccccacctggcatgaccaccagcgtcttccctgtggccggggcctgccacagcgtgaagagcctgcagaggcagagaggagccagccccagccgggagaggaagcccactggagtgtctgtcatctactgggagcggctgctgctgggcagcggcagcggccaggcctctgtgtccctgcggctgaccagccccctgcggcccccagagggcgtgcggctgcgggagaagaccctgacagagcacgccctgctgggccggcagcccaggaccccagagcggcagaagccctgtgcccaggaggtgcccggccgcacctttggaagtgcccaggacctggaggccgccggcggccggggccaccacaggatgggcgctgtgtggcaggagccccaccggctgctgggcggccaggagcccagcacctgggatgagctgggggaggccctgcacgccggggagaagagctttgagtgccgggcctgcagcaaggtgtttgtgaagagcagtgacctgctgaagcacctgcggacccacactggagagcggccctatgaatgtgcccagtgtgggaaggccttcagccagaccagccacctgacccagcaccagaggatccacagcggggagaccccctatgcctgccctgtgtgtgggaaggccttccgccacagcagcagcctggtgcgccaccagaggatccacacagctgagaagagcttccgctgcagtgaatgtgggaaggccttcagccacggcagcaacctgagccagcacaggaagatccacgccggcggccggccctatgcctgtgcccagtgtggccgccgcttctgcaggaacagccacctgatccagcacgagaggacccacactggagagaagccctttgtgtgtgccctgtgtggggccgccttcagccagggcagcagcctcttcaagcaccagagggtgcacactggagagaagccctttgcctgcccccagtgtggccgggccttcagccacagcagcaacctgacccagcaccagctgctgcacactggagagcggcccttccgctgtgtggactgtgggaaggcctttgccaagggagctgtgctgctgagccaccggcgcatccacactggagagaagccctttgtgtgcacccagtgtggccgggccttccgggagaggcctgccctcttccaccaccagaggatccacactggagagaagacagtgcggcgcagccgggccagcctgcacccccaggcccggtctgtggccggggccagcagcgagggcgccccagccaaggagacagagcccaccccagccagcggccctgctgctgtgtcccagcctgctgaggtgtag

SEQ ID NO: 17770 - DNA, 861 bp, Artificial Sequence
  Description of Artificial Sequence: Synthetic coding sequence
atggcctttgaagatgtggccgtgtacttcagccaggaggagtggggcctgctggacacagcccagagggccctgtacagaagagtgatgctggacaactttgccctggtggccagcctgggcctgagcaccagccggccccgggtggtgatccagctggagcggggggaggagccctgggtgcccagcggcacagacaccaccctgagcaggaccacctacagaagaagaaatcctggctcctggagcctgacagaggacagagatgtgtctggagagtggccccgggccttcccagacaccccacctggcatgaccaccagcgtcttccctgtggccggggcctgccacagcgtgaagagcctgcagaggcagagaggagccagccccagccgggagaggaagcccactggagtgtctgtcatctactgggagcggctgctgctgggcagcggcagcggccaggcctctgtgtccctgcggctgaccagccccctgcggcccccagagggcgtgcggctgcgggagaagaccctgacagagcacgccctgctgggccggcagcccaggaccccagagcggcagaagccctgtgcccaggaggtgcccggccgcacctttggaagtgcccaggacctggaggccgccggcggccggggccaccacaggatgggcgctgtgtggcaggagccccaccggctgctgggcggccaggagcccagcacctgggatgagctgggggaggccctgcacgccggggagaagagctttgagtgccgggcctgcagcaaggtgtttgtgaagagcagtgacctgctgaagcacctgcggaccagggtgcggcagggcctgcctgcctag

SEQ ID NO: 17771 - DNA, 993 bp, Artificial Sequence
  Description of Artificial Sequence: Synthetic coding sequence
atgggcgctgtgtggcaggagccccaccggctgctgggcggccaggagcccagcacctgggatgagctgggggaggccctgcatgctggggagaagagctttgaatgtcgggcctgcagcaaggtgtttgtgaagagcagtgacctgctgaagcacctgcggacccacactggagagcggccctatgaatgtgcccagtgtgggaaggccttcagccagaccagccacctgacccagcaccagaggatccacagcggggagaccccctatgcctgccctgtgtgtgggaaggccttccgccacagcagcagcctggtgcgccaccagaggatccacacagctgagaagagcttccgctgcagtgaatgtgggaaggccttcagccacggcagcaacctgagccagcacaggaagatccatgctgggggccggccctatgcctgtgcccagtgtggccgccgcttctgcaggaacagccacctgatccagcacgagaggacccacactggagagaagccctttgtgtgtgccctgtgtggggccgccttcagccagggcagcagcctcttcaagcaccagagggtgcacactggagagaagccctttgcctgcccccagtgtggccgggccttcagccacagcagcaacctgacccagcaccagctgctgcacactggagagcggcccttccgctgtgtggactgtgggaaggcctttgccaagggagctgtgctgctgagccaccggcgcatccacactggagagaagccctttgtgtgcacccagtgtggccgggccttccgggagaggcctgccctcttccaccaccagaggatccacactggagagaagacagtgagaagaagccgggccagcctgcacccccaggcccggtctgtggccggggccagcagcgagggcgccccagccaaggagacagagcccaccccagccagcggccctgctgctgtgtcccagcctgctgaggtgtag

SEQ ID NO: 17772 - DNA, 1662 bp, Artificial Sequence; identical to SEQ ID NO: 17769
  Description of Artificial Sequence: Synthetic coding sequence

SEQ ID NO: 17773 - DNA, 1605 bp, Artificial Sequence
  Description of Artificial Sequence: Synthetic coding sequence
atgggcgtgcccagcgtggtgtctgccatccccatccgggctgactgcagcagcaagccccagcccctgctgcagggccagccccacctgtacttcagccccaagctgctgtgccagctgcggggcagcttcctgcctgtgcacagcgcctgccccggccccctgctgaccaggatgccccaggccaccaccgtgtccctgcccctgggctcctggagcctgacagaggacagagatgtgtctggagagtggccccgggccttcccagacaccccacctggcatgaccaccagcgtcttccctgtggccggggcctgccacagcgtgaagagcctgcagaggcagagaggagccagccccagccgggagaggaagcccactggagtgtctgtcatctactgggagcggctgctgctgggcagcggcagcggccaggcctctgtgtccctgcggctgaccagccccctgcggcccccagagggcgtgcggctgcgggagaagaccctgacagagcacgccctgctgggccggcagcccaggaccccagagcggcagaagccctgtgcccaggaggtgcccggccgcacctttggaagtgcccaggacctggaggccgccggcggccggggccaccacaggatgggcgctgtgtggcaggagccccaccggctgctgggcggccaggagcccagcacctgggatgagctgggggaggccctgcacgccggggagaagagctttgagtgccgggcctgcagcaaggtgtttgtgaagagcagtgacctgctgaagcacctgcggacccacactggagagcggccctatgaatgtgcccagtgtgggaaggccttcagccagaccagccacctgacccagcaccagaggatccacagcggggagaccccctatgcctgccctgtgtgtgggaaggccttccgccacagcagcagcctggtgcgccaccagaggatccacacagctgagaagagcttccgctgcagtgaatgtgggaaggccttcagccacggcagcaacctgagccagcacaggaagatccacgccggcggccggccctatgcctgtgcccagtgtggccgccgcttctgcaggaacagccacctgatccagcacgagaggacccacactggagagaagccctttgtgtgtgccctgtgtggggccgccttcagccagggcagcagcctcttcaagcaccagagggtgcacactggagagaagccctttgcctgcccccagtgtggccgggccttcagccacagcagcaacctgacccagcaccagctgctgcacactggagagcggcccttccgctgtgtggactgtgggaaggcctttgccaagggagctgtgctgctgagccaccggcgcatccacactggagagaagccctttgtgtgcacccagtgtggccgggccttccgggagaggcctgccctcttccaccaccagaggatccacactggagagaagacaggagaccccggccctgcctgcacccccaggcctggcctgctgcccggccaccaccagaaggtgcggcagaggaggaagcccagccccctgcccccccgggcccagccctag

SEQ ID NO: 17774 - DNA, 1635 bp, Artificial Sequence
  Description of Artificial Sequence: Synthetic coding sequence
atgacctttgaagatgtggccgtgtacttcagccaggaggagtggggcctgctggacacagcccagagggccctgtaccgccacgtgatgctggagaacttcaccctggtgaccagcctgggcctgagcaccagccggccccgggtggtgatccagctggagcggggggaggagccctgggtgcccagcggcaaggacatgaccctggccaggaacacctacggccgcctgaacagcggctcctggagcctgacagaggacagagatgtgtctggagagtggccccgggccttcccagacaccccacctggcatgaccaccagcgtcttccctgtggctgatgcctgccacagcgtgaagagcctgcagaggcagcccggggccagccccagccaggagaggaagcccactggagtgtctgtcatctactgggagcggctgctgctgggcagcagaagtgaccaggccagcatcagcctgcggctgaccagccccctgcggccccccaagagcagccggccccgggagaagaccttcacagagtacagagtgcccggccggcagcccaggaccccagagcggcagaagccctgtgcccaggaggtgcccggccgggcctttggaaatgccagtgacctgaaggccgccagcggcggccgggacaggaggatgggcgccgcctggcaggagccccaccggctgctgggcggccaggagcccagcacctgggatgagctgggggaggccctgcacgccggggagaagagctttgagtgccgggcctgcagcaaggtgtttgtgaagagcagtgacctgctgaagcacctgcggacccacactggagagcggccctatgagtgcacccagtgtgggaaggccttcagccagaccagccacctgacccagcaccagaggatccacagcggggagaccccctatgcctgccctgtgtgtgggaaggccttccgccacagcagcagcctggtgcgccaccagaggatccacacagctgagaagagcttccgctgcagtgaatgtgggaaggccttcagccacggcagcaacctgagccagcacaggaagatccacgccggcggccggccctatgcctgtgcccagtgtggccgccgcttctgcaggaacagccacctgatccagcacgagaggacccacactggagagaagccctttgtgtgtgccctgtgtggggccgccttcagccagggcagcagcctcttcctgcaccagagggtgcacactggagagaagccctttgcctgtgcccagtgtggccgctccttcagccgcagcagcaacctgacccagcaccagctgctgcacactggagagcggcccttccgctgtgtggactgtgggaagggctttgccaagggagctgtgctgctgagccaccggcgcatccacactggagagaagccctttgtgtgcacccagtgtggccgggccttccgggagaggcctgccctgctgcaccaccagaggatccacaccacagagaagaccaatgctgctgccccagactgcaccccaggccctggcttcctgcagggccaccacaggaaggtgcggcggggcggcaagcccagccctgtgctgaagccagccaaggtgtag

SEQ ID NO: 17775 - DNA, 1605 bp, Artificial Sequence
  Description of Artificial Sequence: Synthetic coding sequence
atgggcgtgcccacagctgtgtctgccacccctgtgcgggcagatgccagcagcaagccccagcccctgctgcagagccagccccacctgttcttcttccccaagctgctgagccggctgctgggcagccccctgcctgtgcacagcgcctgccccggccccctgctgaccaggatgccccaggccaccaccgtgtccctgcggctgggctcctggagcctgacagaggacagagatgtgtctggagagtggccccgggccttcccagacaccccacctggcatgaccaccagcgtcttccctgtggctgatgcctgccacagcgtgaagagcctgcagaggcagcccggggccagccccagccaggagaggaagcccactggagtgtctgtcatctactgggagcggctgctgctgggcagcagaagtgaccaggccagcatcagcctgcggctgaccagccccctgcggccccccaagagcagccggccccgggagaagaccttcacagagtacagagtgcccggccggcagcccaggaccccagagcggcagaagccctgtgcccaggaggtgcccggccgggcctttggaaatgccagtgacctgaaggccgccagcggcggccgggacaggaggatgggcgccgcctggcaggagccccaccggctgctgggcggccaggagcccagcacctgggatgagctgggggaggccctgcacgccggggagaagagctttgagtgccgggcctgcagcaaggtgtttgtgaagagcagtgacctgctgaagcacctgcggacccacactggagagcggccctatgagtgcacccagtgtgggaaggccttcagccagaccagccacctgacccagcaccagaggatccacagcggggagaccccctatgcctgccctgtgtgtgggaaggccttccgccacagcagcagcctggtgcgccaccagaggatccacacagctgagaagagcttccgctgcagtgaatgtgggaaggccttcagccacggcagcaacctgagccagcacaggaagatccacgccggcggccggccctatgcctgtgcccagtgtggccgccgcttctgcaggaacagccacctgatccagcacgagaggacccacactggagagaagccctttgtgtgtgccctgtgtggggccgccttcagccagggcagcagcctcttcctgcaccagagggtgcacactggagagaagccctttgcctgtgcccagtgtggccgctccttcagccgcagcagcaacctgacccagcaccagctgctgcacactggagagcggcccttccgctgtgtggactgtgggaagggctttgccaagggagctgtgctgctgagccaccggcgcatccacactggagagaagccctttgtgtgcacccagtgtggccgggccttccgggagaggcctgccctgctgcaccaccagaggatccacaccacagagaagaccaatgctgctgccccagactgcaccccaggccctggcttcctgcagggccaccacaggaaggtgcggcggggcggcaagcccagccctgtgctgaagccagccaaggtgtag

SEQ ID NO: 17776 - DNA, 1635 bp, Artificial Sequence; identical to SEQ ID NO: 17774
  Description of Artificial Sequence: Synthetic coding sequence

SEQ ID NO: 17777 - DNA, 1749 bp, Artificial Sequence
  Description of Artificial Sequence: Synthetic coding sequence
atggactttgaagatgactacacccacagcgcctgcaggaacacctaccagggcttcaacggcatggaccgggactatggccctggcagctatggaggcatggaccgggactatggccacggcagctatggaggccagaggtccatggacagctacctgaaccagagctatggcatggacaaccacagcggcggcggcggcggcagcagatttggcccctatgagagctatgacagccgcagcagcctgggcggccgggacctgtacagaagtggctacggcttcaatgaacctgagcagagcagatttggaggcagctatggaggccgctttgagagcagctacagaaacagcctggacagctttggaggaagaaaccagggcggcagctcctgggaggccccctacagccgcagcaagctgcggcccggcttcatggaggaccggggccgggagaactacagcagctacagcagcttcagcagcccccacatgaagccagcccctgtgggcagccggggccggggcaccccagcctacccagagagcaccttcggcagcaggaactatgatgcctttggaggccccagcacaggccggggccggggccggggccacatgggagactttggcagcatccaccggcccggcatcgtggtggactaccagaacaagagcaccaacgtgacagtggccgccgcccggggcatcaagaggaagatgatgcagcccttcaacaagcccagcggcaccttcatcaagaagcccaagctggccaagcccatggagaagatcagcctgagcaagagccccaccaagacagaccccaagaatgaggaggaggagaagaggcgcatcgaggcccggcgggagaagcagaggagaagaagagagaagaacagcgagaagtatggagatggctacaggatggccttcacctgcagcttctgcaagttccgcacctttgaggagaaggacatcgagctgcacctggagagcagcagccaccaggagaccctggaccacatccagaagcagaccaagtttgacaaggtggtgatggagttcctgcacgagtgcatggtgaacaagttcaagaagaccagcatcaggaagcagcagaccaacaaccagacagaggtggtgaagatcatcgagaaggatgtgatggagggcgtgacagtggatgaccacatgatgaaggtggagaccgtgcactgcagcgcctgcagcgtgtacatcccagccctgcacagctctgtgcagcagcacctgaagagcccagaccacatcaagggcaagcaggcctacaaggagcagatcaagcgggagagcgtgctgacagccaccagcatcctgaacaaccccatcgtgaaggcccgctatgaaagatttgtgaagggggagaacccctttgagatccaggaccacagccaggaccagcagattgaaggagatgaggaggatgaggagaagattgatgagcccatcgaggaggaggaggatgaagatgaggaggaggaggccgaggaggtgggggaggtggaggaggtggaggaggtggaggaggtgcgggagggcggcattgaaggagagggcaacatccagggcgtgggggagggcggggaggtgggcgtggtgggggaggtggagggcgtgggggaggtggaggaggtggaggagctggaggaggagacagccaaggaggagcctgctgacttccctgtggagcagccagaagaaaattag

SEQ ID NO: 17778 - DNA, 213 bp, Artificial Sequence
  Description of Artificial Sequence: Synthetic coding sequence
atggactttgaagatgactacacccacagcgcctgcaggaacacctaccagggcttcaacggcatggaccgggactatggccctggcagctatggaggcatggaccgggactatggccacggcagctatggaggccagaggtccatggacagctacctgaaccagagctatggcatggacaaccacagcggcggcggcggcggcagcaggtag

SEQ ID NO: 17779 - DNA, 1482 bp, Artificial Sequence
  Description of Artificial Sequence: Synthetic coding sequence
atggactttgaagatgactacacccacagcgcctgcaggaacacctaccagggcttcaacggcatggaccgggactatggccctggcagctatggaggcatggaccgggactatggccacggcagctatggaggccagaggtccatggacagctacctgaaccagagctatggcatggacaaccacagcggcggcggcggcggcagcagcttcagcagcccccacatgaagccagcccctgtgggcagccggggccggggcaccccagcctacccagagagcaccttcggcagcagaaattatgatgccttcggcggccccagcacaggccggggccggggccggggccacatgggagactttggcagcatccacaggcctggcatcgtggtggactaccagaacaagagcaccaacgtgacagtggccgccgcccggggcatcaagaggaagatgatgcagcccttcaacaagcccagcggcaccttcatcaagaagcccaagctggccaagcccatggagaagatcagcctgagcaagagccccaccaagacagaccccaagaatgaggaggaggagaagagaagaattgaggcccggcgggagaagcagaggagaagaagagagaagaacagcgagaagtatggagatggctacaggatggccttcacctgcagcttctgcaagttccgcacctttgaggagaaggacatcgagctgcacctggagagcagcagccaccaggagaccctggaccacatccagaagcagaccaagtttgacaaggtggtgatggagttcctgcacgagtgcatggtgaacaagttcaagaagaccagcatcaggaagcagcagaccaacaaccagacagaggtggtgaagatcatcgagaaggatgtgatggagggcgtgacagtggatgaccacatgatgaaggtggagaccgtgcactgcagcgcctgcagcgtgtacatcccagccctgcacagctctgtgcagcagcacctgaagagcccagaccacatcaagggcaagcaggcctacaaggagcagatcaagcgggagagcgtgctgacagccaccagcatcctgaacaaccccatcgtgaaggcccgctatgaaagatttgtgaagggggagaacccctttgagatccaggaccacagccaggaccagcagatcgagggagatgaagaagatgaggagaagattgatgagcccatcgaggaggaggaggatgaagatgaggaggaggaggccgaggaggtgggggaggtggaggaggtggaggaggtggaggaggtgcgggagggcggcatcgagggggagggcaacatccagggcgtgggggagggcggggaggtgggcgtggtgggggaggtggagggcgtgggggaggtggaggaggtggaggagctggaggaggagacagccaaggaggagcctgctgacttccctgtggagcagcctgaggagaactag

SEQ ID NO: 17780 - DNA, 1749 bp, Artificial Sequence
  Description of Artificial Sequence: Synthetic coding sequence
atgatgttcaacagagactacacccacagcgcctgcaggaacacctaccagggcttcaacggcatggaccgggactatggccctggcagctatggaggcatggaccgggactatggccacggcagctatggaggccagaggtccatggacagctacctgaaccagagctatggcatggacaaccacagcggcggcggcggcggcagcagatttggcccctatgagagctatgacagccgcagcagcctgggcggccgggacctgtacagaagtggctacggcttcaatgaacctgagcagagcagatttggaggcagctatggaggccgctttgagagcagctacagaaacagcctggacagctttggaggaagaaaccagggcggcagctcctgggaggccccctacagccgcagcaagctgcggcccggcttcatggaggaccggggccgggagaactacagcagctacagcagcttcagcagcccccacatgaagccagcccctgtgggcagccggggccggggcaccccagcctacccagagagcaccttcggcagcaggaactatgatgcctttggaggccccagcacaggccggggccggggccggggccacatgggagactttggcagcatccaccggcccggcatcgtggtggactaccagaacaagagcaccaacgtgacagtggccgccgcccggggcatcaagaggaagatgatgcagcccttcaacaagcccagcggcaccttcatcaagaagcccaagctggccaagcccatggagaagatcagcctgagcaagagccccaccaagacagaccccaagaatgaggaggaggagaagaggcgcatcgaggcccggcgggagaagcagaggagaagaagagagaagaacagcgagaagtatggagatggctacaggatggccttcacctgcagcttctgcaagttccgcacctttgaggagaaggacatcgagctgcacctggagagcagcagccaccaggagaccctggaccacatccagaagcagaccaagtttgacaaggtggtgatggagttcctgcacgagtgcatggtgaacaagttcaagaagaccagcatcaggaagcagcagaccaacaaccagacagaggtggtgaagatcatcgagaaggatgtgatggagggcgtgacagtggatgaccacatgatgaaggtggagaccgtgcactgcagcgcctgcagcgtgtacatcccagccctgcacagctctgtgcagcagcacctgaagagcccagaccacatcaagggcaagcaggcctacaaggagcagatcaagcgggagagcgtgctgacagccaccagcatcctgaacaaccccatcgtgaaggcccgctatgaaagatttgtgaagggggagaacccctttgagatccaggaccacagccaggaccagcagattgaaggagatgaggaggatgaggagaagattgatgagcccatcgaggaggaggaggatgaagatgaggaggaggaggccgaggaggtgggggaggtggaggaggtggaggaggtggaggaggtgcgggagggcggcattgaaggagagggcaacatccagggcgtgggggagggcggggaggtgggcgtggtgggggaggtggagggcgtgggggaggtggaggaggtggaggagctggaggaggagacagccaaggaggagcctgctgacttccctgtggagcagccagaagaaaattag

SEQ ID NO: 17781 - DNA, 1131 bp, Artificial Sequence
  Description of Artificial Sequence: Synthetic coding sequence
atgggagactttggcagcatccaccggcccggcatcgtggtggactaccagaacaagagcaccaacgtgacagtggccgccgcccggggcatcaagaggaagatgatgcagcccttcaacaagcccagcggcaccttcatcaagaagcccaagctggccaagcccatggagaagatcagcctgagcaagagccccaccaagacagaccccaagaatgaggaggaggagaagaggcgcatcgaggcccggcgggagaagcagaggagaagaagagagaagaacagcgagaagtatggagatggctacaggatggccttcacctgcagcttctgcaagttccgcacctttgaggagaaggacatcgagctgcacctggagagcagcagccaccaggagaccctggaccacatccagaagcagaccaagtttgacaaggtggtgatggagttcctgcacgagtgcatggtgaacaagttcaagaagaccagcatcaggaagcagcagaccaacaaccagacagaggtggtgaagatcatcgagaaggatgtgatggagggcgtgacagtggatgaccacatgatgaaggtggagaccgtgcactgcagcgcctgcagcgtgtacatcccagccctgcacagctctgtgcagcagcacctgaagagcccagaccacatcaagggcaagcaggcctacaaggagcagatcaagcgggagagcgtgctgacagccaccagcatcctgaacaaccccatcgtgaaggcccgctatgaaagatttgtgaagggggagaacccctttgagatccaggaccacagccaggaccagcagattgaaggagatgaggaggatgaggagaagattgatgagcccatcgaggaggaggaggatgaagatgaggaggaggaggccgaggaggtgggggaggtggaggaggtggaggaggtggaggaggtgcgggagggcggcattgaaggagagggcaacatccagggcgtgggggagggcggggaggtgggcgtggtgggggaggtggagggcgtgggggaggtggaggaggtggaggagctggaggaggagacagccaaggaggagcctgctgacttccctgtggagcagccagaagaaaattag

SEQ ID NO: 17782 - DNA, 1626 bp, Artificial Sequence
  Description of Artificial Sequence: Synthetic coding sequence
atgaggctgaagatgaccaccaggaacttccctgagcgggaggtgccctgtgatgtggaggtggagcgcttcacccgggaggtgccctgcctgagcagcctgggagatggctgggactgtgagaaccaggagggccacctgcggcagagcgccctgaccctggagaagccaggcacccaggaggccatctgtgagtacccaggctttggagagcacctgattgccagcagtgacctgccccccagccagagggtgctggccaccaacggcttccacgccccagacagcaatgtgtctggcctggactgtgaccctgccctgcccagctaccccaagagctatgctgacaagaggactggagacagtgatgcctgtgggaagggcttcaaccacagcatggaggtgattcatggaagaaatcctgtgcgggagaagccctacaagtacccagagagcgtgaagagcttcaaccacttcaccagcctgggccaccagaagatcatgaagaggggcaagaagagctatgagggcaagaactttgagaacatcttcaccctgagcagcagcctgaatgaaaaccagaggaacctgcccggggagaagcagtaccgctgcacagaatgtgggaagtgcttcaagaggaacagcagcctggtgctgcaccacaggacccacactggagagaagccctacacctgcaatgaatgtgggaagagcttcagcaagaactacaacctgattgtgcaccagaggatccacactggagagaagccctatgagtgcagcaaatgtgggaaggccttcagtgatggcagcgccctgacccagcaccagaggatccacactggagagaagccctatgagtgcctggagtgtgggaagaccttcaacagaaacagcagcctcatcctgcaccagaggacccacactggagagaagccctaccgctgcaatgaatgtgggaagcccttcacagacatcagccacctgactgtgcacctgcgcatccacactggagagaagccctatgagtgcagcaaatgtgggaaggccttcagagatggcagctacctgacccagcacgagaggacccacactggagagaagccctttgaatgtgctgaatgtgggaagagcttcaacagaaacagccacctgattgtgcaccagaagatccacagcggggagaagccctatgagtgcaaggaatgtgggaagaccttcattgaaagtgcctacctgatccgccaccagaggatccacactggagagaagccctacggctgcaaccagtgccagaagctgttcagaaatattgctggcctcatccgccaccagaggacccacactggagagaagccctatgagtgcaaccagtgtgggaaggccttccgggacagcagctgcctgaccaagcaccagaggatccacaccaaggagaccccctaccagtgcccagaatgtgggaagagcttcaagcagaacagccacctggccgtgcaccagaggctgcacagccgggagggccccagccgctgcccccagtgtgggaagatgttccagaagagcagcagcctggtgcgccaccagagggcccacctgggggagcagcccatggagacctag

SEQ ID NO: 17783 - DNA, 1626 bp, Artificial Sequence; identical to SEQ ID NO: 17782
  Description of Artificial Sequence: Synthetic coding sequence

SEQ ID NO: 17784 - DNA, 1626 bp, Artificial Sequence; identical to SEQ ID NO: 17782
  Description of Artificial Sequence: Synthetic coding sequence

SEQ ID NO: 17785 - DNA, 2043 bp, Artificial Sequence
  Description of Artificial Sequence: Synthetic coding sequence
atgaagatgaagaagttccagatccctgtgtccttccaggacctgactgtgaacttcacccaggaggagtggcagcagctggaccctgcccagaggctgctgtacagagatgtgatgctggagaactacagcaacctggtgtctgtgggctaccacgtgtccaagccagatgtgatcttcaagctggagcagggcgaggagccctggatcgtggaggagttcagcaaccagaactacccagacattgatgatgccctggagaagaacaaggagatccaggacaagcacctgacccagaccgtcttcttcagcaacaagaccctcatcacagaaagagaaaatgtgtttgggaagaccctgaacctgggcatgaacagcgtgcccagcaggaagatgccctacaagtgcaaccctgggggcaacagcctgaagaccaacagcgaggtgattgtggccaagaagagcaaagaaaataggaagatcccagatggctacagcggctttgggaagcatgagaagagccacctgggcatgaagaagtaccgctacaaccccatgaggaaggccagcaaccagaatgaaaacctgatcctgcaccagaacatccagatcctgaagcagccctttgactacaacaagtgtgggaagaccttcttcaagagggccatcctgatcacccagaagggccggcagacagagaggaagcccaatgaatgtaatgaatgtaggaagaccttcagcaagaggagcaccctgattgtgcaccagaggatccacactggagagaagccctacgtgtgcagcgactgcaggaagaccttccgggtgaagaccagcctgaccaggcaccggcgcatccacactggagagcggccctatgagtgcagtgaatgtaggaagaccttcatcgacaagagcgccctgattgtgcaccagaagatccatggaggagagaagagctatgagtgcaatgaatgtgggaagaccttcttcaggaagagcgccctggccgagcacttccgcagccacactggagagaagccctatgagtgcaaggaatgtggaaatgccttcagcaagaagagctacctggtggtgcaccagaggacccacagaggagagaagcccaatgaatgcaaggaatgtgggaagaccttcttctgccagagcgccctgacagcccaccagaggatccacactggagagaagccctatgagtgcagtgaatgtgagaagaccttcttctgccagagcgccctgaatgtgcaccggcgcagccacactggagagaagccctatgagtgcagccagtgtgggaagttcctgtgcaccaagagcgccctgattgcccaccagatcacccaccggggcaagaagagctatgagtgcaatgaatgtgggaagttcttctgccacaagagcaccctgaccatccaccagaggacccacactggagagaagcacggcgtcttcaacaagtgtggccgcatcagcatcgtgaagagcaactgcagccagtgcaagaggatgaacaccaaggagaacctgtatgagtgcagcgagcacggccatgctgtgtccaagaacagccacctgattgtgcaccagaggaccatctgggagcggccctatgaatgtaatgaatgtggccgcacctactgcaggaagagcgccctgacccaccaccagaggacccacacaggccagaggccctatgaatgtaatgaatgtgggaagaccttctgccagaagttctcctttgtggagcaccagaggacccacactggagagaagccctatgaatgtaatgaatgtgggaagagcttctgccacaagagcgccttccgggtgcaccggcgcatccacactggagagaagccctatgagtgcaaccagtgtgggaagacctaccgccgcctgtggaccctgacagagcaccagaagatccacactggagagaagccctatgagtgcaacaagtgtgagaagaccttccgccacaagagcaacttcctgctgcaccagaagagccacaaggagtag

SEQ ID NO: 17786 - DNA, 1929 bp, Artificial Sequence
  Description of Artificial Sequence: Synthetic coding sequence
atgctggagaactacagcaacctggtgtctgtgggctaccacgtgtccaagccagatgtgatcttcaagctggagcagggcgaggagccctggatcgtggaggagttcagcaaccagaactacccagacattgatgatgccctggagaagaacaaggagatccaggacaagcacctgacccagaccgtcttcttcagcaacaagaccctcatcacagaaagagaaaatgtgtttgggaagaccctgaacctgggcatgaacagcgtgcccagcaggaagatgccctacaagtgcaaccctgggggcaacagcctgaagaccaacagcgaggtgattgtggccaagaagagcaaagaaaataggaagatcccagatggctacagcggctttgggaagcatgagaagagccacctgggcatgaagaagtaccgctacaaccccatgaggaaggccagcaaccagaatgaaaacctgatcctgcaccagaacatccagatcctgaagcagccctttgactacaacaagtgtgggaagaccttcttcaagagggccatcctgatcacccagaagggccggcagacagagaggaagcccaatgaatgtaatgaatgtaggaagaccttcagcaagaggagcaccctgattgtgcaccagaggatccacactggagagaagccctacgtgtgcagcgactgcaggaagaccttccgggtgaagaccagcctgaccaggcaccggcgcatccacactggagagcggccctatgagtgcagtgaatgtaggaagaccttcatcgacaagagcgccctgattgtgcaccagaagatccatggaggagagaagagctatgagtgcaatgaatgtgggaagaccttcttcaggaagagcgccctggccgagcacttccgcagccacactggagagaagccctatgagtgcaaggaatgtggaaatgccttcagcaagaagagctacctggtggtgcaccagaggacccacagaggagagaagcccaatgaatgcaaggaatgtgggaagaccttcttctgccagagcgccctgacagcccaccagaggatccacactggagagaagccctatgagtgcagtgaatgtgagaagaccttcttctgccagagcgccctgaatgtgcaccggcgcagccacactggagagaagccctatgagtgcagccagtgtgggaagttcctgtgcaccaagagcgccctgattgcccaccagatcacccaccggggcaagaagagctatgagtgcaatgaatgtgggaagttcttctgccacaagagcaccctgaccatccaccagaggacccacactggagagaagcacggcgtcttcaacaagtgtggccgcatcagcatcgtgaagagcaactgcagccagtgcaagaggatgaacaccaaggagaacctgtatgagtgcagcgagcacggccatgctgtgtccaagaacagccacctgattgtgcaccagaggaccatctgggagcggccctatgaatgtaatgaatgtggccgcacctactgcaggaagagcgccctgacccaccaccagaggacccacacaggccagaggccctatgaatgtaatgaatgtgggaagaccttctgccagaagttctcctttgtggagcaccagaggacccacactggagagaagccctatgaatgtaatgaatgtgggaagagcttctgccacaagagcgccttccgggtgcaccggcgcatccacactggagagaagccctatgagtgcaaccagtgtgggaagacctaccgccgcctgtggaccctgacagagcaccagaagatccacactggagagaagccctatgagtgcaacaagtgtgagaagaccttccgccacaagagcaacttcctgctgcaccagaagagccacaaggagtag

SEQ ID NO: 17787 - DNA, 2256 bp, Artificial Sequence
  Description of Artificial Sequence: Synthetic coding sequence
atgggcccccagggcgcccggcggcaggccttcctggcctttggagatgtgacagtggacttcacccagaaggagtggaggctgctgagccctgcccagagggccctgtaccgggaggtgaccctggagaactacagccacctggtgtccctgggcatcctgcacagcaagccagagctgatccggcggctggagcagggcgaggtgccctggggcgaggagaggagaagaagacctggcccctgtgccggcatctatgcagagcacgtgctgcggcccaagaacctgggcctggcccaccagaggcagcagcagctgcagttcagtgaccagagcttccagagcgacacagctgagggccaggagaaggagaagagcaccaagcccatggccttcagcagcccccccctgcggcatgctgtgagcagcagaagaagaaacagcgtggtggagattgagagcagccagggccagcgggagaaccccacagaaattgacaaggtgctgaagggcatcgagaacagccgctggggcgccttcaagtgtgccgagcggggccaggacttcagcaggaagatgatggtgatcatccacaagaaggcccacagccggcagaagctgttcacctgccgggagtgccaccagggcttcagagatgaaagtgccctgctgctgcaccagaacacccacactggagagaagagctatgtgtgcagcgtgtgtggccggggcttcagcctgaaggccaacctgctgcggcaccagaggacccacagcggggagaagcccttcctgtgcaaggtgtgtggccggggctacaccagcaagagctacctgactgtgcatgagaggacccacactggagagaagccctatgagtgccaggagtgtggccgccgcttcaatgacaagagcagctacaacaagcacctgaaggcccacagcggggagaagccctttgtgtgcaaggaatgtggccggggctacaccaacaagagctactttgtggtgcacaagaggatccacagcggggagaagccctaccgctgccaggagtgtggccggggcttcagcaacaagagccacctgatcacccaccagaggacccacagcggggagaagccctttgcctgccggcagtgcaagcagagcttctctgtgaagggcagcctgctgcggcaccagaggacccacagcggggagaagccctttgtgtgcaaggactgtgagaggagcttcagccagaagagcaccctggtgtaccaccagaggacccacagcggggagaagccctttgtgtgccgggagtgtggccagggcttcatccagaagagcaccctggtgaagcaccagatcacccacagcgaggagaagccctttgtgtgcaaggactgtggccggggcttcatccagaagagcaccttcaccctgcaccagaggacccacagcgaggagaagccctacggctgccgggagtgtggccgccgcttccgggacaagagcagctacaacaagcacctgcgggcccacctgggggagaagcgcttcttctgccgggactgtggccggggcttcaccctgaagcccaacctgaccatccaccagaggacccacagcggggagaagcccttcatgtgcaagcagtgtgagaagagcttcagcctgaaggccaacctgctgcggcaccagtggacccacagcggggagcggcccttcaactgcaaggactgtggccggggcttcatcctgaagagcaccctgctcttccaccagaagacccacagcggggagaagcccttcatctgcagtgaatgtggccagggcttcatctggaagagcaacctggtgaagcaccagctggcccacagcggcaagcagccctttgtgtgcaaggaatgtggccggggcttcaactggaagggcaacctgctgacccaccagaggacccacagcggggagaagccctttgtgtgcaatgtgtgtggccagggcttctcctggaagaggagcctgaccaggcaccactggaggatccacagcaaggagaagccctttgtgtgccaggagtgcaagaggggctacaccagcaagagtgacctgactgtgcatgagcgcatccacactggagagcggccctatgagtgccaggagtgtggcaggaagttcagcaacaagagctactacagcaagcacctgaagaggcacctgcgggagaagcgcttctgcaccggctctgtgggggaggccagcagctag

SEQ ID NO: 17788 - DNA, 1920 bp, Artificial Sequence
  Description of Artificial Sequence: Synthetic coding sequence
atgggcccccagggcgcccggcggcaggccttcctggcctttggagatgtgacagtggacttcacccagaaggagtggaggctgctgagccctgcccagagggccctgtaccgggaggtgaccctggagaactacagccacctggtgtccctgggcatcctgcacagcaagccagagctgatccggcggctggagcagggcgaggtgccctggggcgaggagaggagaagaagacctggcccctgtgccggcatctatgcagagcacgtgctgcggcccaagaacctgggcctggcccaccagaggcagcagcagctgcagttcagtgaccagagcttccagagcgacacagctgagggccaggagaaggagaagagcaccaagcccatggccttcagcagcccccccctgcggcatgctgtgagcagcagaagaagaaacagcgtggtggagattgagagcagccagggccagcgggagaaccccacagaaattgacaaggtgctgaagggcatcgagaacagccgctggggcgccttcaagtgtgccgagcggggccaggacttcagcaggaagatgatggtgatcatccacaagaaggcccacagccggcagaagctgttcacctgccgggagtgccaccagggcttcagagatgaaagtgccctgctgctgcaccagaacacccacactggagagaagagctatgtgtgcagcgtgtgtggccggggcttcagcctgaaggccaacctgctgcggcaccagaggacccacagcggggagaagcccttcctgtgcaaggtgtgtggccggggctacaccagcaagagctacctgactgtgcatgagaggacccacactggagagaagccctatgagtgccaggagtgtggccgccgcttcaatgacaagagcagctacaacaagcacctgaaggcccacagcggggagaagccctttgtgtgcaaggaatgtggccggggctacaccaacaagagctactttgtggtgcacaagaggatccacagcggggagaagccctaccgctgccaggagtgtggccggggcttcagcaacaagagccacctgatcacccaccagaggacccacagcggggagaagccctttgcctgccggcagtgcaagcagagcttctctgtgaagggcagcctgctgcggcaccagaggacccacagcggggagaagccctttgtgtgcaaggactgtgagaggagcttcagccagaagagcaccctggtgtaccaccagaggacccacagcggggagaagccctttgtgtgccgggagtgtggccagggcttcatccagaagagcaccctggtgaagcaccagatcacccacagcgaggagaagccctttgtgtgcaaggactgtggccggggcttcatccagaagagcaccttcaccctgcaccagaggacccacagcgaggagaagccctacggctgccgggagtgtggccgccgcttccgggacaagagcagctacaacaagcacctgcgggcccacctgggggagaagcgcttcttctgccgggactgtggccggggcttcaccctgaagcccaacctgaccatccaccagaggacccacagcggggagaagccctttgtgtgcaatgtgtgtggccagggcttctcctggaagaggagcctgaccaggcaccactggaggatccacagcaaggagaagccctttgtgtgccaggagtgcaagaggggctacaccagcaagagtgacctgactgtgcatgagcgcatccacactggagagcggccctatgagtgccaggagtgtggcaggaagttcagcaacaagagctactacagcaagcacctgaagaggcacctgcgggagaagcgcttctgcaccggctctgtgggggaggccagcagctag

SEQ ID NO: 17789 - DNA, 2256 bp, Artificial Sequence; identical to SEQ ID NO: 17787
  Description of Artificial Sequence: Synthetic coding sequence

SEQ ID NO: 17790 - DNA, 2160 bp, Artificial Sequence
  Description of Artificial Sequence: Synthetic coding sequence
atgggcccccagggcgcccggcggcaggccttcctggcctttggagatgtgacagtggacttcacccagaaggagtggaggctgctgagccctgcccagagggccctgtaccgggaggtgaccctggagaactacagccacctggtgtccctgggcatctatgcagagcacgtgctgcggcccaagaacctgggcctggcccaccagaggcagcagcagctgcagttcagtgaccagagcttccagagcgacacagctgagggccaggagaaggagaagagcaccaagcccatggccttcagcagcccccccctgcggcatgctgtgagcagcagaagaagaaacagcgtggtggagattgagagcagccagggccagcgggagaaccccacagaaattgacaaggtgctgaagggcatcgagaacagccgctggggcgccttcaagtgtgccgagcggggccaggacttcagcaggaagatgatggtgatcatccacaagaaggcccacagccggcagaagctgttcacctgccgggagtgccaccagggcttcagagatgaaagtgccctgctgctgcaccagaacacccacactggagagaagagctatgtgtgcagcgtgtgtggccggggcttcagcctgaaggccaacctgctgcggcaccagaggacccacagcggggagaagcccttcctgtgcaaggtgtgtggccggggctacaccagcaagagctacctgactgtgcatgagaggacccacactggagagaagccctatgagtgccaggagtgtggccgccgcttcaatgacaagagcagctacaacaagcacctgaaggcccacagcggggagaagccctttgtgtgcaaggaatgtggccggggctacaccaacaagagctactttgtggtgcacaagaggatccacagcggggagaagccctaccgctgccaggagtgtggccggggcttcagcaacaagagccacctgatcacccaccagaggacccacagcggggagaagccctttgcctgccggcagtgcaagcagagcttctctgtgaagggcagcctgctgcggcaccagaggacccacagcggggagaagccctttgtgtgcaaggactgtgagaggagcttcagccagaagagcaccctggtgtaccaccagaggacccacagcggggagaagccctttgtgtgccgggagtgtggccagggcttcatccagaagagcaccctggtgaagcaccagatcacccacagcgaggagaagccctttgtgtgcaaggactgtggccggggcttcatccagaagagcaccttcaccctgcaccagaggacccacagcgaggagaagccctacggctgccgggagtgtggccgccgcttccgggacaagagcagctacaacaagcacctgcgggcccacctgggggagaagcgcttcttctgccgggactgtggccggggcttcaccctgaagcccaacctgaccatccaccagaggacccacagcggggagaagcccttcatgtgcaagcagtgtgagaagagcttcagcctgaaggccaacctgctgcggcaccagtggacccacagcggggagcggcccttcaactgcaaggactgtggccggggcttcatcctgaagagcaccctgctcttccaccagaagacccacagcggggagaagcccttcatctgcagtgaatgtggccagggcttcatctggaagagcaacctggtgaagcaccagctggcccacagcggcaagcagccctttgtgtgcaaggaatgtggccggggcttcaactggaagggcaacctgctgacccaccagaggacccacagcggggagaagccctttgtgtgcaatgtgtgtggccagggcttctcctggaagaggagcctgaccaggcaccactggaggatccacagcaaggagaagccctttgtgtgccaggagtgcaagaggggctacaccagcaagagtgacctgactgtgcatgagcgcatccacactggagagcggccctatgagtgccaggagtgtggcaggaagttcagcaacaagagctactacagcaagcacctgaagaggcacctgcgggagaagcgcttctgcaccggctctgtgggggaggccagcagctag

SEQ ID NO: 17791 - DNA, 2544 bp, Artificial Sequence
  Description of Artificial Sequence: Synthetic coding sequence
atggcccaggccatctttgaggccctggagggcatggacaaccagacagtgctggccgtgcagagcctgctggatggccagggcgctgtgcctgaccccaccggccagagcgtgaatgcccccccagccatccagcccctggatgatgaagatgtgttcctgtgtgggaagtgcaagaagcagttcaacagcctgcctgccttcatgacccacaagcgggagcagtgccagggcaatgccccagccctggccaccgtgtccctggccaccaacagcatctacccaccttctgctgcccccacagctgtgcagcaggcccccaccccagccaaccggcagatcagcacctacatcaccgtgccccccagccccctcatccagaccctggtgcagggcaacatcctggtgtctgatgatgtgctgatgtctgccatgtctgccttcaccagcctggaccagcccatgccccagggccccccacctgtgcagagcagcctgaacatgcacagcgtgcccagctacctgacccagcccccacctcctcctcctcctcctccacccctgcccccacctcctccaccccagcccccacctcctccaccccagagcctgggccccccaggccggcccaaccctggaggaaatggagtggtggaggtgtacagcgctgctgcccccctggccggcagcggcaccgtggagatccaggccctgggcatgcagccctacccacccctggaggtgcccaaccagtgtgtggagccccctgtgtaccccacccccaccgtgtacagccctgggaagcagggcttcaagcccaagggccccaacccagctgcccccatgaccagcgccaccggcggcaccgtggccacctttgacagccctgccaccctgaagacccggcgggccaaggctgctgggaagcccaaggcccagaagctgaagtgcagctactgtgacaagagcttcaccaagaactttgacctgcagcagcacatccgcagccacactggagagaagcccttccagtgcatcgcctgtggccgggcctttgcccagaagagcaatgtgaagaagcacatgcagacccacaaggtgtggcccccaggccacagcggcggcaccgtgtccagaaattctgtgacagtgcaggtgatggccctgaaccccagccggcaggaggatgaggagagcacaggcctgggccagcccctgcccggggccccccagccccaggccctgagcacagctggggaggaggagggggacaagccagagagcaagcaggtggtgctgattgacagcagctacctgtgccagttctgccccagcaagttcagcacctacttccagctgaagagccacatgacccagcacaagaatgagcaggtgtacaagtgtgtggtgaagagctgtgcccagaccttccccaagctggacaccttcctggagcacatcaagagccaccaggaggagctgagctaccgctgccacctgtgtgggaaggacttccccagcctgtatgacctgggcgtgcaccagtacagccacagcctgctgccccagcacagccccaagaaggacaatgctgtgtacaagtgtgtgaagtgtgtgaacaagtacagcaccccagaggccctggagcaccacctgcagacagccacccacaacttcccctgcccccactgccagaaggtgttcccctgtgagcgctacctgcggcggcacctgcccacccacggcagcggcggccgcttcaagtgccaggtgtgcaagaagttcttcagaagagagcactacctgaagctgcacgcccacatccacagcggggagaagccctacaagtgcagcgtgtgtgagagcgccttcaacaggaaggacaagctgaagaggcacatgctgattcatgagcccttcaagaagtacaagtgccccttcagcacccacacaggctgcagcaaggagttcaacagaccagacaagctgaaggcccacatcctgagccacagcggcatgaagctgcacaagtgtgccctgtgcagcaagagcttcagcagaagagcccacctggccgagcaccagagggcccacactggaaactacaagttccgctgtgccggctgtgccaagggcttcagccgccacaagtacctgaaggaccaccgctgccgcctgggcccccagaaggacaaggacctgcagaccaggaggcctccccagaggcgggccgcccccaggagctgtggcagcggcggcaggaaggtgctgacccccctgcctgaccccctgggcctggaggagctgaaggacaccggggccggcctggtgcctgaggccgtgcctgggaagcccccatttgctgagccagatgctgtgctgagcatcgtggtgggcggcgctgtgggcgctgagacagagctggtggtgcccggccacgccgagggcctgggcagcaacctggccctggccgagctgcaggccggggctgagggcccctgtgccatgctggccgtgcctgtgtacatccaggccagcgagtag

SEQ ID NO: 17792 - DNA, 2565 bp, Artificial Sequence
  Description of Artificial Sequence: Synthetic coding sequence
atggcccaggccatctttgaggccctggagggcatggacaaccagacagtgctggccgtgcagagcctgctggatggccagggcgctgtgcctgaccccaccggccagagcgtgaatgcccccccagccatccagcccctggatgatgaagatgtgttcctgtgtgggaagtgcaagaagcagttcaacagcctgcctgccttcatgacccacaagcgggagcagtgccagggcaatgccccagccctggccaccgtgtccctggccaccaacagcatctacccaccttctgctgcccccacagctgtgcagcaggcccccaccccagccaaccggcagatcagcacctacatcaccgtgccccccagccccctcatccagaccctggtgcagggcaacatcctggtgtctgatgatgtgctgatgtctgccatgtctgccttcaccagcctggaccagcccatgccccagggccccccacctgtgcagagcagcctgaacatgcacagcgtgcccagctacctgacccagcccccacctcctcctcctcctcctccacccctgcccccacctcctccaccccagcccccacctcctccaccccagagcctgggccccccaggccggcccaaccctggaggaaatggagtggtggaggtgtacagcgctgctgcccccctggccggcagcggcaccgtggagatccaggccctgggcatgcagccctacccacccctggaggtgcccaaccagtgtgtggagccccctgtgtaccccacccccaccgtgtacagccctgggaagcagggcttcaagcccaagggccccaacccagctgcccccatgaccagcgccaccggcggcaccgtggccacctttgacagccctgccaccctgaagacccggcgggccaagggggcccggggcctgcctgaggccgccggcaagcccaaggcccagaagctgaagtgcagctactgtgacaagagcttcaccaagaactttgacctgcagcagcacatccgcagccacactggagagaagcccttccagtgcatcgcctgtggccgggcctttgcccagaagagcaatgtgaagaagcacatgcagacccacaaggtgtggcccccaggccacagcggcggcaccgtgtccaggaacagcgtgacagtgcaggtgatggccctgaaccccagccggcaggaggatgaggagagcacaggcctgggccagcccctgcccggggccccccagccccaggccctgagcacagctggggaggaggagggggacaagccagagagcaagcaggtggtgctgattgacagcagctacctgtgccagttctgccccagcaagttcagcacctacttccagctgaagagccacatgacccagcacaagaatgagcaggtgtacaagtgtgtggtgaagagctgtgcccagaccttccccaagctggacaccttcctggagcacatcaagagccaccaggaggagctgagctaccgctgccacctgtgtgggaaggacttccccagcctgtatgacctgggcgtgcaccagtacagccacagcctgctgccccagcacagccccaagaaggacaatgctgtgtacaagtgtgtgaagtgtgtgaacaagtacagcaccccagaggccctggagcaccacctgcagacagccacccacaacttcccctgcccccactgccagaaggtgttcccctgtgagcgctacctgcggcggcacctgcccacccacggcagcggcggccgcttcaagtgccaggtgtgcaagaagttcttccggcgggagcactacctgaagctgcacgcccacatccacagcggggagaagccctacaagtgcagcgtgtgtgagagcgccttcaacaggaaggacaagctgaagaggcacatgctgatccacgagcccttcaagaagtacaagtgccccttcagcacccacacaggctgcagcaaggagttcaacagaccagacaagctgaaggcccacatcctgagccacagcggcatgaagctgcacaagtgtgccctgtgcagcaagagcttcagccggcgggcccacctggccgagcaccagagggcccacacaggcaactacaagttccgctgtgccggctgtgccaagggcttcagccgccacaagtacctgaaggaccaccgctgccgcctgggcccccagaaggacaaggacctgcagacccggcggcccccccagaggagagctgcccccaggagctgtggcagcggcggcaggaaggtgctgacccccctgcctgaccccctgggcctggaggagctgaaggacacaggagctggcctggtgcctgaggccgtgcctgggaagcccccatttgctgagccagatgctgtgctgagcatcgtggtgggcggcgctgtgggcgctgagacagagctggtggtgcccggccatgctgagggcctgggcagcaacctggccctggccgagctgcaggccggggctgagggcccctgtgccatgctggccgtgcctgtgtacatccaggccagcgagtag

SEQ ID NO: 17793 - DNA, 1800 bp, Artificial Sequence
  Description of Artificial Sequence: Synthetic coding sequence
atgatgctgccctaccccagcgccctgggggaccagtactgggaggagatcctgctgcccaagaatggagaaaatgtggagaccatgaagaagctgacccagaaccacaaggccaagggcctgcccagcaatgacacagactgcccccagaagaaggagggcaaggcccagatcgtggtgcctgtgaccttcagagatgtgaccgtcatcttcacagaggccgagtggaagaggctgagccctgagcagaggaacctgtacaaggaggtgatgctggagaactacagaaacctgctgagcctggccgagcccaagccagagatctacacctgcagcagctgcctgctggccttcagctgccagcagttcctgagccagcacgtgctgcagatcttcctgggcctgtgtgccgagaaccacttccaccctggcaacagcagccctggccactggaagcagcagggccagcagtacagccacgtgtcctgctggtttgaaaatgctgagggccaggagcggggcggcggcagcaagccctggagcgccaggacagaggagcgggagaccagccgggccttccccagccccctgcagaggcagagcgccagccccaggaagggcaacatggtggtggagacagagcccagcagcgcccagaggcccaaccctgtgcagctggacaagggcctgaaggagctggagaccctgcgctttggagccatcaactgccgggagtatgagccagaccacaacctggagagcaacttcatcaccaaccccaggaccctgctgggcaagaagccctacatctgcagcgactgtggccgctccttcaaggacaggagcaccctcatccgccaccaccgcatccacagcatggagaagccctacgtgtgcagtgaatgtggccggggcttcagccagaagagcaacctgagccgccaccagaggacccacagcgaggagaagccctacctgtgcagagaatgtggccagagcttccgcagcaagagcatcctgaacagacaccagtggacccacagcgaggagaagccctacgtgtgcagtgaatgtggccggggcttcagcgagaagagcagcttcatccgccaccagaggacccacagcggggagaagccctacgtgtgcctggagtgtggccgctccttctgtgacaagagcaccctgaggaagcaccagaggatccacagcggggagaagccctacgtgtgcagagaatgtggccggggcttcagccagaacagcgacctgatcaagcaccagaggacccacctggatgagaagccctacgtgtgcagagaatgtggccggggcttctgtgacaagagcaccctcatcatccacgagaggacccacagcggggagaagccctacgtgtgtggagaatgtggccggggcttcagcaggaagagcctgctgctggtgcaccagaggacccacagcggggagaagcactacgtgtgcagagaatgtagaagaggcttcagccagaagagcaacctgatccgccaccagaggacccacagcaatgagaagccctacatctgcagagaatgtggccggggcttctgtgacaagagcaccctgattgtgcatgagaggacccacagcggggagaagccctacgtgtgcagtgaatgtggccggggcttcagcaggaagagcctgctgctggtgcaccagaggacccacagcggggagaagcactacgtgtgcagagaatgtggccggggcttcagccacaagagcaacctgatccgccaccagaggacccactag

SEQ ID NO: 17794 - DNA, 357 bp, Artificial Sequence
  Description of Artificial Sequence: Synthetic coding sequence
atgatgctgccctaccccagcgccctgggggaccagtactgggaggagatcctgctgcccaagaatggagaaaatgtggagaccatgaagaagctgacccagaaccacaaggccaagggcctgcccagcaatgacacagactgcccccagaagaaggagggcaaggcccagatcgtggtgcctgtgaccttcagagatgtgaccgtcatcttcacagaggccgagtggaagaggctgagccctgagcagaggaacctgtacaaggaggtgatgctggagaactacagaaacctgctgagcctgggccaggagattgagaccatcctggccaacatcgtgaagagccacctgtactag

SEQ ID NO: 17795 - DNA, 306 bp, Artificial Sequence
  Description of Artificial Sequence: Synthetic coding sequence
atgatgctgccctaccccagcgccctgggggaccagtactgggaggagatcctgctgcccaagaatggagaaaatgtggagaccatgaagaagctgacccagaaccacaaggccaagggcctgcccagcaatgacacagactgcccccagaagaaggagggcaaggcccagatcgtggtgcctgtgaccttcagagatgtgaccgtcatcttcacagaggccgagtggaagaggctgagccctgagcagaggaacctgtacaaggaggtgatgctggagaactacagaaacctgctgagcctgtag

SEQ ID NO: 17796 - DNA, 435 bp, Artificial Sequence
  Description of Artificial Sequence: Synthetic coding sequence
atgatgctgccctaccccagcgccctgggggaccagtactgggaggagatcctgctgcccaagaatggagaaaatgtggagaccatgaagaagctgacccagaaccacaaggccaagggcctgcccagcaatgacacagactgcccccagaagaaggagggcaaggcccagatcgtggtgcctgtgaccttcagagatgtgaccgtcatcttcacagaggccgagtggaagaggctgagccctgagcagaggaacctgtacaaggaggtgatgctggagaactacagaaacctgctgagcctggccgagcccaagccagagatctacacctgcagcagctgcctgctggccttcagctgccagcagttcctgagccagcacgtgctgcagatcttcctgggcctgtgtgccgagaaccacttccaccctggatag

SEQ ID NO: 17797 - DNA, 342 bp, Artificial Sequence
  Description of Artificial Sequence: Synthetic coding sequence
atggagaacctgaccaagcacagcattgagtgcagcagcttccggggggactgggagtgcaagaaccagtttgagaggaagcagggcagccaggagggccacttcagcgagatgatcttcaccccagaggacatgcccaccttcagcatccagcaccagaggatccacacagatgagaagctgctggagtgcaaggaatgtgggaaggacttctcctttgtgtctgtgctggtgcgccaccagaggatccacactggagagaagccctatgagtgcaaggaatgtgggaaggcctttggaagtggggccaacctggcctaccaccagaggatccacacctag

SEQ ID NO: 17798 - DNA, 759 bp, Artificial Sequence
  Description of Artificial Sequence: Synthetic coding sequence
atggccttcagcagcggcagcgccctgaccaggcaccagaggatccacactggagagaagccctacatctgcaatgaatgtgggaaggccttctcctttggaagtgccctgaccaggcaccagaggatccacactggagagaagccctacgtgtgcaaggaatgtgggaaggccttcaacagcggcagtgacctgacccagcaccagaggatccacactggagagaagccctatgagtgcaaggaatgtgagaaggccttccgcagcggcagcaagctgatccagcaccagaggatgcacactggagagaagccctatgagtgcaaggaatgtgggaagaccttcagcagcggcagtgacctgacccagcaccaccgcatccacactggagagaagccctatgagtgcaaggaatgtgggaaggcctttggaagtggcagcaagctgatccagcaccagctgatccacactggagagcggccctatgagtgcaaggaatgtgggaagagcttcagcagcggcagcgccctgaacagacaccagaggatccacactggagagaagccctatgagtgcaaggaatgtgggaaggccttctacagcggcagcagcctgacccagcaccagaggatccacactggagagaagctgtatgagtgcaagaactgtgggaaggcctacggccgggacagcgagttccagcagcacaagaagagccacaacgggaagaagctgtgtgagctggagaccatcaactag

SEQ ID NO: 17799 - DNA, 1467 bp, Artificial Sequence
  Description of Artificial Sequence: Synthetic coding sequence
atggagaacctgaccaagcacagcattgagtgcagcagcttccggggggactgggagtgcaagaaccagtttgagaggaagcagggcagccaggagggccacttcagcgagatgatcttcaccccagaggacatgcccaccttcagcatccagcaccagaggatccacacagatgagaagctgctggagtgcaaggaatgtgggaaggacttctcctttgtgtctgtgctggtgcgccaccagaggatccacactggagagaagccctatgagtgcaaggaatgtgggaaggcctttggaagtggggccaacctggcctaccaccagaggatccacactggagagaagccctttgagtgcaaggaatgtgggaaggcctttggaagtggcagcaacctgacccaccaccagaggatccacactggagagaagccctatgagtgcaaggaatgtgggaaggccttctcctttggaagtggcctcatccgccaccagatcatccacagcggggagaagccctatgagtgcaaggaatgtgggaagagcttctcctttgaaagtgccctgatccgccaccaccgcatccacactggagagaagccctatgaatgtattgactgtgggaaggcctttggaagtggcagcaacctgacccagcaccggcgcatccacactggagagaagccctatgagtgcaaggcctgtggcatggccttcagcagcggcagcgccctgaccaggcaccagaggatccacactggagagaagccctacatctgcaatgaatgtgggaaggccttctcctttggaagtgccctgaccaggcaccagaggatccacactggagagaagccctacgtgtgcaaggaatgtgggaaggccttcaacagcggcagtgacctgacccagcaccagaggatccacactggagagaagccctatgagtgcaaggaatgtgagaaggccttccgcagcggcagcaagctgatccagcaccagaggatgcacactggagagaagccctatgagtgcaaggaatgtgggaagaccttcagcagcggcagtgacctgacccagcaccaccgcatccacactggagagaagccctatgagtgcaaggaatgtgggaaggcctttggaagtggcagcaagctgatccagcaccagctgatccacactggagagcggccctatgagtgcaaggaatgtgggaagagcttcagcagcggcagcgccctgaacagacaccagaggatccacactggagagaagccctatgagtgcaaggaatgtgggaaggccttctacagcggcagcagcctgacccagcaccagaggatccacactggagagaagctgtatgagtgcaagaactgtgggaaggcctacggccgggacagcgagttccagcagcacaagaagagccacaacgggaagaagctgtgtgagctggagaccatcaactag

SEQ ID NO: 17800 - DNA, 1467 bp, Artificial Sequence; identical to SEQ ID NO: 17799
  Description of Artificial Sequence: Synthetic coding sequence

SEQ ID NO: 17801 - DNA, 228 bp, Artificial Sequence
  Description of Artificial Sequence: Synthetic coding sequence
atggagaacctgaccaagcacagcattgagtgcagcagcttccggggggactgggagtgcaagaaccagtttgagaggaagcagggcagccaggagggccacttcagcgagatgatcttcaccccagaggacatgcccaccttcagcatccagcaccagaggatccacacagatgagaagctgctggagtgcaaggaatgtgggaaggacttctcctttgtgtcctag

SEQ ID NO: 17802 - DNA, 1467 bp, Artificial Sequence; identical to SEQ ID NO: 17799
  Description of Artificial Sequence: Synthetic coding sequence

SEQ ID NO: 17803 - DNA, 960 bp, Artificial Sequence
  Description of Artificial Sequence: Synthetic coding sequence
atggagtacccagccccagccaccgtgcaggccgcagatggaggagctgctggcccctacagcagcagcgagctgctggagggccaggagccagatggagtgcgctttgaccgggagcgggcccggcggctgtgggaggccgtgtctggggcccagcctgtgggccgggaggaggcccagttcttcccccacagcaggacagtcatccccatcctggtgctgtctgagacctacagcctgtgccaccctgtggagcacatgatccagaagaaccagtgcctcttcaccaacacccagtgcaaggtgtgctgtgccctgctgatcagcgagagccagaagctggcccactaccagagcaagaagcacgccaacaaggtgaagcgctacctggccatccacggcatggagaccctgaagggggagaccaagaagctggacagcgaccagaagagcagccgcagcaaggacaagaaccagtgctgccccatctgcaacatgaccttcagcagccctgtggtggcccagagccactacctgggcaagacccacgccaagaacctgaagctgaagcagcagagcaccaaggtggaggccctgcaccagaaccgggagatgattgatcctgacaagttctgcagcctgtgccacgccaccttcaatgaccctgtgatggcccagcagcactacgtgggcaagaagcacaggaagcaggagaccaagctgaagctgatggcccgctatggccgcctggccgaccctgctgtgacagacttccctgctgggaagggctacccctgcaagacctgcaagatcgtgctgaacagcattgagcagtaccaggcccacgtgtctggcttcaagcacaagaaccagagccccaagacagtggccagcagcctgggccagatccccatgcagaggcagcccatccagaaggacagcaccaccctggaggactag

SEQ ID NO: 17804 - DNA, 885 bp, Artificial Sequence
  Description of Artificial Sequence: Synthetic coding sequence
atggagtacccagccccagccaccgtgcaggccgcagatggaggagctgctggcccctacagcagcagcgagctgctggagggccaggagccagatggagtgcgctttgaccgggagcgggcccggcggctgtgggaggccgtgtctggggcccagcctgtgggccgggaggaggtggagcacatgatccagaagaaccagtgcctcttcaccaacacccagtgcaaggtgtgctgtgccctgctgatcagcgagagccagaagctggcccactaccagagcaagaagcacgccaacaaggtgaagcgctacctggccatccacggcatggagaccctgaagggggagaccaagaagctggacagcgaccagaagagcagccgcagcaaggacaagaaccagtgctgccccatctgcaacatgaccttcagcagccctgtggtggcccagagccactacctgggcaagacccacgccaagaacctgaagctgaagcagcagagcaccaaggtggaggccctgcaccagaaccgggagatgattgatcctgacaagttctgcagcctgtgccacgccaccttcaatgaccctgtgatggcccagcagcactacgtgggcaagaagcacaggaagcaggagaccaagctgaagctgatggcccgctatggccgcctggccgaccctgctgtgacagacttccctgctgggaagggctacccctgcaagacctgcaagatcgtgctgaacagcattgagcagtaccaggcccacgtgtctggcttcaagcacaagaaccagagccccaagacagtggccagcagcctgggccagatccccatgcagaggcagcccatccagaaggacagcaccaccctggaggactag

SEQ ID NO: 17805 - DNA, 960 bp, Artificial Sequence; identical to SEQ ID NO: 17803
  Description of Artificial Sequence: Synthetic coding sequence

SEQ ID NO: 17806 - DNA, 789 bp, Artificial Sequence
  Description of Artificial Sequence: Synthetic coding sequence
atggagtacccagccccagccaccgtgcaggccgcagatggaggagctgctggcccctacagcagcagcgagctgctggagggccaggagccagatggagtgcgctttgaccgggagcgggcccggcggctgtgggaggccgtgtctggggcccagcctgtgggccgggaggaggtggagcacatgatccagaagaaccagtgcctcttcaccaacacccagtgcaaggtgtgctgtgccctgctgatcagcgagagccagaagctggcccactaccagagcagccgcagcaaggacaagaaccagtgctgccccatctgcaacatgaccttcagcagccctgtggtggcccagagccactacctgggcaagacccacgccaagaacctgaagctgaagcagcagagcaccaaggtggaggccctgcaccagaaccgggagatgattgatcctgacaagttctgcagcctgtgccacgccaccttcaatgaccctgtgatggcccagcagcactacgtgggcaagaagcacaggaagcaggagaccaagctgaagctgatggcccgctatggccgcctggccgaccctgctgtgacagacttccctgctgggaagggctacccctgcaagacctgcaagatcgtgctgaacagcattgagcagtaccaggcccacgtgtctggcttcaagcacaagaaccagagccccaagacagtggccagcagcctgggccagatccccatgcagaggcagcccatccagaaggacagcaccaccctggaggactag

SEQ ID NO: 17807 - DNA, 591 bp, Artificial Sequence
  Description of Artificial Sequence: Synthetic coding sequence
atggagtacccagccccagccaccgtgcaggccgcagatggaggagctgctggcccctacagcagcagcgagctgctggagggccaggagccagatggagtgcgctttgaccgggagcgggcccggcggctgtgggaggccgtgtctggggcccagcctgtgggccgggaggaggccctgagcaagaggctgaccaaccccttcctggtggccagcaccctggccctgcaccagaaccgggagatgattgatcctgacaagttctgcagcctgtgccacgccaccttcaatgaccctgtgatggcccagcagcactacgtgggcaagaagcacaggaagcaggagaccaagctgaagctgatggcccgctatggccgcctggccgaccctgctgtgacagacttccctgctgggaagggctacccctgcaagacctgcaagatcgtgctgaacagcattgagcagtaccaggcccacgtgtctggcttcaagcacaagaaccagagccccaagacagtggccagcagcctgggccagatccccatgcagaggcagcccatccagaaggacagcaccaccctggaggactag

SEQ ID NO: 17808 - DNA, 933 bp, Artificial Sequence
  Description of Artificial Sequence: Synthetic coding sequence
atggagtacccagccccagccaccgtgcaggccgcagatggaggagctgctggcccctacagcagcagcgagctgctggagggccaggagccagatggagtgcgctttgaccgggagcgggcccggcggctgtgggaggccgtgtctggggcccagcctgtgggccgggaggaggtggagcacatgatccagaagaaccagtgcctcttcaccaacacccagtgcaaggtgtgctgtgccctgctgatcagcgagagccagaagctggcccactaccagagcaagaagcacgccaacaaggtgaagcgctacctggccatccacggcatggagaccctgaagggggagaccaagaagctggacagcgaccagaagagcagccgcagcaaggacaagaaccagtgctgccccatctgcaacatgaccttcagcagccctgtggtggcccagagccactacctgggcaagacccacgccaagaacctgaagctgaagcagcagagcaccaaggtggaggccctgagcaagaggctgaccaaccccttcctggtggccagcaccctggccctgcaccagaaccgggagatgattgatcctgacaagttctgcagcctgtgccacgccaccttcaatgaccctgtgatggcccagcagcactacgtgggcaagaagcacaggaagcaggagaccaagctgaagctgatggcccgctatggccgcctggccgaccctgctgtgacagacttccctgctgggaagggctacccctgcaagacctgcaagatcgtgctgaacagcattgagcagtaccaggcccacgtgtctggcttcaagcacaagaaccagagccccaagacagtggccagcagcctgggccagatccccatgcagaggcagcccatccagaaggacagcaccaccctggaggactag

SEQ ID NO: 17809 - DNA, 357 bp, Artificial Sequence
  Description of Artificial Sequence: Synthetic coding sequence
atggagtacccagccccagccaccgtgcaggccgcagatggaggagctgctggcccctacagcagcagcgagctgctggagggccaggagccagatggagtgcgctttgaccgggagcgggcccggcggctgtgggaggccgtgtctggggcccagcctgtgggccgggaggaggccggcaagggctacccctgcaagacctgcaagatcgtgctgaacagcattgagcagtaccaggcccacgtgtctggcttcaagcacaagaaccagagccccaagacagtggccagcagcctgggccagatccccatgcagaggcagcccatccagaaggacagcaccaccctggaggactag

SEQ ID NO: 17810 - DNA, 2520 bp, Artificial Sequence
  Description of Artificial Sequence: Synthetic coding sequence
atggccctgacccagggccaggtgaccttcagagatgtggccatcgagttcagccaggaggagtggacctgcctggaccctgcccagaggaccctgtacagagatgtgatgctggagaactacagaaacctggccagcctgggcatcagctgctttgacctgagcatcatctccatgctggagcagggcaaggagcccttcaccctggagagccaggtgcagattgctggcaacccagatggctgggagtggatcaaggctgtgatcacagccctgagcagcgagtttgtgatgaaggacctgctgcacaagggcaagagcaacacaggagaggtgttccagacagtgatgctggagcggcaggagagccaggacatcgagggctgcagcttccgggaggtgcagaagaacacccacggcctggagtaccagtgcagagatgctgagggcaactacaagggcgtgctgctgacccaggagggcaacctgacccacggcagagatgaacatgacaagagagatgccaggaacaagctgatcaagaaccagctgggcctgagcctgcagagccacctgcctgagctgcagctgttccagtatgagggcaagatctatgagtgcaaccaggtggagaagagcttcaacaacaacagctctgtgagccccccccagcagatgccctacaacgtgaagacccacatcagcaagaagtacctgaaggacttcatcagcagcctgctgctgacccagggccagaaggccaacaactggggcagcccctacaagagcaatggctgcggcatggtgttcccccagaacagccacctggccagccaccagaggagccacaccaaggagaagccctacaagtgctatgaatgtgggaaggccttccgcaccaggagcaacctgaccacccaccaggtgatccacactggagagaagcgctacaagtgcaatgaatgtgggaaggtgttcagcaggaacagccagctgagccagcaccagaagatccacactggagagaagccctacaagtgcaatgaatgtgggaaggtgttcacccagaacagccacctggtgcgccaccggggcatccacactggagagaagccctacaagtgcaatgaatgtgggaaggccttccgggcccggagcagcctggccatccaccaggccacccacagcggggagaagccctacaagtgcaatgaatgtgggaaggtgttcacccagaacagccacctgaccaaccactggaggatccacactggagagaagccctacaagtgcaatgaatgtgggaaggccttcggcgtgcgcagcagcctggccatccacctggtgatccacactggagagaagccctacaagtgccatgaatgtgggaaggtgttcagaagaaacagccacctggcccggcaccagctgatccacactggagagaagccctacaagtgcaatgaatgtgggaaggccttccgggcccacagcaacctgaccacccaccaggtgatccacactggagagaagccctacaagtgcaatgaatgtgggaaggtgttcacccagaacagccacctggccaaccaccagaggatccacactggagtgaagccctacatgtgcaatgaatgtgggaaggccttctctgtgtacagcagcctgaccacccaccaggtgatccacactggagagaagccctacaagtgcaatgaatgtgggaaggtgttcacccagaacagccacctggcccggcaccggggcatccacactggagagaagccctacaagtgcaatgaatgtgggaaggtgttccgccacaacagctacctgagccgccaccagaggatccacactggagagaagccctacaagtacaatgaatatggcaaggccttcagcgagcacagcaacctgaccacccaccaggtgatccacactggagagaagccctacaagtgcaatgaatgtgggaaggtgttcacccagaacagccacctggcccggcaccggcgggtgcacactggaggcaagccctaccagtgcaatgaatgtgggaaggccttcagccagaccagcaagctggcccggcaccagagggtgcacactggagagaagccctatgagtgcaaccagtgtgggaaggccttctctgtgcgcagcagcctgaccacccaccaggccatccacacaggcaagaagccctacaagtgcaatgaatgtgggaaggtgttcacccagaacagccacctggcccggcaccggggcatccacactggagagaagccctacaagtgcaatgaatgtgggaaggccttcagccagaccagcaagctggcccggcaccagaggatccacactggagagaagccctatgaatgtgggaagcccttcagcatctgcagcagcctgaccacccaccagaccatccacactggaggcaagccctacaagtgcaatgtgtggaaggtgctgaagtctgagttcaagccctgcaagcccagccagaacagctag

SEQ ID NO: 17811 - DNA, 282 bp, Artificial Sequence
  Description of Artificial Sequence: Synthetic coding sequence
agcaggaacagccagctgagccagcaccagaagatccacactggagagaagccctacaagtgcaatgaatgtgggaaggtgttcacccagaacagccacctggtgcgccaccggggcatccacactggagagaagccctacaagtgcaatgaatgtgggaagcccttcagcatctgcagcagcctgaccacccaccagaccatccacactggaggcaagccctacaagtgcaatgtgtggaaggtgctgaagtctgagttcaagccctgcaagcccagctag

SEQ ID NO: 17812 - DNA, 2523 bp, Artificial Sequence
  Description of Artificial Sequence: Synthetic coding sequence
atggccctgacccagggccaggtgaccttcagagatgtggccatcgagttcagccaggaggagtggacctgcctggaccctgcccagaggaccctgtacagagatgtgatgctggagaactacagaaacctggccagcctggccggcatcagctgctttgacctgagcatcatctccatgctggagcagggcaaggagcccttcaccctggagagccaggtgcagattgctggcaacccagatggctgggagtggatcaaggccgtcatcacagccctgagcagcgagtttgtgatgaaggacctgctgcacaagggcaagagcaacacaggagaggtgttccagacagtgatgctggagcggcaggagagccaggacatcgagggctgcagcttccgggaggtgcagaagaacacccacggcctggagtaccagtgcagagatgctgagggcaactacaagggcgtgctgctgacccaggagggcaacctgacccacggcagagatgaacatgacaagagagatgccaggaacaagctgatcaagaaccagctgggcctgagcctgcagagccacctgcctgagctgcagctgttccagtatgagggcaagatctatgagtgcaaccaggtggagaagagcttcaacaacaacagctctgtgtccccaccccagcagatgccctacaacgtgaagacccacatcagcaagaagtacctgaaggacttcatcagcagcctgctgctgacccagggccagaaggccaacaactggggcagcccctacaagagcaatggctgcggcatggtgttcccccagaacagccacctggccagccaccagaggagccacaccaaggagaagccctacaagtgctatgaatgtgggaaggccttccgcaccaggagcaacctgaccacccaccaggtgatccacactggagagaagcgctacaagtgcaatgaatgtgggaaggtgttcagcaggaacagccagctgagccagcaccagaagatccacactggagagaagccctacaagtgcaatgaatgtgggaaggtgttcacccagaacagccacctggtgcgccaccggggcatccacactggagagaagccctacaagtgcaatgaatgtgggaaggccttccgggcccggagcagcctggccatccaccaggccacccacagcggggagaagccctacaagtgcaatgaatgtgggaaggtgttcacccagaacagccacctgaccaaccactggaggatccacactggagagaagccctacaagtgcaatgaatgtgggaaggcctttggagtgcgcagcagcctggccatccacctggtgatccacactggagagaagccctacaagtgccatgaatgtgggaaggtgttcagaagaaacagccacctggcccggcaccagctgatccacactggagagaagccctacaagtgcaatgaatgtgggaaggccttccgggcccacagcaacctgaccacccaccaggtgatccacactggagagaagccctacaagtgcaatgaatgtgggaaggtgttcacccagaacagccacctggccaaccaccagaggatccacactggagtgaagccctacatgtgcaatgaatgtgggaaggccttctctgtgtacagcagcctgaccacccaccaggtgatccacactggagagaagccctacaagtgcaatgaatgtgggaaggtgttcacccagaacagccacctggcccggcaccggggcatccacactggagagaagccctacaagtgcaatgaatgtgggaaggtgttccgccacaacagctacctgagccgccaccagaggatccacactggagagaagccctacaagtacaatgaatatggcaaggccttcagcgagcacagcaacctgaccacccaccaggtgatccacactggagagaagccctacaagtgcaatgaatgtgggaaggtgttcacccagaacagccacctggcccggcacagaagagtgcacactggaggcaagccctaccagtgcaatgaatgtgggaaggccttcagccagaccagcaagctggcccggcaccagagggtgcacactggagagaagccctatgagtgcaaccagtgtgggaaggccttctctgtgcgcagcagcctgaccacccaccaggccatccacacaggcaagaagccctacaagtgcaatgaatgtgggaaggtgttcacccagaacagccacctggcccggcaccggggcatccacactggagagaagccctacaagtgcaatgaatgtgggaaggccttcagccagaccagcaagctggcccggcaccagaggatccacactggagagaagccctatgaatgtgggaagcccttcagcatctgcagcagcctgaccacccaccagaccatccacactggaggcaagccctacaagtgcaatgtgtggaaggtgctgaagtctgagttcaagccctgcaagcccagccagaacagctag

SEQ ID NO: 17813 - DNA, 1599 bp, Artificial Sequence
  Description of Artificial Sequence: Synthetic coding sequence
atgatccaggcccaggagagcatcaccctggaggatgtggccgtggacttcacctgggaggagtggcagctgctgggcgccgcccagaaggacctgtacagagatgtgatgctggagaactacagcaacctggtggccgtgggctaccaggccagcaagccagatgccctcttcaagctggagcagggcgagcagctgtggaccattgaagatggcatccacagcggggcctgcagcgacatctggaaggtggaccacgtgctggagcggctgcagagcgagagcctggtgaacagaaggaagccctgccacgagcatgatgcctttgagaacatcgtgcactgcagcaagagccagttcctgctgggccagaaccacgacatctttgacctgcggggcaagagcctgaagagcaacctgaccctggtgaaccagagcaagggctatgagatcaagaacagcgtggagttcaccggaaatggagacagcttcctgcacgccaaccacgagcggctgcacacagccatcaagtttcctgccagccagaagctgatcagcaccaagagccagttcatcagccccaagcaccagaagaccaggaagctggagaagcaccacgtgtgcagtgaatgtgggaaggccttcatcaagaagtcctggctgacagaccaccaggtgatgcacactggagagaagccccaccgctgcagcctgtgtgagaaggccttcagcaggaagttcatgctgacagagcaccagaggacccacactggagagaagccctatgaatgtccagaatgtgggaaggccttcctgaagaagagccggctgaacatccaccagaagacccacactggagagaagccctacatctgcagtgaatgtgggaagggcttcatccagaagggcaacctgattgtgcaccagaggatccacactggagagaagccctacatctgcaatgaatgtgggaagggcttcatccagaagacctgcctgattgcccaccagcgcttccacacaggcaagaccccatttgtgtgcagtgaatgtgggaagagctgcagccagaagagcggcctcatcaagcaccagaggatccacactggagagaagccctttgaatgttctgaatgtgggaaggccttcagcaccaagcagaagctgattgtgcaccagaggacccacactggagagcggccctacggctgcaatgaatgtgggaaggcctttgcctacatgagctgcctggtgaagcacaagaggatccacacccgggagaagcaggaggccgccaaggtggagaaccccccagctgagcggcacagcagcctgcacaccagtgatgtgatgcaggagaagaacagcgccaacggggccaccacccaggtgcccagcgtggccccccagaccagcctgaacatcagcggcctgctggccaacagaaatgtggtgctggtgggccagcctgtggtgcgctgtgccgccagcggggacaacagaggatttgcccaggacaggaacctggtgaatgctgtgaatgtggtggtgcccagcgtcatcaactacgtgctcttctacgtgacagagaacccctag

SEQ ID NO: 17814 - DNA, 1818 bp, Artificial Sequence
  Description of Artificial Sequence: Synthetic coding sequence
atggctgctggccagcgggaggcccggccccaggtgtccctgacctttgaagatgtggccgtgctcttcaccagagatgagtggaggaagctggcccccagccagaggaacctgtacagagatgtgatgctggagaactacagaaacctggtgtccctgggcctgcccttcaccaagcccaaggtgatcagcctgctgcagcagggcgaggacccctgggaggtggagaaggatggcagcggcgtgagcagcctgggcagcaagagcagccacaagaccaccaagagcacccagacccaggacagcagcttccagggcctcatcctgaagaggagcaacagaaatgtgccctgggacctgaagctggagaagccctacatctatgagggccgcctggagaagaagcaggacaagaagggcagcttccagatcgtgtctgccacccacaagaagatccccaccatcgagaggagccacaagaacacagagctgagccagaacttcagccccaagtctgtgctgatccggcagcagatcctgccccgggagaagaccccacccaagtgtgagatccagggcaacagcctgaagcagaacagccagctgctgaaccagcccaagatcacagctgacaagcgctacaagtgcagcctgtgtgagaagaccttcatcaacaccagcagcctgaggaagcatgagaagaaccacagcggggagaagctgttcaagtgcaaggagtgcagcaaggccttcagccagagcagcgccctgatccagcaccagatcacccacactggagagaagccctacatctgcaaggaatgtgggaaggccttcaccctgagcaccagcctgtacaagcacctgcggacccacacagtggagaagagctaccgctgcaaggaatgtgggaagagcttcagcagaagaagtggcctcttcatccaccagaagatccatgctgaggagaacccctgcaagtacaaccctggcaggaaggccagcagctgcagcaccagcctgagcggctgccagaggatccacagcaggaagaagagctacctgtgcaatgaatgtggcaacaccttcaagagcagcagcagcctgcgctaccaccagaggatccacactggagagaagcccttcaagtgcagtgaatgtggccgggccttcagccagagcgccagcctcatccagcacgagcgcatccacactggagagaagccctaccgctgcaatgaatgtgggaagggcttcaccagcatcagccggctgaacagacaccgcatcatccacactggagagaagttctacaactgcaatgaatgtgggaaggccctgagcagccacagcaccctcatcatccacgagcgcatccacactggagagaagccctgcaagtgcaaggtgtgtgggaaggccttccggcagagcagcgccctgatccagcaccagaggatgcacactggagagcggccctacaagtgcaatgaatgtgggaagaccttccgctgcaacagcagcctgagcaaccaccagaggatccacactggagagaagccctaccgctgtgaggagtgtggcatcagctttggccagagcagcgccctgatccagcaccggcgcatccacactggagagaagcccttcaagtgcaacacctgtgggaagaccttccggcagagcagcagccgcatcgcccaccagaggatccacactggagagaagccctatgagtgcaacacctgtgggaagctgttcaaccacaggagcagcctgaccaaccactacaagatccacatcgaggaggacccctag

SEQ ID NO: 17815 - DNA, 408 bp, Artificial Sequence
  Description of Artificial Sequence: Synthetic coding sequence
atggctgctggccagcgggaggcccggccccaggtgtccctgacctttgaagatgtggccgtgctcttcaccagagatgagtggaggaagctggcccccagccagaggaacctgtacagagatgtgatgctggagaactacagaaacctggtgtccctgggcctgcccttcaccaagcccaaggtgatcagcctgctgcagcagggcgaggacccctgggaggtggagaaggatggcagcggcgtgagcagcctgggcagcaagagcagccacaagaccaccaagagcacccagacccaggacagcagcttccagggcctcatcctgaagaggagcaacagaaatgtgccctgggacctgaagctggagaagccctacatctatgagggccgcctggagaagaagtag

SEQ ID NO: 17816 - DNA, 1839 bp, Artificial Sequence
  Description of Artificial Sequence: Synthetic coding sequence
atggctgctggccagcgggaggcccggccccaggtgtccctgacctttgaagatgtggccgtgctcttcacctgggatgagtggaggaagctggcccccagccagaggaacctgtacagagatgtgatgctggagaactacagaaacctggtgtccctgggcctgtccttcaccaagcccaaggtgatcagcctgctgcagcagggcgaggacccctgggaggtggagaaggacagcagcggcgtgagcagcctgggctgcaagagcacccccaagatgaccaagagcacccagacccaggacagcttccaggagcagatcaggaagaggctgaagagagatgagccctggaacttcatcagcgagaggagctgcatctatgaggagaagctgaagaagcagcaggacaagaatgaaaacctgcagatcatctctgtggcccacaccaagatcctgactgtggacaggagccacaagaatgtggagtttggccagaacttctacctgaagtctgtgttcatcaagcagcagagatttgccaaggagaagacccccagcaaatgtgagatccagaggaacagcttcaagcagaacagcaacctgctgaaccagagcaagatcaagacagctgagaagcgctacaagtgcagcacctgtgagaaggccttcatccacaacagcagcctgaggaagcaccagaagaaccacactggagagaagctgttcaagtgcaaggagtgcctgaaggccttcagccagagcagcgccctgatccagcaccagaggacccacactggagagaagccctacatctgcaaggaatgtgggaaggccttcagccacagcgccagcctgtgcaagcacctgcggacccacacagtggagaagtgctaccgctgcaaggaatgtgggaagagcttcagcagaagaagtggcctcttcatccaccagaagatccacgcccaggagaacccccacaagtacaaccctggcaggaaggccagcagctacagcaccagcctgagcggcagccagaagatccacctgaggaagaagagctacctgtgcaatgaatgtggcaacaccttcaagagcagcagcagcctgcgctaccaccagaggatccacactggagagaagcccttcaagtgcagtgaatgtggccgggccttcagccagagcgccagcctcatccagcacgagcgcatccacactggagagaagccctaccgctgcaatgaatgtgggaagggcttcaccagcatcagccggctgaacagacaccgcatcatccacactggagagaagctgtacaactgcaatgaatgtgggaaggccctgagcagccacagcaccctcatcatccacgagcgcatccacactggagagaagccctgcaagtgcaaggtgtgtgggaaggccttccggcagagcagcgccctgatccagcaccagaggatgcacactggagagcggccctacaagtgcaatgaatgtgacaagaccttccgctgcaacagcagcctgagcaaccaccagaggatccacactggagagaagccctaccgctgcctggagtgtggcatgagctttggccagagcgctgccctgatccagcaccagaggatccacactggagagaagcccttcaagtgcaacacctgtgggaagaccttccggcagagcagcagcctcatcgcccaccagaggatccacactggagagaagccctatgaatgtaatgcctgtgggaagctgttcagccagaggagcagcctgaccaaccactacaagatccacatcgaggaggacagcctgaaggctgacctgcacgtgtag

SEQ ID NO: 17817 - DNA, 405 bp, Artificial Sequence
  Description of Artificial Sequence: Synthetic coding sequence
atggctgctggccagcgggaggcccggccccaggtgtccctgacctttgaagatgtggccgtgctcttcacctgggatgagtggaggaagctggcccccagccagaggaacctgtacagagatgtgatgctggagaactacagaaacctggtgtccctgggcctgtccttcaccaagcccaaggtgatcagcctgctgcagcagggcgaggacccctgggaggtggagaaggacagcagcggcgtgagcagcctgggctgcaagagcacccccaagatgaccaagagcacccagacccaggacagcttccaggagcagatcaggaagaggctgaagagagatgagccctggaacttcatcagcgagaggagctgcatctatgaggagaagctgaagaagcagtag

SEQ ID NO: 17818 - DNA, 1665 bp, Artificial Sequence
  Description of Artificial Sequence: Synthetic coding sequence
atggctgtggacctgctgagcgcccaggagcctgtgaccttcagagatgtggccgtgttcttcagccaggatgagtggctgcacctggacagcgcccagagggccctgtaccgggaggtgatgctggagaactacagcagcctggtgtccctgggcatccccttctccatgcccaagctgatccaccagctgcagcagggcgaggacccctgcatggtggagcgggaggtgcccagcgacacccggctgggcttcaagacctggctggagacagaggccctgccccaccggcaggacatcttcatcgaggagaccagccagggcatggtgaagaaggagagcatcaaggatggccactgggacatcaactttgaggaggccgtggagtttgagagcgagattgaggaggagcaggagaagaagcccctgcggcagatgattgacagccatgagaagaccatcagtgaagatggcaaccacaccagcctggagctgggcaagagcctcttcaccaacacagccctggtgacccagcagagcgtgcccatcgagcgcatccccaacatgtactacaccttcggcaaggacttcaagcagaactttgacctgatgaagtgcttccagatctacccaggcggcaagccccacatctgcaatgaatgtgggaagagcttcaagcagaacctgcacctgattgagcaccagaggatccacactggagagaagccctacaagtgcaatgaatgtgagaagaccttcagccacaggagcagcctgctgagccaccagaggatccacactggagagaagccctacaagtgcaatgaatgtgagaaggccttcagcaacagcagcaccctcatcaagcacctgcgggtgcacactggagagaagccctaccgctgccgggagtgtgggaaggccttcagccagtgcagcaccctgactgtgcaccagaggatccacactggagagaagctgtacaagtgtggggagtgtgagaaggccttcaactgccgggccaagctgcaccgccaccagaggatccacactggagagaagccctacaagtgcagtgaatgtgggaagggctacagccagttcaccagcctggccgagcaccagcgcttccacactggagagcagctgtacacctgcctggagtgtggccgcaccttcacccgcatcgtgaccctcatcgagcaccagaggatccacacaggccagaagccctaccagtgcaatgaatgtgagaaggccttcaaccagtacagcagcttcaatgagcacaggaagatccacactggagagaagctgtacacctgtgaggagtgtgggaaggccttcggctgcaagagcaacctgtaccgccaccagaggatccacactggagagaagccctaccagtgcaaccagtgtgggaaggccttcagccagtacagcttcctgacagagcacgagcgcatccacactggagagaagctgtacaagtgcatggagtgtgggaaggcctacagctaccgcagcaacctgtgccgccacaagaaggtgcacaccaaggagaagctgtacaagtggaaggagtatggcaagcccttcatctgcagcagcagcctgacccagtaccagcgcttcttcaagggggacaaggcctatgaggtgtag

SEQ ID NO: 17819 - DNA, 1707 bp, Artificial Sequence
  Description of Artificial Sequence: Synthetic coding sequence
atgagaagatctgtgctggtgaggaaccctggccacaagggcctgcggcctgtgtatgaggagctggacagcgacagcgaggacctggaccccaaccctgaggacctggaccctgtgtctgaagatcctgagccagaccctgaggacctgaacacagtgcctgaagatgtggaccccagctatgaggacctggagcctgtgtctgaggacctggaccctgatgctgaggcccctggcagcgagccccaggaccctgaccccatgagcagcagctttgacctggaccctgatgtgattggccctgtgcccctcatcctggaccccaacagcgacaccctgagccctggggaccccaaggtggaccccatcagcagcggcctgacagccaccccccaggtgctggccaccagccctgctgtgctgcctgccccagccagccccccccggcccttcagctgcccagactgtggccgggccttcagaagaagcagcggcctgagccagcacaggaggacccacagcggggagaagccctaccgctgcccagactgtgggaagagcttcagccacggggccaccctggcccagcaccggggcatccacactggagcccggccctaccagtgtgccgcctgtgggaaggccttcggctggaggagcaccctgctgaagcacaggagcagccacagcggggagaagccccaccactgccctgtgtgtgggaaggccttcggccacggcagcctgctggcccagcacctgcggacccatggaggcccccggccccacaagtgccctgtgtgtgccaagggcttcggccagggcagcgccctgctgaagcacctgcggacccacactggagagcggccctacccctgcccccagtgtgggaaggccttcggccagagcagcgccctgctgcagcaccagaggacccacacagctgagcggccctaccgctgcccccactgtgggaaggccttcggccagagcagcaacctgcagcaccacctgcgcatccacactggagagcggccctatgcctgcccccactgcagcaaggccttcggccagagcagcgccctgctgcagcacctgcacgtgcacagcggggagcggccctaccgctgccagctgtgtgggaaggccttcggccaggccagcagcctgaccaagcacaagagggtgcatgaaggagctgctgctgctgctgctgctgctgctgctgctgctgctgctgctgctgctggcctgggcctgggccctggcctgagccctgcctccatgatgaggcctggccaggtgtccctgctgggcccagatgctgtgtctgtgctgggcagcggcctgggcctgagccctggcaccagcagcggcaggaacccagaccccggcagcggccctggcaccctgcctgaccccagcagcaagcccctgcccggcagccgcagcacccccagccccacccctgtggagagcagtgaccccaaggccggccatgatgctggccctgacctggtgcccagcccagacctggaccctgtgcccagcccagaccctgaccctgtgcccagcccagaccccaaccctgtgtcctgcccagacccctgcagccccacccggggcaccgtgtccccagccctgcccaccggggagagccctgagtgggtgcaggagcagggcgccctgctgggcccagatggatag

SEQ ID NO: 17820 - DNA, 1707 bp, Artificial Sequence; identical to SEQ ID NO: 17819
  Description of Artificial Sequence: Synthetic coding sequence

SEQ ID NO: 17821 - DNA, 1707 bp, Artificial Sequence; identical to SEQ ID NO: 17819
  Description of Artificial Sequence: Synthetic coding sequence

SEQ ID NO: 17822 - DNA, 1263 bp, Artificial Sequence
  Description of Artificial Sequence: Synthetic coding sequence
atgagccgcagcagccccagcggcaagggccacagcaggatggccgagccccgcttcaacaacccctacttctggcccccaccacccaccatgcccagccagctggacaacctggtgctgatcaacaagatcaaggagcagctgatggccgagaagatccggcccccccacctgccccccaccagcgccagcagccagcagcccctgctggtgcccccagccccagctgagagcagccaggccgtgatgagcctgcccaagctgcagcaggtgcccggcctgcacccccaggccgtgccccagccagatgtggccctgcacgcccggcctgccaccagcacagtgacaggcctgggcctgagcaccaggacccccagcgtgtccaccagcgagagcagcgctggggccggcaccggcaccggcaccagcacccccagcacccccaccaccaccagccagagccggctgattgccagcagccccaccctcatcagcggcatcaccagcccccccctgctggacagcatcaagaccatccagggccacggcctgctgggcccccccaagtctgagcggggcaggaagaagatcaaggccgagaaccctgggggcccccctgtgctggtggtgccctaccccatcctggccagcggggagacagccaaggagggcaagacctaccgctgcaaggtgtgccccctgaccttcttcaccaagtctgagatgcagatccacagcaagagccacacagaggccaagccccacaagtgcccccactgcagcaagagctttgccaatgccagctacctggcccagcacctgcgcatccacctgggcgtgaagccctaccactgcagctactgtgacaagagcttccggcagctgagccacctgcagcagcacacccgcatccacactggagaccggccctacaagtgcccccaccctggctgtgagaaggccttcacccagctgagcaacctgcagagccaccagaggcagcacaacaaggacaagccctacaagtgccccaactgctaccgggcctacagcgacagcgccagcctgcagatccacctgagcgcccacgccatcaagcacgccaaggcctactgctgcagcatgtgtggccgggcctacaccagcgagacctacctgatgaagcacatgagcaagcacacagtggtggagcacctggtgagccaccacagcccccagaggacagagagccctggcatccctgtgcgcatcagcctcatctag

SEQ ID NO: 17823 - DNA, 1263 bp, Artificial Sequence; identical to SEQ ID NO: 17822
  Description of Artificial Sequence: Synthetic coding sequence

SEQ ID NO: 17824 - DNA, 2235 bp, Artificial Sequence
  Description of Artificial Sequence: Synthetic coding sequence
atgcagaaggagatgaagatgatcaaggatgaagatgtgcactttgacctggccgtgaagaagacccccagcttcccccactgcctgcagcctgtggccagccggggcaaggccccccagaggcaccccttccctgaggccctgcggggccccttcagccagttccgctatgagcccccacctggggacctggatggcttccctggggtgtttgaaggagctggcagcaggaagaggaagtccatgcccaccaagatgccctacaaccaccctgctgaggaggtgaccctggccctgcacagcgaggagaacaagaaccacggcctgcccaacctgcccctgctcttcccccagcccccccggcccaagtatgacagccagatgattgacctgtgcaatgtgggcttccagttctaccgcagcctggagcactttggaggcaagcctgtgaagcaggagcccatcaagcccagcgctgtgtggccccagcccacccccacccccttcctgcccaccccctacccctactaccccaaggtgcaccctggcctgatgttccccttctttgtgcccagcagcagccccttccccttcagccgccacaccttcctgcccaagcagcccccagagcccctgctgcccaggaaggccgagccccaggagagcgaggagaccaagcagaaggtggagcgggtggatgtgaatgtgcagattgatgacagctactacgtggatgtgggcggcagccagaagcgctggcagtgccccacctgtgagaagagctacaccagcaagtacaacctggtgacccacatcctgggccacagcggcatcaagccccacgcctgcacccactgtgggaagctgttcaagcagctgagccacctgcacacccacatgctgacccaccagggcacccggccccacaagtgccaggtgtgccacaaggccttcacccagaccagccacctgaagaggcacatgatgcagcacagcgaggtgaagccccacaactgccgggtgtgtggccggggctttgcctaccccagcgagctgaaggcccacgaggccaagcacgccagcggccgggagaacatctgtgtggagtgtggcctggacttccccaccctggcccagctgaagaggcacctgaccacccaccggggccccatccagtacaactgcagtgaatgtgacaagaccttccagtaccccagccagctgcagaaccacatgatgaagcacaaggacatccggccctacatctgcagtgaatgtggcatggagtttgtgcagccccaccacctgaagcagcacagcctgacccacaagggcgtgaaggagcacaagtgtggcatctgtggccgggagttcaccctgctggccaacatgaagagacatgtgctgatccacaccaacatccgggcctaccagtgccacctgtgctacaagagctttgtgcagaagcagaccctgaaggcccacatgattgtgcacagtgatgtgaagcccttcaagtgcaagctgtgtgggaaggagttcaacaggatgcacaacctgatgggccacatgcacctgcacagcgacagcaagcccttcaagtgcctgtactgccccagcaagttcaccctgaagggcaacctgaccaggcacatgaaggtgaagcacggcgtgatggagcggggcctgcacagccagggcctgggccggggcagaattgccctggcccagacagctggggtgctgcggagcctggagcaggaggagccctttgacctgagccagaagagaagagccaaggtgcctgtgttccagagtgatggagagagcgcccagggcagccactgccacgaggaggaggaggaggacaactgctatgaggtggagccctacagccctggcctggccccccagagccagcagctgtgcaccccagaggacctgagcaccaagtctgagcacgcccctgaggtgctggaggaggcctgcaaggaggagaaggaggatgccagcaagggggagtgggagaagaggagcaagggggacctgggcgctgagggcggccaggagcgggactgtgccggcagagatgagtgcctgagcctgcgggccttccagagcacccggcggggccccagcttcagtgactacctgtacttcaagcacagagatgagagcctgaaggagctgctggagaggaagatggagaagcaggccgtgctgctgggcatctag

SEQ ID NO: 17825 - DNA, 717 bp, Artificial Sequence
  Description of Artificial Sequence: Synthetic coding sequence
atgaagaatgtggccaacacagtgaccatcagccacatcctgccccacatcaagatcatccacacagaggagaagccagacaagtgtgaggagtgcaacaaggtgttcaactggagcagcacccacaccaagtacaagaggatccacacagaggacaagttctacaagtatgaagaatgtgacaagagcttcaagaacatcagcaccctcatcacccacaagatcatctacgtggtggagaagttctacaagtgtgaagaatgtgggaaggtgttcttcttcttcctgaagtggagcctgaccctgagccccaagctggagtgcaatggagccatctctgtgcactgcaacctgcggctgctgggcagcagtgacagcctggccagcaccagccaggccgccggcattgctggggcctgccaccacgcccagctgatctttgtgttcctggtggagaccggcttccaccactttgaccaggccggctttgagctgctgaccagcagtgaccccccagccctggccagccagagcgcccccaagtgctgggactacaagcatgagcccctgagccctgtggagtgtgggaaggtgttcaacaagctgagcaaccacactggagagaagctgtacaagcccaagagacatgacagcgccctggagaacaccctgaacttcagcaagcacaagaggaaccacagcgtgaagaagccctag

SEQ ID NO: 17826 - DNA, 1686 bp, Artificial Sequence
  Description of Artificial Sequence: Synthetic coding sequence
atgatcaccagccagggctctgtgtccttcagagatgtgacagtgggcttcacccaggaggagtggcagcacctggaccctgcccagaggaccctgtacagagatgtgatgctggagaactacagccacctggtgtctgtgggctactgcatccccaagccagaggtgatcctgaagctggagaagggggaggagccctggatcctggaggagaagttccccagccagagccacctggagctgatcaacaccagcaggaactacagcatcatgaagttcaatgagttcaacaagggcggcaagtgcttctgtgatgagaagcatgagatcatccacagcgaggaggagcccagcgagtacaacaagaatggaaacagcttctggctgaatgaagatctcatctggcaccagaagatcaagaactgggagcagagctttgagtacaatgaatgtgggaaggccttccctgagaacagcctcttcctggtgcacaagaggggctacacaggccagaagacctgcaagtacacagaacatggcaagacctgtgacatgtccttcttcatcacccaccagcagacccacccccgggagaaccactatggaaatgaatgtggggagaacatctttgaggagagcatcctgctggagcaccagagcgtgtaccccttcagccagaagctgaacctgacccccatccagaggacccacagcatcaacaacatcatcgagtacaatgaatgtggcaccttcttcagcgagaagctggtgctgcacctgcagcagaggacccacactggagagaagccctatgagtgccatgaatgtgggaagaccttcacccagaagagcgcccacaccaggcaccagaggacccacactggaggcaagccctatgagtgccatgaatgtgggaagaccttctacaagaacagcgacctgatcaagcaccagaggatccacactggagagcggccctacggctgccatgaatgtgggaagagcttcagcgagaagagcaccctgacccagcaccagaggacccacactggagagaagccctatgagtgccatgaatgtgggaagaccttctccttcaagtctgtgctgactgtgcaccagaagacccacactggagagaagccctatgagtgctacgcctgtgggaaggccttcctgaggaagagtgacctgatcaagcaccagaggatccacactggagagaagccctatgagtgcaatgaatgtgggaagagcttcagcgagaagagcaccctgaccaagcacctgcggacccacactggagagaagccctatgagtgcatccagtgtgggaagttcttctgctactacagcggcttcacagagcacctgcggcggcacactggagagaagcccttcggctgcaatgaatgtgggaagaccttccggcagaagagcgccctgattgtgcaccagaggacccacatccggcagaagccctacggctgcaaccagtgtgggaagagcttctgtgtgaagagcaagctgattgcccaccacaggacccacactggagagaagccctatgagtgcaatgtgtgtgggaagagcttctacgtgaagagcaagctgactgtgcaccagaggatccacctgggcaggaaccccatcaacgtggtgaatgaaggcaactacagcggctag

SEQ ID NO: 17827 - DNA, 1686 bp, Artificial Sequence; identical to SEQ ID NO: 17826
  Description of Artificial Sequence: Synthetic coding sequence

SEQ ID NO: 17828 - DNA, 1188 bp, Artificial Sequence
  Description of Artificial Sequence: Synthetic coding sequence
atgaggaacatcatgtactttggaggcacctgccagagccctgccctgcctgccctggtgcggcccccagccccacccctgcagcccagcctggacatcaagcccttcctgcccttccccctggacacagctgctgctgtgaacctcttccccaacttcaatgccatggaccccatccagaaggccgtcatcaaccacaccttcggcgtgcccctgccccacaggaggaagcagatcatcagctgcaacatctgccagctgcgcttcaacagcgacagccaggccgccgcccactacaagggcaccaagcacgccaagaagctgaaggccctggaggccatgaagaacaagcagaagtctgtgacagccaaggacagcgccaagaccaccttcaccagcatcaccaccaacaccatcaacaccagcagtgacaagacagatggaacagctggcaccccagccatcagcaccaccaccaccgtggagatcaggaagagctctgtgatgaccacagagatcaccagcaaggtggagaagagccccaccacagccactggaaacagcagctgccccagcacagaaacagaggaggagaaggccaagaggctgctgtactgcagcctgtgcaaggtggccgtgaacagcgccagccagctggaggcccacaacagcggcaccaagcacaagaccatgctggaggccagaaatggcagcggcaccatcaaggccttccccagggctggggtgaagggcaagggccctgtgaacaagggcaacacaggcctgcagaacaagaccttccactgtgagatctgtgatgtgcacgtgaacagcgagacccagctgaagcagcacatcagcagcagaagacacaaggacagagctgctgggaagccacccaagcccaagtacagcccctacaacaagctgcagaagacagcccaccccctgggcgtgaagctggtgttcagcaaggagcccagcaagcccctggccccccgcatcctgcccaaccccctggccgctgctgctgctgctgctgctgtggccgtgagcagccccttcagcctgaggacagccccagctgccaccctcttccagaccagcgccctgcccccagccctgctgcggcctgcccctggccccatcagaacagcccacacccctgtgctgtttgccccctactag

SEQ ID NO: 17829 - DNA, 1077 bp, Artificial Sequence
  Description of Artificial Sequence: Synthetic coding sequence
atggagagcctgcggggcaacacagcccagggccccaccaatgaggaggactacaagaatgaaggccagctgagccggcagaccaagtgcccagcccagaagaagagcagctttgaaaatacagtggtgaggaaggtgtctgtgaccctgaaggagatcttcaccggggaggagggccctgagagcagcgagttcagcctgagccccaacctggatgcccagcagaagatccccaagggccacggcagccccatcagcaggaagaacagcaaggacaacagcgacctgatcaagcaccagaggctcttcagccagaggaagccctgcaagtgcaatgaatgtgagaaggccttctcctaccagagcgacctgctggtgcacagccgcatccatggaggagagaagccctttgagtgcaacaagtgtgggaagagcttcagccgcagcacccacctgattgagcaccagaggacccacactggagagaagccctatgagtgcaatgaatgtgggaaggccttcagccgcagcacccacctgagcctgcaccagaggatccacactggagagaagccctatgagtgcagtgaatgtgggaaggccttcagccgcagcaccaacctgagccagcaccagaggacccacacccaggagcggccctacaagtgcaatgaatgtgggaaggccttcggggacaggagcaccatcatccagcaccagaggatccacactggagagaacccctatgagtgcagcaaatgtgggaaggccttctcctggatcagcagcctgacagagcaccagaggacccacactggagagaacccctatgagtgcagtgaatgtgggaaggtgttcagccgcagcagcagcctgacagagcaccagaggatccacagcggggagaagccccatgagtgccgggtgtgtgggaagggcttcagccgcagcagcagcctcatcatccaccagaggacccacactggagagaagccctacaagtgcaatgactgtgggaaggccttctgccagagcagcaccctcatccgccaccagcacctgcacaccaaggagtag

SEQ ID NO: 17830 - DNA, 402 bp, Artificial Sequence
  Description of Artificial Sequence: Synthetic coding sequence
atggagagcctgcggggcaacacagcccagggccccaccaatgaggaggactacaagaatgaaggccagctgagccggcagaccaagtgcccagcccagaagaagagcagctttgaaaatacagtggtgaggaaggtgtctgtgaccctgaaggagatcttcaccggggaggagggccctgagagcagcgagttcagcctgagccccaacctggatgcccagcagaagatccccaagggccacggcagccccatcagcaggaagaacagcaaggacaacagcgacctgatcaagcaccagaggctcttcagccagaggaagccctgcaagtgcaatgaatgtgagaaggccttctcctaccagagcgacctgctggtgcacagccgcatccatggaggatag

SEQ ID NO: 17831 - DNA, 1686 bp, Artificial Sequence
  Description of Artificial Sequence: Synthetic coding sequence
atgaacagcagcctgacagcccagaggcggggcagtgatgctgagctgggcccctgggtgatggccgcccggagcaaggatgctgcccccagccagagagatggcctgctgcctgtgaaggtggaggaggacagccctggctcctgggagcccaactacccagctgccagcccagaccctgagaccagccggctgcacttccggcagctgcgctaccaggaggtggccggccctgaggaggccctgagccggctgcgggagctgtgccgccgctggctgcggcctgagctgctgagcaaggagcagatcctggagctgctggtgctggagcagttcctgaccatcctgcctgaggagctgcaggcctgggtgcgggagcactgcccagagagcggggaggaggccgtggccgtggtgcgggccctgcagagggccctggatggcaccagcagccagggcatggtgacctttgaggacacagctgtgtccctgacctgggaggagtgggagcggctggaccctgcccggcgggacttctgccgggagagcgcccagaaggacagcggcagcacagtgccccccagcctggagagccgggtggagaacaaggagctgatccccatgcagcagatcctggaggaggccgagccccagggccagctgcaggaggccttccagggcaagaggcccctcttcagcaaatgtggcagcacccatgaggacagagtggagaagcagagcggggaccccctgcccctgaagctggagaacagccctgaggccgagggcctgaacagcatcagtgatgtgaacaagaatggcagcattgaaggagaggacagcaagaacaatgagctgcagaacagcgcccgctgcagcaacctggtgctgtgccagcacatccccaaggccgagcggcccacagacagcgaggagcacggcaacaagtgcaagcagagcttccacatggtgacctggcacgtgctgaagccccacaagagtgacagcggggacagcttccaccacagcagcctgtttgagacccagaggcagctgcacgaggagcggccctacaagtgtggcaactgtgggaagagcttcaagcagaggagtgacctcttccgccaccagaggatccacactggagagaagccctacggctgccaggagtgtgggaagagcttcagccagagcgctgccctgaccaagcaccagaggacccacactggagagaagccctacacctgcctgaagtgtggggagcgcttccggcagaacagccacctgaacagacaccagagcacccacagccgggacaagcacttcaagtgtgaggagtgtggggagacctgccacatcagcaacctcttccgccaccagaggctgcacaagggggagcggccctacaagtgtgaagaatgtgagaagagcttcaagcagaggagtgacctcttcaagcaccaccgcatccacactggagagaagccctacggctgcagcgtgtgtgggaagcgcttcaaccagagcgccaccctcatcaagcaccagaggatccacactggagagaagccctacaagtgcctggagtgtggggagcgcttccggcagagcacccacctgatccgccaccagaggatccaccagaacaaggtgctgtctgctggccggggcggcagccggctgtag

SEQ ID NO: 17832 - DNA, 489 bp, Artificial Sequence
  Description of Artificial Sequence: Synthetic coding sequence
atgaacagcagcctgacagcccagaggcggggcagtgatgctgagctgggcccctgggtgatggccgcccggagcaaggatgctgcccccagccagagagatggcctgctgcctgtgaaggtggaggaggacagccctggctcctgggagcccaactacccagctgccagcccagaccctgagaccagccggctgcacttccggcagctgcgctaccaggaggtggccggccctgaggaggccctgagccggctgcgggagctgtgccgccgctggctgcggcctgagctgctgagcaaggagcagatcctggagctgctggtgctggagcagttcctgaccatcctgcctgaggagctgcaggcctgggtgcgggagcactgcccagagagcggggaggaggccgtggccgtggtgcgggccctgcagagggccctggatggcaccagcagccaggtgtggaaggccgagtggaggaccaagagctag

SEQ ID NO: 17833 - DNA, 1416 bp, Artificial Sequence
  Description of Artificial Sequence: Synthetic coding sequence
atgaagggcaactatgagagcctcatctccatggactatgccatcaaccagccagatgtgctgagccagatccagcctgagggggagcacaacacagaggaccaggccggccctgaggagagcgagatccccacagaccccagcgaggagcccggcatcagcaccagtgacatcctgtcctggatcaagcaggaggaggagccccaggtgggcgcccctcctgagagcaaggagagtgatgtgtacaagagcacctatgcagatgaggagctggtgatcaaggccgagggcctggcccggagcagcctgtgcccagaggtgcctgtgcccttcagcagccccccagctgctgccaaggatgccttcagtgatgtggccttcaagagccagcagagcacctccatgacccccttcggccgcccagccacagacctgcctgaggccagcgagggccaggtgaccttcacccagctgggcagctaccccctgcccccacctgtgggggagcaggtgttcagctgccaccactgcggcaagaacctgagccaggacatgctgctgacccaccagtgcagccacgccacagagcaccccctgccctgtgcccagtgccccaagcacttcaccccccaggccgacctgagcagcaccagccaggaccacgccagcgagaccccacccacctgcccccactgtgcccggaccttcacccaccccagccggctgacctaccacctgcgggtgcacaacagcacagagcggcccttcccctgcccagactgccccaagagatttgctgaccaggcccggctgaccagccacagaagagcccacgccagcgagcggcccttccgctgtgcccagtgtggccgctccttcagcctgaagatcagcctgctgctgcaccagaggggccacgcccaggagcggcccttcagctgcccccagtgtggcatcgacttcaacggccacagcgccctgatccgccaccagatgatccacactggagagcggccctacccctgcacagactgcagcaagagcttcatgaggaaggagcacctgctgaaccaccggcggctgcacactggagagcggcccttcagctgcccccactgcggcaagagcttcatcaggaagcaccacctgatgaagcaccagaggatccacactggagagcggccctacccctgcagctactgcggccgctccttccgctacaagcagaccctgaaggaccacctgcggagcggccacaacggcggctgcggcggggacagcgaccccagcggccagccccccaaccccccaggccccctcatcaccggcctggagaccagcggcctgggcgtgaacacagagggcctggagaccaaccagtggtacggggagggcagcggcggcggcgtgctgtag

SEQ ID NO: 17834 - DNA, 1416 bp, Artificial Sequence; identical to SEQ ID NO: 17833
  Description of Artificial Sequence: Synthetic coding sequence

SEQ ID NO: 17835 - DNA, 1416 bp, Artificial Sequence; identical to SEQ ID NO: 17833
  Description of Artificial Sequence: Synthetic coding sequence

SEQ ID NO: 17836 - DNA, 1929 bp, Artificial Sequence
  Description of Artificial Sequence: Synthetic coding sequence
atggccgaggccgccccagcccccaccagcgagtgggacagtgaatgtctgaccagcctgcagcccctgcccctgcccaccccacctgctgccaatgaggcccacctgcagacagctgccatcagcctgtggacagtggtggccgctgtgcaggccattgaaaggaaggtggagatccacagccggcggctgctgcacctggagggccgcactggaacagctgagaagaagctggccagctgtgagaagacagtgacagagctgggcaaccagctggagggcaagtgggccgtgctgggcaccctgctgcaggagtatggcctgctgcagaggcggctggagaacctggagaacctgctgaggaacagaaacttctggatcctgcggctgcccccaggcatcaagggggacatccccaaggtgcctgtggcctttgatgatgtgtccatctacttcagcaccccagagtgggagaagctggaggagtggcagaaggagctgtacaagaacatcatgaagggcaactatgagagcctcatctccatggactatgccatcaaccagccagatgtgctgagccagatccagcctgagggggagcacaacacagaggaccaggccggccctgaggagagcgagatccccacagaccccagcgaggagcccggcatcagcaccagtgacatcctgtcctggatcaagcaggaggaggagccccaggtgggcgcccctcctgagagcaaggagagtgatgtgtacaagagcacctatgcagatgaggagctggtgatcaaggccgagggcctggcccggagcagcctgtgcccagaggtgcctgtgcccttcagcagccccccagctgctgccaaggatgccttcagtgatgtggccttcaagagccagcagagcacctccatgaccccatttggccggcctgccacagacctgcctgaggccagcgagggccaggtgaccttcacccagctgggcagctaccccctgcccccacctgtgggggagcaggtgttcagctgccaccactgtgggaagaacctgagccaggacatgctgctgacccaccagtgcagccacgccacagagcaccccctgccctgtgcccagtgccccaagcacttcaccccccaggccgacctgagcagcaccagccaggaccacgccagcgagaccccacccacctgcccccactgtgcccggaccttcacccaccccagccggctgacctaccacctgcgggtgcacaacagcacagagcggcccttcccctgcccagactgccccaagagatttgctgaccaggcccggctgaccagccaccggcgggcccacgccagcgagcggcccttccgctgtgcccagtgtggccgctccttcagcctgaagatcagcctgctgctgcaccagaggggccacgcccaggagcggcccttcagctgcccccagtgtggcatcgacttcaacggccacagcgccctgatccgccaccagatgatccacactggagagcggccctacccctgcacagactgcagcaagagcttcatgaggaaggagcacctgctgaaccaccggcggctgcacactggagagcggcccttcagctgcccccactgtgggaagagcttcatcaggaagcaccacctgatgaagcaccagaggatccacactggagagcggccctacccctgcagctactgcggccgctccttccgctacaagcagaccctgaaggaccacctgcggagcggccacaatggaggctgcggcggggacagcgaccccagcggccagccccccaaccccccaggccccctcatcaccggcctggagaccagcggcctgggcgtgaacacagagggcctggagaccaaccagtggtatggagagggcagcggcggcggcgtgctgtag

SEQ ID NO: 17837 - DNA, 1416 bp, Artificial Sequence; identical to SEQ ID NO: 17833
  Description of Artificial Sequence: Synthetic coding sequence

SEQ ID NO: 17838 - DNA, 1416 bp, Artificial Sequence; identical to SEQ ID NO: 17833
  Description of Artificial Sequence: Synthetic coding sequence

SEQ ID NO: 17839 - DNA, 1944 bp, Artificial Sequence
  Description of Artificial Sequence: Synthetic coding sequence
atgattggcctcatccagggccggcggctggccgagcagaccagcgagtgggacagcgagtgcctgaccagcctgcagcccctgcccctgcccaccccacctgctgccaatgaggcccacctgcagacagctgccatcagcctgtggacagtggtggccgctgtgcaggccatcgagaggaaggtggagatccacagccggcggctgctgcacctggagggccgcactggaacagctgagaagaagctggccagctgtgagaagacagtgacagagctgggcaaccagctggagggcaagtgggccgtgctgggcaccctgctgcaggagtatggcctgctgcagaggcggctggagaacctggagaacctgctgaggaacagaaacttctggatcctgcggctgcccccaggcatcaagggggacatccccaaggtgcctgtggcctttgatgatgtgtccatctacttcagcaccccagagtgggagaagctggaggagtggcagaaggagctgtacaagaacatcatgaagggcaactatgagagcctcatctccatggactatgccatcaaccagccagatgtgctgagccagatccagcctgagggggagcacaacacagaggaccaggccggccctgaggagagcgagatccccacagaccccagcgaggagcccggcatcagcaccagtgacatcctgtcctggatcaagcaggaggaggagccccaggtgggcgcccctcctgagagcaaggagagtgatgtgtacaagagcacctatgcagatgaggagctggtgatcaaggccgagggcctggcccggagcagcctgtgcccagaggtgcctgtgcccttcagcagccccccagctgctgccaaggatgccttcagtgatgtggccttcaagagccagcagagcacctccatgacccccttcggccgcccagccacagacctgcctgaggccagcgagggccaggtgaccttcacccagctgggcagctaccccctgcccccacctgtgggggagcaggtgttcagctgccaccactgcggcaagaacctgagccaggacatgctgctgacccaccagtgcagccacgccacagagcaccccctgccctgtgcccagtgccccaagcacttcaccccccaggccgacctgagcagcaccagccaggaccacgccagcgagaccccacccacctgcccccactgtgcccggaccttcacccaccccagccggctgacctaccacctgcgggtgcacaacagcacagagcggcccttcccctgcccagactgccccaagagatttgctgaccaggcccggctgaccagccacagaagagcccacgccagcgagcggcccttccgctgtgcccagtgtggccgctccttcagcctgaagatcagcctgctgctgcaccagaggggccacgcccaggagcggcccttcagctgcccccagtgtggcatcgacttcaacggccacagcgccctgatccgccaccagatgatccacactggagagcggccctacccctgcacagactgcagcaagagcttcatgaggaaggagcacctgctgaaccaccggcggctgcacactggagagcggcccttcagctgcccccactgcggcaagagcttcatcaggaagcaccacctgatgaagcaccagaggatccacactggagagcggccctacccctgcagctactgcggccgctccttccgctacaagcagaccctgaaggaccacctgcggagcggccacaacggcggctgcggcggggacagcgaccccagcggccagccccccaaccccccaggccccctcatcaccggcctggagaccagcggcctgggcgtgaacacagagggcctggagaccaaccagtggtacggggagggcagcggcggcggcgtgctgtag

SEQ ID NO: 17840 - DNA, 6747 bp, Artificial Sequence
  Description of Artificial Sequence: Synthetic coding sequence
atgatggacagcgagaacaagccagaaaatgatgaagatgagaagatcaacaaggaggcccaggacctgaccaagctgagcagccacaatgaagatggcggccctgtgtctgatgtgattgccagcttcccagaaaattccatgggcaagaggggcttcagcgagagcagcaacagcgacagcgtggtgattggagaggacaggaacaagcacgccagcaagaggaggaagctggatgaagctgagcccctgaagagcggcaagcagggcatctgccgcctggagaccagcgagagctctgtgacagagggcggcatcgccctggatgaaacaggcaaggagaccttcctgagtgactgcaccgtgggcggcacctgcctgcccaatgccctgagccccagctgcaacttcagcaccattgatgtggtgtccctgaagacagacacagagaagaccagcgcccaggagatggtgtccctggacctggagcgggagagccccttcccccccaaggagatctctgtgtcctgcaccatcggaaatgtggacacagtgctgaagtgcagcatctgtggccacctgttcagcagctgcagcgacctggagaagcatgctgagagccacatgcagcagcccaaggagcacacctgctgccactgcagccacaaggccgagagcagcagcgccctgcacatgcacatcaagcaggcccacggcccccagaaggtgttcagctgtgacctgtgtggcttccagtgcagcgaggagaacctgctgaatgcccactacctgggcaagacccacctgcggcggcagaacctggccgcccggggcggctttgtgcagatcctgaccaagcagcccttccccaagaagagcaggaccatggccaccaagaatgtgcacagcaagcccaggaccagcaagagcatcgccaagaacagcgacagcaagggcctgagaaatgtgggcagcaccttcaaggacttccggggcagcatcagcaagcagagcggcagcagcagcgagctgctggtggagatgatgcccagcaggaacaccctgagccaggaggtggagatcgtggaggagcacgtgaccagcctgggcctggcccagaaccctgagaaccagagcaggaagctggacaccctggtgaccagcgagggcctgctggagaagctggagagcaccaagaacaccctgcaggccgcccacggcaacagcgtgaccagccggcccaggcctgagaggaacatcctggtgctgggcaacagcttcagaagaagaagcagcaccttcaccctgaagggccaggccaagaagcgcttcaacctgctgggcatcaagaggggcaccagcgagacccagaggatgtacatgaagcacctgcggacccagatgaagacccatgatgctgagagcgtgctgaagcacctggaggcctgcagctctgtgcagagggtgtgtgtgaccaccagcgagacccaggaggccgagcagggccagggcagcgcccggcccccagattctggcctgcacagcctgactgtgaagccagccagcggcagccagaccctgtgtgcctgcacagactgtggccaggtggccaccaacagaacagacctggagatccacgtgaagcgctgccacgcccgggagatgaagttctactgcaggacctgtgacttcagctccatgagcagaagagacctggatgagcacctgcacagcaaccagcaccagcagacagcctctgtgctgagctgccagtgctgcagcttcatcagcctggatgagatcaacctgcgggaccacatgaaggagaagcacaacatgcacttcctgtgcaccccctgcaacctcttcttcctgtctgagaaggatgtggaggagcacaaggccacagagaagcacatcaacagcctggtgcagcccaagaccctgcagagcagcaacagcgacctggtgctgcagaccctgcccctgagcaccctggagagtgaaaatgccaaggagagcatggatgacagcggcaaggccagccaggaggagcccctgaagagccgggtgtcccatggaaatgaggtgcgccacagcagcaagccccagttccagtgcaagaagtgcttctacaagaccaggagcagcacagtgctgaccaggcacatcaagctgcggcacggccaggactaccacttcctgtgcaaggcctgcaacctgtacagcctgagcaaggagggcatggagaagcacatcaagaggagcaagcacctggagaatgccaagaagaacaacatcggcctgagctttgaagaatgtattgagcgggtgtgcatcggggccaatgacaagaaggaggagtttgatgtgtctggaaatggaagaattgagggccacatcggcgtgcagctgcaggagcacagctacctggagaagggcatgctggccagcgaggagctgagccagagcggcggcagcaccaaggatgatgagctggccagcaccaccacccccaagaggggccggcccaagggcaacatcagcaggacctgcagccactgcggcctgctggccagcagcatcaccaacctgactgtgcacatccggaggaagcacagccaccagtacagctacctgtgcaaggtgtgcaagtactacacagtgaccaagggggacatggagcggcactgtgccaccaagaagcacaagggccgggtggagattgaggccagcggcaagcacagcagtgacatcatcgtgggccctgagggcggcagcctggaggccggcaagaagaatgccggcagcgctgtgaccatgtctgatgaacatgccaacaagccagctgagagccccacctctgtgctggagaagccagaccggggcaacagcattgaggccgaggtggagaatgtgttccacagcctggatggagaggtgaacagccacctgctggacaagaaggagcagatcagcagcgagccagaagattttgcccagcctggagatgtgtacagccagagagatgtgacaggcaccggggagaacaagtgcctgcactgtgagttcagcgcccacagcagcgccagcctggagctgcacgtgaagaggaagcacaccaaggagtttgagttctactgcatggcctgtgactactatgctgtgacccggcgggagatgaccaggcatgctgccacagagaagcacaagatgaagaggcagagctacctgaacagcgccaacgtggaggccggcagcgctgacatgagcaagaacatcatcatgcctgaggaggagcaccagcagaacagcgaggagttccagatcatcagcggccagcccagcgacaccctgaagagcagaaatgctgctgactgcagcatcctgaatgaaaacaccaacctggacatgagcaaggtgctgtgtgccgctgacagcgtggaggtggagacagaggaggagagcaacttcaatgaagaccacagcttctgtgagaccttccagcaggcccctgtgaaggacaaggtgaggaagccagaggagatgatgagcctgaccatgagcagcaactacggcagccccagccgcttccagaatgaaaattctggcagcagcgccctgaactgtgaaacagccaagaagaaccacgagatcagcaatgatgctggggagctgcgggtgcactgtgagggggagggcggcaatgctggagatggcggcggcgtggtgccccaccgccacctgtgccctgtgaccctggatggagagaggtctgctgagagccctgtgctggtggtgacccgcatcacccgggagcagggcaacctggagagcggcggccagaacagagtggcccggggccacggcctggaggacctgaagggcgtgcaggaggaccctgtgctgggcaacaaggagatcctgatgaacagccagcacgagacagagttcatcctggaggaggatggccctgccagtgacagcacagtggagagcagtgatgtgtatgagaccatcatcagcattgatgacaagggccaggccatgtacagctttggccgctttgacagcagcatcatccgcatcaagaacccagaagatggagagctgattgaccagagcgaggagggcctcatcgccaccggggtgcgcatcagcgagctgcccctgaaggactgtgcccagggcgtgaagaagaagaagtctgagggcagcagcatcggggagagcacccgcatccgctgtgatgactgtggcttcctggctgatggcctgagcggcctgaatgtgcacatcgccatgaagcaccccaccaaggagaagcacttccactgcctgctgtgtgggaagagcttctacacagagagcaacctgcaccagcacctggccagcgctggccacatgagaaatgagcaggcctctgtggaggagctgcctgagggcggggccaccttcaagtgtgtgaagtgcacagagccctttgattctgagcagaacctcttcctgcacatcaagggccagcacgaggagctgctgcgggaggtgaacaagtacatcgtggaggacacagagcagatcaaccgggagcgggaggagaaccagggcaatgtgtgcaagtactgtgggaagatgtgccgcagcagcaacagcatggccttcctggcccacatccgcacccacacaggcagcaagcccttcaagtgcaagatctgccactttgccacagcccagctgggagatgccagaaatcatgtgaagaggcacctgggcatgagggagtacaagtgccacgtgtgtggggtggcctttgtgatgaagaagcacctgaacacccacctgctgggcaagcacggcgtgggcacccccaaggagaggaagttcacctgccacctgtgtgacaggagcttcacagagaagtgggccctgaacaaccacatgaagctgcacactggagagaagcccttcaagtgcacctggcccacctgccactacagcttcctgacagccagcgccatgaaggaccactaccgcacccacactggagagaagagcttcctgtgtgacctgtgtggctttgctgggggcaccaggcatgccctgaccaagcaccggcggcagcacactggagagaagcccttcaagtgtgatgagtgcaactttgccagcaccacccagagccacctgaccaggcacaagagggtgcacactggagagaagccctaccgctgcccctggtgtgactaccgcagcaactgtgccgagaacatcaggaagcacatcctgcacacaggcaagcatgaaggagtgaagatgtacaactgccccaagtgtgactatggcaccaacgtgcctgtggagttcaggaaccacctgaaggagcagcacccagacatcgagaacccagacctggcctacctgcatgctggcatcgtgtccaagagctatgaatgtcggctgaagggccagggcgccacctttgtggagacagacagccccttcaccgctgctgccctggccgaggagcccctggtgaaggagaagcccctgcggagcagccggcggcctgcccctcctcctgagcaggtgcagcaggtgatcatcttccagggctatgatggagaatttgccctggaccccagcgtggaggagacagctgctgccaccctgcagaccctggccatggccggccaggtggcccgggtggtgcacatcacagaagatggccaggtgattgccaccagccagagcggggcccacgtgggctctgtggtgcccggccccatcctgcctgagcagctggctgatggagccacccaggtggtggtggtgggcggctccatggagggccacggcatggatgagagcctgagccctggaggagctgtgatccagcaggtgaccaagcaggagatcctgaacctgtctgaggccggcgtggcccctcctgaggccagcagcgccctggatgccctgctgtgtgctgtgacagagctgggggaggtggagggccgggccggcctggaggagcagggccggcctggggccaaggatgtgctgatccagctgcccggccaggaggtgagccacgtggccgctgaccctgaggcccctgagatccagatgttcccccaggcccaggagagccctgctgctgtggaggtgctgacccaggtggtgcaccccagcgctgccatggccagccaggagcgggcccaggtggccttcaagaagatggtgcagggcgtgctgcagtttgctgtgtgtgacacagctgctgctggccagctggtgaaggatggagtgacccaggtggtggtgtctgaggagggcgctgtgcacatggtggccggggagggcgcccagatcatcatgcaggaggcccagggcgagcacatggacctggtggagagtgatggagagatcagccagatcatcgtgacagaggagctggtgcaggccatggtgcaggagagcagcggcggcttcagcgagggcaccacccactacatcctgacagagctgcccccaggagtgcaggatgagcccggcctgtacagccacacagtgctggagacagctgacagccaggagctgctgcaggccggggccaccctgggcacagaggccggggcccccagcagagctgagcagctggcctctgtggtgatctacacccaggagggcagcagcgctgctgctgccatccagagccagcgggagagcagcgagctgcaggaggcctag

SEQ ID NO: 17841 - DNA, 4983 bp, Artificial Sequence
  Description of Artificial Sequence: Synthetic coding sequence
atgatggacagcgagaacaagccagaaaatgatgaagatgagaagatcaacaaggaggcccaggacctgaccaagctgagcagccacaatgaagatggcggccctgtgtctgatgtgattgccagcttcccagaaaattccatgggcaagaggggcttcagcgagagcagcaacagcgacagcgtggtgattggagaggacaggaacaagcacgccagcaagaggaggaagctggatgaagctgagcccctgaagagcggcaagcagggcatctgccgcctggagaccagcgagagctctgtgacagagggcggcatcgccctggatgaaacaggcaaggagaccttcctgagtgactgcaccgtgggcggcacctgcctgcccaatgccctgagccccagctgcaacttcagcaccattgatgtggtgtccctgaagacagacacagagaagaccagcgcccaggagatggtgtccctggacctggagcgggagagccccttcccccccaaggagatctctgtgtcctgcaccatcggaaatgtggacacagtgctgaagtgcagcatctgtggccacctgttcagcagctgcagcgacctggagaagcatgctgagagccacatgcagcagcccaaggagcacacctgctgccactgcagccacaaggccgagagcagcagcgccctgcacatgcacatcaagcaggcccacggcccccagaaggtgttcagctgtgacctgtgtggcttccagtgcagcgaggagaacctgctgaatgcccactacctgggcaagacccacctgcggcggcagaacctggccgcccggggcggctttgtgcagatcctgaccaagcagcccttccccaagaagagcaggaccatggccaccaagaatgtgcacagcaagcccaggaccagcaagagcatcgccaagaacagcgacagcaagggcctgagaaatgtgggcagcaccttcaaggacttccggggcagcatcagcaagcagagcggcagcagcagcgagctgctggtggagatgatgcccagcaggaacaccctgagccaggaggtggagatcgtggaggagcacgtgaccagcctgggcctggcccagaaccctgagaaccagagcaggaagctggacaccctggtgaccagcgagggcctgctggagaagctggagagcaccaagaacaccctgcaggccgcccacggcaacagcgtgaccagccggcccaggcctgagaggaacatcctggtgctgggcaacagcttcagaagaagaagcagcaccttcaccctgaagggccaggccaagaagcgcttcaacctgctgggcatcaagaggggcaccagcgagacccagaggatgtacatgaagcacctgcggacccagatgaagacccatgatgctgagagcgtgctgaagcacctggaggcctgcagctctgtgcagagggtgtgtgtgaccaccagcgagacccaggaggccgagcagggccagggcagcgcccggcccccagattctggcctgcacagcctgactgtgaagccagccagcggcagccagaccctgtgtgcctgcacagactgtggccaggtggccaccaacagaacagacctggagatccacgtgaagcgctgccacgcccgggagatgaagttctactgcaggacctgtgacttcagctccatgagcagaagagacctggatgagcacctgcacagcaaccagcaccagcagacagcctctgtgctgagctgccagtgctgcagcttcatcagcctggatgagatcaacctgcgggaccacatgaaggagaagcacaacatgcacttcctgtgcaccccctgcaacctcttcttcctgtctgagaaggatgtggaggagcacaaggccacagagaagcacatcaacagcctggtgcagcccaagaccctgcagagcagcaacagcgacctggtgctgcagaccctgcccctgagcaccctggagagtgaaaatgccaaggagagcatggatgacagcggcaaggccagccaggaggagcccctgaagagccgggtgtcccatggaaatgaggtgcgccacagcagcaagccccagttccagtgcaagaagtgcttctacaagaccaggagcagcacagtgctgaccaggcacatcaagctgcggcacggccaggactaccacttcctgtgcaaggcctgcaacctgtacagcctgagcaaggagggcatggagaagcacatcaagaggagcaagcacctggagaatgccaagaagaacaacatcggcctgagctttgaagaatgtattgagcgggtgtgcatcggggccaatgacaagaaggaggagtttgatgtgtctggaaatggaagaattgagggccacatcggcgtgcagctgcaggagcacagctacctggagaagggcatgctggccagcgaggagctgagccagagcggcggcagcaccaaggatgatgagctggccagcaccaccacccccaagaggggccggcccaagggcaacatcagcaggacctgcagccactgcggcctgctggccagcagcatcaccaacctgactgtgcacatccggaggaagcacagccaccagtacagctacctgtgcaaggtgtgcaagtactacacagtgaccaagggggacatggagcggcactgtgccaccaagaagcacaagggccgggtggagattgaggccagcggcaagcacagcagtgacatcatcgtgggccctgagggcggcagcctggaggccggcaagaagaatgccggcagcgctgtgaccatgtctgatgaacatgccaacaagccagctgagagccccacctctgtgctggagaagccagaccggggcaacagcattgaggccgaggtggagaatgtgttccacagcctggatggagaggtgaacagccacctgctggacaagaaggagcagatcagcagcgagccagaagattttgcccagcctggagatgtgtacagccagagagatgtgacaggcaccggggagaacaagtgcctgcactgtgagttcagcgcccacagcagcgccagcctggagctgcacgtgaagaggaagcacaccaaggagtttgagttctactgcatggcctgtgactactatgctgtgacccggcgggagatgaccaggcatgctgccacagagaagcacaagatgaagaggcagagctacctgaacagcgccaacgtggaggccggcagcgctgacatgagcaagaacatcatcatgcctgaggaggagcaccagcagaacagcgaggagttccagatcatcagcggccagcccagcgacaccctgaagagcagaaatgctgctgactgcagcatcctgaatgaaaacaccaacctggacatgagcaaggtgctgtgtgccgctgacagcgtggaggtggagacagaggaggagagcaacttcaatgaagaccacagcttctgtgagaccttccagcaggcccctgtgaaggacaaggtgaggaagccagaggagatgatgagcctgaccatgagcagcaactacggcagccccagccgcttccagaatgaaaattctggcagcagcgccctgaactgtgaaacagccaagaagaaccacgagatcagcaatgatgctggggagctgcgggtgcactgtgagggggagggcggcaatgctggagatggcggcggcgtggtgccccaccgccacctgtgccctgtgaccctggatggagagaggtctgctgagagccctgtgctggtggtgacccgcatcacccgggagcagggcaacctggagagcggcggccagaacagagtggcccggggccacggcctggaggacctgaagggcgtgcaggaggaccctgtgctgggcaacaaggagatcctgatgaacagccagcacgagacagagttcatcctggaggaggatggccctgccagtgacagcacagtggagagcagtgatgtgtatgagaccatcatcagcattgatgacaagggccaggccatgtacagctttggccgctttgacagcagcatcatccgcatcaagaacccagaagatggagagctgattgaccagagcgaggagggcctcatcgccaccggggtgcgcatcagcgagctgcccctgaaggactgtgcccagggcgtgaagaagaagaagtctgagggcagcagcatcggggagagcacccgcatccgctgtgatgactgtggcttcctggctgatggcctgagcggcctgaatgtgcacatcgccatgaagcaccccaccaaggagaagcacttccactgcctgctgtgtgggaagagcttctacacagagagcaacctgcaccagcacctggccagcgctggccacatgagaaatgagcaggcctctgtggaggagctgcctgagggcggggccaccttcaagtgtgtgaagtgcacagagccctttgattctgagcagaacctcttcctgcacatcaagggccagcacgaggagctgctgcgggaggtgaacaagtacatcgtggaggacacagagcagatcaaccgggagcgggaggagaaccagggcaatgtgtgcaagtactgtgggaagatgtgccgcagcagcaacagcatggccttcctggcccacatccgcacccacacaggcagcaagcccttcaagtgcaagatctgccactttgccacagcccagctgggagatgccagaaatcatgtgaagaggcacctgggcatgagggagtacaagtgccacgtgtgtggggtggcctttgtgatgaagaagcacctgaacacccacctgctgggcaagcacggcgtgggcacccccaaggagcgggtgaaggtggcctacaggaagattggcaccctgcccggcatccagaacaacagaaatgccagcagcgccagcgaggcccagagcctgtgtgagcacttctcctag

SEQ ID NO: 17842 - DNA, 5448 bp, Artificial Sequence
  Description of Artificial Sequence: Synthetic coding sequence
atgatggacagcgagaacaagccagaaaatgatgaagatgagaagatcaacaaggaggcccaggacctgaccaagctgagcagccacaatgaagatggcggccctgtgtctgatgtgattgccagcttcccagaaaattccatgggcaagaggggcttcagcgagagcagcaacagcgacagcgtggtgattggagaggacaggaacaagcacgccagcaagaggaggaagctggatgaagctgagcccctgaagagcggcaagcagggcatctgccgcctggagaccagcgagagctctgtgacagagggcggcatcgccctggatgaaacaggcaaggagaccttcctgagtgactgcaccgtgggcggcacctgcctgcccaatgccctgagccccagctgcaacttcagcaccattgatgtggtgtccctgaagacagacacagagaagaccagcgcccaggagatggtgtccctggacctggagcgggagagccccttcccccccaaggagatctctgtgtcctgcaccatcggaaatgtggacacagtgctgaagtgcagcatctgtggccacctgttcagcagctgcagcgacctggagaagcatgctgagagccacatgcagcagcccaaggagcacacctgctgccactgcagccacaaggccgagagcagcagcgccctgcacatgcacatcaagcaggcccacggcccccagaaggtgttcagctgtgacctgtgtggcttccagtgcagcgaggagaacctgctgaatgcccactacctgggcaagacccacctgcggcggcagaacctggccgcccggggcggctttgtgcagatcctgaccaagcagcccttccccaagaagagcaggaccatggccaccaagaatgtgcacagcaagcccaggaccagcaagagcatcgccaagaacagcgacagcaagggcctgagaaatgtgggcagcaccttcaaggacttccggggcagcatcagcaagcagagcggcagcagcagcgagctgctggtggagatgatgcccagcaggaacaccctgagccaggaggtggagatcgtggaggagcacgtgaccagcctgggcctggcccagaaccctgagaaccagagcaggaagctggacaccctggtgaccagcgagggcctgctggagaagctggagagcaccaagaacaccctgcaggccgcccacggcaacagcgtgaccagccggcccaggcctgagaggaacatcctggtgctgggcaacagcttcagaagaagaagcagcaccttcaccctgaagggccaggccaagaagcgcttcaacctgctgggcatcaagaggggcaccagcgagacccagaggatgtacatgaagcacctgcggacccagatgaagacccatgatgctgagagcgtgctgaagcacctggaggcctgcagctctgtgcagagggtgtgtgtgaccaccagcgagacccaggaggccgagcagggccagggcagcgcccggcccccagattctggcctgcacagcctgactgtgaagccagccagcggcagccagaccctgtgtgcctgcacagactgtggccaggtggccaccaacagaacagacctggagatccacgtgaagcgctgccacgcccgggagatgaagttctactgcaggacctgtgacttcagctccatgagcagaagagacctggatgagcacctgcacagcaaccagcaccagcagacagcctctgtgctgagctgccagtgctgcagcttcatcagcctggatgagatcaacctgcgggaccacatgaaggagaagcacaacatgcacttcctgtgcaccccctgcaacctcttcttcctgtctgagaaggatgtggaggagcacaaggccacagagaagcacatcaacagcctggtgcagcccaagaccctgcagagcagcaacagcgacctggtgctgcagaccctgcccctgagcaccctggagagtgaaaatgccaaggagagcatggatgacagcggcaaggccagccaggaggagcccctgaagagccgggtgtcccatggaaatgaggtgcgccacagcagcaagccccagttccagtgcaagaagtgcttctacaagaccaggagcagcacagtgctgaccaggcacatcaagctgcggcacggccaggactaccacttcctgtgcaaggcctgcaacctgtacagcctgagcaaggagggcatggagaagcacatcaagaggagcaagcacctggagaatgccaagaagaacaacatcggcctgagctttgaagaatgtattgagcgggtgtgcatcggggccaatgacaagaaggaggagtttgatgtgtctggaaatggaagaattgagggccacatcggcgtgcagctgcaggagcacagctacctggagaagggcatgctggccagcgaggagctgagccagagcggcggcagcaccaaggatgatgagctggccagcaccaccacccccaagaggggccggcccaagggcaacatcagcaggacctgcagccactgcggcctgctggccagcagcatcaccaacctgactgtgcacatccggaggaagcacagccaccagtacagctacctgtgcaaggtgtgcaagtactacacagtgaccaagggggacatggagcggcactgtgccaccaagaagcacaagggccgggtggagattgaggccagcggcaagcacagcagtgacatcatcgtgggccctgagggcggcagcctggaggccggcaagaagaatgccggcagcgctgtgaccatgtctgatgaacatgccaacaagccagctgagagccccacctctgtgctggagaagccagaccggggcaacagcattgaggccgaggtggagaatgtgttccacagcctggatggagaggtgaacagccacctgctggacaagaaggagcagatcagcagcgagccagaagattttgcccagcctggagatgtgtacagccagagagatgtgacaggcaccggggagaacaagtgcctgcactgtgagttcagcgcccacagcagcgccagcctggagctgcacgtgaagaggaagcacaccaaggagtttgagttctactgcatggcctgtgactactatgctgtgacccggcgggagatgaccaggcatgctgccacagagaagcacaagatgaagaggcagagctacctgaacagcgccaacgtggaggccggcagcgctgacatgagcaagaacatcatcatgcctgaggaggagcaccagcagaacagcgaggagttccagatcatcagcggccagcccagcgacaccctgaagagcagaaatgctgctgactgcagcatcctgaatgaaaacaccaacctggacatgagcaaggtgctgtgtgccgctgacagcgtggaggtggagacagaggaggagagcaacttcaatgaagaccacagcttctgtgagaccttccagcaggcccctgtgaaggacaaggtgaggaagccagaggagatgatgagcctgaccatgagcagcaactacggcagccccagccgcttccagaatgaaaattctggcagcagcgccctgaactgtgaaacagccaagaagaaccacgagatcagcaatgatgctggggagctgcgggtgcactgtgagggggagggcggcaatgctggagatggcggcggcgtggtgccccaccgccacctgtgccctgtgaccctggatggagagaggtctgctgagagccctgtgctggtggtgacccgcatcacccgggagcagggcaacctggagagcggcggccagaacagagtggcccggggccacggcctggaggacctgaagggcgtgcaggaggaccctgtgctgggcaacaaggagatcctgatgaacagccagcacgagacagagttcatcctggaggaggatggccctgccagtgacagcacagtggagagcagtgatgtgtatgagaccatcatcagcattgatgacaagggccaggccatgtacagctttggccgctttgacagcagcatcatccgcatcaagaacccagaagatggagagctgattgaccagagcgaggagggcctcatcgccaccggggtgcgcatcagcgagctgcccctgaaggactgtgcccagggcgtgaagaagaagaagtctgagggcagcagcatcggggagagcacccgcatccgctgtgatgactgtggcttcctggctgatggcctgagcggcctgaatgtgcacatcgccatgaagcaccccaccaaggagaagcacttccactgcctgctgtgtgggaagagcttctacacagagagcaacctgcaccagcacctggccagcgctggccacatgagaaatgagcaggcctctgtggaggagctgcctgagggcggggccaccttcaagtgtgtgaagtgcacagagccctttgattctgagcagaacctcttcctgcacatcaagggccagcacgaggagctgctgcgggaggtgaacaagtacatcgtggaggacacagagcagatcaaccgggagcgggaggagaaccagggcaatgtgtgcaagtactgtgggaagatgtgccgcagcagcaacagcatggccttcctggcccacatccgcacccacacaggcagcaagcccttcaagtgcaagatctgccactttgccacagcccagctgggagatgccagaaatcatgtgaagaggcacctgggcatgagggagtacaagtgccacgtgtgtggggtggcctttgtgatgaagaagcacctgaacacccacctgctgggcaagcacggcgtgggcacccccaaggagaggaagttcacctgccacctgtgtgacaggagcttcacagagaagtgggccctgaacaaccacatgaagctgcacactggagagaagcccttcaagtgcacctggcccacctgccactacagcttcctgacagccagcgccatgaaggaccactaccgcacccacactggagagaagagcttcctgtgtgacctgtgtggctttgctgggggcaccaggcatgccctgaccaagcaccggcggcagcacactggagagaagcccttcaagtgtgatgagtgcaactttgccagcaccacccagagccacctgaccaggcacaagagggtgcacactggagagaagccctaccgctgcccctggtgtgactaccgcagcaactgtgccgagaacatcaggaagcacatcctgcacacaggcaagcatgaaggagtgaagatgtacaactgccccaagtgtgactatggcaccaacgtgcctgtggagttcaggaaccacctgaaggagcagcacccagacatcgagaacccagacctggcctacctgcatgctgggaagggccagaagctgtag

SEQ ID NO: 17843 - DNA, 4983 bp, Artificial Sequence; identical to SEQ ID NO: 17841
  Description of Artificial Sequence: Synthetic coding sequence

SEQ ID NO: 17844 - DNA, 2163 bp, Artificial Sequence
  Description of Artificial Sequence: Synthetic coding sequence
atggaggaggccgaggagctgctgctggagggcaagaaggccctgcagctggcccgggagccccggctgggcctggacctgggctggaaccccagcggggagggctgcacccagggcctgaaggatgtgcccccagagcccacccgggacatcctggccctgaagagcctgccccggggcctggccctgggccccagcctggccaaggagcagaggctgggcgtgtggtgtgtgggggaccccctgcagcccggcctgctgtggggccccctggaggaggagagcgccagcaaggagaagggggagggcgtgaagccccggcaggaggagaacctgagcctgggcccctggggagatgtgtgtgcctgtgagcagagcagcggctggaccagcctggtgcagaggggccgcctggagagcgagggcaatgtggcccctgtgcgcatcagcgagcggctgcacctgcaggtgtaccagctggtgctgcccggcagcgagctgctgctgtggccccagcccagcagcgagggccccagcctgacccagcccggcctggacaaggaggccgctgtggccgtggtgacagaggtggagagcgctgtgcagcaggaggtggccagccctggagaagatgctgctgagccctgcattgatcctggcagccagagccccagcggcatccaggccgagaacatggtgtccccaggcctgaagttccccacccaggaccgcatcagcaaggacagccagcccctgggccccctgctgcaggatggagatgtggatgaggagtgcccagcccaggcccagatgcctcctgagctgcagagcaacagcgccacccagcaggaccctgatggcagcggggccagcttcagcagcagcgcccggggcacccagccccacggctacctggccaagaagctgcacagccccagcgaccagtgccccccccgggccaagaccccagagcccggggcccagcagagcggcttccccaccctgagccgcagccccccaggccctgctggcagcagccccaagcagggccgccgctaccgctgtggagaatgtgggaaggccttcctgcagctgtgccacctgaagaagcacgcctttgtgcacacaggccacaagcccttcctgtgcacagaatgtgggaagagctacagcagcgaggagagcttcaaggcccacatgctgggccacagaggagtgcggcccttcccctgcccccagtgtgacaaggcctacggcacccagagggacctgaaggagcaccaggtggtgcacagcggggcccggccctttgcctgtgaccagtgtgggaaggcctttgcccggcggcccagcctgcggctgcacaggaagacccaccaggtgcctgctgccccagccccctgcccctgccctgtgtgtggccggcccctggccaaccagggcagcctgaggaaccacatgaggctgcacactggagagaagcccttcctgtgcccccactgcggccgggccttccggcagaggggcaacctgcggggccacctgcggctgcacactggagagcggccctaccgctgcccccactgtgctgatgccttcccccagctgcctgagctgcggcggcacctgatcagccacactggagaggcccacctgtgccctgtgtgtgggaaggccctgcgggacccccacaccctgcgggcccacgagcggctgcacagcggggagcggcccttcccctgcccccagtgtggccgggcctacaccctggccaccaagctgcggcggcacctgaagagccacctggaggacaagccctaccgctgccccacctgtggcatgggctacaccctgccccagagcctgcggcggcaccagctgagccacaggcctgaggccccctgcagccccccatctgtgcccagcgctgccagcgagcccaccgtggtgctgctgcaggccgagccccagctgctggacacccaccgggaggaggaggtgtccccagccagagatgtggtggaggtgaccatcagcgagagccaggagaagtgctttgtggtgcctgaggagccagatgctgcccccagcctggtgctgatccacaaggacatgggcctgggcgcctgggccgaggtggtggaggtggagatgggcacctag

SEQ ID NO: 17845 - DNA, 597 bp, Artificial Sequence
  Description of Artificial Sequence: Synthetic coding sequence
atggagaagccagctggcaggaagaagaagacccccaccccccgggaggaggctgatgtgcagaagagcgccctgcgggaggagaaggtgtctggggacaggaagcccccagagcggcccaccgtgcccaggaagcccaggacagagccctgcctgagcccagaagatgaggagcacgtgtttgatgcctttgatgccagcttcaaggatgactttgagggcgtgcctgtgttcatccccttccagaggaagaagccctatgagtgcagtgaatgtggccgcatcttcaagcacaagacagaccacatccgccaccagagggtgcacactggagagaagcccttcaagtgtgcccagtgtgggaaggccttccgccacagcagtgatgtgaccaagcaccagaggacccacactggagagaagcccttcaagtgtggagaatgtgggaaggccttcaactgtggcagcaacctgctgaagcaccagaagacccacactggagagaagccctatgagtgcacccactgtgggaaggcctttgcctacagcagctgcctgatccgccaccagaagaggcaccccaggaagaagccctag

SEQ ID NO: 17846 - DNA, 597 bp, Artificial Sequence; identical to SEQ ID NO: 17845
  Description of Artificial Sequence: Synthetic coding sequence

SEQ ID NO: 17847 - DNA, 597 bp, Artificial Sequence; identical to SEQ ID NO: 17845
  Description of Artificial Sequence: Synthetic coding sequence

SEQ ID NO: 17848 - DNA, 1296 bp, Artificial Sequence
  Description of Artificial Sequence: Synthetic coding sequence
atgctgagtgatgagctggagagcaagccagagctgctggtgcagtttgtgcagaacaccagcatccccctgggccagggcctggtggagagcgaggccaaggacatcacctgcctgagcctgctgcctgtgacagaggcctctgaatgttcccggctgatgctgcctgatgacaccaccaaccacagcaacagcagcaaggaggtgcccagcagcgctgtgctgcggagcctgcgggtgaatgtgggcccagatggagaggagacccgggcccagacagtgcagaagagccctgagttcctgagcaccagcgagagcagcagcctgctgcaggacctgcagcccagcgacagcaccagcttcatcctgctgaacctgaccagggctggcctgggcagcagcgctgagcacctggtgtttgtgcaggatgaagctgaggacagcggaaatgacttcctgagcagcgagagcacagacagcagcatcccctggttcctgcgggtgcaggagctggcccatgacagcctgattgctgccacccgggcccagctggccaagaatgccaagaccagcagcaatggagaaaatgtgcacctgggcagcggagatggccagagcaaggacagcggccccctgccccaggtggagaagaagctgaagtgcaccgtggagggctgtgacaggacctttgtgtggccagcccacttcaagtaccacctgaagacccacagaaatgacaggagcttcatctgcccagctgagggctgtgggaagagcttctacgtgctgcagaggctgaaggtgcacatgaggacccacaacggggagaagcccttcatgtgccacgagagcggctgtgggaagcagttcaccacagctggcaacctgaagaaccaccggcgcatccacactggagagaagcccttcctgtgtgaggcccagggctgcggccgcagctttgctgagtacagcagcctgaggaagcacctggtggtgcacagcggggagaagccccaccagtgccaggtgtgtgggaagaccttcagccagagcggcagcagaaatgtgcacatgaggaagcaccacctgcagctgggcgccgccggcagccaggagcaggagcagacagaggtgctggccgagggcagccccaggagcctgagctctgtgcctgatgtgacccaccacctggtgaccatgcagagcggccggcagagctatgaggtgtctgtgctgacagctgtgaacccccaggagctgctgaaccagggcgacctgacagaaagaagaacatag

SEQ ID NO: 17849 - DNA, 1278 bp, Artificial Sequence
  Description of Artificial Sequence: Synthetic coding sequence
atgctgcctgatgacaccaccaaccacagcaacagcagcaaggaggtgcccagcagcgctgtgctgcggagcctgcgggtgaatgtgggcccagatggagaggagacccgggcccagacagtgcagaagagccctgagttcctgagcaccagcgagagcagcagcctgctgcaggacctgcagcccagcgacagcaccagcttcatcctgctgaacctgacccgggccggcctgggcagcagcgctgagcacctggtgtttgtgcaggatgaagcagaagattctggaaatgacttcctgagcagcgagagcacagacagcagcatcccctggttcctgcgggtgcaggagctggcccatgacagcctgattgctgccacccgggcccagctggccaagaatgccaagaccagcagcaatggagaaaatgtgcacctgggcagcggagatggccagagcaaggacagcggccccctgccccaggtggagaagaagctgaagtgcaccgtggagggctgtgacaggacctttgtgtggccagcccacttcaagtaccacctgaagacccacagaaatgaccgctccttcatctgcccagctgagggctgcggcaagagcttctacgtgctgcagaggctgaaggtgcacatgaggacccacaatggagagaagcccttcatgtgccatgaaagtggctgcggcaagcagttcaccacagctggcaacctgaagaaccaccggcgcatccacactggagagaagcccttcctgtgtgaggcccagggctgcggccgcagctttgctgagtacagcagcctgaggaagcacctggtggtgcacagcggggagaagccccaccagtgccaggtgtgtgggaagaccttcagccagagcggcagcagaaatgtgcacatgaggaagcaccacctgcagctgggcgctgctggcagccaggagcaggagcagacagctgagcccctgatgggcagcagcctgctggaggaggcctctgtgcccagcaagaacctggtgtccatgaacagccagcccagcctgggcggggagagcctgaacctgcccaacaccaacagcatcctgggcgtggatgatgaggtgctggccgagggcagccccaggagcctgagctctgtgcctgatgtgacccaccacctggtgaccatgcagagcggccggcagagctatgaggtgtctgtgctgacagctgtgaacccccaggagctgctgaaccagggcgacctgacagaaagaagaacatag

SEQ ID NO: 17850 - DNA, 1551 bp, Artificial Sequence
  Description of Artificial Sequence: Synthetic coding sequence
atgctgagtgatgagctggagagcaagccagagctgctggtgcagtttgtgcagaacaccagcatccccctgggccagggcctggtggagagcgaggccaaggacatcacctgcctgagcctgctgcctgtgacagaggcctctgaatgttcccggctgatgctgcctgagcctgtgccctggagggaggaggatggcaagagcggctgcagcgacctgaatgacaccaccaaccacagcaacagcagcaaggaggtgcccagcagcgctgtgctgcggagcctgcgggtgaatgtgggcccagatggagaggagacccgggcccagacagtgcagaagagccctgagttcctgagcaccagcgagagcagcagcctgctgcaggacctgcagcccagcgacagcaccagcttcatcctgctgaacctgacccgggccggcctgggcagcagcgctgagcacctggtgtttgtgcaggatgaagcagaagattctggaaatgacttcctgagcagcgagagcacagacagcagcatcccctggttcctgcgggtgcaggagctggcccatgacagcctgattgctgccacccgggcccagctggccaagaatgccaagaccagcagcaatggagaaaatgtgcacctgggcagcggagatggccagagcaaggacagcggccccctgccccaggtggagaagaagctgaagtgcaccgtggagggctgtgacaggacctttgtgtggccagcccacttcaagtaccacctgaagacccacagaaatgaccgctccttcatctgcccagctgagggctgcggcaagagcttctacgtgctgcagaggctgaaggtgcacatgaggacccacaatggagagaagcccttcatgtgccatgaaagtggctgcggcaagcagttcaccacagctggcaacctgaagaaccaccggcgcatccacactggagagaagcccttcctgtgtgaggcccagggctgcggccgcagctttgctgagtacagcagcctgaggaagcacctggtggtgcacagcggggagaagccccaccagtgccaggtgtgtgggaagaccttcagccagagcggcagcagaaatgtgcacatgaggaagcaccacctgcagctgggcgctgctggcagccaggagcaggagcagacagctgagcccctgatgggcagcagcctgctggaggaggcctctgtgcccagcaagaacctggtgtccatgaacagccagcccagcctgggcggggagagcctgaacctgcccaacaccaacagcatcctgggcgtggatgatgaggtgctggccgagggcagccccaggagcctgagctctgtgcctgatgtgacccaccacctggtgaccatgcagagcggccggcagagctatgaggtgtctgtgctgacagctgtgaacccccaggagagcctggcccccctgccccggctggagtgcagcggggccttcagcgcccactgcaacctgtgcctgcccggcagcagtgacagccctgccagcgccagctag

SEQ ID NO: 17851 - DNA, 1404 bp, Artificial Sequence
  Description of Artificial Sequence: Synthetic coding sequence
atgctgagtgatgagctggagagcaagccagagctgctggtgcagtttgtgcagaacaccagcatccccctgggccagggcctggtggagagcgaggccaaggacatcacctgcctgagcctgctgcctgtgacagaggcctctgaatgttcccggctgatgctgcctgatgacaccaccaaccacagcaacagcagcaaggaggtgcccagcagcgctgtgctgcggagcctgcgggtgaatgtgggcccagatggagaggagttcctgagcaccagcgagagcagcagcctgctgcaggacctgcagcccagcgacagcaccagcttcatcctgctgaacctgacccgggccggcctgggcagcagcgctgagcacctggtgtttgtgcaggatgaagcagaagattctggaaatgacttcctgagcagcgagagcacagacagcagcatcccctggttcctgcgggtgcaggagctggcccatgacagcctgattgctgccacccgggcccagctggccaagaatgccaagaccagcagcaatggagaaaatgtgcacctgggcagcggagatggccagagcaaggacagcggccccctgccccaggtggagaagaagctgaagtgcaccgtggagggctgtgacaggacctttgtgtggccagcccacttcaagtaccacctgaagacccacagaaatgaccgctccttcatctgcccagctgagggctgcggcaagagcttctacgtgctgcagaggctgaaggtgcacatgaggacccacaatggagagaagcccttcatgtgccatgaaagtggctgcggcaagcagttcaccacagctggcaacctgaagaaccaccggcgcatccacactggagagaagcccttcctgtgtgaggcccagggctgcggccgcagctttgctgagtacagcagcctgaggaagcacctggtggtgcacagcggggagaagccccaccagtgccaggtgtgtgggaagaccttcagccagagcggcagcagaaatgtgcacatgaggaagcaccacctgcagctgggcgctgctggcagccaggagcaggagcagacagctgagcccctgatgggcagcagcctgctggaggaggcctctgtgcccagcaagaacctggtgtccatgaacagccagcccagcctgggcggggagagcctgaacctgcccaacaccaacagcatcctgggcgtggatgatgaggtgctggccgagggcagccccaggagcctgagctctgtgcctgatgtgacccaccacctggtgaccatgcagagcggccggcagagctatgaggtgtctgtgctgacagctgtgaacccccaggagctgctgaaccagggcgacctgacagaaagaagaacatag

SEQ ID NO: 17852 - DNA, 1218 bp, Artificial Sequence
  Description of Artificial Sequence: Synthetic coding sequence
atgctgagtgatgagctggagagcaagccagagctgctggtgcagtttgtgcagaacaccagcatccccctgggccagggcctggtggagagcgaggccaaggacatcacctgcctgagcctgctgcctgtgacagaggcctctgaatgttcccggctgatgctgcccggcctgggcagcagcgctgagcacctggtgtttgtgcaggatgaagcagaagattctggaaatgacttcctgagcagcgagagcacagacagcagcatcccctggttcctgcgggtgcaggagctggcccatgacagcctgattgctgccacccgggcccagctggccaagaatgccaagaccagcagcaatggagaaaatgtgcacctgggcagcggagatggccagagcaaggacagcggccccctgccccaggtggagaagaagctgaagtgcaccgtggagggctgtgacaggacctttgtgtggccagcccacttcaagtaccacctgaagacccacagaaatgaccgctccttcatctgcccagctgagggctgcggcaagagcttctacgtgctgcagaggctgaaggtgcacatgaggacccacaatggagagaagcccttcatgtgccatgaaagtggctgcggcaagcagttcaccacagctggcaacctgaagaaccaccggcgcatccacactggagagaagcccttcctgtgtgaggcccagggctgcggccgcagctttgctgagtacagcagcctgaggaagcacctggtggtgcacagcggggagaagccccaccagtgccaggtgtgtgggaagaccttcagccagagcggcagcagaaatgtgcacatgaggaagcaccacctgcagctgggcgctgctggcagccaggagcaggagcagacagctgagcccctgatgggcagcagcctgctggaggaggcctctgtgcccagcaagaacctggtgtccatgaacagccagcccagcctgggcggggagagcctgaacctgcccaacaccaacagcatcctgggcgtggatgatgaggtgctggccgagggcagccccaggagcctgagctctgtgcctgatgtgacccaccacctggtgaccatgcagagcggccggcagagctatgaggtgtctgtgctgacagctgtgaacccccaggagctgctgaaccagggcgacctgacagaaagaagaacatag

SEQ ID NO: 17853 - DNA, 213 bp, Artificial Sequence
  Description of Artificial Sequence: Synthetic coding sequence
atgctgagtgatgagctggagagcaagccagagctgctggtgcagtttgtgcagaacaccagcatccccctgggccagggcctggtggagagcgaggccaaggacatcacctgcctgagcctgctgcctgtgacagaggcctctgaatgttcccggctgatgctgcctgatgacaccaccaaccacagcaacagcagcaaggaggtgccctag

SEQ ID NO: 17854 - DNA, 1437 bp, Artificial Sequence
  Description of Artificial Sequence: Synthetic coding sequence
atgctgagtgatgagctggagagcaagccagagctgctggtgcagtttgtgcagaacaccagcatccccctgggccagggcctggtggagagcgaggccaaggacatcacctgcctgagcctgctgcctgtgacagaggcctctgaatgttcccggctgatgctgcctgatgacaccaccaaccacagcaacagcagcaaggaggtgcccagcagcgctgtgctgcggagcctgcgggtgaatgtgggcccagatggagaggagacccgggcccagacagtgcagaagagccctgagttcctgagcaccagcgagagcagcagcctgctgcaggacctgcagcccagcgacagcaccagcttcatcctgctgaacctgaccagggctggcctgggcagcagcgctgagcacctggtgtttgtgcaggatgaagctgaggacagcggaaatgacttcctgagcagcgagagcacagacagcagcatcccctggttcctgcgggtgcaggagctggcccatgacagcctgattgctgccacccgggcccagctggccaagaatgccaagaccagcagcaatggagaaaatgtgcacctgggcagcggagatggccagagcaaggacagcggccccctgccccaggtggagaagaagctgaagtgcaccgtggagggctgtgacaggacctttgtgtggccagcccacttcaagtaccacctgaagacccacagaaatgacaggagcttcatctgcccagctgagggctgtgggaagagcttctacgtgctgcagaggctgaaggtgcacatgaggacccacaacggggagaagcccttcatgtgccacgagagcggctgtgggaagcagttcaccacagctggcaacctgaagaaccaccggcgcatccacactggagagaagcccttcctgtgtgaggcccagggctgcggccgcagctttgctgagtacagcagcctgaggaagcacctggtggtgcacagcggggagaagccccaccagtgccaggtgtgtgggaagaccttcagccagagcggcagcagaaatgtgcacatgaggaagcaccacctgcagctgggcgccgccggcagccaggagcaggagcagacagctgagcccctgatgggcagcagcctgctggaggaggcctctgtgcccagcaagaacctggtgtccatgaacagccagcccagcctgggcggggagagcctgaacctgcccaacaccaacagcatcctgggcgtggatgatgaggtgctggccgagggcagccccaggagcctgagctctgtgcctgatgtgacccaccacctggtgaccatgcagagcggccggcagagctatgaggtgtctgtgctgacagctgtgaacccccaggagctgctgaaccagggcgacctgacagagaggagaacatag

SEQ ID NO: 17855 - DNA, 225 bp, Artificial Sequence
  Description of Artificial Sequence: Synthetic coding sequence
atgctgagtgatgagctggagagcaagccagagctgctggtgcagtttgtgcagaacaccagcatccccctgggccagggcctggtggagagcgaggccaaggacatcacctgcctgagcctgctgcctgtgacagaggcctctgaatgttcccggctgatgctgcctgatgacaccaccaaccacagcaacagcagcaaggaggtgcccagcagcgctgtgtag

SEQ ID NO: 17856 - DNA, 381 bp, Artificial Sequence
  Description of Artificial Sequence: Synthetic coding sequence
atgctgagtgatgagctggagagcaagccagagctgctggtgcagtttgtgcagaacaccagcatccccctgggccagggcctggtggagagcgaggccaaggacatcacctgcctgagcctgctgcctgtgacagaggcctctgaatgttcccggctgatgctgcctgatgacaccaccaaccacagcaacagcagcaaggaggtgcccagcagcgctgtgctgcggagcctgcgggtgaatgtgggcccagatggagaggagacccgggcccagacagtgcagaagagccctgagttcctgagcaccagcgagagcagcagcctgctgcaggacctgcagcccagcgacagcaccagcttcatcctgctgaacctgtag

SEQ ID NO: 17857 - DNA, 819 bp, Artificial Sequence
  Description of Artificial Sequence: Synthetic coding sequence
atgctgagtgatgagctggagagcaagccagagctgctggtgcagtttgtgcagaacaccagcatccccctgggccagggcctggtggagagcgaggccaaggacatcacctgcctgagcctgctgcctgtgacagaggcctctgaatgttcccggctgatgctgcctgatgacaccaccaaccacagcaacagcagcaaggaggtgcccagcagcgctgtgctgcggagcctgcgggtgaatgtgggcccagatggagaggagacccgggcccagacagtgcagaagagccctgagttcctgagcaccagcgagagcagcagcctgctgcaggacctgcagcccagcgacagcaccagcttcatcctgctgaacctgaccagggctggcctgggcagcagcgctgagcacctggtgtttgtgcaggatgaagctgaggacagcggaaatgacttcctgagcagcgagagcacagacagcagcatcccctggttcctgcgggtgcaggagctggcccatgacagcctgattgctgccacccgggcccagctggccaagaatgccaagaccagcagcaatggagaaaatgtgcacctgggcagcggagatggccagagcaaggacagcggccccctgccccaggtggagaagaagctgaagtgcaccgtggagggctgtgacaggacctttgtgtggccagcccacttcaagtaccacctgaagacccaccggcggctgtgggagaagctgctgtgtgccgctgaggccgagggcgcccacgaggacccccagtggagggaggccctgtatgtgccctag

SEQ ID NO: 17858 - DNA, 939 bp, Artificial Sequence
  Description of Artificial Sequence: Synthetic coding sequence
atggaggagaagcccagcggccccatcccagacatgctggccacagctgagcccagcagcagcgagacagacaaggaggtgctgagccctgctgtgcctgctgctgcccccagcagctccatgtctgaggagcccggccctgagcaggccgccaccccacctgtgtgggagcggggcggggccggcggcatgcagcagggcagcagccctgccccagacagctgccagcccggccctggccccagccctggcctgaccagcatcgtgtctggcaccagcgaggacctgcggccccccaggagaagacctcctcctgggaagcagatcccctgcagcagccctggctgctgcctgtccttccccagcgtgcgggacctggcccagcacctgcggacccactgcccccccacccagagcctggagggcaagctgttccgctgcagcgccctgagctgcacagagaccttccccagcatgcaggagctggtggcccacagcaagctgcactacaagcccaaccgctacttcaagtgtgagaactgcctgctgcgcttccgcacccacaggagcctcttcaagcacctgcacgtgtgtgccgagcacgcccagagccctgcccctcctcctcctccagccctggaccgggagcccccagcccctgagaggcctcctgaggtggaccctgccagcgcccctggcctgcccttccccctgctggagcccttcaccaccccagccccagcccccaccggccccttcctgccctacctgaacccagcccccttcggcctgagccccccccggctgcggcccttcctggccgccgcccctggccccccagccagcagcgctgctgtgtggaagaagagccagggcgccggcagcagcccccggcggccccagggcggcagtgatgcccccagcggggcctgcaggtag

SEQ ID NO: 17859 - DNA, 1173 bp, Artificial Sequence
  Description of Artificial Sequence: Synthetic coding sequence
atggaggagaagcccagcggccccatcccagacatgctggccacagctgagcccagcagcagcgagacagacaaggaggtgctgagccctgctgtgcctgctgctgcccccagcagctccatgtctgaggagcccggccctgagcaggccgccaccccacctgtgtgggagcggggcggggccggcggcatgcagcagggcagcagccctgccccagacagctgccagcccggccctggccccagccctggcctgaccagcatcgtgtctggcaccagcgaggacctgcggccccccaggagaagacctcctcctgggaagcagatcccctgcagcagccctggctgctgcctgtccttccccagcgtgcgggacctggcccagcacctgcggacccactgcccccccacccagagcctggagggcaagctgttccgctgcagcgccctgagctgcacagagaccttccccagcatgcaggagctggtggcccacagcaagctgcactacaagcccaaccgctacttcaagtgtgagaactgcctgctgcgcttccgcacccacaggagcctcttcaagcacctgcacgtgtgtgccgagcacgcccagagccctgcccctcctcctcctccagccctggaccgggagcccccagcccctgagaggcctcctgaggtggaccctgccagcgcccctggcctgcccttccccctgctggagcccttcaccaccccagccccagcccccaccggccccttcctgccctacctgaacccagcccccttcggcctgagccccccccggctgcggcccttcctggccgccgcccctggccccccagccagcagcgctgctgtgtggaagaagagccagggcgccggcagcagcccccggcggccccagggcggcagtgatgcccccagcggccatgctgcccccagccgcatcgtgtgggagcacacccggggccgctacagctgcatgcagtgtgccttcagcacagccagcaggcctgccatgaccctgcacctggaggaccacaggcctggggccccagctgccccagctgctggcccccccaggccagatgccccagctgaccctgcccccctggcccccaaggtgagccccctgctgtctgagggggagctgcctgtgttcagccagctgtag

SEQ ID NO: 17860 - DNA, 1785 bp, Artificial Sequence
  Description of Artificial Sequence: Synthetic coding sequence
atggctgctgctgtgctgcgggacagcacctctgtgcctgtgacagctgaggccaagctgatgggcttcacccagggctgtgtgacctttgaagatgtggccatctacttcagccaggaggagtggggcctgctggatgaggcccagaggctgctgtacagagatgtgatgctggagaactttgccctgatcacagccctggtgtgctggcacggcatggaggatgaggagaccccagagcagagcgtgtctgtggagggcgtgccccaggtgaggaccccagaggccagccccagcacccagaagatccagagctgtgacatgtgtgtgcccttcctgacagacatcctgcacctgacagacctgcccggccaggagctgtacctgaccggggcctgtgctgtgttccaccaggaccagaagcaccacagcgctgagaagcccctggagagtgacatggacaaggccagctttgtgcagtgctgcctcttccatgaaagtggcatgcccttcaccagcagcgaggtgggcaaggacttcctggcccccctgggcatcctgcagccccaggccatcgccaactatgagaagcccaacaagatcagcaaatgtgaggaggccttccacgtgggcatcagccactacaagtggagccagtgcagaagagagagcagccacaagcacaccttcttccacccccgggtgtgcaccgggaagaggctgtatgagagcagcaaatgtgggaaggcctgctgctgtgagtgcagcctggtgcagctgcagagggtgcaccctggagagcggccctatgaatgttctgaatgtgggaagagcttcagccagaccagccacctgaatgaccaccggcgcatccacactggagagcggccctacgtgtgtggccagtgtgggaagagcttcagccagagggccaccctcatcaagcaccaccgggtgcacactggagagcggccctatgaatgtggggagtgtgggaagagcttcagccagagcagcaacctgattgagcactgccgcatccacactggagagcggccctatgaatgtgatgaatgtgggaaggccttcggcagcaagagcaccctggtgcgccaccagaggacccacactggagagaagccctatgaatgtggggagtgtgggaagctgttccggcagagcttcagcctggtggtgcaccagaggatccacaccacagcccggccctatgaatgtggccagtgtgggaagagcttcagcctgaagtgtggcctcatccagcaccagctgatccacagcggggcccggccctttgaatgtgatgaatgtgggaagagcttcagccagaggaccaccctgaacaagcaccacaaggtgcacacagctgagcggccctacgtgtgtggggagtgtgggaaggccttcatgttcaagagcaagctggtgcgccaccagaggacccacactggagagcggccctttgaatgttctgaatgtgggaagttcttccggcagagctacaccctggtggagcaccagaagatccacacaggcctgcggccctatgactgtggccagtgtgggaagagcttcatccagaagagcagcctcatccagcaccaggtggtgcacactggagagcggccctatgaatgtgggaaatgtgggaagagcttcacccagcacagcggcctcatcctgcacaggaagagccacacagtggagcggccccgggacagcagcaaatgtgggaagccctacagccccaggagcaacatcgtgtag

SEQ ID NO: 17861 - DNA, 1434 bp, Artificial Sequence
  Description of Artificial Sequence: Synthetic coding sequence
atggctgctgctgtgctgcgggacagcaccagcggctgtgtgacctttgaagatgtggccatctacttcagccaggaggagtggggcctgctggatgaggcccagaggctgctgtacagagatgtgatgctggagaactttgccctgatcacagccctggtgtgctggcacggcatggaggatgaggagaccccagagcagagcgtgtctgtggagggcgtgccccaggtgaggaccccagaggccagccccagcacccagaagatccagagctgtgacatgtgtgtgcccttcctgacagacatcctgcacctgacagacctgcccggccaggagctgtacctgaccggggcctgtgctgtgttccaccaggaccagaagcaccacagcgctgagaagcccctggagagtgacatggacaaggccagctttgtgcagtgctgcctcttccatgaaagtggcatgcccttcaccagcagcgaggtgggcaaggacttcctggcccccctgggcatcctgcagccccaggccatcgccaactatgagaagcccaacaagatcagcaaatgtgaggaggccttccacgtgggcatcagccactacaagtggagccagtgcagaagagagagcagccacaagcacaccttcttccacccccgggtgtgcaccgggaagaggctgtatgagagcagcaaatgtgggaaggcctgctgctgtgagtgcagcctggtgcagctgcagagggtgcaccctggagagcggccctatgaatgttctgaatgtgggaagagcttcagccagaccagccacctgaatgaccaccggcgcatccacactggagagcggccctactatgaatgtggagaatgtgggaagagcttcagccagagcagcaacctgattgagcactgccgcatccacactggagagcggccctatgaatgtgatgaatgtgggaaggccttcggcagcaagagcaccctggtgcgccaccagaggacccacactggagagaagccctatgaatgtggagaatgtgggaagctgttccggcagagcttcagcctggtggtgcaccagaggatccacaccacagcccggccctatgaatgtggccagtgtgggaagagcttcagcctgaagagcaagctggtgcgccaccagaggacccacactggagagcggccctttgagtgcagtgaatgtgggaagttcttccggcagagctacaccctggtggagcaccagaagatccacacaggcctgcggccctatgactgtggccagtgtgggaagagcttcatccagaagagcagcctcatccagcaccaggtggtgcacactggagagcggccctatgaatgtgggaaatgtgggaagagcttcacccagcacagcggcctcatcctgcacaggaagagccacacagtgtag

SEQ ID NO: 17862 - DNA, 1419 bp, Artificial Sequence
  Description of Artificial Sequence: Synthetic coding sequence
atgggcttcacccagggctgtgtgacctttgaagatgtggccatctacttcagccaggaggagtggggcctgctggatgaggcccagaggctgctgtacagagatgtgatgctggagaactttgccctgatcacagccctggtgtgctggcacggcatggaggatgaggagaccccagagcagagcgtgtctgtggagggcgtgccccaggtgaggaccccagaggccagccccagcacccagaagatccagagctgtgacatgtgtgtgcccttcctgacagacatcctgcacctgacagacctgcccggccaggagctgtacctgaccggggcctgtgctgtgttccaccaggaccagaagcaccacagcgctgagaagcccctggagagtgacatggacaaggccagctttgtgcagtgctgcctcttccatgaaagtggcatgcccttcaccagcagcgaggtgggcaaggacttcctggcccccctgggcatcctgcagccccaggccatcgccaactatgagaagcccaacaagatcagcaaatgtgaggaggccttccacgtgggcatcagccactacaagtggagccagtgcagaagagagagcagccacaagcacaccttcttccacccccgggtgtgcaccgggaagaggctgtatgagagcagcaaatgtgggaaggcctgctgctgtgagtgcagcctggtgcagctgcagagggtgcaccctggagagcggccctatgaatgttctgaatgtgggaagagcttcagccagaccagccacctgaatgaccaccggcgcatccacactggagagcggccctacccctatgaatgtggggagtgtgggaagctgttccggcagagcttcagcctggtggtgcaccagaggatccacaccacagcccggccctatgaatgtggccagtgtgggaagagcttcagcctgaagtgtggcctcatccagcaccagctgatccacagcggggcccggccctttgaatgtgatgaatgtgggaagagcttcagccagaggaccaccctgaacaagcaccacaaggtgcacacagctgagcggccctacgtgtgtggggagtgtgggaaggccttcatgttcaagagcaagctggtgcgccaccagaggacccacactggagagcggccctttgaatgttctgaatgtgggaagttcttccggcagagctacaccctggtggagcaccagaagatccacacaggcctgcggccctatgactgtggccagtgtgggaagagcttcatccagaagagcagcctcatccagcaccaggtggtgcacactggagagcggccctatgaatgtgggaaatgtgggaagagcttcacccagcacagcggcctcatcctgcacaggaagagccacacagtgtag

SEQ ID NO: 17863 - DNA, 1728 bp, Artificial Sequence
  Description of Artificial Sequence: Synthetic coding sequence
atggctgctgctgccccccggcggcccacccagcagggcaccgtgacctttgaagatgtggccgtgaacttcagccaggaggagtggtgcctgctgtctgaggcccagcgctgcctgtacagagatgtgatgctggagaacctggccctgatcagcagcctgggctgctggtgtggcagcaaggatgaggaggccccctgcaagcagaggatctctgtgcagcgggagagccagagcaggaccccccgggccggcgtgagccccaagaaggcccacccctgtgagatgtgtggcctcatcctggaggatgtgttccactttgctgaccaccaggagacccaccacaagcagaagctgaacagaagtggggcctgtgggaagaacctggatgacacagcctacctgcaccagcaccagaagcagcacatcggggagaagttctacaggaagtctgtgcgggaggccagctttgtgaagaagaggaagctgcgggtgtcccaggagccctttgtgttccgggagtttgggaaggatgtgctgcccagcagcggcctgtgccaggaggccgctgctgtggagaagacagattctgagaccatgcacggcccccccttccaggagggcaagaccaactacagctgtgggaagaggaccaaggccttcagcaccaagcacagcgtcatcccccaccagaagctgttcaccagagatggctgctacgtgtgcagcgactgtgggaagagcttcagccgctacgtgtccttcagcaaccaccagagggaccacacagccaagggcccctatgactgtggggagtgtgggaagagctacagcaggaagagcagcctcatccagcaccagagggtgcacacaggcaagacagcctacccctgtgaggagtgtgggaagagcttcagccagaagggcagcctcatcagccaccagagggtgcacactggagagcggccctatgaatgtcgggagtatggcaagagctttggccagaagggcaacctgatccagcaccagcagggccacactggagagcgggcctaccactgtggggagtgtgggaagagcttccggcagaagttctgcttcatcaaccaccagagggtgcacactggagagcggccctacaagtgtggggagtgtgggaagagctttggccagaagggcaacctggtgcagcaccagaggggccacactggagagcggccctatgagtgcaaggaatgtgggaagagcttccgctaccgcagccacctgacagagcaccagaggctgcacactggagagcggccctacaactgccgggagtgtgggaagctgttcaacaggaagtaccacctgctggtgcatgagcgggtgcacactggagagcggccctatgcctgtgaggtgtgtgggaagctgtttggaaacaagaactgtgtgaccatccaccagaggatccacactggagagcggccctatgaatgtaatgaatgtgggaagagcttcctgagcagcagcgccctgcacgtgcacaagagggtgcacagcggccagaagccctacaagtgcagtgaatgtgggaagagctttgctgaatgtagcagcctcatcaagcaccggcgcatccacactggagagcggccctatgaatgtaccaagtgtgggaagaccttccagaggagcagcaccctgctgcaccaccagagcagccacaggaggaaggccctgtag

SEQ ID NO: 17864 - DNA, 1131 bp, Artificial Sequence
  Description of Artificial Sequence: Synthetic coding sequence
atgcacggcccccccttccaggagggcaagaccaactacagctgtgggaagaggaccaaggccttcagcaccaagcacagcgtcatcccccaccagaagctgttcaccagagatggctgctacgtgtgcagcgactgtgggaagagcttcagccgctacgtgtccttcagcaaccaccagagggaccacacagccaagggcccctatgactgtggagaatgtgggaagagctacagcaggaagagcagcctcatccagcaccagagggtgcacacaggcaagacagcctacccctgtgaagaatgtgggaagagcttcagccagaagggcagcctcatcagccaccagagggtgcacactggagagcggccctatgagtgccgggagtatggcaagagctttggccagaagggcaacctgatccagcaccagcagggccacactggagagcgggcctaccactgtggagaatgtgggaagagcttccggcagaagttctgcttcatcaaccaccagagggtgcacactggagagcggccctacaagtgtggagaatgtgggaagagctttggccagaagggcaacctggtgcagcaccagaggggccacactggagagcggccctatgagtgcaaggaatgtgggaagagcttccgctaccgcagccacctgacagagcaccagaggctgcacactggagagcggccctacaactgcagagaatgtgggaagctgttcaacaggaagtaccacctgctggtgcatgagcgggtgcacactggagagcggccctatgcctgtgaggtgtgtgggaagctgtttggaaacaagaactgtgtgaccatccaccagaggatccacactggagagcggccctatgagtgcaatgaatgtgggaagagcttcctgagcagcagcgccctgcacgtgcacaagagggtgcacagcggccagaagccctacaagtgcagtgaatgtgggaagagctttgctgagtgcagcagcctcatcaagcaccggcgcatccacactggagagcggccctatgagtgcaccaagtgtgggaagaccttccagaggagcagcaccctgctgcaccaccagagcagccacaggaggaaggccctgtag

SEQ ID NO: 17865 - DNA, 2031 bp, Artificial Sequence
  Description of Artificial Sequence: Synthetic coding sequence
atgcagggcaccgtggcctttgaagatgtggccgtgaacttcagccaggaggagtggagcctgctgtctgaggtgcagcgctgcctgtaccatgatgtgatgctggagaactgggtgctgatcagcagcctgggctgctggtgtggctctgaagatgaggaggcccccagcaagaagagcatcagcatccagagggtgtcccaggtgtccacccctggggccggcgtgagccccaagaaggcccacagctgtgagatgtgtggggccatcctgggggacatcctgcacctggccgaccaccagggcacccaccacaagcagaagctgcaccgctgtgaggcctggggcaacaagctgtatgacagcagcaaccggccccaccagaaccagtacctgggggagaagccctaccgcagctctgtggaggaggccctgtttgtgaagcgctgcaagttccacgtgtctgaggagagcagcatcttcatccagagcggcaaggacttcctgcccagcagcggcctgctgctgcaggaggccacccacactggagagaagagcaacagcaagccagaatgtgagagccccttccagtggggagacacccactacagctgtggggagtgcatgaagcacagcagcaccaagcacgtgtttgtgcagcagcagaggctgcccagccgggaggagtgctactgctgggagtgtgggaagagcttcagcaaatatgacagcgtgagcaaccaccagagggtgcacacaggcaagaggccctatgaatgtggggagtgtgggaagagcttcagccacaagggcagcctggtgcagcaccagagggtgcacacaggcaagaggccctatgaatgtggggagtgtgggaagagcttcagccacaagggcagcctggtgcagcaccagagggtgcacactggagagcggccctatgaatgtggggagtgtgggaagagcttcagccagaatggcaccctcatcaagcaccagagggtgcacactggagagcggccctatgaatgtgaggagtgtgggaagtgcttcacccagaagggcaacctgatccagcaccagaggggccacaccagcgagcggccctatgaatgtgaggagtgtgggaagtgcttcagccagaagggcaccctgacagagcaccaccgggtgcacacccgggagcggccctatgaatgtggggagtgtgggaagagcttcagcaggaagggccacctgaggaaccaccagaggggccacactggagagcggccctatgaatgtggggagtgtgggaagagcttcagcaggaagggcaacctgatccagcaccagaggagccacactggagagcggccctatgaatgtcgggagtgcaggaagctgttccggggcaagagccacctgattgagcaccagagggtgcacactggagagcggccctatgaatgtaatgaatgtgggaagagcttccaggacagcagcggcttccgggtgcaccagagggtgcacactggagagaagccctttgaatgttctgaatgtgggaagagcttcccccagagctgcagcctgctgcggcacagaagagtgcacactggagagcggccctatgaatgtggggagtgtgggaagagcttccaccagagcagcagcctgctgcggcaccagaagacccacacagctgagcggccctatgaatgtcgggagtgtgggaagttcttcagcagcctgctggagcaccggcgggtgcacactggagagcggccctatgagtgcagagaatgtgggaagaccttcacccggcgcagcgcccacttcaagcaccagaggctgcacacccggggcaagccctatgagtgcagtgaatgtgggaagagctttgctgagaccttcagcctgacagagcaccggcgggtgcacactggagagcggccctatgagtgcagtgaatgtgggaagagcttccacaggagcagcagcctgctgcggcaccagagggtgcacacagagaggagcccctacaagtag

SEQ ID NO: 17866 - DNA, 2094 bp, Artificial Sequence
  Description of Artificial Sequence: Synthetic coding sequence
atgcaggagggcctgcacaggatgacctgggactgcatcgccatcggcagccatgaaaattctgtgcagggcaccgtggcctttgaagatgtggccgtgaacttcagccaggaggagtggagcctgctgtctgaggtgcagcgctgcctgtaccatgatgtgatgctggagaactgggtgctgatcagcagcctgggctgctggtgtggctctgaagatgaggaggcccccagcaagaagagcatcagcatccagagggtgtcccaggtgtccaccccaggagctggggtgagccccaagaaggcccacagctgtgagatgtgtggggccatcctgggggacatcctgcacctggccgaccaccagggcacccaccacaagcagaagctgcaccgctgtgaggcctggggcaacaagctgtatgacagcagcaaccggccccaccagaaccagtacctgggggagaagccctaccgcagctctgtggaggaggccctgtttgtgaagcgctgcaagttccacgtgtctgaggagagcagcatcttcatccagagcggcaaggacttcctgcccagcagcggcctgctgctgcaggaggccacccacactggagagaagagcaacagcaagccagaatgtgagagccccttccagtggggagacacccactacagctgtggggagtgcatgaagcacagcagcaccaagcacgtgtttgtgcagcagcagaggctgcccagccgggaggagtgctactgctgggagtgtgggaagagcttcagcaaatatgattctgtgagcaaccaccagagggtgcacacaggcaagaggccctatgaatgtggagaatgtgggaagagcttcagccacaagggcagcctggtgcagcaccagagggtgcacacaggcaagaggccctatgaatgtggagaatgtgggaagagcttcagccacaagggcagcctggtgcagcaccagagggtgcacactggagagcggccctatgaatgtggagaatgtgggaagagcttcagccagaatggcaccctcatcaagcaccagagggtgcacactggagagcggccctatgaatgtgaagaatgtgggaagtgcttcacccagaagggcaacctgatccagcaccagaggggccacaccagcgagcggccctatgaatgtgaagaatgtgggaagtgcttcagccagaagggcaccctgacagagcaccaccgggtgcacacccgggagcggccctatgaatgtggagaatgtgggaagagcttcagcaggaagggccacctgaggaaccaccagaggggccacactggagagcggccctatgaatgtggagaatgtgggaagagcttcagcaggaaaggaaacctgatccagcaccagaggagccacactggagagcggccctatgagtgcagagaatgtaggaagctgttccggggcaagagccacctgattgagcaccagagggtgcacactggagagcggccctatgagtgcaatgaatgtgggaagagcttccaggacagcagcggcttccgggtgcaccagagggtgcacactggagagaagccctttgagtgcagtgaatgtgggaagagcttcccccagagctgcagcctgctgcggcaccggcgggtgcacactggagagcggccctatgaatgtggagaatgtgggaagagcttccaccagagcagcagcctgctgcggcaccagaagacccacacagctgagcggccctatgagtgcagagaatgtgggaagttcttcagcagcctgctggagcacagaagagtgcacactggagagcggccctatgaatgtcgggagtgtgggaagaccttcaccaggagaagtgcccacttcaagcaccagaggctgcacacccggggcaagccctatgaatgttctgaatgtgggaagagctttgctgagaccttcagcctgacagagcacagaagagtgcacactggagagcggccctatgaatgttctgaatgtgggaagagcttccacaggagcagcagcctgctgcggcaccagagggtgcacacagagaggagcccctacaagtag

SEQ ID NO: 17867 - DNA, 1929 bp, Artificial Sequence
  Description of Artificial Sequence: Synthetic coding sequence
atggctgctgctgccctgcggctgcctgcccaggtggtgggcgtggaccagaagatgaggaggcacctgctgcggcgggccttcctgtacaaggagtgcctgcggagcgccctgctgggccaggtgagccccaagaaggcccacagctgtgagatgtgtggggccatcctgggggacatcctgcacctggccgaccaccagggcacccaccacaagcagaagctgcaccgctgtgaggcctggggcaacaagctgtatgacagcagcaaccggccccaccagaaccagtacctgggggagaagccctaccgcagctctgtggaggaggccctgtttgtgaagcgctgcaagttccacgtgtctgaggagagcagcatcttcatccagagcggcaaggacttcctgcccagcagcggcctgctgctgcaggaggccacccacactggagagaagagcaacagcaagccagaatgtgagagccccttccagtggggagacacccactacagctgtggggagtgcatgaagcacagcagcaccaagcacgtgtttgtgcagcagcagaggctgcccagccgggaggagtgctactgctgggagtgtgggaagagcttcagcaaatatgacagcgtgagcaaccaccagagggtgcacacaggcaagaggccctatgaatgtggggagtgtgggaagagcttcagccacaagggcagcctggtgcagcaccagagggtgcacacaggcaagaggccctatgaatgtggggagtgtgggaagagcttcagccacaagggcagcctggtgcagcaccagagggtgcacactggagagcggccctatgaatgtggggagtgtgggaagagcttcagccagaatggcaccctcatcaagcaccagagggtgcacactggagagcggccctatgaatgtgaggagtgtgggaagtgcttcacccagaagggcaacctgatccagcaccagaggggccacaccagcgagcggccctatgaatgtgaggagtgtgggaagtgcttcagccagaagggcaccctgacagagcaccaccgggtgcacacccgggagcggccctatgaatgtggggagtgtgggaagagcttcagcaggaagggccacctgaggaaccaccagaggggccacactggagagcggccctatgaatgtggggagtgtgggaagagcttcagcaggaagggcaacctgatccagcaccagaggagccacactggagagcggccctatgaatgtcgggagtgcaggaagctgttccggggcaagagccacctgattgagcaccagagggtgcacactggagagcggccctatgaatgtaatgaatgtgggaagagcttccaggacagcagcggcttccgggtgcaccagagggtgcacactggagagaagccctttgaatgttctgaatgtgggaagagcttcccccagagctgcagcctgctgcggcacagaagagtgcacactggagagcggccctatgaatgtggggagtgtgggaagagcttccaccagagcagcagcctgctgcggcaccagaagacccacacagctgagcggccctatgaatgtcgggagtgtgggaagttcttcagcagcctgctggagcaccggcgggtgcacactggagagcggccctatgagtgcagagaatgtgggaagaccttcacccggcgcagcgcccacttcaagcaccagaggctgcacacccggggcaagccctatgagtgcagtgaatgtgggaagagctttgctgagaccttcagcctgacagagcaccggcgggtgcacactggagagcggccctatgagtgcagtgaatgtgggaagagcttccacaggagcagcagcctgctgcggcaccagagggtgcacacagagaggagcccctacaagtag

SEQ ID NO: 17868 - DNA, 1083 bp, Artificial Sequence
  Description of Artificial Sequence: Synthetic coding sequence
atgcctgagctggtggtgacagccctgctggcccccagccggctgagcctgaagctgctgcgggccttcatgtggagcctggtgttttctgtggccctggtggccgctgctgtgtatggctgcatcgccctgacccacgtgctgtgccggccccggcggggctgctgcggcagaagaagaagtgccagccctgcctgcctgagtgaccccagcctgggggagcacggcttcctgaacctgaagagcagcggcctgcggctgcactacgtgtctgctggaagaggaaatggccccctgatgctgttcctgcacggcttccctgagaactggttctcctggagataccagctgcgggagttccagagccgcttccacgtggtggccgtggacctgcggggctacggccccagtgatgcccccagagatgtggactgctacaccatcgacctgctgctggtggacatcaaggatgtgatcctgggcctgggctacagcaagtgcatcctggtggcccatgactggggcgccctgctggcctggcacttcagcatctactaccccagcctggtggagaggatggtggtggtgtctggggcccccatgtctgtgtaccaggactacagcctgcaccacatcagccagttcttccgcagccactacatgttcctgttccagctgccctggctgcctgagaagctgctgtccatgtctgacttccagatcctgaagaccaccctgacccacaggaagacaggcatcccctgcctgaccccatctgagctggaggccttcctgtacaacttcagccagcccggcggcctgaccggccccctgaactactacagaaacctcttcaggaacttccccctggagccccaggagctgaccacccccaccctgctgctgtggggcgagaaggacacctacctggagctgggcctggtggaggccatcggcagcagatttgtgcccggccgcctggaggcccacatcctgcccggcatcggccactggatcccccagagcaacccccaggagatgcaccagtacatgtgggccttcctgcaggacctgctggactag

SEQ ID NO: 17869 - DNA, 1290 bp, Artificial Sequence
  Description of Artificial Sequence: Synthetic coding sequence
gaccctgtgcagggctacgtgacctttgaagatgtggccgtgtacttcagccaggaggagtggaggctgctggatgatgcccagaggctgctgtacagaaatgtgatgctggagaacttcaccctgctggccagcctgggcaagcaccctgagctgggcagcgccttcccccccttcccccgggagaggagcctggccgtgtccctgatggacctgatccctgggggcctgtctgtgcagctgagccaccagtgtgactgctgcctgactgtgctcttcctggtgctgcacgtgagccccagccaccagcagaaccccagcgctgtggccttcacagaatgtgtggtggtgggcatggagcggctgctgagcagcaacatccagcagcaccagaagcagcactgtggggagaagcccctgaagaggcaggagggccgggtgcctgtgctgcggagctgcaaggtgcacctgtctgagaagagcctgcagagccgggaggtgggcaaggccctgctgatcagcagtggagtgctgaagcaccaggtgacccacactggagagaagagccacaggagcagcaagagccgggaggccttccacgccggcaagaggcactacaagtgcagtgaatgtgggaaggccttcggccagaagtacctgctggtgcagcaccagaggctgcacactggagagcggccctacggctgcagcaactgtgggaagagcttcagcagaaatgcccacctgattgagcaccagagggtgcacactggagagaagcccttcacctgcagtgaatgtgggaaggccttccgccacaacagcaccctggtgcagcaccacaagatccacactggagtgcggccctatgaatgttctgaatgtgggaagctgttctccttcaacagcagcctgatgaagcaccagaggatccacactggagagcggccctacaagtgcagtgaatgtgggaagttctacagccacaagagcaacctgatcaagcactggagggtgcacactggagagcggccctacaagtgcagcgactgtgggaagttcttcacccagtgcagcagcctgatgcagcaccagaaggtgcacactggagagaagcccttcaagtgcaatgaatgtggccgcttcttccgggagaacagcaccctggtgcgccaccagagggtgcacactggagccaagccctatgaatgtcgggagtgtgggaagttcttcagccagagcagcaccctgatgcagcacaggaaggtgcacatcggggagaagccctag

SEQ ID NO: 17870 - DNA, 1437 bp, Artificial Sequence
  Description of Artificial Sequence: Synthetic coding sequence
atggctgctgctgccctgcgggaccctgcccaggtgcctgtggccgctgacctgctgacagaccacgaggagcagggctacgtgacctttgaagatgtggccgtgtacttcagccaggaggagtggaggctgctggatgatgcccagaggctgctgtacagaaatgtgatgctggagaacttcaccctgctggccagcctgggctgctggcatggagctgaggccgaggaggcccctgagcagatcgcctctgtgggcctgctgagcagcaacatccagcagcaccagaagcagcactgtggggagaagcccctgaagaggcaggagggccgggtgcctgtgctgcggagctgcaaggtgcacctgtctgagaagagcctgcagagccgggaggtgggcaaggccctgctgatcagcagcggcgtgctgaagcaccaggtgacccacactggagagaagagccacaggagcagcaagagccgggaggccttccacgccggcaagaggcactacaagtgcagtgaatgtgggaaggccttcggccagaagtacctgctggtgcagcaccagaggctgcacgccggcaagaagacctatgagtgcagtgaatgtgggaagctgttccgggacatgagcaacctcttcatccaccagatcgtgcacactggagagcggccctacggctgcagcaactgtgggaagagcttcagcagaaatgcccacctgattgagcaccagagggtgcacactggagagaagcccttcacctgcagtgaatgtgggaaggccttccgccacaacagcaccctggtgcagcaccacaagatccacactggagtgcggccctatgagtgcagtgaatgtgggaagctgttctccttcaacagcagcctgatgaagcaccagaggatccacactggagagcggccctacaagtgcagtgaatgtgggaagttctacagccacaagagcaacctgatcaagcactggagggtgcacactggagagcggccctacaagtgcagcgactgtgggaagttcttcacccagtgcagcagcctgatgcagcaccagaaggtgcacactggagagaagcccttcaagtgcaatgaatgtggccgcttcttccgggagaacagcaccctggtgcgccaccagagggtgcacactggagccaagccctatgagtgcagagaatgtgggaagttcttcagccagagcagcaccctgatgcagcacaggaaggtgcacatcggggagaagcccttcaagtgcaatgaatgtggccgcctcttccgggagaacagcagcctggtgaagcaccagagggtgcacactggagccaagccctatgagtgcagagaatgtgggaagttcttccgccacaacagcagcctcttcaagcaccggcgcatccacactggagagatgcagtag

SEQ ID NO: 17871 - DNA, 1329 bp, Artificial Sequence
  Description of Artificial Sequence: Synthetic coding sequence
atggctgctgctgccctgcgggaccctgcccagcagggctacgtgacctttgaagatgtggccgtgtacttcagccaggaggagtggaggctgctggatgatgcccagaggctgctgtacagaaatgtgatgctggagaacttcaccctgctggccagcctgggcctggccagcagcaagacccatgagatcacccagctggagagctgggaggagcccttcatgcctgcctgggaggtggtgaccagcgccatcccccggggctgctggcatggagctgaggccgaggaggcccctgagcagatcgcctctgtgggcctgctgagcagcaacatccagcagcaccagaagcagcactgtggggagaagcccctgaagaggcaggagggccgggtgcctgtgctgcggagctgcaaggtgcacctgtctgagaagagcctgcagagccgggaggtgggcaaggccctgctgatcagcagcggcgtgctgaagcaccaggtgacccacactggagagaagagccacaggagcagcaagagccgggaggccttccacgccggcaagaggcactacaagtgcagtgaatgtgggaaggccttcggccagaagtacctgctggtgcagcaccagaggctgcacgccggcaagaagacctatgagtgcagtgaatgtgggaagctgttccgggacatgagcaacctcttcatccaccagatcgtgcacactggagagcggccctacggctgcagcaactgtgggaagagcttcagcagaaatgcccacctgattgagcaccagagggtgcacactggagagaagcccttcacctgcagtgaatgtgggaaggccttccgccacaacagcaccctggtgcagcaccacaagatccacactggagtgcggccctatgagtgcagtgaatgtgggaagctgttctccttcaacagcagcctgatgaagcaccagaggatccacactggagagcggccctacaagtgcagtgaatgtgggaagttctacagccacaagagcaacctgatcaagcactggagggtgcacactggagagcggccctacaagtgcagcgactgtgggaagttcttcacccagtgcagcagcctgatgcagcaccagaaggtgcacactggagagaagcccttcaagtgcaatgaatgtggccgcttcttccgggagaacagcagcctggtgaagcaccagagggtgcacactggagccaagccctatgagtgcagagaatgtgggaagttcttccgccacaacagcagcctcttcaagcaccggcgcatccacactggagagatgcagtag

SEQ ID NO: 17872 - DNA, 1395 bp, Artificial Sequence
  Description of Artificial Sequence: Synthetic coding sequence
atggctgctgctgccctgcgggaccctgcccagggctacgtgacctttgaagatgtggccgtgtacttcagccaggaggagtggaggctgctggatgatgcccagaggctgctgtacagaaatgtgatgctggagaacttcaccctgctggccagcctgggctgctggcatggagctgaggccgaggaggcccctgagcagatcgcctctgtgggcctgctgagcagcaacatccagcagcaccagaagcagcactgtggggagaagcccctgaagaggcaggagggccgggtgcctgtgctgcggagctgcaaggtgcacctgtctgagaagagcctgcagagccgggaggtgggcaaggccctgctgatcagcagcggcgtgctgaagcaccaggtgacccacactggagagaagagccacaggagcagcaagagccgggaggccttccacgccggcaagaggcactacaagtgcagtgaatgtgggaaggccttcggccagaagtacctgctggtgcagcaccagaggctgcacgccggcaagaagacctatgagtgcagtgaatgtgggaagctgttccgggacatgagcaacctcttcatccaccagatcgtgcacactggagagcggccctacggctgcagcaactgtgggaagagcttcagcagaaatgcccacctgattgagcaccagagggtgcacactggagagaagcccttcacctgcagtgaatgtgggaaggccttccgccacaacagcaccctggtgcagcaccacaagatccacactggagtgcggccctatgagtgcagtgaatgtgggaagctgttctccttcaacagcagcctgatgaagcaccagaggatccacactggagagcggccctacaagtgcagtgaatgtgggaagttctacagccacaagagcaacctgatcaagcactggagggtgcacactggagagcggccctacaagtgcagcgactgtgggaagttcttcacccagtgcagcagcctgatgcagcaccagaaggtgcacactggagagaagcccttcaagtgcaatgaatgtggccgcttcttccgggagaacagcaccctggtgcgccaccagagggtgcacactggagccaagccctatgagtgcagagaatgtgggaagttcttcagccagagcagcaccctgatgcagcacaggaaggtgcacatcggggagaagcccttcaagtgcaatgaatgtggccgcctcttccgggagaacagcagcctggtgaagcaccagagggtgcacactggagccaagccctatgagtgcagagaatgtgggaagttcttccgccacaacagcagcctcttcaagcaccggcgcatccacactggagagatgcagtag

SEQ ID NO: 17873 - DNA, 1536 bp, Artificial Sequence
  Description of Artificial Sequence: Synthetic coding sequence
atggctgctgctgccctgcgggaccctgcccaggtgcctgtggccgctgacctgctgacagaccacgaggagcagggctacgtgacctttgaagatgtggccgtgtacttcagccaggaggagtggaggctgctggatgatgcccagaggctgctgtacagaaatgtgatgctggagaacttcaccctgctggccagcctgggcctggccagcagcaagacccatgagatcacccagctggagagctgggaggagcccttcatgcctgcctgggaggtggtgaccagcgccatcccccggggctgctggcacggggctgaggccgaggaggcccctgagcagatcgcctctgtgggcctgctgagcagcaacatccagcagcaccagaagcagcactgtggggagaagcccctgaagaggcaggagggccgggtgcctgtgctgcggagctgcaaggtgcacctgtctgagaagagcctgcagagccgggaggtgggcaaggccctgctgatcagcagtggagtgctgaagcaccaggtgacccacactggagagaagagccacaggagcagcaagagccgggaggccttccacgccggcaagaggcactacaagtgcagtgaatgtgggaaggccttcggccagaagtacctgctggtgcagcaccagaggctgcatgctgggaagaagacctatgaatgttctgaatgtgggaagctgttccgggacatgagcaacctcttcatccaccagatcgtgcacactggagagcggccctacggctgcagcaactgtgggaagagcttcagcagaaatgcccacctgattgagcaccagagggtgcacactggagagaagcccttcacctgcagtgaatgtgggaaggccttccgccacaacagcaccctggtgcagcaccacaagatccacactggagtgcggccctatgaatgttctgaatgtgggaagctgttctccttcaacagcagcctgatgaagcaccagaggatccacactggagagcggccctacaagtgcagtgaatgtgggaagttctacagccacaagagcaacctgatcaagcactggagggtgcacactggagagcggccctacaagtgcagcgactgtgggaagttcttcacccagtgcagcagcctgatgcagcaccagaaggtgcacactggagagaagcccttcaagtgcaatgaatgtggccgcttcttccgggagaacagcaccctggtgcgccaccagagggtgcacactggagccaagccctatgaatgtcgggagtgtgggaagttcttcagccagagcagcaccctgatgcagcacaggaaggtgcacatcggggagaagcccttcaagtgcaatgaatgtggccgcctcttccgggagaacagcagcctggtgaagcaccagagggtgcacactggagccaagccctatgaatgtcgggagtgtgggaagttcttccgccacaacagcagcctcttcaagcaccggcgcatccacactggagagatgcagtag

SEQ ID NO: 17874 - DNA, 1497 bp, Artificial Sequence
  Description of Artificial Sequence: Synthetic coding sequence
atggctgctgctgccctgcgggaccctgcccagcagggctacgtgacctttgaagatgtggccgtgtacttcagccaggaggagtggaggctgctggatgatgcccagaggctgctgtacagaaatgtgatgctggagaacttcaccctgctggccagcctgggcctggccagcagcaagacccatgagatcacccagctggagagctgggaggagcccttcatgcctgcctgggaggtggtgaccagcgccatcccccggggctgctggcatggagctgaggccgaggaggcccctgagcagatcgcctctgtgggcctgctgagcagcaacatccagcagcaccagaagcagcactgtggggagaagcccctgaagaggcaggagggccgggtgcctgtgctgcggagctgcaaggtgcacctgtctgagaagagcctgcagagccgggaggtgggcaaggccctgctgatcagcagcggcgtgctgaagcaccaggtgacccacactggagagaagagccacaggagcagcaagagccgggaggccttccacgccggcaagaggcactacaagtgcagtgaatgtgggaaggccttcggccagaagtacctgctggtgcagcaccagaggctgcacgccggcaagaagacctatgagtgcagtgaatgtgggaagctgttccgggacatgagcaacctcttcatccaccagatcgtgcacactggagagcggccctacggctgcagcaactgtgggaagagcttcagcagaaatgcccacctgattgagcaccagagggtgcacactggagagaagcccttcacctgcagtgaatgtgggaaggccttccgccacaacagcaccctggtgcagcaccacaagatccacactggagtgcggccctatgagtgcagtgaatgtgggaagctgttctccttcaacagcagcctgatgaagcaccagaggatccacactggagagcggccctacaagtgcagtgaatgtgggaagttctacagccacaagagcaacctgatcaagcactggagggtgcacactggagagcggccctacaagtgcagcgactgtgggaagttcttcacccagtgcagcagcctgatgcagcaccagaaggtgcacactggagagaagcccttcaagtgcaatgaatgtggccgcttcttccgggagaacagcaccctggtgcgccaccagagggtgcacactggagccaagccctatgagtgcagagaatgtgggaagttcttcagccagagcagcaccctgatgcagcacaggaaggtgcacatcggggagaagcccttcaagtgcaatgaatgtggccgcctcttccgggagaacagcagcctggtgaagcaccagagggtgcacactggagccaagccctatgagtgcagagaatgtgggaagttcttccgccacaacagcagcctcttcaagcaccggcgcatccacactggagagatgcagtag

SEQ ID NO: 17875 - DNA, 477 bp, Artificial Sequence
  Description of Artificial Sequence: Synthetic coding sequence
atggctgctgctgccctgcgggaccctgcccaggtgcctgtggccgctgacctgctgacagaccacgaggagggctacgtgacctttgaagatgtggccgtgtacttcagccaggaggagtggaggctgctggatgatgcccagaggctgctgtacagaaatgtgatgctggagaacttcaccctgctggccagcctgggctgctggcacggggctgaggccgaggaggcccctgagcagatcgcctctgtgggcctgctggaggtgctggccaagcagggcggctgcagcggcaagaagacctatgaatgttctgaatgtgggaagctgttccgggacatgagcaacctcttcatccaccagatcgtgcacactggagagcggccctacggctgcagcaactgtgggaagagcttcagcagaaatgcccacctgattgagcaccagagggtgcacactggagagaagcccttctag

SEQ ID NO: 17876 - DNA, 1494 bp, Artificial Sequence
  Description of Artificial Sequence: Synthetic coding sequence
atggctgctgctgccctgcgggaccctgcccagggctacgtgacctttgaagatgtggccgtgtacttcagccaggaggagtggaggctgctggatgatgcccagaggctgctgtacagaaatgtgatgctggagaacttcaccctgctggccagcctgggcctggccagcagcaagacccatgagatcacccagctggagagctgggaggagcccttcatgcctgcctgggaggtggtgaccagcgccatcccccggggctgctggcacggggctgaggccgaggaggcccctgagcagatcgcctctgtgggcctgctgagcagcaacatccagcagcaccagaagcagcactgtggggagaagcccctgaagaggcaggagggccgggtgcctgtgctgcggagctgcaaggtgcacctgtctgagaagagcctgcagagccgggaggtgggcaaggccctgctgatcagcagtggagtgctgaagcaccaggtgacccacactggagagaagagccacaggagcagcaagagccgggaggccttccacgccggcaagaggcactacaagtgcagtgaatgtgggaaggccttcggccagaagtacctgctggtgcagcaccagaggctgcatgctgggaagaagacctatgaatgttctgaatgtgggaagctgttccgggacatgagcaacctcttcatccaccagatcgtgcacactggagagcggccctacggctgcagcaactgtgggaagagcttcagcagaaatgcccacctgattgagcaccagagggtgcacactggagagaagcccttcacctgcagtgaatgtgggaaggccttccgccacaacagcaccctggtgcagcaccacaagatccacactggagtgcggccctatgaatgttctgaatgtgggaagctgttctccttcaacagcagcctgatgaagcaccagaggatccacactggagagcggccctacaagtgcagtgaatgtgggaagttctacagccacaagagcaacctgatcaagcactggagggtgcacactggagagcggccctacaagtgcagcgactgtgggaagttcttcacccagtgcagcagcctgatgcagcaccagaaggtgcacactggagagaagcccttcaagtgcaatgaatgtggccgcttcttccgggagaacagcaccctggtgcgccaccagagggtgcacactggagccaagccctatgaatgtcgggagtgtgggaagttcttcagccagagcagcaccctgatgcagcacaggaaggtgcacatcggggagaagcccttcaagtgcaatgaatgtggccgcctcttccgggagaacagcagcctggtgaagcaccagagggtgcacactggagccaagccctatgaatgtcgggagtgtgggaagttcttccgccacaacagcagcctcttcaagcaccggcgcatccacactggagagatgcagtag

SEQ ID NO: 17877 - DNA, 1335 bp, Artificial Sequence
  Description of Artificial Sequence: Synthetic coding sequence
atggctgctgctgccctgcgggaccctgcccaggtgcctgtggccgctgacctgctgacagaccacgaggagcagggctacgtgacctttgaagatgtggccgtgtacttcagccaggaggagtggaggctgctggatgatgcccagaggctgctgtacagaaatgtgatgctggagaacttcaccctgctggccagcctgggcctggccagcagcaagacccatgagatcacccagctggagagctgggaggagcccttcatgcctgcctgggaggtggtgaccagcgccatcccccggggctgctggcacggggctgaggccgaggaggcccctgagcagatcgcctctgtgggcctgctgagcagcaacatccagcagcaccagaagcagcactgtggggagaagcccctgaagaggcaggagggccgggtgcctgtgctgcggagctgcaaggtgcacctgtctgagaagagcctgcagagccgggaggtgggcaaggccctgctgatcagcagtggagtgctgaagcaccaggtgacccacactggagagaagagccacaggagcagcaagagccgggaggccttccacgccggcaagaggcactacaagtgcagtgaatgtgggaaggccttcggccagaagtacctgctggtgcagcaccagaggctgcatgctgggaagaagacctatgaatgttctgaatgtgggaagctgttccgggacatgagcaacctcttcatccaccagatcgtgcacactggagagcggccctacggctgcagcaactgtgggaagagcttcagcagaaatgcccacctgattgagcaccagagggtgcacactggagagaagcccttcacctgcagtgaatgtgggaaggccttccgccacaacagcaccctggtgcagcaccacaagatccacactggagtgcggccctatgaatgttctgaatgtgggaagctgttctccttcaacagcagcctgatgaagcaccagaggatccacactggagagcggccctacaagtgcagtgaatgtgggaagttctacagccacaagagcaacctgatcaagcactggagggtgcacactggagagcggccctacaagtgcagcgactgtgggaagttcttcacccagtgcagcagcctgatgcagcaccagaaggtgcacactggagagaagcccttcaagtgcaatgaatgtggccgcttcttccgggagaacagcaccctggtgcgccaccagagggtgcacactggagccaagccctatgaatgtcgggagtgtgggaagttcttcagccagagcagcaccctgatgtag

SEQ ID NO: 17878 - DNA, 366 bp, Artificial Sequence
  Description of Artificial Sequence: Synthetic coding sequence
atggctgctgctgccctgcgggaccctgcccagcagggctacgtgacctttgaagatgtggccgtgtacttcagccaggaggagtggaggctgctggatgatgcccagaggctgctgtacagaaatgtgatgctggagaacttcaccctgctggccagcctgggctgctggcacggggctgaggccgaggaggcccctgagcagatcgcctctgtgggcctgctgagcagcaacatccagcagcaccagaagcagcactgtggggagaagcccctgaagaggcaggagggccgggtgcctgtgctgcggagctgcaaggtgcacctgtctgagaagagcctgcagagccgggaggtgggcaagtag

SEQ ID NO: 17879 - DNA, 408 bp, Artificial Sequence
  Description of Artificial Sequence: Synthetic coding sequence
atggctgctgctgccctgcgggaccctgcccagcagggctacgtgacctttgaagatgtggccgtgtacttcagccaggaggagtggaggctgctggatgatgcccagaggctgctgtacagaaatgtgatgctggagaacttcaccctgctggccagcctgggcctggccagcagcaagacccatgagatcacccagctggagagctgggaggagcccttcatgcctgcctgggaggtggtgaccagcgccatcccccggggctgctggcatggagctgaggccgaggaggcccctgagcagatcgcctctgtgggcctgctgagcagcaacatccagcagcaccagaagcagcactgtggggagaagcccctgaagaggcaggagggccgggtgcctgtgctgtag

SEQ ID NO: 17880 - DNA, 1611 bp, Artificial Sequence
  Description of Artificial Sequence: Synthetic coding sequence
atggccaggaagctggtgatgttcagagatgtggccatcgacttcagccaggaggagtgggagtgcctggacagcgcccagagggacctgtacagagatgtgatgctggagaactacagcaacctggtgtccctggacctgcccagccgctgtgccagcaaggacctgagccctgagaagaacacctatgaaacagagctgagccagtgggagatgtctgaccggctggagaactgtgacctggaggagagcaacagccgggactacctggaggccaagggcaagatggagaagcagcaggagaaccagaaggagtacttccggcagggcatgatcatctatgacaagatgagcatcttcaaccagcacacctacctgagccagcacagccgctgccacagcacagagaagccctacaagtgcaaggaatgtgggaaggccttcagaagagccagccacctgacccagcaccagagcatccacactggagagaagccctatgagtgcaagcagtgtgggaaggccttcagccgggacagccagctgagcctgcaccagaggctgcacactggagagaagccctatgcctgcaaggaatgtgggaaggccttcacccagagcagccagctgatcctgcaccaccgcatccacactggagagaagccctacaagtgtgaagaatgtgggaaggccttcatccgcagcagccagctgaccaggcaccagaaggtgcacactggagagaagccctatgagtgcaaggaatgtgggaaggccttcacccagaacagccagctgaccctgcaccagaggctgcacactggagagaagctgtatgagtgcaaggaatgtaggaaggtgttcacccagctgagccagctgatcctgcacaagaggatccacactggagagaagccctatgagtgcaaggaatgtgggaaggccttcatctgtggcagccagctgagccagcaccagaagatccacaacggggagaagccctatgagtgcaaggaatgtggccgggccttcatccggggcagcctgctgatgcagcaccagaggatccacactggagagaagccctacaagtgtgaagaatgtgggaaggccttcatccggggcagccagctgacccagcaccagaggatccacaccaatgagaagccctatgagtgcaaggaatgtgggaagatgttcagccacggcagccagctgacccagcaccagaggatccacactggagagaagccctaccagtgcaaggaatgtgggaaggccttcaacagaggcagcctgctgaccaggcaccagaggatccacactggagagaagccctatgagtgcaaggaatgtgggaagaccttcagccggggcagcgagctgacccagcacgagcgcatccacacagccttcctggccggccagcaggacagaagtgacatctacatgagccgccgcttcaccaagagcatcttccctgtgttcttctctgtgcccaccatgtggaccagcaagctggagctgcgctacagccatggagactttgaaaatggcatctgggtgctgtggatcatggagcagaagtacagaagaagcctgcagccctag

SEQ ID NO: 17881 - DNA, 2067 bp, Artificial Sequence
  Description of Artificial Sequence: Synthetic coding sequence
atggccaggaagctggtgatgttcagagatgtggccatcgacttcagccaggaggagtgggagtgcctggacagcgcccagagggacctgtacagagatgtgatgctggagaactacagcaacctggtgtccctggacctgcccagccgctgtgccagcaaggacctgagccctgagaagaacacctatgaaacagagctgagccagtgggagatgtctgaccggctggagaactgtgacctggaggagagcaacagccgggactacctggaggccaagggcaagatggagaagcagcaggagaaccagaaggagtacttccggcagggcatgatcatctatgacaagatgagcatcttcaaccagcacacctacctgagccagcacagccgctgccacagcacagagaagccctacaagtgcaaggaatgtgggaaggccttcagaagagccagccacctgacccagcaccagagcatccacactggagagaagccctatgagtgcaagcagtgtgggaaggccttcagccgggacagccagctgagcctgcaccagaggctgcacactggagagaagccctatgcctgcaaggaatgtgggaaggccttcacccagagcagccagctgatcctgcaccaccgcatccacactggagagaagccctacaagtgtgaagaatgtgggaaggccttcatccgcagcagccagctgaccaggcaccagaaggtgcacactggagagaagccctatgagtgcaaggaatgtgggaaggccttcacccagaacagccagctgaccctgcaccagaggctgcacactggagagaagctgtatgagtgcaaggaatgtaggaaggtgttcacccagctgagccagctgatcctgcacaagaggatccacactggagagaagccctatgagtgcaaggaatgtgggaaggccttcatctgtggcagccagctgagccagcaccagaagatccacaacggggagaagccctatgagtgcaaggaatgtggccgggccttcatccggggcagcctgctgatgcagcaccagaggatccacactggagagaagccctacaagtgtgaagaatgtgggaaggccttcatccggggcagccagctgacccagcaccagaggatccacaccaatgagaagccctatgagtgcaaggaatgtgggaagatgttcagccacggcagccagctgacccagcaccagaggatccacactggagagaagccctaccagtgcaaggaatgtgggaaggccttcaacagaggcagcctgctgaccaggcaccagaggatccacactggagagaagccctatgagtgcaaggaatgtgggaagaccttcagccggggcagcgagctgacccagcacgagcgcatccacactggagagaagccctatgagtgcaaggaatgtgggaagagcttcatccggggcagccagctgacccagcaccagaggatccacactggagagaagccctatgagtgcaaggaatgtaggatggccttcacccagagcagccacctgagccagcaccagaggctgcacactggagagaagccctacgtgtgcaatgaatgtgggaaggcctttgcccggggcctgctgctgatccagcaccagaggatccacactggagagaagccctaccagtgcaaggaatgtgggaaggccttcatccggggcagccagctgacccagcaccagaggatccacactggagagaagccctatgagtgcaaggaatgtgggaaggccttcagccacggcagccagctgaccctgcaccagaggatccacactggagagaagccctatgagtgcagagaatgtaggaaggccttcacccagagcagccacctgagccgccaccagaggatccacactggagagaagccctaccagtgcaaggaatgtgggaaggccttcacccggggcagccagctgacccagcaccagaggatccacatcagcgagaagagctttgagtacaaggaatgtggcatcgacttcagccacggcagccaggtgtacatgtag

SEQ ID NO: 17882 - DNA, 1665 bp, Artificial Sequence
  Description of Artificial Sequence: Synthetic coding sequence
atggctgctgctgacctgagccacggccactacctgagcggggaccctgtgtgcctgcacgaggagaagaccccagctggaagaattgtggccgactgcctgacagactgctaccaggacagcgtgacctttgatgatgtggccgtggacttcacccaggaggagtggaccctgctggacagcacccagaggagcctgtacagtgatgtgatgctggagaactacaagaacctggccaccgtgggcggccagatcatcaagcccagcctcatctcctggctggagcaggaggagagcaggacagtgcagggcggcgtgctgcagggctgggagatgaggctggagacccagtggagcatcctgcagcaggacttcctgcggggccagaccagcatcggcatccagctggagggcaagcacaacggccgggagctgtgtgactgtgagcagtgtggggaggtgttcagcgagcacagctgcctgaagacccacgtgaggacccagagcacaggcaacacccatgactgcaaccagtatggcaaggacttcctgaccctgtgtgagaagaccagcactggagagaagctgtctgagttcaaccagagcgagaagatcttcagcctgacccccaacatcgtgtaccagaggaccagcacccaggagaagagctttgaatgtagccactgcggcaagagcttcatcaatgaaagctacctgcaggcccacatgaggacccacaatggagagaagctgtatgagtggagaaattatggccctggcttcatcgacagcaccagcctgtctgtgctgattgagaccctgaatgccaagaagccctacaagtgcaaggaatgtgggaagggctaccgctacccagcctacctgagcatccacatgaggacccacactggagagaagccctatgagtgcaaggaatgtgggaaggccttcaactacagcaacagcttccagatccacggccgcacccacactggagagaagccctacgtgtgcaaggaatgtgggaaggccttcacccagtacagcggcctgtccatgcacgtgcgcagccacagcggggacaagccctatgagtgcaaggaatgtgggaagagcttcctgaccagcagccgcctcatccagcacatccgcacccacactggagagaagccctttgtgtgtgtggagtgtgggaaggcctttgctgtgagcagcaacctgagcggccacctgcggacccacacagaggagaaggcctgtgagtgcaagatctgtgggaaggtgtttggctaccccagctgcctgaacaaccacatgaggacccacagcgcccagaagccctacacctgcaaggaatgtgggaaggccttcaactacagcacccacctgaagatccacatgaggatccacactggagagaagccctatgagtgcaagcagtgtgggaaggccttcagccacagcagcagcttccagatccacgagaggacccacactggagagaagccctatgagtgcaaggaatgtgggaaggccttcacctgcagcagcagcttccgcatccacgagaagacccacacagaggagaagccctacaagtgccagcagtgtgggaaggcctacagccaccccaggagcctgcggagacatgagcagatccactag

SEQ ID NO: 17883 - DNA, 1665 bp, Artificial Sequence; identical to SEQ ID NO: 17882
  Description of Artificial Sequence: Synthetic coding sequence

SEQ ID NO: 17884 - DNA, 1626 bp, Artificial Sequence
  Description of Artificial Sequence: Synthetic coding sequence
agtgatggagacatcaatgaaagaagagtgctgaccaggagccacctggccggctggcagctgctgatctgccccatggacagcgtgacctttgatgatgtggccgtggacttcacccaggaggagtggaccctgctggacagcacccagaggagcctgtacagtgatgtgatgctggagaactacaagaacctggccaccgtgggcggccagatcatcaagcccagcctcatctcctggctggagcaggaggagagcaggacagtgcagggcggcgtgctgcagggctgggagatgaggctggagacccagtggagcatcctgcagcaggacttcctgcggggccagaccagcatcggcatccagctggagggcaagcacaacggccgggagctgtgtgactgtgagcagtgtggggaggtgttttctgagcacagctgcctgaagacccacgtgaggacccagagcactggaaacacccatgactgcaaccagtatggcaaggacttcctgaccctgtgtgagaagaccagcactggagagaagctgtctgagttcaaccagagcgagaagatcttcagcctgacccccaacatcgtgtaccagaggaccagcacccaggagaagagctttgagtgcagccactgtgggaagagcttcatcaatgaaagctacctgcaggcccacatgaggacccacaacggggagaagctgtatgagtggaggaactacggccctggcttcatcgacagcaccagcctgtctgtgctgattgagaccctgaatgccaagaagccctacaagtgcaaggaatgtgggaagggctaccgctacccagcctacctgagcatccacatgaggacccacactggagagaagccctatgagtgcaaggaatgtgggaaggccttcaactacagcaacagcttccagatccacggccgcacccacactggagagaagccctacgtgtgcaaggaatgtgggaaggccttcacccagtacagcggcctgtccatgcacgtgcgcagccacagcggggacaagccctatgagtgcaaggaatgtgggaagagcttcctgaccagcagccgcctcatccagcacatccgcacccacactggagagaagccctttgtgtgtgtggagtgtgggaaggcctttgctgtgagcagcaacctgagcggccacctgcggacccacacagaggagaaggcctgtgagtgcaagatctgtgggaaggtgtttggctaccccagctgcctgaacaaccacatgaggacccacagcgcccagaagccctacacctgcaaggaatgtgggaaggccttcaactacagcacccacctgaagatccacatgaggatccacactggagagaagccctatgagtgcaagcagtgtgggaaggccttcagccacagcagcagcttccagatccacgagaggacccacactggagagaagccctatgagtgcaaggaatgtgggaaggccttcacctgcagcagcagcttccgcatccacgagaagacccacacagaggagaagccctacaagtgccagcagtgtgggaaggcctacagccaccccaggagcctgcggagacatgagcagatccactag

SEQ ID NO: 17885 - DNA, 2025 bp, Artificial Sequence
  Description of Artificial Sequence: Synthetic coding sequence
atgggccccctgaccttcacagatgtggccatcgagttcagcctggaggagtggcagtgcctggacacagcccagcagaacctgtacagaaatgtgatgctggagaactacagaaacctggtgttcctgggcattgctgtgtccaagccagacctgatcacctgcctggagaaggagaaggagccctgcaagatgaagagacatgagatggtggatgagccccctgtggtgtgcagccactttgctgaggacttctggccagagcaggacatcaaggacagcttccagaaggtgaccctgcggcgctatgacaagaggggccacgagaacctgcagctgaggaagggctacaagacagtgggggactgcaagctgtacaagggcggctacaacggcctgaaccagtgcctgaccctgacccagagcaagatgtaccactgtgacatctacgtgaaggtgttctacgccttcagcaatgctgaccgctacaagaccaggcacacaggcaagaagcccttccagtgcaagaagtgtgggaagagcttctgcatgctgagccagctgacccagcacaagaagatccacatccgggagaacacctaccgctgcaaggagtttggaaatgccttcaaccagagcagcgccctgaccaaccacaagaggatctacgtgggggagaagcactaccgctgtgaagaatgtgggaaggccttcaaccactacagcaccctgaccaaccacaagaggatccacactggagagaagccctacaagtgcaaggaatgtgggaaggccttcagccgctacagcaccctgaccacccacaagaggatccacagcggggagaagccctacaagtgtgatgaatgtgggaagaccttcagcatcagcagcaccttcaccaagcacaagatcatccacacagaggagaagccctacaagtgcaaggaatgtgggaaggccttcaacagaagcagcaccctgaccagccacaagaggatccacactggagagaagccctacaagtgtgaagaatgtgggaaggccttcaactggagcagcaccctgaccaagcacaaggtgatccacactggagagaagccctacaagtgtgaagaatgtgggaaggccttcaaccagagcagccggctgaccaggcacaagaagatccacactggagaggagccctacaagtttgagaagtgtggccgggtcttcacctgcagcagcaccctgacccaggacaagaagatccacactggagagaagccctacaactgtgaagaatgtgggaaggtgttcacctacagcagcaccctgaccaggcacaagaggatccacacagaggagaagccctacaagtgcaatgaatgtgggaaggccttcaacagaagcagccacctgaccagccaccggcgcatccacactggagagaagccctacaagtgtgaagaatgtgggaaggccttcaagcagagcagcaacctgaacagccacaagaagatccacagcggggagaagccctacaagtgtgaagaatgtgggaaggccttcatcctgagcagccggctgacccagcacaagaagatccacactggagagaagccctacaagtgtgaagaatgtgggaaggccttcaacagaagcagccggctgacccagcacaagaagatccacactggagagaagccctacaagtgcaagcagtgtgacaaggccttcacccacagcagcaacctgagcagccacaagaagatccacagcggggagaagccctacaagtgtgaagaatgtgggaaggccttcaacagaagcagccggctgacccagcacaagaagatccacacccgggagaagccctacaagtgtgaagaatgtgccaaggccttcaccaggagcagccggctgacccagcacaagaagatccacaggatgggcgtggtggcccacgcctgcaaccccagcaccctgggcggccggggcggccgcatcaccaggtctggggaccgggacaggcctggatag

SEQ ID NO: 17886 - DNA, 1731 bp, Artificial Sequence
  Description of Artificial Sequence: Synthetic coding sequence
atggatgacctgaagtatggagtgtaccccctgaaggaggccagcggctgccctggagctgagaggaacctgctggtgtacagctactttgagaaggagaccctgaccttcagagatgtggccatcgagttcagcctggaggagtgggagtgcctgaacccagcccagcagaacctgtacatgaatgtgatgctggagaactacaagaacctggtgttcctgggcgtggccgtgtccaagcaggaccctgtgacctgcctggagcaggagaaggagccctggaacatgaagagacatgagatggtggatgagcccccagccatgtgcagctacttcaccaaggacctgtggccagagcaggacatcaaggacagcttccagcaggtgatcctgcggcgctatggaaaatgtgaacatgagaacctgcagctgaggaagggcagcgcctctgtggatgagtacaaggtgcacaaggagggctacaatgagctgaaccagtgcctgaccaccacccagagcaagatcttcccctgtgacaagtatgtgaaggtgttccacaagttcctgaatgccaacagacacaagaccaggcacacaggcaagaagcccttcaagtgcaagaagtgtgggaagagcttctgcatgctgctgcacctgagccagcacaagaggatccacatcagagaaaattcctaccagtgtgaggagtgtgggaaggccttcaagtggttcagcaccctgaccaggcacaagaggatccacactggagagaagcccttcaagtgtgaggagtgtgggaaggccttcaagcagagcagcaccctgaccacccacaagatcatccacactggagagaagccctaccgctgtgaggagtgtgggaaggccttcaacagaagcagccacctgaccacccacaagatcatccacactggagagaagccctacaagtgtgaggagtgtgggaaggccttcaaccagagcagcaccctgagcacccacaagttcatccatgctggggagaagccctacaagtgtgaggagtgtgacaaggccttcaaccgcttctcctacctgaccaagcacaagatcatccacactggagagaagagctacaagtgtgaggagtgtgggaagggcttcaactggagcagcaccctgaccaagcacaagaggatccacactggagagaagccctacaagtgtgaggtgtgtgggaaggccttcaatgaaagcagcaacctgaccacccacaagatgatccacactggagagaagccctacaagtgtgaggagtgtgggaaggccttcaacagaagcccccagctgacagcccacaagatcatccacactggagagaagccctacaagtgtgaggagtgtgggaaggccttcagccagagcagcatcctgaccacccacaagaggatccacactggagagaagccctacaagtgtgaggagtgtgggaaggccttcaacagaagcagcaacctgaccaagcacaagatcatccacactggagagaagagctacaagtgtgaggagtgtgggaaggccttcaaccagagcagcaccctgaccaagcacaggaagatccacacccggcagaagccctacaactgtgaggagtgtgacaacaccttcaaccagagcagcaacctgatcaagcagaacaacagctactggagggagaccctgcagatgagcaggatgtgggagagcctgtag

SEQ ID NO: 17887 - DNA, 1563 bp, Artificial Sequence
  Description of Artificial Sequence: Synthetic coding sequence
atgccccagctgagcctgagcagcctgggcctgtggcccatggccgccagcccctggctgctgctgctgctggtgggcgcctcctggctgctggcccgcatcctggcctggacctacaccttctatgacaactgctgccgcctgcgctgcttcccccagccccccaagaggaactggttcctgggccacctgggcctcatccacagcagcgaggagggcctgctgtacacccagagcctggcctgcaccttcggggacatgtgctgctggtgggtgggcccctggcacgccatcgtgcgcatcttccaccccacctacatcaagcctgtgctgtttgccccagctgccatcgtgcccaaggacaaggtgttctacagcttcctgaagccctggctgggagatggcctgctgctgtctgctggggagaagtggagccgccacaggaggatgctgaccccagccttccacttcaacatcctgaagccctacatgaagatcttcaatgaatctgtgaacatcatgcacgccaagtggcagctgctggccagcgagggcagcgcccggctggacatgtttgagcacatcagcctgatgaccctggacagcctgcagaagtgtgtgttctcctttgacagccactgccaggagaagcccagcgagtacatcgccgccatcctggagctgagcgccctggtgaccaagaggcaccagcagatcctgctgtacatcgacttcctgtactacctgaccccagatggccagcgcttcagaagagcctgccgcctggtgcatgacttcacagatgctgtgatccaggagaggaggaggaccctgcccagccagggcgtggatgacttcctgcaggccaaggccaagagcaagaccctggacttcattgatgtgctgctgctgagcaaggatgaagatggcaagaagctgagtgatgaggacatccgggcagaggccgacaccttcatgtttgagggccatgacaccacagccagcggcctgtcctgggtgctgtaccacctggccaagcaccctgagtaccaggagcgctgccggcaggaggtgcaggagctgctgaaggaccgggagcccaaggagattgagtgggatgacctggcccagctgcccttcctgaccatgtgcatcaaggagagcctgcggctgcacccccctgtgcctgctgtgagccgctgctgcacccaggacatcgtgctgcctgatggccgggtcatccccaagggcatcatctgcctgatctctgtgtttggcacccaccacaacccagctgtgtggccagaccctgaggtgtatgaccccttccgctttgaccccaagaacatcaaggagaggagccccctggccttcatccccttctctgctggccccaggaactgcatcggccaggcctttgccatggccgagatgaaggtggtgctgggcctgaccctgctgcgcttccgggtgctgcctgaccacacagagcccaggaggaagccagagctggtgctgcgggcagagggcggcctgtggctgcgggtggagcccctgtcctag

SEQ ID NO: 17888 - DNA, 2022 bp, Artificial Sequence
  Description of Artificial Sequence: Synthetic coding sequence
atgatgttccaggacagcgtggcctttgaagatgtggccgtgaccttcacccaggaggagtgggccctgctggaccccagccagaagaacctgtgcagagatgtgatgcaggagaccttcaggaacctggccagcatcggcaagaagtggaagccccagaacatctacgtggagtatgagaacctgcggaggaacctgcgcatcgtgggggagcggctgtttgagagcaaggagggccaccagcacggggagatcctgacccaggtgcctgatgacatgctgaagaagaccaccactggagtgaagagctgtgagagctctgtgtatggagaggtgggcagcgcccacagcagcctgaacagacacatcagagatgacaccggccacaaggcctatgagtaccaggagtatggccagaagccctacaagtgcaagtactgcaagaagcccttcaactgcctgagctctgtgcagacccatgagcgggcccacagcggcaggaagctgtatgtgtgtgaggagtgtgggaagaccttcatcagccacagcaacctgcagaggcaccgcatcatgcacagaggagatggcccctacaagtgcaagttctgtgggaaggccctgatgttcctgagcctgtacctgatccacaagaggacccacactggagagaagccctaccagtgcaagcagtgtgggaaggccttcagccacagcagcagcctgcgcatccacgagaggacccacactggagagaagccctacaagtgcaatgaatgtgggaaggccttccacagcagcacctgcctgcacgcccacaagaggacccacactggagagaagccctatgagtgcaagcagtgtgggaaggccttcagcagcagccacagcttccagatccacgagaggacccacactggagagaagccctatgagtgcaaggaatgtgggaaggccttcaagtgccccagctctgtgagaagacatgagaggacccacagcaggaagaagccctatgagtgcaagcactgcggcaaggtgctgagctacctgaccagcttccagaaccacctgggcatgcacactggagagatcagccacaagtgcaagatctgtgggaaggccttctacagccccagcagcctgcagacccatgagaagacccacactggagagaagccctacaagtgcaaccagtgtgggaaggccttcaacagcagcagcagcttccgctaccacgagaggacccacactggagagaagccctatgagtgcaagcagtgtgggaaggccttccgcagcgccagcctgctgcagacccacggccgcacccacactggagagaagccctatgcctgcaaggaatgtgggaagcccttcagcaacttctccttcttccagatccacgagaggatgcaccgggaggagaagccctatgaatgtaaaggctacggcaagaccttcagcctgcccagcctcttccacagacatgagaggacccacactggaggcaagacctatgagtgcaagcagtgtggccgctccttcaactgcagcagcagcttccgctaccacggccgcacccacactggagagaagccctatgagtgcaagcagtgtgggaaggccttccgcagcgccagccagctgcagatccacggccgcacccacactggagagaagccctatgagtgcaagcagtgtgggaaggcctttggaagtgccagccacctgcagatgcacggccgcacccacactggagagaagccctatgagtgcaagcagtgtgggaagagctttggctgtgccagccggctgcagatgcacggccgcacccacactggagagaagccctacaagtgcaagcagtgtgggaaggccttcggctgccccagcaacctgcggcggcacggccgcacccacactggagagaagccctacaagtgcaaccagtgtgggaaggtgttccgctgcagcagccagctgcaggtgcacggccgggcccactgcatcgacaccccctag

SEQ ID NO: 17889 - DNA, 1917 bp, Artificial Sequence
  Description of Artificial Sequence: Synthetic coding sequence
atgcaggagaccttcaggaacctggccagcatcggcaagaagtggaagccccagaacatctacgtggagtatgagaacctgcggaggaacctgagaattgtgggggagcggctgtttgagagcaaggagggccaccagcacggggagatcctgacccaggtgcctgatgacatgctgaagaagaccaccaccggggtgaagagctgtgagagctctgtgtatggagaggtgggcagcgcccacagcagcctgaacagacacatcagagatgacaccggccacaaggcctatgagtaccaggagtatggccagaagccctacaagtgcaagtactgcaagaagcccttcaactgcctgagctctgtgcagacccatgagcgggcccacagcggcaggaagctgtatgtgtgtgaagaatgtgggaagaccttcatcagccacagcaacctgcagaggcaccgcatcatgcacagaggagatggcccctacaagtgcaagttctgtgggaaggccctgatgttcctgagcctgtacctgatccacaagaggacccacactggagagaagccctaccagtgcaagcagtgtgggaaggccttcagccacagcagcagcctgcgcatccacgagaggacccacactggagagaagccctacaagtgcaatgaatgtgggaaggccttccacagcagcacctgcctgcacgcccacaagaggacccacactggagagaagccctatgagtgcaagcagtgtgggaaggccttcagcagcagccacagcttccagatccacgagaggacccacactggagagaagccctatgagtgcaaggaatgtgggaaggccttcaagtgccccagctctgtgagaagacatgagaggacccacagcaggaagaagccctatgagtgcaagcactgtgggaaggtgctgagctacctgaccagcttccagaaccacctgggcatgcacactggagagatcagccacaagtgcaagatctgtgggaaggccttctacagccccagcagcctgcagacccatgagaagacccacactggagagaagccctacaagtgcaaccagtgtgggaaggccttcaacagcagcagcagcttccgctaccacgagaggacccacactggagagaagccctatgagtgcaagcagtgtgggaaggccttccgcagcgccagcctgctgcagacccacggccgcacccacactggagagaagccctatgcctgcaaggaatgtgggaagcccttcagcaacttctccttcttccagatccacgagaggatgcaccgggaggagaagccctatgagtgcaagggctacggcaagaccttcagcctgcccagcctcttccacagacatgagaggacccacactggaggcaagacctatgagtgcaagcagtgtggccgctccttcaactgcagcagcagcttccgctaccacggccgcacccacactggagagaagccctatgagtgcaagcagtgtgggaaggccttccgcagcgccagccagctgcagatccacggccgcacccacactggagagaagccctatgagtgcaagcagtgtgggaaggccttcggcagcgccagccacctgcagatgcacggccgcacccacactggagagaagccctatgagtgcaagcagtgtgggaagagctttggctgtgccagccggctgcagatgcacggccgcacccacactggagagaagccctacaagtgcaagcagtgtgggaaggccttcggctgccccagcaacctgcggagacatggccgcacccacactggagagaagccctacaagtgcaaccagtgtgggaaggtgttccgctgcagcagccagctgcaggtgcacggccgggcccactgcatcgacaccccctag

SEQ ID NO: 17890 - DNA, 159 bp, Artificial Sequence
  Description of Artificial Sequence: Synthetic coding sequence
atgcaggagaccttcaggaacctggccagcatcggcaagaagtggaagccccagaacatctacgtggagtatgagaacctgcggaggaacctgagaattgtgggggagcggctgtttgagagcaaggagggccaccagcacggggagatcctgacctag

SEQ ID NO: 17891 - DNA, 360 bp, Artificial Sequence
  Description of Artificial Sequence: Synthetic coding sequence
atgcaggagaccttcaggaacctggccagcatcggcaagaagtggaagccccagaacatctacgtggagtatgagaacctgcggaggaacctgagaattgtgggggagcggctgtttgagagcaaggagggccaccagcacggggagatcctgacccaggtgcctgatgacatgctgaagaagaccaccaccggggtgaagagctgtgagagctctgtgtatggagaggtgggcagcgcccacagcagcctgaacagacacatcagagatgacaccggccacaaggcctatgagtaccaggagtatggccagaagccctacaagtgcaagtactgcaagaagcccttcaactgcctgtag

SEQ ID NO: 17892 - DNA, 1458 bp, Artificial Sequence
  Description of Artificial Sequence: Synthetic coding sequence
atgagggacaacagagctgtgtccctgtgccagcaggagtggatgtgccccggccctgcccagagggccctgtacagaggagccacccagaggaaggacagccacgtgtccctggccaccggggtgccctggggctatgaggagaccaagaccctgctggccatcctgagcagcagccagttctacggcaagctgcagacctgccagcagaacagccagatctaccgggccatggccgagggcctgtgggagcagggcttcctgcggaccccagagcagtgcaggaccaagttcaagagcctgcagctgagctacaggaaggtgagaagaggccgggtgcctgagccctgcatcttctatgaggagatgaatgccctgagcggctcctgggccagcgccccacccatggccagtgatgctgtgcccggccaggagggcagtgacattgaagctggggagctgaaccaccagaatggagagcccacagaggtggaggatggcaccgtggatggagctgacagagatgagaaggacttcaggaaccctggccaggaggtgaggaagctggacctgcctgtgctcttccccaaccggctgggctttgagttcaagaatgagatcaagaaggagaacctgaagtgggatgattctgaggaggtggagatcaacaaggccctgcagaggaagagccggggcgtgtactggcacagcgagctgcagaagggcctggagagcgagcccaccagccggcggcagtgcaggaacagccctggagagagcgaggagaagacccccagccaggagaagatgagccaccagagcttctgtgcccgggacaaggcctgcacccacatcctgtgtgggaagaactgcagccagagcgtgcacagcccccacaagccagccctgaagctggagaaggtgtcccagtgcccagaatgtgggaagaccttcagccgcagcagctacctggtgcgccaccagaggatccacactggagagaagccccacaagtgcagtgaatgtgggaagggcttcagcgagaggagcaacctgacagcccacctgcggacccacactggagagcggccctaccagtgtggccagtgtgggaagagcttcaaccagagcagcagcctgattgtgcaccagaggacccacactggagagaagccctaccagtgcatcgtgtgtgggaagcgcttcaacaacagcagccagttcagcgcccaccggcgcatccacactggagagagcccctacaagtgtgctgtgtgtgggaagatcttcaacaacagcagccacttcagcgcccacaggaagacccacactggagagaagccctaccgctgcagccactgtgagcggggcttcaccaagaacagcgccctgaccaggcaccagacagtgcacatgaaggctgtgctgagcagccaggagggcagagatgccctgtag

SEQ ID NO: 17893 - DNA, 2094 bp, Artificial Sequence
  Description of Artificial Sequence: Synthetic coding sequence
atgatggctgctgtgaagagcacagaggcccaccccagcagcaacaaggaccccacccagggccagaagagcgccctgcagggcaacagcccagattctgaggccagccggcagcgcttccggcagttctgctaccaggaggtgacaggcccccatgaggccttcagcaagctgtgggagctgtgctgccagtggctgcggcccaagacccacagcaaggaggagatcctggagctgctggtgctggagcagttcctgaccatcctgcctgaggagatccagacctgggtgcgggagcagcacccagaaaatggagaggaggccgtggccctggtggaggatgtgcagagggcccctggccagcaggtgctggacagcgagaaggacctgaaggtgctgatgaaggagatggcccccctgggcgccacccgggagagcctgcggagccagtggaagcaggaggtgcagcctgaggagcccaccttcaagggcagccagagcagccaccagaggcctggagagcagagcgaggcctggctggccccccaggcccccaggaacctgccccagaacacaggcctgcatgaccaggagactggagctgtggtgtggacagctggcagccagggccctgccatgagggacaacagagctgtgtccctgtgccagcaggagtggatgtgccccggccctgcccagagggccctgtacagaggagccacccagaggaaggacagccacgtgtccctggccaccggggtgccctggggctatgaggagaccaagaccctgctggccatcctgagcagcagccagttctacggcaagctgcagacctgccagcagaacagccagatctaccgggccatggccgagggcctgtgggagcagggcttcctgcggaccccagagcagtgcaggaccaagttcaagagcctgcagctgagctacaggaaggtgagaagaggccgggtgcctgagccctgcatcttctatgaggagatgaatgccctgagcggctcctgggccagcgccccacccatggccagtgatgctgtgcccggccaggagggcagtgacattgaagctggggagctgaaccaccagaatggagagcccacagaggtggaggatggcaccgtggatggagctgacagagatgagaaggacttcaggaaccctggccaggaggtgaggaagctggacctgcctgtgctcttccccaaccggctgggctttgagttcaagaatgagatcaagaaggagaacctgaagtgggatgattctgaggaggtggagatcaacaaggccctgcagaggaagagccggggcgtgtactggcacagcgagctgcagaagggcctggagagcgagcccaccagccggcggcagtgcaggaacagccctggagagagcgaggagaagacccccagccaggagaagatgagccaccagagcttctgtgcccgggacaaggcctgcacccacatcctgtgtgggaagaactgcagccagagcgtgcacagcccccacaagccagccctgaagctggagaaggtgtcccagtgcccagaatgtgggaagaccttcagccgcagcagctacctggtgcgccaccagaggatccacactggagagaagccccacaagtgcagtgaatgtgggaagggcttcagcgagaggagcaacctgacagcccacctgcggacccacactggagagcggccctaccagtgtggccagtgtgggaagagcttcaaccagagcagcagcctgattgtgcaccagaggacccacactggagagaagccctaccagtgcatcgtgtgtgggaagcgcttcaacaacagcagccagttcagcgcccaccggcgcatccacactggagagagcccctacaagtgtgctgtgtgtgggaagatcttcaacaacagcagccacttcagcgcccacaggaagacccacactggagagaagccctaccgctgcagccactgtgagcggggcttcaccaagaacagcgccctgaccaggcaccagacagtgcacatgaaggctgtgctgagcagccaggagggcagagatgccctgtag

SEQ ID NO: 17894 - DNA, 2094 bp, Artificial Sequence; identical to SEQ ID NO: 17893
  Description of Artificial Sequence: Synthetic coding sequence

SEQ ID NO: 17895 - DNA, 771 bp, Artificial Sequence
  Description of Artificial Sequence: Synthetic coding sequence
atggctgctgtgaagagcacagaggcccaccccagcagcaacaaggaccccacccagggccagaagagcgccctgcagggcaacagcccagacagcgaggccagccggcagcgcttccggcagttctgctaccaggaggtgacaggcccccatgaggccttcagcaagctgtgggagctgtgctgccagtggctgcggcccaagacccacagcaaggaggagatcctggagctgctggtgctggagcagttcctgaccatcctgcctgaggagatccagacctgggtgcgggagcagcacccagaaaatggagaggaggccgtggccctggtggaggatgtgcagagggcccctggccagcaggtgctggacagcgagaaggacctgaaggtgctgatgaaggagatggcccccctgggcgccacccgggagagcctgcggagccagtggaagcaggaggtgcagcctgaggagcccaccttcaagggcagccagagcagccaccagaggcctggagagcagagcgaggcctggctggccccccaggcccccaggaacctgccccagaacacaggcctgcatgaccaggagaccggggctgtggtgtggacagctggcagccagggccctgccatgagggacaacagagctgtgtccctgtgccagcaggagtggatgtgccccggccctgcccagagggccctgtacagaggagccacccagaggaaggacagccacgtgtccctggccactggagccctgggcctgtag

SEQ ID NO: 17896 - DNA, 648 bp, Artificial Sequence
  Description of Artificial Sequence: Synthetic coding sequence
atgagggacaacagagctgtgtccctgtgccagcaggagtggatgtgccccggccctgcccagagggccctgtacagaggagccacccagaggaaggacagccacgtgtccctggccaccggggtgccctggggctatgaggagaccaagaccctgctggccatcctgagcagcagccagttctacggcaagctgcagacctgccagcagaacagccagatctaccgggccatggccgagggcctgtgggagcagggcttcctgcggaccccagagcagtgcaggaccaagttcaagagcctgcagctgagctacaggaaggtgagaagaggccgggtgcctgagccctgcatcttctatgaggagatgaatgccctgagcggctcctgggccagcgccccacccatggccagtgatgctgtgcccggccaggagggcagtgacattgaagctggggagctgaaccaccagaatggagagcccacagaggtggaggatggcaccgtggatggagctgacagagatgagaaggacttcaggaaccctggccaggaggtgaggaagctggacctgcctgtgctcttccccaaccggctgggcaagacccccctggccctgatggtgaagggctggcagagccccctgtag

SEQ ID NO: 17897 - DNA, 1227 bp, Artificial Sequence
  Description of Artificial Sequence: Synthetic coding sequence
atggccgagggcctgtgggagcagggcttcctgcggaccccagagcagtgcaggaccaagttcaagagcctgcagctgagctacaggaaggtgcggcggggccgggtgcctgagccctgcatcttctatgaggagatgaatgccctgagcggctcctgggccagcgccccacccatggccagtgatgctgtgcccggccaggagggcagtgacatcgaggccggggagctgaaccaccagaatggagagcccacagaggtggaggatggcaccgtggatggagctgacagagatgagaaggacttcagaaatcctggccaggaggtgaggaagctggacctgcctgtgctcttccccaaccggctgggctttgagttcaagaatgagatcaagaaggagaacctgaagtgggatgacagcgaggaggtggagatcaacaaggccctgcagaggaagagcagaggagtgtactggcacagcgagctgcagaagggcctggagagcgagcccaccagccggcggcagtgcaggaacagccctggagagagcgaggagaagacccccagccaggagaagatgagccaccagagcttctgtgcccgggacaaggcctgcacccacatcctgtgtgggaagaactgcagccagagcgtgcacagcccccacaagccagccctgaagctggagaaggtgtcccagtgcccagaatgtgggaagaccttcagccgcagcagctacctggtgcgccaccagaggatccacactggagagaagccccacaagtgcagtgaatgtgggaagggcttcagcgagaggagcaacctgacagcccacctgcggacccacactggagagcggccctaccagtgtggccagtgtgggaagagcttcaaccagagcagcagcctcatcgtgcaccagaggacccacactggagagaagccctaccagtgcatcgtgtgtgggaagcgcttcaacaacagcagccagttcagcgcccaccggcgcatccacactggagagagcccctacaagtgtgctgtgtgtgggaagatcttcaacaacagcagccacttcagcgcccacaggaagacccacactggagagaagccctaccgctgcagccactgtgagcggggcttcaccaagaacagcgccctgaccaggcaccagacagtgcacatgaaggctgtgctgagcagccaggagggcagagatgccctgtag

SEQ ID NO: 17898 - DNA, 2457 bp, Artificial Sequence
  Description of Artificial Sequence: Synthetic coding sequence
atggattctgagagcaacatccccagcggcaccatccagagcaggaagggcctgcagaacaagagccagttccgcaccatcgcccccaagatcgtgcccaaggtgctgaccagcaggatgctgccctgccacagccccagcagaagtgaccaggtgaacctgggccccagcatcaacagcaagctgctgggcatgagcacccagaactatgccctgatgcaggtggccggccaggagggcaccttcagcctggtggccctgccccacgtggccagcgcccagcccatccagaagcccaggatgagcctgcctgagaacctgaagctgcccatcccccgctaccagccccccaggaacagcaaggccagcaggaagaagcccatcctgatcttccccaagagcggctgcagcaaggccccagcccagacccagatgtgcccccagatgagccccagccccccccaccaccctgagctgctgtacaagcccagcccctttgaggaggtgcccagcctggagcaggccccagccagcatcagcacagctgccctgaccaacggcagtgaccacggggacctgcggccccctgtgaccaacacccacggcagcctgaaccccccagccaccccagccagcagcaccccagaggagcccgccaagcaggacctgacagccctgagcggcaaggcccactttgtgtccaagatcaccagcagcaagcccagcgctgtggccagcgagaagttcaaggagcaggtggacctggccaagaccatgaccaacctgagccccaccatcctgggcaatgctgtgcagctgatcagctctgtgcccaagggcaagctgcccatccccccctacagcaggatgaagaccatggaggtgtacaagatcaagagtgatgccaacattgctggcttcagcctgcccggccccaaggctgactgtgacaagatccccagcaccacagagggcttcaatgctgccaccaaggtggccagccggctgcctgtgccccaggtgtcccagcagagcgcctgtgagagcgccttctgcccccccaccaagctggacctgaaccacaagaccaagctgaacagcggggccgccaagaggaaaggaaggaagaggaaggtgcctgatgagatcctggccttccagggcaagaggaggaagtacatcatcaacaagtgcagagatggcaaggagcgggtgaagaatgacccccaggagttccgggaccagaagctgggcaccctgaagaagtaccgcagcatcatgcccaagcccatcatggtgatccccaccctggccagcctggccagccccaccaccctgcagagccagatgctgggcggcctgggccaggatgtgctgctgaacaacagcctgacccccaagtacctgggctgcaagcaggacaacagcagcagccccaagcccagctctgtgttcagaaatggcttcagcggcatcaagaagccctggcaccgctgccacgtgtgcaaccaccacttccagttcaagcagcacctgcgggaccacatgaacacccacaccaacagaagaccctacagctgccgcatctgcaggaagagctatgtgcggcccggcagcctgagcacccacatgaagctgcaccacggggagaaccggctgaagaagctgatgtgctgtgagttctgtgccaaggtgtttggccacatccgggtgtacttcggccacctgaaggaggtgcaccgggtggtgatcagcacagagcccgcccccagcgagctgcagcccggggacatccccaagaacagagacatgtctgtgcggggcatggagggcagcctggagcgggagaacaagagcaacctggaggaggacttcctgctgaaccaggctgatgaggtgaagctgcagatcaagtgtggccgctgccagatcacagcccagagctttgctgagatcaagttccacctgctggatgtgcacggggaggagattgagggccgcctgcaggagggcaccttccctggcagcaagggcacccaggaggagctggtgcagcacgccagcccagactggaagaggcaccctgagcggggcaagccagagaaggtgcacagcagcagcgaggagagccacgcctgcccccggctgaagaggcagctgcacctgcaccagaatggagtggagatgctgatggagaatgaaggcccccagagcggcaccaacaagccccgggagacctgccagggcccagaatgtcctggcctgcacaccttcctgctgtggagccacagcggcttcaactgcctgctgtgtgccgagatgctgggcaggaaagaagacctgctgcaccactggaagcaccagcacaactgtgaggaccccagcaagctgtgggccatcctgaacacagtgagcaaccagggcgtcatcgagctgagcagcgaggccgagaagtag

SEQ ID NO: 17899 - DNA, 2487 bp, Artificial Sequence
  Description of Artificial Sequence: Synthetic coding sequence
atgcagaacagcgtgtctgtgccccccaaggatgaaggagagagcaacatccccagcggcaccatccagagcaggaagggcctgcagaacaagagccagttccgcaccatcgcccccaagatcgtgcccaaggtgctgaccagcaggatgctgccctgccacagccccagcagaagtgaccaggtgaacctgggccccagcatcaacagcaagctgctgggcatgagcacccagaactatgccctgatgcaggtggccggccaggagggcaccttcagcctggtggccctgccccacgtggccagcgcccagcccatccagaagcccaggatgagcctgcctgagaacctgaagctgcccatcccccgctaccagccccccaggaacagcaaggccagcaggaagaagcccatcctgatcttccccaagagcggctgcagcaaggccccagcccagacccagatgtgcccccagatgagccccagccccccccaccaccctgagctgctgtacaagcccagcccctttgaggaggtgcccagcctggagcaggccccagccagcatcagcacagctgccctgaccaacggcagtgaccacggggacctgcggccccctgtgaccaacacccacggcagcctgaaccccccagccaccccagccagcagcaccccagaggagcccgccaagcaggacctgacagccctgagcggcaaggcccactttgtgtccaagatcaccagcagcaagcccagcgctgtggccagcgagaagttcaaggagcaggtggacctggccaagaccatgaccaacctgagccccaccatcctgggcaatgctgtgcagctgatcagctctgtgcccaagggcaagctgcccatccccccctacagcaggatgaagaccatggaggtgtacaagatcaagagtgatgccaacattgctggcttcagcctgcccggccccaaggctgactgtgacaagatccccagcaccacagagggcttcaatgctgccaccaaggtggccagccggctgcctgtgccccaggtgtcccagcagagcgcctgtgagagcgccttctgcccccccaccaagctggacctgaaccacaagaccaagctgaacagcggggccgccaagaggaaaggaaggaagaggaaggtgcctgatgagatcctggccttccagggcaagaggaggaagtacatcatcaacaagtgcagagatggcaaggagcgggtgaagaatgacccccaggagttccgggaccagaagctgggcaccctgaagaagtaccgcagcatcatgcccaagcccatcatggtgatccccaccctggccagcctggccagccccaccaccctgcagagccagatgctgggcggcctgggccaggatgtgctgctgaacaacagcctgacccccaagtacctgggctgcaagcaggacaacagcagcagccccaagcccagctctgtgttcagaaatggcttcagcggcatcaagaagccctggcaccgctgccacgtgtgcaaccaccacttccagttcaagcagcacctgcgggaccacatgaacacccacaccaacagaagaccctacagctgccgcatctgcaggaagagctatgtgcggcccggcagcctgagcacccacatgaagctgcaccacggggagaaccggctgaagaagctgatgtgctgtgagttctgtgccaaggtgtttggccacatccgggtgtacttcggccacctgaaggaggtgcaccgggtggtgatcagcacagagcccgcccccagcgagctgcagcccggggacatccccaagaacagagacatgtctgtgcggggcatggagggcagcctggagcgggagaacaagagcaacctggaggaggacttcctgctgaaccaggctgatgaggtgaagctgcagatcaagtgtggccgctgccagatcacagcccagagctttgctgagatcaagttccacctgctggatgtgcacggggaggagattgagggccgcctgcaggagggcaccttccctggcagcaagggcacccaggaggagctggtgcagcacgccagcccagactggaagaggcaccctgagcggggcaagccagagaaggtgcacagcagcagcgaggagagccacgcctgcccccggctgaagaggcagctgcacctgcaccagaatggagtggagatgctgatggagaatgaaggcccccagagcggcaccaacaagccccgggagacctgccagggcccagaatgtcctggcctgcacaccttcctgctgtggagccacagcggcttcaactgcctgctgtgtgccgagatgctgggcaggaaagaagacctgctgcaccactggaagcaccagcacaactgtgaggaccccagcaagctgtgggccatcctgaacacagtgagcaaccagggcgtcatcgagctgagcagcgaggccgagaagtag

SEQ ID NO: 17900 - DNA, 1179 bp, Artificial Sequence
  Description of Artificial Sequence: Synthetic coding sequence
atgcccaagcccatcatggtgatccccaccctggccagcctggccagccccaccaccctgcagagccagatgctgggcggcctgggccaggatgtgctgctgaacaacagcctgacccccaagtacctgggctgcaagcaggacaacagcagcagccccaagcccagctctgtgttcagaaatggcttcagcggcatcaagaagccctggcaccgctgccacgtgtgcaaccaccacttccagttcaagcagcacctgcgggaccacatgaacacccacaccaacagaagaccctacagctgccgcatctgcaggaagagctatgtgcggcccggcagcctgagcacccacatgaagctgcaccacggggagaaccggctgaagaagctgatgtgctgtgagttctgtgccaaggtgtttggccacatccgggtgtacttcggccacctgaaggaggtgcaccgggtggtgatcagcacagagcccgcccccagcgagctgcagcccggggacatccccaagaacagagacatgtctgtgcggggcatggagggcagcctggagcgggagaacaagagcaacctggaggaggacttcctgctgaaccaggctgatgaggtgaagctgcagatcaagtgtggccgctgccagatcacagcccagagctttgctgagatcaagttccacctgctggatgtgcacggggaggagattgagggccgcctgcaggagggcaccttccctggcagcaagggcacccaggaggagctggtgcagcacgccagcccagactggaagaggcaccctgagcggggcaagccagagaaggtgcacagcagcagcgaggagagccacgcctgcccccggctgaagaggcagctgcacctgcaccagaatggagtggagatgctgatggagaatgaaggcccccagagcggcaccaacaagccccgggagacctgccagggcccagaatgtcctggcctgcacaccttcctgctgtggagccacagcggcttcaactgcctgctgtgtgccgagatgctgggcaggaaagaagacctgctgcaccactggaagcaccagcacaactgtgaggaccccagcaagctgtgggccatcctgaacacagtgagcaaccagggcgtcatcgagctgagcagcgaggccgagaagtag

SEQ ID NO: 17901 - DNA, 2487 bp, Artificial Sequence; identical to SEQ ID NO: 17899
  Description of Artificial Sequence: Synthetic coding sequence

SEQ ID NO: 17902 - DNA, 1644 bp, Artificial Sequence
  Description of Artificial Sequence: Synthetic coding sequence
atgcagaacagcgtgtctgtgccccccaaggatgaaggagagagcaacatccccagcggcaccatccagagcaggaagggcctgcagaacaagagccagttccgcaccatcgcccccaagatcgtgcccaaggtgctgaccagcaggatgctgccctgccacagccccagcagaagtgaccaggacctgcggcccaccgtcatccgctaccccccaccccagaaggccctgatgcagcccccacgctggcaggccggctacctgttccacaagaccaagctgaacagcggggccgccaagaggaagggcaggaagaggaaggtgcctgatgagatcctggccttccagggcaagaggaggaagtacatcatcaacaagtgcagagatggcaaggagcgggtgaagaatgacccccaggagttccgggaccagaagctgggcaccctgaagaagtaccgcagcatcatgcccaagcccatcatggtgatccccaccctggccagcctggccagccccaccaccctgcagagccagatgctgggcggcctgggccaggatgtgctgctgaacaacagcctgacccccaagtacctgggctgcaagcaggacaacagcagcagccccaagcccagcagcgtcttcagaaatggcttcagcggcatcaagaagccctggcaccgctgccacgtgtgcaaccaccacttccagttcaagcagcacctgcgggaccacatgaacacccacaccaacagaagaccctacagctgccgcatctgcaggaagagctatgtgcggcccggcagcctgagcacccacatgaagctgcaccacggagaaaatcggctgaagaagctgatgtgctgtgagttctgtgccaaggtgtttggccacatccgggtgtacttcggccacctgaaggaggtgcaccgggtggtgatcagcacagagcccgcccccagcgagctgcagcccggggacatccccaagaacagagacatgtctgtgcggggcatggagggcagcctggagcgggagaacaagagcaacctggaggaggacttcctgctgaaccaggctgatgaggtgaagctgcagatcaagtgtggccgctgccagatcacagcccagagctttgctgagatcaagttccacctgctggatgtgcatggagaggagattgagggccgcctgcaggagggcaccttccctggcagcaagggcacccaggaggagctggtgcagcacgccagcccagactggaagaggcaccctgagcggggcaagccagagaaggtgcacagcagcagcgaggagagccacgcctgcccccggctgaagaggcagctgcacctgcaccagaatggagtggagatgctgatggagaatgaaggcccccagagcggcaccaacaagccccgggagacctgccagggccctgagtgccccggcctgcacaccttcctgctgtggagccacagcggcttcaactgcctgctgtgtgccgagatgctgggcaggaaggaggacctgctgcaccactggaagcaccagcacaactgtgaggaccccagcaagctgtgggccatcctgaacacagtgagcaaccagggcgtgattgagctgagcagcgaggccgagaagtag

SEQ ID NO: 17903 - DNA, 2487 bp, Artificial Sequence; identical to SEQ ID NO: 17899
  Description of Artificial Sequence: Synthetic coding sequence

SEQ ID NO: 17904 - DNA, 2487 bp, Artificial Sequence; identical to SEQ ID NO: 17899
  Description of Artificial Sequence: Synthetic coding sequence

SEQ ID NO: 17905 - DNA, 2457 bp, Artificial Sequence; identical to SEQ ID NO: 17898
  Description of Artificial Sequence: Synthetic coding sequence

SEQ ID NO: 17906 - DNA, 2457 bp, Artificial Sequence; identical to SEQ ID NO: 17898
  Description of Artificial Sequence: Synthetic coding sequence

SEQ ID NO: 17907 - DNA, 2340 bp, Artificial Sequence
  Description of Artificial Sequence: Synthetic coding sequence
atgctgccctgccacagccccagcagaagtgaccaggtgaacctgggccccagcatcaacagcaagctgctgggcatgagcacccagaactatgccctgatgcaggtggccggccaggagggcaccttcagcctggtggccctgccccacgtggccagcgcccagcccatccagaagcccaggatgagcctgcctgagaacctgaagctgcccatcccccgctaccagcccccaagaaacagcaaggccagcaggaagaagcccatcctgatcttccccaagagcggctgcagcaaggccccagcccagacccagatgtgcccccagatgagccccagccccccccaccaccctgagctgctgtacaagcccagcccctttgaggaggtgcccagcctggagcaggccccagccagcatcagcacagctgccctgaccaatggaagtgaccatggagacctgcggccccctgtgaccaacacccacggcagcctgaaccccccagccaccccagccagcagcaccccagaggagcccgccaagcaggacctgacagccctgagcggcaaggcccactttgtgtccaagatcaccagcagcaagcccagcgctgtggccagcgagaagttcaaggagcaggtggacctggccaagaccatgaccaacctgagccccaccatcctgggcaatgctgtgcagctgatcagctctgtgcccaagggcaagctgcccatccccccctacagcaggatgaagaccatggaggtgtacaagatcaagagtgatgccaacattgctggcttcagcctgcccggccccaaggctgactgtgacaagatccccagcaccacagagggcttcaatgctgccaccaaggtggccagccggctgcctgtgccccaggtgtcccagcagagcgcctgtgagagcgccttctgcccccccaccaagctggacctgaaccacaagaccaagctgaacagcggggccgccaagaggaagggcaggaagaggaaggtgcctgatgagatcctggccttccagggcaagaggaggaagtacatcatcaacaagtgcagagatggcaaggagcgggtgaagaatgacccccaggagttccgggaccagaagctgggcaccctgaagaagtaccgcagcatcatgcccaagcccatcatggtgatccccaccctggccagcctggccagccccaccaccctgcagagccagatgctgggcggcctgggccaggatgtgctgctgaacaacagcctgacccccaagtacctgggctgcaagcaggacaacagcagcagccccaagcccagcagcgtcttcagaaatggcttcagcggcatcaagaagccctggcaccgctgccacgtgtgcaaccaccacttccagttcaagcagcacctgcgggaccacatgaacacccacaccaacagaagaccctacagctgccgcatctgcaggaagagctatgtgcggcccggcagcctgagcacccacatgaagctgcaccacggagaaaatcggctgaagaagctgatgtgctgtgagttctgtgccaaggtgtttggccacatccgggtgtacttcggccacctgaaggaggtgcaccgggtggtgatcagcacagagcccgcccccagcgagctgcagcccggggacatccccaagaacagagacatgtctgtgcggggcatggagggcagcctggagcgggagaacaagagcaacctggaggaggacttcctgctgaaccaggctgatgaggtgaagctgcagatcaagtgtggccgctgccagatcacagcccagagctttgctgagatcaagttccacctgctggatgtgcatggagaggagattgagggccgcctgcaggagggcaccttccctggcagcaagggcacccaggaggagctggtgcagcacgccagcccagactggaagaggcaccctgagcggggcaagccagagaaggtgcacagcagcagcgaggagagccacgcctgcccccggctgaagaggcagctgcacctgcaccagaatggagtggagatgctgatggagaatgaaggcccccagagcggcaccaacaagccccgggagacctgccagggccctgagtgccccggcctgcacaccttcctgctgtggagccacagcggcttcaactgcctgctgtgtgccgagatgctgggcaggaaggaggacctgctgcaccactggaagcaccagcacaactgtgaggaccccagcaagctgtgggccatcctgaacacagtgagcaaccagggcgtgattgagctgagcagcgaggccgagaagtag

SEQ ID NO: 17908 - DNA, 1500 bp, Artificial Sequence
  Description of Artificial Sequence: Synthetic coding sequence
atgctgagcctgagccccatcctgctgtacacctgtgagatgttccaggaccctgtggccttcaaggatgtggccgtgaacttcacccaggaggagtgggccctgctggacatcagccagaagaacctgtaccgggaggtgatgctggagaccttctggaacctgaccagcatcggcaagaagtggaaggaccagaacattgaatatgagtaccagaaccccaggaggaacttccgctctgtgacagaggagaaggtgaatgagatcaaggaggacagccactgtggggagaccttcacccctgtgcctgatgaccggctgaacttccagaagaagaaggccagccctgaggtgaagagctgtgacagctttgtgtgtgaggtgggcctgggcaacagcagcagcaacatgaacatccggggggacaccggccacaaggcctgtgagtgccaggagtatggccccaagccctggaagagccagcagcccaagaaggccttccgctaccaccccagcctgcggacccaggagcgggaccacacaggcaagaagccctatgcctgcaaggaatgtgggaagaacatcatctaccacagcagcatccagaggcacatggtggtgcacagcggagatggcccctacaagtgcaagttctgtgggaaggccttccactgcctgagcctgtacctgatccacgagaggacccacactggagagaagccctatgagtgcaagcagtgtgggaagagcttctcctacagcgccacccaccgcatccacgagaggacccacatcggggagaagccctatgagtgccaggagtgtgggaaggccttccacagccccaggagctgccacagacatgagaggagccacatgggagagaaggcctaccagtgcaaggaatgtgggaaggccttcatgtgcccccgctacgtgagaagacatgagaggacccacagcaggaagaagctgtatgagtgcaagcagtgtgggaaggccctgagcagcctgaccagcttccagacccacatccgcatgcacagcggggagcggccctatgagtgcaagacctgtgggaagggcttctacagcgccaagagcttccagagacatgagaagacccacagcggggagaagccctacaagtgcaagcagtgtgggaaggccttcaccaggagcggcagcttccgctaccacgagaggacccacactggagagaagccctatgagtgcaagcagtgtgggaaggccttccgcagcgcccccaacctgcagctgcacggccgcacccacactggagagaagccctaccagtgcaaggaatgtgggaaggccttccgcagcgccagccagctgcgcatccaccggcgcatccacactggagagaagccctatgagtgcaagaagtgtgggaaggccttccgctacgtgcagaacttccgcttccacgagaggacccagacccacaagaatgccctgtggaggaagaccctgtag

SEQ ID NO: 17909 - DNA, 1788 bp, Artificial Sequence
  Description of Artificial Sequence: Synthetic coding sequence
atggaccctgtggccttcaaggatgtggccgtgaacttcacccaggaggagtgggccctgctggacatcagccagaggaagctgtaccgggaggtgatgctggagaccttcaggaacctgaccagcctgggcaagcgctggaaggaccagaacatcgagtatgagcaccagaaccccaggaggaacttccgcagcctgattgaggagaaggtgaatgagatcaaggatgacagccactgtggggagaccttcacccctgtgcctgatgaccggctgaacttccaggagaagaaggccagccctgaggtgaagagctgtgagagctttgtgtgtggggaggtgggcctgggcaacagcagcttcaacatgaacatccggggggacatcggccacaaggcctatgagtaccaggagtatggccccaagccctgcaagtgccagcagcccaagaaggccttccgctaccggcccagcttccgcacccaggagcgggaccacactggagagaagcccaatgcctgcaaggtgtgtgggaagaccttcatcagccacagctctgtgcggcggcacatggtgatgcacagcggagatggcccctacaagtgcaagttctgtgggaaggccttccactgcctgcggctgtacctgatccacgagcgcatccacactggagagaagccctgtgagtgcaagcagtgtgggaagagcttctcctacagcgccacccaccgcatccacaagaggacccacactggagagaagccctatgagtaccaggagtgtgggaaggccttccacagccccaggagctacagaagacatgagcgcatccacatgggagagaaggcctaccagtgcaaggaatgtgggaaggccttcacctgcccccgctacgtgcgcatccacgagaggacccacagcaggaagaacctgtatgagtgcaagcagtgtgggaaggccctgagcagcctgaccagcttccagacccacgtgcggctgcacagcggggagcggccctatgagtgcaagatctgtgggaaggacttctgcagcgtgaacagcttccagagacatgagaagatccacagcggggagaagccctacaagtgcaagcagtgtgggaaggccttcccccacagcagcagcctgcgctaccacgagaggacccacactggagagaagccctatgagtgcaagcagtgtgggaaggccttccgcagcgccagccacctgcgggtgcacggccgcacccacactggagagaagccctatgagtgcaaggaatgtgggaaggccttccgctacgtgaacaacctgcagagccatgagaggacccagacccacatccgcatccacagcggggagcggcgctacaagtgcaagatctgtgggaagggcttctactgccccaagagcttccagagacatgagaagacccacactggagagaagctgtatgagtgcaagcagaggtctgtggtgcccagcgtggtgcctgtgccctttgacatcatgaagggcctgaccctggagaggagccccatcaatgccagcaatgtgggcaagcccagcgagctgtgccagagctttgagtgcatggtgggcctgaccctgaagaggaaccccatgtctgtgtccaatgatggcaagcccagcgacctgccccacacctttgaatatgtggtgggccacaccatggagaggagccccatgcacgtgagaaatgtgggcaaccccagcgacctgcccaggacctttgagttcatgaagggccacaagcacacctag

SEQ ID NO: 17910 - DNA, 2082 bp, Artificial Sequence
  Description of Artificial Sequence: Synthetic coding sequence
atggattctgtggcctttgaagatgtggccatcaacttcacctgtgaggagtgggccctgctgggccccagccagaagagcctgtacagagatgtgatgcaggagaccatccggaacctggactgcatcggcatgatctggcagaaccacgacatcgaggaggaccagtacaaggacctgcggaggaacctgcgctgccacatggtggagcgggcctgtgagatcaaggacaacagccagtgtggcggccccttcacccagacccaggacagcatcgtgaatgagaagatccctggggtggacccctgggagagcagtgaatgtacagatgtgctgatgggccgcagcagcctgaactgctacgtgcgggtggacagcgagcacaagccctgtgagtaccaggagtatggagagaagccctacacccacacccagtgtggcacagccttctcctaccagccctgcttccagatccacgagcggccccagcacggcaagaagctgtatgactgcaaggaatgtgccagcttcagcagcctggagaacctgcagaggcacatggccgcccaccacggagatggcccccgcatctgcaagctgtgtggaaatgccttcatctggcccagcctcttccacatgctgcggaggacccacacagaggagaagccctatgaatatgagcagtgcagcacagccttccctgcctacagcagcaccctgcggcatgagaggacccacagcggggagaagccctaccagtgcaagcagtgtgggaaggccttcagctgcagctgctacacccagctgtatgaaagaacccacactggagagcagagctatgagtgcaagcagtgtgggaaggccttctaccacctgggcagcttccagaggcacatgattgtgcacactggagatggcccccacaagtgcaagatctgtgggaagggcttcctgagccccagctctgtgcggcggcacaagaggacccacactggagagaagccctatgagtgcaagtactgcggcaaggccttcagtgactgcaccggcttccgccgccacatgatcacccacactggagatggcccccacaagtgcaaggtgtgtgggaaggcctttgacagccccagcctgtgcagaagacatgagaccacccacactggagagaagccctacaagtgtgaatgtgggaaggccttcagtgacttctactacttcagaaatcatgagaccacccacactggagagaagccctacaagtgcaagcagtgtgggaaggccttcatctgctgcacctacctgcagatccacgagcgcatccacactggagagcggccctacaagtgcaagcagtgtgggaaggccttccgcagcagcaactacatccgggtgcatgagaagacccacactggagagaagccctatgagtgcaagcagtgtgggaaggccctgagccacctgaagagcttccagaggcacatgatcatgcacactggagatggcccccacaagtgcaagatctgtgggaagagctttgacagccccagcagcttcagaagacatgagcgcatccacactggagagcggccctacaagtgcaagctgtgtgggaagggcttccgcagcagcagctacatccagctgcacgagaggacccacactggagagaagccctacggctgccagcagtgtgggaaggccctgagtgacctgagcagcttcagaagacacatgatcacccacactggaaatggcccccacaagtgcaagatctgtgggaagggctttgactaccccagctctgtgcagagacatgagaggacccacactggagagaagccctatgagtgcaaggaatgtgggaaggccttcagccacagcagctacctgcgcatccacgagcgggtgcacactggagagaagccctacaagtgcaaggaatgtgggaagcccttccactgccccagcgccttccacaagcatgagaggacccacagcatggagaagccctacaagtgcaaggaatgtggggaggccttccactgcatcagcagcttccacaagcatgagatgacccactag

SEQ ID NO: 17911 - DNA, 1881 bp, Artificial Sequence
  Description of Artificial Sequence: Synthetic coding sequence
atggtggagcgggcctgtgagatcaaggacaacagccagtgtggcggccccttcacccagacccaggacagcatcgtgaatgagaagatccctggggtggacccctgggagagcagcgagtgcacagatgtgctgatgggccgcagcagcctgaactgctacgtgcgggtggacagcgagcacaagccctgtgagtaccaggagtatggagagaagccctacacccacacccagtgtggcacagccttctcctaccagccctgcttccagatccacgagcggccccagcacggcaagaagctgtatgactgcaaggaatgtgccagcttcagcagcctggagaacctgcagaggcacatggccgcccaccacggagatggcccccgcatctgcaagctgtgtggaaatgccttcatctggcccagcctcttccacatgctgcggaggacccacacagaggagaagccctatgaatatgagcagtgcagcacagccttccctgcctacagcagcaccctgcggcatgagaggacccacagcggggagaagccctaccagtgcaagcagtgtgggaaggccttcagctgcagctgctacacccagctgtatgaaagaacccacactggagagcagagctatgagtgcaagcagtgtgggaaggccttctaccacctgggcagcttccagaggcacatgattgtgcacactggagatggcccccacaagtgcaagatctgtgggaagggcttcctgagccccagctctgtgagaagacacaagaggacccacactggagagaagccctatgagtgcaagtactgtgggaaggccttcagtgactgcaccggcttcagaagacacatgatcacccacactggagatggcccccacaagtgcaaggtgtgtgggaaggcctttgacagccccagcctgtgcagaagacatgagaccacccacactggagagaagccctacaagtgtgaatgtgggaaggccttcagtgacttctactacttcaggaaccacgagaccacccacactggagagaagccctacaagtgcaagcagtgtgggaaggccttcatctgctgcacctacctgcagatccacgagcgcatccacactggagagcggccctacaagtgcaagcagtgtgggaaggccttccgcagcagcaactacatccgggtgcatgagaagacccacactggagagaagccctatgagtgcaagcagtgtgggaaggccctgagccacctgaagagcttccagaggcacatgatcatgcacactggagatggcccccacaagtgcaagatctgtgggaagagctttgacagccccagcagcttcagaagacatgagcgcatccacactggagagcggccctacaagtgcaagctgtgtgggaagggcttccgcagcagcagctacatccagctgcacgagaggacccacactggagagaagccctacggctgccagcagtgtgggaaggccctgagtgacctgagcagcttccgccgccacatgatcacccacactggaaatggcccccacaagtgcaagatctgtgggaaaggatttgactaccccagctctgtgcagagacatgagaggacccacactggagagaagccctatgagtgcaaggaatgtgggaaggccttcagccacagcagctacctgcgcatccacgagcgggtgcacactggagagaagccctacaagtgcaaggaatgtgggaagcccttccactgccccagcgccttccacaagcatgagaggacccacagcatggagaagccctacaagtgcaaggaatgtggggaggccttccactgcatcagcagcttccacaagcatgagatgacccactag

SEQ ID NO: 17912 - DNA, 1884 bp, Artificial Sequence
  Description of Artificial Sequence: Synthetic coding sequence
atgattgtgtttggaggagaagatagaagtgacctcttcctgcctgacagccagaccaatgaggagaggaagcagtatgacagcgtggcctttgaagatgtggccgtgaacttcacccaggaggagtgggccctgctgggccccagccagaagagcctgtacagagatgtgatgtgggagaccatccggaacctggactgcatcggcatgaagtgggaggacaccaacatcgaggaccagcacaggaaccccaggaggagcctgcgctgccacatcatcgagcgcttcagcgagagccggcagcctgacagcacagtgaatgagaagcccccaggagtggacccctgcaagagctctgtgtgtggggagatcatgggctgcagcttcctgaactgctacatcacctttgatgctggccacaagccagatgagtgccaggagtatggagagaagccccacacccacaagcagtgtggcacagccttcaactaccaccacagcttccagacccaggagcggccccacacaggcaagaagagatatgactgcaaggaatgtgggaagaccttcagcagcagcggcaacctgcggcggcacatcatcgtgcagagaggaggcggcccctacatctgcaagctgtgtgggaaggccttcttctggcccagcctcttcaggatgcatgagaggacccacactggagagaagccctatgagtgcaagcagtgctgcaaggccttccccatctacagcagctacctgcggcatgagaggacccacactggagagaagccctatgagtgcaagcactgcagcaaggccttcccagactacagcagctatgtgagacatgagaggacccacactggagagaagccctacaagtgcaagagatgtggccgggccttctctgtgagcagcagcctgcgcatccacgagaggacccacactggagagaagccctatgagtgcaagcagtgtgggaaggccttccaccacctgggcagcttccagaggcacatgatccgccacactggagatggcccccacaagtgcaagatctgtgggaagggctttgactgccccagcagcctgcagagccatgagaggacccacactggagagaagccctatgagtgcaagcagtgtgggaaggccctgagccaccacagcagcttccgcagccacatgatcatgcacactggagatggcccccacaagtgcaaggtgtgtgggaaggccttcatctaccccagcgtcttccagggccacgagaggacccacactggagagaagccctatgagtgcaaggaatgtgggaaggccttccgcatcagcagcagcctgcggagacatgagaccacccacactggagagaagccctacaagtgcaagtgtgggaaggccttcatcgacttctacagcttccagaaccacgagaccacccacactggagagaagccctatgagtgcaaggaatgtgggaaggccttcagctgcttcacctacctgagccagcacaggaggacccacatggccgagaagccctatgagtgcaagacctgcaagaaggccttcagccacttcggcaacctgaaggtgcatgagcgcatccacactggagagaagccctatgagtgcaaggagtgcaggaaggccttctcctggctgacctgcctgctgcggcatgagcgcatccacacaggcaagaagagctatgagtgccagcagtgtgggaaggccttcaccaggagccgcttcctgcggggccacgagaagacccacactggagagaagatgcatgagtgcaaggaatgtgggaaggccctgagcagcctgagcagcctgcaccgccacaagaggacccactggagggacaccctgtag

SEQ ID NO: 17913 - DNA, 1677 bp, Artificial Sequence
  Description of Artificial Sequence: Synthetic coding sequence
atgaagtgggaggacaccaacatcgaggaccagcacaggaacccccggcgcagcctgcgctgccacatcatcgagcgcttcagcgagagccggcagcctgacagcacagtgaatgagaagcccccaggagtggacccctgcaagagctctgtgtgtggggagatcatgggctgcagcttcctgaactgctacatcacctttgatgctggccacaagccagatgagtgccaggagtatggagagaagccccacacccacaagcagtgtggcacagccttcaactaccaccacagcttccagacccaggagcggccccacacaggcaagaagagatatgactgcaaggaatgtgggaagaccttcagcagcagcggcaacctgcggcggcacatcatcgtgcagaggggcggcggcccctacatctgcaagctgtgtgggaaggccttcttctggcccagcctcttcaggatgcatgagaggacccacactggagagaagccctatgagtgcaagcagtgctgcaaggccttccccatctacagcagctacctgcggcatgagaggacccacactggagagaagccctatgagtgcaagcactgcagcaaggccttcccagactacagcagctatgtgagacatgagaggacccacactggagagaagccctacaagtgcaagagatgtggccgggccttctctgtgagcagcagcctgcgcatccacgagaggacccacactggagagaagccctatgagtgcaagcagtgtgggaaggccttccaccacctgggcagcttccagaggcacatgatccgccacactggagatggcccccacaagtgcaagatctgtgggaaaggatttgactgccccagcagcctgcagagccatgagaggacccacactggagagaagccctatgagtgcaagcagtgtgggaaggccctgagccaccacagcagcttccgcagccacatgatcatgcacactggagatggcccccacaagtgcaaggtgtgtgggaaggccttcatctaccccagcgtcttccagggccacgagaggacccacactggagagaagccctatgagtgcaaggaatgtgggaaggccttccgcatcagcagcagcctgcggagacatgagaccacccacactggagagaagccctacaagtgcaagtgtgggaaggccttcatcgacttctacagcttccagaaccacgagaccacccacactggagagaagccctatgagtgcaaggaatgtgggaaggccttcagctgcttcacctacctgagccagcacaggaggacccacatggccgagaagccctatgagtgcaagacctgcaagaaggccttcagccactttggaaacctgaaggtgcatgagcgcatccacactggagagaagccctatgagtgcaaggaatgtaggaaggccttctcctggctgacctgcctgctgcggcatgagcgcatccacacaggcaagaagagctatgagtgccagcagtgtgggaaggccttcaccaggagccgcttcctgcggggccacgagaagacccacactggagagaagatgcatgagtgcaaggaatgtgggaaggccctgagcagcctgagcagcctgcaccgccacaagaggacccactggagggacaccctgtag

SEQ ID NO: 17914 - DNA, 2016 bp, Artificial Sequence
  Description of Artificial Sequence: Synthetic coding sequence
atggcctctgtggccctggaggatgtggccgtgaacttcacccgggaggagtgggccctgctgggcccctgccagaagaacctgtacaaggatgtgatgcaggagaccatccggaacctggactgtgtggtgatgaagtggaaggaccagaacatcgaggaccagtaccgctaccccaggaagaacctgcgctgcaggatgctggagagatttgtggagagcaaggatggcacccagtgtggggagaccagcagccagatccaggacagcatcgtgaccaagaacaccctgcccggggtgggcccctgtgagagctccatgagaggagagaaggtgatgggccacagcagcctgaactgctacatccgggtgggcgccggccacaagccccatgagtaccatgaatgtggggagaagccagacacccacaagcagaggggcaaggccttctcctaccacaacagcttccagacccatgagcggctgcacacaggcaagaagccctatgactgcaaggaatgtgggaagagcttcagcagcctgggcaacctgcagaggcacatggctgtgcagagaggagatggcccctacaagtgcaagctgtgtgggaaggccttcttctggcccagcctgctgcacatgcatgagaggacccacactggagagaagccctatgagtgcaagcagtgcagcaaggccttctccttctacagcagctacctgcggcatgagaggacccacactggagagaagccctatgagtgcaagcagtgcagcaaggccttccccttctacagcagctacctgcggcatgagaggacccacactggagagaagccctacaagtgcaagcagtgcagcaaggccttcccagacagcagcagctgcctgattcatgagaggacccacactggagagaagccctacacctgcaagcagtgtgggaaggccttctctgtgtctggcagcctgcagagacatgagaccacccacagcgctgagaagccctatgcctgccagcagtgtgggaaggccttccaccacctgggcagcttccagaggcacatgatccgccacactggaaatggcccccacaagtgcaagatctgtgggaagggctttgactgccccagcagcctgcagagccatgagaggacccacactggagagaagccctatgagtgcaagcagtgtgggaaggccctgagccacaggagcagcttccgcagccacatgatcatgcacactggagatggcccccacaagtgcaaggtgtgtgggaaggcctttgtgtaccccagcgtcttccagagacatgagaggacccacacagctgagaagccctacaagtgcaagcagtgtgggaaggcctaccgcatcagcagcagcctgcggagacatgagaccacccacactggagagaagccctacaagtgcaagctgggcaaggcctgcatcgacttctgcagcttccagaaccacaagaccacccacactggagagaagccctatgagtgcaaggaatgtgggaaggccttcagccgcttccgctacctgagccgccacaagaggacccacactggagagaagccctatgagtgcaagacctgcaggaaggccttcggccactatgacaacctgaaggtgcatgagcgcatccacagcggggagaagccctatgagtgcaaggaatgtgggaaggccttctcctggctgacctgcttcctgcggcatgagcgcatccacatgagggagaagagctatgaatgtccccagtgtgggaaggccttcacccacagccgcttcctgcagggccacgagaagacccacactggagagaacccctatgagtgcaaggaatgtgggaaggcctttgccagcctgagcagcctgcaccgccacaagaagacccactggaagaagacccacactggagagaacccctatgagtgcaaggaatgtgggaaggcctttgccagcctgagcagcctgcaccgccacaagaagacccactag

SEQ ID NO: 17915 - DNA, 1932 bp, Artificial Sequence
  Description of Artificial Sequence: Synthetic coding sequence
atggcctctgtggccctggaggatgtggccgtgaacttcacccgggaggagtgggccctgctgggcccctgccagaagaacctgtacaaggatgtgatgcaggagaccatccggaacctggactgtgtggtgatgaagtggaaggaccagaacatcgaggaccagtaccgctaccccaggaagaacctgcgctgcaggatgctggagagatttgtggagagcaaggatggcacccagtgtggggagaccagcagccagatccaggacagcatcgtgaccaagaacaccctgcccggggtgggcccctgtgagagctccatgagaggagagaaggtgatgggccacagcagcctgaactgctacatccgggtgggcgccggccacaagccccatgagtaccatgaatgtggggagaagccagacacccacaagcagaggggcaaggccttctcctaccacaacagcttccagacccatgagcggctgcacacaggcaagaagccctatgactgcaaggaatgtgggaagagcttcagcagcctgggcaacctgcagaggcacatggctgtgcagagaggagatggcccctacaagtgcaagctgtgtgggaaggccttcttctggcccagcctgctgcacatgcatgagaggacccacactggagagaagccctatgagtgcaagcagtgcagcaaggccttctccttctacagcagctacctgcggcatgagaggacccacactggagagaagccctatgagtgcaagcagtgcagcaaggccttccccttctacagcagctacctgcggcatgagaggacccacactggagagaagccctacaagtgcaagcagtgcagcaaggccttcccagacagcagcagctgcctgattcatgagaggacccacactggagagaagccctacacctgcaagcagtgtgggaaggccttctctgtgtctggcagcctgcagagacatgagaccacccacagcgctgagaagccctatgcctgccagcagtgtgggaaggccttccaccacctgggcagcttccagaggcacatgatccgccacactggaaatggcccccacaagtgcaagatctgtgggaagggctttgactgccccagcagcctgcagagccatgagaggacccacactggagagaagccctatgagtgcaagcagtgtgggaaggccctgagccacaggagcagcttccgcagccacatgatcatgcacactggagatggcccccacaagtgcaaggtgtgtgggaaggcctttgtgtaccccagcgtcttccagagacatgagaggacccacacagctgagaagccctacaagtgcaagcagtgtgggaaggcctaccgcatcagcagcagcctgcggagacatgagaccacccacactggagagaagccctacaagtgcaagctgggcaaggcctgcatcgacttctgcagcttccagaaccacaagaccacccacactggagagaagccctatgagtgcaaggaatgtgggaaggccttcagccgcttccgctacctgagccgccacaagaggacccacactggagagaagccctatgagtgcaagacctgcaggaaggccttcggccactatgacaacctgaaggtgcatgagcgcatccacatgagggagaagagctatgaatgtccccagtgtgggaaggccttcacccacagccgcttcctgcagggccacgagaagacccacactggagagaacccctatgagtgcaaggaatgtgggaaggcctttgccagcctgagcagcctgcaccgccacaagaagacccactggaagaagacccacactggagagaacccctatgagtgcaaggaatgtgggaaggcctttgccagcctgagcagcctgcaccgccacaagaagacccactag

SEQ ID NO: 17916 - DNA, 1053 bp, Artificial Sequence
  Description of Artificial Sequence: Synthetic coding sequence
atgcctcctggccgctggcacgccgccagcagcggccctgtgtttgaaggagcccggctgcagacagtgaagaaggaggaggaggatgagagctacacccctgtgcaggccgcccggccccagaccctgaaccggcccggccaggagctgttccggcagctgttccggcagctgcgctaccacgagagcagcggccccctggagaccctgagccggctgcgggagctgtgccgctggtggctgcggccagatgtgctgagcaaggcccagatcctggagctgctggtgctggagcagttcctgagcatcctgcctggagagctgcgggtgtgggtgcagctgcacaaccctgagagcggggaggagtggccctgctggaggagctgccggggcaccctgatgggccaccctgggggcacccgggcccctgagccccgctgtgccctggatggctaccgcagccgcagcgcccagatctggagcctggccagccccctgcggagcagcagcgccctgggggaccacctggagcccccctatgaaattgaggcccgggacttcctggccggccagagcgacaccccagctgcccagatgcctgccctcttcccccgggagggctgccctggggaccaggtgacccccaccaggagcctgacagcccagctgcaggagaccatgaccttcaaggatgtggaggtgaccttcagccaggatgagtggggctggctggacagcgcccagaggaacctgtacagagatgtgatgctggagaactacagaaacatggccagcctggtgggccccttcaccaagccagccctgatctcctggctggaggcccgggagccctggggcctgaacatgcaggccgcccagcccaagggcaaccctgtggccgcccccactggagatgacctgcagagcaagaccaacaagttcatcctgaaccaggagcccctggaggaggccgagaccctggccgtgagcagcggctgcccagccacctctgtgtctgagggcatcggcctgcgggagagcttccagcagtag

SEQ ID NO: 17917 - DNA, 3096 bp, Artificial Sequence
  Description of Artificial Sequence: Synthetic coding sequence
atgcctcctggccgctggcacgccgcctacccagcccaggcccagagcagccgggagcggggccgcctgcagacagtgaagaaggaggaggaggatgagagctacacccctgtgcaggccgcccggccccagaccctgaacagacctggccaggagctgttccggcagctgttccggcagctgcgctaccacgagagcagcggccccctggagaccctgagccggctgcgggagctgtgccgctggtggctgcggccagatgtgctgagcaaggcccagatcctggagctgctggtgctggagcagttcctgagcatcctgcccggggagctgcgggtgtgggtgcagctgcacaaccctgagagcggggaggaggccgtggccctgctggaggagctgcagagggacctggatggcacctcctggagggaccccggccctgcccagagcccagatgtgcactggatgggcaccggggccctgcggagcgcccagatctggagcctggccagccccctgcggagcagcagcgccctgggggaccacctggagcccccctatgaaattgaggcccgggacttcctggccggccagagcgacaccccagctgcccagatgcctgccctcttcccccgggagggctgccctggggaccaggtgacccccaccaggagcctgacagcccagctgcaggagaccatgaccttcaaggatgtggaggtgaccttcagccaggatgagtggggctggctggacagcgcccagaggaacctgtacagagatgtgatgctggagaactacagaaacatggccagcctggtgggccccttcaccaagccagccctgatctcctggctggaggcccgggagccctggggcctgaacatgcaggccgcccagcccaagggcaaccctgtggccgcccccactggagatgacctgcagagcaagaccaacaagttcatcctgaaccaggagcccctggaggaggccgagaccctggccgtgagcagcggctgcccagccacctctgtgtctgagggcatcggcctgcgggagagcttccagcagaagagccggcagaaggaccagtgtgagaaccccatccaggtgcgggtgaagaaggaggagaccaacttcagccacaggacaggcaaggacagcgaggtgtctggcagcaacagcctggacctgaagcacgtgacctacctgcgggtgtctggcaggaaggagagcctgaagcacggctgcggcaagcacttcaggatgagcagccaccactatgactacaagaagtatggcaagggcctgcggcacatgattggaggcttcagcctgcaccagaggatccacagcggcctgaagggcaacaagaaggatgtgtgtgggaaggacttcagcctgagcagccaccaccagaggggccagagcctgcacacagtgggcgtgtccttcaagtgcagcgactgtggccgcaccttcagccacagcagccacctggcctaccaccagaggctgcacacccaggagaaggccttcaagtgccgggtgtgtgggaaggccttccgctggagcagcaactgtgcccggcatgagaagatccacactggagtgaagccctacaagtgtgacctgtgtgagaaggccttccggcggctgagcgcctaccgcctgcaccgggagacccacgccaagaagaagttcctggagctgaaccagtaccgggccgccctgacctacagcagcggctttgaccaccacctgggggaccagagcggggagaagctgtttgactgcagccagtgcaggaagagcttccactgcaagagctatgtgctggagcaccagaggatccacacccaggagaagccctacaagtgcaccaagtgcaggaagaccttccgctggaggagcaacttcaccaggcacatgaggctgcacgaggaggagaagttctacaagcaggatgaatgtcgggagggcttccggcagagcccagactgcagccagccccagggcgccccagctgtggagaagaccttcctgtgccagcagtgtgggaagaccttcaccaggaagaagaccctggtggaccaccagaggatccacactggagagaagccctaccagtgcagcgactgtgggaaggactttgcctaccgcagcgccttcatcgtgcacaagaagaagcacgccatgaagaggaagccagagggcggccccagcttcagccaggacacagtgttccaggtgccccagagcagccacagcaaggaggagccctacaagtgcagccagtgtgggaaggccttcaggaaccacagcttcctgctgatccaccagagggtgcacactggagagaagccctacaagtgccgggagtgtgggaaggccttccgctggagcagcaacctgtaccgccaccagaggatccacagcctgcagaagcagtatgactgccatgaaagtgagaagacccccaacgtggagcccaagatcctgactggagagaagcgcttctggtgccaggagtgtgggaagaccttcaccaggaagaggaccctgctggaccacaagggcatccacagcggggagaagcgctacaagtgcaacctgtgtgggaagagctatgacaggaactaccgcctggtgaaccaccagaggatccacagcacagagcggcccttcaagtgccagtggtgtgggaaggagttcatcggccgccacaccctgagcagccaccagaggaagcacaccagggctgcccaggccgagaggagccccccagcccggagcagcagccaggacaccaagctgcggctgcagaagctgaagcccagcgaggagatgcccctggaggactgcaaggaggcctgcagccagagcagccggctgaccggcctgcaggacatcagcatcggcaagaagtgccacaagtgcagcatctgtgggaagaccttcaacaagagcagccagctgatcagccacaagcgcttccacacccgggagcggcccttcaagtgcagcaaatgtgggaagaccttccgctggagcagcaacctggcccggcacatgaagaaccacatccgggactag

SEQ ID NO: 17918 - DNA, 3096 bp, Artificial Sequence; identical to SEQ ID NO: 17917
  Description of Artificial Sequence: Synthetic coding sequence

SEQ ID NO: 17919 - DNA, 822 bp, Artificial Sequence
  Description of Artificial Sequence: Synthetic coding sequence
atgcctcctggccgctggcacgccgccatcagcagcggccctgtgtttgagggcgcccgggccctgcagacagtgaagaaggaggaggaggatgagagctacacccctgtgcaggccgcccggccccagaccctgaaccggcccggccaggagctgttccggcagctgttccggcagctgcgctaccacgagagcagcggccccctggagaccctgagccggctgcgggagctgtgccgctggtggctgcggccagatgtgctgagcaaggcccagatcctggagctgctggtgctggagcagttcctgagcatcctgcctggagagctgcgggtgtgggtgcagctgcacaaccctgagagcggggaggagctgtggccctgctggaggagctgccggggcaccctgatgggccaccctgggggcacccgggccctgcctgagccccgctgtgccctggatggctaccgcagcctgcggagcgcccagatctggagcctggccagccccctgcggagcagcagcgccctgggggaccacctggagcccccctatgaaattgaggcccgggacttcctggccggccagagcgacaccccagctgcccagatgcctgccctcttcccccgggagggctgccctggggaccaggtgacccccaccaggagcctgacagcccagctgcaggagaccatgaccttcaaggatgtggaggtgaccttcagccaggatgagtggggctggctggacagcgcccagaggaacctgtacagagatgtgatgctggagaactacagaaacatggccagcctgggcaagtag

SEQ ID NO: 17920 - DNA, 1353 bp, Artificial Sequence
  Description of Artificial Sequence: Synthetic coding sequence
atgcccagccccctgggccccccctgcctgcctgtgatggaccctgagaccaccctggaggagcctgagacagcccggctgcgcttccggggcttctgctaccaggaggtggccggcccccgggaggccctggcccggctgcgggagctgtgctgccagtggctgcagcctgaggcccacagcaaggagcagatgctggagatgctggtgctggagcagttcctgggcaccctgcccccagagatccaggcctgggtgcggggccagaggcctggcagccctgaggaggccgccgccctggtggagggcctgcagcacgaccccggccagctgctgggctggatcacagcccacgtgctgaagcaggaggtgctgcctgctgcccagaagacagaggagcccctgggcagcccccaccccagcggcaccgtggagagccctggagagggcccccaggacacccgcatcgagggctctgtgcagctgagctgcagcgtgaaggaggagcccaacgtggatggccaggaggtggcccccagcagcccccccctggccgcccagagccctgagggcaaccacggccaccaggagcccgccagcaccagcttccaccccccacgcatccaggaggagtggggcctgctggacaggagccagaaggagctgtactgggatgccatgctggagaagtatggaacagtggtgtccctgggcctgcccccccaccagcctgaggcccaggcccagagcgagctgggcatgctgctgactggaactggagtgtgccgcagcctgcggtctggaaatgaaagtgagggccccccaggctgcccagaggcccagcccccccagggccctggccctgctgcctgggagggcctgtctggagctgccaccccagcccccaccgtgcggcccggcaccccacctgtgcccacccagcccaccccagctgagacccggctggagcctgctgccacccccaggaagccctacacctgtgagcagtgtggccggggctttgactggaagtctgtgtttgtgatccaccacaggacccacaccagcggccctggggtgcagagccctggcctggccactggagagagcacagagaagccaccccagggcgaggtggccttcccccaccacccccggcgcagcctgaccggccccaggagctacccctgtgaagaatgtggctgcagcttctcctggaagagccagctggtgatccacaggaagagccacacaggccagaggaggcacttctgcagcgactgtggccgggcctttgactggaagagccagctggtgatccacaggaagggccacaggcctgaggtgccctag

SEQ ID NO: 17921 - DNA, 1044 bp, Artificial Sequence
  Description of Artificial Sequence: Synthetic coding sequence
atgtccatggacaggaagtggcaccccccagccctgcacctgcagcacagccccctgcggggcaccatggacaccaagaaccagcccccccaccccagcacccaccctggcttcagaagaagtggcggctgctggacaggccacagaagaaactgcaccggcatgcgctgctggaggagcacagcccagtggagcccctgggtgaggaccagccagccccacccagcccccctgcccggggcctgcacccaccctgctgctggcctggccggccagggcctgtgtgccaccagccccacccagctgagccacctgcctgaggagcaccctgtgacctaccagaaccggccccaccccagcttcatgcagaccccctgcctgactgtgccccccacccgggccggcctgcccccccaccagcctgaggcccaggcccagagcgagctgggcatgctgctgaccggcaccggggtgtgccgcagcctgcggtctggaaatgaaagtgagggccccccaggctgcccagaggcccagcccccccagggccctggccctgctgcctgggagggcctgagcggggccgccaccccagcccccaccgtgcggcccggcaccccacctgtgcccacccagcccaccccagctgagacccggctggagcctgctgccacccccaggaagccctacacctgtgagcagtgtggccggggctttgactggaagtctgtgtttgtgatccaccacaggacccacaccagcggccctggggtgcagagccctggcctggccaccggggagagcacagagaagccaccccagggcgaggtggccttcccccaccaccccaggaggagcctgaccggccccaggagctacccctgtgaggagtgtggctgcagcttctcctggaagagccagctggtgatccacaggaagagccacacaggccagaggaggcacttctgcagcgactgtggccgggcctttgactggaagagccagctggtgatccacaggaagggccacaggcctgaggtgccctag

SEQ ID NO: 17922 - DNA, 468 bp, Artificial Sequence
  Description of Artificial Sequence: Synthetic coding sequence
atgcccagccccctgggccccccctgcctgcctgtgatggaccctgagaccaccctggaggagcctgagacagcccggctgcgcttccggggcttctgctaccaggaggtggccggcccccgggaggccctggcccggctgcgggagctgtgctgccagtggctgcagcctgaggcccacagcaaggagcagatgctggagatgctggtgctggagcagttcctgggcaccctgcccccagagatccaggcctgggtgcggggccagaggcctggcagccctgaggaggccgccgccctggtggagggcctgcagcacgaccccggccagctgctgggctggatcacagcccacgtgctgaagcaggaggtgctgcctgctgcccagaagacagaggagcccctgggcgcccccaccccccagggccagtggagccccctgggcaaggtgcccaggaccccagagtag

SEQ ID NO: 17923 - DNA, 1269 bp, Artificial Sequence
  Description of Artificial Sequence: Synthetic coding sequence
atgcccagccccctgggccccccctgcctgcctgtgatggaccctgagaccaccctggaggagcctgagacagcccggctgcgcttccggggcttctgctaccaggaggtggccggcccccgggaggccctggcccggctgcgggagctgtgctgccagtggctgcagcctgaggcccacagcaaggagcagatgctggagatgctggtgctggagcagttcctgggcaccctgcccccagagatccaggcctgggtgcggggccagaggcctggcagccctgaggaggccgccgccctggtggagggcctgcagcacgaccccggccagctgctgggctggatcacagcccacgtgctgaagcaggaggtgctgcctgctgcccagaagacagaggagcccctgggcagcccccaccccagcggcaccgtggagagccctggagagggcccccaggacacccgcatcgagggctctgtgcagctgagctgcagcgtgaaggaggagcccaacgtggatggccaggaggtggcccccagcagcccccccctggccgcccagagccctgagggcaaccacggccaccaggagcccgccagcaccagcttccaccccccacgcatccaggaggagtggggcctgctggacaggagccagaaggagctgtactgggatgccatgctggagaagtatggaacagtggtgtccctgggcctgcccccccaccagcctgaggcccaggcccagagcgagctgggcatgctgctgactggaactggagtgtgccgcagcctgcggtctggaaatgaaagtgagggccccccaggctgcccagaggcccagcccccccagggccctggccctgctgcctgggagggcctgtctggagctgccaccccagcccccaccgtgcggcccggcaccccacctgtgcccacccagcccaccccagctgagacccggctggagcctgctgccacccccaggaagccctacacctgtgagcagtgtggccggggctttgactggaagtctgtgtttgtgatccaccacaggacccacaccagcggccctggggtgcagagccctggcctggccactggagagagcacagagaagccaccccagggcgaggtggccttcccccaccacccccggcgcagcctgaccggccccaggagctacccctgtgaagaatgtggctgcagcttctcctggaagagccagctggtgatccacaggaagagccacaggcctgaggtgccctag

SEQ ID NO: 17924 - DNA, 1353 bp, Artificial Sequence; identical to SEQ ID NO: 17920
  Description of Artificial Sequence: Synthetic coding sequence

SEQ ID NO: 17925 - DNA, 3042 bp, Artificial Sequence
  Description of Artificial Sequence: Synthetic coding sequence
atgggagaccccggcagcgagatcattgaatctgtgcccccagctggccctgaggccagcgagagcaccacagatgaaaatgaagatgacatccagtttgtgtctgagggccccctgcggcctgtgctggagtacatcgacctggtgtccagtgatgatgaggagcccagcaccagctacacagatgagaacatcaagaggaaggaccacatcgactaccagaaggacaaggtggccctgaccctggcccggctggcccggcacgtggaggtggagaagcagcagaaggaggagaagaacagagccttccgggagaagattgacttccagcacgcccacggcctgcaggagctggagttcatccggggccacagcgacacagaagctgcccggctgtgtgtggaccagtggctgaagatgcctggcctgaagacaggcaccatcaactgtggcaccaagagcagcttcagaagaggaggccacacctgggtgtctgggaagcccatcctgtgccccatcatgcactgcaacaaggagtttgacaatggccacctgctgctgggccacctgaagagatttgaccacagcccctgtgaccccaccatcaccctgcacggccccttcttcagcagctttgcctgtgtggtgtgctacaagaagtttgtgacccagcagcagtacagagaccacctgtttgacaaggaggccacagatgatggccacaacaacaacctgctgccccagatcatccagtgctttgcctgccccaactgcttcctgctcttcagcaggaaggaggagtgcagcaagcacatgtctgggaagaaccacttccaccagagcttcaagctgggggacaacaagggcatcgcccaccccatctccttccccagctttgccaagaagctgctgatcagcctgtgcaaggatgtgcccttccaggtgaagtgtgtggcctgccacaagaccctgcggagccacatggagctgacagcccacttccgggtgcactgcagaaatgccggccctgtggccgtggccgagaagagcatcacccaggtggccgagaagttcatcctgcggggctactgcccagactgcaaccaggtgtttgtggatgagaccagcacccagaaccacaagcagaacagcggccacaaggtgcgggtcatcaacagcgtggaggagagcgtgctgctgtactgccacagcagcgagggcaacaaggaccccagcagtgacctgcacctgctgctggaccagagcaagttcagcagcctgaagaggaccatgagcatcaaggagagcagcagcctggagtgcatcgccatccccaagaagaagatgaacctgaaggacaagagccatgagggcgtggcctgtgtgcagaaggagaagtctgtggtgaagacctggttctgtgagtgcaaccagcgcttccccagtgaagatgctgtggagaagcacgtgttcagcgccaacaccatgggctacaagtgtgtggtgtgtgggaaggtgtgtgatgacagcggggtcatccggctgcacatgagccgcatccatggaggagcccacctgaacaacttcctgttctggtgcaggacctgcaagaaggagctgaccaggaaggacaccatcatggcccacgtgacagagttccacaacggccaccgctacttctatgagatggatgaggtggagggggagaccctgcccagcagcagcaccaccctggacaacctgacagccaacaagcccagcagcgccatcaccgtgattgaccacagccctgccaacagcagcccccggggcaagtggcagtgccgcatctgtgaggacatgtttgacagccaggagtatgtgaagcagcactgcatgagcctggccagccacaagttccaccgctacagctgtgcccactgcaggaagcccttccacaagattgagaccctgtaccgccactgccaggatgaacatgacaatgagatcaagatcaagtacttctgtggcctgtgtgacctgatcttcaacgtggaggaggccttcctgagccactatgaggagcaccacagcattgattatgtgtttgtgtctgagaagacagagaccagcatcaagacagaagatgacttccctgtgattgagaccagcaaccagctgacctgtggctgccgggagagctacatctgcaaggtgaacaggaaggaggactacagccgctgcctgcagatcatgctggacaagggcaagctgtggttccgctgcagcctgtgcagcgccacagcccagaacctgacagacatgaacacccacatccaccaggtgcacaaggagaagagtgatgaggaggagcagcagtatgtgatcaagtgtggcacctgcaccaaggccttccatgaccctgagagcgcccagcagcacttccacaggaagcactgcttcctgcagaagcccagcgtggcccactttggaagtgagaagagcaacctgtacaagttcaccgccagcgccagccacacagagaggaagctgaagcaggccatcaactacagcaagagcctggacatggagaagggcgtggagaatgacctgagctaccagaacattggaggcaacaccaactggaagccacccctgaactgcaagatctacaactacctgaaccgcatcggctgcttcttcctgcacccccgctgcagcaagaggaaggatgctgctgactttgccatctgcatgcacgccggccgcctggatgagcagctgcccaagcagatccccttcaccatcctgagcggggaccagggcttcctggagctggagaaccagttcaagaagacccagaggcctgcccacatcctgaacccccaccacctggagggggacatgatgtgtgccctgctgaacagcatcagtgacaccaccaaggaatgtgacagtgatgacaacatgggcgccaagaacaccagcatcggggaggagttcatcagcacagaagatgtggagctggaggaggccatcagaagaagcctggaggagatgtag

SEQ ID NO: 17926 - DNA, 3186 bp, Artificial Sequence
  Description of Artificial Sequence: Synthetic coding sequence
atgggagaccccggcagcgagatcattgaatctgtgcccccagctggccctgaggccagcgagagcaccacagatgaaaatgaagatgacatccagtttgtgtctgagggccccctgcggcctgtgctggagtacatcgacctggtgtccagtgatgatgaggagcccagcaccagctacacagatgagaacatcaagaggaaggaccacatcgactaccagaaggacaaggtggccctgaccctggcccggctggcccggcacgtggaggtggagaagcagcagaaggaggagaagaacagagccttccgggagaagattgacttccagcacgcccacggcctgcaggagctggagttcatccggggccacagcgacacagaagctgcccggctgtgtgtggaccagtggctgaagatgcctggcctgaagacaggcaccatcaactgtggcaccaagagcagcttcagaagaggaggccacacctgggtgtctgggaagcccatcctgtgccccatcatgcactgcaacaaggagtttgacaatggccacctgctgctgggccacctgaagagatttgaccacagcccctgtgaccccaccatcaccctgcacggccccttcttcagcagctttgcctgtgtggtgtgctacaagaagtttgtgacccagcagcagtacagagaccacctgtttgacaaggaggccacagatgatggccacaacaacaacctgctgccccagatcatccagtgctttgcctgccccaactgcttcctgctcttcagcaggaaggaggagtgcagcaagcacatgtctgggaagaaccacttccaccagagcttcaagctgggggacaacaagggcatcgcccaccccatctccttccccagctttgccaagaagctgctgatcagcctgtgcaaggatgtgcccttccaggtgaagtgtgtggcctgccacaagaccctgcggagccacatggagctgacagcccacttccgggtgcactgcagaaatgccggccctgtggccgtggccgagaagagcatcacccaggtggccgagaagttcatcctgcggggctactgcccagactgcaaccaggtgtttgtggatgagaccagcacccagaaccacaagcagaacagcggccacaaggtgcgggtcatcaacagcgtggaggagagcgtgctgctgtactgccacagcagcgagggcaacaaggaccccagcagtgacctgcacctgctgctggaccagagcaagttcagcagcctgaagaggaccatgagcatcaaggagagcagcagcctggagtgcatcgccatccccaagaagaagatgaacctgaaggacaagagccatgagggcgtggcctgtgtgcagaaggagaagtctgtggtgaagacctggttctgtgagtgcaaccagcgcttccccagtgaagatgctgtggagaagcacgtgttcagcgccaacaccatgggctacaagtgtgtggtgtgtgggaaggtgtgtgatgacagcggggtcatccggctgcacatgagccgcatccatggaggagcccacctgaacaacttcctgttctggtgcaggacctgcaagaaggagctgaccaggaaggacaccatcatggcccacgtgacagagttccacaacggccaccgctacttctatgagatggatgaggtggagggggagaccctgcccagcagcagcaccaccctggacaacctgacagccaacaagcccagcagcgccatcaccgtgattgaccacagccctgccaacagcagcccccggggcaagtggcagtgccgcatctgtgaggacatgtttgacagccaggagtatgtgaagcagcactgcatgagcctggccagccacaagttccaccgctacagctgtgcccactgcaggaagcccttccacaagattgagaccctgtaccgccactgccaggatgaacatgacaatgagatcaagatcaagtacttctgtggcctgtgtgacctgatcttcaacgtggaggaggccttcctgagccactatgaggagcaccacagcattgattatgtgtttgtgtctgagaagacagagaccagcatcaagacagaagatgacttccctgtgattgagaccagcaaccagctgacctgtggctgccgggagagctacatctgcaaggtgaacaggaaggaggactacagccgctgcctgcagatcatgctggacaagggcaagctgtggttccgctgcagcctgtgcagcgccacagcccagaacctgacagacatgaacacccacatccaccaggtgcacaaggagaagagtgatgaggaggagcagcagtatgtgatcaagtgtggcacctgcaccaaggccttccatgaccctgagagcgcccagcagcacttccacaggaagcactgcttcctgcagaagcccagcgtggcccactttggaagtgagaagagcaacctgtacaagttcaccgccagcgccagccacacagagaggaagctgaagcaggccatcaactacagcaagagcctggacatggagaagggcgtggagaatgacctgagctaccagaacatcgaggaggagatcgtggagctgcctgacctggactacctgcggaccatgacccacatcgtgtttgtggactttgacaactggagcaacttcttcggccacctgcccggccacctgaaccagggcaccttcatctggggcttccagggcggcaacaccaactggaagccacccctgaactgcaagatctacaactacctgaaccgcatcggctgcttcttcctgcacccccgctgcagcaagaggaaggatgctgctgactttgccatctgcatgcacgccggccgcctggatgagcagctgcccaagcagatccccttcaccatcctgagcggggaccagggcttcctggagctggagaaccagttcaagaagacccagaggcctgcccacatcctgaacccccaccacctggagggggacatgatgtgtgccctgctgaacagcatcagtgacaccaccaaggaatgtgacagtgatgacaacatgggcgccaagaacaccagcatcggggaggagttcatcagcacagaagatgtggagctggaggaggccatcagaagaagcctggaggagatgtag

SEQ ID NO: 17927 - DNA, 1680 bp, Artificial Sequence
  Description of Artificial Sequence: Synthetic coding sequence
atgggagaccccggcagcgagatcattgaatctgtgcccccagctggccctgaggccagcgagagcaccacagatgaaaatgaagatgacatccagtttgtgtctgagggccccctgcggcctgtgctggagtacatcgacctggtgtccagtgatgatgaggagcccagcaccagctacacagacaggatgcctgagagcaaggtgcccagcagcgagaaccacaggcctgagatgtgcagcagctgcaatgtgcccctgcccatcggggacagcagcagcttcagcggcagctgcagcagcagccctgagcgcatcgtgtcccagaccagctctgtggagaaccccctggagaaccagaagaatgaccagaacaacagcgacaccaagatcagcgagacagagaccctgaagagcagccagaacttccagaccctgcccagcagccccctgctggtgccccaggagagcctggccagcagcgaggtgaaggagaacctgagaattgacagcagcagcgccagccagcacggcagagatgccatcctgtacctgcagacccaggtggccgagatgagcagggtcatccgggacctgcagagccgcagctgcttccgcttccaccacagccggcccagcgagaacagctctgtgccctgggacatcagcaccagcaaggaggagaacctgagcacagtggaggaggagacagactacaagagccccagcgcagatgacaagggccagcccagcgaccccagccagagcagcttcaccggcctgctgaagaggatggagcagaggggcgtcatcaagagggtgaccctgcagagcgaggccgagagctgtgagggcaagccagactgtgtgaccagcaagaagaggctggtgccccccctgcaccccctgctgcgcatcgccaccacagaggtgttcaaggaccctgctgactgccaccccagcagcttcatgggccaccgggtgtaccctgtggccaaggacaccagccccttccagcccaaccccccagctgagggccccatcgtggaggccctggagcacagcaagaggggcaacaccaccagccccctggacagcaccagcaaggagatggaggtgatgggctgccgcttctaccacgccgccagcattgctgcccgggccgccagctacatggcctacatgacccagtaccagaggaagctgtgggaggacatggaggacctggtgcatgaccctgagtttgaccggggcaaggcccgctgcatcatcagtgatggcatggatgctggcctgtggcagctgtgcaccacccgggacatcatggacagcgtggtgcgggtgatggccatggccatcgactaccgccggcaggcctggctgcggctgaccagcctgaccaagaagacccaggagaagatcagccacctgccctttgatggcaccagcctgtttggccaggatgtgaaggctgtggtggccgaggacaacaacatcaaggaaaatgactacaaggaccacaagtactacaaccagcaccgctacttctacagccatgaccagaaggcccactaccacaacagaggctacagcaagggggactggtacaagcccaggaaccacccctaccgctacaggaagaagggggacagccctgagagacatggctacaagaactag

SEQ ID NO: 17928 - DNA, 1569 bp, Artificial Sequence
  Description of Artificial Sequence: Synthetic coding sequence
atggctgtgagccacctgcccaccatggtgcaggagagcgtgaccttcaaggatgtggccatcctcttcacccaggaggagtggggccagctgagccctgcccagagggccctgtacagagatgtgatgctggagaactacagcaacctggtgtccctgggcctgctgggccccaagccagacaccttcagccagctggagaagcgggaggtgtggatgcctgaggacacccctgggggcttctgcctggactggatgaccatgcctgccagcaagaagagcacagtgaaggccgagatccctgaggaggagctggaccagtggaccatcaaggagcgcttcagcagcagcagccactggaagtgtgccagcctgctggagtggcagtgtggcggccaggagatcagcctgcagagggtggtgctgacccaccccaacacccccagccaggagtgtgatgaaagtggcagcaccatgagcagcagcctgcacagcgaccagagccagggcttccagcccagcaagaatgcctttgaatgttctgaatgtgggaaggtgttcagcaagagcagcaccctgaacaagcaccagaagatccacaatgagaagaatgccaaccagaagatccacatcaaggagaagagatatgaatgtcgggagtgtgggaaggccttccaccagagcacccacctgatccaccaccagaggatccacactggagagaagccctatgagtgcaaggaatgtgggaaggccttctctgtgagcagcagcctgacctaccaccagaagatccacactggagagaagccctttgagtgcaacctgtgtgggaaggccttcatccggaacatccacctggcccaccaccaccgcatccacactggagagaagcccttcaagtgcaacatctgtgagaaggcctttgtgtgccgggcccacctgaccaagcaccagaacatccacagcggggagaagccctacaagtgcaatgaatgtgggaaggccttcaaccagagcaccagcttcctgcagcaccagaggatccacactggagagaagccctttgaatgtaatgaatgtgggaaggccttccgggtgaacagcagcctgacagagcaccagaggatccacactggagagaagccctacaagtgcaatgaatgtgggaaggccttccgggacaacagcagctttgcccggcacaggaagatccacactggagagaagccctaccgctgtggcctgtgtgagaaggccttccgggaccagagcgccctggcccagcaccagaggatccacactggagagaagccctacacctgcaacatctgtgagaaggccttcagtgaccacagcgccctgacccagcacaagaggatccacacccgggagaagccctacaagtgcaagatctgtgagaaggccttcatccgcagcacccacctgacccagcaccagaggatccacactggagagaagccctacaagtgcaacaagtgtgggaaggccttcaaccagacagccaacctgatccagcaccagaggcaccacatcggggagaagtag

SEQ ID NO: 17929 - DNA, 1569 bp, Artificial Sequence; identical to SEQ ID NO: 17928
  Description of Artificial Sequence: Synthetic coding sequence

SEQ ID NO: 17930 - DNA, 7521 bp, Artificial Sequence
  Description of Artificial Sequence: Synthetic coding sequence
atggaggtgctgcagtgtgatggctgtgacttccgggcccccagctatgaggacctgaaggcccacatccaggatgtgcacacagccttcctgcagcccacagatgtggccgaggacaacgtgaatgagctgcgctgtggctctgtgaatgccagcaaccagacagaggtggagttcagcagcatcaaggatgaatttgccatcgccgaggacctgagcggccagaatgccaccagcctgggcaccggcggctactacggccacagccctggctactacggccagcacatcgccgccaaccccaagcccaccaacaagttcttccagtgcaagttctgtgtgcgctacttccgcagcaagaacctgctgattgagcacaccaggaaggtgcatggagcccaggccgagggcagcagcagcggcccccctgtgcccggcagcctgaactacaacatcatgatgcatgagggctttgggaaggtgttcagctgccagttctgcacctacaagagcccccggcgggcccgcatcatcaagcaccagaagatgtaccacaagaacaacctgaaggagaccacagcccctcctccagccccagcccccatgccagaccctgtggtgccccctgtgtccctgcaggacccctgcaaggagctgcctgctgaggtggtggagaggagcatcctggagagcatggtgaagcccctgaccaagagccggggcaacttctgctgtgagtggtgcagctaccagaccccccggcgggagcgctggtgtgaccacatgatgaagaagcaccgctccatggtgaagatcctgagcagcctgcggcagcagcaggagggcaccaacctgcctgatgtgcccaacaagagcgcccccagccccaccagcaacagcacctacctgaccatgaatgctgccagccgggagatccccaacaccaccgtgagcaacttccggggctccatgggcaacagcatcatgaggcccaacagcagcgccagcaagttcagccccatgagctacccccagatgaagcccaagagcccccacaacagcggcctggtgaacctgacagagaggagccgctatggcatgacagacatgaccaacagcagcgctgacctggagaccaacagcatgctgaatgacagcagcagtgatgaggagctgaatgaaattgattctgaaaatggcctgagcgccatggaccaccagaccagcggcctgtctgctgagcagctgatgggcagtgatggcaacaagctgctggagaccaagggcatccccttccgccgcttcatgaaccgcttccagtgccccttctgccccttcctgaccatgcacagaagaagcatcagccgccacatcgagaacatccacctgagcggcaagacagctgtgtacaagtgtgatgagtgccccttcacctgcaagagcagcctgaagctgggcgcccacaagcagtgccacacaggcaccaccagtgactgggatgctgtgaacagccagagcgagagcatcagcagcagcctgaatgaaggagtggtgtcctatgagagcagcagcatcaatggaaggaagagcggcgtgatgctggaccccctgcagcagcagcagcccccccagcccccacctcctcctcctcctcctccacccagccagccccagcccctgcagcagccccagcccccccagctgcagcccccccaccaggtgcccccccagccccagacccagcccccacccacccagcagccccagccccccacccaggccgcccccctgcacccctacaagtgcaccatgtgcaactacagcaccaccaccctgaagggcctgcgggtgcaccagcagcacaagcacagcttctgtgacaacctgcccaagtttgagggccagcccagcagcctgcccctggagaatgaaacagacagccaccccagcagcagcaacacagtgaagaagagccagaccagcatcctgggcctgagcagcaagaacaactttgtggccaaggccagcaggaagctggccaatgacttccccctggacctgagccctgtgaagaagaggaccagaattgatgaaattgccagcaacctgcagagcaagatcaaccagaccaagcagcaggaggatgctgtgatcaacgtggaggatgatgaggaggaggaggaggacaatgaggtggagattgaggtggagctggaccgggaggaggagcccacagagcccatcatcgaggtgcccaccagcttcagcgcccagcagatctgggtgcgggacaccagcgagccccagaaggagcccaacttcaggaacatcacccatgactacaatgccaccaatggagctgagattgagctgaccctgtctgaagatgaggaggactactacggcagcagcaccaacctgaaggaccaccaggtgagcaacacagccctgctgaacacccagacccccatctatggaacagagcacaacagcgagaacacagactttggagacagcggccgcctgtactactgcaagcactgtgacttcaacaacaagagcgcccggtctgtgtccacccactaccagaggatgcacccctacatcaagttctccttccgctacatcctggaccccaatgaccacagcgctgtgtaccgctgcctggagtgctacatcgactacaccaactttgaggacctgcagcagcactatggagagcaccaccctgaggccatgaatgtgctgaactttgaccacagcgacctgatctaccgctgccgcttctgcagctacaccagccccaacgtgcgcagcctgatgccccactaccagaggatgcaccccaccgtgaagatcaacaatgccatgatcttcagcagctatgtggtggagcagcaggagggcctgaacacagagagccagaccctgcgggagatcctgaacagcgcccccaagaacatggccaccagcacccctgtggcccggggcggcggcctgcctgccaccttcaacaagaacacccccaagaccttcaccccagaatgtgagaaccagaaggaccccctggtgaacacagtggtggtgtatgactgtgatgtgtgcagctttgccagccccaacatgcacagcgtgctggtgcactaccagaagaagcaccctgaggagaaggccagctacttccgcatccagaagaccatgaggatggtgtctgtggaccggggcagcgccctgagccagctgagctttgaggtgggcgcccccatgagccccaagatgagcaacatgggcagccccccaccaccccagcccccacctccagacctgagcacagagctgtactactgcaagcactgcagctacagcaacagatctgtggtgggcgtgctggtgcactaccagaagaggcaccctgagatcaaggtgacagccaagtacatccggcaggccccacccacagctgccatgatgagaggagtggagggcccccagggcagcccccggcccccagcccccatccagcagctgaacagaagcagcagcgagagagatggcccccctgtggagaatgagatgttcttctgccagcactgtgactatggcaacagaacagtgaagggcgtgctgatccactaccagaagaagcaccgggacttcaaggccaatgctgatgtgatccggcagcacacagccaccatccgcagcctgtgtgacaggaaccagaagaagccagccagctgtgtgctggtgagccccagcaacctggagcgggacaagaccaagctgcgggccctgaagtgccggcagtgcagctacaccagcccctacttctacgccctgaggaagcacatcaagaaggaccacccagccctgaaggccaccgtgaccagcatcatgcgctgggccttcctggatggcctcatcgaggccggctaccactgtgagtggtgcatctacagccacacagagcccaacggcctgctgctgcactaccagaggaggcaccctgagcactacgtggactacacctacatggccaccaagctgtgggccggccctgaccccagcccccccagcctgaccatgcctgctgaggccaagacctaccgctgccgggactgtgtgtttgaggccgtgtccatctgggacatcaccaaccactaccaggccttccacccctgggccatgaatggagatgaatctgtgctgctggacatcatcaaggagaaggatgctgtggagaagcccatcctgagcagcgaggagctggccggccctgtgaactgtgagaacagcatccccacccccttccctgagcaggaggctgaatgtccagaagatgcccggctgagccctgagaagagcctgcagctggccagcgccaacccagccatcagcagcaccccctaccagtgcaccgtgtgccagagcgagtacaacaacctgcacggcctgctgacccactacggcaagaagcaccctggcatgaaggtgaaggctgctgactttgcccaggacatcgacatcaaccctggagctgtgtacaagtgccgccactgcccctacatcaacacccgcatccacggcgtgctgacccactaccagaagaggcaccccagcatcaaggtgacagctgaggactttgtgcatgatgtggagcagagcgctgacatcagccagaatgatgtggaggagaccagccgcatcttcaagcagggctacggggcctaccgctgcaagctgtgcccctacacccacggcaccctggagaagctgaagatccactatgagaagtaccacaaccagcctgagtttgatgtgttcagccagagcccccccaagctgcctgtgcccctggagcctgagatgaccacagaggtgagccccagccaggtgtccatcacagaggaggaggtgggggaggagcctgtgtccaccagccacttcagcaccagccacctggtgagccacacagtgttccgctgccagctgtgcaagtacttctgcagcaccaggaaaggaattgcccggcactaccgcatcaagcacaacaacgtgcgggcccagcctgagggcaagaacaacctcttcaagtgtgccctgtgtgcctacaccaaccccatcaggaagggcctggccgcccactaccagaagagacatgacattgatgcctactacacccactgcctggccgccagcaggaccatcagtgacaagcccaacaaggtgatcatccccagcccccccaaggatgacagcccccagctgtctgaggagctgcggcgggctgtggagaagaagaagtgcagcctgtgcagcttccagagcttcagcaagaagggcatcgtgagccactacatgaagaggcaccctggggtcttccccaagaagcagcacgccagcaagctgggcggctacttcaccgctgtgtatgcagatgaacatgagaagcccaccctgatggaggaggaggagcggggcaactttgagaaggccgaggtggagggggaggcccaggagattgagtggctgcccttccgctgcatcaagtgcttcaagctgtccttcagcacagctgagctgctgtgcatgcactacacagaccaccacagccgggacctgaagagggacttcatcatcctgggcaatggcccccggctgcagaacagcacctaccagtgcaagcactgtgacagcaagctgcagagcacagctgagctgaccagccacctgaacatccacaatgaggagttccagaagagggccaagaggcaggagaggaggaagcagctgctgagcaagcagaagtatgcagatggagcctttgctgacttcaagcaggagcggcccttcggccacctggaggaggtgcccaagatcaaggagaggaaggtggtgggctacaagtgcaagttctgtgtggaggtgcaccccaccctgcgggccatctgcaaccacctgaggaagcacgtgcagtatggaaatgtgcctgctgtgtctgctgctgtgaagggcctgcggagccatgagaggagccacctggccctggccatgttcacccgggaggacaagtacagctgccagtactgcagctttgtgtctgccttccgccacaacctggacagacacatgcagacccaccacggccaccacaagcccttccgctgcaagctgtgcagcttcaagagcagctacaacagccggctgaagacccacatcctgaaggcccacgccggggagcacgcctacaagtgctcctggtgcagcttcagcaccatgaccatcagccagctgaaggagcacagcctgaaggtgcacggcaaggccctgaccctgccccggcccagaattgtgtccctgctgagcagccacagccaccacagcagccagaaggccaccccagctgaggaggtggaggacagcaatgacagcagctacagcgagcccccagatgtgcagcagcagctgaaccactaccagagcgctgccctggccaggaacaacagccgggtgtcccctgtgcccctgtctggagctgctgctggaacagagcagaagacagaagctgtgctgcactgtgagttctgtgagttcagcagcggctacatccagagcatcagaagacactacagagacaagcacggcggcaagaagctgttcaagtgcaaggactgcagcttctacacaggcttcaagagcgccttcaccatgcacgtggaggccggccacagcgctgtgcctgaggagggccccaaggacctgcgctgccccctgtgcctgtaccacaccaagtacaagaggaacatgattgaccacatcgtgctgcaccgggaggagcgggtggtgcccatcgaggtgtgccgcagcaagctgagcaagtacctgcagggcgtggtgttccgctgtgacaagtgcaccttcacctgcagcagtgatgagagcctgcagcagcacatcgagaagcacaatgagctgaagccctacaagtgccagctgtgctactatgagaccaagcacacagaggagctggacagccacctgagagatgagcacaaggtgtccaggaactttgagctggtgggccgggtgaacctggaccagctggagcagatgaaggagaagatggagagcagcagcagtgatgatgaggacaaggaggaggagatgaacagcaaggccgaggaccgggagctgatgaggttcagtgaccacggggccgccctgaacacagagaagcgcttcccctgtgagttctgtggccgggccttcagccagggcagcgagtgggagcggcacgtgctgcggcacggcatggccctgaatgacaccaagcaggtgtcccgggaggagatccaccccaaggagatcatggagaacagcgtgaagatgcccagcattgaggagaaggaggatgatgaggccatcggcatcgacttcagcctgaagaatgaaacagtggccatctgtgtggtgacagctgacaagagcctgctggagaatgctgaggccaagaaggagtag

SEQ ID NO: 17931 - DNA, 627 bp, Artificial Sequence
  Description of Artificial Sequence: Synthetic coding sequence
tgagagcacagcctgaaggtgcacggcaaggccctgaccctgccccggcccagaattgtgtccctgctgagcagccacagccaccacagcagccagaaggccaccccagctgaggaggtggaggacagcaatgacagcagctacagcgagcccccagatgtgcagcagcagctgaaccactaccagagcgctgccctggccaggaacaacagccgggtgtcccctgtgcccctgtctggagctgctgctggaacagagcagaagacagaagctgtgctgcactgtgagttctgtgagttcagcagcggctacatccagagcatcagaagacactacagagacaagcacggcggcaagaagctgttcaagtgcaaggactgcagcttctacacaggcttcaagagcgccttcaccatgcacgtggaggccggccacagcgctgtgcctgaggagggccccaaggacctgcgctgccccctgtgcctgtaccacaccaagtacaagaggaacatgattgaccacatcgtgctgcaccggggcaacctgagcaacctggtgttcctggatgctgctgggggccggcagcagcgctggcccagcagagatgccctgtctgagtggcagtag

SEQ ID NO: 17932 - DNA, 7701 bp, Artificial Sequence
  Description of Artificial Sequence: Synthetic coding sequence
atggaggtgctgcagtgtgatggctgtgacttccgggcccccagctatgaggacctgaaggcccacatccaggatgtgcacacagccttcctgcagcccacagatgtggccgaggacaacgtgaatgagctgcgctgtggctctgtgaatgccagcaaccagacagaggtggagttcagcagcatcaaggatgaatttgccatcgccgaggacctgagcggccagaatgccaccagcctgggcaccggcggctactacggccacagccctggctactacggccagcacatcgccgccaaccccaagcccaccaacaagttcttccagtgcaagttctgtgtgcgctacttccgcagcaagaacctgctgattgagcacaccaggaaggtgcatggagcccaggccgagggcagcagcagcggcccccctgtgcccggcagcctgaactacaacatcatgatgcatgagggctttgggaaggtgttcagctgccagttctgcacctacaagagcccccggcgggcccgcatcatcaagcaccagaagatgtaccacaagaacaacctgaaggagaccacagcccctcctccagccccagcccccatgccagaccctgtggtgccccctgtgtccctgcaggacccctgcaaggagctgcctgctgaggtggtggagaggagcatcctggagagcatggtgaagcccctgaccaagagccggggcaacttctgctgtgagtggtgcagctaccagaccccccggcgggagcgctggtgtgaccacatgatgaagaagcaccgctccatggtgaagatcctgagcagcctgcggcagcagcaggagggcaccaacctgcctgatgtgcccaacaagagcgcccccagccccaccagcaacagcacctacctgaccatgaatgctgccagccgggagatccccaacaccaccgtgagcaacttccggggctccatgggcaacagcatcatgaggcccaacagcagcgccagcaagttcagccccatgagctacccccagatgaagcccaagagcccccacaacagcggcctggtgaacctgacagagaggagccgctatggcatgacagacatgaccaacagcagcgctgacctggagaccaacagcatgctgaatgacagcagcagtgatgaggagctgaatgaaattgattctgaaaatggcctgagcgccatggaccaccagaccagcggcctgtctgctgagcagctgatgggcagtgatggcaacaagctgctggagaccaagggcatccccttccgccgcttcatgaaccgcttccagtgccccttctgccccttcctgaccatgcacagaagaagcatcagccgccacatcgagaacatccacctgagcggcaagacagctgtgtacaagtgtgatgagtgccccttcacctgcaagagcagcctgaagctgggcgcccacaagcagtgccacacaggcaccaccagtgactgggatgctgtgaacagccagagcgagagcatcagcagcagcctgaatgaaggagtggtgtcctatgagagcagcagcatcaatggaaggaagagcggcgtgatgctggaccccctgcagcagcagcagcccccccagcccccacctcctcctcctcctcctccacccagccagccccagcccctgcagcagccccagcccccccagctgcagcccccccaccaggtgcccccccagccccagacccagcccccacccacccagcagccccagccccccacccaggccgcccccctgcacccctacaagtgcaccatgtgcaactacagcaccaccaccctgaagggcctgcgggtgcaccagcagcacaagcacagcttctgtgacaacctgcccaagtttgagggccagcccagcagcctgcccctggagaatgaaacagacagccaccccagcagcagcaacacagtgaagaagagccagaccagcatcctgggcctgagcagcaagaacaactttgtggccaaggccagcaggaagctggccaatgacttccccctggacctgagccctgtgaagaagaggaccagaattgatgaaattgccagcaacctgcagagcaagatcaaccagaccaagcagcaggaggatgctgtgatcaacgtggaggatgatgaggaggaggaggaggacaatgaggtggagattgaggtggagctggaccgggaggaggagcccacagagcccatcatcgaggtgcccaccagcttcagcgcccagcagatctgggtgcgggacaccagcgagccccagaaggagcccaacttcaggaacatcacccatgactacaatgccaccaatggagctgagattgagctgaccctgtctgaagatgaggaggactactacggcagcagcaccaacctgaaggaccaccaggtgagcaacacagccctgctgaacacccagacccccatctatggaacagagcacaacagcgagaacacagactttggagacagcggccgcctgtactactgcaagcactgtgacttcaacaacaagagcgcccggtctgtgtccacccactaccagaggatgcacccctacatcaagttctccttccgctacatcctggaccccaatgaccacagcgctgtgtaccgctgcctggagtgctacatcgactacaccaactttgaggacctgcagcagcactatggagagcaccaccctgaggccatgaatgtgctgaactttgaccacagcgacctgatctaccgctgccgcttctgcagctacaccagccccaacgtgcgcagcctgatgccccactaccagaggatgcaccccaccgtgaagatcaacaatgccatgatcttcagcagctatgtggtggagcagcaggagggcctgaacacagagagccagaccctgcgggagatcctgaacagcgcccccaagaacatggccaccagcacccctgtggcccggggcggcggcctgcctgccaccttcaacaagaacacccccaagaccttcaccccagaatgtgagaaccagaaggaccccctggtgaacacagtggtggtgtatgactgtgatgtgtgcagctttgccagccccaacatgcacagcgtgctggtgcactaccagaagaagcaccctgaggagaaggccagctacttccgcatccagaagaccatgaggatggtgtctgtggaccggggcagcgccctgagccagctgagctttgaggtgggcgcccccatgagccccaagatgagcaacatgggcagccccccaccaccccagcccccacctccagacctgagcacagagctgtactactgcaagcactgcagctacagcaacagatctgtggtgggcgtgctggtgcactaccagaagaggcaccctgagatcaaggtgacagccaagtacatccggcaggccccacccacagctgccatgatgagaggagtggagggcccccagggcagcccccggcccccagcccccatccagcagctgaacagaagcagcagcgagagagatggcccccctgtggagaatgagatgttcttctgccagcactgtgactatggcaacagaacagtgaagggcgtgctgatccactaccagaagaagcaccgggacttcaaggccaatgctgatgtgatccggcagcacacagccaccatccgcagcctgtgtgacaggaaccagaagaagccagccagctgtgtgctggtgagccccagcaacctggagcgggacaagaccaagctgcgggccctgaagtgccggcagtgcagctacaccagcccctacttctacgccctgaggaagcacatcaagaaggaccacccagccctgaaggccaccgtgaccagcatcatgcgctgggccttcctggatggcctcatcgaggccggctaccactgtgagtggtgcatctacagccacacagagcccaacggcctgctgctgcactaccagaggaggcaccctgagcactacgtggactacacctacatggccaccaagctgtgggccggccctgaccccagcccccccagcctgaccatgcctgctgaggccaagacctaccgctgccgggactgtgtgtttgaggccgtgtccatctgggacatcaccaaccactaccaggccttccacccctgggccatgaatggagatgaatctgtgctgctggacatcatcaaggagaaggatgctgtggagaagcccatcctgagcagcgaggagctggccggccctgtgaactgtgagaacagcatccccacccccttccctgagcaggaggctgaatgtccagaagatgcccggctgagccctgagaagagcctgcagctggccagcgccaacccagccatcagcagcaccccctaccagtgcaccgtgtgccagagcgagtacaacaacctgcacggcctgctgacccactacggcaagaagcaccctggcatgaaggtgaaggctgctgactttgcccaggacatcgacatcaaccctggagctgtgtacaagtgccgccactgcccctacatcaacacccgcatccacggcgtgctgacccactaccagaagaggcaccccagcatcaaggtgacagctgaggactttgtgcatgatgtggagcagagcgctgacatcagccagaatgatgtggaggagaccagccgcatcttcaagcagggctacggggcctaccgctgcaagctgtgcccctacacccacggcaccctggagaagctgaagatccactatgagaagtaccacaaccagcctgagtttgatgtgttcagccagagcccccccaagctgcctgtgcccctggagcctgagatgaccacagaggtgagccccagccaggtgtccatcacagaggaggaggtgggggaggagcctgtgtccaccagccacttcagcaccagccacctggtgagccacacagtgttccgctgccagctgtgcaagtacttctgcagcaccaggaaaggaattgcccggcactaccgcatcaagcacaacaacgtgcgggcccagcctgagggcaagaacaacctcttcaagtgtgccctgtgtgcctacaccaaccccatcaggaagggcctggccgcccactaccagaagagacatgacattgatgcctactacacccactgcctggccgccagcaggaccatcagtgacaagcccaacaaggtgatcatccccagcccccccaaggatgacagcccccagctgtctgaggagctgcggcgggctgtggagaagaagaagtgcagcctgtgcagcttccagagcttcagcaagaagggcatcgtgagccactacatgaagaggcaccctggggtcttccccaagaagcagcacgccagcaagctgggcggctacttcaccgctgtgtatgcagatgaacatgagaagcccaccctgatggaggaggaggagcggggcaactttgagaaggccgaggtggagggggaggcccaggagattgagtggctgcccttccgctgcatcaagtgcttcaagctgtccttcagcacagctgagctgctgtgcatgcactacacagaccaccacagccgggacctgaagagggacttcatcatcctgggcaatggcccccggctgcagaacagcacctaccagtgcaagcactgtgacagcaagctgcagagcacagctgagctgaccagccacctgaacatccacaatgaggagttccagaagagggccaagaggcaggagaggaggaagcagctgctgagcaagcagaagtatgcagatggagcctttgctgacttcaagcaggagcggcccttcggccacctggaggaggtgcccaagatcaaggagaggaaggtggtgggctacaagtgcaagttctgtgtggaggtgcaccccaccctgcgggccatctgcaaccacctgaggaagcacgtgcagtatggaaatgtgcctgctgtgtctgctgctgtgaaggaggctgatgatcctgcccacctgttcctggatggcctggaggccgccaaggatgccagcggggccctggtgggccgggtggatggagagcactgcctgctggatggcatgctggaggatgagaccaggcctgggggctaccactgcagccagtgtgacagagtgctgatgtccatgcagggcctgcggagccatgagaggagccacctggccctggccatgttcacccgggaggacaagtacagctgccagtactgcagctttgtgtctgccttccgccacaacctggacagacacatgcagacccaccacggccaccacaagcccttccgctgcaagctgtgcagcttcaagagcagctacaacagccggctgaagacccacatcctgaaggcccacgccggggagcacgcctacaagtgctcctggtgcagcttcagcaccatgaccatcagccagctgaaggagcacagcctgaaggtgcacggcaaggccctgaccctgccccggcccagaattgtgtccctgctgagcagccacagccaccacagcagccagaaggccaccccagctgaggaggtggaggacagcaatgacagcagctacagcgagcccccagatgtgcagcagcagctgaaccactaccagagcgctgccctggccaggaacaacagccgggtgtcccctgtgcccctgtctggagctgctgctggaacagagcagaagacagaagctgtgctgcactgtgagttctgtgagttcagcagcggctacatccagagcatcagaagacactacagagacaagcacggcggcaagaagctgttcaagtgcaaggactgcagcttctacacaggcttcaagagcgccttcaccatgcacgtggaggccggccacagcgctgtgcctgaggagggccccaaggacctgcgctgccccctgtgcctgtaccacaccaagtacaagaggaacatgattgaccacatcgtgctgcaccgggaggagcgggtggtgcccatcgaggtgtgccgcagcaagctgagcaagtacctgcagggcgtggtgttccgctgtgacaagtgcaccttcacctgcagcagtgatgagagcctgcagcagcacatcgagaagcacaatgagctgaagccctacaagtgccagctgtgctactatgagaccaagcacacagaggagctggacagccacctgagagatgagcacaaggtgtccaggaactttgagctggtgggccgggtgaacctggaccagctggagcagatgaaggagaagatggagagcagcagcagtgatgatgaggacaaggaggaggagatgaacagcaaggccgaggaccgggagctgatgaggttcagtgaccacggggccgccctgaacacagagaagcgcttcccctgtgagttctgtggccgggccttcagccagggcagcgagtgggagcggcacgtgctgcggcacggcatggccctgaatgacaccaagcaggtgtcccgggaggagatccaccccaaggagatcatggagaacagcgtgaagatgcccagcattgaggagaaggaggatgatgaggccatcggcatcgacttcagcctgaagaatgaaacagtggccatctgtgtggtgacagctgacaagagcctgctggagaatgctgaggccaagaaggagtag

SEQ ID NO: 17933 - DNA, 1392 bp, Artificial Sequence
  Description of Artificial Sequence: Synthetic coding sequence
atgcagacccaccacggccaccacaagcccttccgctgcaagctgtgcagcttcaagagcagctacaacagccggctgaagacccacatcctgaaggcccatgctggggagcacgcctacaagtgctcctggtgcagcttcagcaccatgaccatcagccagctgaaggagcacagcctgaaggtgcacggcaaggccctgaccctgccccggccccgcatcgtgtccctgctgagcagccacagccaccacagcagccagaaggccaccccagctgaggaggtggaggacagcaatgacagcagctacagcgagcccccagatgtgcagcagcagctgaaccactaccagagcgctgccctggccaggaacaacagccgggtgtcccctgtgcccctgagcggggctgctgctggaacagagcagaagacagaggccgtgctgcactgtgagttctgtgagttcagcagcggctacatccagagcatccgccgccactacagagacaagcatggaggcaagaagctgttcaagtgcaaggactgcagcttctacacaggcttcaagagcgccttcaccatgcacgtggaggccggccacagcgctgtgcctgaggagggccccaaggacctgcgctgccccctgtgcctgtaccacaccaagtacaagaggaacatgattgaccacatcgtgctgcaccgggaggagcgggtggtgcccatcgaggtgtgccgcagcaagctgagcaagtacctgcagggcgtggtgttccgctgtgacaagtgcaccttcacctgcagcagtgatgagagcctgcagcagcacatcgagaagcacaatgagctgaagccctacaagtgccagctgtgctactatgagaccaagcacacagaggagctggacagccacctgagagatgagcacaaggtgtccaggaactttgagctggtgggccgggtgaacctggaccagctggagcagatgaaggagaagatggagagcagcagcagtgatgatgaggacaaggaggaggagatgaacagcaaggcagaagatcgggagctgatgaggttcagtgaccatggagctgccctgaacacagagaagcgcttcccctgtgagttctgtggccgggccttcagccagggcagcgagtgggagagacatgtgctgcggcacggcatggccctgaatgacaccaagcaggtgtcccgggaggagatccaccccaaggagatcatggagaacagcgtgaagatgcccagcattgaggagaaggaggatgatgaggccatcggcatcgacttcagcctgaagaatgagaccgtggccatctgtgtggtgacagctgacaagagcctgctggagaatgctgaggccaagaaggagtag

SEQ ID NO: 17934 - DNA, 1569 bp, Artificial Sequence
  Description of Artificial Sequence: Synthetic coding sequence
atggccctgccccagggcctgctgaccttcagagatgtggccatcgagttcagccaggaggagtggaagtgcctggaccctgcccagaggaccctgtacagagatgtgatgctggagaactacagaaacctggtgtccctggacatcagcagcaagtgcatgctgaagaccctgagcagcacaggccagggcaacacagaggtgatccacacaggcaccctgcaccggcaggccagccaccacatcggggagttctgcttccacgagattgagaaggacatccacggctttgagttccagtggaaggaggatgagaccaatggacatgctgcccccatgacagagatcaaggagctggccggcagcacaggccagcacgaccagagacatgctggcaacaagaggatcaaggaccagctgggcagcagcttccacctgcacctgcctgagccccacatcttccagagcgagggcaagattggcaaccaggtggagaagagcatcaacaatgccagctctgtgtccaccagccagaggatctgctgccggcccaagacccacatcagcaacaagtatggcaacaacagcctgcacagcagcctgctgacccagaagtgggaggtgcacatgagggagaagagctttgagtgcatccagagcttcaagagcttcaactgcagcagcctgctgaagaagcaccagatcatccacctggaggagaagcagtgcaagtgtgatgtgtgtgggaaggtgttcaaccagaagcgctacctggcctgccaccggcgctgccacactggagagaagccctacaagtgcaatgaatgtgggaagaccttcggccacaacagcagcctcttcatccacaaggccctgcacactggagagaagccctatgaatgtgaagaatgtgacaaggtgttcagcaggaagagccacctggagcggcacaagaggatccacactggagagaagccctacaagtgcaaggtgtgtgatgaggcctttgcctacaacagctacctggccaagcacaccatcctgcacactggagagaagccctacacctgcaatgaatgtgggaaggtgttcaaccggctgagcaccctggcccggcaccaccggctgcacactggagagaagccctacaagtgtgaagaatgtgacaaggtgttcagcaggaagagccacctggagcggcaccggcgcatccacagcggggagaagccctacaagtgtgaggagtgctgcaaggtgttcagcaggaagagcaacctggagcggcaccggcgcatccacactggagagaagccctacaagtgcaaggtgtgtgacaaggccttccagagggacagccacctggcccagcaccagagggtgcacactggagagaagccctacaagtgcaatgaatgtgggaagaccttcggccagaccagcagcctcatcatccaccggcggctgcacactggagagaagccctacaagtgcaatgaatgtgggaagaccttcagccagatgagcagcctggtgtaccaccaccggctgcacagcggggagaagccctag

SEQ ID NO: 17935 - DNA, 1410 bp, Artificial Sequence
  Description of Artificial Sequence: Synthetic coding sequence
atgctgaagaccctgagcagcacaggccagggcaacacagaggtgatccacacaggcaccctgcaccggcaggccagccaccacatcggggagttctgcttccatgaaattgagaaggacatccacggctttgagttccagtggaaggaggatgagaccaacggccatgctgcccccatgacagagatcaaggagctggccggcagcacaggccagcacgaccagagacatgctggcaacaagaggatcaaggaccagctgggcagcagcttccacctgcacctgcctgagccccacatcttccagagcgagggcaagattggcaaccaggtggagaagagcatcaacaatgccagctctgtgtccaccagccagaggatctgctgccggcccaagacccacatcagcaacaagtatggcaacaacagcctgcacagcagcctgctgacccagaagtgggaggtgcacatgagggagaagagctttgagtgcatccagagcttcaagagcttcaactgcagcagcctgctgaagaagcaccagatcatccacctggaggagaagcagtgcaagtgtgatgtgtgtgggaaggtgttcaaccagaagcgctacctggcctgccaccggcgctgccacactggagagaagccctacaagtgcaatgaatgtgggaagaccttcggccacaacagcagcctcttcatccacaaggccctgcacactggagagaagccctatgaatgtgaggagtgtgacaaggtgttcagcaggaagagccacctggagcggcacaagaggatccacactggagagaagccctacaagtgcaaggtgtgtgatgaggcctttgcctacaacagctacctggccaagcacaccatcctgcacactggagagaagccctacacctgcaatgaatgtgggaaggtgttcaaccggctgagcaccctggcccggcaccaccggctgcacactggagagaagccctacaagtgtgaggagtgtgacaaggtgttcagcaggaagagccacctggagcggcaccggcgcatccacagcggggagaagccctacaagtgtgaggagtgctgcaaggtgttcagcaggaagagcaacctggagcggcaccggcgcatccacactggagagaagccctacaagtgcaaggtgtgtgacaaggccttccagagggacagccacctggcccagcaccagagggtgcacactggagagaagccctacaagtgcaatgaatgtgggaagaccttcggccagaccagcagcctcatcatccaccggcggctgcacactggagagaagccctacaagtgcaatgaatgtgggaagaccttcagccagatgagcagcctggtgtaccaccaccggctgcacagcggggagaagccctag

SEQ ID NO: 17936 - DNA, 654 bp, Artificial Sequence
  Description of Artificial Sequence: Synthetic coding sequence
gtcttcaaccagaagcgctacctggcctgccaccggcgctgccacactggagagaagccctacaagtgcaatgaatgtgggaagaccttcggccacaacagcagcctcttcatccacaaggccctgcacactggagagaagccctatgaatgtgaagaatgtgacaaggtgttcagcaggaagagccacctggagcggcacaagaggatccacactggagagaagccctacaagtgcaaggtgtgtgatgaggcctttgcctacaacagctacctggccaagcacaccatcctgcacactggagagaagccctacacctgcaatgaatgtgggaaggtgttcaaccggctgagcaccctggcccggcaccaccggctgcacactggagagaagccctacaagtgtgaagaatgtgacaaggtgttcagcaggaagagccacctggagcggcaccggcgcatcgtggagaggaacctgaccaacgtgaagaatgtggccaagttcagcagccagatcaagccaggcaagacccaggagttcatcctggagaggaaccacaccaacgtgcgctttgtgacccggctgagccggggcatccacacctggcacaacatccgggagttcatcctggagaggaacctgacctctgtgtag

SEQ ID NO: 17937 - DNA, 1410 bp, Artificial Sequence; identical to SEQ ID NO: 17935
  Description of Artificial Sequence: Synthetic coding sequence

SEQ ID NO: 17938 - DNA, 1569 bp, Artificial Sequence; identical to SEQ ID NO: 17934
  Description of Artificial Sequence: Synthetic coding sequence

SEQ ID NO: 17939 - DNA, 2154 bp, Artificial Sequence
  Description of Artificial Sequence: Synthetic coding sequence
atgaagagccaggaggaggtggaggtggccggcatcaagctgtgcaaggccatgagcctgggctctgtgaccttcacagatgtggccatcgacttcagccaggatgagtgggagtggctgaacctggcccagaggagcctgtacaagaaggtgatgctggagaactacagaaacctggtgtctgtgggcctgtgcatcagcaagccagatgtgatcagcctgctggagcaggagaaggacccctgggtgatcaagggcggcatgaacagaggcctgtgcccagacctggagtgtgtgtgggtgaccaagagcctgagcctgaaccaggacatctatgaggagaagctgcccccagccatcatcatggagcggctgaagagctatgacctggagtgcagcaccctgggcaagaactggaagtgtgaggacctgtttgagcgggagctggtgaaccagaagacccacttccggcaggagaccatcacccacatcgacaccctcatcgagaagagggaccacagcaacaagtctggaacagtgttccacctgaacaccctgagctacatcaagcagatcttccccatggaggagcgcatcttcaacttccacacagacaagaagagcctgaagacccacagcgtggtgaagaagcacaagcaggacagaggagagaagaagctgctgaagtgcaatgactgtgagaagatcttcagcaagatcagcaccctgaccctgcaccagaggatccacactggagagaagccctatgaatgtattgaatgtgggaaggccttcagccagagcgcccacctggcccagcaccagaggatccacactggagagaagccctttgaatgtacagaatgtgggaaggccttcagccagaatgcccacctggtgcagcaccagagggtgcacactggagagaagccctaccagtgcaagcagtgcaacaaggccttcagccagctggcccacctggcccagcaccagagggtgcacactggagagaagccctatgaatgtattgaatgtgggaaggccttcagtgactgcagcagcctggcccaccaccggcgcatccacacaggcaagaggccctatgaatgtattgactgtgggaaggccttccggcagaatgccagcctcatccgccaccggcgctactaccacactggagagaagccctttgactgcatcgactgtgggaaggccttcacagaccacatcggcctcatccagcacaagaggacccacactggagagcggccctacaagtgcaatgtgtgtgggaaggccttcagccacggcagcagcctgactgtgcaccagaggatccacactggagagaagccctatgagtgcaacatctgtgagaaggccttcagccaccggggcagcctgaccctgcaccagagggtgcacactggagagaagccctatgagtgcaaggaatgtgggaaggccttccggcagagcacccacctggcccaccaccagaggatccacactggagagaagccctatgagtgcaaggaatgttccaagaccttcagccagaatgcccacctggcccagcaccagaagatccacactggagagaagccctatgagtgcaaggaatgtgggaaggccttcagccagatcgcccacctggtgcagcaccagagggtgcacactggagagaagccctatgagtgcattgaatgtgggaaggccttcagtgatggcagctacctggtgcagcaccagaggctgcacagcggcaagaggccctatgagtgcctggagtgtgggaaggccttccggcagagggccagcctcatctgccaccagcgctgccacactggagagaagccctatgagtgcaatgtgtgtgggaaggccttcagccacaggaagagcctgaccctgcaccagaggatccacactggagagaagccctatgagtgcaaggaatgttccaaggccttcagccaggtggcccacctgaccctgcacaagaggatccacactggagagcggccctatgagtgcaaggaatgtgggaaggccttccggcagagcgtgcacctggcccaccaccagaggatccacactggagagagcagcgtcatcctgagcagcgccctgccctaccaccaggtgctgtag

SEQ ID NO: 17940 - DNA, 2154 bp, Artificial Sequence; identical to SEQ ID NO: 17939
  Description of Artificial Sequence: Synthetic coding sequence

SEQ ID NO: 17941 - DNA, 1881 bp, Artificial Sequence
  Description of Artificial Sequence: Synthetic coding sequence
atgaatgtggaggtggtgaaggtgatgccccaggacctggtgaccttcaaggatgtggccatcgacttcagccaggaggagtggcagtggatgaacccagcccagaagaggctgtaccgctccatgatgctggagaactaccagagcctggtgtccctgggcctgtgcatcagcaagccctacgtgatcagcctgctggagcagggccgggagccctgggagatgaccagcgagatgaccaggagccccttcagtgactgggagagcatctacgtgacccaggagctgcccctgaagcagttcatgtatgatgatgcctgcatggagggcatcaccagctatggcctggagtgcagcacctttgaggagaactggaagtgggaggacctgtttgagaagcagatgggcagccatgagatgttcagcaagaaggagatcatcacccacaaggagaccatcaccaaggagacagagttcaagtacaccaagtttgggaagtgcatccacctggagaacatcgaggagagcatctacaaccacaccagtgacaagaagagcttcagcaagaacagcatggtgatcaagcacaagaaggtgtatgtgggcaagaagctgttcaagtgcaatgaatgtgacaagaccttcacccacagcagcagcctgactgtgcacttccgcatccacactggagagaagccctatgcctgtgaggagtgtgggaaggccttcaagcagaggcagcacctggcccagcaccacaggacccacactggagagaagctgtttgagtgcaaggagtgcaggaaggccttcaagcagagcgagcacctgatccagcaccagaggatccacactggagagaagccctacaagtgcaaggagtgcaggaaggccttccggcagcctgcccacctggcccagcaccagaggatccacactggagagaagccctatgagtgcaaggaatgtgggaaggccttcagtgatggcagcagctttgcccggcaccagcgctgccacacaggcaagaggccctatgaatgtattgaatgtgggaaggccttccgctacaacaccagcttcatccgccactggaggagctaccacactggagagaagcccttcaactgcatcgactgtgggaaggccttctctgtgcacatcggcctcatcctgcaccggcgcatccacactggagagaagccctacaagtgtggggtgtgtgggaagaccttcagcagcggcagcagcaggacagtgcaccagaggatccacactggagagaagccctatgaatgtgacatctgtgggaaggacttcagccaccacgccagcctgacccagcaccagagggtgcacagcggggagaagccctatgagtgcaaggaatgtgggaaggccttccggcagaatgtgcacctggtgagccacctgcgcatccacactggagagaagccctatgagtgcaaggaatgtgggaaggccttccgcatcagcagccagctggccacccaccagaggatccacactggagagaagccctatgagtgcattgaatgtggaaatgccttcaagcagaggagccacctggcccagcaccagaagacccacactggagagaagccctatgagtgcaatgaatgtgggaaggccttcagccagaccagcaacctgacccagcaccagaggatccacactggagagaagccctacaagtgcacagaatgtgggaaggccttcagtgacagcagcagctgtgcccagcaccagaggctgcacacaggccagaggccctaccagtgctttgaatgtgggaaggccttccggaggaagctgagcctcatctgccaccagaggagccacactggagaggagccctag

SEQ ID NO: 17942 - DNA, 2616 bp, Artificial Sequence
  Description of Artificial Sequence: Synthetic coding sequence
atggccgaggagtttgtgaccctgaaggatgtgggcatggacttcaccctgggggactgggagcagctgggcctggagcagggcgacaccttctgggacacagccctggacaactgccaggacctcttcctgctggaccccccccggcccaacctgaccagccacccagatggcagcgaggacctggagcccctggccggcggcagccctgaggccaccagcccagatgtgacagagaccaagaacagccccctgatggaggacttctttgaggagggcttcagccaggagatcatcgagatgctgagcaaggatggcttctggaacagcaactttggagaggcctgcatcgaggacacctggctggacagcctgctgggggaccctgagagcctgctgcggagtgacatcgccaccaacggggagagccccacagagtgcaagagccatgagctgaagaggggcctgagccctgtgtccacagtgtccactggagaggacagcatggtgcacaacgtgtctgagaagaccctgaccccagccaagagcaaggagtacagaggagagttcttctcctacagcgaccacagccagcaggacagcgtgcaggagggggagaagccctaccagtgcagtgaatgtgggaagagcttcagcggcagctaccgcctgacccagcactggatcacccacacccgggagaagcccaccgtgcaccaggagtgtgagcagggctttgacagaaatgccagcctgtctgtgtaccccaagacccacacaggctacaagttctacgtgtgcaatgaatatggcaccaccttcagccagagcacctacctgtggcaccagaagacccacactggagagaagccctgcaagagccaggacagcgaccacccccccagccatgacacccagcctggagagcaccagaagacccacacagacagcaagagctacaactgcaatgaatgtgggaaggccttcacccgcatcttccacctgaccaggcaccagaagatccacaccaggaagagatatgagtgcagcaagtgccaggccaccttcaacctgaggaagcacctgatccagcaccagaagacccacgccgccaagaccaccagcgagtgccaggagtgtgggaagatcttccgccacagcagcctgctgattgagcaccaggccctgcacgccggggaggagccctacaagtgcaatgaaagaggcaagagcttccgccacaacagcaccctgaagatccaccagagggtgcacagcggggagaagccctacaagtgcagtgaatgtgggaaggccttccaccgccacacccacctgaatgagcaccggcgcatccacacaggctaccggccccacaagtgccaggagtgtgtgcgctccttcagccggcccagccacctgatgaggcaccaggccatccacacagctgagaagccctacagctgtgccgagtgcaaggagaccttcagtgacaacaaccggctggtgcagcaccagaagatgcacacagtgaagaccccctatgagtgccaggagtgtggggagcgcttcatctgtggcagcaccctgaagtgccatgaatctgtgcacgcccgggagaagcagggcttctttgtgtctgggaagatcctggaccagaaccctgagcagaaggagaagtgcttcaagtgcaacaagtgtgagaagaccttcagctgcagcaagtacctgacccagcacgagcgcatccacacccggggcgtgaagccctttgaatgtgaccagtgtgggaaggccttcggccagagcaccaggctcatccaccaccagaggatccacagccgggtgcggctgtacaagtggggcgagcagggcaaggccatcagcagcgccagcctcatcaagctgcagagcttccacaccaaggagcaccccttcaagtgcaatgaatgtgggaagaccttcagccacagcgcccacctgagcaagcaccagctgattcatgctggggagaaccccttcaagtgcagcaaatgtgacagagtcttcacccagaggaactacctggtgcagcacgagaggacccacgccaggaagaagcccctggtgtgcaatgaatgtgggaagaccttccggcagagcagctgcctgagcaagcaccagaggatccacagcggggagaagccctacgtgtgtgactactgcggcaaggccttcggcctgtctgctgagctggtgcgccaccagaggatccacactggagagaagccctacgtgtgccaggagtgtgggaaggccttcacccagagcagctgcctgagcatccacagaagagtgcacactggagagaagccctaccgctgtggggagtgtgggaaggcctttgcccagaaggccaacctgacccagcaccagaggatccacactggagagaagccctacagctgcaatgtgtgtgggaaggcctttgtgctgagcgcccacctgaaccagcacctgcgggtgcacacccaggagaccctgtaccagtgccagcgctgccagaaggccttccgctgccacagcagcctgagccgccaccagagggtgcacaacaagcagcagtactgcctgtag

SEQ ID NO: 17943 - DNA, 2616 bp, Artificial Sequence; identical to SEQ ID NO: 17942
  Description of Artificial Sequence: Synthetic coding sequence

SEQ ID NO: 17944 - DNA, 2580 bp, Artificial Sequence
  Description of Artificial Sequence: Synthetic coding sequence
atggacttcaccctgggggactgggagcagctgggcctggagcagggcgacaccttctgggacacagccctggacaactgccaggacctcttcctgctggaccccccccggcccaacctgaccagccacccagatggcagcgaggacctggagcccctggccggcggcagccctgaggccaccagcccagatgtgacagagaccaagaacagccccctgatggaggacttctttgaggagggcttcagccaggagatcatcgagatgctgagcaaggatggcttctggaacagcaactttggagaggcctgcatcgaggacacctggctggacagcctgctgggggaccctgagagcctgctgcggagtgacatcgccaccaacggggagagccccacagagtgcaagagccatgagctgaagaggggcctgagccctgtgtccacagtgtccactggagaggacagcatggtgcacaacgtgtctgagaagaccctgaccccagccaagagcaaggagtacagaggagagttcttctcctacagcgaccacagccagcaggacagcgtgcaggagggggagaagccctaccagtgcagtgaatgtgggaagagcttcagcggcagctaccgcctgacccagcactggatcacccacacccgggagaagcccaccgtgcaccaggagtgtgagcagggctttgacagaaatgccagcctgtctgtgtaccccaagacccacacaggctacaagttctacgtgtgcaatgaatatggcaccaccttcagccagagcacctacctgtggcaccagaagacccacactggagagaagccctgcaagagccaggacagcgaccacccccccagccatgacacccagcctggagagcaccagaagacccacacagacagcaagagctacaactgcaatgaatgtgggaaggccttcacccgcatcttccacctgaccaggcaccagaagatccacaccaggaagagatatgagtgcagcaagtgccaggccaccttcaacctgaggaagcacctgatccagcaccagaagacccacgccgccaagaccaccagcgagtgccaggagtgtgggaagatcttccgccacagcagcctgctgattgagcaccaggccctgcacgccggggaggagccctacaagtgcaatgaaagaggcaagagcttccgccacaacagcaccctgaagatccaccagagggtgcacagcggggagaagccctacaagtgcagtgaatgtgggaaggccttccaccgccacacccacctgaatgagcaccggcgcatccacacaggctaccggccccacaagtgccaggagtgtgtgcgctccttcagccggcccagccacctgatgaggcaccaggccatccacacagctgagaagccctacagctgtgccgagtgcaaggagaccttcagtgacaacaaccggctggtgcagcaccagaagatgcacacagtgaagaccccctatgagtgccaggagtgtggggagcgcttcatctgtggcagcaccctgaagtgccatgaatctgtgcacgcccgggagaagcagggcttctttgtgtctgggaagatcctggaccagaaccctgagcagaaggagaagtgcttcaagtgcaacaagtgtgagaagaccttcagctgcagcaagtacctgacccagcacgagcgcatccacacccggggcgtgaagccctttgaatgtgaccagtgtgggaaggccttcggccagagcaccaggctcatccaccaccagaggatccacagccgggtgcggctgtacaagtggggcgagcagggcaaggccatcagcagcgccagcctcatcaagctgcagagcttccacaccaaggagcaccccttcaagtgcaatgaatgtgggaagaccttcagccacagcgcccacctgagcaagcaccagctgattcatgctggggagaaccccttcaagtgcagcaaatgtgacagagtcttcacccagaggaactacctggtgcagcacgagaggacccacgccaggaagaagcccctggtgtgcaatgaatgtgggaagaccttccggcagagcagctgcctgagcaagcaccagaggatccacagcggggagaagccctacgtgtgtgactactgcggcaaggccttcggcctgtctgctgagctggtgcgccaccagaggatccacactggagagaagccctacgtgtgccaggagtgtgggaaggccttcacccagagcagctgcctgagcatccacagaagagtgcacactggagagaagccctaccgctgtggggagtgtgggaaggcctttgcccagaaggccaacctgacccagcaccagaggatccacactggagagaagccctacagctgcaatgtgtgtgggaaggcctttgtgctgagcgcccacctgaaccagcacctgcgggtgcacacccaggagaccctgtaccagtgccagcgctgccagaaggccttccgctgccacagcagcctgagccgccaccagagggtgcacaacaagcagcagtactgcctgtag

SEQ ID NO: 17945 - DNA, 2616 bp, Artificial Sequence; identical to SEQ ID NO: 17942
  Description of Artificial Sequence: Synthetic coding sequence

SEQ ID NO: 17946 - DNA, 1575 bp, Artificial Sequence
  Description of Artificial Sequence: Synthetic coding sequence
atggccaagaggcctggccccccaggcagccgggagatgggcctgctgaccttccgggacatcgccatcgagttcagcctggaggagtggcagtgcctggactgtgcccagaggaacctgtacagagatgtgatgctggagaactacagaaacctggtgtccctgggcattgctgtgtccaagccagacctgatcacctgcctggagcagaacaaggagagccagaacatcaagagaaatgagatggtggccaagcaccctgtgaccaggagccacttcacccaggacctgcagcctgagcagggcatcaaggacagcctgcagaaggtgatccccaggacctatggaaaatgtggccacgagaagctgcagttcaagaagtgctgcaagtctgtgggggagtatgaggtgcacaagggcggctacagcgaggtgaaccagtgcctgagcaccacccagaacaagatcttccagacccacaagtatgtgaaggtgtttgggaagttcagcaacagcaacagagacaagacccgctacacaggcaacaagcacttcaagtgcaacaagtatggcaagagcttctgcatgctgagccacctgaaccagcaccaggtgatccacacccgggagaagagctacaagtgcaaggaatgtgggaagagcttcaactgcagcagcaaccacaccacccacaagatcatccacactggagagaagccctaccgctgtgaagaatgtgggaaggccttctcctggagcgccaacctgaccaggcacaagaggacccacactggagagaagccctacacctgtgaagaatgtggccaggccttcagaagaagcagcgccctgaccaaccacaagaggatccacactggagagcggccctacaagtgtgaagaatgtgggaaggccttctctgtgagcagcaccctgacagaccacaagaggatccacactggagagaagccctgccgctgtgaagaatgtgggaaggccttctcctggagcagcaacctgaccaggcacaagaggatccacacccgggagaagccctatgcctgtgaagaatgtggccaggccttcagcctgagcagcaacctgatgaggcaccggcgcatccacactggagagaagccctacacctgtgaagaatgtggccaggacttcagaagaagcagcgccctgaccatccacaagaggatccacactggagagcggccctacaagtgtgaagaatgtgggaaggtgttcagcctgagcagcaccctgacagaccacaagaggatccacactggagagcggccctacaagtgtgaagaatgtgggaaggccttcagcctgagcagcaccctgacagaccacaagaggatccacactggagagcggccctacacctgtgaagaatgtgggaaggccttcaactgcagcagcaccctgatgcagcacaagaggatccacactggagagaagccctacaagtgtgaagaatgtgagcaggccttcaagtggcacagcagcctggccaagcacaagatcatccacactggagagaagccctacaagtgtgagtag

SEQ ID NO: 17947 - DNA, 1857 bp, Artificial Sequence
  Description of Artificial Sequence: Synthetic coding sequence
atggagagagctgtggagccctggggccctgacctgcacaggcctgaggagcgggagccccagagaggagccaggacaggcctgggctctgaaaatgtcatcagccagcccaatgaatttgagcacaccccccaggaggatgacctgggcttcaaggaggaggacctggccccagaccacgaggtgggcaatgccagcctgaagccagagggcatccagaactgggatgacctgtgggtgcagcgggagggcctgggcaagccccagccccgggaccggggcccccggctgctgggggagccccgctggggccaggccagcagtgacagagctgctgtgtgtggggagtgtgggaagagcttccggcagatgtctgacctggtgaagcaccagaggacccacactggagagaagccctacaagtgtggggtgtgtgggaaaggatttggagacagcagcgcccgcatcaagcaccagaggacccacagcggggagaagccctaccgggcccggcccccagcccagggcccccccaagatccccaggagccgcatcccagctggggagcggcccaccatctgtggggagtgtgggaagagcttccggcagagcagtgacctggtgaagcaccagaggacccacactggagagaagccctacaagtgtggcatctgtgggaaaggatttggagacagcagcgcccgcatcaagcaccagaggacccacagaggagagcagccccccaggcctgtggtgccccggcggcagcccagccgggccgccacagctgccacccagggccccaaggcccaggacaagccctacatctgcacagactgtgggaagagatttgtgctgagctgcagcctgctgagccaccagaggagccacctgggccccaagcccttcggctgtgatgtgtgtgggaaggagtttgcccggggcagtgacctggtgaagcacctgcgggtgcacactggagagaagccctacctgtgcccagaatgtgggaagggctttgctgacagcagcgcccgggtgaagcacctgcggacccacagcggggagcggccccacgcctgcccagaatgtgacaggaccttcagcctgagcagcaccctgctgcggcaccggctgacccacatggagccccaggacttctccttccctggctaccccctgcctgccctgatccccagccccccacctccacccctgggcaccagcccccccctgacccccaggagccccagccacagcggggagcccttcggcctgcccggcctggagcctgagcccggcggcccccaggccggggagcccccaccacccctggccggggacaagccccacaagtgcccagaatgtgggaagggcttcagaagaagcagtgacctggtgaagcaccaccgggtgcacactggagagaagccctacctgtgcccagaatgtgggaagggctttgctgacagcagcgcccgggtgaagcacctgcggacccacagaggagagcgggcccggcccccaccacccagcaccctgctgcggccccacaaccccccaggccctgtgcccatggccccccggccccgggtgcgggcccagcccagcggccccagccagccccacgtgtgtggcttctgtgggaaggagttccccaggagcagtgacctggtgaagcacaggaggacccacactggagagaagccctacaagtgtgctgaatgtgggaagggctttggagacagcagcgcccgcatcaagcaccagaggggccacctggtgctgaccccatttggaattggagatggccgggcccggcccctgaagcaggaggccgccaccggcctggagtag

SEQ ID NO: 17948 - DNA, 432 bp, Artificial Sequence
  Description of Artificial Sequence: Synthetic coding sequence
atggagagagctgtggagccctggggccctgacctgcacaggcctgaggagcgggagccccagagaggagccaggacaggcctgggctctgaaaatgtcatcagccagcccaatgaatttgagcacaccccccaggaggatgacctgggcttcaaggaggaggacctggccccagaccacgaggtgggcaatgccagcctgaagccagagggcatccagaactgggatgacctgtgggtgcagcgggagggcctgggcaagccccagccccgggaccggggcccccggctgctgggggagccccgctggggccaggccagcagtgacagagctgctgtgtgtggggagtgtgggaagagcttccggcagatgtctgacctggtgaagcaccagaggacccacactggagagaagccctacaagtgtggctag

SEQ ID NO: 17949 - DNA, 444 bp, Artificial Sequence
  Description of Artificial Sequence: Synthetic coding sequence
atggagagagctgtggagccctggggccctgacctgcacaggcctgaggagcgggagccccagagaggagccaggacaggcctgggctctgaaaatgtcatcagccagcccaatgaatttgagcacaccccccaggaggatgacctgggcttcaaggaggaggacctggccccagaccacgaggtgggcaatgccagcctgaagccagagggcatccagaactgggatgacctgtgggtgcagcgggagggcctgggcaagccccagccccgggaccggggcccccggctgctgggggagccccgctggggccaggccagcagtgacagagctgctgtgtgtggggagtgtgggaagagcttccggcagatgtctgacctggtgaagcaccagaggacccacactggagagaagccctacaagtgtggggtgtgtgggaagtag

SEQ ID NO: 17950 - DNA, 2235 bp, Artificial Sequence
  Description of Artificial Sequence: Synthetic coding sequence
atgcaggccgtggtgcccctgaacaagatgacagccatcagccctgagccccagaccctggccagcacagagcagaatgaggtgccccgggtggtgaccagcggggagcaggaggccatcctgcggggaaatgctgctgatgctgagagcttccggcagcgcttccgctggttctgctacagcgaggtggccggccccaggaaggccctgagccagctgtgggagctgtgcaaccagtggctgcggccagacatccacaccaaggagcagatcctggagctgctggtgtttgagcagttcctgaccatcctgcctggagagatccgcatctgggtgaagagccagcaccctgagagcagcgaggaggtggtgaccctgattgaggacctgacccagatgctggaggagaaggaccctgtgtcccaggacagcacagtgtcccaggaggagaacagcaaggaggacaagatggtgacagtgtgccccaacacagagagctgtgagagcatcaccctgaaggatgtggccgtgaacttcagcagaggagagtggaagaagctggagcccttccagaaggagctgtacaaggaggtgctgctggagaacctgaggaacctggagttcctggacttccctgtgtccaagctggagctgatcagccagctgaagtgggtggagctgccctggctgctggaggaggtgtccaagagcagccggctggatgaaagtgccctggacaagatcatcgagcgctgcctgagagatgatgaccacggcctgatggaggagagccagcagtactgcggcagcagtgaagaagatcatggcaaccagggcaacagcaagggccgggtggcccagaacaagaccctgggcagcggcagccggggcaagaagtttgatcctgacaagagccccttcggccacaacttcaaggagaccagtgacctgatcaagcacctgcgggtgtacctgaggaagaagagccgccgctacaatgaaagcaagaagcccttctccttccacagcgacctggtgctgaacaggaaggagaagacagctggggagaagagcaggaagagcaatgatggcggcaaggtgctgagccacagcagcgccctgacagagcaccagaagaggcagaagatccacctgggggacaggagccagaagtgcagcaaatgtggcatcatcttcatcagaagaagcaccctgagcaggaggaagacccccatgtgtgagaagtgcaggaaggacagctgccaggaggccgccctgaacaaggatgagggcaatgaaagtggagagaagacccacaagtgcagcaaatgtgggaaggccttcggctacagcgccagcctgaccaagcaccggcgcatccacactggagagaagccctacatgtgcaatgaatgtgggaaggccttcagtgacagcagcagcctgaccccccaccacaggacccacagcggggagaagcccttcaagtgtgatgactgtgggaagggcttcaccctgagcgcccacctgatcaagcaccagaggatccacactggagagaagccctacaagtgcaaggactgtggccggcccttcagtgacagcagcagcctcatccagcaccagaggatccacactggagagaagccctacacctgcagcaactgtgggaagagcttcagccacagcagcagcctgagcaagcaccagaggatccacactggagagaagccctacaagtgtggagaatgtgggaaggccttccggcagaacagctgcctgaccaggcaccagaggatccacactggagagaagccctacctgtgcaatgactgtggcatgaccttcagccacttcaccagcgtcatctaccaccagaggctgcacagcggggagaagccctacaagtgcaaccagtgtgagaaggccttccccacccacagcctgctgagccgccaccagaggatccacactggagtgaagccctacaagtgcaaggaatgtgggaagagcttcagccagagcagcagcctgaatgagcaccaccgcatccacactggagagaagccctatgagtgcaactactgtggggccaccttcagccgcagcagcatcctggtggagcacctgaagatccacacaggccggcgggagtatgagtgcaatgaatgtgagaagaccttcaagagcaacagcggcctcatccgccaccggggcttccacagcgctgagtag

SEQ ID NO: 17951 - DNA, 735 bp, Artificial Sequence
  Description of Artificial Sequence: Synthetic coding sequence
atgcaggccgtggtgcccctgaacaagatgacagccatcagccctgagccccagaccctggccagcacagagcagaatgaggtgccccgggtggtgaccagcggggagcaggaggccatcctgcggggaaatgctgctgatgctgagagcttccggcagcgcttccgctggttctgctacagcgaggtggccggccccaggaaggccctgagccagctgtgggagctgtgcaaccagtggctgcggccagacatccacaccaaggagcagatcctggagctgctggtgtttgagcagttcctgaccatcctgcctggagagatccgcatctgggtgaagagccagcaccctgagagcagcgaggaggtggtgaccctgattgaggacctgacccagatgctggaggagaaggaccctgtgtcccaggacagcacagtgtcccaggaggagaacagcaaggaggacaagatggtgacagtgtgccccaacacagagagctgtgagagcatcaccctgaaggatgtggccgtgaacttcagcagaggagagtggaagaagctggagcccttccagaaggagctgtacaaggaggtgctgctggagaacctgaggaacctggagttcctggacttccctgtgtccaagctggagctgatcagccagctgaagtgggtggagctgccctggctgctggaggaggtgtccaagagcagccggctgggcagcgtcatctag

SEQ ID NO: 17952 - DNA, 771 bp, Artificial Sequence
  Description of Artificial Sequence: Synthetic coding sequence
atgcaggccgtggtgcccctgaacaagatgacagccatcagccctgagccccagaccctggccagcacagagcagaatgaggtgccccgggtggtgaccagcggggagcaggaggccatcctgcggggaaatgctgctgatgctgagagcttccggcagcgcttccgctggttctgctacagcgaggtggccggccccaggaaggccctgagccagctgtgggagctgtgcaaccagtggctgcggccagacatccacaccaaggagcagatcctggagctgctggtgtttgagcagttcctgaccatcctgcctggagagatccgcatctgggtgaagagccagcaccctgagagcagcgaggaggtggtgaccctgattgaggacctgacccagatgctggaggagaaggaccctgtgtcccaggacagcacagtgtcccaggaggagaacagcaaggaggacaagatggtgacagtgtgccccaacacagagagctgtgagagcatcaccctgaaggatgtggccgtgaacttcagcagaggagagtggaagaagctggagcccttccagaaggagctgtacaaggaggtgctgctggagaacctgaggaacctggagttcctggacttccctgtgtccaagctggagctgatcagccagctgaagtgggtggagctgccctggctgctggaggaggtgtccaagagcagccggctggacatccatggagctgtgaagaagatgcagatgttttctgaggccgagtag

SEQ ID NO: 17953 - DNA, 537 bp, Artificial Sequence
  Description of Artificial Sequence: Synthetic coding sequence
atgcaggccgtggtgcccctgaacaagatgacagccatcagccctgagccccagaccctggccagcacagagcagaatgaggtgccccgggtggtgaccagcggggagcaggaggccatcctgcggggaaatgctgctgatgctgagagcttccggcagcgcttccgctggttctgctacagcgaggtggccggccccaggaaggccctgagccagctgtgggagctgtgcaaccagtggctgcggccagacatccacaccaaggagcagatcctggagctgctggtgtttgagcagttcctgaccatcctgcctggagagatccgcatctgggtgaagagccagcaccctgagagcagcgaggaggtggtgaccctgattgaggacctgacccagatgctggaggagaagggggagatctaccgctggagggaggaggccggggacatcgccagcaagtctgagagcaagttcctgaagaggcggcagttcaccgccaaggaggagagcgaggtgcgctcctgggactgggtgtag

SEQ ID NO: 17954 - DNA, 2451 bp, Artificial Sequence
  Description of Artificial Sequence: Synthetic coding sequence
atgctggagaactacttcaacctgatctctgtgggctgccaggtgcccaagccagaggtgatcttcagcctggagcaggaggagccctgcatgctggatggagagatccccagccagagcaggccagatggagacatcggcttcggccccctgcagcagaggatgtctgaggaggtgtccttccagagcgagatcaacatcaacctcttcaccagagatgacccctacagcatcctggaggagctgtggaaggatgatgagcacaccaggaaatgtggggagaaccagaacaagcccctgagccgggtggtgttcatcaacaagaagaccctggccaatgacagcatctttgagtacaaggacatcggggagatcgtgcacgtgaacacccacctggtgagcagcaggaagaggccccacaactgcaacagctgtgggaagaacctggagcccatcatcaccctgtacaacagaaataatgccacagaaaattctgacaagaccatcggagatggagacatcttcacccacctgaacagccacacagaggtgacagcctgtgagtgcaaccagtgtgggaagcccctgcaccacaagcaggccctgatccagcagcagaagatccacacccgggagagcctgtacctgttcagtgactatgtgaatgtgttcagccccaagagccacgcctttgcccacgagagcatctgtgccgaggagaagcagcacgagtgccatgaatgtgaggccgtgttcacccagaagagccagctggatggcagccagagggtgtatgccggcatctgcacagaatatgagaaggacttcagcctgaagagcaaccggcagaagaccccctatgagggcaactactacaagtgcagcgactatggccgggccttcatccagaagagtgacctcttccgctgccagaggatccacagcggggagaagccctatgagtacagtgaatgtgagaagaacctgccccagaacagcaacctgaacatccacaagaagatccacactggaggcaagcactttgaatgtacagaatgtgggaaggccttcaccaggaagagcaccctgtccatgcaccagaagatccacactggagagaagccctacgtgtgcacagaatgtgggaaggccttcatcaggaagagccacttcatcacccatgagcgcatccacactggagagaagccctatgaatgtagtgactgtgggaagagcttcatcaagaagagccagctgcacgtgcaccagaggatccacactggagagaaccccttcatctgcagtgaatgtgggaaggtgttcacccacaagaccaacctgatcatccaccagaagatccacactggagagcggccctacatctgcaccgtgtgtgggaaggccttcacagacaggagcaacctgatcaagcaccagaagatccacactggagagaagccctacaagtgcagcgactgtgggaagagcttcacctggaagagccggctgcgcatccaccagaagtgccacactggagagcggcactatgaatgttctgaatgtgggaaggccttcatccagaagagcaccctgtccatgcaccagaggatccacagaggagagaagccctacgtgtgcacagaatgtgggaaggccttcttccacaagagccacttcatcacccatgagcgcatccacactggagagaagccctatgaatgttccatctgtgggaagagcttcaccaagaagagccagctgcacgtgcaccagcagatccacactggagagaagccctaccgctgtgccgagtgtgggaaggccttcacagacaggagcaacctcttcacccaccagaagatccacactggagagaagccctacaagtgcagcgactgtgggaaggccttcaccaggaagagcggcctgcacatccaccagcagagccacactggagagcggcactatgaatgttctgaatgtgggaaggcctttgccaggaagagcaccctcatcatgcaccagaggatccacactggagagaagccctacatctgcaatgaatgtgggaagagcttcatccagaagagccacctgaacagacaccggcgcatccacactggagagaagccctatgaatgtagtgactgtgggaagagcttcatcaagaagagccagctgcacgagcaccaccgcatccacactggagagaagccctacatctgtgccgagtgtgggaaggccttcaccatccgcagcaacctgatcaagcaccagaagatccacaccaagcagaagccctacaagtgcagcgacctgggcaaggccctgaactggaagccccagctgtccatgccccagaagagtgacaatggagaggtggagtgcagcatgccccagctgtggtgtggggacagcgagggggaccagggccagctgagcagcatctag

SEQ ID NO: 17955 - DNA, 2559 bp, Artificial Sequence
  Description of Artificial Sequence: Synthetic coding sequence
atgaccaagagcctggagagcgtgtccttcaaggatgtgacagtggacttcagcagagatgagtggcagcagctggacctggcccagaagagcctgtaccgggaggtgatgctggagaactacttcaacctgatctctgtgggctgccaggtgcccaagccagaggtgatcttcagcctggagcaggaggagccctgcatgctggatggagagatccccagccagagcaggccagatggagacatcggcttcggccccctgcagcagaggatgtctgaggaggtgtccttccagagcgagatcaacatcaacctcttcaccagagatgacccctacagcatcctggaggagctgtggaaggatgatgagcacaccaggaaatgtggggagaaccagaacaagcccctgagccgggtggtgttcatcaacaagaagaccctggccaatgacagcatctttgagtacaaggacatcggggagatcgtgcacgtgaacacccacctggtgagcagcaggaagaggccccacaactgcaacagctgtgggaagaacctggagcccatcatcaccctgtacaacagaaataatgccacagaaaattctgacaagaccatcggagatggagacatcttcacccacctgaacagccacacagaggtgacagcctgtgagtgcaaccagtgtgggaagcccctgcaccacaagcaggccctgatccagcagcagaagatccacacccgggagagcctgtacctgttcagtgactatgtgaatgtgttcagccccaagagccacgcctttgcccacgagagcatctgtgccgaggagaagcagcacgagtgccatgaatgtgaggccgtgttcacccagaagagccagctggatggcagccagagggtgtatgccggcatctgcacagaatatgagaaggacttcagcctgaagagcaaccggcagaagaccccctatgagggcaactactacaagtgcagcgactatggccgggccttcatccagaagagtgacctcttccgctgccagaggatccacagcggggagaagccctatgagtacagtgaatgtgagaagaacctgccccagaacagcaacctgaacatccacaagaagatccacactggaggcaagcactttgaatgtacagaatgtgggaaggccttcaccaggaagagcaccctgtccatgcaccagaagatccacactggagagaagccctacgtgtgcacagaatgtgggaaggccttcatcaggaagagccacttcatcacccatgagcgcatccacactggagagaagccctatgaatgtagtgactgtgggaagagcttcatcaagaagagccagctgcacgtgcaccagaggatccacactggagagaaccccttcatctgcagtgaatgtgggaaggtgttcacccacaagaccaacctgatcatccaccagaagatccacactggagagcggccctacatctgcaccgtgtgtgggaaggccttcacagacaggagcaacctgatcaagcaccagaagatccacactggagagaagccctacaagtgcagcgactgtgggaagagcttcacctggaagagccggctgcgcatccaccagaagtgccacactggagagcggcactatgaatgttctgaatgtgggaaggccttcatccagaagagcaccctgtccatgcaccagaggatccacagaggagagaagccctacgtgtgcacagaatgtgggaaggccttcttccacaagagccacttcatcacccatgagcgcatccacactggagagaagccctatgaatgttccatctgtgggaagagcttcaccaagaagagccagctgcacgtgcaccagcagatccacactggagagaagccctaccgctgtgccgagtgtgggaaggccttcacagacaggagcaacctcttcacccaccagaagatccacactggagagaagccctacaagtgcagcgactgtgggaaggccttcaccaggaagagcggcctgcacatccaccagcagagccacactggagagcggcactatgaatgttctgaatgtgggaaggcctttgccaggaagagcaccctcatcatgcaccagaggatccacactggagagaagccctacatctgcaatgaatgtgggaagagcttcatccagaagagccacctgaacagacaccggcgcatccacactggagagaagccctatgaatgtagtgactgtgggaagagcttcatcaagaagagccagctgcacgagcaccaccgcatccacactggagagaagccctacatctgtgccgagtgtgggaaggccttcaccatccgcagcaacctgatcaagcaccagaagatccacaccaagcagaagccctacaagtgcagcgacctgggcaaggccctgaactggaagccccagctgtccatgccccagaagagtgacaatggagaggtggagtgcagcatgccccagctgtggtgtggggacagcgagggggaccagggccagctgagcagcatctag

SEQ ID NO: 17956 - DNA, 2451 bp, Artificial Sequence; identical to SEQ ID NO: 17954
  Description of Artificial Sequence: Synthetic coding sequence

SEQ ID NO: 17957 - DNA, 2565 bp, Artificial Sequence
  Description of Artificial Sequence: Synthetic coding sequence
atgtctgtgctgagcctgcctgagagcgtgtccttcaaggatgtgacagtggacttcagcagagatgagtggcagcagctggacctggcccagaagagcctgtaccgggaggtgatgctggagaactacttcaacctgatctctgtgggctgccaggtgcccaagccagaggtgatcttcagcctggagcaggaggagccctgcatgctggatggagagatccccagccagagcaggccagatggagacatcggcttcggccccctgcagcagaggatgtctgaggaggtgtccttccagagcgagatcaacatcaacctcttcaccagagatgacccctacagcatcctggaggagctgtggaaggatgatgagcacaccaggaaatgtggggagaaccagaacaagcccctgagccgggtggtgttcatcaacaagaagaccctggccaatgacagcatctttgagtacaaggacatcggggagatcgtgcacgtgaacacccacctggtgagcagcaggaagaggccccacaactgcaacagctgtgggaagaacctggagcccatcatcaccctgtacaacagaaataatgccacagaaaattctgacaagaccatcggagatggagacatcttcacccacctgaacagccacacagaggtgacagcctgtgagtgcaaccagtgtgggaagcccctgcaccacaagcaggccctgatccagcagcagaagatccacacccgggagagcctgtacctgttcagtgactatgtgaatgtgttcagccccaagagccacgcctttgcccacgagagcatctgtgccgaggagaagcagcacgagtgccatgaatgtgaggccgtgttcacccagaagagccagctggatggcagccagagggtgtatgccggcatctgcacagaatatgagaaggacttcagcctgaagagcaaccggcagaagaccccctatgagggcaactactacaagtgcagcgactatggccgggccttcatccagaagagtgacctcttccgctgccagaggatccacagcggggagaagccctatgagtacagtgaatgtgagaagaacctgccccagaacagcaacctgaacatccacaagaagatccacactggaggcaagcactttgaatgtacagaatgtgggaaggccttcaccaggaagagcaccctgtccatgcaccagaagatccacactggagagaagccctacgtgtgcacagaatgtgggaaggccttcatcaggaagagccacttcatcacccatgagcgcatccacactggagagaagccctatgaatgtagtgactgtgggaagagcttcatcaagaagagccagctgcacgtgcaccagaggatccacactggagagaaccccttcatctgcagtgaatgtgggaaggtgttcacccacaagaccaacctgatcatccaccagaagatccacactggagagcggccctacatctgcaccgtgtgtgggaaggccttcacagacaggagcaacctgatcaagcaccagaagatccacactggagagaagccctacaagtgcagcgactgtgggaagagcttcacctggaagagccggctgcgcatccaccagaagtgccacactggagagcggcactatgaatgttctgaatgtgggaaggccttcatccagaagagcaccctgtccatgcaccagaggatccacagaggagagaagccctacgtgtgcacagaatgtgggaaggccttcttccacaagagccacttcatcacccatgagcgcatccacactggagagaagccctatgaatgttccatctgtgggaagagcttcaccaagaagagccagctgcacgtgcaccagcagatccacactggagagaagccctaccgctgtgccgagtgtgggaaggccttcacagacaggagcaacctcttcacccaccagaagatccacactggagagaagccctacaagtgcagcgactgtgggaaggccttcaccaggaagagcggcctgcacatccaccagcagagccacactggagagcggcactatgaatgttctgaatgtgggaaggcctttgccaggaagagcaccctcatcatgcaccagaggatccacactggagagaagccctacatctgcaatgaatgtgggaagagcttcatccagaagagccacctgaacagacaccggcgcatccacactggagagaagccctatgaatgtagtgactgtgggaagagcttcatcaagaagagccagctgcacgagcaccaccgcatccacactggagagaagccctacatctgtgccgagtgtgggaaggccttcaccatccgcagcaacctgatcaagcaccagaagatccacaccaagcagaagccctacaagtgcagcgacctgggcaaggccctgaactggaagccccagctgtccatgccccagaagagtgacaatggagaggtggagtgcagcatgccccagctgtggtgtggggacagcgagggggaccagggccagctgagcagcatctag

SEQ ID NO: 17958 - DNA, 1326 bp, Artificial Sequence
  Description of Artificial Sequence: Synthetic coding sequence
atggccccccgggcccagatccagggccccctgacctttggagatgtggccgtggccttcaccagaattgagtggaggcacctggatgctgcccagagggccctgtacagagatgtgatgctggagaactacggcaacctggtgtctgtgggcctgctgagcagcaagcccaagctgatcacccagctggagcagggcgctgagccctggacagaggtgcgggaggcccccagcggcacccatgctgtggaggactactggtttgagaccaagatgtctgccctgaagcagagcaccagcgaggcctctgtgctgggggagaggaccaagtctgtgatgatggagaagggcctggactgggagggccgcagcagcacagagaagaactacaagtgcaaggaatgtgggaaggtgttcaagtacaacagcagcttcatcagccaccagaggaaccacaccagcgagaagccccacaagtgcaaggaatgtggcatcgccttcatgaacagcagcagcctgctgaaccaccacaaggtgcatgctgggaagcagccctaccgctgcattgaatgtgggaagttcctgaagaagcacagcaccttcatcaaccaccagaggatccacagccgggagaagccccacaagtgcattgaatgtgggaagaccttcaggaagaacagcatcctgctgagccaccagaggatccacacaggccagaagccctacaagtgcaatgactgtgggaaggcctttgcccagaatgctgccctgaccaggcatgagcgcatccacagcggggagaagcccttcaagtgcaacaagtgtggccgggccttccgggacaacagcacagtgctggagcaccagaagatccacactggagagaagccctaccagtgcaatgaatgtgggaaggccttcaggaagagcagcaccctcatcagccaccagaggatgcacactggagagaagccctaccactgcagcaaatgtgggaagagcttccgctacagcagcagctttgctggccaccagaagacccacagcggcaacaagccctaccagtgccgggactgtgggaaggccttcaccaagagcagcaccctgaccggccaccagaggatccacactggagagaagccctaccactgcaagaagtgtgggaaggccttccgccacagcagcggcctggtggagcaccagaggctgcacactggagagaagccctacaagtgcaatgaatgtgggaaggccttccccaggagcagcgccctgaagcagcacaagaagatccacaacaaggagcgggccatgaagtgcagctag

SEQ ID NO: 17959 - DNA, 1326 bp, Artificial Sequence; identical to SEQ ID NO: 17958
  Description of Artificial Sequence: Synthetic coding sequence

SEQ ID NO: 17960 - DNA, 1053 bp, Artificial Sequence
  Description of Artificial Sequence: Synthetic coding sequence
atgtctgccctgaagcagagcaccagcgaggcctctgtgctgggggagaggaccaagtctgtgatgatggagaagggcctggactgggagggccgcagcagcacagagaagaactacaagtgcaaggaatgtgggaaggtgttcaagtacaacagcagcttcatcagccaccagaggaaccacaccagcgagaagccccacaagtgcaaggaatgtggcatcgccttcatgaacagcagcagcctgctgaaccaccacaaggtgcacgccggcaagcagccctaccgctgcattgaatgtgggaagttcctgaagaagcacagcaccttcatcaaccaccagaggatccacagccgggagaagccccacaagtgcattgaatgtgggaagaccttcaggaagaacagcatcctgctgagccaccagaggatccacacaggccagaagccctacaagtgcaatgactgtgggaaggcctttgcccagaatgctgccctgaccaggcatgagcgcatccacagcggggagaagcccttcaagtgcaacaagtgtggccgggccttccgggacaacagcacagtgctggagcaccagaagatccacactggagagaagccctaccagtgcaatgaatgtgggaaggccttcaggaagagcagcaccctcatcagccaccagaggatgcacactggagagaagccctaccactgcagcaaatgtgggaagagcttccgctacagcagcagctttgctggccaccagaagacccacagcggcaacaagccctaccagtgccgggactgtgggaaggccttcaccaagagcagcaccctgaccggccaccagaggatccacactggagagaagccctaccactgcaagaagtgtgggaaggccttccgccacagcagcggcctggtggagcaccagaggctgcacactggagagaagccctacaagtgcaatgaatgtgggaaggccttccccaggagcagcgccctgaagcagcacaagaagatccacaacaaggagcgggccatgaagtgcagctag

SEQ ID NO: 17961 - DNA, 354 bp, Artificial Sequence
  Description of Artificial Sequence: Synthetic coding sequence
atggccccccgggcccagatccagggccccctgacctttggagatgtggccgtggccttcaccagaattgagtggaggcacctggatgctgcccagagggccctgtacagagatgtgatgctggagaactacggcaacctggtgtctgtgggcctgctgagcagcaagcccaagctgatcacccagctggagcagggcgctgagccctggacagaggtgcgggaggcccccagcggcacccatgctgtggaggactactggtttgagaccaagatgtctgccctgaagcagagcaccagcgaggcctctgtgctgggggagaggaccaagtctgtgatgatggagaagggctag

SEQ ID NO: 17962 - DNA, 1392 bp, Artificial Sequence
  Description of Artificial Sequence: Synthetic coding sequence
atgcctggccccctgcggagcctggagatggagagcctgcagttcagagatgtggccgtggagttcagcctggaggagtggcactgcctggacacagcccagcagaacctgtacagagatgtgatgctggagaactaccgccacctggtgttcctgggcatcatcgtgtccaagccagacctgatcacctgcctggagcagggcatcaagcccctgaccatgaagagacatgagatgattgccaagccccctgtggtgtgcagccactttgcccaggacctgtggccagagcagagcatcaaggacagctaccagaaggtgatcctgaggaagtttgagaagtgtggccacggcaacctgcacttcaagaagggctgtgagagcgtggatgagtgcaagctgcacaagaggggctacaacggcctgaaccagtgcctgaccaccacccagagcaagatcttccagtgtgggaagtatgtgaaggtgttccaccagttcagcaacagcaagaggcacaagaggaggcacacagagaagaagcccctgaagtacattgaaggagacaaggccttcaaccagagcagcacccacaccacccacaagaagattgacacaggagagaagccctacaagtgtgaggagtgtgggaaggccttcaacagaagcagccacctgaccacccacaagatcacccacacccgggagaagccctacaagtgtgaggagtgtgggaaggtgttcaagtacttcagcagcttcaccacccacaagaagatccacagcggggagaagccctacatctgtgaggagtgtgggaaggccttcatgtacccctacaccctgaccacccacaagatcatccacactggagagcagccctacaagtgcaaggaatgtgacaaggccttcaaccacccagccaccctgagcagccacaagaagatccacactggagagaagccctacacctgtgacaagtgtgggaaggccttcatcagcagcagcatcctgagcaagcatgagaagatccacactggagagaagccctacaagtgtgaggagtgtgggaaggccttcaccaggagcagccacctgaccatgcacaagatcatccacactggagagaagccctacaagtgtgaggagtgtgggaaggccttcacctggagcgctggcctgcacaagcacaggaggacccacactggagagaagccctacaagtgtgaggagtgtgggaaggcctacaccaccagcagcaacctgacagagcacaagaccacccacactggagagaagccctacaagtgcaaggaatgtgggaaggccttcaactggagcagtgacctgaacaagcacaagaggatccacatcggccagaagcccaggacatag

SEQ ID NO: 17963 - DNA, 1509 bp, Artificial Sequence
  Description of Artificial Sequence: Synthetic coding sequence
gtgagccgctgcatctggagcagccgcagccccctgcgctacagcgtgagcagcgccccccggggccccccatctgtggccctgtgccctgtgggcatcggccgcagcacagccaagatgcctggccccctgcggagcctggagatggagagcctgcagttcagagatgtggccgtggagttcagcctggaggagtggcactgcctggacacagcccagcagaacctgtacagagatgtgatgctggagaactaccgccacctggtgttcctgggcatcatcgtgtccaagccagacctgatcacctgcctggagcagggcatcaagcccctgaccatgaagagacatgagatgattgccaagccccctgtggtgtgcagccactttgcccaggacctgtggccagagcagagcatcaaggacagctaccagaaggtgatcctgaggaagtttgagaagtgtggccacggcaacctgcacttcaagaagggctgtgagagcgtggatgagtgcaagctgcacaagaggggctacaacggcctgaaccagtgcctgaccaccacccagagcaagatcttccagtgtgggaagtatgtgaaggtgttccaccagttcagcaacagcaagaggcacaagagaagacacacagagaagaagcccctgaagtacatcgagggggacaaggccttcaaccagagcagcacccacaccacccacaagaagattgacaccggggagaagccctacaagtgtgaagaatgtgggaaggccttcaacagaagcagccacctgaccacccacaagatcacccacacccgggagaagccctacaagtgtgaagaatgtgggaaggtgttcaagtacttcagcagcttcaccacccacaagaagatccacagcggggagaagccctacatctgtgaagaatgtgggaaggccttcatgtacccctacaccctgaccacccacaagatcatccacactggagagcagccctacaagtgcaaggaatgtgacaaggccttcaaccacccagccaccctgagcagccacaagaagatccacactggagagaagccctacacctgtgacaagtgtgggaaggccttcatcagcagcagcatcctgagcaagcatgagaagatccacactggagagaagccctacaagtgtgaagaatgtgggaaggccttcaccaggagcagccacctgaccatgcacaagatcatccacactggagagaagccctacaagtgtgaagaatgtgggaaggccttcacctggagcgctggcctgcacaagcacaggaggacccacactggagagaagccctacaagtgtgaagaatgtgggaaggcctacaccaccagcagcaacctgacagagcacaagaccacccacactggagagaagccctacaagtgcaaggaatgtgggaaggccttcaactggagcagtgacctgaacaagcacaagaggatccacatcggccagaagcccaggacatag

SEQ ID NO: 17964 - DNA, 573 bp, Artificial Sequence
  Description of Artificial Sequence: Synthetic coding sequence
tgaagaccccggcccaggacccccagccggggccccagcgacctgcgcttccggggggaggccggcctgcggcgggtcttcctgaagaaggccggcggctctgtgtccttcagtgatgtggccgtgggcttcacccaggaggagtggcagcacctggacagcgcccagaggaccccctacagagacatgatgctggagaactacagcctgctgctgtctgtgggctactgcatcaccaagccagaggtggtgtgcaagctggagcacggccaggtgctgtggatcctggaggaggagagccccagccagagccacctggactgctgcattgatgatgacctgatggagaagaggcaggagaaccaggaccagcacctgcagaaggtggactttgtgaacaacaagaccctgaccatggacagaaatggagtgctgggcaagaccttcagcctggacaccaaccccatcctgagcaggaagatccggggcaactgtgacagcagcggcatgaacctgaacaacatcagcgagctgatcatcagcaacagaagcagctttgtgaggaacccctag

SEQ ID NO: 17965 - DNA, 1347 bp, Artificial Sequence
  Description of Artificial Sequence: Synthetic coding sequence
atggccagccggccccggcccaggacccccagccggggccccagcgacctgcgcttccggggggaggccggcctgcggcgggtcttcctgaagaaggccggcggctctgtgtccttcagtgatgtggccgtgggcttcacccaggaggagtggcagcacctggacagcgcccagaggaccccctacagagacatgatgctggagaactacagcctgctgctgtctgtgggctactgcatcaccaagccagaggtggtgtgcaagctggagcacggccaggtgctgtggatcctggaggaggagagccccagccagagccacctggactgctgcattgatgatgacctgatggagaagaggcaggagaaccaggaccagcacctgcagaaggtggactttgtgaacaacaagaccctgaccatggacagaaatggagtgctgggcaagaccttcagcctggacaccaaccccatcctgagcaggaagatccggggcaactgtgacagcagcggcatgaacctgaacaacatcagcgagctgatcatcagcaacagaagcagctttgtgaggaacccagctgagtgcaatgtgcggggcaagttcctgctgtgcatgaagcgggagaacccctatgcccggggcaagcccctggagtatgatggaaatggcaaggctgtgtcccagaatgaagatctcttccgccaccagtacatccagaccctgaagcagtgctttgagtacaaccaccggggctacacagaggagaggaaccccatgaatgccctgaatgtgggcaagctgctggacatcggccacgccctgcagtacatcaaggagcacacccgggacaagacctatgaatgtaatgaatgtgggaagaacttctgtgagaagagcaacctgcacgtgcaccagaggacccacactggagagaagccctacggctgcaatgaatgccagaaggcctttggagacagaagtgccctgaaggtgcaccagaggatccacactggagagaagccctatgagctgcaccagaggacccacactggagagaagccctatgcctgcagtgaatgtgggaagaccttctaccagaagagcagcctgaccacccaccagaggacccacacccgggagcagccctatgagtacaatgaaagcttctaccagaaccccaacttcaccaagtgccagagggacaacatcgaggagaccctggtgaacatcctgaaggcccagaagcccagccccagctggaccaggagcattgctgagaccacccaggtgggcggctctgtgtccctgaaggatgtgacagtggacttcacccaggaggagtggtag

SEQ ID NO: 17966 - DNA, 627 bp, Artificial Sequence
  Description of Artificial Sequence: Synthetic coding sequence
atgatgctggagaactacagcctgctgctgtctgtgggctactgcatcaccaagccagaggtggtgtgcaagctggagcacggccaggtgctgtggatcctggaggaggagagccccagccagagccacctggactgctgcattgatgatgacctgatggagaagaggcaggagaaccaggaccagcacctgcagaaggtggactttgtgaacaacaagaccctgaccatggacagaaatggagtgctgggcaagaccttcagcctggacaccaaccccatcctgagcaggaagatccggggcaactgtgacagcagcggcatgaacctgaacaacatcagcgagctgatcatcagcaacagaagcagctttgtgaggaacccagctgagtgcaatgtgcggggcaagttcctgctgtgcatgaagcgggagaacccctatgcccggggcaagcccctggagtatgatggaaatggcaaggctgtgtcccagaatgaagatctcttccgccaccagtacatccagaccctgaagcagtgctttgagtacaaccagtgtgggaaggccttccacgaggaggccgcctgcagcacccacaagagggtgtgctcctgggagaccctgtag

SEQ ID NO: 17967 - DNA, 420 bp, Artificial Sequence
  Description of Artificial Sequence: Synthetic coding sequence
atgatgctggagaactacagcctgctgctgtctgtgggctactgcatcaccaagccagaggtggtgtgcaagctggagcacggccaggtgctgtggatcctggaggaggagagccccagccagagccacctggactgctgcattgatgatgacctgatggagaagaggcaggagaaccaggaccagcacctgcagaaggtggactttgtgaacaacaagaccctgaccatggacagaaatggagtgctgggcaagaccttcagcctggacaccaaccccatcctgagcaggaagatccggggcaactgtgacagcagcggcatgaacctgaacaacatcagcgagctgatcatcagcaacagaagcagctttgtgaggaacccagctgagtgcaatgtgcggggcaagttcctgctgtag

SEQ ID NO: 17968 - DNA, 360 bp, Artificial Sequence
  Description of Artificial Sequence: Synthetic coding sequence
atgatgctggagaactacagcctgctgctgtctgtgggctactgcatcaccaagccagaggtggtgtgcaagctggagcacggccaggtgctgtggatcctggaggaggagagccccagccagagccacctggactgctgcattgatgatgacctgatggagaagaggcaggagaaccaggaccagcacctgcagaaggtggactttgtgaacaacaagaccctgaccatggacagaaatggagtgctgggcaagaccttcagcctggacaccaaccccatcctgagcaggaagatccggggcaactgtgacagcagcggcatgaacctgaacaacatcagcgagctgatcatctcctag

SEQ ID NO: 17969 - DNA, 1023 bp, Artificial Sequence
  Description of Artificial Sequence: Synthetic coding sequence
atgcctgagtggccaccctgcctgtctgtggccccagccctggtgatcaccatggccgccggcaagggggcccccctgagccccagcgcagaaaatcgctggaggctgtctgagcctgagctgggccggggctgcaagcctgtgctgctggagaagaccaaccggctgggccctgaggccgctgtgggccgggccggcagagatgtgggcagcgctgagctggccctgctggtggcccctgggaagcccaggcctgggaagcccctgccccccaagaccagaggagagcagaggcagagcgccttcacagagctgcccaggatgaaggaccggcaggtggatgcccaggcccaggagcgggagcatgatgaccccaccggccagcccggggccccccagctgacccagaacatcccccggggccctgctggcagcaaggtgttttctgtgtggcccagcggggcccggtctgagcagaggtctgccttcagcaagcccaccaagaggcctgctgagaggcctgagctgaccagcgtcttccctgctggggagagcgcagatgccctgggggagctgagcggcctgctgaacaccacagacctggcctgctggggccgcctgagcacccccaagctgctggtgggggacctgtggaacctgcaggccctgccccagaatgcccccctgtgcagcaccttcctgggcgcccccaccctgtggctggagcacacccaggcccaggtgcccccacccagcagcagcagcaccacctcctgggccctgctgccccccaccctgaccagcctgggcctgagcacccagaactggtgtgccaagtgcaacctgtccttccggctgaccagtgacctggtgttccacatgaggagccaccacaagaaggagcacgccggccctgacccccacagccagaagaggcgggaggaggccctggcctgccctgtgtgccaggagcacttccgggagcggcaccacctgagccgccacatgaccagccacagctag

SEQ ID NO: 17970 - DNA, 222 bp, Artificial Sequence
  Description of Artificial Sequence: Synthetic coding sequence
atgcctgagtggccaccctgcctgtctgtggccccagccctggtgatcaccatggccgccggcaagggggcccccctgagccccagcgcagaaaatcgctggaggctgtctgagcctgagctgggccggggctgcaagcctgtgctgctggagaagaccaaccggctgggccctgaggccgctgtgggccgggccggcagagatgtgggcagcgctgagtag

SEQ ID NO: 17971 - DNA, 360 bp, Artificial Sequence
  Description of Artificial Sequence: Synthetic coding sequence
atgcctgagtggccaccctgcctgtctgtggccccagccctggtgatcaccatggccgccggcaagggggcccccctgagccccagcgcagaaaatcgctggaggctgtctgagcctgagctgggccggggctgcaagcctgtgctgctggagaagaccaaccggctgggccctgaggccgctgtgggccgggccggcagagatgtgggcagcgctgagctggccctgctggtggcccctgggaagcccaggcctgggaagcccctgccccccaagaccagaggagagcagaggcagagcgccttcacagagctgcccaggatgaaggaccggcaggtggatgcccaggcccaggagtag

SEQ ID NO: 17972 - DNA, 318 bp, Artificial Sequence
  Description of Artificial Sequence: Synthetic coding sequence
atgcctgagtggccaccctgcctgtctgtggccccagccctggtgatcaccatggccgccggcaagggggcccccctgagccccagcgcagaaaatcgctggaggctgtctgagcctgagctgggccggggctgcaagcctgtgctgctggagaagaccaaccggctgggccctgaggccgctgtgggccgggccggcagagatgtgggcagcgctgagctggccctgctggtggcccctgggaagcccaggcctgggaagcccctgccccccaagaccagaggagagcagaggcagagcgccttcacagagctgtag

SEQ ID NO: 17973 - DNA, 261 bp, Artificial Sequence
  Description of Artificial Sequence: Synthetic coding sequence
atgcctgagtggccaccctgcctgtctgtggccccagccctggtgatcaccatggccgccggcaagggggcccccctgagccccagcgcagaaaatcgctggaggctgtctgagcctgagctgggccggggctgcaagcctgtgctgctggagaagaccaaccggctgggccctgaggccgctgtgggccgggccggcagagatgtgggcagcgctgagctggccctgctggtggcccctgggaagcccaggcctggatag

SEQ ID NO: 17974 - DNA, 210 bp, Artificial Sequence
  Description of Artificial Sequence: Synthetic coding sequence
atgcctgagtggccaccctgcctgtctgtggccccagccctggtgatcaccatggccgccggcaagggggcccccctgagccccagcgcagaaaatcgctggaggctgtctgagcctgagctgggccggggctgcaagcctgtgctgctggagaagaccaaccggctgggccctgaggccgctgtgggccgggccggcagagatgtgtag

SEQ ID NO: 17975 - DNA, 393 bp, Artificial Sequence
  Description of Artificial Sequence: Synthetic coding sequence
atgcctgagtggccaccctgcctgtctgtggccccagccctggtgatcaccatggccgccggcaagggggcccccctgagccccagcgcagaaaatcgctggaggctgtctgagcctgagctgggccggggctgcaagcctgtgctgctggagaagaccaaccggctgggccctgaggccgctgtgggccgggccggcagagatgtgggcagcgctgagctggccctgctggtggcccctgggaagcccaggcctgggaagcccctgccccccaagaccagaggagagcagaggcagagcgccttcacagagctgcccaggatgaaggaccggcaggtggatgcccaggcccaggagcgggagcatgatgaccccaccggccagcctggatag

SEQ ID NO: 17976 - DNA, 1590 bp, Artificial Sequence
  Description of Artificial Sequence: Synthetic coding sequence
atgagaagaaacagcagcctgtccttccagatggagcggcccctggaggagcaggtgcagagcaagtggagcagcagccagggccgcacaggcaccggcggcagtgatgtgctgcagatgcagaacagcgagcaccacggccagagcatcaagacccagacagacagcatcagcctggaggatgtggccgtgaacttcaccctggaggagtgggccctgctggaccccggccagaggaacatctacagagatgtgatgagggccaccttcaagaacctggcctgcatcggggagaagtggaaggaccaggacattgaagatgagcacaagaaccagggcaggaacctgcggagccccatggtggaggccctgtgtgagaacaaggaggactgcccctgtgggaagagcaccagccagatcccagacctgaacaccaacctggagacccccaccggcctgaagccctgtgactgcagcgtgtgtggggaggtgttcatgcaccaggtgtccctgaacagacacatgaggagccacacagagcagaagcccaatgaatgtcatgaatatggagagaagccccacaagtgcaaggaatgtgggaagaccttcaccaggagcagcagcatccgcacccatgagcgcatccacactggagagaagccctatgagtgcaaggaatgtgggaaggcctttgccttcctgttctccttcaggaaccacatccgcatccacactggagagaccccctatgagtgcaaggaatgtgggaaggccttccgctacctgacagccctgcggagacatgagaagaaccacactggagagaagccctacaagtgcaagcagtgtgggaaggccttcatctactaccagcccttcctgacccatgagaggacccacactggagagaagccctatgagtgcaagcagtgtgggaaggccttcagctgccccacctacctgcggagccatgagaagacccacactggagagaagccctttgtgtgccgggagtgtggccgggccttcttcagccacagcagcctgaggaagcacgtgaagacccacactggagtgcagccctacacctgcaagaagtgtggggaggccttcaagagcagcagcagctgtgaggtgcatgagaggacccactttggagagaagccctatgagtgcaagcagtgtgggaaggccttcaacagcagcagctacctgcagctgcacgagcgggtgcacactggagagaagacctatgagtgcaaggaatgtgggaaggccttcctgtacagcacccacttccgcatccacgagaggacccacacccgggagaagccctatgagtgcaagcagtgtggccgggtcttcatctacttcagccacctgcggagacatgagaggagccacactggagtgaagccctgtgagtgcaagcagtgtgggaaggccttcacctgcctgaacagcctgaaggtgcacaagaggatccacactggagagcggcccttccagtgccggcagtgtgggaaggccttctcctacagcaagagcctgcacgtgcatgagaggacccacagccggcagaagccctag

SEQ ID NO: 17977 - DNA, 1314 bp, Artificial Sequence
  Description of Artificial Sequence: Synthetic coding sequence
atgggagagcggctgtttgagagcgctgagggcagccagtgtggggagaccttcacccaggtgcctgaggacatgctgaacaagaagaccctgcccggggtgaagagctgtgagagcggcacctgtggggagatcttcatgggctacagcagcttcaacagaaacatcagaacagacaccggccaccagccccacaagtgccagaagttcctggagaagccctacaagcacaagcagaggaggaaggccctgagccacagccactgcttccgcacccatgagcggccccacacccgggagaagccctttgactgcaaggaatgtgagaagagcttcatcagccctgccagcatccgccgctacatggtgacccacagcggagatggcccctacaagtgcaagttctgtgggaaggccctggactgcctgagcctgtacctgacccatgagaggacccacactggagagaagagatatgagtgcaagcagtgtgggaaggccttctcctggcacagctctgtgcgcatccacgagaggacccacactggagagaagccctatgagtgcaaggaatgtgggaagagcttcaacttcagcagcagcttcagaagacatgagaggacccacactggagagaagccctacaagtgcaaggaatgtgggaaggccttcaactgccccagcagcttccacagacatgagaggacccacactggagagaagccctatgagtgcaagctgtatggcaaggccctgagccgcctcatctccttcagaagacacatgaggatgcacactggagagcggccccacaagtgcaagatctgtgggaaggccttctacagccccagcagcttccagagacatgagaggagccacactggagagaagccctacaagtgcaagcagtgtgggaaggccttcacctgcagcaccagcttccagtaccacgagaggacccacactggagagaagccagatggctgcaagcagtgtgggaaggccttccgcagcgccaagtacatccgcatccacggccgcacccacactggagagaagccctatgagtgcaagcagtgtgggaaggccttccactgtgtgtcctccttccacagacatgagaggacccacgccggggagaagccctatgagtgcaagcactgtgggaaggccttcacctgcagcatctacatccgcatccacgagcgcatccacactggagagaagccctaccagtgcaaggaatgtgggaaggccttcatccgcagcagctactgcaggaagcatgagaggacccacaccatcaacatctag

SEQ ID NO: 17978 - DNA, 420 bp, Artificial Sequence
  Description of Artificial Sequence: Synthetic coding sequence
atgggagagcggctgtttgagagcgctgagggcagccagtgtggggagaccttcacccaggtgcctgaggacatgctgaacaagaagaccctgcccggggtgaagagctgtgagagcggcacctgtggggagatcttcatgggctacagcagcttcaacagaaacatcagaacagacaccggccaccagccccacaagtgccagaagttcctggagaagccctacaagcacaagcagaggaggaaggccctgagccacagccactgcttccgcacccatgagcggccccacacccgggagaagccctttgactgcaaggaatgtgagaagagcttcatcagccctgccagcatccgccgctacatggtgacccacagcggagatggcccctacaagtgcaagttctgtgggaaggcctag

SEQ ID NO: 17979 - DNA, 1230 bp, Artificial Sequence
  Description of Artificial Sequence: Synthetic coding sequence
atgggagagcggctgtttgagagcgctgagggcagccagtgtggggagaccttcacccaggtgcctgaggacatgctgaacaagaagaccctgcccggggtgaagagctgtgagagcggcacctgtggggagatcttcatgggctacagcagcttcaacagaaacatcagaacagacaccggccaccagccccacaagtgccagaagttcctggagaagccctacaagcacaagcagaggaggaaggccctgagccacagccactgcttccgcacccatgagcggccccacacccgggagaagccctttgactgcaaggaatgtgagaagagcttcatcagccctgccagcatccgccgctacatggtgacccacagcggagatggcccctacaagtgcaagttctgtgggaaggccctggactgcctgagcctgtacctgacccatgagaggacccacactggagagaagagatatgagtgcaagcagtgtgggaaggccttctcctggcacagctctgtgcgcatccacgagaggacccacactggagagaagccctatgagtgcaaggaatgtgggaagagcttcaacttcagcagcagcttcagaagacatgagaggacccacactggagagaagccctatgagtgcaagctgtatggcaaggccctgagccgcctcatctccttcagaagacacatgaggatgcacactggagagcggccccacaagtgcaagatctgtgggaaggccttctacagccccagcagcttccagagacatgagaggagccacactggagagaagccctacaagtgcaagcagtgtgggaaggccttcacctgcagcaccagcttccagtaccacgagaggacccacactggagagaagccagatggctgcaagcagtgtgggaaggccttccgcagcgccaagtacatccgcatccacggccgcacccacactggagagaagccctatgagtgcaagcagtgtgggaaggccttccactgtgtgtcctccttccacagacatgagaggacccacgccggggagaagccctatgagtgcaagcactgtgggaaggccttcacctgcagcatctacatccgcatccacgagcgcatccacactggagagaagccctaccagtgcaaggaatgtgggaaggccttcatccgcagcagctactgcaggaagcatgagaggacccacaccatcaacatctag

SEQ ID NO: 17980 - DNA, 1596 bp, Artificial Sequence
  Description of Artificial Sequence: Synthetic coding sequence
atgctggagaactacagaaacctggtgtttgtgggcattgctgccagcaagccagacctgatcacctgcctggagcagggcaaggagccctggaatgtgaagagacatgagatggtggccgagccccctgtggtgtgcagctactttgcccgggacctgtggcccaagcagggcaagaagaactacttccagaaggtgatcctgcggcgctacaagaagtgtggctgtgagaacctgcagctgaggaagtactgcaagtccatggatgagtgcaaggtgcacaaggagtgctacaacggcctgaaccagtgcctgaccaccacccagaacaagatcttccagtgtgacaagtatgtgaaggtgttccacaagttcagcaacagcaacagacacaccatccgccacacaggcaagaagagcttcaagtgcaaggaatgtgagaagagcttctgcatgctgagccacctggcccagcacaagaggatccacagcggggagaagccctacaagtgcaaggaatgtgggaaggcctacaatgagaccagcaacctgagcacccacaagaggatccacacaggcaagaagccctacaagtgtgaagaatgtgggaaggccttcaaccggctgagccacctgaccacccacaagatcatccacacaggcaagaagccctacaagtgtgaagaatgtgggaaggccttcaaccagagcgccaacctgaccacccacaagaggatccacactggagagaagccctacaagtgtgaagaatgtggccgggccttcagccagagcagcaccctgacagcccacaagatcatccacgccggggagaagccctacaagtgtgaagaatgtgggaaggccttcagccagagcagcaccctgaccacccacaagatcatccacactggagagaagttctacaagtgtgaagaatgtgggaaggccttcagccagctgagccacctgaccacccacaagaggatccacagcggggagaagccctacaagtgtgaagaatgtgggaaggccttcaagcagagcagcaccctgaccacccacaagagaattcatgctggggagaagttctacaagtgtgaggtgtgcagcaaggccttcagccgcttcagccacctgaccacccacaagaggatccacactggagagaagccctacaagtgtgaagaatgtgggaaggccttcaacctgagcagccagctgaccacccacaagatcatccacactggagagaagccctacaagtgtgaagaatgtgggaaggccttcaaccagagcagcaccctgagcaagcacaaggtgatccacactggagagaagccctacaagtatgaagaatgtgggaaggccttcaaccagagcagccacctgaccacccacaagatgatccacactggagagaagccctacaagtgtgaagaatgtgggaaggccttcaacaacagcagcatcctgaacagacacaagatgatccacactggagagaagctgtacaagccagagagctgcaacaatgcctgtgacaacatcgccaagatcagcaagtacaagaggaactgtgccggggagaagtag

SEQ ID NO: 17981 - DNA, 1941 bp, Artificial Sequence
  Description of Artificial Sequence: Synthetic coding sequence
atgaatgaatgtaatgtgcacaaggagggctacaatgagctgaaccagtacctgaccaccacccagagcaagatcttccagtgtgacaagtatgtgaaggtgttccacaagctgctgaacagcaacagacacaacaccaagcacacaggcaagaagcccttcaagtgcaagaagtgtgggaagagcttctgcatgctgctgcacctgtgccagcacaagaggatccacatcagagaaaattcctaccgctgtgaggagtgtgggaaggccttcatctggttcagcaccctgaccaggcacagaagagtgcacactggagagaagagctacaagtatgaatgtgggaagagcttcaaccaggacagcaacctgaccacccacaagaggatccacacaggccagaagccctacaagtgtgaagaatgtggcaccagcttctaccagttctcctacctgaccaggcacaagctgatccacacccgggagaagccctacaagtgtgagcagtatggcaagaccttcaaccagagcagcaccctgaccggccacaagatcatccacaacggggagaagccctacaagtgtgaagaatgtgggaaggccttcagcatcttcagcacccccaccaagcacaagatcatccacacagaggagaagagccaccgctgtgaggagtactgcaaggcctacaaggagagcagccacctgaccacccacaagaggatccacactggagagaagccctacaagtgtgaagaatgtgggaaggccttcagcatcttcagcaccctgaccaagcacaagatcatccacacagaggagaagagccaccgctgtgaagaatgtgggaaggcctacaaggagagcagccacctgaccacccacaagaggatccacactggagagaagccctacaagtgtgaagaatgtgggaagaccttctctgtgttcagcatcctgaccaagcacaagatcatccacacagaggagaagccctacaagtgtgaagaatgtgggaaggccttcaagaggagcagcaccctgaccaagcaccgcatcatccacacagaggagaagccctacaagtgtgaagaatgtgggaaggccttcaaccagagcagcaccctgagcatccacaagatcatccacactggagagaagccctacaagtgtgaagaatgtgggaaggccttcaagaggagcagcaccctgaccatccacaagatgatccacactggagagaagccctacaagtgtgaagaatgtgggaaggccttcaacagaagcagccacctgaccacccacaagaggatccacacaggccacaagccctacaagtgcaaggaatgtgggaagagcttctctgtgttcagcaccctgaccaagcacaagatcatccacacagacaagaagccctacaagtgtgaagaatgtgggaaggccttcaacagaagcagcatcctgagcatccacaagaagatccacactggagagaagccctacaagtgtgaagaatgtgggaaggccttcaagaggagcagccacctggccggccacaagcagatccacagcgtgcagaagccctacaagtgtgaagaatgtgggaaggccttcagcatcttcagcaccctgaccaagcacaagatcatccacacagaggagaagccctacaagtgtgagaagtgtgggaagaccttctaccgcttcagcaacctgaacacccacaagatcatccacactggagagaagccctgcaagtgtgaagaatgtgggaaggccttcaaccacagcagcaacctgatcaagcacaagctgatccacactggagacaagccctacaagtgtgaggcctgtgggaaggccttcagaagaagcagccacctgagccgccacaagatcatccacatcggcatccacacagaggagaccgtgcagaagtag

SEQ ID NO: 17982 - DNA, 2325 bp, Artificial Sequence
  Description of Artificial Sequence: Synthetic coding sequence
atgcctggccccccagagagcctggacatgggccccctgaccttcagagatgtggccatcgagttcagcctggaggagtggcagtgcctggacacagcccagcaggacctgtacaggaaggtgatgctggagaactacagaaacctggtgttcctgggcattgctgtgtccaagccagacctggtgacctgcctggagcagggcaaggacccctggaacatgaagggccacagcacagtggtgaagccccctgtgatctgcagccactttgctgaggacttctgccccggccctggcatcaaggacagcttccagaaggtgatcctgcgggagtatgtgaagtgtggccacaaggacctgcagctgaggaagggctgcaagtccatgaatgaatgtaatgtgcacaaggagggctacaatgagctgaaccagtacctgaccaccacccagagcaagatcttccagtgtgacaagtatgtgaaggtgttccacaagctgctgaacagcaacagacacaacaccaagcacacaggcaagaagcccttcaagtgcaagaagtgtgggaagagcttctgcatgctgctgcacctgtgccagcacaagaggatccacatcagagaaaattcctaccgctgtgaggagtgtgggaaggccttcatctggttcagcaccctgaccaggcacagaagagtgcacactggagagaagagctacaagtatgaatgtgggaagagcttcaaccaggacagcaacctgaccacccacaagaggatccacacaggccagaagccctacaagtgtgaagaatgtggcaccagcttctaccagttctcctacctgaccaggcacaagctgatccacacccgggagaagccctacaagtgtgagcagtatggcaagaccttcaaccagagcagcaccctgaccggccacaagatcatccacaacggggagaagccctacaagtgtgaagaatgtgggaaggccttcagcatcttcagcacccccaccaagcacaagatcatccacacagaggagaagagccaccgctgtgaggagtactgcaaggcctacaaggagagcagccacctgaccacccacaagaggatccacactggagagaagccctacaagtgtgaagaatgtgggaaggccttcagcatcttcagcaccctgaccaagcacaagatcatccacacagaggagaagagccaccgctgtgaagaatgtgggaaggcctacaaggagagcagccacctgaccacccacaagaggatccacactggagagaagccctacaagtgtgaagaatgtgggaagaccttctctgtgttcagcatcctgaccaagcacaagatcatccacacagaggagaagccctacaagtgtgaagaatgtgggaaggccttcaagaggagcagcaccctgaccaagcaccgcatcatccacacagaggagaagccctacaagtgtgaagaatgtgggaaggccttcaaccagagcagcaccctgagcatccacaagatcatccacactggagagaagccctacaagtgtgaagaatgtgggaaggccttcaagaggagcagcaccctgaccatccacaagatgatccacactggagagaagccctacaagtgtgaagaatgtgggaaggccttcaacagaagcagccacctgaccacccacaagaggatccacacaggccacaagccctacaagtgcaaggaatgtgggaagagcttctctgtgttcagcaccctgaccaagcacaagatcatccacacagacaagaagccctacaagtgtgaagaatgtgggaaggccttcaacagaagcagcatcctgagcatccacaagaagatccacactggagagaagccctacaagtgtgaagaatgtgggaaggccttcaagaggagcagccacctggccggccacaagcagatccacagcgtgcagaagccctacaagtgtgaagaatgtgggaaggccttcagcatcttcagcaccctgaccaagcacaagatcatccacacagaggagaagccctacaagtgtgagaagtgtgggaagaccttctaccgcttcagcaacctgaacacccacaagatcatccacactggagagaagccctgcaagtgtgaagaatgtgggaaggccttcaaccacagcagcaacctgatcaagcacaagctgatccacactggagacaagccctacaagtgtgaggcctgtgggaaggccttcagaagaagcagccacctgagccgccacaagatcatccacatcggcatccacacagaggagaccgtgcagaagtag

SEQ ID NO: 17983 - DNA, 312 bp, Artificial Sequence
  Description of Artificial Sequence: Synthetic coding sequence
atgcctggccccccagagagcctggacatgggccccctgaccttcagagatgtggccatcgagttcagcctggaggagtggcagtgcctggacacagcccagcaggacctgtacaggaaggtgatgctggagaactacagaaacctggtgttcctggccggcattgctgtgtccaagccagacctggtgacctgcctggagcagggcaaggacccctggaacatgaagggccacagcacagtggtgaagccccctgtggagaccggcttccaccgcttcagccaggacggcctgtacctgctgaccagctag

SEQ ID NO: 17984 - DNA, 1497 bp, Artificial Sequence
  Description of Artificial Sequence: Synthetic coding sequence
atggagagcccccggggctggaccctgcaggtggcccctgaggagggccaggtgctgtgcaatgtgaagacagccacccggggcctgtctgagggcgctgtgtctgggggctggggcgcctgggagaacagcacagaggtgccccgggaggccggagatggccagaggcagcaggccaccctgggcgctgctgatgagcagggcggccctggccgggagctgggccctgcagatggcggcagagatggagctggccccaggtctgagcctgctgaccgggccctgcggcccagccccctgcctgaggagcccggctgccgctgtggggagtgtgggaaggccttcagccagggcagctacctgctgcagcacagaagagtgcacactggagagaagccctacacctgcccagaatgtgggaaggcctttgcctggagcagcaacctgagccagcaccagaggatccacagcggggagaagccctatgcctgccgggagtgtgggaaggccttccgggcccacagccagctgatccaccaccaggagacccacagcggcctgaagcccttccgctgcccagactgtgggaagagctttggccgcagcaccaccctggtgcagcacaggaggacccacactggagagaagccctatgaatgtccagaatgtgggaaggccttctcctggaacagcaacttcctggagcacagaagagtgcacactggagcccggccccacgcctgccgggactgtgggaaggccttcagccagagcagcaacctggccgagcacctgaagatccatgctggggcccggccccacgcctgcccagactgtgggaaggcctttgtgcgggtggccggcctgcggcagcacaggaggacccacagcagcgagaagcccttcccctgtgccgagtgtgggaaggccttccgggagagcagccagctgctgcagcaccagaggacccacactggagagcggccctttgaatgtgccgagtgtggccaggcctttgtgatgggcagctacctggccgagcacagaagagtgcacactggagagaagccccacgcctgtgcccagtgtgggaaggccttcagccagaggagcaacctgctgagccacaggaggacccacagcggggccaagccctttgcctgtgccgactgtgggaaggccttccggggcagcagcggcctggcccaccaccggctgagccacactggagagcggccctttgcctgtgccgagtgtgggaaggccttccggggcagcagcgagctgcggcagcaccagaggctgcacagcggggagcggccctttgtgtgtgcccactgcagcaaggcctttgtgaggaagtctgagctgctgagccacaggaggacccacactggagagcggccctatgcctgtggggagtgtgggaagcccttcagccaccgctgcaacctgaatgagcaccagaagagacatggaggccgggccgccccctag

SEQ ID NO: 17985 - DNA, 678 bp, Artificial Sequence
  Description of Artificial Sequence: Synthetic coding sequence
cacagcggggagaagccctatgcctgcagagaatgtgggaaggccttccgggcccacagccagctgatccaccaccaggagacccacagcggcctgaagcccttccgctgcccagactgtgggaagagctttggccgcagcaccaccctggtgcagcacaggaggacccacactggagagaagccctatgagtgcccagaatgtgggaaggcctttgtgcgggtggccggcctgcggcagcacaggaggacccacagcagcgagaagcccttcccctgtgctgaatgtgggaaggccttccgggagagcagccagctgctgcagcaccagaggacccacactggagagcggccctttgaatgtgctgaatgtggccaggcctttgtgatgggcagctacctggccgagcaccggcgggtgcacactggagagaagccccacgcctgtgcccagtgtgggaaggccttcagccagaggagcaacctgctgagccacaggaggacccacagcggggccaagccctttgcctgtgccgactgtgggaaggccttccggggcagcagcggcctggcccaccaccggctgagccacactggagagcggccctttgcctgtgctgaatgtgggaaggccttccggggcagcagcgagctgcggcagcaccagaggctgcactag

SEQ ID NO: 17986 - DNA, 1497 bp, Artificial Sequence; identical to SEQ ID NO: 17984
  Description of Artificial Sequence: Synthetic coding sequence

SEQ ID NO: 17987 - DNA, 1419 bp, Artificial Sequence
  Description of Artificial Sequence: Synthetic coding sequence
atgctgaaggagcaccctgagatggccgaggccccccagcagcagctgggcatccctgtggtgaagctggagaaggagctgccctggggccggggccgggaggaccccagccctgagaccttccggctgcgcttccggcagttccgctaccaggaggccgccggcccccaggaggccctgcgggagctgcaggagctgtgccgccgctggctgcggcctgagctgcacaccaaggagcagatcctggagctgctggtgctggagcagttcctgaccatcctgccccgggagttctacgcctggatccgggagcacggccctgagagcggcaaggccctggccgccatggtggaggacctgacagagcgggccctggaggccaaggctgtgccctgccaccggcagggcgagcaggaggagacagccctgtgccgcggggcctgggagcccggcatccagctgggccctgtggaggtgaagccagagtggggcatgcctcctggagagggcgtgcagggccctgaccccggcacagaggagcagctgagccaggaccctggagatgagacccgggccttccaggagcagggcggcggcagcaaggagaaggaggccaagccaccccaggaggacctgaagggggccctggtggccctgaccagcgagagatttggagaggccagcctgcagggccctggcctgggccgggtgtgtgagcaggagcccggcggccctgctggcagcgcccctggcctgcccccaccccagcacggggccatccccctgcctgatgaggtgaagacccacagcagcttctggaagcccttccagtgcccagaatgtgggaagggcttcagccgcagcagcaacctggtgcgccaccagaggacccatgaggagaagagctatggctgtgtggagtgtgggaagggcttcaccctgcgggagtacctgatgaagcaccagaggacccacctgggcaagaggccctacgtgtgcagcgagtgctggaagaccttcagccagaggcaccacctggaggtgcaccagaggagccacactggagagaagccctacaagtgtggggactgctggaagagcttcagccggcggcagcacctgcaggtgcacaggaggacccacactggagagaagccctacacctgtgaatgtgggaagagcttcagcagaaatgccaacctggccgtgcacagaagagcccacactggagagaagccctacggctgccaggtgtgtgggaagcgcttcagcaaaggagagcggctggtgcgccaccagaggatccacactggagagaagccctaccactgcccagcctgtggccgctccttcaaccagaggagcatcctgaacagacaccagaagacccagcaccggcaggagcccctggtgcagtag

SEQ ID NO: 17988 - DNA, 1635 bp, Artificial Sequence
  Description of Artificial Sequence: Synthetic coding sequence
atgctgaaggagcaccctgagatggccgaggccccccagcagcagctgggcatccctgtggtgaagctggagaaggagctgccctggggccggggccgggaggaccccagccctgagaccttccggctgcgcttccggcagttccgctaccaggaggccgccggcccccaggaggccctgcgggagctgcaggagctgtgccgccgctggctgcggcctgagctgcacaccaaggagcagatcctggagctgctggtgctggagcagttcctgaccatcctgccccgggagttctacgcctggatccgggagcacggccctgagagcggcaaggccctggccgccatggtggaggacctgacagagcgggccctggaggccaaggctgtgccctgccaccggcagggcgagcaggaggagacagccctgtgccgcggggcctgggagcccggcatccagctgggccctgtggaggtgaagccagagtggggcatgcctcctggagagggcgtgcagggccctgaccccggcacagaggagcagctgagccaggaccctggagatgagacccgggccttccaggagcaggccctgcctgtgctgcaggccggccctggcctgcctgctgtgaacccccgggaccaggagatggctgctggcttcttcaccgctggcagccagggcctgggccccttcaaggacatggccctggccttccctgaggaggagtggaggcatgtgaccccagcccagattgactgctttggagaatatgtggagccccaggactgccgggtgtcccctgggggcggcagcaaggagaaggaggccaagccaccccaggaggacctgaagggggccctggtggccctgaccagcgagagatttggagaggccagcctgcagggccctggcctgggccgggtgtgtgagcaggagcccggcggccctgctggcagcgcccctggcctgcccccaccccagcacggggccatccccctgcctgatgaggtgaagacccacagcagcttctggaagcccttccagtgcccagaatgtgggaagggcttcagccgcagcagcaacctggtgcgccaccagaggacccatgaggagaagagctatggctgtgtggagtgtgggaagggcttcaccctgcgggagtacctgatgaagcaccagaggacccacctgggcaagaggccctacgtgtgcagcgagtgctggaagaccttcagccagaggcaccacctggaggtgcaccagaggagccacactggagagaagccctacaagtgtggggactgctggaagagcttcagccggcggcagcacctgcaggtgcacaggaggacccacactggagagaagccctacacctgtgaatgtgggaagagcttcagcagaaatgccaacctggccgtgcacagaagagcccacactggagagaagccctacggctgccaggtgtgtgggaagcgcttcagcaaaggagagcggctggtgcgccaccagaggatccacactggagagaagccctaccactgcccagcctgtggccgctccttcaaccagaggagcatcctgaacagacaccagaagacccagcaccggcaggagcccctggtgcagtag

SEQ ID NO: 17989 - DNA, 1635 bp, Artificial Sequence; identical to SEQ ID NO: 17988
  Description of Artificial Sequence: Synthetic coding sequence

SEQ ID NO: 17990 - DNA, 213 bp, Artificial Sequence
  Description of Artificial Sequence: Synthetic coding sequence
atgctgaaggagcaccctgagatggccgaggccccccagcagcagctgggcatccctgtggtgaagctggagaaggagctgccctggggccggggccgggaggaccccagccctgagaccttccggctgcgcttccggcagttccgctaccaggaggccgccggcccccaggaggccctgcgggagctgcaggagctgtgccgccgctggtag

SEQ ID NO: 17991 - DNA, 5424 bp, Artificial Sequence
  Description of Artificial Sequence: Synthetic coding sequence
atggccaagcccaccagcaaggacagcggcctgaaggagaagttcaagatcctgctgggcctgggcaccccccggcccaaccccaggtctgctgagggcaagcagacagagttcatcatcacagctgagatcctgcgggagctgtccatggagtgtggcctgaacaaccgcatccgcatgattggccagatctgtgaggtggccaagaccaagaagtttgaggagcacgctgtggaggccctgtggaaggctgtggccgacctgctgcagcctgagcggcccctggaggcccggcatgctgtgctggccctgctgaaggccatcgtgcagggccagggcgagcggctgggcgtgctgcgggccctcttcttcaaggtgatcaaggactaccccagcaatgaagacctgcacgagcggctggaggtgttcaaggccctgacagacaatggccgccacatcacctacctggaggaggagctggccgactttgtgctgcagtggatggatgtgggcctgagcagcgagttcctgctggtgctggtgaacctggtgaagttcaacagctgctacctggatgagtacatcgccaggatggtgcagatgatctgcctgctgtgtgtgaggacagccagctctgtggacatcgaggtgtccctgcaggtgctggatgctgtggtgtgctacaactgcctgcctgctgagagcctgcccctcttcatcgtgaccctgtgcaggaccatcaacgtgaaggagctgtgtgagccctgctggaagctgatgaggaacctgctgggcacccacctgggccacagcgccatctacaacatgtgccacctgatggaggaccgggcctacatggaggatgcccccctgctgcggggagctgtgttctttgtgggcatggccctgtggggcgcccaccggctgtacagcctgaggaacagccccacctctgtgctgcccagcttctaccaggccatggcctgccccaatgaggtggtgtcctatgagatcgtgctgagcatcaccaggctcatcaagaagtacaggaaggagctgcaggtggtggcctgggacatcctgctgaacatcatcgagcggctgctgcagcagctgcagaccctggacagccctgagctgcggaccatcgtgcatgacctgctgaccaccgtggaggagctgtgtgaccagaatgagttccacggcagccaggagcgctactttgagctggtggagcgctgtgccgaccagaggcctgagagcagcctgctgaacctgatctcctaccgggcccagagcatccacccagccaaggatggctggatccagaacctgcaggccctgatggagcgcttcttccgctctgagagcagaggagctgtgcgcatcaaggtgctggatgtgctgagctttgtgctgctgatcaaccggcagttctatgaggaggagctgatcaacagcgtggtgatcagccagctgagccacatccctgaggacaaggaccaccaggtgaggaagctggccacccagctgctggtggacctggccgagggctgccacacccaccacttcaacagcctgctggacatcatcgagaaggtgatggcccggagcctgagccccccacctgagctggaggagagagatgtggccgcctacagcgccagcctggaggatgtgaagacagctgtgctgggcctgctggtgatcctgcagaccaagctgtacaccctgcctgccagccacgccaccagggtgtatgagatgctggtgagccacatccagctgcactacaagcacagctacaccctgcccatcgccagcagcatccggctgcaggcctttgacttcctgctgctgctgcgggctgacagcctgcaccggctgggcctgcccaacaaggatggagtggtgcgcttcagcccctactgtgtgtgtgactacatggagcctgagcggggcagcgagaagaagaccagcggccccctgagccccccaactggacctcctggccctgccccagctggccctgctgtgcggctgggctctgtgccctacagcctgctcttccgggtgctgctgcagtgcctgaagcaggagagtgactggaaggtgctgaagctggtgctgggccgcctgcctgagagcctgcgctacaaggtgctgatcttcaccagcccctgcagcgtggaccagctgtgcagcgccctgtgcagcatgctgagcggccccaagaccctggagcggctgcggggggcccctgagggcttcagcaggacagacctgcacctggccgtggtgcctgtgctgacagccctgatctcctaccacaactacctggacaagaccaagcagcgggagatggtgtactgcctggagcagggcctcatccaccgctgtgccagccagtgtgtggtggccctgagcatctgcagcgtggagatgccagacatcatcatcaaggccctgcctgtgctggtggtgaagctgacccacatcagcgccacagcctccatggctgtgcccctgctggagttcctgagcaccctggcccggctgccccacctgtacagaaactttgctgctgagcagtatgcctctgtgtttgccatcagcctgccctacaccaaccccagcaagttcaaccagtacatcgtgtgcctggcccaccacgtgattgccatgtggttcatccgctgccgcctgcccttcaggaaggactttgtgcccttcatcaccaagggcctgcggagcaatgtgctgctgagctttgatgacaccccagagaaggacagcttccgggcccggagcaccagcctgaatgaaagacccaagagcctgagaattgcccggccccccaagcagggcctgaacaacagcccccctgtgaaggagttcaaggagagcagcgctgctgaggccttccgctgccgcagcatctctgtgtctgaacatgtggtgcgcagccgcatccagaccagcctgaccagcgccagcctgggcagcgcagatgaaaattctgtggcccaggctgatgacagcctgaagaacctgcacctggagctgacagagacctgcctggacatgatggcccgctacgtgttcagcaacttcaccgctgtgcccaagaggagccctgtgggggagttcctgctggccggcggccgcaccaagacctggctggtgggcaacaagctggtgacagtgaccacctctgtgggcaccggcaccaggagcctgctgggcctggacagcggggagctgcagagcggccctgagagcagcagcagccctggggtgcacgtgcggcagaccaaggaggccccagccaagctggagagccaggccggccagcaggtgtccagaggagcccgggacagagtgcgctccatgtctgggggccacggcctgcgggtgggcgccctggatgtgcctgccagccagttcctgggcagcgccaccagccctggccccaggacagccccagctgccaagccagagaaggccagcgctggcaccagggtgcctgtgcaggagaagaccaacctggccgcctacgtgcccctgctgacccagggctgggccgagatcctggtgcggcggcccactggaaacacctcctggctgatgagcctggagaaccccctgagccccttcagcagtgacatcaacaacatgcccctgcaggagctgagcaatgccctgatggctgctgagcgcttcaaggagcaccgggacacagccctgtacaagagcctgtctgtgcctgctgccagcacagccaagcccccacccctgcccaggagcaacacagtggccagcttcagcagcctgtaccagagcagctgccagggccagctgcacaggtctgtgtcctgggccgacagcgctgtggtgatggaggagggcagccctggagaggtgcctgtgctggtggagcccccaggcctggaggatgtggaggccgccctgggcatggacagaagaacagatgcctacagccgcagcagctctgtgagcagccaggaggagaagagcctgcatgctgaggagctggtgggccggggcatccccatcgagcgggtggtgtcctctgagggcggccggcccagcgtggacctgtccttccagcccagccagcccctgagcaagagcagcagcagccctgagctgcagaccctgcaggacatcctgggggaccccggggacaaggcagatgtgggccgcctgagccctgaggtgaaggcccggagccagagcggcaccctggatggagagagcgctgcctggagcgccagcggggaggacagccggggccagcctgagggccccctgcccagcagcagccccaggagccccagcggcctgcggccccggggctacaccatcagtgacagcgcccccagccggcggggcaagagggtggagagagatgccctgaagagccgggccacagccagcaatgctgagaaggtgcccggcatcaaccccagctttgtgttcctgcagctgtaccacagccccttctttggagatgagagcaacaagcccatcctgctgcccaatgaaagccagagctttgagaggtctgtgcagctgctggaccagatccccagctatgacacccacaagattgctgtgctgtatgtgggggagggccagagcaacagcgagctggccatcctgagcaatgagcacggcagctaccgctacacagagttcctgaccggcctgggccgcctcatcgagctgaaggactgccagcctgacaaggtgtacctgggcggcctggatgtgtgtggggaggatggccagttcacctactgctggcatgatgacatcatgcaggccgtgttccacatcgccaccctgatgcccaccaaggatgtggacaagcaccgctgtgacaagaagaggcacctgggcaatgactttgtgtccatcgtgtacaatgattctggagaggacttcaagctgggcaccatcaagggccagttcaactttgtgcacgtgattgtgacccccctggactatgagtgcaacctggtgtccctgcagtgcaggaaggacatggagggcctggtggacacctctgtggccaagatcgtgtctgacaggaacctgccctttgtggcccggcagatggccctgcacgccaacatggccagccaggtgcaccacagccgcagcaaccccacagacatctaccccagcaagtggatcgcccggctgcggcacatcaagaggctgcggcagaggatctgtgaggaggccgcctacagcaaccccagcctgcccctggtgcacccccccagccacagcaaggccccagcccagaccccagctgagcccaccccaggctatgaggtgggccagaggaagaggctcatcagctctgtggaggacttcacagaatttgtgtag

SEQ ID NO: 17992 - DNA, 1326 bp, Artificial Sequence
  Description of Artificial Sequence: Synthetic coding sequence
atggccaccgtgcccggcctgcagcccctgcccaccctggagcaggacctggagcaggaggagatcctgattgtgaaggtggaggaggacttctgcctggaggaggagcccagcgtggagacagaggaccccagccctgagaccttccggcagctgttccgcctcttctgctaccaggaggtggccggcccccgggaggccctgagccggctgtgggagctgtgctgccgctggctgcggcctgagctgcggaccaaggagcagatcctggagctgctggtgctggagcagttcctgactgtgctgcctggagagatccaggcccgggtgcgggagcagcagcctgagagcggggaggaggccgtggtgctggtggagggcctgcagaggaagcccaggaagcaccggcagaggggcagcgagctgctgagtgatgatgaggtgcccctgggcatcggcggccagttcctgaagcaccaggccgaggcccagcctgaggacctgagcctggaggaggaggcccgcttcagcagccagcagcccccagcccagctgagccaccggccccagaggggccccctgctgtggccagagcggggccccccagcccccaggcaccaggagatggccagcgccagccccttcctgagcgcctggagccaggtgcctgtgaacctggaggatgtggccgtgtacctgagcggggaggagccccgctgcatggaccctgcccagagagatgcccccctggagaatgaaggacctggcatccagctggaggatggaggagatggaagagaagatgcccccctgaggatggagtggtacagagtgctgagcgcccgctgccagggccctggccaccccctgcccggccagaggcctgcccctgtgcggggcctggtgcggccagaccagccccggggcggccccccacctggaagaagagccagccatggagctgacaagccctacacctgcccagaatgtgggaagggcttcagcaagaccagccacctgaccaagcaccagaggacccacactggagagcggccctacaagtgcctggtgtgtgggaagggcttcagtgacaggagcaacttcagcacccaccagagggtgcacactggagagaagccctacccctgcccagaatgtgggaagcgcttcagccagagcagcagcctggtgatccacaggaggacccacagcggggagcggccctatgcctgcacccagtgtgggaagcgcttcaacaacagcagccacttcagcgcccacaggaggacccacacaggccacatcctgcggagcggctgcacctag

SEQ ID NO: 17993 - DNA, 648 bp, Artificial Sequence
  Description of Artificial Sequence: Synthetic coding sequence
atgaacagcagccagatcagcctgaggatgaagcacggccgggtgaacatgcagaagaagcccagcaaatgttctgaatgtgggaagttcttcacccagaggagcagcctgacccagcaccagaggatccacagaggagagaagccctacgtgtgcagtgaatgtggcagctgcttcaggaagcagagcaacctgacccagcacctgcgcatccacactggagagaagccctacaagtgcaatgaatgtgagaaggccttccagaccaaggccatcctggtgcagcacctgcgcatccacactggagagaagccctacaagtgcaatgaatgtgggaaggccttctgccagagccccagcctcatcaagcaccagaggatccacactggagagaagccctacacctgcacagaatgtgggaaggccttcacccagaacagcagcctggtggagcacgagaggacccacactggagagaagctgtacaagtgcagtgaatgtgagaagaccttcaggaagcaggcccacctgtctgagcactaccgcatccacactggagagaagccctatgaatgtgtgggctgcggcaagagcttccgccacagcagcgccctgctgcggcaccagaggctgcatgctggggagtag

SEQ ID NO: 17994 - DNA, 816 bp, Artificial Sequence
  Description of Artificial Sequence: Synthetic coding sequence
atgaacagcagccagatcagcctgaggatgaagcacggccgggtgaacatgcagaagaagcccagcaaatgttctgaatgtgggaagttcttcacccagaggagcagcctgacccagcaccagaggatccacagaggagagaagccctacgtgtgcagtgaatgtggcagctgcttcaggaagcagagcaacctgacccagcacctgcgcatccacactggagagaagccctacaagtgcaatgaatgtgagaaggccttccagaccaaggccatcctggtgcagcacctgcgcatccacactggagagaagccctacaagtgcaatgaatgtgggaaggccttctgccagagccccagcctcatcaagcaccagaggatccacactggagagaagccctacaagtgcacagaatgtgggaaggccttcagccagagcatctgcctgaccaggcaccagaggagccacagcggggacaagcccttcaagtgcaatgaatgtgggaaggccttcaaccagagcgcctgcctgatgcagcaccagaggatccacagcggggagaagccctacacctgcacagaatgtgggaaggccttcacccagaacagcagcctggtggagcacgagaggacccacactggagagaagctgtacaagtgcagtgaatgtgagaagaccttcaggaagcaggcccacctgtctgagcactaccgcatccacactggagagaagccctatgaatgtgtgggctgcggcaagagcttccgccacagcagcgccctgctgcggcaccagaggctgcatgctggggagtag

SEQ ID NO: 17995 - DNA, 1635 bp, Artificial Sequence
  Description of Artificial Sequence: Synthetic coding sequence
atgctgaacatgcagggcgctgaggagcgggacatcagaagagagacctgccccggctgggtgaacaagaacaagccagccctggagcaggatgtgtgcaagattgacagcagcggcatcgtggtgaagcgcttccaggaggatgagtaccaggacagcacctttgaggagaagtatgcctgtgagggcatgaaggagaacagcccccgggagattgctgagagctgcctcttccaggagggcggcttcggccgcatcaccttcatccacaaggaggcccctcctgagatcatcagccagggctacaactttgagaagagcctgctgctgaccagcagcctggtgacccggctgcgggtgtccacagaggagagcctgcaccagtgggagaccagcaacatccagaccaatgacatcagtgaccagagcaagtgccccaccctgtgcacccagaagaagtcctggaagtgcaatgaatgtgggaagaccttcacccagagcagcagcctgacccagcaccagaggacccacactggagagcggccctacacctgtgaagaatgtgggaaggccttcagccgcagcagcttcctggtgcagcaccagaggatccacactggagtgaagccctacggctgtgagcagtgtgggaagaccttccgctgccgctccttcctgacccagcaccagaggatccacactggagagaagccctacaagtgcaatgaatgtggcaacagcttcaggaaccacagccacctgacagagcaccagaggatccacactggagagaagccctacaagtgcaacagatgtgggaaggccttcaaccagaacacccacctgatccaccaccagaggatccacactggagagaagccctacatctgcagtgaatgtggcagcagcttcaggaagcacagcaacctgacccagcaccagaggatccacactggagagaagccccacaagtgtgatgaatgtgggaagaccttccagaccaaggccaacctgagccagcaccagaggatccacagcggggagaagccctacaagtgcaaggaatgtgggaaggccttctgccagagccccagcctcatcaagcaccagaggatccacactggagagaagccctacaagtgcaaggaatgtgggaaggccttcacccagagcacccccctgaccaagcaccagaggatccacactggagagcggccctacaagtgcagtgaatgtgggaaggccttcatccagagcatctgcctgatccgccaccagaggagccacactggagagaagccctacaagtgcaatgaatgtgggaagggcttcaaccagaacacctgcctgacccagcacatgaggatccacactggagagaagccctacaagtgcaaggaatgtgggaaggcctttgcccacagcagcagcctgacagagcaccacaggacccacactggagagaagctgtacaagtgcagtgaatgtgagaagaccttcagaaaatatgcccacctgtctgagcactaccgcatccacactggagagaagccctatgagtgcattgaatgtgggaagttcttccgccacagctctgtgctcttccgccaccagaagctgcacagcggggactag

SEQ ID NO: 17996 - DNA, 468 bp, Artificial Sequence
  Description of Artificial Sequence: Synthetic coding sequence
atgctgaacatgcagggcgctgaggagcgggacatcagaagagagacctgccccggctgggtgaacaagaacaagccagccctggagcaggatgtgtgcaagattgacagcagcggcatcgtggtgaagcgcttccaggaggatgagtaccaggacagcacctttgaggagaagtatgcctgtgagggcatgaaggagaacagcccccgggagattgctgagagctgcctcttccaggagggcggcttcggccgcatcaccttcatccacaaggaggcccctcctgagatcatcagccagggctacaactttgagaagagcctgctgctgaccagcagcctggtgacccggctgcgggtgtccacagaggagagcctgcaccagtgggagaccagcaacatccagaccaatgacatcagtgaccagagcaagtgccccaccctgtgcacccagaagaagtcctggtag

SEQ ID NO: 17997 - DNA, 1362 bp, Artificial Sequence
  Description of Artificial Sequence: Synthetic coding sequence
atgctgaacatgcagggcgctgaggagcgggacatcagaagagagacctgccccggctgggtgaacaagaacaagccagccctggagcaggatgtgtgcaagattgacagcagcggcatcgtggtgaagcgcttccaggaggatgagtaccaggacagcacctttgaggagaagtatgcctgtgagggcatgaaggagaacagcccccgggagattgctgagagctgcctcttccaggagggcggcttcggccgcatcaccttcatccacaaggaggcccctcctgagatcatcagccagggctacaactttgagaagagcctgctgctgaccagcagcctggtgacccggctgcgggtgtccacagaggagagcctgcaccagtgggagaccagcaacatccagaccaatgacatcagtgaccagagcaagtgccccaccctgtgcacccagaagaagtcctggaagtgcaatgaatgtgggaagaccttcacccagagcagcagcctgacccagcaccagaggacccacactggagagcggccctacacctgtgaagaatgtgggaaggccttcagccgcagcagcttcctggtgcagcaccagaggatccacactggagtgaagccctacggctgtgagcagtgtgggaagcactttgatgtggaccacttcctgctgagcatcaaggagttcaccctggagaggaacctgatcaatgccatgaatgtgggcatccccagcgccatcacccacatcagcctgaacacccgggagttcaccctggagaggaacctgatcaatgccatcggcgtgggccgccacagcatccgcatccacaccctcttcatcatccgggagttcaccctggtgcgcagcctgacctatgctgtgaatgtggccctgctgtttgagaacacccagatcctgaggaacatccgggagttcaccctgggcaagaaccccatcaacgtgaccaacgtgggcaagctgagcaagcagaggcagaccagcctgagcatccgggagttcatcgtggagaggaaccccatcaacgtgaagaatgtggccaagccctttgtgcgggcccacctgctgctgaacaccagcgagttcatcctggagaagaaccacatctctgtgaagaatgtggccaagaggctgctgcgggccccccacagcctgaacatccgggagtacatccagggccgggaccccaccaatgctgtgaatgtggtgaagcccagcttccgggcctttgccctgtttggcacccgggaggtgaccctggagaagaaccccatcaatgccatgaatgtggagcgggccctgatccgcaccccagccagcctgagcatctag

SEQ ID NO: 17998 - DNA, 1635 bp, Artificial Sequence; identical to SEQ ID NO: 17995
  Description of Artificial Sequence: Synthetic coding sequence

SEQ ID NO: 17999 - DNA, 1635 bp, Artificial Sequence; identical to SEQ ID NO: 17995
  Description of Artificial Sequence: Synthetic coding sequence

SEQ ID NO: 18000 - DNA, 1335 bp, Artificial Sequence
  Description of Artificial Sequence: Synthetic coding sequence
atgggccccctgcagttcagagatgtggccatcgagttcagcctggaggagtggcactgcctggatgctgcccagaggaacctgtacagagatgtgatgctggagaactacagaaacctgatcttcctgggcatcgtggtgtccaagcccaacctgatcacctgcctggagcagggcaagaagcccctgaccatgaagagacatgagatgattgccaagccccctgtgatgtacagccactttgcccaggacctgtggagcgagcagagcatcaaggacagcttccagaaggtgatcctgcggcgctatgaaaaatgtagacatgacaacctgcagctgaagaagggctgtgagagcgtggatgagtgccctgtgcacaagaggggctacaacggcctgaagcagtgcctggccaccacccagaggaagatcttccagtgtgatgaatatgtgaagttcctgcacaagttcagcaacagcaacaagcacaagatccgggacaccgggaagaagagcttcaagtgcatcgagtatggcaagaccttcaaccagagcagcaccaggaccacctacaagaagattgatgctggggagaagcgctacaagtgtgaagaatgtgggaaggcctacaagcagagcagccacctgaccacccacaagaagatccacactggagagaagccctacaagtgtgaagaatgtgggaaggcctacaagcagagctgcaacctgaccacccacaagatcatccacactggagagaagccctaccgctgcagagaatgtgggaaggccttcaaccacccagccaccctcttcagccacaagaagatccacactggagagaagccctacaagtgtgacaagtgtgggaaggccttcatcagcagcagcaccctgaccaagcatgagatcatccacactggagagaagccctacaagtgtgaagaatgtgggaaggccttcaacagaagcagcaacctgaccaagcacaagaggatccacactggagatgtgccctacaagtgtgatgaatgtgggaagaccttcacctggtacagcagcctgagcaagcacaagagggcccacactggagagaagccctacaagtgtgaagaatgtgggaaggccttcaccgccttcagcaccctgacagagcacaagatcatccacactggagagaagccctacaagtgtgaagaatgtgggaaggccttcaactggagcagcgccctgaacaagcacaagaagatccacatccggcagaagccctgcatcgtgaagaatgtggagaacctgctgaatgtgccccagcccctcatcagcatcagatag

SEQ ID NO: 18001 - DNA, 1239 bp, Artificial Sequence
  Description of Artificial Sequence: Synthetic coding sequence
atgggccccctgcagttcagagatgtggccatcgagttcagcctggaggagtggcactgcctggatgctgcccagaggaacctgtacagagatgtgatgctggagaactacagaaacctgatcttcctggtgatgtacagccactttgcccaggacctgtggagcgagcagagcatcaaggacagcttccagaaggtgatcctgcggcgctatgaaaaatgtagacatgacaacctgcagctgaagaagggctgtgagagcgtggatgagtgccctgtgcacaagaggggctacaacggcctgaagcagtgcctggccaccacccagaggaagatcttccagtgtgatgaatatgtgaagttcctgcacaagttcagcaacagcaacaagcacaagatccgggacaccgggaagaagagcttcaagtgcatcgagtatggcaagaccttcaaccagagcagcaccaggaccacctacaagaagattgatgctggggagaagcgctacaagtgtgaagaatgtgggaaggcctacaagcagagcagccacctgaccacccacaagaagatccacactggagagaagccctacaagtgtgaagaatgtgggaaggcctacaagcagagctgcaacctgaccacccacaagatcatccacactggagagaagccctaccgctgcagagaatgtgggaaggccttcaaccacccagccaccctcttcagccacaagaagatccacactggagagaagccctacaagtgtgacaagtgtgggaaggccttcatcagcagcagcaccctgaccaagcatgagatcatccacactggagagaagccctacaagtgtgaagaatgtgggaaggccttcaacagaagcagcaacctgaccaagcacaagaggatccacactggagatgtgccctacaagtgtgatgaatgtgggaagaccttcacctggtacagcagcctgagcaagcacaagagggcccacactggagagaagccctacaagtgtgaagaatgtgggaaggccttcaccgccttcagcaccctgacagagcacaagatcatccacactggagagaagccctacaagtgtgaagaatgtgggaaggccttcaactggagcagcgccctgaacaagcacaagaagatccacatccggcagaagccctgcatcgtgaagaatgtggagaacctgctgaatgtgccccagcccctcatcagcatcagatag

SEQ ID NO: 18002 - DNA, 1335 bp, Artificial Sequence; identical to SEQ ID NO: 18000
  Description of Artificial Sequence: Synthetic coding sequence

SEQ ID NO: 18003 - DNA, 237 bp, Artificial Sequence
  Description of Artificial Sequence: Synthetic coding sequence
atgggccccctgcagttcagagatgtggccatcgagttcagcctggaggagtggcactgcctggatgctgcccagaggaacctgtacagagatgtgatgctggagaactacagaaacctgatcttcctgggcatcgtggtgtccaagcccaacctgatcacctgcctggagcagggcaagaagcccctgaccatgaagagacatgagatgattgccaagcccccaggcggcctgtag

SEQ ID NO: 18004 - DNA, 2862 bp, Artificial Sequence
  Description of Artificial Sequence: Synthetic coding sequence
atggaggagagcagctctgtggccatgctggtgcctgacatcggggagcaggaggccatcctgacagctgagagcatcatcagccccagcctggagattgatgagcagaggaagaccaagccagaccccctcatccacgtgatccagaagctgagcaagatcgtggagaatgagaagagccagaagtgcctgctgattggcaagaagaggcccaggagcagcgctgccacccacagcctggagacccaggagctgtgtgagatcccagccaaggtgatccagagccctgctgctgacaccaggagagctgagatgagccagaccaacttcaccccagacaccctggcccagaatgaaggcaaggccatgagctaccagtgcagcctgtgcaagttcctgagcagcagcttctctgtgctgaaggaccacatcaagcagcacggccagcagaatgaagtcatcctgatgtgcagcgagtgccacatcaccagccgcagccaggaggagctggaggcccacgtggtgaatgaccatgacaatgatgccaacatccacacccagagcaaggcccagcagtgtgtgagccccagcagcagcctgtgcaggaagaccacagaaagaaatgagaccatcccagacatccctgtgtctgtggacaacctgcagacccacacagtgcagacagcctctgtggccgagatgggccgcaggaagtggtacgcctatgagcagtatggcatgtaccgctgcctcttctgcagctacacctgtggccagcagaggatgctgaagacccacgcctggaagcatgctggggaggtggactgcagctaccccatctttgaaaatgaaaatgagcccctgggcctgctggacagcagcgctgctgctgcccctggaggagtggatgctgtggtgattgccatcggggagagcgagctgagcatccacaacggccccagcgtgcaggtgcagatctgcagcagcgagcagctgagcagcagcagccccctggagcagagcgctgagcggggcgtgcacctgagccagagcgtgaccctggaccccaatgaggaggagatgctggaggtgatcagtgatgctgaggagaacctgatcccagacagcctgctgaccagcgcccagaagatcatcagcagcagccccaacaagaagggccacgtgaatgtcatcgtggagcggctgcccagcgctgaggagaccctgagccagaagcgcttcctgatgaacacagagatggaggagggcaaggacctgagcctgacagaggcccagatcggccgggagggcatggatgatgtgtacagagctgacaagtgcaccgtggacattggaggcctcatcatcggctggagcagcagcgagaagaaggatgagctgatgaacaagggcctggccacagatgaaaatgcccctcctggaagaagaaggaccaacagcgagagcctgcggctgcacagcctggccgctgaggccctggtgaccatgcccatccgggctgctgagctgacccgggccaacctgggccactacggggacatcaacctgctggaccctgacaccagccagaggcaggtggacagcaccctggccgcctacagcaagatgatgagccccctgaagaacagcagtgatggcctgaccagcctgaaccagagcaacagcaccctggtggccctgcctgagggccggcaggagctgagtgatggccaggtgaagacaggcatctccatgagcctgctgactgtgattgagaagctgcgggagaggacagaccagaatgccagtgatgatgacatcctgaaggagctgcaggacaatgcccagtgccagcccaacagcgacaccagcctgagcggcaacaacgtggtggagtacatccccaatgctgagcggccctaccgctgccgcctgtgccactacaccagcggcaacaagggctacatcaagcagcacctgcgggtgcaccggcagaggcagccctaccagtgccccatctgtgagcacatcgctgacaacagcaaggacctggagagccacatgatccaccactgcaagacccgcatctaccagtgcaagcagtgtgaggagagcttccactacaagagccagctgagaaatcatgagcgggagcagcacagcctgcctgacaccctgagcatcgccaccagcaatgagccccgcatcagcagtgacacagcagatggaaaatgtgtgcaggagggcaacaagagctctgtgcagaagcagtaccgctgtgatgtgtgtgactacaccagcaccacctacgtgggcgtgaggaaccaccggcgcatccacaacagcgacaagccctaccgctgcagcctgtgtggctacgtgtgcagccacccccccagcctgaagagccacatgtggaagcacgccagtgaccagaactacaactatgagcaggtgaacaaggccatcaatgatgccatcagccagagcggccgggtgctgggcaagagccctgggaagacccagctgaagagcagcgaggagagcgctgaccctgtgacaggcagcagtgaaaatgctgtgagcagcagcgagctgatgagccagacccccagcgaggtgctgggcaccaatgaaaatgagaagctgagccccaccagcaacaccagctacagcctggagaagatcagcagcctggcccctccttccatggagtactgtgtgctgctcttctgctgctgcatctgtggctttgagagcaccagcaaggagaacctgctggaccacatgaaggagcatgaaggagaaattgtgaacatcatcctgaacaaggaccacaacacagccctgaacaccaactag

SEQ ID NO: 18005 - DNA, 2862 bp, Artificial Sequence; identical to SEQ ID NO: 18004
  Description of Artificial Sequence: Synthetic coding sequence

SEQ ID NO: 18006 - DNA, 2874 bp, Artificial Sequence
  Description of Artificial Sequence: Synthetic coding sequence
atggaggagagcagctctgtggccatgctggtgcctgacatcggggagcaggaggccatcctgacagctgagagcatcatcagccccagcctggagattgatgagcagaggaagaccaagccagaccccctcatccacgtgatccagaagctgagcaagatcgtggagaatgagaagagccagaagtgcctgctgattggcaagaagaggcccaggagcagcgctgccacccacagcctggagacccaggagctgtgtgagatcccagccaaggtgatccagagccctgctgctgacaccaggagagctgagatgagccagaccaacttcaccccagacaccctggcccagaatgaaggcaaggccatgagctaccagtgcagcctgtgcaagttcctgagcagcagcttctctgtgctgaaggaccacatcaagcagcacggccagcagaatgaagtcatcctgatgtgcagcgagtgccacatcaccagccgcagccaggaggagctggaggcccacgtggtgaatgaccatgacaatgatgccaacatccacacccagagcaaggcccagcagtgtgtgagccccagcagcagcctgtgcaggaagaccacagaaagaaatgagaccatcccagacatccctgtgtctgtggacaacctgcagacccacacagtgcagacagcctctgtggccgagatgggccgcaggaagtggtacgcctatgagcagtatggcatgtaccgctgcctcttctgcagctacacctgtggccagcagaggatgctgaagacccacgcctggaagcatgctggggaggtggactgcagctaccccatctttgaaaatgaaaatgagcccctgggcctgctggacagcagcgctgctgctgcccctggaggagtggatgctgtggtgattgccatcggggagagcgagctgagcatccacaacggccccagcgtgcaggtgcagatctgcagcagcgagcagctgagcagcagcagccccctggagcagagcgctgagcggggcgtgcacctgagccagagcgtgaccctggaccccaatgaggaggagatgctggaggtgatcagtgatgctgaggagaacctgatcccagacagcctgctgaccagcgcccagaagatcatcagcagcagccccaacaagaagggccacgtgaatgtcatcgtggagcggctgcccagcgctgaggagaccctgagccagaagcgcttcctgatgaacacagagatggaggagggcaaggacctgagcctgacagaggcccagatcggccgggagggcatggatgatgtgtacagagctgacaagtgcaccgtggacattggaggcctcatcatcggctggagcagcagcgagaagaaggatgagctgatgaacaagggcctggccacagatgaaaatgcccctcctggaagaagaaggaccaacagcgagagcctgcggctgcacagcctggccgctgaggccctggtgaccatgcccatccgggctgctgagctgacccgggccaacctgggccactacggggacatcaacctgctggaccctgacaccagccagaggcaggtggacagcaccctggccgcctacagcaagatgatgagccccctgaagaacagcagtgatggcctgaccagcctgaaccagagcaacagcaccctggtggccctgcctgagggccggcaggagctgagtgatggccaggtgaagacaggcatctccatgagcctgctgactgtgattgagaagctgcgggagaggacagaccagaatgccagtgatgatgacatcctgaaggagctgcaggacaatgcccagtgccagcccaacagcgacaccagcctgagcggcaacaacgtggtggagtacatccccaatgctgagcggccctaccgctgccgcctgtgccactacaccagcggcaacaagggctacatcaagcagcacctgcgggtgcaccggcagaggcagccctaccagtgccccatctgtgagcacatcgctgacaacagcaaggacctggagagccacatgatccaccactgcaagacccgcatctaccagtgcaagcagtgtgaggagagcttccactacaagagccagctgagaaatcatgagcgggagcagcacagcctgcctgacaccctgagcatcgccaccagcaatgagccccgcatcagcagtgacacagcagatggaaaatgtgtgcaggagggcaacaagagctctgtgcagaagcagtaccgctgtgatgtgtgtgactacaccagcaccacctacgtgggcgtgaggaaccaccggcgcatccacaacagcgacaagccctacaggaaggagttccgctgcagcctgtgtggctacgtgtgcagccacccccccagcctgaagagccacatgtggaagcacgccagtgaccagaactacaactatgagcaggtgaacaaggccatcaatgatgccatcagccagagcggccgggtgctgggcaagagccctgggaagacccagctgaagagcagcgaggagagcgctgaccctgtgacaggcagcagtgaaaatgctgtgagcagcagcgagctgatgagccagacccccagcgaggtgctgggcaccaatgaaaatgagaagctgagccccaccagcaacaccagctacagcctggagaagatcagcagcctggcccctccttccatggagtactgtgtgctgctcttctgctgctgcatctgtggctttgagagcaccagcaaggagaacctgctggaccacatgaaggagcatgaaggagaaattgtgaacatcatcctgaacaaggaccacaacacagccctgaacaccaactag

SEQ ID NO: 18007 - DNA, 1689 bp, Artificial Sequence
  Description of Artificial Sequence: Synthetic coding sequence
atgagccgcagcctgctgctgtggttcctgctcttcctgctgctgctgccccccctgcctgtgctgctggccgaccccggggcccccacccctgtgaacccctgctgctactacccctgccagcaccagggcatctgtgtgcgcttcggcctggaccgctaccagtgtgactgcaccaggacaggctacagcggccccaactgcaccatccctggcctgtggacctggctgaggaacagcctgcggcccagccccagcttcacccacttcctgctgacccacggccgctggttctgggagtttgtgaatgccaccttcatccgggagatgctgatgaggctggtgctgactgtgcgcagcaacctgatccccagcccccccacctacaacagcgcccatgactacatctcctgggagagcttcagcaatgtgtcctactacacccgcatcctgcccagcgtgcccaaggactgccccacccccatgggcaccaagggcaagaagcagctgcctgatgcccagctgctggcccggcgcttcctgctgcggaggaagttcatcccagacccccagggcaccaacctgatgtttgccttctttgcccagcacttcacccaccagttcttcaagaccagcggcaagatgggccctggcttcaccaaggccctgggccatggagtggacctgggccacatctatggagacaacctggagcggcagtaccagctgcggctcttcaaggatggcaagctgaagtaccaggtgctggatggagagatgtacccacccagcgtggaggaggcccctgtgctgatgcactacccccggggcatccccccccagagccagatggctgtgggccaggaggtgtttggcctgctgcccggcctgatgctgtatgccaccctgtggctgcgggagcacaacagagtgtgtgacctgctgaaggccgagcaccccacctggggagatgagcagctgttccagaccaccaggctcatcctgattggagagaccatcaagatcgtcatcgaggagtatgtgcagcagctgagcggctacttcctgcagctgaagtttgatcctgagctgctgtttggagtgcagttccagtacagaaaccgcatcgccatggagttcaaccacctgtaccactggcaccccctgatgccagacagcttcaagattggaggcggcaggaacatggaccaccacatcctgcacgtggccgtggatgtgatccgggagagccgggagatgaggctgcagcccttcaatgagtacaggaagcgcttcggcatgaagccctacaccagcttccaggagctggtgggggagaaggagatggctgctgagctggaggagctgtatggagacattgatgccctggagttctacccaggcctgctgctggagaagtgccaccccaacagcatctttggagagagcatgattgaaattggagcccccttcagcctgaagggcctgctgggcaaccccatctgcagccctgagtactggaagcccagcaccttcggcggggaggtgggcttcaacatcgtgaagacagccaccctgaagaagctggtgtgcctgaacaccaagacctgcccctacgtgtccttccgggtgcctgatgccagccaggatgatggccctgctgtggagcggcccagcacagagctgtag

SEQ ID NO: 18008 - DNA, 405 bp, Artificial Sequence
  Description of Artificial Sequence: Synthetic coding sequence
atgagcccccaccctgaggccatcacagactgtgtgaccctgaacacagtgggccagctggccgagggcggctaccccctgcgcttcagcaccctcttccaggagcagcagaagatgaacatcagccaggcctctgtgtccttcaaggatgtgaccatcgagttcacccaggaggagtggcagcagatggcccctgtgcagaagaacctgtacagagatgtgatgctggagaactacagcaacctggtgtctgtgggctactgctgcttcaagccagaggtgatcttcaagctggagcagggcgaggagccctggttcagcgaggaggagttcagcaaccagagccaccccagcgagctgctgagcagcagccgccacaacagcgctggggtggtgcggctgtag

SEQ ID NO: 18009 - DNA, 2052 bp, Artificial Sequence
  Description of Artificial Sequence: Synthetic coding sequence
atgagcccccaccctgaggccatcacagactgtgtgaccctgaacacagtgggccagctggccgagggcggctaccccctgcgcttcagcaccctcttccaggagcagcagaagatgaacatcagccaggcctctgtgtccttcaaggatgtgaccatcgagttcacccaggaggagtggcagcagatggcccctgtgcagaagaacctgtacagagatgtgatgctggagaactacagcaacctggtgtctgtgggctactgctgcttcaagccagaggtgatcttcaagctggagcagggcgaggagccctggttcagcgaggaggagttcagcaaccagagccaccccaaggactacagaggagatgacctgatcaagcagaacaagaagatcaaggacaagcacctggagcaggccatctgcatcaacaacaagaccctgaccacagaggaggagaaggtgctgggcaagcccttcaccctgcacgtggccgctgtggccagcaccaagatgagctgcaagtgcaacagctgggaggtgaacctgcagagcatcagcgagttcatcatcaacaacagaaactacagcaccaagaagattggctgtggaaatgtgtgtgagaacagccccttcaagatcaactttgagaagacccagacaggagagaagttctatgagcacaacaagaacatgaaggccctgaactacaatgaaaacctgcccaagcaccccaagttccagaccctggagcaggcctttgagtgcaacaagattggcaaggccttcaatgacaaggccaactgtgtgaagcacaacagcagccacactggagagaccagcagcaaggatgatgagttcaggaagaactgtgacaagaagaccctgtttgaccacagaagaacaggcaccgggaagaagcacctgcacctgaaccagtgtgggaagagctttgagaagagcacagtggaggagtacaacaagctgaacatgggcatcaagcactatgagctgaaccccagcggcaacaacttcaacaggaaggcccacctgacagacccccagacagctgtgattgaggagaaccccctggtgtccaatgacaggacccagacctgggtgaagagcagcgagtaccacgagaacaagaagagctaccagacctctgtgcaccgggtgagaagaagaagccacagcatgatgaagccctacaagtgcaatgaatgtgggaagagcttctgccagaagggccacctgatccagcaccagaggacccacactggagagaagccctttgaatgttctgaatgtgggaagaccttcagccagaagagccacctgagcacccaccagaggatccacacagctgagaagccctacaagtgcaatgaatgtgggaagacctttgtgcagaagagcaccctgcggggccaccagaggatccacactggagagaagccctatgaatgttctgaatgtgggaagacctttgtgcagaagagcaccctgcgggaccaccaccgcatccacactggagagaagagcttccagtgcaaccagtgtgggaagaccttcggccagaagagcaacctgcgcatccaccagaggacccacactggagagaagacctaccagtgcaatgaatgtgagaagagcttctggaggaaggaccacctgatccagcaccagaagacccacactggagagaagcccttcaagtgcaatgaatgtgggaagacctttgcccggaccagcaccctgcgggtgcaccagaggatccacactggagagaagcccttcaagtgcaatgaatgtgggaagaagtttgtgaggaaggccatcctgagtgaccaccagaggatccacactggagagaagcccttccagtgcaacaagtgtgggaagaccttcggccagaagagcaacctgcgcatccaccagaggacccacagcggggagaagagctatgaatgtaatgaatatggcaagctgtgcaagaagagcaccctgagcctgtaccagaagatccagggcgagggcaacccctactag

SEQ ID NO: 18010 - DNA, 789 bp, Artificial Sequence
  Description of Artificial Sequence: Synthetic coding sequence
atgcagctgcccccagccctgtgtgcccggctggccgccggccctggagctgctgagcccctgcctgtggagcgggaccctgctgctggagctgcccccttccgctttgtggcccggcctgtgcgcttcccccgggagcaccagttctttgaagatggagatgtgcagaggcacctgtacctgcaggatgtgatcatgcaggtggctgatgtgcctgagaagccccgggtgcctgcctttgcctgccaggtggccggctgctgccaggtgtttgatgccctggatgattatgagcaccactaccacaccctgcatggaaatgtgtgcagcttctgcaagagggccttccccagcggccacctgctggatgcccacatcctggagtggcatgacagcctcttccagatcctgtctgagcggcaggacatgtaccagtgcctggtggagggctgcacagagaagttcaagaccagccgggacaggaaggaccacatggtgaggatgcacctgtacccagctgacttccgctttgacaagcccaagaagagccgcagccctgccagcgctgaggcccctggggacagcggggagaggtctgagggggaggccatggagatctgcagcgagcctgtggccgccagccctgccccagctggggagcggcgcatctaccgccacaggtctgtgtctgagctgttcctgaagcctgtgctgaacatgtgcagcgtgctgcgcatcctgggctgcacctgggccgccgccctgctgatcctgaacagcgagaggtag

SEQ ID NO: 18011 - DNA, 759 bp, Artificial Sequence
  Description of Artificial Sequence: Synthetic coding sequence
atgcagctgcccccagccctgtgtgcccggctggccgccggccctggagctgctgagcccctgcctgtggagcgggaccctgctgctggagctgcccccttccgctttgtggcccggcctgtgcgcttcccccgggagcaccagttctttgaagatggagatgtgcagaggcacctgtacctgcaggatgtgatcatgcaggtggctgatgtgcctgagaagccccgggtgcctgcctttgcctgccaggtggccggctgctgccaggtgtttgatgccctggatgattatgagcaccactaccacaccctgcatggaaatgtgtgcagcttctgcaagagggccttccccagcggccacctgctggatgcccacatcctggagtggcatgacagcctcttccagatcctgtctgagcggcaggacatgtaccagtgcctggtggagggctgcacagagaagttcaagaccagccgggacaggaaggaccacatggtgaggatgcacctgtacccagctgacttccgctttgacaagcccaagaagagccgcagccctgccagcgctgaggcccctggggacagcggggagaggtctgagggggaggccatggagatctgcagcgagcctgtggccgccagccctgccccagctggggagcggcgcatctaccgccaccgcatccccagcaccatctgcttcggccagggcgccgcccggggcttcaagagcaacaagaagaagaccaagcagtgctag

SEQ ID NO: 18012 - DNA, 933 bp, Artificial Sequence
  Description of Artificial Sequence: Synthetic coding sequence
atgcaggtggctgatgtgcctgagaagccccgggtgcctgcctttgcctgccaggtggccggctgctgccaggtgtttgatgccctggatgattatgagcaccactaccacaccctgcacggcaatgtgtgcagcttctgcaagagggccttccccagcggccacctgctggatgcccacatcctggagtggcatgacagcctcttccagatcctgtctgagcggcaggacatgtaccagtgcctggtggagggctgcacagagaagttcaagaccagccgggacaggaaggaccacatggtgaggatgcacctgtacccagctgacttccgctttgacaagcccaagaagagccgcagccctgccagcgctgaggcccctggggacagcggggagaggtctgagggggaggccatggagatctgcagcgagcctgtggccgccagccctgccccagctggggagcggcgcatctaccgccaccggctgctgctggtgaccagcctggtggtggtgctgctgtgggaggccggggctgtgcctgcccccaaggtgcccatcaagatgcaggtgaagcactggcccagcgagcaggaccctgagaaggcctggggcgcccgggtggtggagcccccagagaaggatgaccagctggtggtgctcttccctgtgcagaagcccaagctgctgaccacagaggagaagccccggggccagggccggggccccatcctgcccggcaccaaggcctggatggagacagaggacaccctgggccacgtgctgagccctgagccagaccatgacagcctgtaccaccccccacctgaggaggaccagggcgaggagcggccccggctgtgggtgatgcccaaccaccaggtgctgctgggccctgaggaggaccaggaccacatctaccacccccagtag

SEQ ID NO: 18013 - DNA, 1704 bp, Artificial Sequence
  Description of Artificial Sequence: Synthetic coding sequence
atgagcagccggctgggcgctgtgcctgccaccagcggccccaccaccttcaagcagcagaggagcaccagaattgtgggcgccaagaacagcaggacccagtgcagcatcaaggacaacagcttccagtacaccatcccccatgatgacagcctgagcggcagcagcagcgccagcagctgtgagcctgtgtctgacttccctgccagcttcaggaagagcacctactggatgaagatgaggcgcatcaagccagctgccaccagccacgtggagggcagcggcggcgtgtctgccaagggcaagaggaagccccggcaggaggaggatgaggactaccgggagttcccccagaagaagcacaagctgtatggcaggaagcagaggcccaagacccagcccaaccccaagagccaggcccggcgcatcaggaaggagccccctgtgtatgctgctggcagcctggaggagcagtggtacctggagatcgtggacaagggctctgtgtcctgccccacctgccaggccgtgggcaggaagaccatcgagggcctgaagaagcacatggagaactgcaagcaggagatgttcacctgccaccactgtgggaagcagctgcggagcctggccggcatgaagtaccacgtgatggccaaccacaacagcctgcccatcctgaaggctggagatgaaattgatgagcccagcgagcgggagcggctgaggacagtgctgaagaggctgggcaagctgcgctgcatgagggagagctgcagcagcagcttcaccagcatcatgggctacctgtaccacgtgaggaaatgtgggaaaggagctgctgagctggagaagatgaccctgaagtgccaccactgtgggaagccctaccgcagcaaggccggcctggcctaccacctgcggtctgagcacggccccatctccttcttccctgagagcggccagccagaatgtctgaaggagatgaacctggagagcaagagcggcggccgggtgcagaggagaagtgccaagattgctgtgtaccacctgcaggagctggccagcgctgagctggccaaggagtggcccaagaggaaggtgctgcaggacctggtgcctgatgacaggaagctgaagtacaccaggcctggcctgcccaccttcagccaggaggtgctgcacaagtggaagacagacatcaagaagtaccaccgcatccagtgccccaaccagggctgtgaggccgtgtacagctctgtgtctggcctgaaggcccacctgggcagctgcaccctgggcaactttgtggccggcaagtacaagtgcctgctgtgccagaaggagtttgtgtctgagagcggcgtgaagtaccacatcaacagcgtgcatgctgaggactggtttgtggtgaaccccaccaccaccaagagctttgagaagctgatgaagatcaagcagaggcagcaggaggaggagaagaggcggcagcagcacaggagcagaagaagcctgcggcggcggcagcagcccggcatcgagctgcctgagacagagctgagcctgcgggtgggcaaggaccagaggagaaataatgaggagctggtggtgtctgccagctgcaaggagcctgagcaggagcctgtgcctgcccagttccagaaggtgaagccacccaagaccaaccacaagaggggcaggaagtag

SEQ ID NO: 18014 - DNA, 1701 bp, Artificial Sequence
  Description of Artificial Sequence: Synthetic coding sequence
atgagcagccggctgggcgctgtgcctgccaccagcggccccaccaccttcaagcagcagaggagcaccagaattgtgggcgccaagaacagaacccagtgcagcatcaaggacaacagcttccagtacaccatcccccatgatgacagcctgagcggcagcagcagcgccagcagctgtgagcctgtgtctgacttccctgccagcttcaggaagagcacctactggatgaagatgaggcgcatcaagccagctgccaccagccacgtggagggcagcggaggagtgtctgccaagggcaagaggaagccccggcaggaggaggatgaggactaccgggagttcccccagaagaagcacaagctgtatggcaggaagcagaggcccaagacccagcccaaccccaagagccaggcccggcgcatcaggaaggagccccctgtgtatgctgctggcagcctggaggagcagtggtacctggagatcgtggacaagggctctgtgtcctgccccacctgccaggccgtgggcaggaagaccatcgagggcctgaagaagcacatggagaactgcaagcaggagatgttcacctgccaccactgcggcaagcagctgcggagcctggccggcatgaagtaccacgtgatggccaaccacaacagcctgcccatcctgaaggctggagatgaaattgatgagcccagcgagcgggagcggctgaggacagtgctgaagaggctgggcaagctgcgctgcatgagggagagctgcagcagcagcttcaccagcatcatgggctacctgtaccacgtgaggaaatgtgggaaaggagctgctgagctggagaagatgaccctgaagtgccaccactgcggcaagccctaccgcagcaaggccggcctggcctaccacctgcggagtgaacatggccccatctccttcttccctgagagcggccagcctgagtgcctgaaggagatgaacctggagagcaagagcggcggccgggtgcagaggagaagtgccaagattgctgtgtaccacctgcaggagctggccagcgctgagctggccaaggagtggcccaagaggaaggtgctgcaggacctggtgcctgatgacaggaagctgaagtacacccggcccggcctgcccaccttcagccaggaggtgctgcacaagtggaagacagacatcaagaagtaccaccgcatccagtgccccaaccagggctgtgaggccgtgtacagctctgtgtctggcctgaaggcccacctgggcagctgcaccctgggcaactttgtggccggcaagtacaagtgcctgctgtgccagaaggagtttgtgtctgagagcggcgtgaagtaccacatcaacagcgtgcatgctgaggactggtttgtggtgaaccccaccaccaccaagagctttgagaagctgatgaagatcaagcagaggcagcaggaggaggagaagaggcggcagcagcacaggagccgccgcagcctgcggcggcggcagcagcccggcatcgagctgcctgagacagagctgagcctgcgggtgggcaaggaccagaggaggaacaatgaggagctggtggtgtctgccagctgcaaggagcctgagcaggagcctgtgcctgcccagttccagaaggtgaagccacccaagaccaaccacaagaggggcaggaagtag

SEQ ID NO: 18015 - DNA, 1473 bp, Artificial Sequence
  Description of Artificial Sequence: Synthetic coding sequence
atgaagatgaggcgcatcaagccagctgccaccagccacgtggagggcagcggaggagtgtctgccaagggcaagaggaagccccggcaggaggaggatgaggactaccgggagttcccccagaagaagcacaagctgtatggcaggaagcagaggcccaagacccagcccaaccccaagagccaggcccggcgcatcaggaaggagccccctgtgtatgctgctggcagcctggaggagcagtggtacctggagatcgtggacaagggctctgtgtcctgccccacctgccaggccgtgggcaggaagaccatcgagggcctgaagaagcacatggagaactgcaagcaggagatgttcacctgccaccactgcggcaagcagctgcggagcctggccggcatgaagtaccacgtgatggccaaccacaacagcctgcccatcctgaaggctggagatgaaattgatgagcccagcgagcgggagcggctgaggacagtgctgaagaggctgggcaagctgcgctgcatgagggagagctgcagcagcagcttcaccagcatcatgggctacctgtaccacgtgaggaaatgtgggaaaggagctgctgagctggagaagatgaccctgaagtgccaccactgcggcaagccctaccgcagcaaggccggcctggcctaccacctgcggagtgaacatggccccatctccttcttccctgagagcggccagcctgagtgcctgaaggagatgaacctggagagcaagagcggcggccgggtgcagaggagaagtgccaagattgctgtgtaccacctgcaggagctggccagcgctgagctggccaaggagtggcccaagaggaaggtgctgcaggacctggtgcctgatgacaggaagctgaagtacacccggcccggcctgcccaccttcagccaggaggtgctgcacaagtggaagacagacatcaagaagtaccaccgcatccagtgccccaaccagggctgtgaggccgtgtacagctctgtgtctggcctgaaggcccacctgggcagctgcaccctgggcaactttgtggccggcaagtacaagtgcctgctgtgccagaaggagtttgtgtctgagagcggcgtgaagtaccacatcaacagcgtgcatgctgaggactggtttgtggtgaaccccaccaccaccaagagctttgagaagctgatgaagatcaagcagaggcagcaggaggaggagaagaggcggcagcagcacaggagccgccgcagcctgcggcggcggcagcagcccggcatcgagctgcctgagacagagctgagcctgcgggtgggcaaggaccagaggaggaacaatgaggagctggtggtgtctgccagctgcaaggagcctgagcaggagcctgtgcctgcccagttccagaaggtgaagccacccaagaccaaccacaagaggggcaggaagtag

SEQ ID NO: 18016 - DNA, 1617 bp, Artificial Sequence
  Description of Artificial Sequence: Synthetic coding sequence
atgagcagccggctgggcgctgtgcctgccaccagcggccccaccaccttcaagcagcagaggagcaccagaattgtgggcgccaagaacagaacccagtgcagcatcaaggacaacagcttccagtacaccatcccccatgatgacagcctgagcggcagcagcagcgccagcagctgtgagcctgtgtctgacttccctgccagcttcaggaagagcacctactggatgaagatgaggcgcatcaagccagctgccaccagccacgtggagggcagcggaggagtgtctgccaagggcaagaggaagccccggcaggaggaggatgaggactaccgggagttcccccagaagaagcacaagctgtatggcagcctggaggagcagtggtacctggagatcgtggacaagggctctgtgtcctgccccacctgccaggccgtgggcaggaagaccatcgagggcctgaagaagcacatggagaactgcaagcaggagatgttcacctgccaccactgcggcaagcagctgcggagcctggccggcatgaagtaccacgtgatggccaaccacaacagcctgcccatcctgaaggctggagatgaaattgatgagcccagcgagcgggagcggctgaggacagtgctgaagaggctgggcaagctgcgctgcatgagggagagctgcagcagcagcttcaccagcatcatgggctacctgtaccacgtgaggaaatgtgggaaaggagctgctgagctggagaagatgaccctgaagtgccaccactgcggcaagccctaccgcagcaaggccggcctggcctaccacctgcggagtgaacatggccccatctccttcttccctgagagcggccagcctgagtgcctgaaggagatgaacctggagagcaagagcggcggccgggtgcagaggagaagtgccaagattgctgtgtaccacctgcaggagctggccagcgctgagctggccaaggagtggcccaagaggaaggtgctgcaggacctggtgcctgatgacaggaagctgaagtacacccggcccggcctgcccaccttcagccaggaggtgctgcacaagtggaagacagacatcaagaagtaccaccgcatccagtgccccaaccagggctgtgaggccgtgtacagctctgtgtctggcctgaaggcccacctgggcagctgcaccctgggcaactttgtggccggcaagtacaagtgcctgctgtgccagaaggagtttgtgtctgagagcggcgtgaagtaccacatcaacagcgtgcatgctgaggactggtttgtggtgaaccccaccaccaccaagagctttgagaagctgatgaagatcaagcagaggcagcaggaggaggagaagaggcggcagcagcacaggagccgccgcagcctgcggcggcggcagcagcccggcatcgagctgcctgagacagagctgagcctgcgggtgggcaaggaccagaggaggaacaatgaggagctggtggtgtctgccagctgcaaggagcctgagcaggagcctgtgcctgcccagttccagaaggtgaagccacccaagaccaaccacaagaggggcaggaagtag

SEQ ID NO: 18017 - DNA, 1158 bp, Artificial Sequence
  Description of Artificial Sequence: Synthetic coding sequence
atgagcaagggccaggtggagtaccagccccggggcaaaggaaatcctggcaggaagaagatgaagaccatcgagaacttcctgcggcgcagcatctccttcatgggcggcagcaatggcctgaagctgagccccatccccaaccccaggcctgtggtgtttggaagaaaccaccagttcatgcagcaggagatgttcacctgccaccactgcggcaagcagctgcggagcctggccggcatgaagtaccacgtgatggccaaccacaacagcctgcccatcctgaaggctggagatgaaattgatgagcccagcgagcgggagcggctgaggacagtgctgaagaggctgggcaagctgcgctgcatgagggagagctgcagcagcagcttcaccagcatcatgggctacctgtaccacgtgaggaaatgtgggaaaggagctgctgagctggagaagatgaccctgaagtgccaccactgcggcaagccctaccgcagcaaggccggcctggcctaccacctgcggagtgaacatggccccatctccttcttccctgagagcggccagcctgagtgcctgaaggagatgaacctggagagcaagagcggcggccgggtgcagaggagaagtgccaagattgctgtgtaccacctgcaggagctggccagcgctgagctggccaaggagtggcccaagaggaaggtgctgcaggacctggtgcctgatgacaggaagctgaagtacacccggcccggcctgcccaccttcagccaggaggtgctgcacaagtggaagacagacatcaagaagtaccaccgcatccagtgccccaaccagggctgtgaggccgtgtacagctctgtgtctggcctgaaggcccacctgggcagctgcaccctgggcaactttgtggccggcaagtacaagtgcctgctgtgccagaaggagtttgtgtctgagagcggcgtgaagtaccacatcaacagcgtgcatgctgaggactggtttgtggtgaaccccaccaccaccaagagctttgagaagctgatgaagatcaagcagaggcagcaggaggaggagaagaggcggcagcagcacaggagccggcggggcagccaggacacctgcatgcccaaggccctgcacaggatgtag

SEQ ID NO: 18018 - DNA, 690 bp, Artificial Sequence
  Description of Artificial Sequence: Synthetic coding sequence
atggattctgctggccaggacatcaacctgaacagccccaacaagggcctgctgagtgacagcatgacagatgtgcctgtggacacaggagtggccgcccggaccccagctgtggagggcctgacagaggccgaggaggaggagctgcgggcagagctgaccaaggtggaggaggagatcgtgaccctgcggcaggtgctggccgccaaggagcggcactgtggggagctgaagaggcggctgggcctgagcaccctgggggagctgaagcagaacctgagccgctcctggcatgatgtgcaggtgagcagcgcctacgtgaagaccagcgagaagctgggggagtggaatgagaaggtgacccagagcgacctgtacaagaagacccaggagaccctgagccaggccggccagaagaccagcgctgccctgagcacagtgggcagcgccatcagcaggaagctgggggacatgagggcccaccccttcagccacagcttcagcagctacagcatccgccacagcatctccatgcctgccatgaggaacagcgccaccttcaagagctttgaagatagagtgggcaccatcaagagcaaggtggtgggggaccgggagaatggaagtgacaacctgcccagcagcgctggcagcggggacaagcccctgagtgaccctgcccccttctag

SEQ ID NO: 18019 - DNA, 2679 bp, Artificial Sequence
  Description of Artificial Sequence: Synthetic coding sequence
atgacagaccccttctgtgtgggcggccggcggctgcccggcagcagcaagagcggccctgggaaggatggcagcaggaaggaggtgcggctgcccatgctgcatgacccccccaagatgggcatgcctgtggtgcggggcggccagacagtgcccggccaggcccccctgtgctttgatcctggcagccctgccagtgacaagacagagggcaagaagaagggccggcccaaggccgagaaccaggccctgcgggacatccccctgagcctgatgaatgactggaaggatgagttcaaggcccacagccgggtgaagtgccccaacagcggctgctggctggagttccccagcatctacggcctgaagtaccactaccagcgctgccagggcggggccatcagtgaccggctggccttcccctgccccttctgtgaggccgccttcaccagcaagacccagctggagaagcaccgcatctggaaccacatggaccggcccctgcctgccagcaagccaggccccatcagcaggcctgtgaccatcagcaggcctgtgggcgtgtccaagcccatcggcgtgtccaagcctgtgaccatcggcaagcctgtgggcgtgtccaagcccatcggcatcagcaagcctgtgtctgtgggccggcccatgcctgtgaccaaggccatccctgtgaccaggcctgtgcctgtgaccaagcctgtgacagtgtcccggcccatgcctgtgaccaaggccatgcctgtgaccaagcccatcaccgtgaccaagtctgtgcctgtgaccaagcctgtgcctgtgaccaagcccatcaccgtgaccaagctggtgacagtgaccaagcctgtgcctgtgaccaagcctgtgacagtgtcccggcccatcgtggtgtccaagcctgtgacagtgtcccggcccatcgccatcagccgccacaccccaccctgcaagatggtgctgctgaccaggtctgagaacaaggccccccgggccactggaagaaattctgggaagaagagagctgctgacagcctggacacctgccccatcccccccaagcaggcccggccagaaaatggagaatatggccccagctccatgggccagagcagcgccttccagctgtctgctgacaccagcagcggcagcctgagccctggcagccggcccagcggcggcatggaggccctgaaggctgctggccctgccagccccccagaagaagatcctgagaggaccaagcacaggaggaagcagaagacccccaagaagttcaccggggagcagcccagcatcagcggcaccttcggcctgaagggcctggtgaaggccgaggacaaggcccgggtgcacaggagcaagaagcaggagggccctggcccagaagatgccaggaagaaggtgcctgctgcccccatcaccgtgtccaaggaggccccagcccctgtggcccacccagcccctgggggccctgaggagcagtggcagagggccatccacgagcggggggaggccgtgtgccccacctgcaatgtggtgaccaggaagaccctggtgggcctgaagaagcacatggaggtgtgccagaagctgcaggatgccctgaagtgccagcactgcaggaagcagttcaagagcaaggccggcctgaactaccacaccatggccgagcacagcgccaagcccagtgatgctgaggccagcgagggcggggagcaggaggagcgggagcggctgaggaaggtgctgaagcagatgggccgcctgcgctgcccccaggagggctgtggggccgccttcagcagcctgatgggctaccagtaccaccagaggcgctgtgggaagccaccctgtgaggtggacagccccagcttcccctgcacccactgcggcaagacctaccgcagcaaggccggccatgactaccacgtgcgctctgagcacacagcccctcctcctgaggagcccacagacaagagccctgaggccgaggaccccctgggcgtggagaggaccccatctggccgggtgcggaggaccagcgcccaggtggccgtgttccacctgcaggagattgctgaagatgagctggcccgggactggaccaagaggaggatgaaggatgacctggtgcctgagacagcccggctgaactacaccaggcctggcctgcccaccctgaacccccagctgctggaggcctggaagaatgaggtgaaggagaagggccacgtgaactgccccaatgactgctgtgaggccatctacagctctgtgtctggcctgaaggcccacctggccagctgcagcaagggggcccacctggccggcaagtaccgctgcctgctgtgccccaaggagttcagcagcgagagcggcgtgaagtaccacatcctgaagacccatgctgagaactggttccgcaccagcgctgaccccccacccaagcacaggagccaggacagcctggtgcccaagaaggagaagaagaagaacctggccggcggcaagaagaggggcaggaagcccaaggagaggaccccagaggagcctgtggccaagctgcccccaagaagagatgactggcccccaggctgccgggacaagggggcccggggcagcacaggcaggaaggtgggcgtgtccaaggcccctgagaagtag

SEQ ID NO: 18020 - DNA, 2679 bp, Artificial Sequence; identical to SEQ ID NO: 18019
  Description of Artificial Sequence: Synthetic coding sequence

SEQ ID NO: 18021 - DNA, 1203 bp, Artificial Sequence
  Description of Artificial Sequence: Synthetic coding sequence
atgacctttgaagatgtggccgtggagttcagccagtgggagtggggccagctgaacccagcccagaaggacctgtaccgggaggtgatgctggagaacttcaggaacctggccatcctgggcctgctggtgtccaagccctacgtgatctgccagctggaggagggcggggagcccttcatggtggagcgggagatcagcactggagcccacagcgactggaagaggaggagcaagagcaaggagagcatgcccagctggggcatcagcaaggaggagctgttccaggtggtgtctgtggagaagcacatccaggatgtgctgcagttcagcaagctgaaggccgcctgtggctgtgatggccagctggagatgcagcagatcaagcaggagcggcacctgaagcagatgagcaccatccacaagagcgccaccaccctgagccgggactacaagtggaatggcttcggccgcagcctgggcctgcggtctgtgctggtgaaccagcacagcatcctgatgggagagggcagctacaagtgtgacacagagttccggcagaccctgggcggcaacaacagccagaggacccaccctgagaagaagagctgcaagtgcaatgaatgtgggaagagcttccacttccagagcgagctgcggcggcaccagcgctgccacactggagagaagccctatgaatgtagtgactgtggccgggccttcggccacatcagcagcctcatcaagcaccagaggacccacactggagagaagccctatgaatgttctgaatgtggccgggccttcagccagagcagcagcctggtgctgcactaccgcttccacactggagagaagccctacaagtgcaatgaatgtggccgggccttcggccacaccagcagcctcatcaagcaccagaggacccacactggagagaagccctatgaatgtcgggagtgtggccgcaccttcagccagagcagcagcctcatcgtgcactaccgcttccacactggagagaagccctacaagtgcaacaagtgtggccgggccttcagccagagcagcagcctgacccagcactaccgcttccacactggagagaagccctacaagtgcaatgaatgtggccgggcctttgcccacacagccagcctcatcaagcaccagaggagccatgctgggaagaagaccctgtag

SEQ ID NO: 18022 - DNA, 1203 bp, Artificial Sequence; identical to SEQ ID NO: 18021
  Description of Artificial Sequence: Synthetic coding sequence

SEQ ID NO: 18023 - DNA, 162 bp, Artificial Sequence
  Description of Artificial Sequence: Synthetic coding sequence
cagagcgagctgcggcggcaccagcgctgccacactggagagaagccctatgagtgcagcgactgtggccgggccttcggccacatcagcagcctcatcaagcaccagctgatcctggagaagagccccatgaatgctgtgaatgtgggggagcccagctag

SEQ ID NO: 18024 - DNA, 3492 bp, Artificial Sequence
  Description of Artificial Sequence: Synthetic coding sequence
atggacaggaaccgggaggccgagatggagctgcggcggggccccagccccacccgggccggccggggccacgaggtggatggagacaaggccacctgccacacctgctgcatctgtgggaagagcttccccttccagagcagcctgagccagcacatgaggaagcacactggagagaagccctacaagtgcccctactgtgaccaccgggccagccagaagggcaacctgaagatccacatccgcagccacaggacaggcaccctcatccagggccacgagcctgaggccggggaggcccccctgggggagatgagggccagcgagggcctggatgcctgtgccagccccaccaagagcgccagcgcctgcaaccggctgctgaatggagccagccaggctgatggagcccgggtgctgaatggagccagccaggccgacagcggccgggtgctgctgcggagcagcaagaagggagctgagggcagcgcctgtgcccctggagaggccaaggctgctgtgcagtgcagcttctgcaagagccagtttgagaggaagaaggacctggagctgcacgtgcaccaggcccacaagcccttcaagtgccgcctgtgcagctatgccaccctgcgggaggagagcctgctgagccacatcgagcgggaccacatcacagcccagggccctggcagcggggaggcctgtgtggagaatggcaagccagagctgagccctggagagttcccctgtgaggtgtgtggccaggccttcagccagacctggttcctgaaggcccacatgaagaagcaccggggcagctttgaccacggctgccacatctgtggccgccgcttcaaggagccctggttcctgaagaaccacatgaaggcccacggccccaagacaggcagcaagaaccggcccaagtctgagctggaccccatcgccaccatcaacaacgtggtgcaggaggaggtgattgtggccggcctgagcctgtatgaggtgtgtgccaagtgtggcaacctcttcaccaacctggacagcctgaatgcccacaatgccatccaccggcgggtggaggccagcaggacccgggccccagctgaggagggcgctgagggccccagcgacaccaagcagttcttcctgcagtgcctgaacctgcggcccagcgctgctggggacagctgccccggcacccaggccggcagaagagtggccgagctggaccctgtgaacagctaccaggcctggcagctggccacccggggcaaggtggccgagcctgctgagtacctgaagtacggggcctgggatgaggccctggccggagatgtggcctttgacaaggacagaagagaatatgtgctggtgtcccaggagaagaggaagcgggagcaggatgccccagctgcccagggcccccccaggaagagggccagcggccctggggaccctgccccagctggccacctggaccccaggtctgctgcccggcccaacagaagagctgctgccaccaccggccagggcaagagcagcgagtgctttgaatgtgggaagatcttccgcacctaccaccagatggtgctgcacagccgggtgcaccggcgggcccggcgggagcgggacagtgatggagacagagctgcccgggcccgctgtggcagcctgtctgagggggacagcgccagccagcccagcagccctggcagcgcctgtgccgctgctgacagccctggcagcggcctggctgatgaagctgctgaagattctggagaggagggcgcccctgagcccgcccctgggggccagccccggcgctgctgcttcagcgaggaggtgaccagcacagagctgagcagcggggaccagagccacaagatgggagacaatgccagcgagcgggacacaggagagagcaaggccggcattgctgcctctgtgtccatcctggagaacagcagccgggagaccagccggcggcaggagcagcaccgcttctccatggacctgaagatgcctgccttccaccccaagcaggaggtgcctgtgcctggagatggagtggagttccccagcagcactggagctgagggccagacaggccaccctgctgagaagctgagtgacctgcacaacaaggagcacagcggcggcggcaagagggccctggccccagacctgatgcccctggacctgagcgcccggagcaccagagatgaccccagcaacaaggagacagccagcagcctgcaggccgccctggtggtgcacccctgcccctactgcagccacaagacctactacccagaggtgctgtggatgcacaagaggatctggcaccgggtgtcctgcaacagcgtggccccaccctggatccagcccaacggctacaagagcatccgcagcaacctggtgttcctgagccgcagcggccgcacaggccccccaccagccctgggcggcaaggagtgccagcccctgctgctggcccgcttcaccaggacccaggtgcctgggggcatgcctggcagcaagagcggcagcagccccctgggcgtggtgaccaaggccgcctccatgcccaagaacaaggagagccacagcggcggcccctgtgccctgtgggcccctggcccagatggctaccggcagaccaagccctgccacggccaggagccccatggagctgccacccagggccccctggccaagccccggcaggaggccagcagcaagcctgtgcctgcccctgggggcggcggcttcagccgcagcgccacccccacccccaccgtcatcgcccgggccggggcccagcccagcgccaacagcaagcctgtggagaagtttggagtgcccccagctggggccggctttgcccccaccaacaagcacagcgccccagacagcctgaaggccaagttcagcgcccagccccagggccccccaccagccaagggggagggcggggccccacccctgcccccccgggagccccccagcaaggccgcccaggagctgcggaccctggccacctgtgccgccggcagcagaggagatgctgccctgcaggcccagcccggggtggccggggcccctcctgtgctgcacagcatcaagcaggagcctgtggccgagggccacgagaagaggctggacatcctgaacatcttcaagacctacatccccaaggactttgccaccctgtaccagggctggggcgtgtctggccctggcctggagcaccggggcaccctgcggacccaggcccggcctggagaatttgtgtgcattgaatgtgggaagagcttccaccagcccggccacctgcgggcccacatgagggcccacagcgtggtgtttgaaagtgatggcccccggggcagcgaggtgcacaccaccagcgcagatgcccccaagcagggccgggaccacagcaacacaggaacagtgcagacagtgcccctgaggaagggcacctag

SEQ ID NO: 18025 - DNA, 228 bp, Artificial Sequence
  Description of Artificial Sequence: Synthetic coding sequence
atggacaggaaccgggaggccgagatggagctgcggcggggccccagccccacccgggccggccggggccacgaggtggatggagacaaggccacctgccacacctgctgcatctgtgggaagagcttccccttccagagcagcctgagccagcacatgaggaagcacactggagagaagccctacaagtgcccctactgtgaccaccgggccagccagaagggctag

SEQ ID NO: 18026 - DNA, 1479 bp, Artificial Sequence
  Description of Artificial Sequence: Synthetic coding sequence
atggccatggccctgcccatgcctggcccccaggaggccgtggtgtttgaagatgtggccgtgtacttcacccgcatcgagtggagctgcctggccccagaccagcaggccctgtacagagatgtgatgctggagaactacggcaacctggccagcctgggcttcctggtggccaagccagccctgatcagcctgctggagcagggcgaggagcccggggccctgatcctgcaggtggccgagcagagcgtggccaaggccagcctgtgcacagacagcaggatggaggccggcatcatggagagccccctgcagaggaagctgagccggcaggccggcctgcccggcaccgtgtggggctgcctgccctggggccaccctgtgggcggccacccagccccaccccacccccacggcggcccagaagatggcagtgacaagcccacccacccccgggcccgggagcacagcgccagcccccgggtgctgcaggaggacctgggccggcctgtgggcagcagcgccccccgctaccgctgtgtgtgtgggaaggccttccgctacaacagcctgctgctgcggcaccagatcatccacactggagccaagcccttccagtgcacagaatgtgggaaggccttcaagcagagcagcatcctgctgcggcaccagctgatccacacagaggagaagcccttccagtgtggagaatgtgggaaggccttccggcagagcacccagctggccgcccaccaccgggtgcacacccgggagcggccctatgcctgtggagaatgtgggaaggccttcagccgcagcagccggctgctgcagcaccagaagttccacactggagagaagccctttgcctgcacagaatgtgggaaggccttctgccgccgcttcaccctgaatgaacatggccgcatccacagcggggagcggccctaccgctgcctgcgctgtggccagcgcttcatccggggcagcagcctgctgaagcaccaccggctgcacgcccaggagggcgcccaggacggcggcgtgggccagggcgccctgctgggcgccgcccagaggccccaggccggggacccccctcatgaatgtcctgtgtgtggccggcccttccgccacaacagcctgctgctgctgcacctgcggctgcacactggagagaagccctttgaatgtgccgagtgtgggaaggcctttggaaggaagagcaacctgaccctgcaccagaagatccacaccaaggagaagccctttgcctgcacagaatgtgggaaggccttccgccgcagctacaccctgaatgagcactaccgcctgcacagcggggagcggccctaccgctgccgggcctgtggccgggcctgcagccggctgagcaccctcatccagcaccagaaggtgcacggccgggagcccggggaggacacagagggcagaagagccccctgctgggccagctag

SEQ ID NO: 18027 - DNA, 1479 bp, Artificial Sequence; identical to SEQ ID NO: 18026
  Description of Artificial Sequence: Synthetic coding sequence

SEQ ID NO: 18028 - DNA, 1479 bp, Artificial Sequence; identical to SEQ ID NO: 18026
  Description of Artificial Sequence: Synthetic coding sequence

SEQ ID NO: 18029 - DNA, 3225 bp, Artificial Sequence
  Description of Artificial Sequence: Synthetic coding sequence
atgaaggacatcggccagcagctgtacaccacccacctgaatggaggccacaacagcctgaccatgagccccaagcagccagatgccaacggggccccccggcccaaccggcaggaggcccagaccctgctgtaccagggcagcgaggccgaggccgccatgatgaccatcgccacctgtgccaagtgcaagtctgtgcacaagatcagcctgcaggacctgcagaagggcaccgggaaggatggcatgtatgtgtgcttccagtgcagcctgggcgccgccccacccaacttccactttgtgagcaacaacagcagcgccacccacgtgggcaacaagacagagaacttcagcagctctgtgaacagcaagttcaaggtgaggaacttcaagccaggcaagtactactgtgacaagtgccgcttcagcaccaaggaccccctgcagtacaagaagcacaccctgcagcacgaggagatcaagttcatctgcagccactgcagctacatctcctacaccaagggggagttccagaggcacctggtgaagcacacaggcatcttcccctaccagtgtgagtactgtgactatggagccatcagaaatgactacatcgtgaagcacaccaagagggtgcatgagcgggccggggccaagaggcctgtgaaggctgtggccaagctggagcccaagaggacaggcaccagcaagcagaaccctgagctgctgaaggccagcaaccccaggaccaccttccagaacaagtggagcgaccagctgagcggcttcagcctgcacgccaacaaggacaagatgcacaacatcatgctgctgcctgagcccaaggagtaccagaaggatgtggtgtgcatccccaacaagatgaccctgtctgagcccaatgaggtgaacctgtttgagaacaagaatgtggaggtggaggtgctgagccctgccaaggagcctgtgcagcccggcatgcccctgactgtggtggccccagctgagctggtggtgcctgccaactgcctggcccagctgattgatgtgaaggtggtgaatggcacccagcagctggtgctgaagctgttccccctggaggagaacaactgcctggaggccggccgggacaatggaggcaacagcgagaggatggtgaaggagaagggcagcaatgagcaggagaaggtgctgtctgctgagaagaccaagagcctgactgtggatggaaatgtgggcaagctggtgggcatcgacagcttccagcccagcgtgcagaagcagctgaagaatgtgaagtgggtgcgctcctatgacttcatcatgcccaacagctctgtgcacaacaacgggaagagcttcatcaacagcgagaccatcgaggacttccagaagaagaacaacctgtacccccacaggacagccttccccagcgtggccctgaagggccacagcctggccagcgtcttcaagaacagcgtgctgcggagcctgggcgccgccagcaaccccttcccctacaaggctgctgtgtgctttgctgagagcggcaggaacctgcacagcagcagccagcagctgctgccctttgctgccagccctgccacctgcagcttcagcggggagaagggcctgctgcctgtgtctgaaaatgacctggagagcaccagcaaggtgaacatccctgtgaaggtggtgagcagcaacaggaagcaggaggacaaccagacagaggagcacaaggctgtgtccacagtgggccagatcagcagccagcacaagtctgagtacctgcacatcaacatcactggagaagatagaagccagcagcccggggacaagcccctggagctgaagaacagcgagaggaccaacaacaccaatgatggccctgtgatcagctctgtgttcagcctgagcagcggctctgaaaatgtgcctgagggcatcaagtggaacagcagcaccagcaagatcaagagcattgagctgctgcggaggaagatcgcccagctgattgagagctgtgggaagcccagcagcctggccagcaacagcgcccacagaagatctgtgggccaggccagcaagggcaccagcaaggccaccagcgagggcatccaggagatcaacgtgtccctgaccggcctgggccacagcacaggcaccctgcagaagcccccaaatgatggcggcatcaccggcaaccggcagctgacccaccagcagatctacccccactttgctgatggcagcaacaggaagaccaagagccgggtggccaggaaggcccacgtggccacccctgtgctgatccccaagggagctgtgctgcgggtgctgaacagcagtgaaaatgcccacatcatcgaggccacctgtgaggcccctgtgtccatcccctgcagcgagcggcagctgatcaagcctgtgcccttctgccctgtgcggcaggccgacagcgacctgcagcccctgcggtctgagcggggccccatcgacatgagccccaacatcgagacccccctgcggcccaagctgaggaaggagagcgctgtgtgcagcaccatccacaggaagacaggcctgctgtatggccagcagggcagcagcgagctgaacaagcagggccgcctgctgagccgcagcctgagcatcagcaggaacaagaccaagcaggtgcacctgagcaggaagaagaacaagatccaggccgagcccagccgctgcctgaaggaccccagcatcttccaggtggcccggcagctgcggctgattgctgccaagccagaccagctgatcaagtgccccaggaggaaccagcccgtcatcgtgctgaaccacccagatgtggacagccctgaggtgaccaacgtgatgaaggtgatcaacaagtacaagggaaatgtgctgaaggtggtgctgtctgagaggacccgctgccagctgggcatccgccgccaccacgtgcggctgacctaccagaatgctgaggaggccagccagatcaagaggcagatgatgctgaagatgaagctgaagaaggtgcacaagaacaactaccaggtggtggacagcctgcctgatgacagcagccagtgtgtgttcaagtgctggttctgtggccgcctgtatgaggaccaggaggagtggatgagccacggccagaggcacctgattgaggccacccgggactgggatgtgctgagcagcaagggcaagtag

SEQ ID NO: 18030 - DNA, 228 bp, Artificial Sequence
  Description of Artificial Sequence: Synthetic coding sequence
atgaaggacatcggccagcagctgtacaccacccacctgaatggaggccacaacagcctgaccatgagccccaagcagccagatgccaacggggccccccggcccaaccggcaggaggcccagaccctgctgtaccagggcagcgaggccgaggccgccatgatgaccatcgccacctgtgccaagtgcaagtctgtgcacaagatcagcctgcaggacctgcagtag

SEQ ID NO: 18031 - DNA, 1623 bp, Artificial Sequence
  Description of Artificial Sequence: Synthetic coding sequence
atggagctgctgaccttcagagatgtggccatcgagttcagccctgaggagtggaagtgcctggaccctgcccagcagaacctgtacagagatgtgatgctggagaactacagaaacctggtgtccctggccgtgtacagctactacaaccagggcatcctgcctgagcagggcatccaggacagcttcaagaaggccaccctgggccgctatggcagctgtggcctggagaacatctgcctgtggaagaactgggagagcatcggggagggggagggccagaaggagtgctacaacctgtgcagccagtacctgaccaccagccacaacaagcacctgactgtgaagggggacaaggagtaccgcatcttccagaagaagccccagttcctgtctgctgcccccacagagccctgcatccccatgaacaagtaccagcacaagttcctgaagagcgtcttctgcaacaagaaccagatcaacttcaaccacgacagcaacatcagcaagcaccacagcacccacttcctggagaactactacaactgcaatgaatgtgagaaggtgttctaccagagcagcaagctgatcttccctgagaacatccacatccagaagaagccctacaacagcaatgaatgtggggagaccagtgaccccttcagcaagctgacccagcaccagaggatctacatcggggagagcagccagcgctgcaacaagaagtgcatcatcgtgttcagccagagccacctgaagggccacaagatcatcaacacaggagagaagtctgtgaagtacaaggagcggggcaaggccttcacccggggcctgcacctgggccaccagaagatccacactggagagaagccctacaagtgcaagaagtgtgacaaggccttcaacaagagcagccacctggcccagcaccagaggatccacactggagagaagcccttcaagtgcaaggaatgtgggaaggccttcaacagaggcagctacctgacccagcaccagaggatccacactggagagcgggccttcaagtgtgaggagtgtgggaaggccttcaacagaggcagctacctgacccagcaccagaggatccacactggagagaagcccttccgctgcaaggaatgtgggaaggccttcaacagaagcagctatgtgacccagcaccagaggatgcacactggagagaagcccttcaagtgcaaggaatgtgggaaggccttcaacagagccagccacctgacccagcaccagaggatccacactggagagaagcacttcaagtgcaaggaatgtgggaaggccttcaacagaggcagccacctgaccaggcaccagaggatccacactggagagaagagcttcaagtgtgaggagtgtgggaaggccttcatctggggcagccacctgacccagcaccagagggtgcacactggagagaagttcttcaagtgcaaggaatgtgggaaggccttcaccaggagcagccacctgacccagcaccagaggatccacactggagagaagcccttcaagtgcaaggaatgtgggaaggccttcaacagaagaagcaccctgacccagcaccagatcatccacaccaggtag

SEQ ID NO: 18032 - DNA, 1623 bp, Artificial Sequence; identical to SEQ ID NO: 18031
  Description of Artificial Sequence: Synthetic coding sequence

SEQ ID NO: 18033 - DNA, 795 bp, Artificial Sequence
  Description of Artificial Sequence: Synthetic coding sequence
atggacacccccagcccagaccccctgcccagccccctgcccggggaggaggagaagcccctggccctgagcccccctgtgccccggggcagaagaggccggcggcctgggggcgccaccagcagcaacagaaccctgaaggccagcctgcccaggaagaggggccggccccccaagagcggccaggagccccccctggtgcaggtgcagggcgtgacagcccctgtgggcagcagcggcggcagtgacctgctgctgattgatgaccagggcgtgccctacacagtgtctgagggcagcgctgctggccctgagggcagcggccccaggaaggccccccacttctgccctgtgtgcctgcgggccttcccctacctgagtgacctggagcggcacagcatcagccacagcgagctgaagccccaccagtgcaaggtgtgtgggaagaccttcaagaggagcagccacctgcggcggcactgcaacatccatgctggcctgcggcccttccgctgccccctgtgcccccggcgcttccgggaggccggggagctggcccaccaccaccgggtgcacagcggggagcggccctaccagtgccccatctgccgcctgcgcttcacagaggccaacaccctgcggagacatgccaagaggaagcaccctgaggccatgggcgtgcccctgtgtgccccagaccccggcagcgagcccccctgggatgaggagggcatcccagccacagctggagctgaggaggaggaggagacagagggcaagggggagcccgcctag

SEQ ID NO: 18034 - DNA, 594 bp, Artificial Sequence
  Description of Artificial Sequence: Synthetic coding sequence
atgagcagcctgacctaccaccaccggctgcacactggagagaagccctacaagtgtgaagaatgtgacaaggccttccgccacaacagcgccctgcagaggcaccggcgcatccacactggagagaagccccacaagtgcaatgaatgtgggaagaccttcagccagaagagctacctggcctgccacaggagcatccacacaggcaagaagccctatgaatgtgaagaatgtgacaaggccttctccttcaagagcaacctggagagccaccgcatcacccacactggagagaagccctacaagtgcaatgactgtgggaagaccttcagccacatgagcaccctgacctgccaccggcggctgcacactggagagaagccctacaagtgtgaagaatgtgatgaggccttccgcttcaagagcagcctggagcggcaccggcgcatccacaacggggagaagctgtacaagtgcaatgaatgtgggaagaccttcagccaggagctgagcctgacctgccactgccgcctgcacagcggggagaagccctgcaagtgtggagaatgtgacaaggcctacagcttcaagtag

SEQ ID NO: 18035 - DNA, 1332 bp, Artificial Sequence
  Description of Artificial Sequence: Synthetic coding sequence
atgctggagaactacagaaacctggtgtccctgggcatcagcagcaagtgcaccatgaaggagttcagcagcacagcccagggcaacacagaggtgatccacacaggcaccctgcagagacatgagcggcaccacatcggggacttctccttccaggagattgagaaggacatccacaactttgagttccagtggcaggaggatgaaagaaatggacatgaggcccccatgaccaagatcaagaagctgatgggcagcacagagcagtatgaccacagacatgctggcaacaagcccatcaagtaccagctgggcagcagcttccacagccacctgtctgagctgcacatcttccagcccaagggcaagatcaacaaccaggtggagaagagcatcaatgatgccagctctgtgtccacagcccagaggatcagctgccggcccaagacccacatcagcaacaactacggggacaacttcctgaactacagcctgctgacccagaggcaggaggtgaggatgagggagaagagcttccagtgcatcgagagcggcaaggccttcaactacagcagcctgctgaggaagcaccagatcatccacctgggggagaagcagtacaagtgtgatgtgtgtgacaaggtgttcatcaggaagcgctacctggcccggcaccggcgctgccacactggagagaagccctacaagtgcaatgaatgtgggaagagcttcagccagatgagcagcctgacctaccaccaccggctgcacactggagagaagccctacaagtgtgaagaatgtgacaaggccttccgccacaacagcgccctgcagaggcaccggcgcatccacactggagagaagccccacaagtgcaatgaatgtgggaagaccttcagccagaagagctacctggcctgccacaggagcatccacacaggcaagaagccctatgaatgtgaagaatgtgacaaggccttctccttcaagagcaacctggagagccaccgcatcacccacactggagagaagccctacaagtgcaatgactgtgggaagaccttcagccacatgagcaccctgacctgccaccggcggctgcacactggagagaagccctacaagtgtgaagaatgtgatgaggccttccgcttcaagagcagcctggagcggcaccggcgcatccacaacggggagaagctgtacaagtgcaatgaatgtgggaagaccttcagccaggagctgagcctgacctgccactgccgcctgcacagcggggagaagccctgcaagtgtggagaatgtgacaaggcctacagcttcaagtag

SEQ ID NO: 18036 - DNA, 1440 bp, Artificial Sequence
  Description of Artificial Sequence: Synthetic coding sequence
atggccctgccccagggcctgctgaccttcagagatgtggccatcgagttcagccaggaggagtggaagtgcctggaccctgcccagaggaccctgtacagagatgtgatgctggagaactacagaaacctggtgtccctgggcatcagcagcaagtgcaccatgaaggagttcagcagcacagcccagggcaacacagaggtgatccacacaggcaccctgcagagacatgagcggcaccacatcggggacttctccttccaggagattgagaaggacatccacaactttgagttccagtggcaggaggatgaaagaaatggacatgaggcccccatgaccaagatcaagaagctgatgggcagcacagagcagtatgaccacagacatgctggcaacaagcccatcaagtaccagctgggcagcagcttccacagccacctgtctgagctgcacatcttccagcccaagggcaagatcaacaaccaggtggagaagagcatcaatgatgccagctctgtgtccacagcccagaggatcagctgccggcccaagacccacatcagcaacaactacggggacaacttcctgaactacagcctgctgacccagaggcaggaggtgaggatgagggagaagagcttccagtgcatcgagagcggcaaggccttcaactacagcagcctgctgaggaagcaccagatcatccacctgggggagaagcagtacaagtgtgatgtgtgtgacaaggtgttcatcaggaagcgctacctggcccggcaccggcgctgccacactggagagaagccctacaagtgcaatgaatgtgggaagagcttcagccagatgagcagcctgacctaccaccaccggctgcacactggagagaagccctacaagtgtgaagaatgtgacaaggccttccgccacaacagcgccctgcagaggcaccggcgcatccacactggagagaagccccacaagtgcaatgaatgtgggaagaccttcagccagaagagctacctggcctgccacaggagcatccacacaggcaagaagccctatgaatgtgaagaatgtgacaaggccttctccttcaagagcaacctggagagccaccgcatcacccacactggagagaagccctacaagtgcaatgactgtgggaagaccttcagccacatgagcaccctgacctgccaccggcggctgcacactggagagaagccctacaagtgtgaagaatgtgatgaggccttccgcttcaagagcagcctggagcggcaccggcgcatccacaacggggagaagctgtacaagtgcaatgaatgtgggaagaccttcagccaggagctgagcctgacctgccactgccgcctgcacagcggggagaagccctgcaagtgtggagaatgtgacaaggcctacagcttcaagtag

SEQ ID NO: 18037 - DNA, 153 bp, Artificial Sequence
  Description of Artificial Sequence: Synthetic coding sequence
atggccctgccccagggcctgctgaccttcagagatgtggccatcgagttcagccaggaggagtggaagtgcctggaccctgcccagaggaccctgtacagagatgtgatgctggagaactacagaaacctggtgtccctgggcttcctgtag

SEQ ID NO: 18038 - DNA, 1887 bp, Artificial Sequence
  Description of Artificial Sequence: Synthetic coding sequence
atggccctgacccagggccccctgaagttcatggatgtggccatcgagttcagccaggaggagtggaagtgcctggaccctgcccagaggaccctgtacagagatgtgatgctggagaactacagaaacctggtgtccctgggcatctgcctgcctgacctgtctgtgacctccatgctggagcagaagagggacccctggaccctgcagagcgaggagaagatcgccaatgaccctgatggaagagagtgcatcaagggcgtgaacacagagaggagcagcaagctgggcagcaatgccggcaacaagccctgcaagaaccagctgggcttcaccttccagctgcacctgagtgacctgcagctgttccaggccgagaggaagatcagcggctgcaagcactttgagaagcctgtgtctgacaacagctctgtgagccccctggagaagatcagcagctctgtgaagagccacctgctgaacaagtacagaaacaactttgaccacgcccccctgctgccccaggagcagaaggcccacatccgggagaaggcctacaagtgcaatgaacatggccaggtgttccgggccagcgccagcctgaccaaccaggtgatccacaatgctgacaacccctacaagtgcagtgaatgtgggaaggtgttcagctgcagcagcaagctggtgatccacaggaggatgcacactggagagaagccctacaagtgccatgaatgtgggaagctgttcagcagcaacagcaacctgagccagcaccagaggatccacactggagagaagccctacaagtgccatgaatgtgacaaggtgttccgcagcagcagcaagctggcccagcaccagaggatccacactggagagaagccctacaagtgccatgaatgtgacaaggtgttcaaccagatcgcccacctggtgcgccaccagaagatccacactggagagaagccctacagctgcaacaagtgtgggaaggtgttcagccgccacagctacctggccgagcaccagacagtgcacactggagagaagccctacaagtgtgaagaatgtgggaaggccttctctgtgcgcagcagcctcatcacccaccagctgatccacacaggcaggaagccctacaagtgcaaggaatgtgacaaggtgtttggaaggaagtgcttcctgaccagccaccagaggatccacacccgggagcggccctacggctgcagccagtgtgggaagatcttcagccagaagagtgacctgatccgccacaggaagacccacacagatgagaagccctacaagtgcaacaagtgtggcacagccttccgggagttcagtgacctgacagcccacttcctgatccacagcggggagaagccctatgagtgcaaggaatgtgggaaggtgttccgctacaagagcagcctgaccagccaccaccgcatccacactggagagaagccctacaagtgcaacagatgtgggaaggtgttcagccgcagcagcaacctggtgtgccaccagaagatccacactggagagaagccctacaagtgcaaccagtgtgggaaggtgttcaaccaggccagctacctgaccaggcaccagatcatccacactggagagcggccctaccgctgcagcaaatgtgggaaggccttccggggctgcagcggcctgacagcccacctggccatccacacagagaagaagagccatgagtgcaaggaatgtgggaagatcttcacccagaagagcagcctgaccaaccaccaccgcatccacatcggggagaagccctacaagtgcaccctgtgcagcaaggtgttcagccacaacagcgacctggcccagcaccagagggtgcacagctag

SEQ ID NO: 18039 - DNA, 246 bp, Artificial Sequence
  Description of Artificial Sequence: Synthetic coding sequence
atggccctgacccagggccccctgaagttcatggatgtggccatcgagttcagccaggaggagtggaagtgcctggaccctgcccagaggaccctgtacagagatgtgatgctggagaactacagaaacctggtgtccctgggcatctgcctgcctgacctgtctgtgacctccatgctggagcagaagagggacccctggaccctgcagagcgaggagaagatcgccaatgaccctgatggatag

SEQ ID NO: 18040 - DNA, 45 bp, Artificial Sequence
  Description of Artificial Sequence: Synthetic coding sequence
atggccctgacccagggccccctgaagttcatggatgtggcctag

SEQ ID NO: 18041 - DNA, 1800 bp, Artificial Sequence
  Description of Artificial Sequence: Synthetic coding sequence
atggctgctgccctgcgggcccccacccagcaggtgtttgtggcctttgaagatgtggccatctacttcagccaggaggagtgggagctgctggatgagatgcagaggctgctgtacagagatgtgatgctggagaactttgctgtgatggccagcctgggctgctggtgtggggctgtggatgagggcacccccagcgctgagagcgtgtctgtggaggagctgagccagggccgcacccccaaggctgacaccagcacagacaagagccacccctgtgagatctgcacccctgtgctgcgggacatcctgcagatgattgagctgcacgccagcccctgtggccagaagctgtacctgggcggggccagccgggacttctggatgagcagcaacctgcaccagctgcagaagctggacaatggagagaagctgttcaaggtggatggagaccaggccagcttcatgatgaactgccgcttccacgtgtctgggaagcccttcaccttcggggaggtgggccgggacttcagcgccaccagcggcctgctgcagcaccaggtgacccccaccatcgagcggccccacagccgcatccgccacctgcgggtgcccaccggcaggaagcccctgaagtacacagagagcaggaagagcttccgggagaagagcgtcttcatccagcaccagagagctgacagcggggagcggccctacaagtgcagtgaatgtgggaagagcttcagccagagcagcggcttcctgcggcacaggaaggcccacggccgcaccaggacccatgagtgcagtgaatgtgggaagagcttcagcaggaagacccacctgacccagcaccagagggtgcacactggagagcggccctatgactgcagtgaatgtgggaagagcttccggcaggtgtctgtgctgatccagcaccagagggtgcacactggagagcggccctatgagtgcagtgaatgtgggaagagcttcagccacagcaccaacctgtaccgccacaggtctgcccacaccagcacccggccctatgagtgcagtgaatgtgggaagagcttcagccacagcaccaacctcttccgccactggagggtgcacactggagtgcggccctatgagtgcagtgaatgtgggaaggccttcagctgcaacatctacctgatccaccaccagcgcttccacactggagagcggccctacgtgtgcagtgaatgtgggaagagctttggccagaagtctgtgctgatccagcaccagagggtgcacactggagagcggccctatgagtgcagtgaatgtgggaaggtgttcagccagagcagcggcctcttccgccaccggcgggcccacaccaagaccaagccctatgagtgcagtgaatgtgagaagagcttcagctgcaagacagacctgatccgccaccagacagtgcacactggagagcggccctatgagtgcagcgtgtgtgggaagagcttcatcaggaagacccacctgatccgccaccagacagtgcacaccaatgaaagaccctatgaatgtgatgaatgtgggaagagctacagccagagcagcgccctgctgcagcaccggcgggtgcacactggagagcggccctatgagtgcagagaatgtgggaagagcttcaccaggaagaaccacctgatccagcacaagacagtgcacactggagagcggccctatgagtgcagtgaatgtgggaagagcttcagccagagcagcggcctgctgcggcaccggcgggtgcacgtgcagtag

SEQ ID NO: 18042 - DNA, 3906 bp, Artificial Sequence
  Description of Artificial Sequence: Synthetic coding sequence
atgaccatgggagacatgaagaccccagactttgatgacctgctggccgcctttgacatcccagacatggtggaccccaaggccgccatcgagagcggccatgatgaccacgagagccacatgaagcagaatgcccacggggaggatgacagccacgcccccagcagcagtgatgtgggcgtgtctgtcatcgtgaagaatgtgagaaatattgacagcagcgagggcggggagaaggatggccacaaccccactggaaatggcctgcacaacggcttcctgacagccagcagcctggacagctacagcaaggatggagccaagagcctgaagggagatgtgcctgccagcgaggtgaccctgaaggacagcaccttcagccagttcagccccatcagcagcgctgaggagtttgatgatgatgagaagattgaggtggatgatcctccagacaaggaggacatgaggagcagcttccgcagcaatgtgctgactggaagtgccccccagcaggactatgacaagctgaaggccctgggcggggagaacagcagcaagacaggcctgagcaccagcggaaatgtggagaagaacaaggctgtgaagcgggagacagaggccagcagcatcaacctgtctgtgtatgagcccttcaaggtgaggaaggccgaggacaagctgaaggagagcagtgacaaggtgctggagaacagagtgctggatggcaagctgagcagcgagaagaatgacaccagcctgcccagcgtggcccccagcaagaccaagagcagcagcaagctgagcagctgcatcgccgccatcgccgccctgagcgccaagaaggccgccagtgacagctgcaaggagcctgtggccaacagccgggagagcagccccctgcccaaggaggtgaatgacagccccagggctgctgacaagagccctgagagccagaacctgattgatggcaccaagaagcccagcctgaagcagcctgacagccccaggagcatcagcagcgagaacagcagcaagggcagccccagcagccctgctggcagcaccccagccatccccaaggtgcgcatcaagaccatcaagaccagcagcggggagatcaagaggacagtgaccagggtgctgcctgaggtggacctggacagcggcaagaagcccagcgagcagacagcctctgtgatggcctctgtgaccagcctgctgagcagccctgccagcgctgctgtgctgagcagccccccccgggcccccctgcagagcgctgtggtgaccaatgctgtgtccccagctgagctgacccccaagcaggtgaccatcaagcctgtggccacagccttcctgcctgtgtctgctgtgaagacagctggcagccaggtgatcaacctgaagctggccaacaacaccaccgtgaaggccaccgtcatctctgctgcctctgtgcagagcgccagcagcgccatcatcaaggccgccaatgccatccagcagcagacagtggtggtgcctgccagcagcctggccaatgccaagctggtgcccaagacagtgcacctggccaacctgaacctgctgccccagggcgcccaggccaccagcgagctgcggcaggtgctgaccaagccccagcagcagatcaagcaggccatcatcaatgctgctgccagccagccccccaagaaggtgtcccgggtgcaggtggtgagcagcctgcagagctctgtggtggaggccttcaacaaggtgctgagctctgtgaaccctgtgcctgtgtacatccccaacctgagccccccagccaatgccggcatcaccctgcccacccggggctacaagtgcctggagtgtggggacagctttgccctggagaagagcctgacccagcactatgacagaagatctgtgcgcatcgaggtgacctgcaaccactgcaccaagaacctggtgttctacaacaagtgcagcctgctgagccacgcccggggccacaaggagaagggcgtggtgatgcagtgcagccacctgatcctgaagcctgtgcctgctgaccagatgattgtgagccccagcagcaacaccagcaccagcaccagcaccctgcagagccctgtgggcgccggcacccacacagtgaccaagatccagagcggcatcaccggcaccgtcatcagcgcccccagcagcacccccatcaccccagccatgcccctggatgaggaccccagcaagctgtgccgccacagcctgaagtgcctggagtgcaatgaggtgttccaggatgagaccagcctggccacccacttccagcaggccgctgacaccagcggccagaagacctgcaccatctgccagatgctgctgcccaaccagtgcagctatgccagccaccagaggatccaccagcacaagagcccctacacctgcccagaatgtggggccatctgccgctctgtgcacttccagacccacgtgaccaagaactgcctgcactacacccggcgggtgggcttccgctgtgtgcactgcaatgtggtgtacagtgatgtggccgccctgaagagccacatccagggcagccactgtgaggtgttctacaagtgccccatctgccccatggccttcaagagcgcccccagcacccacagccacgcctacacccagcaccctggcatcaagatcggggagcccaagatcatctacaagtgcagcatgtgtgacaccgtcttcaccctgcagaccctgctgtaccgccactttgaccagcacatcgagaaccagaaggtgtctgtgttcaagtgcccagactgcagcctgctgtatgcccagaagcagctgatgatggaccacatcaagtccatgcacggcaccctgaagagcattgagggcccccccaacctgggcatcaacctgcccctgagcatcaagccagccacccagaacagcgccaaccagaacaaggaggacaccaagtccatgaatggcaaggagaagctggagaagaagagccccagccctgtgaagaagtccatggagaccaagaaggtggccagccctggctggacctgctgggagtgtgactgcctcttcatgcagagagatgtgtacatcagccacgtgaggaaggagcacggcaagcagatgaagaagcacccctgccggcagtgtgacaagagcttcagcagcagccacagcctgtgccgccacaaccgcatcaagcacaagggcatcaggaaggtgtatgcctgcagccactgcccagacagcaggaggaccttcaccaagaggctgatgctggagaagcacgtgcagctgatgcacggcatcaaggaccctgacctgaaggagatgacagatgccaccaatgaggaggagacagagatcaaggaggacaccaaggtgcccagccccaagaggaagctggaggagcctgtgctggagttccggccccccaggggggccatcacccagcccctgaagaagctgaagatcaacgtgttcaaggtgcacaagtgtgctgtgtgtggcttcaccacagagaacctgctgcagttccacgagcacatcccccagcacaagagtgatggcagcagctaccagtgcagagaatgtggcctgtgctacaccagccacgtgtccctgagccgccacctgttcatcgtgcacaagctgaaggagccccagcctgtgtccaagcagaatggagctggggaggacaaccagcaggagaacaagcccagccatgaagatgagagcccagatggagctgtgtctgacaggaagtgcaaggtgtgtgccaagacctttgaaacagaagctgccctgaacacccacatgaggacccacggcatggccttcatcaagagcaagaggatgagcagcgctgagaagtag

SEQ ID NO: 18043 - DNA, 582 bp, Artificial Sequence
  Description of Artificial Sequence: Synthetic coding sequence
atggccctgacccagggccagctgtccttcagtgatgtggccatcgagttcagccaggaggagtggaagtgcctggaccccggccagaaggccctgtacagagatgtgatgctggagaactacagaaacctggtgtccctgggcatctgcctgcctgacctgtctgtgacctccatgctggagcagaagagggacccctggaccctgcagagcgaggtgaagatcatcaacaacccagatggaagagagtgcatcaagggcgtgaacacagacttcagcctgctggcctgggatgcccgggtcttccgggtggaggcctggagggccagcggcggcgctgaggagcccaccggccccaactttgtgggcaatgacagccccctgcccagccccctggccctgctgcccttccccagcgtgtctgccagcctgggagatgccaagagggcccggctgacagctgagggccggggccacggcaccctgcgggccggccctgccccccggcccaggtctgctgccccccacgccccagatgctgtgcagcgctggcccccagagcagaggctgcccaggagctag

SEQ ID NO: 18044 - DNA, 2025 bp, Artificial Sequence
  Description of Artificial Sequence: Synthetic coding sequence
atggccctgacccagggccagctgtccttcagtgatgtggccatcgagttcagccaggaggagtggaagtgcctggaccccggccagaaggccctgtacagagatgtgatgctggagaactacagaaacctggtgtccctgggagaagataatgtgcggcctgaggcctgcatctgcagcggcatctgcctgcctgacctgtctgtgacctccatgctggagcagaagagggacccctggaccctgcagagcgaggtgaagatcatcaacaacccagatggccgggagtgcatcaagggcgtgaacacagagaagagcagcaagctgggcagcagcgctggcaacaagagcctgaagaaccagcacggcctgaccctgcagctgcacctgacagagtggcagcccttccaggccgtgaggaacatctacggctgcaagcacgtggagaagagcatcagtgacaacagctctgtgtcccctgtgcagatctccttcttctctgtgaagacccacatcttcaacaactacagaaatgacttcctgttcagcaccctgctgccccaggagcagaaggtgcacatccgggagaagccctacggctgcaatgagcacggcaaggtgttccgggtgagcagcagcctgaccaaccggcaggtgatccacatcgctgacaagacctacaagtgcagcgactgtggggagatcttcagcagcaacagcaactttgcccagcaccagaggatccacactggagagaagccctacaagtacaatgaatgtgggaaggtgttcaaccagaacagccacctggcccagcaccagaagatccacacaggccagaagccctacaacaacaaggaatgtgggaaggtgttcagccaccacgcctacctggcccagcacaggaagatccacactggagagaagccctacaagtgcagtgaatgtgggaaggccttctctgtgtgcagcagcctgacagcccacctggtgatccacactggagagaagccctatgactgcaaggaatgtgggaaggtgttccgccacaagagcagcctgaccacccaccagacagtgcacactggagagcggccctacaagtgcaatgaatgtgggaagggcttcagcagaattgccttcctggcccggcacaggaaggtgcacactggagagaagccctacaagtgcaatgaatgtgggaaggtgttcatcggcaacagccggctggcccggcacaggaagatccacactggaggaagacgctacaagtgcaatgaatgtgggaaggccttccgcacctgcagcgacctgacagcccacctgctgatccacactggagagaagccctatgagtgcatcgactgtgggaaggtgttccgccacaagagcagcctgacctaccactgccgcatccacactggagagaagccctacaagtgcaatgaatgtgggaaggtgttcagccagaacagcaacctgcagaggcacaggaagatccacactggagagaagctgtacaagtgcaatgaatgtgggaaggtgttccggcagaacagccacctggcccagcaccgggacatccacactggagagaagccctacagctgcaatgaatgtgggaaggtgttcagaagaaacagccacctggtgcgccacagaaatgtgcacactggagagaagccctacagctgcaatgaatgtgggaaggtgttcagcaggaacagccacctggcccggcacaggaacatccacactggagagaagccccacagctgcaatgaatgtgggaaggtgttcagcaggaacagccacctggcccggcacaggaagatccacactggagagaagctgtacaagtgcaatgaatgttccaaggtgttcagcaggaacagccggctggcccagcacaggaacatccacactggagtgaagccctacagctgcaatgaatgtgggaaggtgttcagcaagaacagcatcctggtgcagcactgcagcatccacacccgggagaagccctag

SEQ ID NO: 18045 - DNA, 2022 bp, Artificial Sequence
  Description of Artificial Sequence: Synthetic coding sequence
gtgctgaccaccggccagctgtccttcagtgatgtggccatcgagttcagccaggaggagtggaagtgcctggaccccggccagaaggccctgtacagagatgtgatgctggagaactacagaaacctggtgtccctgggggaggacaacgtgcggcctgaggcctgcatctgcagcggcatctgcctgcctgacctgtctgtgacctccatgctggagcagaagagggacccctggaccctgcagagcgaggtgaagatcatcaacaacccagatggaagagagtgcatcaagggcgtgaacacagagaagagcagcaagctgggcagcagcgctggcaacaagagcctgaagaaccagcacggcctgaccctgcagctgcacctgacagagtggcagcccttccaggccgtgaggaacatctacggctgcaagcacgtggagaagagcatcagtgacaacagctctgtgtcccctgtgcagatctccttcttctctgtgaagacccacatcttcaacaactacagaaatgacttcctgttcagcaccctgctgccccaggagcagaaggtgcacatccgggagaagccctacggctgcaatgaacatggcaaggtgttccgggtgagcagcagcctgaccaaccggcaggtgatccacatcgctgacaagacctacaagtgcagcgactgtggggagatcttcagcagcaacagcaactttgcccagcaccagaggatccacactggagagaagccctacaagtacaatgaatgtgggaaggtgttcaaccagaacagccacctggcccagcaccagaagatccacacaggccagaagccctacaacaacaaggaatgtgggaaggtgttcagccaccacgcctacctggcccagcacaggaagatccacactggagagaagccctacaagtgcagtgaatgtgggaaggccttctctgtgtgcagcagcctgacagcccacctggtgatccacactggagagaagccctatgactgcaaggaatgtgggaaggtgttccgccacaagagcagcctgaccacccaccagacagtgcacactggagagcggccctacaagtgcaatgaatgtgggaagggcttcagccgcatcgccttcctggcccggcacaggaaggtgcacactggagagaagccctacaagtgcaatgaatgtgggaaggtgttcatcggcaacagccggctggcccggcacaggaagatccacactggaggccgccgctacaagtgcaatgaatgtgggaaggccttccgcacctgcagcgacctgacagcccacctgctgatccacactggagagaagccctatgaatgtattgactgtgggaaggtgttccgccacaagagcagcctgacctaccactgccgcatccacactggagagaagccctacaagtgcaatgaatgtgggaaggtgttcagccagaacagcaacctgcagaggcacaggaagatccacactggagagaagctgtacaagtgcaatgaatgtgggaaggtgttccggcagaacagccacctggcccagcaccgggacatccacactggagagaagccctacagctgcaatgaatgtgggaaggtgttcagaagaaacagccacctggtgcgccacagaaatgtgcacactggagagaagccctacagctgcaatgaatgtgggaaggtgttcagcaggaacagccacctggcccggcacaggaacatccacactggagagaagccccacagctgcaatgaatgtgggaaggtgttcagcaggaacagccacctggcccggcacaggaagatccacactggagagaagctgtacaagtgcaatgaatgttccaaggtgttcagcaggaacagccggctggcccagcacaggaacatccacactggagtgaagccctacagctgcaatgaatgtgggaaggtgttcagcaagaacagcatcctggtgcagcactgcagcatccacacccgggagaagccctag

SEQ ID NO: 18046 - DNA, 453 bp, Artificial Sequence
  Description of Artificial Sequence: Synthetic coding sequence
atggccctgacccagggccagctgtccttcagtgatgtggccatcgagttcagccaggaggagtggaagtgcctggaccccggccagaaggccctgtacagagatgtgatgctggagaactacagaaacctggtgtccctggacttcagcctgctggcctgggatgcccgggtcttccgggtggaggcctggagggccagcggcggcgctgaggagcccaccggccccaactttgtgggcaatgacagccccctgcccagccccctggccctgctgcccttccccagcgtgtctgccagcctgggagatgccaagagggcccggctgacagctgagggccggggccacggcaccctgcgggccggccctgccccccggcccaggtctgctgcccctcatgccccagatgctgtgcagcgctggcccccagagcagaggctgcccaggagctag

SEQ ID NO: 18047 - DNA, 1986 bp, Artificial Sequence
  Description of Artificial Sequence: Synthetic coding sequence
atggccctgacccagggccagctgtccttcagtgatgtggccatcgagttcagccaggaggagtggaagtgcctggaccccggccagaaggccctgtacagagatgtgatgctggagaactacagaaacctggtgtccctgggcatctgcctgcctgacctgtctgtgacctccatgctggagcagaagagggacccctggaccctgcagagcgaggtgaagatcatcaacaacccagatggaagagagtgcatcaagggcgtgaacacagagaagagcagcaagctgggcagcagcgctggcaacaagagcctgaagaaccagcacggcctgaccctgcagctgcacctgacagagtggcagcccttccaggccgtgaggaacatctacggctgcaagcacgtggagaagagcatcagtgacaacagctctgtgtcccctgtgcagatctccttcttctctgtgaagacccacatcttcaacaactacagaaatgacttcctgttcagcaccctgctgccccaggagcagaaggtgcacatccgggagaagccctacggctgcaatgaacatggcaaggtgttccgggtgagcagcagcctgaccaaccggcaggtgatccacatcgctgacaagacctacaagtgcagcgactgtggggagatcttcagcagcaacagcaactttgcccagcaccagaggatccacactggagagaagccctacaagtacaatgaatgtgggaaggtgttcaaccagaacagccacctggcccagcaccagaagatccacacaggccagaagccctacaacaacaaggaatgtgggaaggtgttcagccaccacgcctacctggcccagcacaggaagatccacactggagagaagccctacaagtgcagtgaatgtgggaaggccttctctgtgtgcagcagcctgacagcccacctggtgatccacactggagagaagccctatgactgcaaggaatgtgggaaggtgttccgccacaagagcagcctgaccacccaccagacagtgcacactggagagcggccctacaagtgcaatgaatgtgggaagggcttcagccgcatcgccttcctggcccggcacaggaaggtgcacactggagagaagccctacaagtgcaatgaatgtgggaaggtgttcatcggcaacagccggctggcccggcacaggaagatccacactggaggccgccgctacaagtgcaatgaatgtgggaaggccttccgcacctgcagcgacctgacagcccacctgctgatccacactggagagaagccctatgaatgtattgactgtgggaaggtgttccgccacaagagcagcctgacctaccactgccgcatccacactggagagaagccctacaagtgcaatgaatgtgggaaggtgttcagccagaacagcaacctgcagaggcacaggaagatccacactggagagaagctgtacaagtgcaatgaatgtgggaaggtgttccggcagaacagccacctggcccagcaccgggacatccacactggagagaagccctacagctgcaatgaatgtgggaaggtgttcagaagaaacagccacctggtgcgccacagaaatgtgcacactggagagaagccctacagctgcaatgaatgtgggaaggtgttcagcaggaacagccacctggcccggcacaggaacatccacactggagagaagccccacagctgcaatgaatgtgggaaggtgttcagcaggaacagccacctggcccggcacaggaagatccacactggagagaagctgtacaagtgcaatgaatgttccaaggtgttcagcaggaacagccggctggcccagcacaggaacatccacactggagtgaagccctacagctgcaatgaatgtgggaaggtgttcagcaagaacagcatcctggtgcagcactgcagcatccacacccgggagaagccctag

SEQ ID NO: 18048 - DNA, 3903 bp, Artificial Sequence
  Description of Artificial Sequence: Synthetic coding sequence
atggaggaggccagcctgtgcctgggcgtgagcagcgctgagcctgaggccgagccccacctgagcggccctgtgctgaatggccagtatgccatgagccagaagctgcaccagatcaccagccagctgagccacgccttccctgagctgcacccccggcccaaccctgaggagaagcccccagccagcctggaggagaaggcccacgtgcccatgagcggccagcccatgggcagccagatggccctgctggccaaccagctgggccgggaggtggacaccagcctgaatggccgggtggacctgcagcagttcctgaatggccagaacctgggcatcatgagccagatgtctgacattgaagatgatgccaggaagaacaggaagtacccctgccccctgtgtgggaagcgcttccgcttcaacagcatcctgagcctgcacatgaggacccacactggagagaagcccttcaagtgcccctactgtgaccacagagctgcccagaagggcaacctgaagatccacctgcggacccacaagctgggcaacctgggcaagggccggggccgggtgcgggaggagaaccggctgctgcacgagctggaggagcgggccatcctgcgggacaagcagctgaagggcagcctgctgcagcccaggccagacctgaagcccccacctcatgcccagcaggcccccctggccgcctgcaccctggccctgcaggccaaccacagcgtgcctgatgtggcccaccctgtgcccagccccaagccagcctctgtgcaggaggatgctgtggccccagctgctggcttccgctgcaccttctgcaagggcaagttcaagaagcgggaggagctggacagacacatccgcatcctgcacaagccctacaagtgcaccctgtgtgactttgctgccagccaggaggaggagctgatcagccacgtggagaaggcccacatcacagctgagagcgcccagggccagggccccaatggaggaggagagcagagcgccaatgagttccgctgtgaggtgtgtggccaggtgttcagccaggcctggttcctgaagggccacatgaggaagcacaaggacagctttgagcactgctgccagatctgtggccgccgcttcaaggagccctggttcctgaagaaccacatgaaggtgcacctgaacaagctgtctgtgaagaacaagagccccagcgaccctgaggtgcctgtgcccatgggcggcatgagccaggaggcccacgccaacctgtacagccgctacctgagctgcctgcagagcggcttcatgaccccagacaaggccggcctgtctgagcccagccagctgtatggaaaaggagagctgcccatgaaggagaaggaggccctgggcaagctgctgagccccatcagctccatggcccacggcgtgcctgagggggacaagcacagcctgctgggctgcctgaacctggtgccccccctgaagagcagctgcatcgagcggctgcaggccgccgccaaggctgctgagatggaccctgtgaacagctaccaggcctggcagctgatggcccggggcatggccatggagcacggcttcctgagcaaggagcaccccctgcagaggaaccacgaggacaccctggccaatgccggcgtgctgtttgacaaggagaagcgggagtatgtgctggtgggcgcagatggcagcaagcagaagatgcctgctgacctggtgcacagcaccaaggtgggcagccagagggacctgcccagcaagctggaccccctggagagcagccgggacttcctgagccacggcctgaaccagaccctggagtacaacctgcagggccctggcaacatgaaggagaagcccacagagtgcccagactgtggccgggtcttccgcacctaccaccaggtggtggtgcacagccgggtgcacaagagggacaggaagggggaggaggatggcctgcacgtgggcctggatgaaagaagaggcagcggcagtgaccaggagagccagagcgtgagccgcagcaccaccccaggcagcagcaatgtgacagaggagagcggcgtgggcggcggcctgagccagacaggcagcgcccaggaggacagcccccaccccagcagccccagcagcagtgacattggagaggaggccggccgctctgctggggtgcagcagcctgccctgctgcgggacaggagcctgggcagcgccatgaaggactgcccctactgtgggaagaccttccgcaccagccaccacctgaaggtgcacctgcgcatccacactggagagaagccctacaagtgcccccactgtgactatgccggcacccagagcgccagcctgaagtaccacctggagcggcaccaccgggagcggcagaatggagctggccccctgagcggccagccccccaaccaggaccacaaggatgagatgagcagcaaggccagcctcttcatccggccagacatcctgcggggggccttcaagggcctgcccggcatcgacttccggggcggccctgccagccagcagtggaccagcggcgtgctgagcagcggggaccacagcggccaggccaccggcatgagcagcgaggtgcccagtgatgccctgaagggcacagacctgcccagcaagagcacccacttcagcgagatcggccgggcctaccagagcatcgtgtccaatggagtgaacttccagggcagcctgcaggccttcatggacagctttgtgctgagcagcctgaagaaggagaaggacatgaaggacaaggccctggccgacccccccagcatgaaggtgcacggcgtggatggaggagaggagaagcccagcggcaagagcagccagaggaagtctgagaagagccagtatgagcccctggacctgtctgtgcggccagatgctgccagcctgcccggcagctctgtgacagtgcaggacagcatcgcctggcacggctgcctcttctgtgccttcaccaccagctccatggagctgatggccctgcacctgcaggccaaccacctgggcaaggccaagaggaaggacaacaccatcggcgtgacagtgaactgcaaggaccaggcccgggaggccagcaagatggccctgctgcccagcctgcagagcaacaaggacctgggcctgagcaacatgatcagcagcctggacagcgccagcgagaagatggcccagggccagctgaaggagaccctgggggagcagaagagcggggcctggacaggccacgtggaccctgccttctgcaacttccccagcgacttctacaagcagtttggagtgtacccaggcatggtgggcagcggggccagcagcagctgccccaacaaggagccagatggcaaggcccacagtgaagaagatgtgcccatcctgatccctgagaccaccagcaagaacaccacagatgacctgagtgacatcgccagcagcgaggacatggacagcagcaagggggagaacaatgatgaagaagatgtggagacagagcctgagatgatgaccaagcccctgagcgccctgagcaaggacagcagcagtgatggaggagacagcctgcagcccaccggcaccagccagcctgtgcagggcctggtgagccccctgagccaggcccctgagaagcagtggcacagccagggcctgctgcaggcccaggaccccctggccggcctgcccaagccagagcggggcccccagagcctggacaagcccatgaacatgctgtctgtgctgcgggcctacagcagtgatggcctggccgccttcaacggcctggccagcagcacagccaacagcggctgcatcaagaggccagacctgtgtgggaagtag

SEQ ID NO: 18049 - DNA, 4098 bp, Artificial Sequence
  Description of Artificial Sequence: Synthetic coding sequence
atggaccagtacagcctgggagatgagggcgccctgcccagcgagatgcacctgcccagcttcagcgagagccagggcctgaactgcagcgacaccctgaacagagacctgggccccaacacccggggcttcctgtatgccggcctgagcggcctggaccctgaccccagcctgcccaccccagacatgagcagcgaggtgctggaggacaacctggacaccctgagcctgtacagcggcaaggacagcgacagcgtgaagctgctggaggagtatgctgacagcgagagccaggccagcctgcaggacctgggcctgggcgtgctgaaggccaaggaggctgatgaaggaggccgggccaccagcggcagcgccaggaagggcaagaggcagcacagcagcccccagaaccccctgctggactgcagcctgtgtgggaaggtgttcagcagcgccagcagcctgagcaagcactacctgacccacagccaggagaggaagcacgtgtgcaagatctgcagcaaggccttcaagaggcaggaccacctgaccggccacatgctgacccaccagaagaccaagccctttgtgtgcatcgagcagggctgcagcaagagctactgtgactaccgcagcctgcggcggcactatgaggtgcaccacggcctgtgcatcctgaaggaggcccctcctgaggaggaggcctgtggggacagcccccacgcccatgaatctgctggccagcccccacccagcagcctgcggagcctggtgcccccagaggcccggagccctggcagcctgctgccccaccgggacctgctgcggcgcatcgtgagcagcatcgtgcaccagaagacccccagccctggccctgccccagctggggccagtgacagcgagggcaggaacacagcctgcccctgcccagccagcagcggcagcagcagctgcaccccagctggcccccatgctgccccagctgccctggacacagagctgcctgaggagccctgcctgccccagaaggagcccgccacagatgtgttcaccgcccccaacagcagagctgctgaaaatggagccccagaccccccagagcctgagccagacacagccctgctgcaggcccggagcacagctgagtgctggccagagggcggctctgtgcctgcctgcctgcccctcttccggggccagacagtgcctgccagcagccagcccagcagccacagcttccagtggctgaggaacctgcccggctgccccaagagcaagggcaacaacgtgtttgtggtgcacaagcccagcgctgtgcccagccgggagggcagcgagagcggccctggccccagcagcggcagccccagcgaggagagccccccaggccctgggggcggcctggaggatgccctgcccttccctgctgccctgctgcgggtgcctgctgaggcccccagcgaccccaggtctgccagcggagaagatgacccctgtgcccccaagaaggtgaaggtggactgtgacagcttcctgtgccagaaccctggagagcccggcctgcaggaggcccagaaggccggcggcctgcctgcagatgccagccccctcttccggcagctgttcctgaagagccaggagcccctggtgtcccatgagcagatgcaggtgttccagatgatcaccaagagccagaggatcttcagccacgcccaggtggccgctgtgagcagccagctgcctgcccctgagggcaagccagctgccctgcggcccctgcagggcccctggccccagcagcccccacccctggccccagctgtggacagcctgcatgctggccctggcaaccctgaggccgagggcagccctgcccggcggaggaagaccaccccaggagtgccccgggaggccagccctggcagcaccaggagagatgccaagggcggcctgaaggtggccgctgtgcccacccccctggccgcccccagcctggaccccagcagaaatccagacatcagcagcctggccaagcagctgcggagcagcaagggcaccctggacctggaggacatcttccccagcacaggccagaggcagacccagctgggcggggaggagcccccaggggccagcctgcccgggaagcaggccccagcagaaaatggagctgccagccgcatcaccaagggggagaagggccctgcctgcagccggggcggcggctaccgcctgctgggcaacccccgggccccccgcttcagcggcttcaggaaggagaaggccaagatggacatgtgctgtgccgccagccccagccaggtggccatggccagcttcagcagcgctggccccccagctgaccccagcaagagcaagctgaccatcttcagccgcatccagggcggcaacatctaccgcctgccccaccctgtgaaggaggagaatgtggccggccggggcaaccagcagaatggcagccccacagactggaccaagcccaggagcacctttgtgtgcaagaactgcagccagatgttctacacagagaagggcctgagcagccacatgtgcttccacagcgaccagtggcccagcccccggggcaagcaggagccccaggtgtttggaacagagttctgcaagcccctgcggcaggtgctgcggcctgagggggacagacacagccccccaggcaccaagaagcccctggaccccacagctgctgcccccctggtggtgccccagagcatccctgtggtgcctgtgaccaggcacatcggctccatggccatgatggagtggtgcagccgctggctgcaggccaccacctgtggcagcaagctgctgcagggccaggagaaggatggagaggagcgggacagcaaggagagcagccagcagaggaagaggaagaagaggcccccacccagcacagctggggagcccggccctgctggctgccaccagagccggctgcggagccccatgttcctggtggactgcctgctgaagggcctcttccagtgcagcccctacaccccaccacccatgctgagccccatccgggagggcagcggcgtgtacttcaacaccctgtgcagcaccagcacccaggccagcccagaccagctgatcagctccatgctggaccaggtggatggcagctttggcatctgtgtggtgaaggatgacaccaagatcagcattgagccccacatcaacatcggcagccgcttccaggccgagatccctgagctgcaggagaggagcctggccggcacagatgagcacgtggccagcctggtgtggaagccctggggagacatgatgatcagcagcgagacccaggacagagtgacagagctgtgcaatgtggcctgcagctctgtgatgcctgggggcggcaccaacctggagctggccctgcactgcctgcacgaggcccagggcaatgtgcaggtggccctggagaccctgctgctgcggggcccccacaagcccaggacccacctgctggccgactaccgctacacaggcagtgatgtgtggacccccatcgagaagaggctcttcaagaaggccttctacgcccacaagaaggacttctacctgatccacaagatgatccagaccaagacagtggcccagtgtgtggagtactactacatctggaagaagatgatcaagtttgactgtggccgggcccctggcctggagaagagggtgaagcgggagcctgaggaggtggagaggacagaggagaaggtgccctgcagcccccgggagcggcccagccaccaccccacccccaagctgaagaccaagagctacagaagagagagcatcctgagcagcagccccaatgccggcagcaagaggaccccagagctgctgggcagcgctgagagccagggcatcttcccctgccgggagtgtgagcgggtgtttgacaagatcaagagcagaaatgcccacatgaagaggcaccggctgcaggaccacgtggagcccatcatccgggtgaagtggcctgtgaagcccttccagctgaaggaggaggagctgggcgctgacatcggccccctgcagtggtag

SEQ ID NO: 18050 - DNA, 3267 bp, Artificial Sequence
  Description of Artificial Sequence: Synthetic coding sequence
atggaccagtacagcctgggagatgagggcgccctgcccagcgagatgcacctgcccagcttcagcgagagccagggcctgaactgcagcgacaccctgaacagagacctgggccccaacacccggggcttcctgtatgccggcctgagcggcctggaccctgaccccagcctgcccaccccagacatgagcagcgaggtgctggaggacaacctggacaccctgagcctgtacagcggcaaggacagcgacagcgtgaagctgctggaggagtatgctgacagcgagagccaggccagcctgcaggacctgggcctgggcgtgctgaaggccaaggaggctgatgaaggaggccgggccaccagcggcagcgccaggaagggcaagaggcagcacagcagcccccagaaccccctgctggactgcagcctgtgtgggaaggtgttcagcagcgccagcagcctgagcaagcactacctgacccacagccaggagaggaagcacgtgtgcaagatctgcagcaaggccttcaagaggcaggaccacctgaccggccacatgctgacccaccagaagaccaagccctttgtgtgcatcgagcagggctgcagcaagagctactgtgactaccgcagcctgcggcggcactatgaggtgcaccacggcctgtgcatcctgaaggaggcccctcctgaggaggaggcctgtggggacagcccccacgcccatgaatctgctggccagcccccacccagcagcctgcggagcctggtgcccccagaggcccggagccctggcagcctgctgccccaccgggacctgctgcggcgcatcgtgagcagcatcgtgcaccagaagacccccagccctggccctgccccagctggggccagtgacagcgagggcaggaacacagcctgcccctgcccagccagcagcggcagcagcagctgcaccccagctggcccccatgctgccccagctgccctggacacagagctgcctgaggagccctgcctgccccagaaggagcccgccacagatgtgttcaccgcccccaacagcagagctgctgaaaatggagccccagaccccccagagcctgagccagacacagccctgctgcaggcccggagcacagctgagtgctggccagagggcggctctgtgcctgcctgcctgcccctcttccggggccagacagtgcctgccagcagccagcccagcagccacagcttccagtggctgaggaacctgcccggctgccccaagagcaagggcaacaacgtgtttgtggtgcacaagcccagcgctgtgcccagccgggagggcagcgagagcggccctggccccagcagcggcagccccagcgaggagagccccccaggccctgggggcggcctggaggatgccctgcccttccctgctgccctgctgcgggtgcctgctgaggcccccagcgaccccaggtctgccagcggagaagatgacccctgtgcccccaagaaggtgaaggtggactgtgacagcttcctgtgccagaaccctggagagcccggcctgcaggaggcccagaaggccggcggcctgcctgcagatgccagccccctcttccggcagctgttcctgaagagccaggagcccctggtgtcccatgagcagatgcaggtgttccagatgatcaccaagagccagaggatcttcagccacgcccaggtggccgctgtgagcagccagctgcctgcccctgagggcaagccagctgccctgcggcccctgcagggcccctggccccagcagcccccacccctggccccagctgtggacagcctgcatgctggccctggcaaccctgaggccgagggcagccctgcccggcggaggaagaccaccccaggagtgccccgggaggccagccctggcagcaccaggagagatgccaagggcggcctgaaggtggccgctgtgcccacccccctggccgcccccagcctggaccccagcagaaatccagacatcagcagcctggccaagcagctgcggagcagcaagggcaccctggacctggaggacatcttccccagcacaggccagaggcagacccagctgggcggggaggagcccccaggggccagcctgcccgggaagcaggccccagcagaaaatggagctgccagccgcatcaccaagggggagaagggccctgcctgcagccggggcggcggctaccgcctgctgggcaacccccgggccccccgcttcagcggcttcaggaaggagaaggccaagatggacatgtgctgtgccgccagccccagccaggtggccatggccagcttcagcagcgctggccccccagctgaccccagcaagagcaagctgaccatcttcagccgcatccagggcggcaacatctaccgcctgccccaccctgtgaaggaggagaatgtggccggccggggcaaccagcagaatggcagccccacagactggaccaagcccaggagcacctttgtgtgcaagaactgcagccagatgttctacacagagaagggcctgagcagccacatgtgcttccacagcgaccagtggcccagcccccggggcaagcaggagccccaggtgtttggaacagagttctgcaagcccctgcggcaggtgctgcggcctgagggggacagacacagccccccaggcaccaagaagcccctggaccccacagctgctgcccccctggtggtgccccagagcatccctgtggtgcctgtgaccaggcacatcggctccatggccatgatccagaccaagacagtggcccagtgtgtggagtactactacatctggaagaagatgatcaagtttgactgtggccgggcccctggcctggagaagagggtgaagcgggagcctgaggaggtggagaggacagaggagaaggtgccctgcagcccccgggagcggcccagccaccaccccacccccaagctgaagaccaagagctaccgccgggagagcatcctgagcagcagccccaatgccggcagcaagaggaccccagagctgctgggcagcgctgagagccagggcatcttcccctgcagagaatgtgagcgggtgtttgacaagatcaagagcagaaatgcccacatgaagaggcaccggctgcaggaccacgtggagcccatcatccgggtgaagtggcctgtgaagcccttccagctgaaggaggaggagctgggcgctgacatcggccccctgcagtggtag

SEQ ID NO: 18051 - DNA, 1803 bp, Artificial Sequence
  Description of Artificial Sequence: Synthetic coding sequence
atggccgccagcgcccaggtgtctgtgacctttgaagatgtggccgtgaccttcacccaggaggagtggggccagctggatgctgcccagaggaccctgtaccaggaggtgatgctggagacctgtggcctgctgatgagcctgggctgccccctcttcaagccagagctgatctaccagctggaccaccggcaggagctgtggatggccaccaaggacctgagccagagcagctacccaggggacaacaccaagcccaagaccacagagcccaccttcagccacctggccctgcctgaggaggtgctgctgcaggagcagctgacccagggcgccagcaagaacagccagctgggccagagcaaggaccaggacggccccagcgagatgcaggaggtgcacctgaagattggaattggcccccagaggggcaagctgctggagaagatgagcagcgagagagatggcctgggcagtgatgatggagtgtgcaccaagatcacccagaagcaggtgtccacagaaggagacctgtatgaatgtgacagccacggccctgtgacagatgccctgatccgggaggagaagaacagctacaagtgtgaagaatgtgggaaggtgttcaagaagaatgccctgctggtgcagcacgagcgcatccacacccaggtgaagccctatgagtgcacagaatgtgggaagaccttcagcaagagcacccacctgctgcagcacctgatcatccacactggagagaagccctacaagtgcatggagtgtgggaaggccttcaacagaagaagccacctgaccaggcaccagaggatccacagcggggagaagccctacaagtgcagtgaatgtgggaaggccttcacccacaggagcacctttgtgctgcaccacaggagccacactggagagaagccctttgtgtgcaaggaatgtgggaaggccttccgggaccggcccggcttcatccgccactacatcatccacactggagagaagccctatgagtgcattgaatgtgggaaggccttcaacagaagaagctacctgacctggcaccagcagatccacactggagtgaagccctttgagtgcaatgaatgtgggaaggccttctgtgagagcgctgacctgatccagcactacatcatccacactggagagaagccctacaagtgcatggagtgtgggaaggccttcaacagaagaagccacctgaagcagcaccagaggatccacactggagagaagccctatgagtgcagtgaatgtgggaaggccttcacccactgcagcacctttgtgctgcacaagaggacccacactggagagaagccctatgagtgcaaggaatgtgggaaggccttcagtgacagagctgacctgatccgccacttcagcatccacactggagagaagccctatgaatgtgtggagtgtgggaaggccttcaacagaagcagccacctgaccaggcaccagcagatccacactggagagaagccctatgagtgcatccagtgtgggaaggccttctgccgcagcgccaacctgatccgccacagcatcatccacactggagagaagccctatgagtgcagtgaatgtgggaaggccttcaacagaggcagcagcctgacccaccaccagaggatccacacaggcaggaaccccaccatcgtgacagatgtgggccggcccttcatgacagcccagacctctgtgaacatccaggagctgctgctgggcaaggagttcctgaacatcaccacagaggagaacctgtggtag

SEQ ID NO: 18052 - DNA, 2148 bp, Artificial Sequence
  Description of Artificial Sequence: Synthetic coding sequence
atggaggcccgctccatgctggtgcccccccaggcctctgtgtgctttgaagatgtggccatggccttcacccaggaggagtgggagcagctggacctggcccagaggaccctgtaccgggaggtgaccctggagacctgggagcacatcgtgtccctgggcctcttcctgagcaagagtgatgtgatcagccagctggagcaggaggaggacctgtgcagagctgagcaggaggccccccgggactggaaggccaccctggaggagaaccggctgaacagcgagaaggaccgggcccgggaggagctgagccaccacgtggaggtgtaccgcagcggccctgaggagccccccagcctggtgctgggcaaggtgcaggaccagagcaaccagctgcgggagcaccaggagaacagcctgcgcttcatggtgctgaccagcgagcggctgtttgcccagcgggagcactgtgagctggagctgggcggcggctacagcctgcccagcaccctgagcctgctgcccaccaccctgcccaccagcacaggcttccccaagcccaacagccaggtgaaggagctgaagcagaacagcgccttcatcaaccacgagaagaatggagcagatggcaagcactgtgagagccaccagtgtgcccgggccttctgccagagcatctacctgagcaagctgggcaatgtggagaccgggaagaagaacccctatgagtacatcgtgtctggggacagcctgaactacggcagcagcctgtgcttccacggccgcaccttctctgtgaagaagagtgatgactgcaaggactatggcaacctcttcagccacagcgtgtccctgaatgagcagaagcctgtgcactttgggaagagccagtatgaatgtgatgagtgccgggagacctgcagcgagagcctgtgcctggtgcagacagagaggagcggccctggagagacccccttccgctgtgaggagcgctgtgccgccttccccatggccagcagcttcagtgactgcaacatcatccagaccacagagaagcccagcgtgtgcaaccagtgtgggaagagcttcagctgctgcaagctgatccaccagaggacccacactggagagaagccctttgaatgtacccagtgtgggaagagcttcagccagagctatgacctggtgatccaccagaggacccacactggagagaagccctatgaatgtgacctgtgtgggaagagcttcacccagaggagcaagctgatcacccaccagaggatccacactggagagaagccctaccagtgcatcgagtgcaggaagagcttccgctggaacagcaacctgattgtgcaccagaggatccacactggagagaagccctatgaatgtacccactgcggcaagagcttcagccagagctatgagctggtgacccacaagaggacccacactggagagaagcccttcaagtgcacccagtgtgggaagagcttcagccagaagtatgacctggtggtgcaccagaggacccacactggagagaagccctatgagtgcaacctgtgtgggaagagcttcagccagagcagcaagctgatcacccaccagaggatccacactggagagaagccctaccagtgcattgaatgtgggaagagcttccgctggaacagcaacctggtgatccaccagaggatccacactggagagaagccctatgactgcacccactgcggcaagagcttcagccagagctaccagctggtggcccacaagaggacccacactggagagaagccctatgaatgtaatgaatgtgggaaggccttcaacagaagcacccagctgatccgccacctgcagatccacactggagagaagccctacaagtgcaaccagtgcaacaaggcctttgcccggagcagctacctggtgatgcaccagaggacccacactggagagaagccctttgaatgttcccagtgtgggaaggccttcagcggcagcagcaacctgctgagccaccaccgcatccacagcggggagaagccctatgaatgtagtgactgtgggaagagcttccggcagcagagccagctggtggtgcacaggaggacccacactggagagaagccctag

SEQ ID NO: 18053 - DNA, 321 bp, Artificial Sequence
  Description of Artificial Sequence: Synthetic coding sequence
atggaggcccgctccatgctggtgcccccccaggcctctgtgtgctttgaagatgtggccatggccttcacccaggaggagtgggagcagctggacctggcccagaggaccctgtaccgggaggtgaccctggagacctgggagcacatcgtgtccctgggcctcttcctgagcaagagtgatgtgatcagccagctggagcaggaggaggacctgtgcagagctgagcaggaggccccccggggcaccagcggcctgagccaggtgactggagtggtggctgatggcagcttccgcttccctgtgtgggacttcacctag

SEQ ID NO: 18054 - DNA, 2064 bp, Artificial Sequence
  Description of Artificial Sequence: Synthetic coding sequence
atggaggcccgctccatgctggtgcccccccaggcctctgtgtgctttgaagatgtggccatggccttcacccaggaggagtgggagcagctggacctggcccagaggaccctgtaccgggaggtgaccctggagacctgggagcacatcgtgtccctggactggaaggccaccctggaggagaaccggctgaacagcgagaaggaccgggcccgggaggagctgagccaccacgtggaggtgtaccgcagcggccctgaggagccccccagcctggtgctgggcaaggtgcaggaccagagcaaccagctgcgggagcaccaggagaacagcctgcgcttcatggtgctgaccagcgagcggctgtttgcccagcgggagcactgtgagctggagctgggcggcggctacagcctgcccagcaccctgagcctgctgcccaccaccctgcccaccagcacaggcttccccaagcccaacagccaggtgaaggagctgaagcagaacagcgccttcatcaaccacgagaagaatggagcagatggcaagcactgtgagagccaccagtgtgcccgggccttctgccagagcatctacctgagcaagctgggcaatgtggagaccgggaagaagaacccctatgagtacatcgtgtctggggacagcctgaactacggcagcagcctgtgcttccacggccgcaccttctctgtgaagaagagtgatgactgcaaggactatggcaacctcttcagccacagcgtgtccctgaatgagcagaagcctgtgcactttgggaagagccagtatgaatgtgatgagtgccgggagacctgcagcgagagcctgtgcctggtgcagacagagaggagcggccctggagagacccccttccgctgtgaggagcgctgtgccgccttccccatggccagcagcttcagtgactgcaacatcatccagaccacagagaagcccagcgtgtgcaaccagtgtgggaagagcttcagctgctgcaagctgatccaccagaggacccacactggagagaagccctttgaatgtacccagtgtgggaagagcttcagccagagctatgacctggtgatccaccagaggacccacactggagagaagccctatgaatgtgacctgtgtgggaagagcttcacccagaggagcaagctgatcacccaccagaggatccacactggagagaagccctaccagtgcatcgagtgcaggaagagcttccgctggaacagcaacctgattgtgcaccagaggatccacactggagagaagccctatgaatgtacccactgcggcaagagcttcagccagagctatgagctggtgacccacaagaggacccacactggagagaagcccttcaagtgcacccagtgtgggaagagcttcagccagaagtatgacctggtggtgcaccagaggacccacactggagagaagccctatgagtgcaacctgtgtgggaagagcttcagccagagcagcaagctgatcacccaccagaggatccacactggagagaagccctaccagtgcattgaatgtgggaagagcttccgctggaacagcaacctggtgatccaccagaggatccacactggagagaagccctatgactgcacccactgcggcaagagcttcagccagagctaccagctggtggcccacaagaggacccacactggagagaagccctatgaatgtaatgaatgtgggaaggccttcaacagaagcacccagctgatccgccacctgcagatccacactggagagaagccctacaagtgcaaccagtgcaacaaggcctttgcccggagcagctacctggtgatgcaccagaggacccacactggagagaagccctttgaatgttcccagtgtgggaaggccttcagcggcagcagcaacctgctgagccaccaccgcatccacagcggggagaagccctatgaatgtagtgactgtgggaagagcttccggcagcagagccagctggtggtgcacaggaggacccacactggagagaagccctag

SEQ ID NO: 18055 - DNA, 804 bp, Artificial Sequence
  Description of Artificial Sequence: Synthetic coding sequence
atggccagcagcttcagtgactgcaacatcatccagaccacagagaagcccagcgtgtgcaaccagtgtgggaagagcttcagctgctgcaagctgatccaccagaggacccacactggagagaagccctttgaatgtacccagtgtgggaagagcttcagccagagctatgacctggtgatccaccagaggacccacactggagagaagccctatgaatgtgacctgtgtgggaagagcttcacccagaggagcaagctgatcacccaccagaggatccacactggagagaagccctaccagtgcatcgagtgcaggaagagcttccgctggaacagcaacctgattgtgcaccagaggatccacactggagagaagccctatgaatgtacccactgcggcaagagcttcagccagagctatgagctggtggcccacaagaggacccacactggagagaagccctatgaatgtaatgaatgtgggaaggccttcaacagaagcacccagctgatccgccacctgcagatccacactggagagaagccctacaagtgcaaccagtgcaacaaggcctttgcccggagcagctacctggtgatgcaccagaggacccacactggagagaagccctttgaatgttcccagtgtgggaaggccttcagcggcagcagcaacctgctgagccaccaccgcatccacagcggggagaagccctatgaatgtagtgactgtgggaagagcttccggcagcagagccagctggtggtgcacaggaggacccacactggagagaagccctag

SEQ ID NO: 18056 - DNA, 2511 bp, Artificial Sequence
  Description of Artificial Sequence: Synthetic coding sequence
atgcaggtggacccccccctgcacggccccccaaatgacttcctgatcttccagatcatccccctgcacagcctgagcatcatgccccgcttcctgtggatcctgtgcttctccatggaggagacccagggcgagctgaccagcagctgtggcagcaagaccatggccaacgtgtccctggccttcagagatgtgtccattgacctgagccaggaggagtgggagtgcctggatgctgtgcagagggacctgtacaaggatgtgatgctggagaactacagcaacctggtgtccctgggctacaccatccccaagccagatgtgatcaccctgctggagcaggagaaggagccctggatcgtgatgagggagggcaccaggaactggttcacagacctggagtacaagtacatcaccaagaacctgctgtctgagaagaatgtgtgcaagatctacctgagccagctgcagacaggagagaagagcaagaacaccatccacgaggacaccatcttcagaaatggcctgcagtgcaagcatgaatttgagcggcaggagcggcaccagatgggctgtgtgtcccagatgctgatccagaagcagatcagccaccccctgcaccccaagatccacgcccgggagaagagctatgagtgcaaggaatgtaggaaggccttccggcagcagagctacctgatccagcacctgcgcatccacactggagagcggccctacaagtgcatggagtgtgggaaggccttctgccgggtgggggacctgcgggtgcaccacaccatccacgccggggagcggccctatgagtgcaaggaatgtgggaaggccttccggctgcactaccacctgacagagcaccagaggatccacagcggcgtgaagccctatgagtgcaaggaatgtgggaaggccttcagccgggtgcgggacctgcgggtgcaccagaccatccacgccggggagcggccctatgagtgcaaggaatgtgggaaggccttccggctgcactaccagctgacagagcaccagaggatccacactggagagcggccctatgagtgcaaggtgtgtgggaagaccttccgggtgcagaggcacatcagccagcaccagaagatccacactggagtgaagccctacaagtgcaatgaatgtgggaaggccttcagccacggcagctacctggtgcagcaccagaagatccacactggagagaagccctatgagtgcaaggaatgtgggaagagcttctccttccacgccgagctggcccggcaccggcgcatccacactggagagaagccctatgagtgcagagaatgtgggaaggccttccggctgcagacagagctgaccaggcaccacaggacccacactggagagaagccctatgagtgcaaggaatgtgggaaggccttcatctgtggctaccagctgaccctgcacctgcggacccacactggagagatcccctatgagtgcaaggaatgtgggaagaccttcagcagccgctaccacctgacccagcactaccgcatccacactggagagaagccctacatctgcaatgaatgtgggaaggccttccggctgcagggcgagctgaccaggcaccaccgcatccacacctgtgagaagccctatgagtgcaaggaatgtgggaaggccttcatccacagcaaccagttcatcagccaccagaggatccacaccagcgagagcacctacatctgcaaggaatgtgggaagatcttcagccgccgctacaacctgacccagcacttcaagatccacactggagagaagccctacatctgcaatgaatgtgggaaggccttccgcttccagacagagctgacccagcaccaccgcatccacactggagagaagccctacaagtgcacagaatgtgggaaggccttcatccgcagcacccacctgacccagcaccaccgcatccacactggagagaagccctatgagtgcacagaatgtgggaagaccttcagccgccactaccacctgacccagcaccaccggggccacactggagagaagccctacatctgcaatgaatgtggaaatgccttcatctgcagctaccgcctgaccctgcaccagaggatccacactggagagctgccctatgagtgcaaggaatgtgggaagaccttcagccgccgctaccacctgacccagcacttccggctgcacactggagagaagccctacagctgcaaggaatgtggaaatgccttccggctgcaggccgagctgaccaggcaccacatcgtgcacactggagagaagccctacaagtgcaaggaatgtgggaaggccttctctgtgaacagcgagctgaccaggcaccaccgcatccacactggagagaagccctaccagtgcaaggaatgtgggaaggccttcatccgcagtgaccagctgaccctgcaccagaggaaccacatcagcgaggaggtgctgtgcatcatgtag

SEQ ID NO: 18057 - DNA, 1344 bp, Artificial Sequence
  Description of Artificial Sequence: Synthetic coding sequence
aagaccttccgggtgcagaggcacatcagccagcaccagaagatccacactggagtgaagccctacaagtgcaatgaatgtgggaaggccttcagccacggcagctacctggtgcagcaccagaagatccacactggagagaagccctatgagtgcaaggaatgtgggaagagcttctccttccacgccgagctggcccggcaccggcgcatccacactggagagaagccctatgaatgtcgggagtgtgggaaggccttccggctgcagacagagctgaccaggcaccacaggacccacactggagagaagccctatgagtgcaaggaatgtgggaaggccttcatctgtggctaccagctgaccctgcacctgcggacccacactggagagatcccctatgagtgcaaggaatgtgggaagaccttcagcagccgctaccacctgacccagcactaccgcatccacactggagagaagccctatgagtgcaaggaatgtgggaaggccttcatccacagcaaccagttcatcagccaccagaggatccacaccagcgagagcacctacatctgcaaggaatgtgggaagatcttcagccgccgctacaacctgacccagcacttcaagatccacactggagagaagccctacatctgcaatgaatgtgggaaggccttccgcttccagacagagctgacccagcaccaccgcatccacactggagagaagccctacaagtgcacagaatgtgggaaggccttcatccgcagcacccacctgacccagcaccaccgcatccacactggagagaagccctatgaatgtacagaatgtgggaagaccttcagccgccactaccacctgacccagcaccaccggggccacactggagagaagccctacatctgcaatgaatgtggaaatgccttcatctgcagctaccgcctgaccctgcaccagaggatccacactggagagctgccctatgagtgcaaggaatgtgggaagaccttcagccgccgctaccacctgacccagcacttccggctgcacactggagagaagccctacagctgcaaggaatgtggaaatgccttccggctgcaggccgagctgaccaggcaccacatcgtgcacactggagagaagccctacaagtgcaaggaatgtgggaaggccttctctgtgaacagcgagctgaccaggcaccaccgcatccacactggagagaagccctaccagtgcaaggaatgtgggaaggccttcatccgcagtgaccagctgaccctgcaccagaggaaccacatcagtgaccgggagtttgtgatctgcaaggagtag

SEQ ID NO: 18058 - DNA, 1209 bp, Artificial Sequence
  Description of Artificial Sequence: Synthetic coding sequence
atggccgagatgaacccagcccagggccacgtggtgtttgaagatgtggccatctacttcagccaggaggagtggggccacctggatgaggcccagaggctgctgtacagagatgtgatgctggagaacctggccctgctgagcagcctgggctgctgccacggggctgaagatgaggaggcccccctggagcccggggtgtctgtgggcgtgtcccaggtgatggcccccaagccctgcctgagcacccagaacacccagccctgtgagacctgcagcagcctgctgaaggacatcctgcggctggccgagcatgatggcacccaccctgagcagggcctgtacacctgcccagcccacctgcaccagcaccagaaggagcagatccgggagaagctgagcagaggagatggcggccggcccacctttgtgaagaaccaccgggtgcacatggccggcaagaccttcctgtgcagtgaatgtgggaaggccttcagccacaagcacaagctgagtgaccaccagaagatccacactggagagaggacctacaagtgcagcaaatgtggcatcctcttcatggagaggagcaccctgaacagacaccagaggacccacactggagagcggccctatgaatgtaatgaatgtgggaaggccttcctgtgcaagagccacctggtgcgccaccagaccatccacagcggggagcggccctatgaatgttctgaatgtgggaagctgttcatgtggagcagcaccctcatcacccaccagagggtgcacacaggcaagaggccctacggctgcagtgaatgtgggaagttcttcaagtgcaacagcaacctcttccgccactaccgcatccacacaggcaagaggagctatggctgcagtgaatgtgggaagttcttcatggagaggagcaccctgagccgccaccagagggtgcacactggagagcggccctatgaatgtaatgaatgtgggaagttcttcagcctgaagtctgtgctgatccagcaccagagggtgcacactggagagcggccctatgaatgttctgaatgtgggaaggccttcctgaccaagagccacctgatctgccaccagacagtgcacacagctgccaagcagtgcagtgaatgtgggaagttcttccgctacaacagcaccctgctgcggcaccagaaggtgcacactggatag

SEQ ID NO: 18059 - DNA, 1065 bp, Artificial Sequence
  Description of Artificial Sequence: Synthetic coding sequence
atggccgagatgaacccagcccagggccacgtggtgtttgaagatgtggccatctacttcagccaggaggagtggggccacctggatgaggcccagaggctgctgtacagagatgtgatgctggagaacctggccctgctgagcagcctgggctgctgccacggggctgaagatgaggaggcccccctggagcccggggtgtctgtgggcgtgtcccaggtgatggcccccaagccctgcctgagcacccagaacacccagccctgtgagacctgcagcagcctgctgaaggacatcctgcggctggccgagcatgatggcacccaccctgagcagggcctgtacacctgcccagcccacctgcaccagcaccagaaggagcagatccgggagaagctgagcagaggagatggcggccggcccacctttgtgaagaaccaccgggtgcacatggccggcaagaccttcctgtgcagtgaatgtgggaaggccttcagccacaagcacaagctgagtgaccaccagaagatccacactggagagaggacctacaagtgcagcaaatgtggcatcctcttcatggagaggagcaccctgaacagacaccagaggacccacactggagagcggccctatgaatgtaatgaatgtgggaaggccttcctgtgcaagagccacctggtgcgccaccagaccatccacagcggggagcggccctatgaatgttctgaatgtgggaagctgttcatgtggagcagcaccctcatcacccaccagagggtgcacacaggcaagaggccctacggctgcagtgaatgtgggaagttcttcaagtgcaacagcaacctcttccgccactaccgcatccacacaggcaagaggagctatggctgcagtgaatgtgggaagttcttcatggagaggagcaccctgagccgccaccagagggtgcacactggagagcggccctatgaatgtaatgaatgtgggaagttcttcagcctgaagtctgtgctgatccagcaccagaggagagtgtacacagaggaggagagcttccagtag

SEQ ID NO: 18060 - DNA, 1638 bp, Artificial Sequence
  Description of Artificial Sequence: Synthetic coding sequence
atgaacctgacagagggccccctggccatggccgagatggaccccacccagggccgggtggtgtttgaagatgtggccatctacttcagccaggaggagtggggccacctggatgaggcccagaggctgctgtacagagatgtgatgctggagaacctggccctgctgagcagcctgggctcctggcatggagcagaagatgaggaggcccccagccagcagggcttctctgtgggcgtgtctgaggtgacagccagcaagccctgcctgagcagccagaaggtgcaccccagcgagacctgtggcccccccctgaaggacatcctgtgcctggtggagcacaacggcatccaccctgagcagcacatctacatctgtgaggccgagctgttccagcaccccaagcagcagatcggggagaacctgagcagaggagatgactggatccccagctttgggaagaaccaccgggtgcacatggccgaggagatcttcacctgcatggagggctggaaggacctgcctgccaccagctgcctgctgcagcaccagggcccccagagcgagtggaagccctacagagacacagaagatcgggaggccttccagacaggccagaatgactacaagtgcagtgaatgtgggaagaccttcacctgcagctacagctttgtggagcaccagaagatccacactggagagaggagctatgagtgcaacaagtgtgggaagttcttcaagtacagcgccaacttcatgaagcaccagacagtgcacaccagcgagaggacctatgagtgcagagaatgtgggaagagcttcatgtacaactaccgcctgatgaggcacaagagggtgcacactggagagcggccctatgagtgcaacacctgtgggaagttcttccgctacagcagcacctttgtgcgccaccagagggtgcacactggagagcggccctatgagtgcagagaatgtgggaagttcttcatggacagcagcaccctcatcaagcaccagagggtgcacactggagagcggccctacaagtgcaatgactgtgggaagttcttccgctacatcagcaccctcatccgccaccagaggatccacactggagagcggccctatgagtgcagcgtgtgtggggagctgttccgctacaacagcagcctggtgaagcactggaggaaccacactggagagcggccctacaagtgcagtgaatgtgggaagagcttccgctaccactgccgcctcatccgccaccagagggtgcacactggagagcggccctatgagtgcagtgaatgtgggaagttcttccgctacaacagcaacctgatcaagcactggaggaaccacactggagagcggccctatgagtgcagagaatgtgggaaggccttcagccacaagcacatcctggtggagcaccagaagatccacagcggggagcggccctatgagtgcagcgagtgccagaaggccttcatcaggaagagccacctggtgcaccaccagaagatccacagcgaggagcggctggtgtgcagcatgaatgtgggcaacagcctggccaagacccccaccagcctgaacatccgggacttcaccatggagaaggtgtaccactag

SEQ ID NO: 18061 - DNA, 1602 bp, Artificial Sequence
  Description of Artificial Sequence: Synthetic coding sequence
atgaacctgacagagggccgggtggtgtttgaagatgtggccatctacttcagccaggaggagtggggccacctggatgaggcccagaggctgctgtacagagatgtgatgctggagaacctggccctgctgagcagcctgggctcctggcatggagcagaagatgaggaggcccccagccagcagggcttctctgtgggcgtgtctgaggtgacagccagcaagccctgcctgagcagccagaaggtgcaccccagcgagacctgtggcccccccctgaaggacatcctgtgcctggtggagcacaacggcatccaccctgagcagcacatctacatctgtgaggccgagctgttccagcaccccaagcagcagatcggggagaacctgagcagaggagatgactggatccccagctttgggaagaaccaccgggtgcacatggccgaggagatcttcacctgcatggagggctggaaggacctgcctgccaccagctgcctgctgcagcaccagggcccccagagcgagtggaagccctacagagacacagaagatcgggaggccttccagacaggccagaatgactacaagtgcagtgaatgtgggaagaccttcacctgcagctacagctttgtggagcaccagaagatccacactggagagaggagctatgagtgcaacaagtgtgggaagttcttcaagtacagcgccaacttcatgaagcaccagacagtgcacaccagcgagaggacctatgagtgcagagaatgtgggaagagcttcatgtacaactaccgcctgatgaggcacaagagggtgcacactggagagcggccctatgagtgcaacacctgtgggaagttcttccgctacagcagcacctttgtgcgccaccagagggtgcacactggagagcggccctatgagtgcagagaatgtgggaagttcttcatggacagcagcaccctcatcaagcaccagagggtgcacactggagagcggccctacaagtgcaatgactgtgggaagttcttccgctacatcagcaccctcatccgccaccagaggatccacactggagagcggccctatgagtgcagcgtgtgtggggagctgttccgctacaacagcagcctggtgaagcactggaggaaccacactggagagcggccctacaagtgcagtgaatgtgggaagagcttccgctaccactgccgcctcatccgccaccagagggtgcacactggagagcggccctatgagtgcagtgaatgtgggaagttcttccgctacaacagcaacctgatcaagcactggaggaaccacactggagagcggccctatgagtgcagagaatgtgggaaggccttcagccacaagcacatcctggtggagcaccagaagatccacagcggggagcggccctatgagtgcagcgagtgccagaaggccttcatcaggaagagccacctggtgcaccaccagaagatccacagcgaggagcggctggtgtgcagcatgaatgtgggcaacagcctggccaagacccccaccagcctgaacatccgggacttcaccatggagaaggtgtaccactag

SEQ ID NO: 18062 - DNA, 1884 bp, Artificial Sequence
  Description of Artificial Sequence: Synthetic coding sequence
atggccgaggccgccctggtgatcaccccccagggccacgtgacctttgaagatattgctgtgtacttcagccaggaggagtggggcctgctggatgaggcccagcgctgcctgtaccatgatgtgatgctggagaacttcagcctgatggcctctgtgggctgcctgcatggaattgaagctgaggaggcccccagcgagcagaccctgagcgcccagggcgtgtcccaggcccggacccccaagctgggccccagcatccccaatgcccacagctgtgagatgtgcatcctggtgatgaaggacatcctgtacctgtctgagcaccagggcaccctgccctggcagaagccctacacctctgtggccagcggcaagtggttctcctttggcagcaacctgcagcagcaccagaaccaggacagcggggagaagcacatcaggaaggaggagagcagcgccctgctgctgaacagctgcaagatccccctgagtgacaacctcttcccctgcaaggatgtggagaaggacttccccaccatcctgggcctgctgcagcaccagaccacccacagccggcaggagtatgcccacaggagccgggagaccttccagcagaggcgctacaagtgtgagcaggtgttcaatgagaaggtgcacgtgacagagcaccagagggtgcacactggagagaaggcctacaagaggcgggagtatggcaagagcctgaacagcaagtacctgtttgtggagcaccagaggacccacaatgctgagaagccctacgtgtgcaacatctgtgggaagagcttcctgcacaagcagaccctggtgggccaccagcagaggatccacacccgggagaggagctatgtgtgcattgaatgtgggaagagcctgagcagcaagtacagcctggtggagcaccagaggacccacaacggggagaagccctacgtgtgcaatgtgtgtgggaagagcttccgccacaagcagacctttgtgggccaccagcagaggatccacactggagagcggccctacgtgtgcatggagtgtgggaagagcttcatccacagctatgaccgcatccgccaccagagggtgcacactggagagggcgcctaccagtgcagtgaatgtgggaagagcttcatctacaagcagagcctgctggaccaccaccgcatccacactggagagcggccctatgagtgcaaggaatgtgggaaggccttcatccacaagaagaggctgctggagcaccagaggatccacactggagagaagccctacgtgtgcatcatctgtgggaagagcttcatccgcagcagtgactacatgaggcaccagaggatccacactggagagcgggcctatgaatgtagtgactgtgggaaggccttcatcagcaagcagaccctgctgaagcaccacaagatccacacccgggagcggccctatgaatgttctgaatgtgggaagggcttctacctggaggtgaagctgctgcagcaccagaggatccacacccgggagcagctgtgtgaatgtaatgaatgtgggaaggtgttcagccaccagaagaggctgctggagcaccagaaggtgcacactggagagaagccctgtgaatgttctgaatgtgggaagtgcttccgccacaggaccagcctcatccagcaccagaaggtgcacagcggggagcggccctacaactgcacagcctgtgagaaggccttcatctacaagaacaagctggtggagcaccagaggatccacactggagagaagccctatgaatgtgggaaatgtgggaaggccttcaacaagcgctacagcctggtgcgccaccagaaggtgcacatcacagaggagccctag

SEQ ID NO: 18063 - DNA, 1923 bp, Artificial Sequence
  Description of Artificial Sequence: Synthetic coding sequence
atggccgaggccgccctggtgatcaccccccagatccccatggtgacagaggagtttgtgaagcccagccagggccacgtgacctttgaggacattgctgtgtacttcagccaggaggagtggggcctgctggatgaggcccagcgctgcctgtaccatgatgtgatgctggagaacttcagcctgatggcctctgtgggctgcctgcacggcatcgaggccgaggaggcccccagcgagcagaccctgagcgcccagggcgtgtcccaggcccggacccccaagctgggccccagcatccccaatgcccacagctgtgagatgtgcatcctggtgatgaaggacatcctgtacctgtctgagcaccagggcaccctgccctggcagaagccctacacctctgtggccagcggcaagtggttctcctttggcagcaacctgcagcagcaccagaaccaggacagcggggagaagcacatcaggaaggaggagagcagcgccctgctgctgaacagctgcaagatccccctgagtgacaacctcttcccctgcaaggatgtggagaaggacttccccaccatcctgggcctgctgcagcaccagaccacccacagccggcaggagtatgcccacaggagccgggagaccttccagcagaggcgctacaagtgtgagcaggtgttcaatgagaaggtgcacgtgacagagcaccagagggtgcacactggagagaaggcctacaagagaagagaatatggcaagagcctgaacagcaagtacctgtttgtggagcaccagaggacccacaatgctgagaagccctacgtgtgcaacatctgtgggaagagcttcctgcacaagcagaccctggtgggccaccagcagaggatccacacccgggagaggagctatgtgtgcattgaatgtgggaagagcctgagcagcaagtacagcctggtggagcaccagaggacccacaatggagagaagccctacgtgtgcaatgtgtgtgggaagagcttccgccacaagcagacctttgtgggccaccagcagaggatccacactggagagcggccctacgtgtgcatggagtgtgggaagagcttcatccacagctatgaccgcatccgccaccagagggtgcacactggagagggcgcctaccagtgcagtgaatgtgggaagagcttcatctacaagcagagcctgctggaccaccaccgcatccacactggagagcggccctatgagtgcaaggaatgtgggaaggccttcatccacaagaagaggctgctggagcaccagaggatccacactggagagaagccctacgtgtgcatcatctgtgggaagagcttcatccgcagcagtgactacatgaggcaccagaggatccacactggagagcgggcctatgagtgcagcgactgtgggaaggccttcatcagcaagcagaccctgctgaagcaccacaagatccacacccgggagcggccctatgagtgcagtgaatgtgggaagggcttctacctggaggtgaagctgctgcagcaccagaggatccacacccgggagcagctgtgtgagtgcaatgaatgtgggaaggtgttcagccaccagaagaggctgctggagcaccagaaggtgcacactggagagaagccctgtgagtgcagtgaatgtgggaagtgcttccgccacaggaccagcctcatccagcaccagaaggtgcacagcggggagcggccctacaactgcacagcctgtgagaaggccttcatctacaagaacaagctggtggagcaccagaggatccacactggagagaagccctatgaatgtgggaaatgtgggaaggccttcaacaagcgctacagcctggtgcgccaccagaaggtgcacatcacagaggagccctag

SEQ ID NO: 18064 - DNA, 1173 bp, Artificial Sequence
  Description of Artificial Sequence: Synthetic coding sequence
atggccgagaccaaggatgctgcccagatgctggtgaccttcaaggatgtggccgtgaccttcacccgggaggagtggaggcagctggacctggcccagaggaccctgtaccgggaggtgatgctggagacctgtggcctgctggtgtccctgggggaccgggcccaggtgcacacccgggagcccaccacctacccacctgtgctgtctgagcgggccttcctgcggggcagcctgaccctggagagcagcaccagcagtgacagccggctgggccgggccagagatgaggagggcctgctggagatgcagaagggcaaggtgaccccagagacagacctgcacaaggagacccacctgggcaaggtgtccctggagggggagggcctgggcacagatgatggcctgcacagccgggccctgcaggagtggctgtctgcagatgtgctgcatgaatgtgacagccagcagcccgggaaggatgccctgattcatgctggcaccaacccctacaagtgcaagcagtgtgggaagggcttcaacaggaagtggtacctggtgcgccaccagagggtgcacacaggcatgaagccctatgagtgcaatgcctgtgggaaggccttcagccagagcagcaccctcatccgccactacctgatccacactggagagaagccctacaagtgcctggagtgtgggaaggccttcaagaggaggagctacctgatgcagcaccaccccatccacactggagagaagccctatgagtgcagccagtgcaggaaggccttcacccacaggagcaccttcatccgccacaacagaacccacactggagagaagccctttgagtgcaaggaatgtgagaaggccttcagcaacagagcccacctgatccagcactacatcatccacactggagagaagccctatgactgcatggcctgtgggaaggccttccgctgcagcagcgagctgatccagcaccagaggatccacactggagagaagccctatgagtgcacccagtgtgggaaggccttccacaggagcacctacctgatccagcacagcgtcatccacactggagagatgccctacaagtgcattgaatgtgggaaggccttcaagaggaggagccacctgctgcagcaccagagggtgcacacctag

SEQ ID NO: 18065 - DNA, 1269 bp, Artificial Sequence
  Description of Artificial Sequence: Synthetic coding sequence
atggccgagaccaaggatgctgcccagatgctggtgaccttcaaggatgtggccgtgaccttcacccgggaggagtggaggcagctggacctggcccagaggaccctgtaccgggaggtgatgctggagacctgtggcctgctggtgtccctgggccaccgggtgcccaagccagagctggtgcacctgctggagcacggccaggagctgtggatcgtgaagaggggcctgagccacgccacctgtgccggggaccgggcccaggtgcacacccgggagcccaccacctacccacctgtgctgtctgagcgggccttcctgcggggcagcctgaccctggagagcagcaccagcagtgacagccggctgggccgggccagagatgaggagggcctgctggagatgcagaagggcaaggtgaccccagagacagacctgcacaaggagacccacctgggcaaggtgtccctggagggggagggcctgggcacagatgatggcctgcacagccgggccctgcaggagtggctgtctgcagatgtgctgcatgaatgtgacagccagcagcccgggaaggatgccctgattcatgctggcaccaacccctacaagtgcaagcagtgtgggaagggcttcaacaggaagtggtacctggtgcgccaccagagggtgcacacaggcatgaagccctatgagtgcaatgcctgtgggaaggccttcagccagagcagcaccctcatccgccactacctgatccacactggagagaagccctacaagtgcctggagtgtgggaaggccttcaagaggaggagctacctgatgcagcaccaccccatccacactggagagaagccctatgagtgcagccagtgcaggaaggccttcacccacaggagcaccttcatccgccacaacagaacccacactggagagaagccctttgagtgcaaggaatgtgagaaggccttcagcaacagagcccacctgatccagcactacatcatccacactggagagaagccctatgactgcatggcctgtgggaaggccttccgctgcagcagcgagctgatccagcaccagaggatccacactggagagaagccctatgagtgcacccagtgtgggaaggccttccacaggagcacctacctgatccagcacagcgtcatccacactggagagatgccctacaagtgcattgaatgtgggaaggccttcaagaggaggagccacctgctgcagcaccagagggtgcacacctag

SEQ ID NO: 18066 - DNA, 1146 bp, Artificial Sequence
  Description of Artificial Sequence: Synthetic coding sequence
atgctggtgaccttcaaggatgtggccgtgaccttcacccgggaggagtggaggcagctggacctggcccagaggaccctgtaccgggaggtgatgctggagacctgtggcctgctggtgtccctgggggaccgggcccaggtgcacacccgggagcccaccacctacccacctgtgctgtctgagcgggccttcctgcggggcagcctgaccctggagagcagcaccagcagtgacagccggctgggccgggccagagatgaggagggcctgctggagatgcagaagggcaaggtgaccccagagacagacctgcacaaggagacccacctgggcaaggtgtccctggagggggagggcctgggcacagatgatggcctgcacagccgggccctgcaggagtggctgtctgcagatgtgctgcatgaatgtgacagccagcagcccgggaaggatgccctgattcatgctggcaccaacccctacaagtgcaagcagtgtgggaagggcttcaacaggaagtggtacctggtgcgccaccagagggtgcacacaggcatgaagccctatgaatgtaatgcctgtgggaaggccttcagccagagcagcaccctcatccgccactacctgatccacactggagagaagccctacaagtgcctggagtgtgggaaggccttcaagagaagaagctacctgatgcagcaccaccccatccacactggagagaagccctatgaatgttcccagtgcaggaaggccttcacccacaggagcaccttcatccgccacaacagaacccacactggagagaagccctttgagtgcaaggaatgtgagaaggccttcagcaacagagcccacctgatccagcactacatcatccacactggagagaagccctatgactgcatggcctgtgggaaggccttccgctgcagcagcgagctgatccagcaccagaggatccacactggagagaagccctatgaatgtacccagtgtgggaaggccttccacaggagcacctacctgatccagcacagcgtcatccacactggagagatgccctacaagtgcattgaatgtgggaaggccttcaagagaagaagccacctgctgcagcaccagagggtgcacacctag

SEQ ID NO: 18067 - DNA, 1965 bp, Artificial Sequence
  Description of Artificial Sequence: Synthetic coding sequence
atggctgctgtggccctgcgggacagcgcccagggcatgacctttgaagatgtggccatctacttcagccaggaggagtgggagctgctggatgagagccagcgcttcctgtactgtgatgtgatgctggagaactttgcccacgtgaccagcctgggctactgccacggcatggagaatgaggccatcgccagcgagcagagcgtgtccatccaggtgaggaccagcaaaggaaacacccccacccagaagacccacctgtctgagatcaagatgtgtgtgcctgtgctgaaggacatcctgcctgctgctgagcaccagaccaccagccctgtgcagaagagctacctgggcagcacctccatgaggggcttctgcttctctgctgacctgcaccagcaccagaagcactacaatgaggaggagccctggaagaggaaggtggatgaggccacctttgtgacaggctgccgcttccacgtgctgaactacttcacctgtggggaggccttccctgcccccacagacctgctgcagcacgaggccaccccatctggagaggagccccacagcagcagcagcaagcacatccaggccttcttcaatgccaagagctactacaagtggggcgagtacaggaaggccagcagccacaagcacaccctggtgcagcaccagagcgtgtgcagcgagggcggcctgtatgagtgcagcaaatgtgagaaggccttcacctgcaagaacaccctggtgcagcaccagcagatccacacaggccagaagatgtttgagtgcagtgaatgtgaggagagcttcagcaagaagtgccacctgatcctgcacaagatcatccacactggagagcggccctatgagtgcagcgaccgggagaaggccttcatccacaagtctgagttcatccaccaccagaggaggcacactggaggagtgagacatgaatgtggagaatgtaggaagaccttctcctacaagagcaacctgattgagcaccagagggtgcacactggagagcggccctatgaatgtggagaatgtgggaagagcttccggcagagcagcagcctcttccgccaccagagggtgcacagcggggagcggccctaccagtgctgtgaatgtgggaagagcttccggcagatcttcaacctgatccgccaccggcgggtgcacactggagagatgccctaccagtgcagcgactgtgggaagagcttcagctgcaagtctgagctgatccagcaccagaggatccacagcggggagcggccctatgagtgcagagaatgtgggaagagcttccggcagttcagcaacctgatccgccacaggagcatccacactggagaccggccctatgagtgcagtgaatgtgagaagagcttcagcaggaagttcatcctgatccagcaccagagggtgcacactggagagcggccctatgagtgcagtgaatgtgggaagagcttcaccaggaagagtgacctgatccagcaccggcgcatccacacaggcacccggccctatgagtgcagtgaatgtgggaagagcttccggcagaggagcggcctcatccagcaccggcggctgcacactggagagcggccctatgagtgcagtgaatgtgggaagagcttcagccagagcgccagcctcatccagcaccagagggtgcacactggagagcggccctatgagtgcagtgaatgtgggaagagcttcagccagagcagcagcctcatccagcaccagaggggccacactggagagcggccctatgagtgcagccagtgtgggaagcccttcacccacaagagtgacctgatccagcaccagagggtgcacactggagagcggccctatgagtgcagtgaatgtgggaagagcttcagcaggaagagcaacctgatccgccaccggcgggtgcacacagaggagcggccctag

SEQ ID NO: 18068 - DNA, 2013 bp, Artificial Sequence
  Description of Artificial Sequence: Synthetic coding sequence
atgcctgcccctgtgggcagaagaagcccccccagccccaggagctccatggctgctgtggccctgcgggacagcgcccagggcatgacctttgaagatgtggccatctacttcagccaggaggagtgggagctgctggatgagagccagcgcttcctgtactgtgatgtgatgctggagaactttgcccacgtgaccagcctgggctactgccacggcatggagaatgaggccatcgccagcgagcagagcgtgtccatccaggtgaggaccagcaaaggaaacacccccacccagaagacccacctgtctgagatcaagatgtgtgtgcctgtgctgaaggacatcctgcctgctgctgagcaccagaccaccagccctgtgcagaagagctacctgggcagcacctccatgaggggcttctgcttctctgctgacctgcaccagcaccagaagcactacaatgaggaggagccctggaagaggaaggtggatgaggccacctttgtgacaggctgccgcttccacgtgctgaactacttcacctgtggggaggccttccctgcccccacagacctgctgcagcacgaggccaccccatctggagaggagccccacagcagcagcagcaagcacatccaggccttcttcaatgccaagagctactacaagtggggcgagtacaggaaggccagcagccacaagcacaccctggtgcagcaccagagcgtgtgcagcgagggcggcctgtatgagtgcagcaaatgtgagaaggccttcacctgcaagaacaccctggtgcagcaccagcagatccacacaggccagaagatgtttgagtgcagtgaatgtgaggagagcttcagcaagaagtgccacctgatcctgcacaagatcatccacactggagagcggccctatgagtgcagcgaccgggagaaggccttcatccacaagtctgagttcatccaccaccagaggaggcacactggaggagtgagacatgaatgtggagaatgtaggaagaccttctcctacaagagcaacctgattgagcaccagagggtgcacactggagagcggccctatgaatgtggagaatgtgggaagagcttccggcagagcagcagcctcttccgccaccagagggtgcacagcggggagcggccctaccagtgctgtgaatgtgggaagagcttccggcagatcttcaacctgatccgccaccggcgggtgcacactggagagatgccctaccagtgcagcgactgtgggaagagcttcagctgcaagtctgagctgatccagcaccagaggatccacagcggggagcggccctatgagtgcagagaatgtgggaagagcttccggcagttcagcaacctgatccgccacaggagcatccacactggagaccggccctatgagtgcagtgaatgtgagaagagcttcagcaggaagttcatcctgatccagcaccagagggtgcacactggagagcggccctatgagtgcagtgaatgtgggaagagcttcaccaggaagagtgacctgatccagcaccggcgcatccacacaggcacccggccctatgagtgcagtgaatgtgggaagagcttccggcagaggagcggcctcatccagcaccggcggctgcacactggagagcggccctatgagtgcagtgaatgtgggaagagcttcagccagagcgccagcctcatccagcaccagagggtgcacactggagagcggccctatgagtgcagtgaatgtgggaagagcttcagccagagcagcagcctcatccagcaccagaggggccacactggagagcggccctatgagtgcagccagtgtgggaagcccttcacccacaagagtgacctgatccagcaccagagggtgcacactggagagcggccctatgagtgcagtgaatgtgggaagagcttcagcaggaagagcaacctgatccgccaccggcgggtgcacacagaggagcggccctag

SEQ ID NO: 18069 - DNA, 1269 bp, Artificial Sequence
  Description of Artificial Sequence: Synthetic coding sequence
atgacctttgaagatgtggccatctacttcagccaggaggagtgggagctgctggatgagagccagcgcttcctgtactgtgatgtgatgctggagaactttgcccacgtgaccagcctggtgaccagccaccagaagcactacaatgaggaggagccctggaagaggaaggtggatgaggccacctttgtgacaggctgccgcttccacgtgctgaactacttcacctgtggggaggccttccctgcccccacagacctgctgcagcacgaggccaccccatctggagaggagccccacagcagcagcagcaagcacatccaggccttcttcaatgccaagagctactacaagtggggcgagtacaggaaggccagcagccacaagcacaccctggtgcagcaccagagccgggtgcacactggagagcggccctatgaatgtggggagtgtgggaagagcttccggcagagcagcagcctcttccgccaccagagggtgcacagcggggagcggccctaccagtgctgtgaatgtgggaagagcttccggcagatcttcaacctgatccgccacagaagagtgcacactggagagatgccctaccagtgcagcgactgtgggaagagcttcagctgcaagtctgagctgatccagcaccagaggatccacagcggggagcggccctatgaatgtcgggagtgtgggaagagcttccggcagttcagcaacctgatccgccacaggagcatccacactggagaccggccctatgaatgttctgaatgtgagaagagcttcagcaggaagttcatcctgatccagcaccagagggtgcacactggagagcggccctatgaatgttctgaatgtgggaagagcttcaccaggaagagtgacctgatccagcaccggcgcatccacacaggcacccggccctatgaatgttctgaatgtgggaagagcttccggcagaggagcggcctcatccagcaccggcggctgcacactggagagcggccctatgaatgttctgaatgtgggaagagcttcagccagagcgccagcctcatccagcaccagagggtgcacactggagagcggccctatgaatgttctgaatgtgggaagagcttcagccagagcagcagcctcatccagcaccagaggggccacactggagagcggccctatgaatgttcccagtgtgggaagcccttcacccacaagagtgacctgatccagcaccagagggtgcacactggatag

SEQ ID NO: 18070 - DNA, 1224 bp, Artificial Sequence
  Description of Artificial Sequence: Synthetic coding sequence
atggctgctgctgccctgcgcttccctgtgcagggcaccgtgacctttgaagatgtggccgtgaagttcacccaggaggagtggaacctgctgtctgaggcccagcgctgcctgtacagagatgtgaccctggagaacctggccctgatgagcagcctgggctgctggtgtggggtggaggatgaagctgcccccagcaagcagagcatctacatccagcgggagacccaggtgaggacccccatggccggcgtgagccccaagaaggcccacccctgtgagatgtgtggccccatcctgggggacatcctgcacgtggccgaccaccagggcacccaccacaagcagaagctgcaccgctgtgaggcctggggcaacaagctgtatgattctggcaacttccaccagcaccagaatgagcacatcggggagaagccctaccggggctctgtggaggaggccctgtttgccaagcgctgcaagctgcacgtgtctggagagagctctgtgttcagcgagagcggcaaggacttcctgctgcggagcggcctgctgcagcaggaggccacccacacaggcaagagcaacagcaagacagaatgtgtgtccctcttccacggcggcaagagccactacagctgtggcggctgcatgaagcacttcagcaccaaggacatcctgagccagcacgagcggctgctgcccacagaggagcccagcgtgtggtgtgaatgtgggaagagcagcagcaaatatgacagcttcagcaaccaccagggcgtgcacacccgggagaagccctacacctgtggcatctgtgggaagctgttcaacagcaagagccacctgctggtgcaccagaggatccacactggagagaagccctatgaatgtgaggtgtgccagaagttcttccgccacaagtaccacctgattgcccaccagagggtgcacactggagagcggccctatgaatgtagtgactgtgggaagagcttcacccacagcagcaccttccgggtgcacaagagggtgcacacaggccagaagccctatgaatgttctgaatgtgggaagagctttgctgagagcagcagcctgaccaagcacagaagagtgcacactggagagaagccctacggctgcagtgaatgtgagaagaagttccggcagatcagcagcctgcggcaccaccagagggtgcacaagaggaagggcctgtag

SEQ ID NO: 18071 - DNA, 1617 bp, Artificial Sequence
  Description of Artificial Sequence: Synthetic coding sequence
atggtgacctgtgcccacctgggcagaagagcccggctgcctgctgcccagcccagcgcctgccccggcacctgcttcagccaggaggagaggatggccgccggctacctgccccgctggagccaggagctggtgacctttgaagatgtgtccatggacttcagccaggaggagtgggagctgctggagcccgcccagaagaacctgtaccgggaggtgatgctggagaactacagaaatgtggtgtccctggaggccctgaagaaccagtgcacagatgtgggcatcaaggagggccccctgagccctgcccagaccagccaggtgaccagcctgagctcctggacaggctacctgctcttccagcctgtggccagcagccacctggagcagcgggaggccctgtggattgaggagaagggcaccccccaggccagctgcagcgactggatgacagtgctgaggaaccaggacagcacctacaagaaggtggccctgcaggaggagcccgccagcggcatcaacatgatcaagctgatccgggaggatggcggctggaagcagctggaggacagccatgaggacccccagggcctgctgagccagaaggccagcctgcacgtggtggccgtgccccaggagaaggccacagcctggcacggctttggagaaaatggaaacctgagccctgccctggtgctgagccagggcagcagcaagggcaaccacctgtgtggcagcgagctggacatcaccagcctggccagtgacagcgtgctgaaccaccaccagctgggctacgccgaccggcggccctgtgagagcaatgaatgtggaaatgccatccggcagaacagccacttcatccagcacggcggcaagatgtttgtgtacctggagaatggccagagcctgaaccacggcatggccctgaccatccacaacaagatcaacacagctgagaagccctttgagtgccaccagtgtgggaaggtgttcaacagaagacacagcctgtctgagcaccagaggatccacactggagagaagccctatgagtgccaggagtgtggccgggccttcacccacagcagcaccctgaccaggcacctgcggacccacactggagagaagccctacggctgtggggagtgtgggaaggccttcaaccgcatcagcagcctgacccagcaccagaggatccacactggagagaagccctacaagtgtgaggactgtgggaagagcttctgccagagcagctacctgatcctgcacaagaggacccacactggagagaagccctatgaatgttctgaatgtgggaaggccttcagtgacaggagcagcctgaaccagcacgagaggacccacactggagagaacccctatgagtgcaagcagtgtggccgggccttcagccagaggagcagcctggtgagacatgagaggacccacactggagagaagccctaccgctgccaggagtgtgggaaggccttcagccagagcagcagcctggtgacccaccagaagacccacagcagccagaagacctacaagatcatcgactgtgggaaggccttctaccagaacagacacctgattggctactag

SEQ ID NO: 18072 - DNA, 1887 bp, Artificial Sequence
  Description of Artificial Sequence: Synthetic coding sequence
atggattctgtggtgtttgaagatgtggccgtggacttcaccctggaggagtgggccctgctggacagcgcccagagggacctgtacagagatgtgatgctggagaccttccagaacctggcctctgtggatgatgagacccagttcaaggccagcggctctgtgtcccagcaggacatctatggagagaagatccccaaggagagcaagatcgccaccttcaccagaaatgtgtcctgggcctctgtgctgggcaagatctgggacagcctgagcattgaggaccagaccaccaaccagggcaggaacctgagcaggaaccacggcctggagcggctgtgtgagagcaatgaccagtgtggggaggccctgagccagatcccccacctgaacctgtacaagaagatccccccaggagtgaagcagtatgagtacaacacctacggcaaggtgttcatgcacaggaggaccagcctgaagagccccatcaccgtgcacacaggccacaagccctaccagtgccaggagtgtggccaggcctacagctgccgcagccacctgaggatgcacgtgaggacccacaatggagagcggccctacgtgtgcaagctgtgtgggaagaccttccccaggaccagcagcctgaacagacatgtgcgcatccacacagctgagaagacctatgagtgcaagcagtgtgggaaggccttcatcgacttcagcagcctgaccagccacctgcggagccacactggagagaagccctacaagtgcaaggaatgtgggaaggccttctcctacagcagcaccttccgccgccacaccatcacccacactggagagaagccctacaagtgcaaggaatgtgccgaggccttctcctacagcagcaccttccgccgccacatgatcagccacactggagagaagccccacaagtgcaaggaatgtggggaggccttctcctacagcagcgccttccgccgccacatgatcacccacactggagagaagccctatgagtgcaagcagtgtgggaagaccttcatctacctgcagagcttcagaagacatgagcgcatccacactggagagaagccctatgagtgcaagcagtgtgggaagaccttcatctacccccagagcttcagaagacatgagaggacccacggcggggagaagccctatgagtgcaaccagtgtgggaaggccttcagccaccccagcagcttccggggccacatgagggtgcacactggagagaagccctatgagtgcaagcagtgtgggaagaccttcaactggcccatcagcctgaggaagcacatgaggacccacacccgggagaagccctatgagtgcaagcagtgtgggaaggccttcagcctgagcgcctgcttccgggagcacgtgaggatgcaccctgaggacaagagctatgagtgcaagctgtgtgggaaggccttctactgccacatcagcctgcagaagcacatgaggaggcacacagctgagaagctgtacaagtgcaagcagtgtgggaaggccttctcctggccagagctgctgcagcagcacgtgaggacccacacagtggagaagccctatgagtgcaaggaatgtgggaaggtgttcaagtggcccagcagcctgcccatccacatgaggctgcacactggagagaagccctaccagtgcaagcactgcggcaaggccttcaactgcagcagcagcctgcggcggcacgtgcgcatccacaccacagagaagcagtacaagtgcaatgtgggccaccccccagccaatgagttcatgtgcagcgccagcgagaagagccaccaggagcgggacctgatcaaggtggtgaacatggtgctgcccctgtag

SEQ ID NO: 18073 - DNA, 1632 bp, Artificial Sequence
  Description of Artificial Sequence: Synthetic coding sequence
atggattctgtggtgtttgaagatgtggccgtggacttcaccctggaggagtgggccctgctggacagcgcccagagggacctgtacagagatgtgatgctggagaccttccagaacctggcctctgtggatgatgagacccagttcaaggccagcggctctgtgtcccagcaggacatctatggagagaagatccccaaggagagcaagatcgccaccttcaccagaaatgtgtcctgggcctctgtgctgggcaagatctgggacagcctgagcattgaggaccagaccaccaaccagggcaggaacctgagaaatcatggcctggagcggctgtgtgagagcaatgaccagtgtggggaggccctgagccagatcccccacctgaacctgtacaagaagatccccccaggagtgaagcagtatgagtacaacacctacggcaaggtgttcatgcacaggaggaccagcctgaagagccccatcaccgtgcacacaggccacaagccctaccagtgccaggagtgtggccaggcctacagctgccgcagccacctgaggatgcacgtgaggacccacaacggggagcggccctacgtgtgcaagctgtgtgggaagaccttccccaggaccagcagcctgaacagacatgtgcgcatccacacagctgagaagacctatgagtgcaagcagtgtgggaaggccttcatcgacttcagcagcctgaccagccacctgcggagccacactggagagaagccctacaagtgcaaggaatgtgggaaggccttctcctacagcagcaccttcagaagacacaccatcacccacactggagagaagccctacaagtgcaaggaatgtgccgaggccttctcctacagcagcaccttcagaagacacatgatcagccacactggagagaagccccacaagtgcaaggaatgtggggaggccttctcctacagcagcgccttcagaagacacatgatcacccacactggagagaagccctatgagtgcaagcagtgtgggaagaccttcatctacctgcagagcttcagaagacatgagcgcatccacactggagagaagccctatgagtgcaagcagtgtgggaagaccttcatctacccccagagcttcagaagacatgagaggacccatggaggagagaagccctatgagtgcaaccagtgtgggaaggccttcagccaccccagcagcttccggggccacatgagggtgcacactggagagaagccctatgagtgcaagcagtgtgggaagaccttcaactggcccatcagcctgaggaagcacatgaggacccacacccgggagaagccctatgagtgcaaggaatgtgggaaggtgttcaagtggcccagcagcctgcccatccacatgaggctgcacactggagagaagccctaccagtgcaagcactgtgggaaggccttcaactgcagcagcagcctgcggagacatgtgcgcatccacaccacagagaagcagtacaagtgcaatgtgggccaccccccagccaatgagttcatgtgcagcgccagcgagaagagccaccaggagcgggacctgatcaaggtggtgaacatggtgctgcccctgtag

SEQ ID NO: 18074 - DNA, 1371 bp, Artificial Sequence
  Description of Artificial Sequence: Synthetic coding sequence
atggacacagtggtgtttgaagatgtggtggtggacttcaccctggaggagtgggccctgctgaacccagcccagaggaagctgtacagagatgtgatgctggagaccttcaagcacctggcctctgtggacaatgaggcccagctgaaggccagcggcagcatcagccagcaggacaccagcggggagaagctgagcctgaagcagaagattgagaagttcaccaggaagaacatctgggccagcctgctgggcaagaactgggaggagcacagcgtgaaggacaagcacaacaccaaggagcggcacctgagcaggaacccccgggtggagcggccctgcaagagcagcaagggcaacaagaggggccgcaccttcaggaagaccaggaactgcaacagacacctgaggaagaactgctgcacctctgtgagaagatatgagtgcagccagtgtgggaagctgttcacccacagcagcagcctcatccgccacaagagggcccacagcggccagaagctgtacaagtgcaaggaatgtgggaaggccttcagccggcccagctacctgcagacccatgagaagacccacagcggggagaagccctatgcctgccagagctgtgggaagaccttcctgcggagccacagcctgacagaacatgtgaggacccacactggagagaagccctatgaatgtggccagtgtgggaagggcttcagctgccccaagagcttccgggcccacgtgatgatgcacgccggcggccggccctatgagtgcaagcactgtgggaaggccttccgctgccagaagagcttccgggtgcacatgatcatgcacgccggcggccggccctatgagtgcaagcagtgtgggaaggcctactgctgggccaccagcttccagagacatgtgcgcatccacaacggggagaagccctacaagtgtgggaaatgtgggaaggccttcggctggcccagcagcctgcacaagcacgcccggacccacgccaagaagaagcctgtgtctgggggctctgtgggcaagagcagcgcccggccccggcccagcacagatgtgaagagccagacccgggagaaggtgtacaagtgtgagacctgtgggaagacctacggctggagcagcagcctgcacaagcatgagaggaagcacactggagagaagcctgtgaatgctgcctctgtgggcaagcccagcggcggcctgtgcagcagcaagaatgtgaggacccagatcggccagaagcccagcaaatgtgagaagtgtgggaaggccttcagctgccccaaggccttccagggccacgtgcgcagccacacaggcaagaagagctgcaccagcaagtag

SEQ ID NO: 18075 - DNA, 1293 bp, Artificial Sequence
  Description of Artificial Sequence: Synthetic coding sequence
atggctgctgtggtgctgcccccaacagctgccctgagcagcctcttccctgccagccagcgggagggccacacagaaggaggagagctggtgaatgagctgctgaagtcctggctgaagggcctggtgacctttgaagatgtggccgtggagttcacccaggaggagtgggccctgctggaccctgcccagaggaccctgtacagagatgtgatgctggagaactgcaggaacctggccagcctgggcaaccaggtggacaagcccaggctcatcagccagctggagcaggaggacaaggtgatgacagaggagcggggcatcctgagcggcacctgcccagatgtggagaaccccttcaaggccaagggcctgacccccaagctgcacgtgttcaggaaggagcagagcaggaacatgaagatggagaggaaccacctgggcgccaccctgaatgaatgcaaccagtgcttcaaggtgttcagcaccaagagcagcctgaccaggcacaggaagatccacactggagagcggccctacggctgcagtgaatgtgggaagagctacagcagccgcagctacctggccgtgcacaagaggatccacaatggagagaagccctatgaatgtaatgactgtgggaagaccttcagcagccgcagctacctgactgtgcacaagaggatccacaatggagagaagccctatgaatgtagtgactgtgggaagaccttcagcaacagcagctacctgcggccccacctgcgcatccacactggagagaagccctacaagtgcaaccagtgcttccgggagttccgcacccagagcatcttcaccaggcacaagagggtgcacactggagagggccactacgtgtgcaaccagtgtgggaaggccttcggcaccaggagcagcctgagcagccactacagcatccacactggagagtacccctatgaatgtcatgactgtggccgcaccttcagaagaagaagcaacctgacccagcacatccgcacccacactggagagaagccctacacctgcaatgaatgtgggaagagcttcaccaacagcttcagcctgaccatccaccggcgcatccacaatggagagaagagctatgaatgtagtgactgtgggaagagcttcaacgtgctgagctctgtgaagaagcacatgaggacccacacaggcaagaagccctatgagtgcaactactgcggcaagagcttcaccagcaacagctacctgtctgtgcacaccaggatgcacaaccggcagatgtag

SEQ ID NO: 18076 - DNA, 1293 bp, Artificial Sequence; identical to SEQ ID NO: 18075
  Description of Artificial Sequence: Synthetic coding sequence

SEQ ID NO: 18077 - DNA, 1272 bp, Artificial Sequence
  Description of Artificial Sequence: Synthetic coding sequence
atggctgctgtggtgctgcccccaacagctgccagccagcgggagggccacacagagggcggggagctggtgaatgagctgctgaagtcctggctgaagggcctggtgacctttgaagatgtggccgtggagttcacccaggaggagtgggccctgctggaccctgcccagaggaccctgtacagagatgtgatgctggagaactgcaggaacctggccagcctgggcaaccaggtggacaagcccaggctcatcagccagctggagcaggaggacaaggtgatgacagaggagcggggcatcctgagcggcacctgcccagatgtggagaaccccttcaaggccaagggcctgacccccaagctgcacgtgttcaggaaggagcagagcaggaacatgaagatggagaggaaccacctgggcgccaccctgaatgaatgcaaccagtgcttcaaggtgttcagcaccaagagcagcctgaccaggcacaggaagatccacactggagagcggccctacggctgcagtgaatgtgggaagagctacagcagccgcagctacctggccgtgcacaagaggatccacaacggggagaagccctatgagtgcaatgactgtgggaagaccttcagcagccgcagctacctgactgtgcacaagaggatccacaacggggagaagccctatgagtgcagcgactgtgggaagaccttcagcaacagcagctacctgcggccccacctgcgcatccacactggagagaagccctacaagtgcaaccagtgcttccgggagttccgcacccagagcatcttcaccaggcacaagagggtgcacactggagagggccactacgtgtgcaaccagtgtgggaaggccttcggcaccaggagcagcctgagcagccactacagcatccacactggagagtacccctatgagtgccacgactgtggccgcaccttcagaagaagaagcaacctgacccagcacatccgcacccacactggagagaagccctacacctgcaatgaatgtgggaagagcttcaccaacagcttcagcctgaccatccaccggcgcatccacaacggggagaagagctatgagtgcagcgactgtgggaagagcttcaacgtgctgagctctgtgaagaagcacatgaggacccacacaggcaagaagccctatgagtgcaactactgtgggaagagcttcaccagcaacagctacctgtctgtgcacaccaggatgcacaaccggcagatgtag

SEQ ID NO: 18078 - DNA, 1209 bp, Artificial Sequence
  Description of Artificial Sequence: Synthetic coding sequence
atggctgctgtgatcctgcccagcacagctgcccccagcagcctcttccctgccagccagcagaagggccacacccagggcggggagctggtgaatgagctgctgacctcctggctgcggggcctggtgacctttgaagatgtggccgtggagttcacccaggaggagtgggccctgctggaccctgcccagaggaccctgtacagagatgtgatgctggagaactgcaggaacctggccagcctgggctgccgggtgaacaagcccagcctcatcagccagctggagcaggacaagaaggtggtgacagaggagcggggcatcctgcccagcacctgcccagacctggagaccctgctgaaggccaagtggctgacccccaagaagaatgtgttcaggaaggagcagagcaagggcgtgaagacagagaggagccaccggggcgtgaagctgaatgaatgcaaccagtgcttcaaggtgttcagcaccaagagcaacctgacccagcacaagaggatccacactggagagaagccctatgactgcagccagtgtgggaagagcttcagcagccgcagctacctgaccatccacaagaggatccacaatggagagaagccctatgagtgcaaccactgcggcaaggccttcagtgaccccagcagcctgcggctgcacctgcgcatccacactggagagaagccctatgagtgcaaccagtgcttccacgtgttccgcaccagctgcaacctgaagagccacaagaggatccacactggagagaaccaccacgagtgcaaccagtgtgggaaggccttcagcaccaggagcagcctgaccggccacaacagcatccacactggagagaagccctatgaatgtcatgactgtgggaagaccttcaggaagagcagctacctgacccagcacgtgaggacccacactggagagaagccctatgaatgtaatgaatgtgggaagagcttcagcagcagcttcagcctgactgtgcacaagaggatccacactggagagaagccctatgaatgtagtgactgtgggaaggccttcaacaacctgtctgctgtgaagaagcacctgcggacccacactggagagaagccctatgagtgcaaccactgcggcaagagcttcaccagcaacagctacctgtctgtgcacaagaggatccacaaccgctggatctag

SEQ ID NO: 18079 - DNA, 996 bp, Artificial Sequence
  Description of Artificial Sequence: Synthetic coding sequence
atgctggagaactgcaggaacctggccagcctgggctgccgggtgaacaagcccagcctcatcagccagctggagcaggacaagaaggtggtgacagaggagcggggcatcctgcccagcacctgcccagacctggagaccctgctgaaggccaagtggctgacccccaagaagaatgtgttcaggaaggagcagagcaaaggagtgaagacagagaggagccacagaggagtgaagctgaatgaatgcaaccagtgcttcaaggtgttcagcaccaagagcaacctgacccagcacaagaggatccacactggagagaagccctatgactgcagccagtgtgggaagagcttcagcagccgcagctacctgaccatccacaagaggatccacaacggggagaagccctatgagtgcaaccactgtgggaaggccttcagtgaccccagcagcctgcggctgcacctgcgcatccacactggagagaagccctatgagtgcaaccagtgcttccacgtgttccgcaccagctgcaacctgaagagccacaagaggatccacactggagagaaccaccacgagtgcaaccagtgtgggaaggccttcagcaccaggagcagcctgaccggccacaacagcatccacactggagagaagccctatgagtgccacgactgtgggaagaccttcaggaagagcagctacctgacccagcacgtgaggacccacactggagagaagccctatgagtgcaatgaatgtgggaagagcttcagcagcagcttcagcctgactgtgcacaagaggatccacactggagagaagccctatgagtgcagcgactgtgggaaggccttcaacaacctgtctgctgtgaagaagcacctgcggacccacactggagagaagccctatgagtgcaaccactgtgggaagagcttcaccagcaacagctacctgtctgtgcacaagaggatccacaaccgctggatctag

SEQ ID NO: 18080 - DNA, 1617 bp, Artificial Sequence
  Description of Artificial Sequence: Synthetic coding sequence
atggtggccggctggctgaccaactacagccaggacagcgtgacctttgaagatgtggccgtggacttcacccaggaggagtggaccctgctggaccagacccagaggaacctgtacagagatgtgatgctggagaactacaagaacctggtggccgtggactgggagagccacatcaacaccaagtggagcgccccccagcagaacttcctgcagggcaagaccagctctgtggtggagatggagaggaaccactttggagaggagctgtttgacttcaaccagtgtgagaaggccctgtctgagcacagctgcctgaagacccacaggaggacctacttcaggaagaagacctgtgagtgcaaccagtgtgagaaggccttcaggaagcccagcatcttcaccctgcacaagaagacagacatcggggaggagctgcccaactgcaaccagtgtgaaacagccttcagccagcacctgcacctggtgtgcaagaagaccagccagaacctgcacctggtgtgcaagaagacccacacccaggagaagccctacaagtgcagcgactgtgagaagggcctgcccagcagcagccacctgcgggagtgtgtgcgcatctatggaggagagcggccctacacccacaaggagtatgtggagaccttcagccacagcacagccctgtttgtgcacatgcagacccaggatggagagaagttctatgagtgcaaggcctgtgggaagcccttcacagagagcagctacctgacccagcacctgcggacccacagccgggtgctgcccatcgagcacaagaagtttgggaaggcctttgccttctccccagacctggccaagcacatccggctgcggacccggggcaagcactacgtgtgcaatgaatgtgggaaggagttcacctgcttcagcaagctgaacatccacatccgggtgcacactggagagaagccctatgagtgcaacaagtgtgggaaggccttcacagacagcagcggcctcatcaagcacaggaggacccacactggagagaagccctatgagtgcaaggaatgtgggaaggcctttgccaacagcagccacctgactgtgcacatgaggacccacactggagagaagccctaccagtgcaaggaatgtgggaaggccttcatcaacagcagcagcttcaagagccacatgcagacccaccctggggtgaagccctatgactgccagcagtgtgggaaggccttcatccgcagcagcttcctgatccgccacctgcggagccacagcgctgagcggccctttgaatgtgaagaatgtgggaaggccttccgctacagcagccacctgagccagcacaagaggatccacactggagagcggccctacaagtgccagaagtgtggccaggccttcagcatcagcagcggcctgactgtgcacatgaggacccacactggagagcggccctttgagtgccaggagtgtgggaaggccttcaccaggagcacctacctgatccgccacctgcggagccacagcgtggagaagccctacaaggaatgtggccagaccttcagcaacagcagctgcctgacagaatgtgtgtag

SEQ ID NO: 18081 - DNA, 1617 bp, Artificial Sequence; identical to SEQ ID NO: 18080
  Description of Artificial Sequence: Synthetic coding sequence

SEQ ID NO: 18082 - DNA, 1377 bp, Artificial Sequence
  Description of Artificial Sequence: Synthetic coding sequence
atggagaggaaccactttggagaggagctgtttgacttcaaccagtgtgagaaggccctgtctgagcacagctgcctgaagacccacaggaggacctacttcaggaagaagacctgtgagtgcaaccagtgtgagaaggccttcaggaagcccagcatcttcaccctgcacaagaagacagacatcggggaggagctgcccaactgcaaccagtgtgaaacagccttcagccagcacctgcacctggtgtgcaagaagaccagccagaacctgcacctggtgtgcaagaagacccacacccaggagaagccctacaagtgcagcgactgtgagaagggcctgcccagcagcagccacctgcgggagtgtgtgcgcatctatggaggagagcggccctacacccacaaggagtatgtggagaccttcagccacagcacagccctgtttgtgcacatgcagacccaggatggagagaagttctatgagtgcaaggcctgtgggaagcccttcacagagagcagctacctgacccagcacctgcggacccacagccgggtgctgcccatcgagcacaagaagtttgggaaggcctttgccttctccccagacctggccaagcacatccggctgcggacccggggcaagcactacgtgtgcaatgaatgtgggaaggagttcacctgcttcagcaagctgaacatccacatccgggtgcacactggagagaagccctatgagtgcaacaagtgtgggaaggccttcacagacagcagcggcctcatcaagcacaggaggacccacactggagagaagccctatgagtgcaaggaatgtgggaaggcctttgccaacagcagccacctgactgtgcacatgaggacccacactggagagaagccctaccagtgcaaggaatgtgggaaggccttcatcaacagcagcagcttcaagagccacatgcagacccaccctggggtgaagccctatgactgccagcagtgtgggaaggccttcatccgcagcagcttcctgatccgccacctgcggagccacagcgctgagcggccctttgaatgtgaagaatgtgggaaggccttccgctacagcagccacctgagccagcacaagaggatccacactggagagcggccctacaagtgccagaagtgtggccaggccttcagcatcagcagcggcctgactgtgcacatgaggacccacactggagagcggccctttgagtgccaggagtgtgggaaggccttcaccaggagcacctacctgatccgccacctgcggagccacagcgtggagaagccctacaaggaatgtggccagaccttcagcaacagcagctgcctgacagaatgtgtgtag

SEQ ID NO: 18083 - DNA, 1617 bp, Artificial Sequence; identical to SEQ ID NO: 18080
  Description of Artificial Sequence: Synthetic coding sequence

SEQ ID NO: 18084 - DNA, 2373 bp, Artificial Sequence
  Description of Artificial Sequence: Synthetic coding sequence
atggcctactgcctgaccaactgctaccagtacagcgtgacctttgaggacacagctgtggacttcacccaggaggagtggatcctgctggaccctgtgcagaggaacctgtacagagatgtgatgctggagaactatgaaaatgtggccaaggtgggcttccagctgttcaagcccagcgtcatctcctggctggaggaggaggagctgcggaccctgcagcagggcgtgctgcaggactgggccatcaagcaccagacctctgtgtctgccctgcagcaggagttctggaagatccagaccagcaatggcatccagatggacctggtgacctttgacagcgtggccgtggagttcacccaggaggagtggaccctgctggaccctgcccagaggaacctgtacagtgatgtgatgctggagaactacaagaacctgagctctgtgggctaccagctgttcaagcccagcctcatctcctggctggaggaggaggaggagctgagcaccctgccccgggtgctgcaggagtggaagatgtgcctgaagaccaagggccctgccctgtggcaggacaacttctgcctgaagaccctgaatggcatccagctggccaggaaccagaatggagaggagctgtatgactgcaagcagtgtgaagatgtgttctgcaagcacccctgcctgaagaccaacatgagcacccagaacagaggcaacaccagcgagtgcatccagtatgccaaggacctgctgagcctgtacaacaagaccagcaccatcaggaaggtgtctgtgttcagcaagcacggcaagagcttccgcctcatcctgaatgtgcaggtgcagaggaagtgcacccaggacaagagctttgagggcacagattatggcaaggccttcatctaccagagctacctggaggcccacaggaagacccagagcggggagaagctgaatgagtggaagcagtgtggggaggccttcacccacagcaccagccatgctgtgaatgtggagacccacatcatcaagaacccctatgagtgcaaggaatgtgggaaggacttccgctaccccacccacctgaacaaccacatgcagacccacatcggcatcaagccctacaagtgcaagcactgcggcaagaccttcaccgtgcccagcggcttcctggagcacgtgaggacccacactggagagaagccctacggctgcaaggaatgtgggaaggccttcggcaccagcgctggcctcatcgagcacatccgctgccacgcccgggagaagaccttcaagtgtgaccactgcggcaaggccttcatctcctaccccagcctgtttggccacctgcgggtgcacaatggagagaagccctatgagcacaaggagtatggcaaggccttcggcaccagcagtggagtgattgaagatagaagaagcaacacaggccagaagagatttgactgtgaccagtgtgggaaggtgtttgtgtccttcagcagcctgtttgcccacctgcggacccacactggagagaagcccttcaagtgctacaagtgtgggaagcccttcaccagcagcgcctgcctgcgcatccacatgaggacccacacagaggagcggctgtaccagtgcaagaagtgtgggaaggccttcaccaagtgcagctacctgaccaagcacctgcggacccatgctggggagaagccctatgagtgcatgaagtgtgggaaggccttcacagagaggagctacctgaccaagcacctgcggcggcacagcggggagaagccctatgagtgcaagaagtgtgggaaggccttcacagagaggagtgacctgaccaagcacctgcggcggcacactggagacaagccctatgagtacaaggactgtgggaaggcctttgtggtgagcagcagcctggtggaccacctgcggacccacacaggctacaagccctacaagtgcaatgcctgtgagaaggcctacagccgcagctgtgtgctgacccagcacctgaagacccatgctgctgagaagaccagtgaatgtaatgcctgtggcaacagcttcaggaacagcatgtgcttccatgaccggctgaagaccctgaccaagatcaagccctacaagtgcaaggactgtgggaaggccttcacctgccacagcgacctgaccaaccacgtgcgcatccacactggagagaagccctacaagtgcaaggaatgtgggaaggccttccgcaccagcagcggccgcatccagcacctgcggacccacatgggagagaagccctttgaatgtgaccagtgtgggaaggcctttgccagcttcagcgcccgcatcgcccacctgaagacccactag

SEQ ID NO: 18085 - DNA, 1461 bp, Artificial Sequence
  Description of Artificial Sequence: Synthetic coding sequence
atggccgccatctacctgagccggggcttcttcagccgggagcccatctgcccctttgaggagaagaccaaggtggagaggatggtggaggactacctggccagcggctaccaggacagcgtgacctttgatgatgtggccgtggacttcaccccagaggagtgggccctgctggacaccacagagaagtacctgtacagagatgtgatgctggagaactacatgaacctggcctctgtggagtgggagatccagcccaggaccaagaggagcagcctgcagcagggcttcctgaagaaccagatcttcagcggcatccagatgacccggggctacagcggctggaagctgtgtgactgcaagaactgtggggaggtgttccgggagcagttctgcctgaagacccacatgagggtgcagaatggaggcaacaccagcgagggcaactgctacggcaaggacaccctgtctgtgcacaaggaggccagcacaggccaggagctgagcaagttcaacccctgtgggaaggtgttcaccctgaccccaggcctggccgtgcacctggaggtgctgaatgcccggcagccctacaagtgcaaggaatgtgggaagggcttcaagtactttgccagcctggacaaccacatgggcatccacacagatgagaagctgtgtgagttccaggagtatggccgggctgtgacagccagcagccacctgaagcagtgtgtggccgtgcacacaggcaagaagagcaagaagaccaagaagtgtgggaagagcttcaccaacttcagccagctgtatgcccctgtgaagacccacaagggggagaagagctttgagtgcaaggaatgtggccgctccttcaggaacagcagctgcctgaatgaccacatccagatccacacaggcatcaagccccacaagtgcacctactgtgggaaggccttcaccaggagcacccagctgacagaacatgtgaggacccacacaggcatcaagccctatgagtgcaaggaatgtggccaggcctttgcccagtacagcggcctgagcatccacatccgcagccacagcggcaagaagccctaccagtgcaaggaatgtgggaaggccttcaccaccagcaccagcctcatccagcacacccgcatccacactggagagaagccctatgaatgtgtggagtgtgggaagaccttcatcaccagcagcagaagaagcaagcacctgaagacccacagcggggagaagccctttgtgtgcaagatctgtgggaaggccttcctgtacagcagccggctgaatgtgcacctgcggacccacactggagagaagccctttgtgtgcaaggaatgtgggaaggcctttgctgtgagcagccggctgagcagacatgagcgcatccacactggagagaagccctatgagtgcaaggacatgtctgtgaccatctag

SEQ ID NO: 18086 - DNA, 1053 bp, Artificial Sequence
  Description of Artificial Sequence: Synthetic coding sequence
atgagggtgcagaatggaggcaacaccagcgagggcaactgctacggcaaggacaccctgtctgtgcacaaggaggccagcacaggccaggagctgagcaagttcaacccctgtgggaaggtgttcaccctgaccccaggcctggccgtgcacctggaggtgctgaatgcccggcagccctacaagtgcaaggaatgtgggaagggcttcaagtactttgccagcctggacaaccacatgggcatccacacagatgagaagctgtgtgagttccaggagtatggccgggctgtgacagccagcagccacctgaagcagtgtgtggccgtgcacacaggcaagaagagcaagaagaccaagaagtgtgggaagagcttcaccaacttcagccagctgtatgcccctgtgaagacccacaagggggagaagagctttgagtgcaaggaatgtggccgctccttcaggaacagcagctgcctgaatgaccacatccagatccacacaggcatcaagccccacaagtgcacctactgtgggaaggccttcaccaggagcacccagctgacagaacatgtgaggacccacacaggcatcaagccctatgagtgcaaggaatgtggccaggcctttgcccagtacagcggcctgagcatccacatccgcagccacagcggcaagaagccctaccagtgcaaggaatgtgggaaggccttcaccaccagcaccagcctcatccagcacacccgcatccacactggagagaagccctatgaatgtgtggagtgtgggaagaccttcatcaccagcagcagaagaagcaagcacctgaagacccacagcggggagaagccctttgtgtgcaagatctgtgggaaggccttcctgtacagcagccggctgaatgtgcacctgcggacccacactggagagaagccctttgtgtgcaaggaatgtgggaaggcctttgctgtgagcagccggctgagcagacatgagcgcatccacactggagagaagccctatgagtgcaaggacatgtctgtgaccatctag

SEQ ID NO: 18087 - DNA, 231 bp, Artificial Sequence
  Description of Artificial Sequence: Synthetic coding sequence
atggccgccatctacctgagccggggcttcttcagccgggagcccatctgcccctttgaggagaagaccaaggtggagaggatggtggaggactacctggccagcggctaccaggacagcgtgacctttgatgatgtggccgtggacttcaccccagaggagtgggccctgctggacaccacagagaagtacctgtacagagatgtgatgctggagaactacatgaactag

SEQ ID NO: 18088 - DNA, 1254 bp, Artificial Sequence
  Description of Artificial Sequence: Synthetic coding sequence
atgctggagaactacatgaacctggcctctgtggagtgggagatccagcccaggaccaagaggagcagcctgcagcagggcttcctgaagaaccagatcttcagcggcatccagatgacccggggctacagcggctggaagctgtgtgactgcaagaactgtggggaggtgttccgggagcagttctgcctgaagacccacatgagggtgcagaatggaggcaacaccagcgagggcaactgctacggcaaggacaccctgtctgtgcacaaggaggccagcacaggccaggagctgagcaagttcaacccctgtgggaaggtgttcaccctgaccccaggcctggccgtgcacctggaggtgctgaatgcccggcagccctacaagtgcaaggaatgtgggaagggcttcaagtactttgccagcctggacaaccacatgggcatccacacagatgagaagctgtgtgagttccaggagtatggccgggctgtgacagccagcagccacctgaagcagtgtgtggccgtgcacacaggcaagaagagcaagaagaccaagaagtgtgggaagagcttcaccaacttcagccagctgtatgcccctgtgaagacccacaagggggagaagagctttgagtgcaaggaatgtggccgctccttcaggaacagcagctgcctgaatgaccacatccagatccacacaggcatcaagccccacaagtgcacctactgcggcaaggccttcaccaggagcacccagctgacagagcacgtgaggacccacacaggcatcaagccctatgagtgcaaggaatgtggccaggcctttgcccagtacagcggcctgagcatccacatccgcagccacagcggcaagaagccctaccagtgcaaggaatgtgggaaggccttcaccaccagcaccagcctcatccagcacacccgcatccacactggagagaagccctatgaatgtgtggagtgtgggaagaccttcatcaccagcagccgccgcagcaagcacctgaagacccacagcggggagaagccctttgtgtgcaagatctgtgggaaggccttcctgtacagcagccggctgaatgtgcacctgcggacccacactggagagaagccctttgtgtgcaaggaatgtgggaaggcctttgctgtgagcagccggctgagcagacatgagcgcatccacactggagagaagccctatgagtgcaaggacatgtctgtgaccatctag

SEQ ID NO: 18089 - DNA, 126 bp, Artificial Sequence
  Description of Artificial Sequence: Synthetic coding sequence
atggccgccatctacctgagccggggcttcttcagccgggagcccatctgcccctttgaggagaagaccaaggtggagaggatggtggaggactacctggccagcggctaccaggacagcgtgtag

SEQ ID NO: 18090 - DNA, 1065 bp, Artificial Sequence
  Description of Artificial Sequence: Synthetic coding sequence
atgtctgcctttgacatgagccatgacttcttcttctgcctgaccagcgagtgggagatccagcccaggaccaagaggagcagcctgcagcagggcttcctgaagaaccagatcttcaccggcatccagatgcagaccaggagctacagcggctggaagctgtgtgagaactgtggggaggtgttttctgagcagttctgcctgaagacccacatgagggcccagaatggaggcaacacctttgagggcaactgctacggcaaggacagcatctctgtgcacaaggaggccagcatcggccaggagctgagcaagttcaacccctgtgggaaggtgttcaccctgaccccaggcctggccgtgcacctggagatcctgaatggccggcagccctacaagtgcaaggaatgtgggaagggcttcaagtactttgccagcctggacaaccacatgggcatccacatcggggagaagctgtgtgagttccaggagtgtgagcgggccatcaccaccagcagccacctgaagcagtgtgtggccgtgcacacaggcaagaagtctgagaagaccaagaactgtgggaagagcttcaccaacttcagccagctgagcgcccacgccaagacccacaagggggagaagagctttgagtgcaaggaatgtggccgctccttcaggaacagcagcagcttcaacgtgcacatccagatccacacaggcatcaagccccacaagtgcacagaatgtgggaaggccttcaccaggagcacccacctgacccagcacgtgaggacccacacaggcatcaagccctatgagtgcaaggaatgtggccaggccttcacccagtacacaggcctggccatccacatccggaaccacactggagagaagccctaccagtgcaaggaatgtgggaaggccttcaacagaagcagcaccctgacccagcaccggcgcatccacactggagagaagccctatgaatgtgtggagtgtgggaagaccttcatcaccagcagccacaggagcaagcacctgaagacccacagcggggagaggtag

SEQ ID NO: 18091 - DNA, 1281 bp, Artificial Sequence
  Description of Artificial Sequence: Synthetic coding sequence
atgtctgcctttgacatgagccacggcttcttcccccgggagcccatctgcccctttgaggagaagaccaagattggcaccatggtggaggaccacaggagcaacagctaccaggacagcgtgacctttgatgatgtggccgtggagttcaccccagaggagtgggccctgctggacaccacccagaagtacctgtacagagatgtgatgctggagaactacatgaacctggcctctgtggacttcttcttctgcctgaccagcgagtgggagatccagcccaggaccaagaggagcagcctgcagcagggcttcctgaagaaccagatcttcaccggcatccagatgcagaccaggagctacagcggctggaagctgtgtgagaactgtggggaggtgttttctgagcagttctgcctgaagacccacatgagggcccagaatggaggcaacacctttgagggcaactgctacggcaaggacagcatctctgtgcacaaggaggccagcatcggccaggagctgagcaagttcaacccctgtgggaaggtgttcaccctgaccccaggcctggccgtgcacctggagatcctgaatggccggcagccctacaagtgcaaggaatgtgggaagggcttcaagtactttgccagcctggacaaccacatgggcatccacatcggggagaagctgtgtgagttccaggagtgtgagcgggccatcaccaccagcagccacctgaagcagtgtgtggccgtgcacacaggcaagaagtctgagaagaccaagaactgtgggaagagcttcaccaacttcagccagctgagcgcccacgccaagacccacaagggggagaagagctttgagtgcaaggaatgtggccgctccttcaggaacagcagcagcttcaacgtgcacatccagatccacacaggcatcaagccccacaagtgcacagaatgtgggaaggccttcaccaggagcacccacctgacccagcacgtgaggacccacacaggcatcaagccctatgagtgcaaggaatgtggccaggccttcacccagtacacaggcctggccatccacatccggaaccacactggagagaagccctaccagtgcaaggaatgtgggaaggccttcaacagaagcagcaccctgacccagcaccggcgcatccacactggagagaagccctatgaatgtgtggagtgtgggaagaccttcatcaccagcagccacaggagcaagcacctgaagacccacagcggggagaggtag

SEQ ID NO: 18092 - DNA, 1281 bp, Artificial Sequence; identical to SEQ ID NO: 18091
  Description of Artificial Sequence: Synthetic coding sequence

SEQ ID NO: 18093 - DNA, 1074 bp, Artificial Sequence
  Description of Artificial Sequence: Synthetic coding sequence
atgctggagaactacatgaacctggcctctgtggacttcttcttctgcctgaccagcgagtgggagatccagcccaggaccaagaggagcagcctgcagcagggcttcctgaagaaccagatcttcaccggcatccagatgcagaccaggagctacagcggctggaagctgtgtgagaactgtggggaggtgttcagcgagcagttctgcctgaagacccacatgagggcccagaatggaggcaacacctttgagggcaactgctacggcaaggacagcatctctgtgcacaaggaggccagcatcggccaggagctgagcaagttcaacccctgtgggaaggtgttcaccctgaccccaggcctggccgtgcacctggagatcctgaatggccggcagccctacaagtgcaaggaatgtgggaagggcttcaagtactttgccagcctggacaaccacatgggcatccacatcggggagaagctgtgtgagttccaggagtgtgagcgggccatcaccaccagcagccacctgaagcagtgtgtggccgtgcacacaggcaagaagtctgagaagaccaagaactgtgggaagagcttcaccaacttcagccagctgagcgcccacgccaagacccacaagggggagaagagctttgagtgcaaggaatgtggccgctccttcaggaacagcagcagcttcaacgtgcacatccagatccacacaggcatcaagccccacaagtgcacagaatgtgggaaggccttcaccaggagcacccacctgacccagcacgtgaggacccacacaggcatcaagccctatgagtgcaaggaatgtggccaggccttcacccagtacacaggcctggccatccacatccggaaccacactggagagaagccctaccagtgcaaggaatgtgggaaggccttcaacagaagcagcaccctgacccagcaccggcgcatccacactggagagaagccctatgaatgtgtggagtgtgggaagaccttcatcaccagcagccacaggagcaagcacctgaagacccacagcggggagaggtag

SEQ ID NO: 18094 - DNA, 933 bp, Artificial Sequence
  Description of Artificial Sequence: Synthetic coding sequence
atgaccaggagctacagcggctggaagctgtgtgagaactgtggggaggtgttttctgagcagttctgcctgaagacccacatgagggcccagaatggaggcaacacctttgagggcaactgctacggcaaggacagcatctctgtgcacaaggaggccagcatcggccaggagctgagcaagttcaacccctgtgggaaggtgttcaccctgaccccaggcctggccgtgcacctggagatcctgaatggccggcagccctacaagtgcaaggaatgtgggaagggcttcaagtactttgccagcctggacaaccacatgggcatccacatcggggagaagctgtgtgagttccaggagtgtgagcgggccatcaccaccagcagccacctgaagcagtgtgtggccgtgcacacaggcaagaagtctgagaagaccaagaactgtgggaagagcttcaccaacttcagccagctgagcgcccacgccaagacccacaagggggagaagagctttgagtgcaaggaatgtggccgctccttcaggaacagcagcagcttcaacgtgcacatccagatccacacaggcatcaagccccacaagtgcacagaatgtgggaaggccttcaccaggagcacccacctgacccagcacgtgaggacccacacaggcatcaagccctatgagtgcaaggaatgtggccaggccttcacccagtacacaggcctggccatccacatccggaaccacactggagagaagccctaccagtgcaaggaatgtgggaaggccttcaacagaagcagcaccctgacccagcaccggcgcatccacactggagagaagccctatgaatgtgtggagtgtgggaagaccttcatcaccagcagccacaggagcaagcacctgaagacccacagcggggagaggtag

SEQ ID NO: 18095 - DNA, 1170 bp, Artificial Sequence
  Description of Artificial Sequence: Synthetic coding sequence
atggattctgtgacctttgatgatgtggccgtggagttcaccccagaggagtgggccctgctggacaccacccagaagtacctgtacagagatgtgatgctggagaactacatgaacctggcctctgtggacttcttcttctgcctgaccagcgagtgggagatccagcccaggaccaagaggagcagcctgcagcagggcttcctgaagaaccagatcttcaccggcatccagatgcagaccaggagctacagcggctggaagctgtgtgagaactgtggggaggtgttcagcgagcagttctgcctgaagacccacatgagggcccagaatggaggcaacacctttgagggcaactgctacggcaaggacagcatctctgtgcacaaggaggccagcatcggccaggagctgagcaagttcaacccctgtgggaaggtgttcaccctgaccccaggcctggccgtgcacctggagatcctgaatggccggcagccctacaagtgcaaggaatgtgggaagggcttcaagtactttgccagcctggacaaccacatgggcatccacatcggggagaagctgtgtgagttccaggagtgtgagcgggccatcaccaccagcagccacctgaagcagtgtgtggccgtgcacacaggcaagaagtctgagaagaccaagaactgtgggaagagcttcaccaacttcagccagctgagcgcccacgccaagacccacaagggggagaagagctttgagtgcaaggaatgtggccgctccttcaggaacagcagcagcttcaacgtgcacatccagatccacacaggcatcaagccccacaagtgcacagaatgtgggaaggccttcaccaggagcacccacctgacccagcacgtgaggacccacacaggcatcaagccctatgagtgcaaggaatgtggccaggccttcacccagtacacaggcctggccatccacatccggaaccacactggagagaagccctaccagtgcaaggaatgtgggaaggccttcaacagaagcagcaccctgacccagcaccggcgcatccacactggagagaagccctatgaatgtgtggagtgtgggaagaccttcatcaccagcagccacaggagcaagcacctgaagacccacagcggggagaggtag

SEQ ID NO: 18096 - DNA, 1431 bp, Artificial Sequence
  Description of Artificial Sequence: Synthetic coding sequence
atggatgctgtggcctttgaagatgtggccgtgaacttcacccaggaggagtgggccctgctgggccccagccagaagaacctgtaccgctacgtgatgcaggagaccatccggaacctggactgcatccgcatgatctgggaggagcagaacacagaggaccagtacaagaaccccaggaggaacctgcgctgccacatggtggagcgcttcagcgagagcaaggacagcagccagtgtggggagaccttcagcctcatccgggacagcatcgtgaacaacagcatctgccctggagaggacccctgccagagcgcagaatgtgaggaggtgatcatgggccacctgagcctgaacagccacatccgggtggacagcggccacaagccccatgagtaccaggagtatggagagaagccccacacccacaagcagaggggcaaggccttctcctaccaccacagcttccagagccggggccggccccacacaggcaagaagagatatgagtgcaaggaatgtgggaagaccttcagcagcagaagaaacctgcggcggcacatggtggtgcagggcggcaaccggccctacaagtgcaagctgtgtgggaaggccttcttctggcccagcctgctgaggatgcatgagaggacccacactggagagaagccctatgagtgcaagcagtgcagcaaggccttccccttctacagcagctacagaagacatgagaggatgcacactggagagaagccctatgagtgcaagcagtgcagcaaggccctgcctgacagcagcagctacatcagacatgagaggacccacactggagagaagccctacacctgcaagcagtgtgggaaggccttctctgtgagcagcagcctgcggagacatgagaccacccacagcgctgagaagccctatgagtgcaagcagtgtgggaagaccttccaccacctgggcagcttccagatccacatgaagaggcacactggagaccggccccacaagtgcaagatctgtgggaagggctttgaccggcccagcctggtgcgctaccacgagcgcatccacactggagagaagccctatgagtgcaagcagtgtgggaagaccctgagccacagcagcagcttcagaagacacatgatcatgcacactggaggcggcccccacaagtgcaagatctgtgggaaggcctttgtgtaccccagcgtgtgccagagacatgagaagagccacagcggggagaagccctatgagtgcaagcagtgtgggaaggccctgagccacagcagcagcttcagaagacacatggtgatgcacactggagatggccccaacaagtgcaaggtgtgtgggaaggcctttgtgtaccccagcgtgtgccagagacatgagaagacccactggagggagaccatctag

SEQ ID NO: 18097 - DNA, 690 bp, Artificial Sequence
  Description of Artificial Sequence: Synthetic coding sequence
atggatgctgtggcctttgaagatgtggccgtgaacttcacccaggaggagtgggccctgctgggccccagccagaagaacctgtaccgctacgtgatgcaggagaccatccggaacctggactgcatccgcatgatctgggaggagcagaacacagaggaccagtacaagaaccccaggaggaacctgcgctgccacatggtggagcgcttcagcgagagcaaggacagcagccagtgtggggagaccttcagcctcatccgggacagcatcgtgaacaacagcatctgccctggagaggacccctgccagagcgcagaatgtgaggaggtgatcatgggccacctgagcctgaacagccacatccgggtggacagcggccacaagccccatgagtaccaggagtatggagagaagccccacacccacaagcagaggggcaaggccttctcctaccaccacagcttccagagccggggccggccccacacaggcaagaagagatatgagtgcaaggaatgtgggaagaccttcagcagcagaagaaacctgcggcggcacatggtggtgcagggcggcaaccggccctacaagttccccatcgaggacatgagggagtgcaccctgggcaggaacaggatgaatgtgtcctctgtgctgaagccctgcctgatccctgtgcccatctag

SEQ ID NO: 18098 - DNA, 1662 bp, Artificial Sequence
  Description of Artificial Sequence: Synthetic coding sequence
atggattctgtggcctctgaagatgtggccgtgaacttcaccctggaggagtgggccctgctggaccccagccagaagaagctgtacagagatgtgatgagggagaccttcaggaacctggcctgtgtgggcaagaagtgggaggaccagagcattgaggactggtacaagaaccagggccgcatcctgaggaaccacatggaggagggcctgtctgagagcaaggagtatgaccagtgtggggaggccttcagccagatcctgaacctgaacctgaacaagaagatccccaccatcgtgcggccctgtgagtgcagcctgtgtgggaaggtgttcatgcaccacagcagcctgagccgccacatccgcagccacctgggccacaagccctatgactaccaggagtatggagagaagccctacaagtgcaagcagtgtgggaaggccttcagcagctgccagagcttcagaagacatgagaggacccacactggagagaagccctatgcctgcccagaatgtgggaaggccttcatcagcctgcccagcgtgagaagacacatgatcaagcacactggagatggcccctacaagtgccaggagtgtgggaaggcctttgaccggcccagcctcttccagatccacgagaggacccacactggagagaagccctatgagtgccaggagtgtgccaaggccttcatcagcctgcccagcttccagaggcacatgatccgccacactggagatggcccctacaagtgccaggagtgtgggaaggcctttgaccggcccagcctcttccgcatccacgagaggacccacactggagagaagccccatgagtgcaagcagtgtgggaaggccttcatctccttcaccaacttccagagccacatgatccgccacactggagatggcccctacaagtgcaaggtgtgtggccgggccttcatcttccccagctatgtgaggaagcatgagaggacccacactggagagaagccctatgagtgcaacaagtgtgggaagaccttcagcagcagcagcaatgtgaggacccatgagaggacccacactggagagaagccctatgagtgcaaggaatgtgggaaggccttcatcagcctgcccagcgtgagaagacacatgatcaagcacactggagatggcccctacaagtgccaggtgtgtggccgggcctttgactgccccagcagcttccagatccacgagaggacccacactggagagaagccctatgagtgccaggtgtgtgggaaggccttcatcagcctgaagaggatcaggaagcacatgatcctgcacactggagatggcccctacaagtgccaggtgtgtgggaaggcctttgactgccccagctctgtgaggacccatgagaggacccacactggagagaagccctatgagtgcaaggaatgtgggaaggccttcaactatgccagcagcatccgcatccacgagaggacccacactggagagaagccctatgagtgcaagcagtgtgggaagaccttctcctacagcagcagcttccagagacatgagcgggcccacaacggggacaagccctacgtgaagaatgtgggcaagctgtccttcatcacccagcccagcaacacctgtgaaaatgaatag

SEQ ID NO: 18099 - DNA, 1260 bp, Artificial Sequence
  Description of Artificial Sequence: Synthetic coding sequence
atggcccaggagagcgtgatgttcagtgatgtgtctgtggacttcagccaggaggagtgggagtgcctgaatgatgaccagagggacctgtacagagatgtgatgctggagaactacagcaacctggtgtccatggccggccacagcatcagcaagcccaacgtcatctcctacctggagcagggcaaggagccctggctggccgaccgggagctgacccggggccagtggcctgtgctggagagccgctgtgagaccaagaagctgttcctgaagaaggagatctatgaaattgagagcacccagtgggagatcatggagaagctgacccggcgggacttccagtgcagcagcttcagagatgactgggagtgcaaccggcagttcaagaaggagctgggcagccagggcggccacttcaaccagctggtgttcacccatgaggacctgcccaccctgagccaccaccccagcttcaccctgcagcagatcatcaacagcaagaagaagttctgtgccagcaaggagtacaggaagaccttcagacatggcagccagtttgccacccatgagatcatccacaccatcgagaagccctatgagtgcaaggaatgtgggaagagcttccgccaccccagccggctgacccaccaccagaagatccacacaggcaagaagccctttgagtgcaaggaatgtgggaagaccttcatctgtggcagtgacctgaccaggcaccaccgcatccacactggagagaagccctatgagtgcaaggaatgtgggaaggccttcagcagcggcagcaacttcaccaggcaccagaggatccacactggagagaagccctatgagtgcaaggaatgtgggaaggccttcagcagcggcagcaacttcacccagcaccagaggatccacactggagagaagccctatgagtgcaaggaatgtggaaatgccttcagccagagcagccagctgatcaagcaccagaggatccacactggagagaagccctatgagtgcaaggaatgtgagaaggccttccgcagcggcagtgacctgaccaggcaccagaggatccacactggagagaagccctatgagtgcaagatctgtgggaaggcctacagccagagcagccagctgatcagccaccaccgcatccacaccagcgagaagccctatgagtaccgggagtgtgggaagaacttcaactatgacccccagctgatccagcaccagaacctgtactggtag

SEQ ID NO: 18100 - DNA, 1257 bp, Artificial Sequence
  Description of Artificial Sequence: Synthetic coding sequence
atggcccaggagagcgtgatgttcagtgatgtgtctgtggacttcagccaggaggagtgggagtgcctgaatgatgaccagagggacctgtacagagatgtgatgctggagaactacagcaacctggtgtccatgggccacagcatcagcaagcccaacgtcatctcctacctggagcagggcaaggagccctggctggccgaccgggagctgacccggggccagtggcctgtgctggagagccgctgtgagaccaagaagctgttcctgaagaaggagatctatgaaattgagagcacccagtgggagatcatggagaagctgacccggcgggacttccagtgcagcagcttcagagatgactgggagtgcaaccggcagttcaagaaggagctgggcagccagggcggccacttcaaccagctggtgttcacccatgaggacctgcccaccctgagccaccaccccagcttcaccctgcagcagatcatcaacagcaagaagaagttctgtgccagcaaggagtacaggaagaccttccgccacggcagccagtttgccacccatgagatcatccacaccatcgagaagccctatgagtgcaaggaatgtgggaagagcttccgccaccccagccggctgacccaccaccagaagatccacacaggcaagaagccctttgagtgcaaggaatgtgggaagaccttcatctgtggcagtgacctgaccaggcaccaccgcatccacactggagagaagccctatgagtgcaaggaatgtgggaaggccttcagcagcggcagcaacttcaccaggcaccagaggatccacactggagagaagccctatgagtgcaaggaatgtgggaaggccttcagcagcggcagcaacttcacccagcaccagaggatccacactggagagaagccctatgagtgcaaggaatgtggaaatgccttcagccagagcagccagctgatcaagcaccagaggatccacactggagagaagccctatgagtgcaaggaatgtgagaaggccttccgcagcggcagtgacctgaccaggcaccagaggatccacactggagagaagccctatgagtgcaagatctgtgggaaggcctacagccagagcagccagctgatcagccaccaccgcatccacaccagcgagaagccctatgagtacagagaatgtgggaagaacttcaactatgacccccagctgatccagcaccagaacctgtactggtag

SEQ ID NO: 18101 - DNA, 477 bp, Artificial Sequence
  Description of Artificial Sequence: Synthetic coding sequence
atggcccaggagagcgtgatgttcagtgatgtgtctgtggacttcagccaggaggagtgggagtgcctgaatgatgaccagagggacctgtacagagatgtgatgctggagaactacagcaacctggtgtccatggccggccacagcatcagcaagcccaacgtcatctcctacctggagcagggcaaggagccctggctggccgaccgggagctgacccggggccagtggcctgtgctggagagccgctgtgagaccaagaagctgttcctgaagaaggagatctatgaaattgagagcacccagtgggagatcatggagaagctgacccggcgggacttccagtgcagcagcttcagagatgactgggagtgcaaccggcagttcaagaaggagctgggcagccagggcggccacttcaaccagctggtgttcacccatgaggacctgcccaccctgagccaccaccccagctag

SEQ ID NO: 18102 - DNA, 1257 bp, Artificial Sequence; identical to SEQ ID NO: 18100
  Description of Artificial Sequence: Synthetic coding sequence

SEQ ID NO: 18103 - DNA, 1260 bp, Artificial Sequence; identical to SEQ ID NO: 18099
  Description of Artificial Sequence: Synthetic coding sequence

SEQ ID NO: 18104 - DNA, 1935 bp, Artificial Sequence
  Description of Artificial Sequence: Synthetic coding sequence
atgaccagccagagcagcgtcatcagcaacagctgtgtgaccatggagcggctgagccacatgatggagaggaaggcctggtgcagccaggagagcgccctgtctgaggaggaggaggacaccacccggcccctggagaccgtgaccttcaaggatgtggccgtggacctgacccaggaggagtgggagcagatgaagccagcccagaggaacctgtacagagatgtgatgctggagaactacagcaacctggtgacagtgggctgccaggtgaccaagccagatgtgatcttcaagctggagcaggaggaggagccctgggtgatggaggaggagatgtttggccgccactgcccagaggtgtgggaggtggatgagcagatcaagaagcagcaggagaccctggtgaggaaggtgaccagcatcagcaagaagatcctgatcaaggagaaggtgattgagtgcaagaaggtggccaagatcttccccctgagcagtgacatcgtgaccagccggcagagcttctatgactgtgacagcctggacaagggcctggagcacaacctggacctgctgcgctatgagaagggctgtgtgcgggagaagcagagcaatgaatttgggaagcccttctaccactgtgccagctatgtggtgacccccttcaagtgcaaccagtgtggccaggacttcagccacaagtttgacctgatcagacatgagcgcatccatgctggggagaagccctatgagtgcaaggaatgtgggaaggccttcagcaggaaagaaaatctcatcacccaccagaagatccacactggagagaagccctacaagtgcaatgaatgtgggaaggccttcatccagatgagcaacctgatccgccaccaccgcatccacactggagagaagccctatgcctgcaaggactgctggaaggccttcagccagaagagcaacctgattgagcacgagcgcatccacactggagagaagccctatgagtgcaaggaatgtgggaagagcttcagccagaagcagaacctgattgagcacgagaagatccacactggagagaagccctatgcctgcaatgaatgtggccgggccttcagcaggatgagctctgtgaccctgcacatgaggagccacactggagagaagccctacaagtgcaacaagtgtgggaaggccttcagccagtgcagcgtcttcatcatccacatgaggagccacactggagagaagccctacgtgtgcagtgaatgtgggaaggccttcagccagagcagcagcctgactgtgcacatgaggaaccacacagctgagaagccctatgagtgcaaggaatgtgggaaggccttcagcaggaaagaaaatctcatcacccaccagaagatccacactggagagaagccctatgaatgttctgaatgtgggaaggccttcatccagatgagcaacctgatccgccaccagaggatccacactggagagaagccctatgcctgcaccgtgtgtgggaaggccttcagccagaagagcaacctgacagagcacgagaagatccacactggagagaagccctaccactgcaaccagtgtgggaaggccttcagccagaggcagaacctgctggagcacgagaagatccacactggagagaagcccttcaagtgcaatgaatgtgggaaggccttcagccgcatcagcagcctgaccctgcacgtgcgcagccacactggagagaagccctatgagtgcaacaagtgtgggaaggccttcagccagtgcagcctgctgatcatccacatgaggagccacactggagagaagccctttgaatgtaatgaatgtgggaaggccttcagccagagggccagcctgagcatccacaagaggggccacactggagagcggcaccaggtgtactag

SEQ ID NO: 18105 - DNA, 1743 bp, Artificial Sequence
  Description of Artificial Sequence: Synthetic coding sequence
atgaagccagcccagaggaacctgtacagagatgtgatgctggagaactacagcaacctggtgacagtgggctgccaggtgaccaagccagatgtgatcttcaagctggagcaggaggaggagccctgggtgatggaggaggagatgtttggccgccactgcccagaggtgtgggaggtggatgagcagatcaagaagcagcaggagaccctggtgaggaaggtgaccagcatcagcaagaagatcctgatcaaggagaaggtgattgagtgcaagaaggtggccaagatcttccccctgagcagtgacatcgtgaccagccggcagagcttctatgactgtgacagcctggacaagggcctggagcacaacctggacctgctgcgctatgagaagggctgtgtgcgggagaagcagagcaatgaatttgggaagcccttctaccactgtgccagctatgtggtgacccccttcaagtgcaaccagtgtggccaggacttcagccacaagtttgacctgatcagacatgagcgcatccatgctggggagaagccctatgagtgcaaggaatgtgggaaggccttcagcaggaaagaaaatctcatcacccaccagaagatccacactggagagaagccctacaagtgcaatgaatgtgggaaggccttcatccagatgagcaacctgatccgccaccaccgcatccacactggagagaagccctatgcctgcaaggactgctggaaggccttcagccagaagagcaacctgattgagcacgagcgcatccacactggagagaagccctatgagtgcaaggaatgtgggaagagcttcagccagaagcagaacctgattgagcacgagaagatccacactggagagaagccctatgcctgcaatgaatgtggccgggccttcagcaggatgagctctgtgaccctgcacatgaggagccacactggagagaagccctacaagtgcaacaagtgtgggaaggccttcagccagtgcagcgtcttcatcatccacatgaggagccacactggagagaagccctacgtgtgcagtgaatgtgggaaggccttcagccagagcagcagcctgactgtgcacatgaggaaccacacagctgagaagccctatgagtgcaaggaatgtgggaaggccttcagcaggaaagaaaatctcatcacccaccagaagatccacactggagagaagccctatgaatgttctgaatgtgggaaggccttcatccagatgagcaacctgatccgccaccagaggatccacactggagagaagccctatgcctgcaccgtgtgtgggaaggccttcagccagaagagcaacctgacagagcacgagaagatccacactggagagaagccctaccactgcaaccagtgtgggaaggccttcagccagaggcagaacctgctggagcacgagaagatccacactggagagaagcccttcaagtgcaatgaatgtgggaaggccttcagccgcatcagcagcctgaccctgcacgtgcgcagccacactggagagaagccctatgagtgcaacaagtgtgggaaggccttcagccagtgcagcctgctgatcatccacatgaggagccacactggagagaagccctttgaatgtaatgaatgtgggaaggccttcagccagagggccagcctgagcatccacaagaggggccacactggagagcggcaccaggtgtactag

SEQ ID NO: 18106 - DNA, 1716 bp, Artificial Sequence
  Description of Artificial Sequence: Synthetic coding sequence
atgaagccagcccagaggaacctgtacagagatgtgatgctggagaactacagcaacctggtgacagtgggctgccaggtgaccaagccagatgtgatcttcaagctggagcaggaggaggagccctgggtgatggaggaggagatgtttggccgccactgcccagagcccaggagaggagagaactgctgtgccagcgaggtgatggccgagggcctgaagttcaaggatgtggtgatctacttcagccagaaggagtgggagtgcctgcacagcgcccagaaggacctgtacagagatgtgatgctggagaactacggcaacctggtgctgctgggcctgagtgacaccaagcccaacgtcatcagcctgctggagcagaagaaggagccctggatggtgaagaggaaggagaccaaggagtggtgcccagactgggagtttggccgggagaccaagaacctgagccccaaggagaacatctatgagatccgcagcccccagcaggagaaggcccgggtcatccgggagatccgctgccaggtggagcggcagcagggccaccaggagggccacttccggcctgctgtgatccccttcacctccatgcagtgcacagcccaccgggagtaccagtggctgcacactggagagaagagctgtgagtgcaggaagtgcaagaatgccttccgctaccagagctgccccatccagcacgagatcatccacaacaaggagaaggagccagaatgtggagaatgtaggaagatcttcaacagcggcagtgacctgatcaagcaccagaccctgcacgagagcaagaagcacagcgagaacaacaagtgtgccttcaaccacgacagcggcatcacccagccccagagcatcaacacaggagagaagccccacaagtgcaaggaatgtgggaaggccttccgcagcagcagccagatcagccagcaccagaggatgcacctgggggagaagccctacaagtgcagagaatgtgggaaggccttccccagcacagcccagctgaacctgcaccagaggatccacacagatgagaagtactatgagagcaaggcctgtgggaaggccttcacccggcccagccacctgttccgccaccagaggatccacactggagagaagccccacaagtgcaaggaatgtgggaaggccttccgctatgacacccagctgagcctgcaccagatcatccacactggagagaggagatatgagtgcagagaatgtgggaaggtgtacagctgtgccagccagctgagcctgcaccagaggatccacactggagagaagccccatgagtgcaaggaatgtgggaaggccttcatcagtgacagccacctgatccgccaccagagcgtgcacactggagagaagccctgcaagtgcaaggaatgtgggaagagcttcagaagaggcagcgagctgaccaggcaccagagggcccacactggagagaagccctatgagtgcaaggaatgtgagaaggccttcacctgcagcacagagctggtgcgccaccagaaggtgcacactggagagcggccccacaagtgcaaggaatgtgggaaggccttcatccgccgctctgagctgacccaccacgagaggagccacactggagagaagccctatgagtgcaaggaatgtgggaagccctttggaggcggcagcgagctgtcctag

SEQ ID NO: 18107 - DNA, 1752 bp, Artificial Sequence
  Description of Artificial Sequence: Synthetic coding sequence
atgaccagccagagcagcgtcatcagcaacagctgtgtgaccatggagcggctgagccacatgatggagaggaaggcctggtgcagccaggagagcgccctgtctgaggaggaggaggacaccacccggcccctggagaccgtgaccttcaaggatgtggccgtggacctgacccaggaggagtgggagcagatgaagccagcccagaggaacctgtacagagatgtgatgctggagaactacagcaacctggtgacagtgggctgccaggtgaccaagccagatgtgatcttcaagctggagcaggaggaggagccctgggtgatggaggaggagatgtttggccgccactgcccagagcccaggagaggagagaactgctgtgccagcgaggtgatggccgagggcctgaagttcaaggatgtggtgatctacttcagccagaaggagtgggagtgcctgcacagcgcccagaaggacctgtacagagatgtgatgctggagaactacggcaacctggtgctgctgggcctgagtgacaccaagcccaacgtcatcagcctgctggagcagaagaaggagccctggatggtgaagaggaaggagaccaaggagtggtgcccagactgggagtttggccgggagaccaagaacctgagccccaaggagaacatctatgagatccgcagcccccagcaggagaaggcccgggtcatccgggagatccgctgccaggtggagcggcagcagggccaccaggagggccacttccggcctgctgtgatccccttcacctccatgcagtgcacagcccaccgggagtaccagtggctgcacactggagagaagagctgtgagtgcaggaagtgcaagaatgccttccgctaccagagctgccccatccagcacgagatcatccacaacaaggagaaggagccagaatgtggagaatgtaggaagatcttcaacagcggcagtgacctgatcaagcaccagaccctgcacgagagcaagaagcacagcgagaacaacaagtgtgccttcaaccacgacagcggcatcacccagccccagagcatcaacacaggagagaagccccacaagtgcaaggaatgtgggaaggccttccgcagcagcagccagatcagccagcaccagaggatgcacctgggggagaagccctacaagtgcagagaatgtgggaaggccttccccagcacagcccagctgaacctgcaccagaggatccacacagatgagaagtactatgagagcaaggcctgtgggaaggccttcacccggcccagccacctgttccgccaccagaggatccacactggagagaagccccacaagtgcaaggaatgtgggaaggccttccgctatgacacccagctgagcctgcaccagatcatccacactggagagaggagatatgagtgcagagaatgtgggaaggtgtacagctgtgccagccagctgagcctgcaccagaggatccacactggagagaagccccatgagtgcaaggaatgtgggaaggccttcatcagtgacagccacctgatccgccaccagagcgtgcacactggagagaagccctgcaagtgcaaggaatgtgggaagagcttcagaagaggcagcgagctgaccaggcaccagagggcccacactggagagaagccctatgagtgcaaggaatgtgagaaggccttcacctgcagcacagagctggtgcgccaccagaagtag

SEQ ID NO: 18108 - DNA, 1668 bp, Artificial Sequence
  Description of Artificial Sequence: Synthetic coding sequence
atggattctgtggtgtttgaagatgtggccgtggacttcaccctggaggagtgggccctgctggacagcgcccagagggacctgtacagagatgtgatgctggagaccttcaggaacctggcctctgtggatgatggcacccagttcaaggccaacggctctgtgtccctgcaggacatgtatggccaggagaagagcaaggagcagaccatccccaacttcaccggcaacaacagctgtgcctacaccctggagaagaactgtgagggctatggaacagaggaccaccacaagaacctgaggaaccacatggtggaccgcttctgcacccacaatgaaggcaaccagtatggagaggccatccaccagatgccagacctgaccctgcacaagaaggtgtctgctggggagaagccctatgaatgtaccaagtgcaggacagtgttcacccacctgagcagcctgaagagacatgtgaagagccactgcggcaggaaggcccctcctggagaggagtgcaagcaggcctgcatctgccccagccacctgcacagccacggccgcacagacacagaggagaagccctacaagtgccaggcctgtggccagaccttccagcacccccgctacctgagccaccacgtgaagacccacacagctgagaagacctacaagtgtgagcagtgcaggatggccttcaacggctttgccagcttcaccaggcatgtgaggacccacaccaaggaccggccctacaagtgccaggagtgtggccgggccttcatctaccccagcaccttccagaggcacatgaccacccacactggagagaagccctacaagtgccagcactgcggcaaggccttcacctacccccaggccttccagagacatgagaagacccacactggagagaagccctatgagtgcaagcagtgtgggaagaccttctcctggagcgagaccctgcgggtgcacatgaggatccacactggagacaagctgtacaagtgtgagcactgcggcaaggccttcaccagcagccgctccttccagggccacctgcggacccacactggagagaagccctatgagtgcaagcagtgtgggaaggccttcacctggagcagcaccttccgggagcacgtgcgcatccacacccaggagcagctgtacaagtgtgagcagtgtgggaaggccttcaccagcagccgctccttccggggccacctgcggacccacactggagagaagccctatgagtgcaagcagtgtgggaagaccttcacctggagcagcaccttccgggagcacgtgcgcatccacacccaggagcagctgcacaagtgtgagcactgcggcaaggccttcaccagcagccgggccttccagggccacctgaggatgcacactggagagaagccctatgagtgcaagcagtgtgggaagaccttcacctggagcagcaccctgcacaaccacgtgaggatgcacactggagagaagccccacaagtgcaagcagtgtggcatgtccttcaagtggcacagcagcttcaggaaccacctgaggatgcacacaggccagaagagccatgagtgccagagctacagcaaggccttcagctgccaggtgatcctgagcaagaccagcgagagcacccactag

SEQ ID NO: 18109 - DNA, 1674 bp, Artificial Sequence
  Description of Artificial Sequence: Synthetic coding sequence
atggattctgtggtgtttgaagatgtggccgtggacttcaccctggaggagtgggccctgctggacagcgcccagagggacctgtacagagatgtgatgctggagaccttcaggaacctggcctctgtgggctgtgagatgtgggagaggaccaacggctctgtgtccctgcaggacatgtatggccaggagaagagcaaggagcagaccatccccaacttcaccggcaacaacagctgtgcctacaccctggagaagaagaggatcaccaggtctggggaccagagccagctgcctgtgagaagaagaaaccacatggtggaccgcttctgcacccacaatgaaggcaaccagtatggagaggccatccaccagatgccagacctgaccctgcacaagaaggtgtctgctggggagaagccctatgaatgtaccaagtgcaggacagtgttcacccacctgagcagcctgaagagacatgtgaagagccactgcggcaggaaggcccctcctggagaggagtgcaagcaggcctgcatctgccccagccacctgcacagccacggccgcacagacacagaggagaagccctacaagtgccaggcctgtggccagaccttccagcacccccgctacctgagccaccacgtgaagacccacacagctgagaagacctacaagtgtgagcagtgcaggatggccttcaacggctttgccagcttcaccaggcatgtgaggacccacaccaaggaccggccctacaagtgccaggagtgtggccgggccttcatctaccccagcaccttccagaggcacatgaccacccacactggagagaagccctacaagtgccagcactgcggcaaggccttcacctacccccaggccttccagagacatgagaagacccacactggagagaagccctatgagtgcaagcagtgtgggaagaccttctcctggagcgagaccctgcgggtgcacatgaggatccacactggagacaagctgtacaagtgtgagcactgcggcaaggccttcaccagcagccgctccttccagggccacctgcggacccacactggagagaagccctatgagtgcaagcagtgtgggaaggccttcacctggagcagcaccttccgggagcacgtgcgcatccacacccaggagcagctgtacaagtgtgagcagtgtgggaaggccttcaccagcagccgctccttccggggccacctgcggacccacactggagagaagccctatgagtgcaagcagtgtgggaagaccttcacctggagcagcaccttccgggagcacgtgcgcatccacacccaggagcagctgcacaagtgtgagcactgcggcaaggccttcaccagcagccgggccttccagggccacctgaggatgcacactggagagaagccctatgagtgcaagcagtgtgggaagaccttcacctggagcagcaccctgcacaaccacgtgaggatgcacactggagagaagccccacaagtgcaagcagtgtggcatgtccttcaagtggcacagcagcttcaggaaccacctgaggatgcacacaggccagaagagccatgagtgccagagctacagcaaggccttcagctgccaggtgatcctgagcaagaccagcgagagcacccactag

SEQ ID NO: 18110 - DNA, 1611 bp, Artificial Sequence
  Description of Artificial Sequence: Synthetic coding sequence
atggctgtgggcctgctgaaggccatgtaccaggagctggtgaccttcagagatgtggccgtggacttcagccaggaggagtgggactgcctggacagcagccagaggcacctgtacagcaatgtgatgctggagaactaccgcatcctggtgtccctgggcctgtgcttcagcaagcccagcgtcatcctgctgctggagcagggcaaggccccctggatggtgaagcgggagctgaccaagggcctgtgcagcggctgggagcccatctgtgaaacagaggagctgacccccaagcaggacttctatgaggagcaccagagccagaagatcatcgagaccctgaccagctacaacctggagtacagcagcctgcgggaggagtggaagtgtgagggctactttgagcggcagcccggcaaccagaaggcctgcttcaaggaggagatcatcacccatgaggagcccctgtttgatgagcgggagcaggagtacaagtcctggggcagcttccaccagaaccccctgctgtgcacccagaagatcatccccaaggaggagaaggtgcacaagcatgacacccagaagaggagcttcaagaagaacctgatggccatcaagcccaagtctgtgtgtgccgagaagaagctgctgaagtgcaatgactgtgagaaggtgttcagccagagcagcagcctgaccctgcaccagaggatccacactggagagaagccctacaagtgcattgaatgtgggaaggccttcagccagaggagcaacctggtgcagcaccagaggatccacactggagagaagccctatgagtgcaaggagtgcaggaaggccttcagccagaatgcccacctggtgcagcacctgcgggtgcacactggagagaagccctatgagtgcaaggtgtgcaggaaggccttcagccagtttgcctacctggcccagcaccagagggtgcacactggagagaagccctatgaatgtattgaatgtgggaaggccttcagcaacagaagcagcatcgcccagcaccagagggtgcacactggagagaagccctatgaatgtaatgtgtgtgggaaggccttcagcctgcgggcctacctgactgtgcaccagaggatccacactggagagcggccctatgagtgcaaggaatgtgggaaggccttcagccagaacagccacctggcccagcaccagaggatccacactggagagaagccctacaagtgccaggagtgcaggaaggccttcagccagatcgcctacctggcccagcaccagagggtgcacactggagagaagccctatgaatgtattgaatgtgggaaggccttcagcaatgacagcagcctgacccagcaccagagggtgcacactggagagaagccctatgaatgtactgtgtgtgggaaggccttctcctactgcggcagcctggcccagcaccagaggatccacactggagagcggccctatgagtgcaaggagtgcaagaagaccttccggcagcacgcccacctggcccaccaccagaggatccacatcggggagagcctgagcccccccaaccctgtgaaccaccaggtgctgtag

SEQ ID NO: 18111 - DNA, 1002 bp, Artificial Sequence
  Description of Artificial Sequence: Synthetic coding sequence
atggccatcaagcccaagtctgtgtgtgccgagaagaagctgctgaagtgcaatgactgtgagaaggtgttcagccagagcagcagcctgaccctgcaccagaggatccacactggagagaagccctacaagtgcattgaatgtgggaaggccttcagccagaggagcaacctggtgcagcaccagaggatccacactggagagaagccctatgagtgcaaggaatgtaggaaggccttcagccagaatgcccacctggtgcagcacctgcgggtgcacactggagagaagccctatgagtgcaaggtgtgcaggaaggccttcagccagtttgcctacctggcccagcaccagagggtgcacactggagagaagccctatgagtgcattgaatgtgggaaggccttcagcaacagaagcagcatcgcccagcaccagagggtgcacactggagagaagccctatgagtgcaatgtgtgtgggaaggccttcagcctgcgggcctacctgactgtgcaccagaggatccacactggagagcggccctatgagtgcaaggaatgtgggaaggccttcagccagaacagccacctggcccagcaccagaggatccacactggagagaagccctacaagtgccaggagtgcaggaaggccttcagccagatcgcctacctggcccagcaccagagggtgcacactggagagaagccctatgagtgcattgaatgtgggaaggccttcagcaatgacagcagcctgacccagcaccagagggtgcacactggagagaagccctatgagtgcaccgtgtgtgggaaggccttctcctactgcggcagcctggcccagcaccagaggatccacactggagagcggccctatgagtgcaaggagtgcaagaagaccttccggcagcacgcccacctggcccaccaccagaggatccacatcggggagagcctgagcccccccaaccctgtgaaccaccaggtgctgtag

SEQ ID NO: 18112 - DNA, 1830 bp, Artificial Sequence
  Description of Artificial Sequence: Synthetic coding sequence
atgccccacctgctggtgaccttcagagatgtggccatcgacttcagccaggaggagtgggagtgcctggaccctgcccagagggacctgtacagagatgtgatgctggagaactacagcaacctgatcagcctggacctggagagcagctgtgtgaccaagaagctgagccctgagaaggagatctatgagatggagagcctgcagtgggagaacatgggcaagaggatcaaccaccacctgcagtacaacggcctgggggacaacatggagtgcaagggcaacctggagggccaggaggccagccaggagggcctgtacatgtgtgtgaagatcacctgtgaggagaaggccacagagagccacagcaccagcagcaccttccaccgcatcatccccaccaaggagaagctgtacaagtgcaaggaatgtcggcagggcttctcctacctgagctgcctgatccagcacgaggagaaccacaacattgaaaaatgttctgaggtgaagaagcacaggaacaccttcagcaagaagcccagctacatccagcaccagaggatccagacaggagagaagccctatgagtgcatggagtgtgggaaggccttcggccgcaccagtgacctgatccagcaccagaagatccacaccaatgagaagccctaccagtgcaatgcctgtgggaaggccttcatccggggcagccagctgacagagcaccagagggtgcacactggagagaagccctatgagtgcaagaagtgtgggaaggccttctcctactgcagccagtacaccctgcaccagaggatccacagcggggagaagccctatgagtgcaaggactgtgggaaggccttcatcctgggcagccagctgacctaccaccagaggatccacagcggggagaagccctatgagtgcaaggaatgtgggaaggccttcatcctgggcagccacctgacctaccaccagagggtgcacactggagagaagccctacatctgcaaggaatgtgggaaggccttcctgtgtgccagccagctgaatgagcaccagaggatccacactggagagaagccctatgagtgcaaggaatgtgggaagaccttcttccggggcagccagctgacctaccacctgcgggtgcacagcggggagcggccctacaagtgcaaggaatgtgggaaggccttcatcagcaacagcaacctgatccagcaccagaggatccacactggagagaagccctacaagtgcaaggaatgtgggaaggccttcatctgtgggaagcagctgtctgagcaccagaggatccacactggagagaagccctttgagtgcaaggaatgtgggaaggccttcatccgggtggcctacctgacccagcacgagaagatccatggagagaagcactatgagtgcaaggaatgtgggaagacctttgtgcgggccacccagctgacctaccaccagaggatccacactggagagaagccctacaagtgcaaggaatgtgacaaggccttcatctacggcagccagctgtctgagcaccagaggatccacagaggagagaagccctatgagtgcaagcagtgtgggaaggccttcatccggggcagccacctgacagagcacctgcggacccacactggagagaagccctatgagtgcaaggaatgtggccgggccttcagccggggcagcgagctgaccctgcaccagaggatccacactggagagaagccctacacctgtgtgcagtgtgggaaggacttccgctgccccagccagctgacccagcacacccggctgcacaactag

SEQ ID NO: 18113 - DNA, 1830 bp, Artificial Sequence; identical to SEQ ID NO: 18112
  Description of Artificial Sequence: Synthetic coding sequence

SEQ ID NO: 18114 - DNA, 1830 bp, Artificial Sequence; identical to SEQ ID NO: 18112
  Description of Artificial Sequence: Synthetic coding sequence

SEQ ID NO: 18115 - DNA, 1590 bp, Artificial Sequence
  Description of Artificial Sequence: Synthetic coding sequence
atggagcaggagaagaagctgctggtgtctgacagcaacagcttcatggagcgggagagcctgaagagccccttcaccggggacacctccatgaacaacctggagaccgtgcaccacaacaacagcaaggctgacaagctgaaggagaagcccagcgagtggagcaagaggcaccggccccagcactacaagcatgaagatgccaaggagatgcccctgacctgggtgcaggatgagatctggtgccacgacagctatgaaagtgatggcaagtctgagaactggggcaacttcatcgccaaggaggaggagaagcccaaccaccaggagtgggacagcggggagcacaccaatgcctgtgtgcagcagaacagcagctttgtggaccggccctacaagtgcagcgagtgctggaagagcttcagcaacagcagccacctgcggacccaccagaggacccacagcggggagaagccctacaagtgcagtgaatgtgccaagtgcttctgcaacagcagccacctgatccagcacctgaggatgcacactggagagaagccctaccagtgtggggagtgtgggaagagcttcagcaacaccagccacctgatcatccacgagaggacccacactggagagaagccctacaagtgcccagaatgtgggaagcgcttcagcagcagcagccacctgatccagcaccacaggagccacactggagagaagccctatgaatgttctgtgtgtgggaagggcttcagccacagctatgtgctgattgagcaccagaggacccacactggagagaagccctacaagtgcccagactgtgggaagagcttcagccagagcagcagcctcatccgccaccagaggacccacactggagagaagccctacaagtgcctggagtgtgagaagagctttggctgcaacagcaccctcatcaagcaccagaggatccacactggagagaagccctaccagtgcccagaatgtgggaagaacttcagccgcagcagcaacctgatcacccaccagaagatgcacactggagagaagagctatgagagcagtgaatatgaggagagcctgggccagaactgcaacgtcatcgaggagtgccgcatccagctgggggagaagccctaccgctgctgtgaatgtgggaagagctttggcctgagcagccacctgatccgccaccagaggacccacactggagagaagccctaccgctgcagcgagtgctggaagaccttcagccagagcagcaccctggtgatccaccagaggacccacactggagagaagccctacaagtgcccagactgtggggagagcttcagccagagcttcaacctgatccgccacaggaggacccacatcggggagaagccctacaagtgcaccagctgtgagaagtgcttcagccgcagcgcctacctgagccagcacaggaagatccacgtggagaagccctttgagagcccagatgtgggggacttcccccatgagtggacctggaagaactgcagcggggagatgcccttcatcagcagcttctctgtgagcaacagcagcagctag

SEQ ID NO: 18116 - DNA, 1824 bp, Artificial Sequence
  Description of Artificial Sequence: Synthetic coding sequence
atggagagctgcagcgtggcccaggccggcgtgcagtggccagacctgagcagcctgcagcccccaccaccccgcttcaagcagttcagctgccacagcctgcaggtggccggcatcacagacctggacctgcagtgtgagatcatctcctacatcgaggtgcccacctatgaaacagacatcagcagcacccagctgcagagcatctacaagcgggagaagctgtatgagtgcaagaagtgccagaagaagttcagcagcggctaccagctgatcctgcaccaccgcttccacgtgattgaaagaccctatgagtgcaaggaatgtgggaagaacttccgcagcggctaccagctgaccctgcaccagcgcttccacactggagagaagccctatgaatgtacagaatgtgggaagaacttccgcagcggctaccagctgactgtgcaccagcgcttccacactggagagaagacctatgaatgtcggcagtgtgggaaggccttcatctatgccagccacatcgtgcagcacgagcgcatccacactggaggcaagccctatgagtgccaggagtgtggccgggccttcagccagggcggccacctgcgcatccaccagagggtgcacactggagagaagccctacaagtgcaaggaatgtgggaagaccttcagcagaagaagcaacctggtggagcacggccagttccacacagatgagaagccctacatctgtgagaagtgtgggaaggccttccggcggggccaccagctgactgtgcaccagagggtgcacacaggcaagaagccctatgagtgcaaggaatgtgggaagggctacaccacagccagctacttcctgctgcaccagaggatccacaagggcggcaagccctatgagtgcaaggagtgcaagaagaccttcaccctgtacagaaacctgaccaggcaccagaacatccacactggagagaagctgtttgagtgcaagcagtgtgggaagacctacaccaccggcagcaagctgttccagcaccagaagacccacactggagagaagccctatgagtgcaaggaatgtgggaaggccttcagcctgtatggctacctgaagcagcaccagaagatccacacaggcatgaagcactttgagtgcaaggagtgcaagaagaccttcaccctgtacagaaacctgaccaggcaccagaacatccacacaggcaagaagctgtttgagtgccaggagtgtgggaaggcctacagcacaggcagcaacctgatccagcacaggaagacccacactggagagaagccctacaagtgcaaggaatgtgggaagaccttcagcctgcacggctacctgaaccagcaccagaagatccacacaggcatgaagccctatgagtgcaaggtgtgcaggaagaccttcaccttctacagaaacctgaccctgcaccagagcatccacacagatgagaagccctttgagtgcaaggaatgtgggaagaccttccgccgcagcagccacctgacagcccaccagagcatccatgctgacaagaagccctatgagtgcaaggaatgtgggaaggccttcaagatgtatggctacctgacccagcaccagaagatccacactggaggcaagccctatgagtgcaaggaatgtgggaaggccttcagccgggccagcaacctggtgcagcacgagcgcatccacactggagagaagccctacgtgtgcaagcagtgtgggaagaccttccgctatggcagcgccctgaaggcccaccagaggatccacaggagcatcaaggtgtag

SEQ ID NO: 18117 - DNA, 1734 bp, Artificial Sequence
  Description of Artificial Sequence: Synthetic coding sequence
atgatcctgcgggaggagacccagttcacagacctggacctgcagtgtgagatcatctcctacatcgaggtgcccacctatgaaacagacatcagcagcacccagctgcagagcatctacaagcgggagaagctgtatgagtgcaagaagtgccagaagaagttcagcagcggctaccagctgatcctgcaccaccgcttccacgtgattgaaagaccctatgagtgcaaggaatgtgggaagaacttccgcagcggctaccagctgaccctgcaccagcgcttccacactggagagaagccctatgaatgtacagaatgtgggaagaacttccgcagcggctaccagctgactgtgcaccagcgcttccacactggagagaagacctatgaatgtcggcagtgtgggaaggccttcatctatgccagccacatcgtgcagcacgagcgcatccacactggaggcaagccctatgagtgccaggagtgtggccgggccttcagccagggcggccacctgcgcatccaccagagggtgcacactggagagaagccctacaagtgcaaggaatgtgggaagaccttcagcagaagaagcaacctggtggagcacggccagttccacacagatgagaagccctacatctgtgagaagtgtgggaaggccttccggcggggccaccagctgactgtgcaccagagggtgcacacaggcaagaagccctatgagtgcaaggaatgtgggaagggctacaccacagccagctacttcctgctgcaccagaggatccacaagggcggcaagccctatgagtgcaaggagtgcaagaagaccttcaccctgtacagaaacctgaccaggcaccagaacatccacactggagagaagctgtttgagtgcaagcagtgtgggaagacctacaccaccggcagcaagctgttccagcaccagaagacccacactggagagaagccctatgagtgcaaggaatgtgggaaggccttcagcctgtatggctacctgaagcagcaccagaagatccacacaggcatgaagcactttgagtgcaaggagtgcaagaagaccttcaccctgtacagaaacctgaccaggcaccagaacatccacacaggcaagaagctgtttgagtgccaggagtgtgggaaggcctacagcacaggcagcaacctgatccagcacaggaagacccacactggagagaagccctacaagtgcaaggaatgtgggaagaccttcagcctgcacggctacctgaaccagcaccagaagatccacacaggcatgaagccctatgagtgcaaggtgtgcaggaagaccttcaccttctacagaaacctgaccctgcaccagagcatccacacagatgagaagccctttgagtgcaaggaatgtgggaagaccttccgccgcagcagccacctgacagcccaccagagcatccatgctgacaagaagccctatgagtgcaaggaatgtgggaaggccttcaagatgtatggctacctgacccagcaccagaagatccacactggaggcaagccctatgagtgcaaggaatgtgggaaggccttcagccgggccagcaacctggtgcagcacgagcgcatccacactggagagaagccctacgtgtgcaagcagtgtgggaagaccttccgctatggcagcgccctgaaggcccaccagaggatccacaggagcatcaaggtgtag

SEQ ID NO: 18118 - DNA, 129 bp, Artificial Sequence
  Description of Artificial Sequence: Synthetic coding sequence
atgctggagaactacagaaacctggtgtccctgggcggccacagcatcagcaagcctgtggtggtggacctgctggagcggggcaaggagccctggatgatcctgcgggaggagacccagttcacctag

SEQ ID NO: 18119 - DNA, 1737 bp, Artificial Sequence
  Description of Artificial Sequence: Synthetic coding sequence
atgctggagaactacagaaacctggtgtccctggacctggacctgcagtgtgagatcatctcctacatcgaggtgcccacctatgaaacagacatcagcagcacccagctgcagagcatctacaagcgggagaagctgtatgagtgcaagaagtgccagaagaagttcagcagcggctaccagctgatcctgcaccaccgcttccacgtgattgagcggccctatgagtgcaaggaatgtgggaagaacttccgcagcggctaccagctgaccctgcaccagcgcttccacactggagagaagccctatgagtgcacagaatgtgggaagaacttccgcagcggctaccagctgactgtgcaccagcgcttccacactggagagaagacctatgagtgccggcagtgtgggaaggccttcatctatgccagccacatcgtgcagcacgagcgcatccacactggaggcaagccctatgagtgccaggagtgtggccgggccttcagccagggcggccacctgcgcatccaccagagggtgcacactggagagaagccctacaagtgcaaggaatgtgggaagaccttcagccgccgcagcaacctggtggagcacggccagttccacacagatgagaagccctacatctgtgagaagtgtgggaaggccttcagaagaggccaccagctgactgtgcaccagagggtgcacacaggcaagaagccctatgagtgcaaggaatgtgggaagggctacaccacagccagctacttcctgctgcaccagaggatccacaagggcggcaagccctatgagtgcaaggagtgcaagaagaccttcaccctgtacagaaacctgaccaggcaccagaacatccacactggagagaagctgtttgagtgcaagcagtgtgggaagacctacaccaccggcagcaagctgttccagcaccagaagacccacactggagagaagccctatgagtgcaaggaatgtgggaaggccttcagcctgtatggctacctgaagcagcaccagaagatccacacaggcatgaagcactttgagtgcaaggagtgcaagaagaccttcaccctgtacagaaacctgaccaggcaccagaacatccacacaggcaagaagctgtttgagtgccaggagtgtgggaaggcctacagcacaggcagcaacctgatccagcacaggaagacccacactggagagaagccctacaagtgcaaggaatgtgggaagaccttcagcctgcacggctacctgaaccagcaccagaagatccacacaggcatgaagccctatgagtgcaaggtgtgcaggaagaccttcaccttctacagaaacctgaccctgcaccagagcatccacacagatgagaagccctttgagtgcaaggaatgtgggaagaccttcagaagaagcagccacctgacagcccaccagagcatccacgccgacaagaagccctatgagtgcaaggaatgtgggaaggccttcaagatgtatggctacctgacccagcaccagaagatccacactggaggcaagccctatgagtgcaaggaatgtgggaaggccttcagccgggccagcaacctggtgcagcacgagcgcatccacactggagagaagccctacgtgtgcaagcagtgtgggaagaccttccgctatggcagcgccctgaaggcccaccagaggatccacaggagcatcaaggtgtag

SEQ ID NO: 18120 - DNA, 1734 bp, Artificial Sequence
  Description of Artificial Sequence: Synthetic coding sequence
ttcatcctgcggaccagcagctttgtgtctgacctggacctgcagtgtgagatcatctcctacatcgaggtgcccacctatgaaacagacatcagcagcacccagctgcagagcatctacaagcgggagaagctgtatgagtgcaagaagtgccagaagaagttcagcagcggctaccagctgatcctgcaccaccgcttccacgtgattgaaagaccctatgagtgcaaggaatgtgggaagaacttccgcagcggctaccagctgaccctgcaccagcgcttccacactggagagaagccctatgaatgtacagaatgtgggaagaacttccgcagcggctaccagctgactgtgcaccagcgcttccacactggagagaagacctatgaatgtcggcagtgtgggaaggccttcatctatgccagccacatcgtgcagcacgagcgcatccacactggaggcaagccctatgagtgccaggagtgtggccgggccttcagccagggcggccacctgcgcatccaccagagggtgcacactggagagaagccctacaagtgcaaggaatgtgggaagaccttcagcagaagaagcaacctggtggagcacggccagttccacacagatgagaagccctacatctgtgagaagtgtgggaaggccttccggcggggccaccagctgactgtgcaccagagggtgcacacaggcaagaagccctatgagtgcaaggaatgtgggaagggctacaccacagccagctacttcctgctgcaccagaggatccacaagggcggcaagccctatgagtgcaaggagtgcaagaagaccttcaccctgtacagaaacctgaccaggcaccagaacatccacactggagagaagctgtttgagtgcaagcagtgtgggaagacctacaccaccggcagcaagctgttccagcaccagaagacccacactggagagaagccctatgagtgcaaggaatgtgggaaggccttcagcctgtatggctacctgaagcagcaccagaagatccacacaggcatgaagcactttgagtgcaaggagtgcaagaagaccttcaccctgtacagaaacctgaccaggcaccagaacatccacacaggcaagaagctgtttgagtgccaggagtgtgggaaggcctacagcacaggcagcaacctgatccagcacaggaagacccacactggagagaagccctacaagtgcaaggaatgtgggaagaccttcagcctgcacggctacctgaaccagcaccagaagatccacacaggcatgaagccctatgagtgcaaggtgtgcaggaagaccttcaccttctacagaaacctgaccctgcaccagagcatccacacagatgagaagccctttgagtgcaaggaatgtgggaagaccttccgccgcagcagccacctgacagcccaccagagcatccatgctgacaagaagccctatgagtgcaaggaatgtgggaaggccttcaagatgtatggctacctgacccagcaccagaagatccacactggaggcaagccctatgagtgcaaggaatgtgggaaggccttcagccgggccagcaacctggtgcagcacgagcgcatccacactggagagaagccctacgtgtgcaagcagtgtgggaagaccttccgctatggcagcgccctgaaggcccaccagaggatccacaggagcatcaaggtgtag

SEQ ID NO: 18121 - DNA, 1734 bp, Artificial Sequence; identical to SEQ ID NO: 18117
  Description of Artificial Sequence: Synthetic coding sequence

SEQ ID NO: 18122 - DNA, 1998 bp, Artificial Sequence
  Description of Artificial Sequence: Synthetic coding sequence
atgtttcctgtgctggagccccaccaggtgggcctcatccgcagctacaacagcaagaccatgacctgcttccaggagctggtgaccttcagagatgtggccatcgacttcagccggcaggagtgggagtacctggaccccaaccagagggacctgtacagagatgtgatgctggagaactacagaaacctggtgtccctgggcggccacagcatcagcaagcctgtggtggtggacctgctggagcggggcaaggagccctggatgatcctgcgggaggagacccagttcacagacctggacctgcagtgtgagatcatctcctacatcgaggtgcccacctatgaaacagacatcagcagcacccagctgcagagcatctacaagcgggagaagctgtatgagtgcaagaagtgccagaagaagttcagcagcggctaccagctgatcctgcaccaccgcttccacgtgattgaaagaccctatgagtgcaaggaatgtgggaagaacttccgcagcggctaccagctgaccctgcaccagcgcttccacactggagagaagccctatgaatgtacagaatgtgggaagaacttccgcagcggctaccagctgactgtgcaccagcgcttccacactggagagaagacctatgaatgtcggcagtgtgggaaggccttcatctatgccagccacatcgtgcagcacgagcgcatccacactggaggcaagccctatgagtgccaggagtgtggccgggccttcagccagggcggccacctgcgcatccaccagagggtgcacactggagagaagccctacaagtgcaaggaatgtgggaagaccttcagcagaagaagcaacctggtggagcacggccagttccacacagatgagaagccctacatctgtgagaagtgtgggaaggccttccggcggggccaccagctgactgtgcaccagagggtgcacacaggcaagaagccctatgagtgcaaggaatgtgggaagggctacaccacagccagctacttcctgctgcaccagaggatccacaagggcggcaagccctatgagtgcaaggagtgcaagaagaccttcaccctgtacagaaacctgaccaggcaccagaacatccacactggagagaagctgtttgagtgcaagcagtgtgggaagacctacaccaccggcagcaagctgttccagcaccagaagacccacactggagagaagccctatgagtgcaaggaatgtgggaaggccttcagcctgtatggctacctgaagcagcaccagaagatccacacaggcatgaagcactttgagtgcaaggagtgcaagaagaccttcaccctgtacagaaacctgaccaggcaccagaacatccacacaggcaagaagctgtttgagtgccaggagtgtgggaaggcctacagcacaggcagcaacctgatccagcacaggaagacccacactggagagaagccctacaagtgcaaggaatgtgggaagaccttcagcctgcacggctacctgaaccagcaccagaagatccacacaggcatgaagccctatgagtgcaaggtgtgcaggaagaccttcaccttctacagaaacctgaccctgcaccagagcatccacacagatgagaagccctttgagtgcaaggaatgtgggaagaccttccgccgcagcagccacctgacagcccaccagagcatccatgctgacaagaagccctatgagtgcaaggaatgtgggaaggccttcaagatgtatggctacctgacccagcaccagaagatccacactggaggcaagccctatgagtgcaaggaatgtgggaaggccttcagccgggccagcaacctggtgcagcacgagcgcatccacactggagagaagccctacgtgtgcaagcagtgtgggaagaccttccgctatggcagcgccctgaaggcccaccagaggatccacaggagcatcaaggtgtag

SEQ ID NO: 18123 - DNA, 1452 bp, Artificial Sequence
  Description of Artificial Sequence: Synthetic coding sequence
atgtctgggggcggccccagcggcggcggccctgggggcagcggccgggcccggaccagcagctttgctgagcccggcggcggcggcggcggcggcggcggcggccctgggggcagcgccagcggccctgggggcaccggcggcggcaaggcctctgtgggcgccatgggcggcggcgtgggcgccagcagcagcggcggcggccctgggggcagcggcggcggcggcagcggcggccctggggccggcaccagcttccccccacctggggtgaagctgggccgggacagcggcaaggtgaccaccgtggtggccaccctgggccagggccctgagaggagccaggaggtggcctacacagacatcaaggtgattggaaatggcagctttggagtggtgtaccaggcccggctggccgagacccgggagctggtggccatcaagaaggtgctgcaggacaagcgcttcaagaaccgggagctgcagatcatgaggaagctggaccactgcaacatcgtgcggctgcgctacttcttctacagcagcggggagaagaaggatgagctgtacctgaacctggtgctggagtatgtgcctgagaccgtgtacagagtggcccggcacttcaccaaggccaagctgaccatccccatcctgtatgtgaaggtgtacatgtaccagctgttccgcagcctggcctacatccacagccagggcgtgtgccaccgggacatcaagccccagaacctgctggtggaccctgacacagctgtgctgaagctgtgtgactttggcagcgccaagcagctggtgcggggggagcccaacgtgtcctacatctgcagccgctactaccgggcccctgagctgatctttggagccacagactacaccagcagcattgatgtgtggagcgctggctgtgtgctggccgagctgctgctgggccagcccatcttccctggggacagcggcgtggaccagctggtggagatcatcaaggtgctgggcacccccacccgggagcagatccgggagatgaaccccaactacacagagttcaagttcccccagatcaaggcccacccctggaccaaggtgttcaagagcaggaccccacctgaggccatcgccctgtgcagcagcctgctggagtacacccccagcagccggctgagccccctggaggcctgtgcccacagcttctttgatgagctgcgctgcctgggcacccagctgcccaacaaccggcccctgcccccactcttcaacttctctgctggggagctgagcatccagcccagcctgaatgccatcctgatccccccccacctgcggagccctgctggcaccaccaccctgacccccagcagccaggccctgacagagacccccaccagcagtgactggcagagcacagatgccacccccaccctgaccaacagcagctag

SEQ ID NO: 18124 - DNA, 2691 bp, Artificial Sequence
  Description of Artificial Sequence: Synthetic coding sequence
atgacagaggagagcgaggagaccgtgctgtacatcgagcaccgctacgtgtgcagcgagtgcaaccagctgtatggcagcctggaggaggtgctgatgcaccagaacagccacgtgccccagcagcactttgagctggtgggcgtggccgaccccggggtgacagtggccacagacacagccagcggcaccggcctgtaccagaccctggtgcaggagagccagtaccagtgcctggagtgtggccagctgctgatgagccccagccagctgctggagcaccaggagctgcacctgaagatgatggccccccaggaggccgtgcctgctgagcccagccccaaggccccacccctgagcagcagcaccatccactatgaatgtgtggactgcaaggccctgtttgccagccaggagctgtggctgaaccaccggcagacccacctgcgggccacccccaccaaggccccagcccctgtggtgctgggcagccctgtggtgctgggcccccctgtgggccaggcccgggtggccgtggagcacagctacaggaaggccgaggagggcggggagggcgccaccgtgcccagcgctgctgccaccaccacagaggtggtgacagaggtggagctgctgctgtacaagtgcagcgagtgcagccagctgttccagctgcctgctgacttcctggagcaccaggccacccacttccctgcccctgtgcctgagagccaggagcccgccctgcagcaggaggtgcaggccagcagccctgctgaggtgcctgtgtcccagcctgaccccctgcctgccagtgaccacagctatgagctgagaaatggagaggccatcggccgggaccggcggggcagaagagcccggaggaacaacagcggggaggccggcggggccgccacccaggagctgttctgcagcgcctgtgaccagctgttcctgagcccccaccagctgcagcagcacctgcggagccaccgggagggcgtcttcaagtgccccctgtgcagcagggtcttccccagccccagcagcctggaccagcacctgggggaccacagcagcgagagccacttcctgtgtgtggactgtggcctggcctttggaacagaggccctgctgctggcccacagaagagcccacacccccaaccccctgcacagctgcccctgtgggaagacctttgtgaacctgaccaagttcctgtaccacaggaggacccatggagtgggcggcgtgcccctgcccaccacccctgtgcccccagaggagcccgtcatcggcttccctgagcccgccccagctgagaccggggagcctgaggcccctgagccccctgtgtctgaggagaccagcgctggccctgctgcccctggcacctaccgctgcctgctgtgcagccgggagtttgggaaggccctgcagctgaccaggcaccagagatttgtgcaccggctggagaggaggcacaagtgcagcatctgtgggaagatgttcaagaagaagagccacgtgaggaaccacctgcggacccacactggagagcggcccttcccctgcccagactgcagcaagcccttcaacagccctgccaacctggcccggcaccggctgacccacactggagagcggccctaccgctgtggggactgtgggaaggccttcacccagagcagcaccctgcggcagcaccggctggtgcacgcccagcacttcccctaccgctgccaggagtgtggggtgcgcttccaccggccctaccgcctgctgatgcaccgctaccaccacactggagagtacccctacaagtgcagagaatgtcccaggagcttcctgctgcggcggctgctggaggtgcaccagctggtggtgcatgctggccggcagccccaccgctgccccagctgtggggccgccttccccagcagcctgcggctgcgggagcaccgctgtgccgctgctgctgcccaggcccccaggagatttgaatgtggcacctgtgggaagaaggtgggcagcgctgcccggctgcaggcccatgaagctgcccacgccgccgccggccctggagaggtgctggccaaggagcccccagccccccgggccccccgggccacccgggcccctgtggccagccctgctgccctgggcagcacagccacagccagccctgctgccccagccaggagaagaggcctggagtgcagcgagtgcaagaagctgttcagcacagagaccagcctgcaggtgcaccggcgcatccacactggagagcggccctacccctgcccagactgtgggaaggccttccggcagagcacccacctgaaggaccaccggcggctgcacactggagagcggccctttgcctgtgaggtgtgtgggaaggcctttgccatctccatgaggctggccgagcaccggcgcatccacactggagagcggccctacagctgcccagactgtgggaagagctaccgctccttcagcaacctgtggaagcacaggaagacccaccagcagcagcaccaggccgctgtgcggcagcagctggccgaggccgaggccgctgtgggcctggccgtgatggagacagctgtggaggccctgcccctggtggaggccatcgagatctaccccctggccgaggccgagggcgtgcagatctctggatag

SEQ ID NO: 18125 - DNA, 1635 bp, Artificial Sequence
  Description of Artificial Sequence: Synthetic coding sequence
atgtccatgtgggaggacctgtgccagccctaccaggtgcccctgagccctgcctacagctggggccggggctgccccctgcccaccacccctgtgcccccagaggagcctgtgattggcttccctgagcccgccccagctgagactggagagcctgaggcccctgagccccctgtgtctgaggagaccagcgctggccctgctgcccctggcacctaccgctgcctgctgtgcagccgggagtttgggaaggccctgcagctgaccaggcaccagagatttgtgcaccggctggagcggcggcacaagtgcagcatctgtgggaagatgttcaagaagaagagccacgtgaggaaccacctgcggacccacactggagagcggcccttcccctgcccagactgcagcaagcccttcaacagccctgccaacctggcccggcaccggctgacccacactggagagcggccctaccgctgtggggactgtgggaaggccttcacccagagcagcaccctgcggcagcaccggctggtgcacgcccagcacttcccctaccgctgccaggagtgtggggtgcgcttccaccggccctaccgcctgctgatgcaccgctaccaccacactggagagtacccctacaagtgccgggagtgccccaggagcttcctgctgcggcggctgctggaggtgcaccagctggtggtgcacgccggccggcagccccaccgctgccccagctgtggggccgccttccccagcagcctgcggctgcgggagcaccgctgtgccgctgctgctgcccaggcccccaggagatttgaatgtggcacctgtgggaagaaggtgggcagcgctgcccggctgcaggcccacgaggccgcccatgctgctgctggccctggagaggtgctggccaaggagcccccagccccccgggccccccgggccacccgggcccctgtggccagccctgctgccctgggcagcacagccacagccagccctgctgccccagcccggcggcggggcctggagtgcagcgagtgcaagaagctgttcagcacagagaccagcctgcaggtgcaccggcgcatccacactggagagcggccctacccctgcccagactgtgggaaggccttccggcagagcacccacctgaaggacacaggagcctgcacccaggtgtctggccccctgcctgtgaagtgtgtggcccggcccctgcccagcccctgtgcctggcagaacattgctgccagcacccaggccaatgaccccaccccagccctgactgtggcccgggccacagcccccagccccaccagcggcagcacagcccggcccatcagcagcagcatccggcagctgtgtggcagctcctggcagaggcggcggctgcccctggcctggcccagctggaggctgctgtggaggcgctacccctggtggaagcccctgcggagcaccctgtggccccggctgcggggcagccgctctgtggccgacagcgcccggctgcccctgtggcacctgcacagcctgctgctgaaggccctgcagcaccccctgaagcacctgtacatcctgtgccccttcctgttccccagccccccaccctgcaagttctag

SEQ ID NO: 18126 - DNA, 2691 bp, Artificial Sequence; identical to SEQ ID NO: 18124
  Description of Artificial Sequence: Synthetic coding sequence

SEQ ID NO: 18127 - DNA, 738 bp, Artificial Sequence
  Description of Artificial Sequence: Synthetic coding sequence
atgctggagagaggagctgagagcgctgctggggccacagaccccagccccaccgggaaggagcctgtgaccaaggaggccccccaccagggccccccccagaagcccagccagagcgcccctggccccacagccagcgctggcagccccccccggcccaggagaagacctccaccccagaggccccaccgctgcccagactgtgacaaggccttctcctaccccagcaagctggccacccaccggctggcccatggaggagcccggccccacccctgcccagactgccccaaggccttctcctaccccagcaagctggccgcccaccggctgacccacagcggggcccggccccacccctgcccccactgccccaagagctttggccacaggagcaagctggccgcccacctgtggacccacgcccccacccggccctacccctgcccagactgccccaagagcttctgctaccccagcaagctggccgcccaccgccacacccaccacgccacagatgcccggccctacccctgcccccactgccccaaggccttctccttccccagcaagctggccgcccaccggctgtgccacgaccccccaacagcccctggcagccaggccacagcctggcaccgctgcagcagctgtggccaggccttcggccagaggcggctgctgctgctgcaccagaggagccaccaccaggtggagcacaagggggagcgggactag

SEQ ID NO: 18128 - DNA, 1035 bp, Artificial Sequence
  Description of Artificial Sequence: Synthetic coding sequence
atgagcctggtgcccggcctgaccagcattgagcagccccagccccagctgctggaccagctgggcatcccccggcgctgcttccaggactgggtggaccagaatggcctgcccggcctgtctgtgacccagcagatccggggcatcaccctgctgcggcggctggagtgcagcaacaccatcatcgcccactgcagacatgagctgctgggcccccccaccctgagccccagcgcctggagcagccctgccagccccccaccccgggccctgcccctgggcagctgtgccagcaagatgctggagagaggagctgagagcgctgctggggccacagaccccagccccaccgggaaggagcctgtgaccaaggaggccccccaccagggccccccccagaagcccagccagagcgcccctggccccacagccagcgctggcagccccccccggccccggcggcggcccccaccccagaggccccaccgctgcccagactgtgacaaggccttctcctaccccagcaagctggccacccaccggctggcccacggcggggcccggccccacccctgcccagactgccccaaggccttctcctaccccagcaagctggccgcccaccggctgacccacagcggggcccggccccacccctgcccccactgccccaagagctttggccacaggagcaagctggccgcccacctgtggacccacgcccccacccggccctacccctgcccagactgccccaagagcttctgctaccccagcaagctggccgcccaccgccacacccaccacgccacagatgcccggccctacccctgcccccactgccccaaggccttctccttccccagcaagctggccgcccaccggctgtgccacgaccccccaacagcccctggcagccaggccacagcctggcaccgctgcagcagctgtggccaggccttcggccagaggcggctgctgctgctgcaccagaggagccaccaccaggtggagcacaagggggagcgggactag

SEQ ID NO: 18129 - DNA, 513 bp, Artificial Sequence
  Description of Artificial Sequence: Synthetic coding sequence
atggaggaccccaaccctgaggagaacatgaagcagcaggacagccccaaggagaggagcccccagagccctgggggcaacatctgccacctgggcgcccccaagtgcacccgctgcctgatcacctttgctgacagcaagttccaggagcggcacatgaagcgggagcaccctgctgactttgtggcccagaagctgcagggcgtgctcttcatctgcttcacctgtgcccgctccttccccagcagcaaggccctgatcacccaccagaggagccacggccctgctgccaagcccaccctgcctgtggccaccaccacagcccagcccaccttcccctgcccagactgtgggaagaccttcggccaggccgtgtccctgcggcggcaccggcagatgcatgaggtgcgggcccctcctggcacctttgcctgcacagaatgtggccaggactttgcccaggaggccggcctgcaccagcactacatcagacatgcccggggggagctgtag

SEQ ID NO: 18130 - DNA, 513 bp, Artificial Sequence; identical to SEQ ID NO: 18129
  Description of Artificial Sequence: Synthetic coding sequence

SEQ ID NO: 18131 - DNA, 513 bp, Artificial Sequence; identical to SEQ ID NO: 18129
  Description of Artificial Sequence: Synthetic coding sequence

SEQ ID NO: 18132 - DNA, 513 bp, Artificial Sequence; identical to SEQ ID NO: 18129
  Description of Artificial Sequence: Synthetic coding sequence

SEQ ID NO: 18133 - DNA, 513 bp, Artificial Sequence; identical to SEQ ID NO: 18129
  Description of Artificial Sequence: Synthetic coding sequence

SEQ ID NO: 18134 - DNA, 513 bp, Artificial Sequence; identical to SEQ ID NO: 18129
  Description of Artificial Sequence: Synthetic coding sequence

SEQ ID NO: 18135 - DNA, 1458 bp, Artificial Sequence
  Description of Artificial Sequence: Synthetic coding sequence
atgaagaatgccaccatcgtgatgtctgtgagaagagagcagggcagcagcagcggggagggcagcctgagctttgaagatgtggccgtgggcttcacccgggaggagtggcagttcctggaccagagccagaaggtgctgtacaaggaggtgatgctggagaactacatcaacctggtgtccatcggctaccggggcaccaagccagacagcctcttcaagctggagcagggcgagcccccaggcattgctgagggcgccgcccacagccagatctgccccggcttcgtcatccagagcagaagatatgctgggaaggacagtgatgcctttggaggctacggccgcagctgcctgcacatcaagagggacaagaccctgactggagtgaagtaccaccgctgtgtgaagcccagcagccccaagagccagctgaatgacctgcagaagatctgtgccggcggcaagccccatgaatgttctgtgtgtggccgggccttcagcaggaaggcccagctgatccagcaccagaggacagagcggggggagaagccccacggctgtggggagtgtgggaagaccttcatgaggaagatccagctgacagagcaccagaggacccacactggagagaagccccatgaatgttctgaatgtgggaaggccttcagcaggaagagccagctgatggtgcaccagaggacccacactggagagaagccctaccgctgcagcaaatgtgggaaggccttcagcaggaagtgccgcctgaacagacaccagaggagccacactggagagaagctgtatggctgcagcgtgtgtgggaaggccttcagccagaaggcctacctgacagcccaccagaggctgcacactggagacaagccctacaagtgcagcgactgtggccgcaccttctacttcaagagtgacctgaccaggcaccagaggatccacactggagagaagccctatgaatgttctgaatgtgagaaggccttccgcagcaagagcaagctgatccagcaccagaggacccacactggagagcggccctacagctgccgggagtgtgggaaggcctttgcccacatgtctgtgctgatcaagcatgagaagacccacatccgggagacagccatcaacagcctgactgtggagaagcccagcagccgcagccacaccagcctgtacatgtctgagctgatccaggagcagaagacagtgaacacagtgcccatcgagatgcccagcagcggcaccccacccctgctgaacaagtctgagcggctggtgggcagaaatgtggtgattgtggagcagcccttccccaggaaccaggcctttgtggtgaaccaggagtttgagcagaggatcagcctgaccaatgaggtgaatgtggcccccagcgtcatcaactacatcctgtacctgacagacatcgtgtctgagtag

SEQ ID NO: 18136 - DNA, 135 bp, Artificial Sequence
  Description of Artificial Sequence: Synthetic coding sequence
atgaagaatgccaccatcgtgatgtctgtgagaagagagcagggcagcagcagcggggagggcagcctgagctttgaagatgtggccgtgggcttcacccgggaggagtggcagttcctggaccagagccagtag

SEQ ID NO: 18137 - DNA, 177 bp, Artificial Sequence
  Description of Artificial Sequence: Synthetic coding sequence
atgaagaatgccaccatcgtgatgtctgtgagaagagagcagggcagcagcagcggggagggcagcctgagctttgaagatgtggccgtgggcttcacccgggaggagtggcagttcctggaccagagccagaaggtgctgtacaaggaggtgatgctggagaactacatcaactag

SEQ ID NO: 18138 - DNA, 189 bp, Artificial Sequence
  Description of Artificial Sequence: Synthetic coding sequence
atgaagaatgccaccatcgtgatgtctgtgagaagagagcagggcagcagcagcggggagggcagcctgagctttgaagatgtggccgtgggcttcacccgggaggagtggcagttcctggaccagagccagaaggtgctgtacaaggaggtgatgctggagaactacatcaacctggtgtccatctag

SEQ ID NO: 18139 - DNA, 1443 bp, Artificial Sequence
  Description of Artificial Sequence: Synthetic coding sequence
atgaagaatgccaccatcgtgatgtctgtgagaagagagcagggcagcagcagcggggagggcagcctgagctttgaagatgtggccgtgggcttcacccgggaggagtggcagttcctggaccagagccagaaggtgctgtacaaggaggtgatgctggagaactacatcaacctggtgtccatcggctaccggggcaccaagccagacagcctcttcaagctggagcagggcgagcccccaggcattgctgagggcgccgcccacagccagatctgccccggcttcgtcatccagagcagaagatatgctgggaaggacagtgatgcctttggaggctacggccgcagctgcctgcacatcaagagggacaagaccctgactggagtgaagtaccaccgctgtgtgaagcccagcagccccaagagccagctgaatgacctgcagaagatctgtgccggcggcaagccccatgaatgttctgtgtgtggccgggccttcagcaggaaggcccagctgatccagcaccagaggacagagcggggggagaagccccacggctgtggggagtgtgggaagaccttcatgaggaagatccagctgacagagcaccagaggacccacactggagagaagccccatgaatgttctgaatgtgggaaggccttcagcaggaagagccagctgatggtgcaccagaggacccacactggagagaagccctaccgctgcagcaaatgtgggaaggccttcagcaggaagtgccgcctgaacagacaccagaggagccacactggagagaagctgtatggctgcagcgtgtgtgggaaggccttcagccagaaggcctacctgacagcccaccagaggctgcacactggagacaagccctacaagtgcagcgactgtggccgcaccttctacttcaagagtgacctgaccaggcaccagaggatccacactggagagaagccctatgaatgttctgaatgtgagaaggccttccgcagcaagagcaagctgatccagcaccagaggacccacactggagagcggccctacagctgccgggagtgtgggaaggcctttgcccacatgtctgtgctgatcaagcatgagaagacccacatccgggagacagccatcaacagcctgactgtggagaagcccagcagccgcagccacaccagcctgtacatgtctgagctgatccaggagcagaagacagtgaacacagtgcccatcgagatgcccagcagcggcaccccacccctgctgaacaagtctgagcggctggtgggcagaaatgtggtgattgtggagcagcccttccccaggaaccaggcctttgtggtgaaccaggagtttgagcagaggatcagcctgaccaatgaggtgaatgtggcccccagcgtcatcaactacatcctgtacctgacctag

SEQ ID NO: 18140 - DNA, 1689 bp, Artificial Sequence
  Description of Artificial Sequence: Synthetic coding sequence
atggacccccagcccccacctccagcccagggcagccccccccaccggggccggggccggggccggggccggggccggggccggggccggggccggggccggggcggggccggggccccccgggcccccctgccctgccccacctgtggccgcctcttccgcttcccctactacctgagccgccaccggctgagccacagcggcctgcggccccacgcctgccccctgtgccccaaggccttccggcggcctgcccacctgagccgccacctgcggggccacggcccccagccccccctgcgctgtgccgcctgccccaggaccttccctgagcccgcccagctgcggcggcacctggcccaggagcacgccggcggggaggtggagctggccatcgagcgggtggccaaggagacagctgagcccagctggggcccccaggatgagggcagcgagccccccaccacagctgctgctggggccacagaggaggaggccgtggccgcctggccagagacctggccagctggggagcccagcaccctggccgcccccaccagcgctgctgagccccgggagagcgagagcgaggaggccgaggccggggctgctgagctgcgggcagagctggccctggccgccggccggcaggaggagaagcaggtgctgctgcaggccgactggaccctgctgtgcctgcgctgccgggaggcctttgccaccaagggggagctgaaggcccacccctgcctgcggcctgagggggagcaggagggggagggcggccccccaccccggcccaagaggcaccagtgcagcatctgcctgaaggcctttgcccggccctggagcctgagccgccaccggctggtgcacagcacagaccggccctttgtgtgcccagactgtggcctggccttccggctggccagctacctgcggcagcacagaagagtgcacggccccctgagcctgctggcccccctgcctgctgctgggaagaaggatgacaaggccagcggggccagaaattctgccaagggccctgagggcggggagggcgcagaatgtggcggggccagcgagggcggggagggccagaatggaggagatgctgccccagcccggcccccagctggggagccccgcttctggtgcccagaatgtgggaagggcttcagaagaagagcccacctgcggcagcacggcgtgacccacagcggggcccggcccttccagtgtgtgcgctgccagcgggagttcaagaggctggccgacctggcccggcatgcccaggtgcatgctgggggccctgccccccacccctgcccccgctgcccccggcgcttcagccgggcctacagcctgctgcggcaccagcgctgccacagagctgagctggagagagctgctgccctgcaggccctgcaggcccaggcccccaccagccccccacctcctcctccacccctgaaggccgagcaggaggaggagggcctgcccctgcccctggccaacatcaaggaggagccccccagccctggcaccccaccccagagccccccagcccctcctgtgttcctgagcgccagctgctttgacagccaggaccacagcgcctttgagatggaggaggaggaggtggacagcaaggcccacctgcggggcctgggcggcctggccagctag

SEQ ID NO: 18141 - DNA, 519 bp, Artificial Sequence
  Description of Artificial Sequence: Synthetic coding sequence
atgctgctgctgcccccccggcccccccaccccaggagcagcagccctgaggccatggaccccccaccacccaaggccccacccttccccaaggccgagggccccagcagcacccccagcagcgctgctggccccaggcctccccggctgggccgccacctgctgattgatgccaatggagtgccctacacctacacagtgcagctggaggaggagccccggggccccccccagcgggaggcccctcctggagagcccggccccaggaagggctacagctgcccagaatgtgcccgggtgtttgccagccccctgcggctgcagagccaccgggtgagccacagcgacctgaagcccttcacctgtggggcctgtgggaaggccttcaagaggagcagccacctgagccgccaccgggccacccaccgggcccgggccggccccccccacacctgccccctgtgcccccggcgcttccaggatgctgctgagctggcccagcacgtgcggctgcactag

SEQ ID NO: 18142 - DNA, 519 bp, Artificial Sequence; identical to SEQ ID NO: 18141
  Description of Artificial Sequence: Synthetic coding sequence

SEQ ID NO: 18143 - DNA, 519 bp, Artificial Sequence; identical to SEQ ID NO: 18141
  Description of Artificial Sequence: Synthetic coding sequence

SEQ ID NO: 18144 - DNA, 594 bp, Artificial Sequence
  Description of Artificial Sequence: Synthetic coding sequence
atgctggtgctgcccagcccctgcccccagcccctggccttcagctctgtggagaccatggagggcccccccaggaggacctgccgcagccctgagcccggccccagcagcagcatcggcagcccccaggccagcagccccccccggcccaaccactacctgctgattgacacccagggcgtgccctacacagtgctggtggatgaggagagccagcgggagcccggggccagcggggcccctggccagaagaagtgctacagctgccctgtgtgcagccgggtgtttgagtacatgagctacctgcagaggcacagcatcacccacagcgaggtgaagccctttgaatgtgacatctgtgggaaggccttcaagagggccagccacctggcccggcaccacagcatccacctggccggcggcggccggccccacggctgccccctgtgcccccggcgcttcagagatgctggggagctggcccagcacagccgggtgcacagcggggagcggcccttccagtgcccccactgcccccggcgcttcatggagcagaacaccctgcagaagcacacccgctggaagcacccctag

SEQ ID NO: 18145 - DNA, 1554 bp, Artificial Sequence
  Description of Artificial Sequence: Synthetic coding sequence
atgagcctgggcagcgagctgttcagagatgtggccatcgtgttcagccaggaggagtggcagtggctggccccagcccagagggacctgtacagagatgtgatgctggagacctacagcaacctggtgtccctgggcctggccgtgtccaagccagatgtgatctccttcctggagcagggcaaggagccctggatggtggagcgggtggtgtctgggggcctgtgccctgtgctggagagccgctatgacaccaaggagctgttccccaagcagcacgtgtatgaggtggagagcccccagtgggagatcatggagagcctgaccagctatggcctggagtgcagcagcttccaggatgactgggagtgcaggaaccagtttgaccggcagcagggcaacccagacagacacttccaccagatgatcatcagacatgaggagatgcccacctttgaccagcacgccagcctgaccttctaccagaagatccacacccgggagaagcccttcggctacaacaagtgcaggaaggacttctggcagaaggagctgctgatcaaccaccagggcatctacaccaatgagaagccctacaagtgcaaggaatgtgggaaggccttcaagtatggcagccgcctcatccagcacgagaacatccacagcggcaagaagccctatgagtgcaaggaatgtgggaaggccttcaacagcggcagcaacttcatccagcaccagagggtgcacactggagagaagccctatgagtgcaaggactgtgagaaggccttcagccgcagcagccagctgattgagcaccagaggacccacactggagagaagccctaccagtgcaaggaatgtgggaaggccttcaaccgcatcagccacctgaaggtgcactaccgcatccacactggagagaagccctatgcctgcaaggaatgtgggaagaccttcagccacaggagccagctgatccagcaccagacagtgcacacaggcaggaagctgtatgagtgcaaggaatgtgggaaggccttcaaccagggcagcaccctcatccgccaccagaggatccacactggagagaagccctatgagtgcaaggtgtgtgggaaggccttccgggtgagcagccagctgaagcagcaccagaggatccacactggagagaagccctaccagtgcaaggtgtgtggccgggccttcaagagggtgagccacctgactgtgcactaccgcatccacactggagagaagccctatgagtgcaaggaatgtgggaaggccttcagccactgcagccagctgatccaccaccaggtgatccacacagagaagaagccctatgagtacaaggaatgtgagaagaccctgagccatgacagcaccaccgtgcagccccagaggatgcacaaccgggagacccacgtgaacatcatcaacgtggagaagcccagcatcagcagctaccccctgctgatcatccgggagttcatgctggccagcaaccacatgaatggcagcaatggagagagccccctggcctag

SEQ ID NO: 18146 - DNA, 1710 bp, Artificial Sequence
  Description of Artificial Sequence: Synthetic coding sequence
atgagcaaggacctggtgacctttggagatgtggccgtgaacttcagccaggaggagtgggagtggctgaacccagcccagaggaacctgtacaggaaggtgatgctggagaactaccgcagcctggtgtccctgggcgtgtctgtgtccaagccagatgtgatcagcctgctggagcagggcaaggagccctggatggtgaagaaggagggcacccggggcccctgcccagactgggagtatgtgttcaagaacagcgagttcagcagcaagcaggagacctatgaggagagcagcaaggtggtgacagtgggcgcccggcacctgagctacagcctggactaccccagcctgcgggaggactgccagagcgaggactggtacaagaaccagctgggcagccaggaggtgcacctgagccagctgatcatcacccacaaggagatcctgcctgaggtgcagaacaaggagtacaacaagtcctggcagaccttccaccaggacaccatctttgacatccagcagagcttccccaccaaggagaaggcccacaagcatgagccccagaagaagagctacaggaagaagtctgtggagatgaagcacaggaaggtgtatgtggagaagaagctgctgaagtgcaatgactgtgagaaggtgttcaaccagagcagcagcctgaccctgcaccagaggatccacactggagagaagccctatgcctgtgtggagtgtgggaagaccttcagccagagcgccaacctggcccagcacaagaggatccacactggagagaagccctatgagtgcaaggagtgcaggaaggccttcagccagaatgcccacctggcccagcaccagagggtgcacactggagagaagccctaccagtgcaaggagtgcaagaaggccttcagccagatcgcccacctgacccagcaccagagggtgcacactggagagcggccctttgaatgtattgaatgtgggaaggccttcagcaatggcagcttcctggcccagcaccagaggatccacactggagagaagccctacgtgtgcaatgtgtgtgggaaggccttcagccaccggggctacctgattgtgcaccagaggatccacactggagagcggccctatgagtgcaaggagtgcaggaaggccttcagccagtatgcccacctggcccagcaccagagggtgcacactggagagaagccctatgagtgcaaggtgtgcaggaaggccttcagccagatcgcctacctggaccagcaccagagggtgcacactggagagaagccctatgaatgtattgaatgtgggaaggccttcagcaacagcagcagcctggcccagcaccagaggagccacactggagagaagccctacatgtgcaaggagtgcaggaagaccttcagccagaatgccggcctggcccagcaccagaggatccacactggagagaagccctatgaatgtaatgtgtgtgggaaggccttctcctacagcggcagcctgaccctgcaccagaggatccacactggagagcggccctatgagtgcaaggactgcaggaagagcttccggcagagggcccacctggcccaccacgagcgcatccacaccatggagagcttcctgaccctgagcagccccagccccagcaccagcaaccagctgcccaggcctgtgggcttcatctcctag

SEQ ID NO: 18147 - DNA, 1710 bp, Artificial Sequence; identical to SEQ ID NO: 18146
  Description of Artificial Sequence: Synthetic coding sequence

SEQ ID NO: 18148 - DNA, 414 bp, Artificial Sequence
  Description of Artificial Sequence: Synthetic coding sequence
atgagcaaggacctggtgacctttggagatgtggccgtgaacttcagccaggaggagtgggagtggctgaacccagcccagaggaacctgtacaggaaggtgatgctggagaactaccgcagcctggtgtccctgggcgtgtctgtgtccaagccagatgtgatcagcctgctggagcagggcaaggagccctggatggtgaagaaggagggcacccggggcccctgcccagactgggagtatgtgttcaagaacagcgagttcagcagcaagcaggagacctatgaggagagcagcaaggtggtgacagtgggcgcccggcacctgagctacagcctggactaccccagcctgcgggaggactgccagagcgaggactggtacaagaaccagctgggcagccaggaggtgtag

SEQ ID NO: 18149 - DNA, 390 bp, Artificial Sequence
  Description of Artificial Sequence: Synthetic coding sequence
atgagcaaggacctggtgacctttggagatgtggccgtgaacttcagccaggaggagtgggagtggctgaacccagcccagaggaacctgtacaggaaggtgatgctggagaactaccgcagcctggtgtccctgggcgtgtctgtgtccaagccagatgtgatcagcctgctggagcagggcaaggagccctggatggtgaagaaggagggcacccggggcccctgcccagactgggagtatgtgttcaagaacagcgagttcagcagcaagcaggagacctatgaggagagcagcaaggtggtgacagtgggcgcccggcacctgagctacagcctggactaccccagcctgcgggaggactgccagagcgaggactggtacaagtag

SEQ ID NO: 18150 - DNA, 1266 bp, Artificial Sequence
  Description of Artificial Sequence: Synthetic coding sequence
atggccggggaggccgaggcccagctggaccccagcctgcagggcctggtgatgtttgaagatgtgacagtgtacttcagccgggaggagtggggcctgctgaatgtgacccagaagggcctgtacagagatgtgatgctggagaactttgccctggtgagcagcctgggcctggcccccagccgcagccctgtgttcacccagctggaggatgatgagcagagctgggtgcccagctgggtggatgtgacccctgtgtccagagctgaggcccggcggggcttcggcctggatggcctgtgccgggtggaggatgagcgggcccaccctgagcacctgaagagctacagagtcatccagcaccaggacacccacagcgagggcaagcccaggaggcacacagagcacggggccgccttccccccaggcagcagctgtggccagcagcaggaggtgcacgtggccgagaagctgttcaagtgcagcgactgtgggaaggtgttcctgaaggcctttgccctgctggaccacctgatcacccacagcgaggagcggcccttccgctgccccaccggccgcagcgccttcaagaagagcgcccacatcaaccccaggaagatccacactggagaaacagcccacgtgtgcaatgaatgtgggaaggccttctcctaccccagcaagctgaggaagcaccagaaggtgcacacaggcatcaagcccttcaagtgcagcgactgtgggaagaccttcaacaggaaggatgccctggtgctgcaccagaggatccacactggagagcggccctatgaatgttccaaatgtgggaagaccttctctgtgctgagcaccctcatccgccacaggaaggtgcacatcggggagcggccctatgaatgtacagaatgtgggaagttcttcaagtacaacaacagcttcatcctgcaccagagggtgcacactggagagcggccctttgagtgcaagcagtgtgggaagggctacgtgaccaggagcggcctgtaccagcactggaaggtgcacactggagagcggccctatgaatgttccctgtgtgggaagaccttcaccaccaggagctacagaaacagacaccagcagttccacacagaggagaggagctatgaatgtacagaatgtgggaaggccttcaagcacagcagcaccctgctgcagcacaagaaggtgcacaccccagagcggcggcaggaggaccgggcccacggcaaggtggtgtcctgctag

SEQ ID NO: 18151 - DNA, 438 bp, Artificial Sequence
  Description of Artificial Sequence: Synthetic coding sequence
atggccggggaggccgagggcctggtgatgtttgaagatgtgacagtgtacttcagccgggaggagtggggcctgctgaatgtgacccagaagggcctgtacagagatgtgatgctggagaactttgccctggtgagcagcctgggcctggcccccagccgcagccctgtgttcacccagctggaggatgatgagcagagctgggtgcccagctgggtggatgtgacccctgtgtccagagctgaggcccggcggggcttcggcctgggccctgcctgcagctgcctgagcggcctgcggctgctgattgccctgctgtgcatctgtgccgagctgagcacagtgggggacagcgtgcgggtgctgaagtgtgcccacatcctgaagcagatggtgtgtgtggagtggaggatgagggagcccatcctgagcatctag

SEQ ID NO: 18152 - DNA, 924 bp, Artificial Sequence
  Description of Artificial Sequence: Synthetic coding sequence
cctggcagcagctgtggccagcagcaggaggtgcacgtggccgagaagctgttcaagtgcagcgactgtgggaaggtgttcctgaaggcctttgccctgctggaccacctgatcacccacagcgaggagcggcccttccgctgccccaccggccgcagcgccttcaagaagagcgcccacatcaaccccaggaagatccacactggagaaacagcccacgtgtgcaatgaatgtgggaaggccttctcctaccccagcaagctgaggaagcaccagaaggtgcacacaggcatcaagcccttcaagtgcagcgactgtgggaagaccttcaacaggaaggatgccctggtgctgcaccagaggatccacactggagagcggccctatgagtgcagcaaatgtgggaagaccttctctgtgctgagcaccctcatccgccacaggaaggtgcacatcggggagcggccctatgagtgcacagaatgtgggaagttcttcaagtacaacaacagcttcatcctgcaccagagggtgcacactggagagcggccctttgagtgcaagcagtgtgggaagggctacgtgaccaggagcggcctgtaccagcactggaaggtgcacactggagagcggccctatgagtgcagcctgtgtgggaagaccttcaccaccaggagctacagaaacagacaccagcagttccacacagaggagaggagctatgagtgcacagaatgtgggaaggccttcaagcacagcagcaccctgctgcagcacaagaaggtgcacaccccagagcggcccttcatctgcttcaactgtgggaagaacttcaacatgagcagctgcctggcctggcaccagaagctgcaccctggagagaagccctttgactacagcaaatgtaggaaggtgttcacctag

SEQ ID NO: 18153 - DNA, 2145 bp, Artificial Sequence
  Description of Artificial Sequence: Synthetic coding sequence
atgctggagacctacagccacctgctgtctgtgggctaccaggtgcctgaggccgaggtggtgatgctggagcagggcaaggagccctgggccctgcagggcgagcggccccggcagagctgccctggagagaagctgtgggaccacaaccagtgcaggaagatcctgagctacaagcaggtgagcagccagccccagaagatgtacccaggagagaaggcctatgaatgtgccaagtttgagaagatcttcacccagaagagccagctgaaggtgcacctgaaggtgctggccggggagaagctgtatgtgtgcattgaatgtgggaaggcctttgtgcagaagccagagttcatcatccaccagaagacccacatgagggagaagcccttcaagtgcaatgaatgtgggaagagcttcttccaggtgagcagcctcttccgccaccagaggatccacactggagagaagctgtatgagtgcagccagtgtgggaagggcttctcctacaacagcgacctgagcatccacgagaagatccacactggagagcggcaccacgagtgcacagactgtgggaaggccttcacccagaagagcaccctgaagatgcaccagaagatccacactggagagaggagctacatctgcattgaatgtggccaggccttcatccagaagacccacctgattgcccaccggcgcatccacactggagagaagccctatgagtgcagcaactgtgggaagagcttcatcagcaagagccagctgcaggtgcaccagagggtgcacaccagggtgaagccctacatctgcacagaatatggcaaggtgttcagcaacaacagcaacctggtgacccacaagaaggtgcagagccgggagaagagcagcatctgcacagaatgtgggaaggccttcacctacagaagtgagctgatcatccaccagaggatccacactggagagaagccctatgagtgcagcgactgtgggaaggccttcacccagaagagcgccctgactgtgcaccagaggatccacactggagagaagagctacatctgcatgaagtgtggcctggccttcatccagaaggcccacctgattgcccaccagatcatccacactggagagaagccccacaagtgtggccactgtgggaagctgttcaccagcaagagccagctgcacgtgcacaagaggatccacactggagagaagccctacatgtgcaacaagtgtgggaaggccttcaccaacagaagcaacctgatcacccaccagaagacccacactggagagaagagctacatctgcagcaaatgtgggaaggccttcacccagaggagtgacctgatcacccaccagaggatccacactggagagaagccctatgagtgcaacacctgtgggaaggccttcacccagaagagccacctgaacatccaccagaagatccacactggagagcggcagtatgagtgccatgaatgtgggaaggccttcaaccagaagagcatcctgattgtgcaccagaagatccacactggagagaagccctacgtgtgcacagaatgtggccgggccttcatcaggaagagcaacttcatcacccaccagaggatccacactggagagaagccctatgagtgcagcgactgtgggaagagcttcaccagcaagagccagctgctggtgcaccagcctgtgcacactggagagaagccctacgtgtgtgctgaatgtgggaaggccttcagcggccgcagcaacctgagcaagcaccagaagacccacactggagagaagccctacatctgcagtgaatgtgggaagaccttccggcagaagtctgagctgatcacccaccaccgcatccacactggagagaagccctatgagtgcagcgactgtgggaagagcttcaccaagaagagccagctgcaggtgcaccagaggatccacactggagagaagccctacgtgtgtgctgaatgtgggaaggccttcacagacaggagcaacctgaacaagcaccagaccacccacactggagacaagccctacaagtgtggcatctgtgggaagggctttgtgcagaagagcgtcttctctgtgcaccagagcagccacgcctag

SEQ ID NO: 18154 - DNA, 1221 bp, Artificial Sequence
  Description of Artificial Sequence: Synthetic coding sequence
atgctggagacctacagccacctgctgtctgtgggctaccaggtgcctgaggccgaggtggtgatgctggagcagggcaaggagccctgggccctgcagggcgagcggccccggcagagctgccctggagagaagctgtgggaccacaaccagtgcaggaagatcctgagctacaagcaggtgagcagccagccccagaagatgtacccaggagagaaggcctatgaatgtgccaagtttgagaagatcttcacccagaagagccagctgaaggtgcacctgaaggtgctggccggggagaagctgtatgtgtgcattgaatgtgggaaggcctttgtgcagaagccagagttcatcatccaccagaagacccacatgagggagaagcccttcaagtgcaatgaatgtgggaagagcttcttccaggtgagcagcctcttccgccaccagaggatccacactggagagaagctgtatgagtgcagccagtgtgggaagggcttctcctacaacagcgacctgagcatccacgagaagatccacactggagagcggcaccacgagtgcacagactgtgggaaggccttcacccagaagagcaccctgaagatgcaccagaagatccacactggagagaggagctacatctgcattgaatgtggccaggccttcatccagaagacccacctgattgcccaccggcgcatccacactggagagaagccctatgagtgcagcaactgtgggaagagcttcatcagcaagagccagctgcaggtgcaccagagggtgcacaccagggtgaagccctacatctgcacagaatatggcaaggtgttcagcaacaacagcaacctggtgacccacaagaaggtgcagagccgggagaagagcagcatctgcacagaatgtgggaaggccttcacctacagaagtgacctgatcacccaccaccgcatccacactggagagaagccctatgagtgcagcgactgtgggaagagcttcaccaagaagagccagctgcaggtgcaccagaggatccacactggagagaagccctacgtgtgtgctgaatgtgggaaggccttcacagacaggagcaacctgaacaagcaccagaccacccacactggagacaagccctacaagtgtggcatctgtgggaagggctttgtgcagaagagcgtcttctctgtgcaccagagcagccacgcctag

SEQ ID NO: 18155 - DNA, 2310 bp, Artificial Sequence
  Description of Artificial Sequence: Synthetic coding sequence
atgcctgccaactggaccagcccccagaagagcagcgccctggccccagaagatcatggcagcagctatgagggctctgtgtccttcagagatgtggccatcgacttcagccgggaggagtggaggcacctggaccccagccagaggaacctgtacagagatgtgatgctggagacctacagccacctgctgtctgtgggctaccaggtgcctgaggccgaggtggtgatgctggagcagggcaaggagccctgggccctgcagggcgagcggccccggcagagctgccctggagagaagctgtgggaccacaaccagtgcaggaagatcctgagctacaagcaggtgagcagccagccccagaagatgtacccaggagagaaggcctatgaatgtgccaagtttgagaagatcttcacccagaagagccagctgaaggtgcacctgaaggtgctggccggggagaagctgtatgtgtgcattgaatgtgggaaggcctttgtgcagaagccagagttcatcatccaccagaagacccacatgagggagaagcccttcaagtgcaatgaatgtgggaagagcttcttccaggtgagcagcctcttccgccaccagaggatccacactggagagaagctgtatgaatgttcccagtgtgggaagggcttctcctacaacagcgacctgagcatccacgagaagatccacactggagagcggcaccatgaatgtacagactgtgggaaggccttcacccagaagagcaccctgaagatgcaccagaagatccacactggagagaggagctacatctgcattgaatgtggccaggccttcatccagaagacccacctgattgcccaccggcgcatccacactggagagaagccctatgaatgtagcaactgtgggaagagcttcatcagcaagagccagctgcaggtgcaccagagggtgcacaccagggtgaagccctacatctgcacagaatatggcaaggtgttcagcaacaacagcaacctggtgacccacaagaaggtgcagagccgggagaagagcagcatctgcacagaatgtgggaaggccttcacctacagaagtgagctgatcatccaccagaggatccacactggagagaagccctatgaatgtagtgactgtgggaaggccttcacccagaagagcgccctgactgtgcaccagaggatccacactggagagaagagctacatctgcatgaagtgtggcctggccttcatccagaaggcccacctgattgcccaccagatcatccacactggagagaagccccacaagtgtggccactgcggcaagctgttcaccagcaagagccagctgcacgtgcacaagaggatccacactggagagaagccctacatgtgcaacaagtgtgggaaggccttcaccaacagaagcaacctgatcacccaccagaagacccacactggagagaagagctacatctgcagcaaatgtgggaaggccttcacccagaggagtgacctgatcacccaccagaggatccacactggagagaagccctatgagtgcaacacctgtgggaaggccttcacccagaagagccacctgaacatccaccagaagatccacactggagagcggcagtatgaatgtcatgaatgtgggaaggccttcaaccagaagagcatcctgattgtgcaccagaagatccacactggagagaagccctacgtgtgcacagaatgtggccgggccttcatcaggaagagcaacttcatcacccaccagaggatccacactggagagaagccctatgaatgtagtgactgtgggaagagcttcaccagcaagagccagctgctggtgcaccagcctgtgcacactggagagaagccctacgtgtgtgccgagtgtgggaaggccttcagcggccgcagcaacctgagcaagcaccagaagacccacactggagagaagccctacatctgcagtgaatgtgggaagaccttccggcagaagtctgagctgatcacccaccaccgcatccacactggagagaagccctatgaatgtagtgactgtgggaagagcttcaccaagaagagccagctgcaggtgcaccagaggatccacactggagagaagccctacgtgtgtgccgagtgtgggaaggccttcacagacaggagcaacctgaacaagcaccagaccacccacactggagacaagccctacaagtgtggcatctgtgggaaaggatttgtgcagaagtctgtgttttctgtgcaccagagcagccacgcctag

SEQ ID NO: 18156 - DNA, 2145 bp, Artificial Sequence; identical to SEQ ID NO: 18153
  Description of Artificial Sequence: Synthetic coding sequence

SEQ ID NO: 18157 - DNA, 1074 bp, Artificial Sequence
  Description of Artificial Sequence: Synthetic coding sequence
atgaagtgtggcctggccttcatcaggaaggcccacctgatcacccaccagatcatccacactggagagaagccctacaagtgtggccactgcggcaagctgttcaccagcaagagccagctgcacgtgcacaagaggatccacactggagagaagccctacgtgtgcaacaagtgtgggaaggccttcaccaacagaagcaacctgatcacccaccagaagacccacactggagagaagagctacatctgcagcaaatgtgggaaggccttcacccagaggagtgacctgatcacccaccagaggatccacactggagagaagccctatgagtgcaacacctgtgggaaggccttcacccagaagagcaacctgaacatccaccagaagatccacactggagagcggcagtatgaatgtcatgaatgtgggaaggccttcaaccagaagagcatcctgattgtgcaccagaagatccacactggagagaagccctacgtgtgcacagaatgtggccgggccttcatcaggaagagcaacttcatcacccaccagaggatccacactggagagaagccctatgaatgtagtgactgtgggaagagcttcaccagcaagagccagctgctggtgcaccagcctgtgcacactggagagaagccctacgtgtgtgccgagtgtgggaaggccttcagcggccgcagcaacctgagcaagcaccagaagacccacactggagagaagccctacatctgcagtgaatgtgggaagaccttccggcagaagtctgagctgatcacccaccaccgcatccacactggagagaagccctatgaatgtagtgactgtgggaagagcttcaccaagaagagccagctgcaggtgcaccagaggatccacactggagagaagccctacgtgtgtgccgagtgtgggaaggccttcagcaacagaagcaacctgaacaagcaccagaccacccacactggagacaagccctacaagtgtggcatctgtgggaaaggatttgtgcagaagtctgtgttttctgtgcaccagagcagccacgcctag

SEQ ID NO: 18158 - DNA, 2145 bp, Artificial Sequence
  Description of Artificial Sequence: Synthetic coding sequence
atgctggagacctacagccacctgctgtctgtgggctaccaggtgcccaagccagaggtggtgatgctggagcagggcaaggagccctgggccctgcagggcgagcggcccaggcacagctgccctggagagaagctgtgggaccacaaccagcacaggaagatcatcggctacaagccagccagcagccaggaccagaagatctacagcggggagaagagctatgaatgtgccgagtttgggaagagcttcacctggaagagccagttcaaggtgcacctgaaggtgcccaccggggagaagctgtatgtgtgcattgaatgtggccgggcctttgtgcagaagccagagttcatcacccaccagaagacccacatgagggagaagccctacaagtgcaatgaatgtgggaagagcttcttccaggtgagcagcctcttccgccaccaccgcatccacactggagagaagctgtatgagtgcagtgaatgtgggaagggcttcccctacaacagcgacctgagcatccacgagaagatccacactggagagcggcaccacgagtgcacagactgtgggaaggccttcacccagaagagcaccctgaagatccaccagaagatccacactggagagaggagctacatctgcattgaatgtggccaggccttcatccagaagacccagctgattgcccaccggcgcatccacagcggggagaagccctatgagtgcaacaactgtgggaagagcttcatcagcaagagccagctgcaggtgcaccagagggtgcacaccagggtgaagccctacatctgcacagaatatggcaaggtgttcagcaacaacagcaacctgatcacccatgagaagatccagagccgggagaagagcagcatctgcacagaatgtgggaaggccttcacctacagaagtgagctgatcatccaccagaggatccacactggagagaagccctatgagtgcagcgactgtggccgggccttcacccagaagagcgccctgactgtgcaccagaggatccacactggagagaagagctacatctgcatgaagtgtggcctggccttcatcaggaaggcccacctgatcacccaccagatcatccacactggagagaagccctacaagtgtggccactgtgggaagctgttcaccagcaagagccagctgcacgtgcacaagaggatccacactggagagaagccctacgtgtgcaacaagtgtgggaaggccttcaccaacagaagcaacctgatcacccaccagaagacccacactggagagaagagctacatctgcagcaaatgtgggaaggccttcacccagaggagtgacctgatcacccaccagaggatccacactggagagaagccctatgagtgcaacacctgtgggaaggccttcacccagaagagcaacctgaacatccaccagaagatccacactggagagcggcagtatgagtgccatgaatgtgggaaggccttcaaccagaagagcatcctgattgtgcaccagaagatccacactggagagaagccctacgtgtgcacagaatgtggccgggccttcatcaggaagagcaacttcatcacccaccagaggatccacactggagagaagccctatgagtgcagcgactgtgggaagagcttcaccagcaagagccagctgctggtgcaccagcctgtgcacactggagagaagccctacgtgtgtgctgaatgtgggaaggccttcagcggccgcagcaacctgagcaagcaccagaagacccacactggagagaagccctacatctgcagtgaatgtgggaagaccttccggcagaagtctgagctgatcacccaccaccgcatccacactggagagaagccctatgagtgcagcgactgtgggaagagcttcaccaagaagagccagctgcaggtgcaccagaggatccacactggagagaagccctacgtgtgtgctgaatgtgggaaggccttcagcaacagaagcaacctgaacaagcaccagaccacccacactggagacaagccctacaagtgtggcatctgtgggaagggctttgtgcagaagagcgtcttctctgtgcaccagagcagccacgcctag

SEQ ID NO: 18159 - DNA, 2310 bp, Artificial Sequence
  Description of Artificial Sequence: Synthetic coding sequence
atgcctgcctcctggaccagcccccagaagagcagcgccctggccccagaagatcatggcagcagctatgagggctctgtgtccttcagagatgtggccatcgacttcagccgggaggagtggaggcacctggacctgagccagaggaacctgtacagagatgtgatgctggagacctacagccacctgctgtctgtgggctaccaggtgcccaagccagaggtggtgatgctggagcagggcaaggagccctgggccctgcagggcgagcggcccaggcacagctgccctggagagaagctgtgggaccacaaccagcacaggaagatcatcggctacaagccagccagcagccaggaccagaagatctacagcggggagaagagctatgaatgtgccgagtttgggaagagcttcacctggaagagccagttcaaggtgcacctgaaggtgcccactggagagaagctgtatgtgtgcattgaatgtggccgggcctttgtgcagaagccagagttcatcacccaccagaagacccacatgagggagaagccctacaagtgcaatgaatgtgggaagagcttcttccaggtgagcagcctcttccgccaccaccgcatccacactggagagaagctgtatgaatgttctgaatgtgggaagggcttcccctacaacagcgacctgagcatccacgagaagatccacactggagagcggcaccatgaatgtacagactgtgggaaggccttcacccagaagagcaccctgaagatccaccagaagatccacactggagagaggagctacatctgcattgaatgtggccaggccttcatccagaagacccagctgattgcccaccggcgcatccacagcggggagaagccctatgagtgcaacaactgtgggaagagcttcatcagcaagagccagctgcaggtgcaccagagggtgcacaccagggtgaagccctacatctgcacagaatatggcaaggtgttcagcaacaacagcaacctgatcacccatgagaagatccagagccgggagaagagcagcatctgcacagaatgtgggaaggccttcacctacagaagtgagctgatcatccaccagaggatccacactggagagaagccctatgaatgtagtgactgtggccgggccttcacccagaagagcgccctgactgtgcaccagaggatccacactggagagaagagctacatctgcatgaagtgtggcctggccttcatcaggaaggcccacctgatcacccaccagatcatccacactggagagaagccctacaagtgtggccactgcggcaagctgttcaccagcaagagccagctgcacgtgcacaagaggatccacactggagagaagccctacgtgtgcaacaagtgtgggaaggccttcaccaacagaagcaacctgatcacccaccagaagacccacactggagagaagagctacatctgcagcaaatgtgggaaggccttcacccagaggagtgacctgatcacccaccagaggatccacactggagagaagccctatgagtgcaacacctgtgggaaggccttcacccagaagagcaacctgaacatccaccagaagatccacactggagagcggcagtatgaatgtcatgaatgtgggaaggccttcaaccagaagagcatcctgattgtgcaccagaagatccacactggagagaagccctacgtgtgcacagaatgtggccgggccttcatcaggaagagcaacttcatcacccaccagaggatccacactggagagaagccctatgaatgtagtgactgtgggaagagcttcaccagcaagagccagctgctggtgcaccagcctgtgcacactggagagaagccctacgtgtgtgccgagtgtgggaaggccttcagcggccgcagcaacctgagcaagcaccagaagacccacactggagagaagccctacatctgcagtgaatgtgggaagaccttccggcagaagtctgagctgatcacccaccaccgcatccacactggagagaagccctatgaatgtagtgactgtgggaagagcttcaccaagaagagccagctgcaggtgcaccagaggatccacactggagagaagccctacgtgtgtgccgagtgtgggaaggccttcagcaacagaagcaacctgaacaagcaccagaccacccacactggagacaagccctacaagtgtggcatctgtgggaaaggatttgtgcagaagtctgtgttttctgtgcaccagagcagccacgcctag

SEQ ID NO: 18160 - DNA, 195 bp, Artificial Sequence
  Description of Artificial Sequence: Synthetic coding sequence
atggctgctgctgctgccctgcgggccccagcccagagctctgtgacctttgaagatgtggccgtgaacttcagcctggaggagtggagcctgctgaatgaggcccagggctgcctgtaccatgatgtgatgctggagaccctgaccctcatcagcagcctgggctgctggctgcaggtggaggatggagcctag

SEQ ID NO: 18161 - DNA, 1080 bp, Artificial Sequence
  Description of Artificial Sequence: Synthetic coding sequence
atgctggagaccctgaccctcatcagcagcctgggctgctggcatggaggagaagatgaagctgcccccagcaagcagagcacctgcatccacatctacaaggaccagggcggccacagcggggagcggccctatgaatgtggggagtacaggaagctgttcaagaacaagagctgcctgacagagccccggcgggaccacaagcacagaaatgtgaggactggagagcggccctatgagtgcagcaaatatggcaagctgttccaccagaagcccaccctgcacatccacgagcgcttccacacaggccagaagacctatgagtgcagtgaatgtgggaagagcttccaccagagcagcagcctgctgcagaggcagaccctgcacacccgggagcggccctatgagtgcattgaatgtgggaaggcctttgctgagaagagcagcctcatcaaccacaggaaggtgcacagcggggccaagagatatgagtgcaatgaatgtgggaagagctttgcctacaccagcagcctcatcaagcaccggcgcatccacactggagagcggccctatgagtgcagtgaatgtggccgcagctttgctgagaacagcagcctcatcaagcacctgcgggtgcacactggagagcggccctatgaatgtgtggagtgtgggaagagcttcagaagaagcagcagcctgctgcagcaccagagggtgcacacccgggagcggccctatgagtgcagtgaatgtgggaagagcttcagcctgcggagcaacctgatccaccaccagagggtgcacactggagagagacatgaatgtggccagtgtgggaagagcttcagcaggaagagcagcctcatcatccacctgcgggtgcacactggagagcggccctatgaatgtagtgactgtgggaagagctttgctgagaacagcagcctcatcaagcacctgcgggtgcacactggagagcggccctatgaatgtattgactgtgggaagagcttccgccacagcagcagcttccgccgccaccagagggtgcacacaggcatgaggccctacaagtag

SEQ ID NO: 18162 - DNA, 633 bp, Artificial Sequence
  Description of Artificial Sequence: Synthetic coding sequence
atggctgctgctgctgccctgcgggccccagcccaggtggtgggcatggagggcaagatgaggcagcacctgctgagccgggcccgggtgtacatctacaccaagacccgggaggtgattgtggagaagggcctgatgtctgtgggcaacatcggcaactacctgcggaccagccctgccagcctgaaccctgaggagatcaccaacacaggcatgtttgccctggagaagggcctgatgtctgctgccaacatgggcaactacttcaccaagagcctgcacagcatcttcatgagggacttcatcctgggcaagaggcccatgtctgctgtgtctgtggagaaccacttcaccaaggccctgcacagctgcagcgtgcgccacttcaccctggagaagggcctgatgtctgtgctgaatgtgggcaagcccctgctgaagagccctgtgtccctgaccaccgggaagttcaccctggagcagagcgtgatgaatgccatgaatgtgggcagccccctgctgatccacctggtgtccctgaacacaggaggcttcaccctggagcggggcctgatgtctgctgtgaatgtgggggaccccctgctgaagacccctgtgctgctgaacacctag

SEQ ID NO: 18163 - DNA, 1209 bp, Artificial Sequence
  Description of Artificial Sequence: Synthetic coding sequence
atggctgctgctgctgccctgcgggccccagcccagagctctgtgacctttgaagatgtggccgtgaacttcagcctggaggagtggagcctgctgaatgaggcccagcgctgcctgtacagagatgtgatgctggagaccctgaccctcatcagcagcctgggctgctggcacggcggagaagatgaggccgcccccagcaagcagagcacctgcatccacatctacaaggaccagggcggccacagcggggagcggccctatgaatgtggggagtacaggaagctgttcaagaacaagagctgcctgacagagccccggcgggaccacaagcacagaaatgtgaggactggagagcggccctatgaatgttccaaatatggcaagctgttccaccagaagcccaccctgcacatccacgagcgcttccacacaggccagaagacctatgaatgttctgaatgtgggaagagcttccaccagagcagcagcctgctgcagaggcagaccctgcacacccgggagcggccctatgaatgtattgaatgtgggaaggcctttgctgagaagagcagcctcatcaaccacaggaaggtgcacagcggggccaagagatatgaatgtaatgaatgtgggaagagctttgcctacaccagcagcctcatcaagcaccggcgcatccacactggagagcggccctatgaatgttctgaatgtggccgcagctttgctgagaacagcagcctcatcaagcacctgcgggtgcacactggagagcggccctatgaatgtgtggagtgtgggaagagcttccgccgcagcagcagcctgctgcagcaccagagggtgcacacccgggagcggccctatgaatgttctgaatgtgggaagagcttcagcctgcggagcaacctgatccaccaccagagggtgcacactggagagagacatgaatgtggccagtgtgggaagagcttcagcaggaagagcagcctcatcatccacctgcgggtgcacactggagagcggccctatgagtgcagcgactgtgggaagagctttgctgagaacagcagcctcatcaagcacctgcgggtgcacactggagagcggccctatgagtgcatcgactgtgggaagagcttccgccacagcagcagcttcagaagacaccagagggtgcacacaggcatgaggccctacaagtag

SEQ ID NO: 18164 - DNA, 300 bp, Artificial Sequence
  Description of Artificial Sequence: Synthetic coding sequence
atggctgctgctgctgccctgcgggccccagcccagagctctgtgacctttgaagatgtggccgtgaacttcagcctggaggagtggagcctgctgaatgaggcccagggctgcctgtaccatgatgtgatgctggagaccctgaccctcatcagcagcctgaagggctgcacccggcagcagttctgcaacagaagcaccctgaacaaggaggacagagtcatctacaacctgcggcgcagccccagctgccgcttccccctgcccggcaccggcccccacatcctgtatgtgtcctag

SEQ ID NO: 18165 - DNA, 1209 bp, Artificial Sequence; identical to SEQ ID NO: 18163
  Description of Artificial Sequence: Synthetic coding sequence

SEQ ID NO: 18166 - DNA, 498 bp, Artificial Sequence
  Description of Artificial Sequence: Synthetic coding sequence
atggctgctgctgccccccggcggcccacccagggcaccgtgacctttgaagatgtggccgtgaagttcacccaggaggagtggaacctgctgtctgaggcccagcgctgcctgtacagagatgtgaccctggagaacctggccctgatgagcagcctgggctgctggtgtggggtggaggatgaagctgcccccagcaagcagagcatctacatccagcgggagacccaggtgaggacccctgtgactggagtgagccccaagaaggcccacccctgtgagatgtgtggccccatcctgggggacatcctgcacgtggccgaccaccagggcacccaccacaagcagaagctgcaccgctgtgaggcctggggcaacaagctgtatgattctggcaacttccaccagcaccagaatgagcacatcggggagaagccctaccggggctctgtggaggaggccctgtttgtgaagaggagcggccactgtgacctgtag

SEQ ID NO: 18167 - DNA, 1728 bp, Artificial Sequence
  Description of Artificial Sequence: Synthetic coding sequence
atggctgctgctgtgccccggcggcccacccagcagggcaccgtgacctttgaagatgtggccgtgaacttcagccaggaggagtggtgcctgctgtctgaggcccagcgctgcctgtacagagatgtgatgctggagaacctggccctgatcagcagcctgggctgctggtgtggcagcaaggatgaggaggccccctgcaagcagaggatctctgtgcagcgggagagccagagcaggaccccccgggccggcgtgagccccaagaaggcccacccctgtgagatgtgtggcctcatcctggaggatgtgttccactttgctgaccaccaggagacccaccacaagcagaagctgaacagaagtggggcctgtgggaagaacctggatgacacagcctacctgcaccagcaccagaagcagcacatcggggagaagttctacaggaagtctgtgcgggaggccagctttgtgaagaagaggaagctgcgggtgtcccaggagccctttgtgttccgggagtttgggaaggatgtgctgcccagcagcggcctgtgccaggaggaggccgctgtggagaagacagattctgagaccatgcacggcccccccttccaggagggcaagaccaactacagctgtgggaagaggaccaaggccttcagcaccaagcacagcgtcatcccccaccagaagctgttcaccagagatggctgctacgtgtgcagcgactgtgggaagagcttcagccgctacgtgtccttcagcaaccaccagagggaccacacagccaagggcccctatgactgtggggagtgtgggaagagctacagcaggaagagcagcctcatccagcaccagagggtgcacacaggccagacagcctacccctgtgaggagtgtgggaagagcttcagccagaagggcagcctcatcagccaccagctggtgcacactggagagggcccctatgaatgtcgggagtgtgggaagagctttggccagaagggcaacctgatccagcaccagcagggccacactggagagcgggcctaccactgtggggagtgtgggaagagcttccggcagaagttctgcttcatcaaccaccagagggtgcacactggagagcggccctacaagtgtggggagtgtgggaagagctttggccagaagggcaacctggtgcaccaccagaggggccacactggagagcggccctatgagtgcaaggaatgtgggaagagcttccgctaccgcagccacctgacagagcaccagaggctgcacactggagagcggccctacaactgccgggagtgtgggaagctgttcaacaggaagtaccacctgctggtgcatgagcgggtgcacactggagagcggccctatgcctgtgaggtgtgtgggaagctgtttggaaacaagcacagcgtgaccatccaccagaggatccacactggagagcggccctatgaatgttctgaatgtgggaagagcttcctgagcagcagcgccctgcacgtgcacaagagggtgcacagcggccagaagccctacaagtgcagtgaatgtgggaagagcttctctgaatgtagcagcctcatcaagcaccggcgcatccacactggagagcggccctatgaatgtaccaagtgtgggaagaccttccagaggagcagcaccctgctgcaccaccagagcagccacaggaggaaggccctgtag

SEQ ID NO: 18168 - DNA, 1599 bp, Artificial Sequence
  Description of Artificial Sequence: Synthetic coding sequence
atgctggagaacctggccctgatcagcagcctgggctgctggtgtggcagcaaggatgaggaggccccctgcaagcagaggatctctgtgcagcgggagagccagagcaggacccccagggctggggtgagccccaagaaggcccacccctgtgagatgtgtggcctcatcctggaggatgtgttccactttgctgaccaccaggagacccaccacaagcagaagctgaacagaagtggggcctgtgggaagaacctggatgacacagcctacctgcaccagcaccagaagcagcacatcggggagaagttctacaggaagtctgtgcgggaggccagctttgtgaagaagaggaagctgcgggtgtcccaggagccctttgtgttccgggagtttgggaaggatgtgctgcccagcagcggcctgtgccaggaggaggccgctgtggagaagacagacagcgagaccatgcacggcccccccttccaggagggcaagaccaactacagctgtgggaagaggaccaaggccttcagcaccaagcacagcgtcatcccccaccagaagctgttcaccagagatggctgctacgtgtgcagcgactgtgggaagagcttcagccgctacgtgtccttcagcaaccaccagagggaccacacagccaagggcccctatgactgtggagaatgtgggaagagctacagcaggaagagcagcctcatccagcaccagagggtgcacacaggccagacagcctacccctgtgaagaatgtgggaagagcttcagccagaagggcagcctcatcagccaccagctggtgcacactggagagggcccctatgagtgcagagaatgtgggaagagctttggccagaagggcaacctgatccagcaccagcagggccacactggagagcgggcctaccactgtggagaatgtgggaagagcttccggcagaagttctgcttcatcaaccaccagagggtgcacactggagagcggccctacaagtgtggagaatgtgggaagagctttggccagaagggcaacctggtgcaccaccagaggggccacactggagagcggccctatgagtgcaaggaatgtgggaagagcttccgctaccgcagccacctgacagagcaccagaggctgcacactggagagcggccctacaactgcagagaatgtgggaagctgttcaacaggaagtaccacctgctggtgcatgagcgggtgcacactggagagcggccctatgcctgtgaggtgtgtgggaagctgtttggaaacaagcacagcgtgaccatccaccagaggatccacactggagagcggccctatgagtgcagtgaatgtgggaagagcttcctgagcagcagcgccctgcacgtgcacaagagggtgcacagcggccagaagccctacaagtgcagtgaatgtgggaagagcttcagcgagtgcagcagcctcatcaagcaccggcgcatccacactggagagcggccctatgagtgcaccaagtgtgggaagaccttccagaggagcagcaccctgctgcaccaccagagcagccacaggaggaaggccctgtag

SEQ ID NO: 18169 - DNA, 1209 bp, Artificial Sequence
  Description of Artificial Sequence: Synthetic coding sequence
atggctgtggtggccaccctgcggctgagcgcccagggcaccgtgacctttgaagatgtggccgtgaagttcacccaggaggagtggaacctgctgtctgaggcccagcgctgcctgtacagagatgtgaccctggagaacctggccctgatgagcagcctgggctgctggtgtggggtggaggatgaggccgcccccagcaagcagagcatctacatccagcgggagacccaggtgaggacccctgtgactggagtgagccccaagaaggcccacccctgtgagatgtgtggccccatcctgggggacatcctgcacgtggccgaccaccagggcacccaccacaagcagaagctgcaccgctgtgaggcctggggcaacaagctgtatgacagcggcaacttccaccagcaccagaatgagcacatcggggagaagccctaccggggctctgtggaggaggccctgtttgtgaagcgctgcaagctgcacgtgtctggagagagcagcgtcttcagcgagagcggcaaggacttcctgcccaggagcggcctgctgcagcaggaggccagccacactggagagaagagcaacagcaagacagaatgtgtgagccccttccagtgtggcggggcccactacagccacggggacagcatgaagcacttcagcaccaagcacatcctgagccagcaccagaggctgctgccccgggaggagtgctacgtgtgctgtgaatgtgggaagagcttcagcaaatatgtgtccttcagcaaccaccagagggtgcacagcggcaagaggccctatgaatgtggggagtgtgagaagagcttcagccagaagagcagcctcatccagcaccagcagttccacactggaggcaagccctacggctgtgaggagtgtgggaagtacttcagcctggagggctacctgcggcggcaccagaaggtgcatgctgggaagggcccctatgaatgtggggagtgtgggaagagcttcagcagcaatgtgaacctgaagagccaccagaggatccacactggagagcggccctacaagtgtggggagtgtgagaagagcttcagcaggaagcccagcctgagctaccaccagagatttggccggccccgctgggtggaccacaaggacaggaaggagttcaagaccagcctgggcaacatcgtgaagagctgcctcttctag

SEQ ID NO: 18170 - DNA, 1860 bp, Artificial Sequence
  Description of Artificial Sequence: Synthetic coding sequence
atggctgctgctgtgccccggcggcccacccagcagggcaccgtgacctttgaagatgtggccgtgaacttcagccaggaggagtggtgcctgctgtctgaggcccagcgctgcctgtacagagatgtgatgctggagaacctggccctgatcagcagcctgggctgctggtgtggcagcaaggatgaggaggccccctgcaagcagaggatctctgtgcagcgggagagccagagcaggaccccccgggccggcgtgagccccaagaaggcccacccctgtgagatgtgtggcctcatcctggaggatgtgttccactttgctgaccaccaggagacccaccacaagcagaagctgaacagaagtggggcctgtgggaagaacctggatgacacagcctacctgcaccagcaccagaagcagcacatcggggagaagttctacaggaagtctgtgcgggaggccagctttgtgaagaagaggaagctgcgggtgtcccaggagccctttgtgttccgggagtttgggaaggatgtgctgcccagcagcggcctgtgccaggaggaggccgctgtggagaagacagattctgagaccatgcacggcccccccttccaggagggcaagaccaactacagctgtgggaagaggaccaaggccttcagcaccaagcacagcgtcatcccccaccagaagctgttcaccagagatggctgctacgtgtgcagcgactgtgggaagagcttcagccgctacgtgtccttcagcaaccaccagagggaccacacagccaagggcccctatgactgtggggagtgtgggaagagctacagcaggaagagcagcctcatccagcaccagagggtgcacacaggccagacagcctacccctgtgaggagtgtgggaagagcttcagccagaagggcagcctcatcagccaccagctggtgcacactggagagggcccctatgaatgtcgggagtgtgggaagagctttggccagaagggcaacctgatccagcaccagcagggccacactggagagcgggcctaccactgtggggagtgtgggaagagcttccggcagaagttctgcttcatcaaccaccagagggtgcacactggagagcggccctacaagtgtggggagtgtgggaagagctttggccagaagggcaacctggtgcaccaccagaggggccacactggagagcggccctatgagtgcaaggaatgtgggaagagcttccgctaccgcagccacctgacagagcaccagaggctgcacactggagagcggccctacaactgccgggagtgtgggaagctgttcaacaggaagtaccacctgctggtgcatgagcgggtgcacactggagagcggccctatgcctgtgaggtgtgtgggaagctgtttggaaacaagcacagcgtgaccatccaccagaggatccacactggagagcggccctatgaatgttctgaatgtgggaagagcttcctgagcagcagcgccctgcacgtgcacaagagggtgcacagcggccagaagccctacaagtgcagtgaatgtgggaagagcttctctgaatgtagcagcctcatcaagcaccggcgcatccacactggagagcggccctatgaatgtaccaagtgtgggaagaccttccagaggagcagcaccctgctgcaccaccgggtgcacactggagagcggccctatgagtgcagtgaatatggcaagagctttgctgaggccagccggctggtgaagcaccggcgggtgcacactggagagcggccctatgagtgctgccagtgtgggaagcaccagaatgtgtgctgccccaggagctag

SEQ ID NO: 18171 - DNA, 1269 bp, Artificial Sequence
  Description of Artificial Sequence: Synthetic coding sequence
atgattgacttccagatgctgaaccagctgtgcaggaccatcatcaaccccagcgtcatcccctgcctgaagtactgtggggaccagatcggccctgtgacctttgaagatgtggccgtgctcttcacagaagctgagtggaagaggctgagcctggagcagaggaacctgtacaaggaggtgatgctggagaacctgaggaacctggtgtccctggagagcaagccagaggtgcacacctgccccagctgccccctggccttcggcagccagcagttcctgagccaggatgagctgcacaaccaccccatccctggcttccacgccggcaaccagctgcaccctggcaacccctgcccagaggaccagccccagagccagcaccccagcgacaagaaccacagaggagctgaggccgaggaccagagggtggagggcggcgtgcggcccctcttctggagcaccaatgaaagaggagccctggtgggcttcagcagcctcttccagaggcctcccatcagctcctggggcggcaaccgcatcctggagatccagctgagccctgcccagaatgccagcagcgaggaggtggaccgcatcagcaagagagctgagaccccaggctttggagctgtgaccttcggggagtgtgccctggccttcaaccagaagagcaacctcttccggcagaaggctgtgacagctgagaagagcagtgacaagaggcagagccaggtgtgcagagaatgtggccggggcttcagcaggaagagccagctgatcatccaccagaggacccacactggagagaagccctacgtgtgtggagaatgtggccggggcttcatcgtggagagcgtgctgaggaaccacctgagcacccacagcggggagaagccctacgtgtgcagccactgcggccggggcttcagctgcaagccctacctgatccgccaccagaggacccacacccgggagaagagcttcatgtgcaccgtgtgtggccggggcttccgggagaagtctgagctgatcaagcaccagcagcgctgccaggtgacagtgcccctggaggagtggagcctgcacctgaccaccagcttctgcaactgtgtgctgcccctggcctccatgaccctgagctgcttcatcttcttctacatcagcagcctgtgctgcttcctgagctaccccaccttccgcttctacagcgagttcagcctgcagccctacaacctgcgggacaccttcaccaggagccccagctag

SEQ ID NO: 18172 - DNA, 1095 bp, Artificial Sequence
  Description of Artificial Sequence: Synthetic coding sequence
atgtgggccccccgggagcagctgctgggctggacagctgaggccctgcctgccaaggacagcgcctggccctgggaggagaagccccgctacctgggccctgtgacctttgaagatgtggccgtgctcttcacagaagctgagtggaagaggctgagcctggagcagaggaacctgtacaaggaggtgatgctggagaacctgaggaacctggtgtccctggccgagagcaagccagaggtgcacacctgccccagctgccccctggccttcggcagccagcagttcctgagccaggatgagctgcacaaccaccccatccctggcttccacgccggcaaccagctgcaccctggcaacccctgcccagaggaccagccccagagccagcaccccagcgacaagaaccacagaggagctgaggccgaggaccagagggtggagggcggcgtgcggcccctcttctggagcaccaatgaaagaggagccctggtgggcttcagcagcctcttccagaggcctcccatcagctcctggggcggcaaccgcatcctggagatccagctgagccctgcccagaatgccagcagcgaggaggtggaccgcatcagcaagagagctgagaccccaggctttggagctgtgacctttggagaatgtgccctggccttcaaccagaagagcaacctcttccggcagaaggctgtgacagctgagaagagcagtgacaagaggcagagccaggtgtgccgggagtgtggccggggcttcagcaggaagagccagctgatcatccaccagaggacccacactggagagaagccctacgtgtgtggggagtgtggccggggcttcatcgtggagagcgtgctgaggaaccacctgagcacccacagcggggagaagccctacgtgtgcagccactgcggccggggcttcagctgcaagccctacctgatccgccaccagaggacccacacccgggagaagagcttcatgtgcaccgtgtgtggccggggcttccgggagaagtctgagctgatcaagcaccagaggatccacactggagacaagccctacgtgtgccgggactag

SEQ ID NO: 18173 - DNA, 534 bp, Artificial Sequence
  Description of Artificial Sequence: Synthetic coding sequence
atgtgggccccccgggagcagctgctgggctggacagctgaggccctgcctgccaaggacagcgcctggccctgggaggagaagccccgctacctgggccctgtgacctttgaagatgtggccgtgctcttcacagaagctgagtggaagaggctgagcctggagcagaggaacctgtacaaggaggtgatgctggagaacctgaggaacctggtgtccctggagagcaagccagaggtgcacacctgccccagctgccccctggccttcggcagccagcagttcctgagccaggatgagctgcacaaccaccccatccctggcttccacgccggcaaccagctgcaccctggcaacccctgcccagaggaccagccccagagccagcaccccagcgacaagaaccacagaggagctgaggccgaggaccagagggtggagggcggcgtgcggcccctcttctggatcctggagctgggcagccccaggagcggcctgctgcccctggacctgaacctggacctgtggctgtag

SEQ ID NO: 18174 - DNA, 1095 bp, Artificial Sequence; identical to SEQ ID NO: 18172
  Description of Artificial Sequence: Synthetic coding sequence

SEQ ID NO: 18175 - DNA, 471 bp, Artificial Sequence
  Description of Artificial Sequence: Synthetic coding sequence
atgggccgcagcagaagaactggagcccaccgggcccacagcctggcccggcagatgaaggccaagagaagaagaccagacctggatgagatccaccgggagctgcggccccagggcagcgcccggccccagcctgaccccaatgctgagtttgatcctgacctgcccggcggcggcctgcaccgctgcctggcctgtgcccgctacttcatcgacagcaccaacctgaagacccacttccgcagcaaggaccacaagaagagatatgaaggagtgagaagaggcctgatggatggctgcagcgctgaccgggccctgacctggagcgcccccaacagctgcttctccttcagccaggccgaggccgctgagcggcgggccctgcagagcggccggggcggggagggcagcggctacggcatcctgtgtgccccccaggccgccggcagcgcccacggctctgtgcactag

SEQ ID NO: 18176 - DNA, 405 bp, Artificial Sequence
  Description of Artificial Sequence: Synthetic coding sequence
atgggccgcagcagaagaactggagcccaccgggcccacagcctggcccggcagatgaaggccaagagaagaagaccagacctggatgagatccaccgggagctgcggccccagggcagcgcccggccccagcctgaccccaatgctgagtttgatcctgacctgcccggcggcggcctgcaccgctgcctggcctgtgcccgctacttcatcgacagcaccaacctgaagacccacttccgcagcaaggaccacaagaagaggctgaagcagctgtctgtggagccctacagccaggaggaggccgagagagctgctggcatgggcagctatgtgcccccccggcggctggccgtgcccacagaggtgtccacagaggtgcctgagatggacaccagcacctag

SEQ ID NO: 18177 - DNA, 996 bp, Artificial Sequence
  Description of Artificial Sequence: Synthetic coding sequence
atgaatgtgaagaatgtgggcaagctgaaccagagcagtgacctgctgcggcaccaccgcatccacagcggggagaagccctacgtgtgcaacaagtgtggggagagcttccgcagcagcagtgacctgatcaagcaccaccgggtgcacactggagagaagccccatgaatgttctgaatgtgggaaggtgttcagccagaggagccacctggtgacccaccagaagatccacactggagagaagccctaccagtgcacagaatgtgagaaggccttcagaagaagaagcctgctgatccagaggcggcgcatccacagcggggagaagccctatgagtgcaaggaatgtgggaagctgttcatgtggcacacagccttcctgaagcaccagaggctgcatgctggggagaagctggaggagcgggagaagaccttcagcaaggatgaggagctgcggggggagcagaagatccaccaggaggagaaggcctactggtgcaaccagtgtggccgggccttccagggcagcagtgacctgattggccaccaggtgacccacactggagagaagccctatgagtgcaaggaatgtgggaagaccttcaaccagagcagtgacctgctgcggcaccaccgcatccacagcggggagaagccctacgtgtgcaacaagtgtgggaagagcttccggggcagcagtgacctgatccgccaccaccgggtgcacactggagagaagccctatgagtgcccagagtgctggaaggccttcagccagaacagccacctggtgagccaccagaggatccacacccgggagaagccctttgagtgcagcaactgtgggaaggccttcagcggctggacagccttcctgaagcaccagaagctgcacatcggcaaggagtttgaggactgcaagagcctgcagacaggccccatcctgattggcagcaggaacctgatgaatgctgtgaagctgggcaaggtgtag

SEQ ID NO: 18178 - DNA, 918 bp, Artificial Sequence
  Description of Artificial Sequence: Synthetic coding sequence
atgaatgtgaagaatgtgggcaagaaccagagcagtgacctgctgcggcaccaccgcatccacagcggggagaagccctgtgtgtgcagcaaatgtgggaagagcttccggggcagcagtgacctgatccgccaccaccgggtgcacactggagagaagccctatgagtgcagtgaatgtgggaaggccttcagccagaggagccacctggtgacccaccagaagatccacactggagagaagccctaccagtgcacagaatgtgggaaggccttcagaagaagaagcctgctgatccagcaccggcgcatccacagcggggagaagccctatgagtgcaaggaatgtgggaagctgttcatctggaggacagccttcctgaagcaccagagcctgcacactggagagaagctggagtgtgagaagaccttcagccaggatgaggagctgcggggggagcagaagatccaccaggaggccaaggcctactggtgcaaccagtgtggccgggccttccagggcagcagtgacctgatccgccaccaggtgacccacacccgggagaagccctatgagtgcaaggaatgtgggaagaccttcaaccagagcagtgacctgctgcggcaccaccgcatccacagcggggagaagccctacgtgtgcaacaagtgtgggaagagcttccggggcagcagtgacctgatcaagcaccaccgcatccacactggagagaagccctatgagtgcagtgaatgtgggaaggccttcagccagaggagccacctggccacccaccagaagatccacactggagagaagccctaccagtgcatggagtgtgggaagctgttcatgtggcacacagccttcctgaagcaccagaggctgcacgccggggagaagctggaggagtgctag

SEQ ID NO: 18179 - DNA, 2424 bp, Artificial Sequence
  Description of Artificial Sequence: Synthetic coding sequence
atgaaggagtggaagagcaagatggagatcagcgaggagaagaagagcgcccgggccgccagcgagaagctgcagaggcagatcacccaggagtgtgagctggtggagaccagcaacagtgaagatcggctgctgaagcactgggtgagccccctgaaggatgccatgaggcacctgcccagccaggagagcggcatccgggagatgcacatcatcccccagaaggccatcgtgggggagattggacatggctgcaatgaaggagagaagatcctgtctgctggggagagcagccacagatatgaggtgtctggccagaacttcaagcagaagagcggcctgacagagcaccagaagatccacaacatcaacaagacctatgagtgcaaggaatgtgagaagaccttcaacagaagcagcaacctgatcatccaccagaggatccacacaggcaacaagccctacgtgtgcaatgaatgtgggaaggacagcaaccagagcagcaacctgatcatccaccagaggatccacacaggcaagaagccctacatctgccatgaatgtgggaaggacttcaaccagagcagcaacctggtgcgccacaagcagatccacagcggcggcaacccctatgagtgcaaggaatgtgggaaggccttcaagggcagcagcaacctggtgctgcaccagaggatccacagccggggcaagccctacctgtgcaacaagtgtgggaaggccttcagccagagcacagacctgatcatccaccaccgcatccacactggagagaagccctatgagtgctatgactgtggccagatgttcagccagagcagccacctggtgccccaccagaggatccacactggagagaagcccctgaagtgcaatgaatgtgagaaggccttccggcagcacagccacctgacagagcaccagaggctgcacagcggggagaagccctatgagtgccaccgctgtgggaagaccttcagcggccgcacagccttcctgaagcaccagaggctgcacgccggggagaagattgaggagtgtgagaagaccttcagcaaggatgaggagctgcgggaggagcagaggatccaccaggaggagaaggcctactggtgcaaccagtgtggcaggaacttccagggcaccagtgacctgatccgccaccaggtgacccacactggagagaagccctatgagtgcaaggaatgtgggaagaccttcaaccagagcagtgacctgctgcggcaccaccgcatccacagcggggagaagccctgtgtgtgcagcaaatgtgggaagagcttccggggcagcagtgacctgatccgccaccaccgggtgcacactggagagaagccctatgaatgttctgaatgtgggaaggccttcagccagaggagccacctggtgacccaccagaagatccacactggagagaagccctaccagtgcacagaatgtgggaaggccttcagaagaagaagcctgctgatccagcaccggcgcatccacagcggggagaagccctatgagtgcaaggaatgtgggaagctgttcatctggaggacagccttcctgaagcaccagagcctgcacactggagagaagctggagtgtgagaagaccttcagccaggatgaggagctgcggggggagcagaagatccaccaggaggccaaggcctactggtgcaaccagtgtggccgggccttccagggcagcagtgacctgatccgccaccaggtgacccacacccgggagaagccctatgagtgcaaggaatgtgggaagaccttcaaccagagcagtgacctgctgcggcaccaccgcatccacagcggggagaagccctacgtgtgcaacaagtgtgggaagagcttccggggcagcagtgacctgatcaagcaccaccgcatccacactggagagaagccctatgaatgttctgaatgtgggaaggccttcagccagaggagccacctggccacccaccagaagatccacactggagagaagccctaccagtgcagtgaatgtggaaatgccttcagaagaagaagcctgctgatccagcaccggcggctgcacagcggggagaagccctatgagtgcaaggaatgtgggaagctgttcatgtggcacacagccttcctgaagcaccagaggctgcatgctggggagaagctggaggagtgtgagaagaccttcagcaaggatgaggagctgaggaaggagcagaggacccaccaggagaagaaggtgtactggtgcaaccagtgcagcaggaccttccagggcagcagtgacctgatccgccaccaggtgacccacacccgggagaagccctatgagtgcaaggaatgtgggaagacccagagcgagctgcggcccagcgagaccagctag

SEQ ID NO: 18180 - DNA, 1515 bp, Artificial Sequence
  Description of Artificial Sequence: Synthetic coding sequence
atgcccagcccagacagcatgacctttgaggacatcatcgtggacttcacccaggaggagtgggccctgctggacaccagccagaggaagctgttccaggatgtgatgctggagaacatcagccacctggtgtccatcggcaagcagctgtgcaagtctgtggtgctgagccagctggagcaggtggagaagctgagcacccagaggatcagcctgctgcagggccgggaggtgggcatcaagcaccaggagatccccttcatccagcacatctaccagaagggcaccagcaccatcagcaccatgaggagccacacccaggaggaccccttcctgtgcaatgacctgggggaggacttcacccagcacatcgccctgacccagaatgtcatcacctacatgaggaccaagcactttgtgtccaagaagtttgggaagatcttcagtgactggctgtccttcaaccagcacaaggagatccacaccaagtgcaagagctatggcagccacctgtttgattatgccttcatccagaacagcgccctgcggccccacagcgtgacccacacccgggagatcaccctggagtgccgggtgtgtgggaagaccttcagcaagaacagcaacctgcggagacatgagatgatccacactggagagaagccccacggctgccacctgtgtgggaaggccttcacccactgcagcgacctgaggaagcatgagaggacccacactggagagaagccctacggctgccacctgtgtgggaaggccttcagcaagagcagcaacctgcggagacatgagatgatccacacccgggagaaggcccagatctgccacctgtgtgggaaggccttcacccactgcagcgacctgaggaagcatgagaggacccacctgggggacaagccctacggctgcctgctgtgtgggaaggccttcagcaagtgcagctacctgcggcagcacgagaggacccacaacggggagaagccctatgagtgccacctgtgtgggaaggccttcagccactgcagccacctgcggcagcacgagaggagccacaacggggagaagccccacggctgccacctgtgtgggaaggccttcacagagagctctgtgctgaagagacatgagcgcatccacactggagagaagccctatgagtgccacgtgtgtgggaaggccttcacagagagcagtgacctgcggagacatgagaggacccacactggagagaagccctatgagtgccacctgtgtgggaaggccttcaaccacagctctgtgctgcggagacatgagaggacccacactggagagaagccctatgagtgcaacatctgtgggaaggccttcaacagaagctacaacttccggctgcaccggcgggtgcacactggagagaagccctacgtgtgccccctgtgtgggaaggccttcagcaagttcttcaacctgcggcagcacgagaggacccacaccaagaaggccatgaacatgtag

SEQ ID NO: 18181 - DNA, 1305 bp, Artificial Sequence
  Description of Artificial Sequence: Synthetic coding sequence
atgcccagcccagacagcatgacctttgaggacatcatcgtggacttcacccaggaggagtgggccctgctggacaccagccagaggaagctgttccaggatgtgatgctggagaacatcagccacctggtgtccatcggggaggacttcacccagcacatcgccctgacccagaatgtcatcacctacatgaggaccaagcactttgtgtccaagaagtttgggaagatcttcagtgactggctgtccttcaaccagcacaaggagatccacaccaagtgcaagagctatggcagccacctgtttgattatgccttcatccagaacagcgccctgcggccccacagcgtgacccacacccgggagatcaccctggagtgccgggtgtgtgggaagaccttcagcaagaacagcaacctgcggagacatgagatgatccacactggagagaagccccacggctgccacctgtgtgggaaggccttcacccactgcagcgacctgaggaagcatgagaggacccacactggagagaagccctacggctgccacctgtgtgggaaggccttcagcaagagcagcaacctgcggagacatgagatgatccacacccgggagaaggcccagatctgccacctgtgtgggaaggccttcacccactgcagcgacctgaggaagcatgagaggacccacctgggggacaagccctacggctgcctgctgtgtgggaaggccttcagcaagtgcagctacctgcggcagcacgagaggacccacaacggggagaagccctatgagtgccacctgtgtgggaaggccttcagccactgcagccacctgcggcagcacgagaggagccacaacggggagaagccccacggctgccacctgtgtgggaaggccttcacagagagctctgtgctgaagagacatgagcgcatccacactggagagaagccctatgagtgccacgtgtgtgggaaggccttcacagagagcagtgacctgcggagacatgagaggacccacactggagagaagccctatgagtgccacctgtgtgggaaggccttcaaccacagctctgtgctgcggagacatgagaggacccacactggagagaagccctatgagtgcaacatctgtgggaaggccttcaacagaagctacaacttccggctgcaccggcgggtgcacactggagagaagccctacgtgtgccccctgtgtgggaaggccttcagcaagttcttcaacctgcggcagcacgagaggacccacaccaagaaggccatgaacatgtag

SEQ ID NO: 18182 - DNA, 1515 bp, Artificial Sequence; identical to SEQ ID NO: 18180
  Description of Artificial Sequence: Synthetic coding sequence

SEQ ID NO: 18183 - DNA, 1275 bp, Artificial Sequence
  Description of Artificial Sequence: Synthetic coding sequence
atggcctccatgccacccaccccagaggcccagggccccatcctgtttgaggacctggccgtgtacttcagccaggaggagtgtgtgaccctgcacccagcccagaggagcctgagcaaggatggcaccaaggagagcctggaggatgctgccctgatgggagaggagggcaagccagagatcaaccagcagctgagcctggagagcatggagctggatgagctggccctggagaagtaccccatcgccgcccccctggtgccctacccagagaagagcagtgaagatggagtgggcaaccctgaggccaagatcctgagcggcacccccacctacaagagaagagtcatcagcctgctggtgaccatcgagaaccacacccccctggtggagctgtctgagtacctgggcaccaacaccctgtctgagatcctggacagcccctgggagggcgccaagaatgtgtacaagtgcccagaatgtgaccagaacttcagtgaccacagctacctggtgctgcaccagaagatccacagcggggagaagaagcacaagtgtggggactgtgggaagatcttcaaccaccgggccaacctgcggacccaccggcgcatccacactggagagaagccctacaagtgtgccaagtgcagcgccagcttccggcagcacagccacctgagccgccacatgaacagccacgtgaaggagaagccctacacctgcagcatctgtggccggggcttcatgtggctgcccggcctggcccagcaccagaagagccacagcgctgagaacacctatgagagcaccaactgtgacaagcacttcaatgagaagcccaacctggccctgcctgaggagacctttgtgtctggcccccagtaccagcacaccaagtgcatgaagagcttccggcagagcctgtacccagccctgtctgagaagagccatgatgaggacagcgagcgctgcagtgatgatggagacaacttcttctccttcagcaagttcaagcccctgcagtgcccagactgtgacatgaccttcccctgcttcagcgagctgatcagccaccagaacatccacacagaggagcggccccacaagtgcaagacctgtgaggagagctttgccctggacagcgagctggcctgccaccagaagagccacatgctggccgagcccttcaagtgcaccgtgtgtgggaagaccttcaagagcaacctgcacctgatcacccacaagaggacccacatcaagaacaccacctag

SEQ ID NO: 18184 - DNA, 1767 bp, Artificial Sequence
  Description of Artificial Sequence: Synthetic coding sequence
atggccgccccagccctggccctggtgtcctttgaagatgtggtggtgaccttcaccggggaggagtggggccacctggacctggcccagaggaccctgtaccaggaggtgatgctggagacctgccgcctgctggtgtccctgggccaccctgtgcccaagccagagctgatctacctgctggagcacggccaggagctgtggacagtgaagaggggcctgagccagagcacctgtgccggggagaaggccaagcccaagatcacagagcccacagccagccagctggccttcagcgaggagagcagcttccaggagctgctggcccagaggagcagccgggacagccggctgggccaggccagagatgaggagaagctgatcaagatccaggagggcaacctgcggcccggcaccaacccccacaaggagatctgcccagagaagctgagctacaagcatgatgacctggagccagatgacagcctgggcctgcgggtgctgcaggagcgggtgaccccccaggatgccctgcatgaatgtgacagccagggccctgggaaggaccccatgacagatgccaggaacaacccctacacctgcacagaatgtgggaagggcttcagcaagaagtgggccctggtgcgccaccagcagatccacgccggcgtgaagccctatgagtgcaatgaatgtgggaaggcctgccgctacatggctgatgtgatccgccacatgaggctgcacactggagagaagccctacaagtgcattgaatgtgggaaggccttcaagaggcgcttccacctgacagagcaccagaggatccacactggagacaagccctatgagtgcaaggaatgtgggaaggccttcacccacaggagcagcttcatccagcacaacatgacccacacccgggagaagcccttcctgtgcaaggaatgtgggaaggccttctactacagcagcagctttgcccagcacatgaggatccacacaggcaagaagctgtatgaatgtggagaatgtgggaaggccttcacccacaggagcaccttcatccagcacaacgtgacccacactggagagaagcccttcctgtgcaaggaatgtgggaagaccttctgcctgaacagcagcttcacccagcacatgaggatccacactggagagaagccctatgaatgtggagaatgtgggaaggccttcacccacaggagcaccttcatccgccacaagaggacccacactggagagaagccctttgagtgcaaggaatgtgggaaggccttctgtgacagcagcagcctcatccagcacatgaggatccacactggagagaagccctatgagtgcagtgaatgtgggaaggccttcacccaccacagcgtcttcatccgccacaacagaacccacagcggccagaagcccctggagtgcaaggaatgtgccaaggccttctactacagcagcagcttcaccaggcacatgaggatccacactggagagaagccctacgtgtgcagagaatgtgggaaggccttcacccagcctgccaactttgtgcgccacaaccgcatccacactggagagaagccctttgagtgcaaggaatgtgagaaggccttctgtgacaactttgccctgacccagcacatgaggacccacactggagagaagccctttgagtgcaatgaatgtgggaagaccttcagccacagcagcagcttcacccaccacaggaagatccacaccagggtgtag

SEQ ID NO: 18185 - DNA, 270 bp, Artificial Sequence
  Description of Artificial Sequence: Synthetic coding sequence
gccctggtgtcctttgaagatgtggtggtgaccttcaccggggaggagtggggccacctggacctggcccagaggaccctgtaccaggaggtgatgctggagacctgccgcctgctggtgtccctgggccaccctgtgcccaagccagagctgatctacctgctggagcacggccaggagctgtggacagtgaagaggggcctgagccagagcacctgtgccgccagcttcagcctgctgtggaagagctaccaccctggccacggctag

SEQ ID NO: 18186 - DNA, 927 bp, Artificial Sequence
  Description of Artificial Sequence: Synthetic coding sequence
tacacctgcacagaatgtgggaagggcttcagcaagaagtgggccctggtgcgccaccagcagatccacgccggcgtgaagccctatgagtgcaatgaatgtgggaaggcctgccgctacatggctgatgtgatccgccacatgaggctgcacactggagagaagccctacaagtgcattgaatgtgggaaggccttcaagaggcgcttccacctgacagagcaccagaggatccacactggagacaagccctatgagtgcaaggaatgtgggaaggccttcacccacaggagcagctttgcccagcacatgaggatccacacaggcaagaagctgtatgaatgtggagaatgtgggaaggccttcacccacaggagcaccttcatccagcacaacgtgacccacactggagagaagcccttcctgtgcaaggaatgtgggaagaccttctgcctgaacagcagcttcacccagcacatgaggatccacactggagagaagccctatgaatgtggagaatgtgggaaggccttcacccacaggagcaccttcatccgccacaagaggacccacactggagagaagccctttgagtgcaaggaatgtgggaaggccttctgtgacagcagcagcctcatccagcacatgaggatccacactggagagaagccctatgagtgcagtgaatgtgggaaggccttcacccaccacagcgtcttcatccgccacaacagaacccacagcggccagaagcccctggagtgcaaggaatgtgccaaggccttctactacagcagcagcttcaccaggcacatgaggatccacactggagagaagccctacgtgtgcagagaatgtgggaaggccttcacccagcctgccaactttgtgcgccacaaccgcatccacactggagagaagccctag

SEQ ID NO: 18187 - DNA, 1764 bp, Artificial Sequence
  Description of Artificial Sequence: Synthetic coding sequence
aaggccccagccagcgccctggtgtcctttgaagatgtggtggtgaccttcaccggggaggagtggggccacctggacctggcccagaggaccctgtaccaggaggtgatgctggagacctgccgcctgctggtgtccctgggccaccctgtgcccaagccagagctgatctacctgctggagcacggccaggagctgtggacagtgaagaggggcctgagccagagcacctgtgccggggagaaggccaagcccaagatcacagagcccacagccagccagctggccttcagcgaggagagcagcttccaggagctgctggcccagaggagcagccgggacagccggctgggccaggccagagatgaggagaagctgatcaagatccaggagggcaacctgcggcccggcaccaacccccacaaggagatctgcccagagaagctgagctacaagcatgatgacctggagccagatgacagcctgggcctgcgggtgctgcaggagcgggtgaccccccaggatgccctgcatgaatgtgacagccagggccctgggaaggaccccatgacagatgccaggaacaacccctacacctgcacagaatgtgggaagggcttcagcaagaagtgggccctggtgcgccaccagcagatccatgctggggtgaagccctatgaatgtaatgaatgtgggaaggcctgccgctacatggctgatgtgatccgccacatgaggctgcacactggagagaagccctacaagtgcattgaatgtgggaaggccttcaagaggcgcttccacctgacagagcaccagaggatccacactggagacaagccctatgagtgcaaggaatgtgggaaggccttcacccacaggagcagcttcatccagcacaacatgacccacacccgggagaagcccttcctgtgcaaggaatgtgggaaggccttctactacagcagcagctttgcccagcacatgaggatccacacaggcaagaagctgtatgaatgtggggagtgtgggaaggccttcacccacaggagcaccttcatccagcacaacgtgacccacactggagagaagcccttcctgtgcaaggaatgtgggaagaccttctgcctgaacagcagcttcacccagcacatgaggatccacactggagagaagccctatgaatgtggggagtgtgggaaggccttcacccacaggagcaccttcatccgccacaagaggacccacactggagagaagccctttgagtgcaaggaatgtgggaaggccttctgtgacagcagcagcctcatccagcacatgaggatccacactggagagaagccctatgaatgttctgaatgtgggaaggccttcacccaccacagcgtcttcatccgccacaacagaacccacagcggccagaagcccctggagtgcaaggaatgtgccaaggccttctactacagcagcagcttcaccaggcacatgaggatccacactggagagaagccctacgtgtgccgggagtgtgggaaggccttcacccagcctgccaactttgtgcgccacaaccgcatccacactggagagaagccctttgagtgcaaggaatgtgagaaggccttctgtgacaactttgccctgacccagcacatgaggacccacactggagagaagccctttgaatgtaatgaatgtgggaagaccttcagccacagcagcagcttcacccaccacaggaagatccacaccagggtgtag

SEQ ID NO: 18188 - DNA, 2169 bp, Artificial Sequence
  Description of Artificial Sequence: Synthetic coding sequence
atgatgaaggaggtgctgagcacaggccagggcaacacagaggtgatccacacaggcaccctgcagcgctaccagagctaccacatcggggacttctgcttccaggagattgagaaggagatccatgacatcgagttccagtgccaggaggatgaaagaaatggccacgaggcccccatgaccaagatcaagaagctgaccggcagcacagaccagcacgaccacagacatgctggcaacaagcccatcaaggaccagctgggcagcagcttctacagccacctgcctgagctgcacatcatccagatcaagggcaagattggcaaccagtttgagaagagcaccagtgatgcccccagcgtgtccaccagccagaggatcagcccccggccccagatccacatcagcaacaactacggcaacaacagccccaacagcagcctgctgccccagaagcaggaggtgtacatgagggagaagagcttccagtgcaatgaaagtggcaaggccttcaactgcagcagcctgctgaggaagcaccagatcccccacctgggggacaagcagtacaagtgtgatgtgtgtgggaagctgttcaaccacaagcagtacctgacctgccactgccgctgccacactggagagaagccctacaagtgcaatgaatgtgggaagagcttcagccaggtgagcagcctgacctgccaccggcggctgcacacagctgtgaagagccacaagtgcaatgaatgtgggaagatcttcggccagaacagcgccctggtgatccacaaggccatccacactggagagaagccctacaagtgcaatgaatgtgacaaggccttcaaccagcagagcaacctggcccggcaccggcgcatccacactggagagaagccctacaagtgtgaggagtgtgacaaggtgttcagcaggaagagcaccctggagagccacaagaggatccacactggagagaagccctacaagtgcaaggtgtgtgacacagccttcacctggaacagccagctggcccggcacaagaggatccacactggagagaagacctacaagtgcaatgaatgtgggaagaccttcagccacaagagcagcctggtgtgccaccaccggctgcacggcggggagaagagctacaagtgcaaggtgtgtgacaaggcctttgcctggaacagccacctggtgcgccacacccgcatccacagcggcggcaagccctacaagtgcaatgaatgtgggaagaccttcggccagaacagcgacctgctgatccacaagagcatccacactggagagcagccctacaagtatgaggagtgtgagaaggtgttcagctgtggcagcaccctggagacccacaagatcatccacactggagagaagccctacaagtgcaaggtgtgtgacaaggcctttgcctgccacagctacctggccaagcacacccgcatccacagcggggagaagccctacaagtgcaatgaatgttccaagaccttccggctgcggagctacctggccagccacagaagagtgcacagcggggagaagccctacaagtgcaatgaatgttccaagaccttcagccagaggagctacctgcactgccaccggcggctgcacagcggggagaagccctacaagtgcaatgaatgtgggaagaccttcagccacaagcccagcctggtgcaccaccggcggctgcacactggagagaagagctacaagtgcaccgtgtgtgacaaggcctttgtgagaaattcctacctggcccggcacacccgcatccacacagctgagaagccctacaagtgcaatgaatgtgggaaggccttcaaccagcagagccagctgagcctgcaccaccgcatccatgctggggagaagctgtacaagtgtgagacctgtgacaaggtgttcagcaggaagagccacctgaagaggcaccggcgcatccaccctgggaagaagccctacaagtgcaaggtgtgtgacaagacctttggaagtgacagccacctgaagcagcacacaggcctgcacactggagagaagccctacaagtgcaatgaatgtgggaaggccttcagcaagcagagcaccctcatccaccaccaggccgtgcacggcgtgggcaagctggactag

SEQ ID NO: 18189 - DNA, 1926 bp, Artificial Sequence
  Description of Artificial Sequence: Synthetic coding sequence
atgatccagagccagatcagctttgaagatgtggccgtggacttcaccctggaggagtggcagctgctgaaccccacccagaagaacctgtacagagatgtgatgctggagaactacagcaacctggtgttcctggaggtgtggctggacaaccccaagatgtggctgcgggacaaccaggacaacctgaagtccatggagcggggccacaagtatgatgtgtttgggaagatcttcaacagcagcatcaacatcgtgcacgtgggcctgcggagccacaagtgtggcactggagagaagagcctgaagtgcccctttgacctgctgatccccaagaacaactgtgagaggaagaagattgatgagctgaacaagaagctgctcttctgcatcaagccaggccgcacccatggaggcatcaagtactgtgactgcagcacctgcaggaagagcagcaatgaggagccctggctgacagccaaccacatcacccacactggagtgtacctgtgcatggagtgtggccgcttcttcaacaagaagagccagctggtgatccaccagaggacccacactggagagaagccctaccagtgcagtgaatgtgggaaggccttcagccagaagagcctgctgactgtgcaccagaggacccacagcggggagaagccccacggctgcagcgagtgccagaaggccttcagcaggaagagcctgctgatcctgcaccagaggatccacactggagagaagccctacggctgcagtgaatgtgggaaggccttcagcaggaagagccagctgaagaggcaccagatcacccacaccatcgagaagccctacagctgcagtgaatgtgggaaggccttcagccagaagctgaagctgatcacccaccagagggcccacactggagagaagccctacccctgcagccactgtgggaaggccttcttctggaagagccagctgatcacccaccagaggacccacacaggcaagaagccctacggctgtggggagtgccagaaggccttcagcaggaacagcctgctgatccgccaccagaggatccacactggagagaagccctatgagtgcaatgaatgtggggaggccttcatcaggaagccccagctgatcaagcaccagatcacccacactggagagaagaactaccgctgcagcgactgtgaggaggccttcttcaagaagtctgagctgatccgccaccagaagatccacctgggggagaagccctacggctgcatccagtgtgggaagaccttcttcggcaagagccagctgctgacccaccacaggacccacactggagagaagccctatgagtgcagtgaatgtgggaaggccttcacccagaagagcagcctcatcagccaccagaggacccacactggagagaagccctatgagtgcagtgaatgtaggaagaccttcagcgagaagagcagcctcatccaccaccagaggacccacactggagagaagccctttgagtgcagtgaatgtaggaaggcctttgcctggaagccccagctgctgcggcaccagaggatccacactggagagaagccctatgagtgcagtgaatgtgggaaggcctttgtgcagaaggtgcagctgatcaagcaccagaggaaccacactggagagaagacctacggctgcagcgactgtgccaaggccttctttgagaaggcccagctgatcatccaccagaggatccacactggagagcggccctacaagtgtggagaatgtgggaagagcttcaccaggaagagccacctgatgaggcaccagaggatccacactggagacaagtactacggctgcaatgaatgtggcaccaccttcaacaggaagagccagctgatgatccaccagaggaaccacatcatctag

SEQ ID NO: 18190 - DNA, 2019 bp, Artificial Sequence
  Description of Artificial Sequence: Synthetic coding sequence
atgatccagagccagatcagctttgaagatgtggccgtggacttcaccctggaggagtggcagctgctgaaccccacccagaagaacctgtacagagatgtgatgctggagaactacagcaacctggtgttcctgggcttccagatcctgaagccagatgccatgttcaagctggagcagcaggacccctggatcatcggccaggagatcctgaaccagaacttcagcgaggtgtggctggacaaccccaagatgtggctgcgggacaaccaggacaacctgaagtccatggagcggggccacaagtatgatgtgtttgggaagatcttcaacagcagcatcaacatcgtgcacgtgggcctgcggagccacaagtgtggcaccggggagaagagcctgaagtgcccctttgacctgctgatccccaagaacaactgtgagaggaagaagattgatgagctgaacaagaagctgctcttctgcatcaagccaggccgcacccacggcggcatcaagtactgtgactgcagcacctgcaggaagagcagcaatgaggagccctggctgacagccaaccacatcacccacactggagtgtacctgtgcatggagtgtggccgcttcttcaacaagaagagccagctggtgatccaccagaggacccacactggagagaagccctaccagtgcagtgaatgtgggaaggccttcagccagaagagcctgctgactgtgcaccagaggacccacagcggggagaagccccacggctgcagcgagtgccagaaggccttcagcaggaagagcctgctgatcctgcaccagaggatccacactggagagaagccctacggctgcagtgaatgtgggaaggccttcagcaggaagagccagctgaagaggcaccagatcacccacaccatcgagaagccctacagctgcagtgaatgtgggaaggccttcagccagaagctgaagctgatcacccaccagagggcccacactggagagaagccctacccctgcagccactgcggcaaggccttcttctggaagagccagctgatcacccaccagaggacccacacaggcaagaagccctacggctgtggggagtgccagaaggccttcagcaggaacagcctgctgatccgccaccagaggatccacactggagagaagccctatgaatgtaatgaatgtggggaggccttcatcaggaagccccagctgatcaagcaccagatcacccacactggagagaagaactaccgctgcagcgactgtgaggaggccttcttcaagaagtctgagctgatccgccaccagaagatccacctgggggagaagccctacggctgcatccagtgtgggaagaccttcttcggcaagagccagctgctgacccaccacaggacccacactggagagaagccctatgaatgttctgaatgtgggaaggccttcacccagaagagcagcctcatcagccaccagaggacccacactggagagaagccctatgaatgttctgagtgcaggaagaccttcagcgagaagagcagcctcatccaccaccagaggacccacactggagagaagccctttgaatgttctgagtgcaggaaggcctttgcctggaagccccagctgctgcggcaccagaggatccacactggagagaagccctatgaatgttctgaatgtgggaaggcctttgtgcagaaggtgcagctgatcaagcaccagaggaaccacactggagagaagacctacggctgcagcgactgtgccaaggccttctttgagaaggcccagctgatcatccaccagaggatccacactggagagcggccctacaagtgtggggagtgtgggaagagcttcaccaggaagagccacctgatgaggcaccagaggatccacactggagacaagtactacggctgcaatgaatgtggcaccaccttcaacaggaagagccagctgatgatccaccagaggaaccacatcatctag

SEQ ID NO: 18191 - DNA, 2091 bp, Artificial Sequence
  Description of Artificial Sequence: Synthetic coding sequence
atgtcctatggcagcatcacctttggagatgtggccatcgacttcagccaccaggagtgggagtacctgagcctggtgcagaagaccctgtaccaggaggtgatgatggagaactatgacaacctggtgtccctggccggccacagcgtgtccaagccagacctgatcaccctgctggagcagggcaaggagccctggatgattgtgcgggaggagaccagaggagagtgcacagacctggacagccgctgtgagatcatcagtgatggcaagatgcagctgtacaggaagcacagctgtgtgaccctgcaccagaggatccacaacggccagaagccctatgagtgcaagcagtgccagaagagcttcagccacctgacagagctgatggtgcaccagaccatccacaccagcgaggagccagaccagtgtgagaagttcaggaaggccttcagccacctgacagacctgaggaagcaccagaagatcaatgcccgggagaagccctatgaatgtgaggagtgtgggaaggtgttctcctacccagccaacctggcccagcacggcaaggtgcacgtggagaagccctatgagtgcaaggaatgtggggaggccttccgcaccagccggcagctgactgtgcaccaccgcttccactacggggagaagccctatgagtgcaaggaatgtgggaaggccttctctgtgtatggccgcctgagccgccaccagagcatccacactggagagaagccctttgagtgcaacaagtgtgggaagagcttccggctgaaggccggcctgaaggtgcaccagagcatccacactggagagaagccccatgagtgcaaggaatgtgggaaggccttccggcagttcagccacctggtgggccacaagaggatccacactggagagaagccctatgagtgcaaggaatgtgggaagggcttcacctgccgctaccagctgaccatgcaccagaggatctacagcggggagaagcactatgagtgcaaggaaaatggagaggccttcagcagcggccaccagctgacagccccccacacctttgagagcgtggagaagccctacaagtgtgaagaatgtgggaaggccttctctgtgcacggccgcctgaccaggcaccagggcatccacagcggcaagaagccctatgagtgcaacaagtgtgggaagagcttccggctgaacagcagcctgaagatccaccagaacatccacactggagagaagccctacaagtgcaaggaatgtgggaaggccttcagccagagggcccacctggcccaccacaaccgcatccacacaggctacaagccctttgagtgcaaggaatgtgggaagagcttccgctgtgccagctacctggtgattcatgagcgcatccacactggagagaagccctacgtgtgccaggagtgtgggaagggcttctcctacagccacaagctgaccatccaccggcgggtgcacactggagagaagccctatgagtgcaaggaatgtgggaaggccttctctgtgtctggccagctgacccagcacctgagcatccacagcggcaagaagccctttgagtgcaacaagtgtgggaagagcttccgcttcatctctgtgctgaaggcccaccagaacatccacagcgctgagaagccctatgagtgcaaggaatgtgggaaggccttcagacatgccaccagcctcatctaccatgacaggacccacgccggggagaagagctatgagtgcaaggaatgtggggagaccttcagccacgccagccacctgatcatccacgagcgcatccacaccagtgacaagccctatgagtgcaagagatgtgggaaggccttccactgtgccagctacctggtgagacatgaatctgtgcatgctgatggcaacccctacatgtgtgaagaatgtgggaaggccttcaacagcagccatgagctgagcatccaccaccgggtgcacactggagagaagcccttcaagtgcaacaagtgcagaagaagcttccggctgcggagcatcctggaggtgcaccagaggatccacatctag

SEQ ID NO: 18192 - DNA, 2088 bp, Artificial Sequence
  Description of Artificial Sequence: Synthetic coding sequence
atgtcctatggcagcatcacctttggagatgtggccatcgacttcagccaccaggagtgggagtacctgagcctggtgcagaagaccctgtaccaggaggtgatgatggagaactatgacaacctggtgtccctgggccacagcgtgtccaagccagacctgatcaccctgctggagcagggcaaggagccctggatgattgtgcgggaggagaccagaggagaatgtacagacctggacagccgctgtgagatcatcagtgatggcaagatgcagctgtacaggaagcacagctgtgtgaccctgcaccagaggatccacaacggccagaagccctatgagtgcaagcagtgccagaagagcttcagccacctgacagagctgatggtgcaccagaccatccacaccagcgaggagccagaccagtgtgagaagttcaggaaggccttcagccacctgacagacctgaggaagcaccagaagatcaatgcccgggagaagccctatgaatgtgaagaatgtgggaaggtgttctcctacccagccaacctggcccagcacggcaaggtgcacgtggagaagccctatgagtgcaaggaatgtggggaggccttccgcaccagccggcagctgactgtgcaccaccgcttccactatggagagaagccctatgagtgcaaggaatgtgggaaggccttctctgtgtatggccgcctgagccgccaccagagcatccacactggagagaagccctttgagtgcaacaagtgtgggaagagcttccggctgaaggccggcctgaaggtgcaccagagcatccacactggagagaagccccatgagtgcaaggaatgtgggaaggccttccggcagttcagccacctggtgggccacaagaggatccacactggagagaagccctatgagtgcaaggaatgtgggaagggcttcacctgccgctaccagctgaccatgcaccagaggatctacagcggggagaagcactatgagtgcaaggaaaatggagaggccttcagcagcggccaccagctgacagccccccacacctttgaatctgtggagaagccctacaagtgtgaggagtgtgggaaggccttctctgtgcacggccgcctgaccaggcaccagggcatccacagcggcaagaagccctatgagtgcaacaagtgtgggaagagcttccggctgaacagcagcctgaagatccaccagaacatccacactggagagaagccctacaagtgcaaggaatgtgggaaggccttcagccagagggcccacctggcccaccacaaccgcatccacacaggctacaagccctttgagtgcaaggaatgtgggaagagcttccgctgtgccagctacctggtgatccacgagcgcatccacactggagagaagccctacgtgtgccaggagtgtgggaagggcttctcctacagccacaagctgaccatccacagaagagtgcacactggagagaagccctatgagtgcaaggaatgtgggaaggccttctctgtgtctggccagctgacccagcacctgagcatccacagcggcaagaagccctttgagtgcaacaagtgtgggaagagcttccgcttcatctctgtgctgaaggcccaccagaacatccacagcgctgagaagccctatgagtgcaaggaatgtgggaaggccttcagacatgccaccagcctcatctaccatgacaggacccatgctggggagaagagctatgagtgcaaggaatgtggggagaccttcagccacgccagccacctgatcatccacgagcgcatccacaccagtgacaagccctatgagtgcaagagatgtgggaaggccttccactgtgccagctacctggtgagacatgagagcgtgcatgctgatggcaacccctacatgtgtgaggagtgtgggaaggccttcaacagcagccatgagctgagcatccaccaccgggtgcacactggagagaagcccttcaagtgcaacaagtgccgccgctccttccggctgcggagcatcctggaggtgcaccagaggatccacatctag

SEQ ID NO: 18193 - DNA, 4236 bp, Artificial Sequence
  Description of Artificial Sequence: Synthetic coding sequence
atgagcctgagcagcggggccagcggcggcaaaggagtggatgccaaccctgtggagacctatgattctggagatgagtgggacattggagtgggcaacctgatcatcgacctggatgctgacctggagaaggaccagcagaagctggagatgagcggcagcaaggaggtgggcatcccagccccaaatgctgtggccaccctgcctgacaacatcaagtttgtgacccctgtgcccggcccccagggcaaggagggcaagagcaagagcaagaggagcaagagcggcaaggacaccagcaagcccaccccaggcaccagcctcttcacccccagcgagggcgccgccagcaagaaggaggtgcagggccgctctggagatggagccaatgccggcggcctggtggccgccatcgcccccaagggcagcgagaaggccgccaaggccagccgctctgtggccggcagcaagaaggagaaggagaacagcagcagcaagagcaagaaggagaggtctgagggcgtgggcacctgcagcgagaaggaccccggggtgctgcagcctgtgcccctgggcggccggggcggccagtatgatggcagcgctggggtggacaccggggctgtggagcccctgggcagcatcgccatcgagcctggagctgccctgaaccccctgggcaccaagccagagcctgaggagggggagaatgaatgtcggctgctgaagaaggtgaagtctgagaagatggagagccctgtgtccaccccagctgtgctgcccatccacctgctggtgcctgtggtgaacaatgacatcagcagcccctgtgagcagatcatggtgaggaccaggtctgtgggcgtgaacacctgtgatgtggccctggccacagagccagaatgtctgggcccctgtgagcccggcacctctgtgaacctggagggcatcgtgtggcaggagacagaagatggcatgctggtggtgaatgtgacctggaggaacaagacctacgtgggcaccctgctggactgcaccaggcatgactgggccccaccccgcttctgtgacagccccaccagtgacctggagatgagaaatggccggggccggggcaagaggatgaggcccaacagcaacacccctgtgaatgaaacagccacagccagtgacagcaagggcaccagcaacagcagcaagaccagggctggggccaacagcaagggccggcggggcagccagaacagcagcgagcaccggcccccagccagcagcaccagtgaagatgtgaaggccagccccagcagcgccaacaagaggaagaacaagcccctgagtgacatggagctgaacagcagcagcgaggacagcaagggcagcaagagggtgaggaccaacagcatgggcagcgccaccggccccctgcccggcaccaaggtggagcccaccgtgctggacaggaactgccccagccctgtgctgattgactgcccccaccccaactgcaacaagaagtacaagcacatcaatggcctgaagtaccaccaggcccacgcccacacagatgatgacagcaagccagaggctgatggagacagtgaatatggagaggagcccatcctgcatgctgacctgggcagctgcaatggagcctctgtgtcccagaagggcagcctgagccctgcccggagcgccacccccaaggtgcggctggtggagccccacagccccagccccagcagcaagttcagcaccaagggcctgtgcaagaagaagctgagcggggagggggacacagacctgggcgccctgagcaatgatggcagtgatgatggccccagcgtgatggatgagaccagcaatgatgcctttgacagcctggagaggaagtgcatggagaaggagaagtgcaagaagcccagcagcctgaagccagagaagatccccagcaagagcctgaagagcgcccggcccatcgccccagccatccccccccagcagatctacaccttccagacagccaccttcaccgctgccagccctggcagcagcagcggcctgacagccaccgtggcccaggccatgcccaacagcccccagctgaagcccatccagcccaagcccaccgtgatgggagagcccttcaccgtgaacccagccctgaccccagccaaggacaagaagaagaaggacaagaagaagaaggagagcagcaaggagctggagagccccctgaccccaggcaaggtgtgcagagctgaggagggcaagagccccttccgggagagcagtggagatggcatgaagatggagggcctgctgaatggcagcagtgacccccaccagagccggctggccagcatcaaggccgaggccgacaagatctacagcttcacagacaatgcccccagccccagcattggaggcagcagccggctggagaacaccacccccacccagcccctgacccccctgcacgtggtgacccagaatggagctgaggccagctctgtgaagaccaacagccctgcctacagcgacatcagtgatgctggagaagatggagagggcaaggtggacagcgtgaagagcaaggatgctgagcagctggtgaaggagggcgccaagaagaccctcttccccccccagccccagagcaaggacagcccctactaccagggctttgagagctactacagccccagctatgcccagagcagccctggggccctgaaccccagcagccaggccggcgtggagagccaggccctgaagaccaagagagatgaggagcctgagagcattgagggcaaggtgaagaatgacatctgtgaggagaagaagccagagctgagcagcagcagccagcagcccagcgtcatccagcagaggcccaacatgtacatgcagagcctgtactacaaccagtatgcctacgtgcccccctacggctacagcgaccagagctaccacacccacctgctgagcaccaacacagcctaccggcagcagtatgaggagcagcagaagaggcagagcctggagcagcagcagaggggcgtggacaagaaggccgagatgggcctgaaggagcgggaggccgccctgaaggaggagtggaagcagaagcccagcatcccccccaccctgaccaaggcccccagcctgacagacctggtgaagagcggccctgggaaggccaaggagcccggggctgaccctgccaagagcgtcatcatccccaagctggatgacagcagcaagctgcccggccaggcccctgagggcctgaaggtgaagctgagtgatgccagccacctgagcaaggaggccagcgaggccaagacaggagcagaatgtggccggcaggccgagatggaccccatcctgtggtaccggcaggaggccgagcccaggatgtggacctacgtgtacccagccaagtacagcgacatcaagtcagaagatgagcgctggaaggaggagcgggacaggaagctgaaggaggagaggagccgcagcaaggacagcgtgcccaaggaggatggcaaggagagcaccagcagtgactgcaagctgcccaccagcgaggagagccggctgggcagcaaggagccccggcccagcgtgcacgtgcctgtgagcagccccctgacccagcaccagagctacatcccctacatgcacggctacagctacagccagagctatgaccccaaccaccccagctaccgctccatgcctgctgtgatgatgcagaactacccaggcagctacctgcccagcagctacagcttcagcccctacggcagcaaggtgtctggaggagaagatgctgacaaggcccgggccagccccagcgtgacctgcaagagcagcagcgagagcaaggccctggacatcctgcagcagcacgccagccactacaagagcaagagccccaccatcagtgacaagaccagccaggagcgggacagaggaggctgcggcgtggtgggcggcggcggcagctgcagctctgtgggcggggccagcggcggggagaggtctgtggaccggcccaggaccagccccagccagaggctgatgagcacccaccaccaccaccaccacctgggctacagcctgctgcctgcccagtacaacctgccctatgctgctggcctgagcagcacagccatcgtggccagccagcagggcagcacccccagcctgtaccccccacccaggaggtag

SEQ ID NO: 18194 - DNA, 1260 bp, Artificial Sequence
  Description of Artificial Sequence: Synthetic coding sequence
atgctgtgtgatgaggaggcccagaagaggaaggccaaggagagcggcatggccctgccccagggccgcctgaccttcatggatgtggccatcgagttcagccaggaggagtggaagagcctggaccccggccagagggccctgtacagagatgtgatgctggagaactacagaaacctggtgttcctgggccgcagctgtgtgctgggcagcaatgctgagaacaagcccatcaagaaccagctgggcctgaccctggaggcccacctgtctgagctgcagctgttccaggccggcaggaagatctaccgcagcaaccaggtggagaagttcaccaaccacaggagctctgtgagccccctgcagaagatcagcagcagcttcaccacccacatcttcaacaagtacagaaatgacctgattgacttccccctgctgccccaggaggagaaggcctacatccggggcaagagctatgaatatgagtgcagtgaagatggagaggtgttccgggtgcgggccagcctgaccaaccaccaggtgatccacacagctgagaagccctacaagtgcacagaatgtgggaaggtgttcagcaggaacagccacctggtggagcactggaggatccacacaggccagaagccctacaagtgcagtgaatgtgacaaggtgttcaacagaaacagcaacctggcccggcaccagaggatccacactggagagaagccccacaagtgcaatgaatgtgggaaggccttccgggagtgcagcggcctgaccacccacctggtgatccacactggagagaagccctacaagtgcaatgaatgtgggaagaacttccgccacaagttcagcctgaccaaccaccagaggagccacacagctgagaagccctacaagtgcaatgaatgtgggaaggtgttcagcctgctgagctacctggcccggcaccagatcatccacagcacagagaagccctacaagtgcaatgaatgtggccgggccttccacaagaggcctggcctgatggcccacctgctgatccacactggagagaagccctacaagtgcaatgaatgtgacaaggtgtttggaaggaagctgtacctgaccaaccaccagaggatccacactggagagcggccctacaagtgcaatgcctgtgggaaggtgttcaaccagaacccccacctgagccgccacaggaagatccacgccggggagaacagcctgcggaccctgcagatggagtag

SEQ ID NO: 18195 - DNA, 1389 bp, Artificial Sequence
  Description of Artificial Sequence: Synthetic coding sequence
atgctgtgtgatgaggaggcccagaagaggaaggccaaggagagcggcatggccctgccccagggccgcctgaccttcatggatgtggccatcgagttcagccaggaggagtggaagagcctggaccccggccagagggccctgtacagagatgtgatgctggagaactacagaaacctggtgttcctgggcatctgcctgcctgacctgagcatcatctccatgctgaagcagaggcgggagcccctcatcctgcagagccaggtgaagatcgtgaagaacacagatggaagagaatgtgtgcgctctgtgaacacaggccgcagctgtgtgctgggcagcaatgctgagaacaagcccatcaagaaccagctgggcctgaccctggaggcccacctgtctgagctgcagctgttccaggccggcaggaagatctaccgcagcaaccaggtggagaagttcaccaaccacaggagctctgtgagccccctgcagaagatcagcagcagcttcaccacccacatcttcaacaagtacagaaatgacctgattgacttccccctgctgccccaggaggagaaggcctacatccggggcaagagctatgaatatgaatgttctgaagatggagaggtgttccgggtgcgggccagcctgaccaaccaccaggtgatccacacagctgagaagccctacaagtgcacagaatgtgggaaggtgttcagcaggaacagccacctggtggagcactggaggatccacacaggccagaagccctacaagtgcagtgaatgtgacaaggtgttcaacagaaacagcaacctggcccggcaccagaggatccacactggagagaagccccacaagtgcaatgaatgtgggaaggccttcagagaatgttctggcctgaccacccacctggtgatccacactggagagaagccctacaagtgcaatgaatgtgggaagaacttccgccacaagttcagcctgaccaaccaccagaggagccacacagctgagaagccctacaagtgcaatgaatgtgggaaggtgttcagcctgctgagctacctggcccggcaccagatcatccacagcacagagaagccctacaagtgcaatgaatgtggccgggccttccacaagaggcctggcctgatggcccacctgctgatccacactggagagaagccctacaagtgcaatgaatgtgacaaggtgtttggaaggaagctgtacctgaccaaccaccagaggatccacactggagagcggccctacaagtgcaatgcctgtgggaaggtgttcaaccagaacccccacctgagccgccacaggaagatccatgctggggagaacagcctgcggaccctgcagatggagtag

SEQ ID NO: 18196 - DNA, 1389 bp, Artificial Sequence; identical to SEQ ID NO: 18195
  Description of Artificial Sequence: Synthetic coding sequence

SEQ ID NO: 18197 - DNA, 1260 bp, Artificial Sequence; identical to SEQ ID NO: 18194
  Description of Artificial Sequence: Synthetic coding sequence

SEQ ID NO: 18198 - DNA, 2118 bp, Artificial Sequence
  Description of Artificial Sequence: Synthetic coding sequence
atgctgcgggaggaggccgcccagaagaggaagggcaaggagcccggcatggccctgccccagggccgcctgaccttcagagatgtggccatcgagttcagcctggccgagtggaagtgcctgaaccccagccagagggccctgtaccgggaggtgatgctggagaactacagaaacctggaggccgtggacatcagcagcaagtgcatgatgaaggaggtgctgagcacaggccagggcaacacagaggtgatccacacaggcaccctgcagagacatgagagccaccacatcggggacttctgcttccaggagattgagaaggagatccatgacatcgagttccagtgccaggaggatgaaagaaatggcctggaggcccccatgaccaagatcaagaagctgaccggcagcacagaccagcacgaccacagacatgctggcaacaagcccatcaaggaccagctgggcagcagcttctacagccacctgcctgagctgcacatcttccagatcaagggggagatcggcaaccagctggagaagagcaccaatgatgcccccagcgtgtccaccttccagaggatcagctgccggccccagacccagatcagcaacaactacggcaacaaccccctgaacagcagcctgctgccccagaagcaggaggtgcacatgagggagaagagcttccagtgcaacaagagcggcaaggccttcaactgcagcagcctgctgaggaagcaccagatcccccacctgggggacaagcagtacaagtgtgatgtgtgtgggaagctgttcaaccacgagcagtacctggcctgccacgaccgctgccacacagtggagaagccctacaagtgcaaggaatgtgggaagaccttcagccaggagagcagcctgacctgccaccggcggctgcacactggagtgaagcgctacaactgcaatgaatgtgggaagatcttcggccagaacagcgccctgctgattgacaaggccatcgacaccggggagaacccctacaagtgcaatgaatgtgacaaggccttcaaccagcagagccagctgagccaccaccgcatccacactggagagaagccctacaagtgtgaggagtgtgacaaggtgttcagcaggaagagcaccatcgagacccacaagaggatccacactggagagaagccctaccgctgcaaggtgtgtgacacagccttcacctggcacagccagctggcccggcaccggcgcatccacacagccaagaagacctacaagtgcaatgaatgtgggaagaccttcagccacaagagcagcctggtgtgccaccaccggctgcacggcggggagaagagctacaagtgcaaggtgtgtgacaaggcctttgtgtggagcagccagctggccaagcacaccagaattgactgtggggagaagccctacaagtgcaatgaatgtgggaagaccttcggccagaacagcgacctgctgatccacaagagcatccacactggagagcagccctacaagtgtgatgaatgtgagaaggtgttcagcaggaagagcagcctggagacccacaagattggccacactggagagaagccctacaagtgcaaggtgtgtgacaaggcctttgcctgccacagctacctggccaagcacacccgcatccacagcggggagaagccctacaagtgcaatgaatgttccaagaccttcagccacaggagctacctggtgtgccaccaccgggtgcacagcggggagaagccctacaagtgcaatgaatgttccaagaccttcagcagaagaagcagcctgcactgccaccggcggctgcacagcggggagaagccctacaagtgcaatgaatgtggcaacaccttccgccactgcagcagcctcatctaccaccggcggctgcacactggagagaagagctacaagtgcaccatctgtgacaaggcctttgtgaggaacagcctgctgagccgccacacccgcatccacacagctgagaagccctacaagtgcaatgaatgtgggaaggccttcaaccagcagagccacctgagccgccaccaccgcatccacactggagagaagccctag

SEQ ID NO: 18199 - DNA, 1911 bp, Artificial Sequence
  Description of Artificial Sequence: Synthetic coding sequence
atgatgaaggaggtgctgagcacaggccagggcaacacagaggtgatccacacaggcaccctgcagagacatgagagccaccacatcggggacttctgcttccaggagattgagaaggagatccatgacatcgagttccagtgccaggaggatgaaagaaatggcctggaggcccccatgaccaagatcaagaagctgaccggcagcacagaccagcacgaccacagacatgctggcaacaagcccatcaaggaccagctgggcagcagcttctacagccacctgcctgagctgcacatcttccagatcaagggggagatcggcaaccagctggagaagagcaccaatgatgcccccagcgtgtccaccttccagaggatcagctgccggccccagacccagatcagcaacaactacggcaacaaccccctgaacagcagcctgctgccccagaagcaggaggtgcacatgagggagaagagcttccagtgcaacaagagcggcaaggccttcaactgcagcagcctgctgaggaagcaccagatcccccacctgggggacaagcagtacaagtgtgatgtgtgtgggaagctgttcaaccacgagcagtacctggcctgccacgaccgctgccacacagtggagaagccctacaagtgcaaggaatgtgggaagaccttcagccaggagagcagcctgacctgccaccggcggctgcacactggagtgaagcgctacaactgcaatgaatgtgggaagatcttcggccagaacagcgccctgctgattgacaaggccatcgacacaggagagaacccctacaagtgcaatgaatgtgacaaggccttcaaccagcagagccagctgagccaccaccgcatccacactggagagaagccctacaagtgtgaagaatgtgacaaggtgttcagcaggaagagcaccatcgagacccacaagaggatccacactggagagaagccctaccgctgcaaggtgtgtgacacagccttcacctggcacagccagctggcccggcaccggcgcatccacacagccaagaagacctacaagtgcaatgaatgtgggaagaccttcagccacaagagcagcctggtgtgccaccaccggctgcatggaggagagaagagctacaagtgcaaggtgtgtgacaaggcctttgtgtggagcagccagctggccaagcacaccagaattgactgtggggagaagccctacaagtgcaatgaatgtgggaagaccttcggccagaacagcgacctgctgatccacaagagcatccacactggagagcagccctacaagtgtgatgaatgtgagaaggtgttcagcaggaagagcagcctggagacccacaagattggccacactggagagaagccctacaagtgcaaggtgtgtgacaaggcctttgcctgccacagctacctggccaagcacacccgcatccacagcggggagaagccctacaagtgcaatgaatgttccaagaccttcagccacaggagctacctggtgtgccaccaccgggtgcacagcggggagaagccctacaagtgcaatgaatgttccaagaccttcagccgccgcagcagcctgcactgccaccggcggctgcacagcggggagaagccctacaagtgcaatgaatgtggcaacaccttccgccactgcagcagcctcatctaccaccggcggctgcacactggagagaagagctacaagtgcaccatctgtgacaaggcctttgtgaggaacagcctgctgagccgccacacccgcatccacacagctgagaagccctacaagtgcaatgaatgtgggaaggccttcaaccagcagagccacctgagccgccaccaccgcatccacactggagagaagccctag

SEQ ID NO: 18200 - DNA, 2118 bp, Artificial Sequence; identical to SEQ ID NO: 18198
  Description of Artificial Sequence: Synthetic coding sequence

SEQ ID NO: 18201 - DNA, 2118 bp, Artificial Sequence; identical to SEQ ID NO: 18198
  Description of Artificial Sequence: Synthetic coding sequence

SEQ ID NO: 18202 - DNA, 1854 bp, Artificial Sequence
  Description of Artificial Sequence: Synthetic coding sequence
atgatcaagagccaggagagcctgaccctggaggatgtggccgtggagttcacctgggaggagtggcagctgctgggccctgcccagaaggacctgtacagagatgtgatgctggagaactacagcaacctggtgtctgtgggctaccaggccagcaagccagatgccctcttcaagctggagcagggcgagccctggacagtggagaatgagatccacagccagatctgcccagagatcaagaaggtggacaaccacctgcagatgcacagccagaagcagcgctgcctgaagagggtggagcagtgccacaagcacaatgcctttggaaacatcatccaccagaggaagagtgacttccccctgcggcagaaccacgacacctttgacctgcacggcaagatcctgaagagcaacctgagcctggtgaaccagaacaagagatatgagatcaagaacagcgtgggcgtgaatggagatggcaagagcttcctgcacgccaagcatgagcagttccacaatgagatgaacttccctgagggcggcaacagcgtgaacaccaacagccagttcatcaagcaccagaggacccagaacatcgacaagccccacgtgtgcacagaatgtgggaaggccttcctgaagaagagccgcctcatctaccaccagagggtgcacactggagagaagccccacggctgcagcatctgtgggaaggccttcagcaggaagagcggcctgacagagcaccagaggaaccacactggagagaagccctatgaatgtacagaatgtgacaaggccttccgctggaagagccagctgaatgcccaccagaagatccacactggagagaagagctacatctgcagcgactgtgggaagggcttcatcaagaagagccgcctcatcaaccaccagagggtgcacactggagagaagccccacggctgcagcctgtgtgggaaggccttcagcaagaggagccggctgacagagcaccagaggacccacactggagagaagccctatgaatgtacagaatgtgacaaggccttccgctggaagagccagctgaatgcccaccagaaggcccacactggagagaagagctacatctgccgggactgtgggaagggcttcatccagaagggcaacctgattgtgcaccagaggatccacactggagagaagccctacatctgcaatgaatgtgggaagggcttcatccagaagggcaacctgctgatccacaggaggacccacactggagagaagccctacgtgtgcaatgaatgtgggaagggcttcagccagaagacctgcctgatcagccaccagcgcttccacacaggcaagaccccatttgtgtgcacagaatgtgggaagagctgcagccacaagagcggcctcatcaaccaccagaggatccacactggagagaagccctacacctgcagcgactgtgggaaggccttccgggacaagagctgcctgaacagacacaggaggacccacactggagagcggccctacggctgcagcgactgtgggaaggccttcagccacctgagctgcctggtgtaccacaagggcatgctgcacgcccgggagaagtgtgtgggctctgtgaagctggagaacccctgcagcgagagccacagcctgagccacacccgggacctgatccaggacaaggacagcgtgaacatggtgaccctgcagatgcccagcgtggccgcccagaccagcctgaccaacagcgccttccaggccgagagcaaggtggccatcgtgtcccagcctgtggcccggagctctgtgtctgctgacagccgcatctgcacagaatag

SEQ ID NO: 18203 - DNA, 1746 bp, Artificial Sequence
  Description of Artificial Sequence: Synthetic coding sequence
atgctggagaactacagcaacctggtgtctgtgggctaccaggccagcaagccagatgccctcttcaagctggagcagggcgagccctggacagtggagaatgagatccacagccagatctgcccagagatcaagaaggtggacaaccacctgcagatgcacagccagaagcagcgctgcctgaagagggtggagcagtgccacaagcacaatgcctttggaaacatcatccaccagaggaagagtgacttccccctgcggcagaaccacgacacctttgacctgcacggcaagatcctgaagagcaacctgagcctggtgaaccagaacaagagatatgagatcaagaacagcgtgggcgtgaatggagatggcaagagcttcctgcacgccaagcatgagcagttccacaatgagatgaacttccctgagggcggcaacagcgtgaacaccaacagccagttcatcaagcaccagaggacccagaacatcgacaagccccacgtgtgcacagaatgtgggaaggccttcctgaagaagagccgcctcatctaccaccagagggtgcacactggagagaagccccacggctgcagcatctgtgggaaggccttcagcaggaagagcggcctgacagagcaccagaggaaccacactggagagaagccctatgaatgtacagaatgtgacaaggccttccgctggaagagccagctgaatgcccaccagaagatccacactggagagaagagctacatctgcagcgactgtgggaagggcttcatcaagaagagccgcctcatcaaccaccagagggtgcacactggagagaagccccacggctgcagcctgtgtgggaaggccttcagcaagaggagccggctgacagagcaccagaggacccacactggagagaagccctatgaatgtacagaatgtgacaaggccttccgctggaagagccagctgaatgcccaccagaaggcccacactggagagaagagctacatctgccgggactgtgggaagggcttcatccagaagggcaacctgattgtgcaccagaggatccacactggagagaagccctacatctgcaatgaatgtgggaagggcttcatccagaagggcaacctgctgatccacaggaggacccacactggagagaagccctacgtgtgcaatgaatgtgggaagggcttcagccagaagacctgcctgatcagccaccagcgcttccacacaggcaagaccccatttgtgtgcacagaatgtgggaagagctgcagccacaagagcggcctcatcaaccaccagaggatccacactggagagaagccctacacctgcagcgactgtgggaaggccttccgggacaagagctgcctgaacagacacaggaggacccacactggagagcggccctacggctgcagcgactgtgggaaggccttcagccacctgagctgcctggtgtaccacaagggcatgctgcacgcccgggagaagtgtgtgggctctgtgaagctggagaacccctgcagcgagagccacagcctgagccacacccgggacctgatccaggacaaggacagcgtgaacatggtgaccctgcagatgcccagcgtggccgcccagaccagcctgaccaacagcgccttccaggccgagagcaaggtggccatcgtgtcccagcctgtggcccggagctctgtgtctgctgacagccgcatctgcacagaatag

SEQ ID NO: 18204 - DNA, 933 bp, Artificial Sequence
  Description of Artificial Sequence: Synthetic coding sequence
aagaggagccggctgacagagcaccagaggacccacactggagagaagccctatgaatgtacagaatgtgacaaggccttccgctggaagagccagctgaatgcccaccagaaggcccacactggagagaagagctacatctgccgggactgtgggaagggcttcatccagaagggcaacctgattgtgcaccagaggatccacactggagagaagccctacatctgcaatgaatgtgggaagggcttcatccagaagggcaacctgctgatccacaggaggacccacactggagagaagccctacgtgtgcaatgaatgtgggaagggcttcagccagaagacctgcctgatcagccaccagcgcttccacacaggcaagaccccatttgtgtgcacagaatgtgggaagagctgcagccacaagagcggcctcatcaaccaccagaggatccacactggagagaagccctacacctgcagcgactgtgggaaggccttccgggacaagagctgcctgaacagacacaggaggacccacactggagagcggccctacggctgcagcgactgtgggaaggccttcagccacctgagctgcctggtgtaccacaagggcatgctgcacgcccgggagaagtgtgtgggctctgtgaagctggagaacccctgcagcgagagccacagcctgagccacacccgggacctgatccaggacaaggacagcgtgaacatggtgaccctgcagatgcccagcgtggccgcccagaccagcctgaccaacagcgccttccaggccgagagcaaggtggccatcgtgtcccagcctgtggcccggagctctgtgtctgctgacagcagatttgcccagaacaagaaccacatgaatgctgtgaatgtggtggtgctgagcgtcatcaactacatcatctag

SEQ ID NO: 18205 - DNA, 1758 bp, Artificial Sequence
  Description of Artificial Sequence: Synthetic coding sequence
atgatcaagacccaggagagcctgaccctggaggatgtggccgtggagttctcctgggaggagtggcagctgctggacacagcccagaagaacctgtacagagatgtgatggtggagaactacaaccacctggtgtccctgggctaccagaccagcaagccagatgtgctgagcaagctggcccacggccaggagccctggaccacagatgccaagatccagaacaagaactgccccggcatcggcaaggtggacagccacctgcaggagcacagccccaaccagaggctgctgaagtctgtgcagcagtgcaatggccagaacaccctgagaaatattgtgcacctgagcaagacccacttccccatcgtgcagaaccacgacacctttgacctgtacaggaagaacctgaagagcagcctgagcctcatcaaccagaagagaagacatggcatcaacaaccctgtggagttcatcggcggggagaagaccctgctgcacggcaagcatgagaggacccacaccaagacccgcttctctgaaaatgccaagtgcatccacaccaagttccaggtgttcaagcaccagaggacccagaagattgagaagccccacgcctgcattgaatgtgagcagaccttcctgaggaagagccagctgatctaccacgagaacatctgcatccaggagaaccctggcagcggccagtgtgagaagctgagccgctctgtgctcttcaccaagcacctgaagaccaacaccacagacaagatctgcatccccaatgagtacaggaagggcagcacagtgaagagcagcctcatcacccaccagcagacccacacagaggagaagagctacatgtgcagtgaatgtgggaagggcttcaccatgaagcgctacctgattgcccaccagaggacccacagcggggagaagccctacgtgtgcaaggaatgtgggaagggcttcaccgtgaagagcaacctgattgtgcaccagaggacccacactggagagaagccctacatctgcagtgaatgtgggaagggcttcaccatgaagcgctacctggtggtgcaccagaggacccacactggagagaagccctacatgtgcagtgaatgtgggaagggcttcaccgtgaagagcaacctgattgtgcaccagaggagccacactggagagaagagctacatctgcagtgaatgtgggaagggcttcaccgtgaagaggaccctggtgatccaccagaggacccacactggagagaagagctacatctgcaatgaatgtgggaagggcttcaccaccaagaggaccctcatcatccaccagaggacccacactggagagaagccctatgagtgcaatgaatgtgggaaggccttcagccagaagatctgcctgatccagcacgagcgctgccacacaggcaagaccccatttgtgtgcacagaatgtgggaagagctacagccacaagtatggcctcatcacccaccagaggatccacactggagagaagccctatgagtgcaatgaatgtgggaaggccttcaccaccaagtctgtgctgaatgtgcaccagaggacccacactggagagcggccctacggctgcagcgactgtgagaaggccttcagccacctgagcaacctggtgaagcacaagaagatgcacacccgggagatgggccgcatcagccaggtggagaacagctgcaatggagagagccagctgctgccctacaagtag

SEQ ID NO: 18206 - DNA, 597 bp, Artificial Sequence
  Description of Artificial Sequence: Synthetic coding sequence
atgatcaagacccaggagagcctgaccctggaggatgtggccgtggagttctcctgggaggagtggcagctgctggacacagcccagaagaacctgtacagagatgtgatggtggagaactacaaccacctggtgtccctgggctaccagaccagcaagccagatgtgctgagcaagctggcccacggccaggagccctggaccacagatgccaagatccagaacaagaactgccccggcatcggcaaggtggacagccacctgcaggagcacagccccaaccagaggctgctgaagtctgtgcagcagtgcaatggccagaacaccctgagaaatattgtgcacctgagcaagacccacttccccatcgtgcagaaccacgacacctttgacctgtacaggaagaacctgaagagcagcctgagcctcatcaaccagaagagaagacatggcatcaacaaccctgtggagttcatcggggagaccggcagcctggagcggccccggcaggccgaccacctgcggtctgaggtgcaggaccagcccggccagagaggagagaccctgtgcctgctgaagatccacaccaagaactag

SEQ ID NO: 18207 - DNA, 2226 bp, Artificial Sequence
  Description of Artificial Sequence: Synthetic coding sequence
atgacagcccaggagagcctgaccctggaggatgtggccgtggacttcacctgggaggagtggcagttcctgagccctgcccagaaggacctgtacagagatgtgatgctggagaactacagcaacctggtggccgtgggctaccaggccagcaagccagatgccctgagcaagctggagcggggggaggagacctgcaccacagaagatgagatctacagccgcatctgcagcgacagcggcggggccagcggcggggcctatgcagagatcaggaagattgatgaccccctgcagcaccacctgcagaaccagagcatccagaagtctgtgaagcagtgccacgagcagaacatgtttggaaatattgtgaaccagaacaagggccacttcctgctgaagcaggactgtgacacctttgacctgcacgagaagcccctgaagagcaacctgagctttgagaaccagaagaggagcagcggcctgaagaacagcgctgagttcaacagagatggcaagagcctcttccacgccaaccacaagcagttctacacagagatgaagtttcctgccatcgccaagcccatcaacaagagccagttcatcaagcagcagaggacccacaacattgaaaatgcccacgtgtgcagtgaatgtgggaaggccttcctgaagctgagccagttcatcgaccaccagagggtgcacactggagagaagccccacgtgtgcagcatgtgtgggaaggccttcagcaggaagagccggctgatggaccaccagaggacccacacagagctgaagcactatgaatgtacagaatgtgacaagaccttcctgaagaagagccagctgaacatccaccagaagacccacatgggcggcaagccctacacctgcagccagtgtgggaaggccttcatcaagaagtgccgcctcatctaccaccagaggacccacactggagagaagccccacggctgcagcgtgtgtgggaaggccttcagcaccaagttcagcctgaccacccaccagaagacccacactggagagaagccctacatctgcagtgaatgtgggaagggcttcatcgagaagaggcggctgacagcccaccacaggacccacactggagagaagcccttcatctgcaacaagtgtgggaagggcttcaccctgaagaacagcctcatcacccaccagcagacccacactggagagaagctgtacacctgcagtgaatgtgggaagggcttctccatgaagcactgcctgatggtgcaccagaggacccacactggagagaagccctacaagtgcaatgaatgtgggaaaggatttgccctgaagagccccctcatccgccaccagaggacccacactggagagaagccctacgtgtgcacagagtgcaggaagggcttcaccatgaagagtgacctgattgtgcaccagaggacccacacagctgagaagccctacatctgcaatgactgtgggaagggcttcaccgtgaagagccgcctcatcgtgcaccagaggacccacactggagagaagccctacgtgtgtggggagtgtgggaagggcttccctgccaagatccggctgatgggccaccagaggacccacactggagagaagccctacatctgcaatgaatgtgggaagggcttcacagagaagagccacctgaatgtgcacaggaggacccacactggagagaagccctacgtgtgcagtgaatgtgggaagggcctgaccgggaagtccatgctgattgcccaccagaggacccacactggagagaagccctacatctgcaatgaatgtgggaagggcttcaccatgaagagcaccctgagcatccaccagcagacccacactggagagaagccctacaagtgcaatgaatgtgacaagaccttcaggaagaagacctgcctgatccagcaccagcgcttccacacaggcaagaccagctttgcctgcacagaatgtgggaagttcagcctgaggaagaatgacctgatcacccaccagaggatccacactggagagaagccctacaagtgcagcgactgtgggaaggccttcaccaccaagagcggcctgaatgtgcaccagaggaagcacactggagagcggccctacggctgcagcgactgtgggaaggcctttgcccacctgagcatcctggtgaagcaccggcgcatccacaggtag

SEQ ID NO: 18208 - DNA, 2196 bp, Artificial Sequence
  Description of Artificial Sequence: Synthetic coding sequence
atgatgcaggcccaggagagcctgaccctggaggatgtggccgtggacttcacctgggaggagtggcagttcctgagccctgcccagaaggacctgtacagagatgtgatgctggagaactacagcaacctggtggccgtgggctaccaggccagcaagccagatgccctgagcaagctggagcggggggaggagacctgcaccacagaagatgagatctacagccgcatctgcagcgagatcaggaagattgatgaccccctgcagcaccacctgcagaaccagagcatccagaagtctgtgaagcagtgccacgagcagaacatgtttggaaatattgtgaaccagaacaagggccacttcctgctgaagcaggactgtgacacctttgacctgcacgagaagcccctgaagagcaacctgagctttgagaaccagaagaggagcagcggcctgaagaacagcgctgagttcaacagagatggcaagagcctcttccacgccaaccacaagcagttctacacagagatgaagtttcctgccatcgccaagcccatcaacaagagccagttcatcaagcagcagaggacccacaacattgaaaatgcccacgtgtgcagtgaatgtgggaaggccttcctgaagctgagccagttcatcgaccaccagagggtgcacactggagagaagccccacgtgtgcagcatgtgtgggaaggccttcagcaggaagagccggctgatggaccaccagaggacccacacagagctgaagcactatgaatgtacagaatgtgacaagaccttcctgaagaagagccagctgaacatccaccagaagacccacatgggcggcaagccctacacctgcagccagtgtgggaaggccttcatcaagaagtgccgcctcatctaccaccagaggacccacactggagagaagccccacggctgcagcgtgtgtgggaaggccttcagcaccaagttcagcctgaccacccaccagaagacccacactggagagaagccctacatctgcagtgaatgtgggaagggcttcatcgagaagaggcggctgacagcccaccacaggacccacactggagagaagcccttcatctgcaacaagtgtgggaagggcttcaccctgaagaacagcctcatcacccaccagcagacccacactggagagaagctgtacacctgcagtgaatgtgggaagggcttctccatgaagcactgcctgatggtgcaccagaggacccacactggagagaagccctacaagtgcaatgaatgtgggaaaggatttgccctgaagagccccctcatccgccaccagaggacccacactggagagaagccctacgtgtgcacagagtgcaggaagggcttcaccatgaagagtgacctgattgtgcaccagaggacccacacagctgagaagccctacatctgcaatgactgtgggaagggcttcaccgtgaagagccgcctcatcgtgcaccagaggacccacactggagagaagccctacgtgtgtggggagtgtgggaagggcttccctgccaagatccggctgatgggccaccagaggacccacactggagagaagccctacatctgcaatgaatgtgggaagggcttcacagagaagagccacctgaatgtgcacaggaggacccacactggagagaagccctacgtgtgcagtgaatgtgggaagggcctgaccgggaagtccatgctgattgcccaccagaggacccacactggagagaagccctacatctgcaatgaatgtgggaagggcttcaccatgaagagcaccctgagcatccaccagcagacccacactggagagaagccctacaagtgcaatgaatgtgacaagaccttcaggaagaagacctgcctgatccagcaccagcgcttccacacaggcaagaccagctttgcctgcacagaatgtgggaagttcagcctgaggaagaatgacctgatcacccaccagaggatccacactggagagaagccctacaagtgcagcgactgtgggaaggccttcaccaccaagagcggcctgaatgtgcaccagaggaagcacactggagagcggccctacggctgcagcgactgtgggaaggcctttgcccacctgagcatcctggtgaagcaccggcgcatccacaggtag

SEQ ID NO: 18209 - DNA, 2058 bp, Artificial Sequence
  Description of Artificial Sequence: Synthetic coding sequence
atgacagcccaggagagcctgaccctggaggatgtggccgtggacttcacctgggaggagtggcagttcctgagccctgcccagaaggacctgtacagagatgtgatgctggagaactacagcaacctggtggccgtgggctaccaggccagcaagccagatgccctgagcaagctggagcggggggaggagacctgcaccacagaagatgagatctacagccgcatctgcagcgacagcggcggggccagcggcggggcctatgcagagatcaggaagattgatgaccccctgcagcaccacctgcagaaccagagcatccagaagtctgtgaagcagtgccacgagcagaacatgtttggaaatattgtgaaccagaacaagggccacttcctgctgaagcaggactgtgacacctttgacctgcacgagaagcccctgaagagcaacctgagctttgagaaccagaagaggagcagcggcctgaagaacagcgctgagttcaacagagatggcaagagcctcttccacgccaaccacaagcagttctacacagagatgaagtttcctgccatcgccaagcccatcaacaagagccagttcatcaagcagcagaggacccacaacattgaaaatgcccacgtgtgcagtgaatgtgggaaggccttcctgaagctgagccagttcatcgaccaccagagggtgcacactggagagaagccccacgtgtgcagcatgtgtgggaaggccttcagcaggaagagccggctgatggaccaccagaggacccacacagagctgaagcactatgaatgtacagaatgtgacaagaccttcctgaagaagagccagctgaacatccaccagaagacccacatgggcggcaagccctacacctgcagccagtgtgggaaggccttcatcaagaagtgccgcctcatctaccaccagaggacccacactggagagaagccccacggctgcagcgtgtgtgggaaggccttcagcaccaagttcagcctgaccacccaccagaagacccacactggagagaagccctacatctgcagtgaatgtgggaagggcttcatcgagaagaggcggctgacagcccaccacaggacccacactggagagaagcccttcatctgcaacaagtgtgggaagggcttcaccctgaagaacagcctcatcacccaccagcagacccacactggagagaagctgtacacctgcagtgaatgtgggaagggcttctccatgaagcactgcctgatggtgcaccagaggacccacactggagagaagccctacaagtgcaatgaatgtgggaaaggatttgccctgaagagccccctcatccgccaccagaggacccacactggagagaagccctacgtgtgcacagagtgcaggaagggcttcaccatgaagagtgacctgattgtgcaccagaggacccacacagctgagaagccctacatctgcaatgactgtgggaagggcttcaccgtgaagagccgcctcatcgtgcaccagaggacccacactggagagaagccctacgtgtgtggggagtgtgggaagggcttccctgccaagatccggctgatgggccaccagaggacccacactggagagaagccctacatctgcaatgaatgtgggaagggcttcaccatgaagagcaccctgagcatccaccagcagacccacactggagagaagccctacaagtgcaatgaatgtgacaagaccttcaggaagaagacctgcctgatccagcaccagcgcttccacacaggcaagaccagctttgcctgcacagaatgtgggaagttcagcctgaggaagaatgacctgatcacccaccagaggatccacactggagagaagccctacaagtgcagcgactgtgggaaggccttcaccaccaagagcggcctgaatgtgcaccagaggaagcacactggagagcggccctacggctgcagcgactgtgggaaggcctttgcccacctgagcatcctggtgaagcaccggcgcatccacaggtag

SEQ ID NO: 18210 - DNA, 2211 bp, Artificial Sequence
  Description of Artificial Sequence: Synthetic coding sequence
atgaggcctgagcccaccaagttctgggaggagagcctgaccctggaggatgtggccgtggacttcacctgggaggagtggcagttcctgagccctgcccagaaggacctgtacagagatgtgatgctggagaactacagcaacctggtggccgtgggctaccaggccagcaagccagatgccctgagcaagctggagcggggggaggagacctgcaccacagaagatgagatctacagccgcatctgcagcgagatcaggaagattgatgaccccctgcagcaccacctgcagaaccagagcatccagaagtctgtgaagcagtgccacgagcagaacatgtttggaaacatcgtgaaccagaacaagggccacttcctgctgaagcaggactgtgacacctttgacctgcacgagaagcccctgaagagcaacctgagctttgagaaccagaagaggagcagcggcctgaagaacagcgctgagttcaacagagatggcaagagcctcttccacgccaaccacaagcagttctacacagagatgaagtttcctgccatcgccaagcccatcaacaagagccagttcatcaagcagcagaggacccacaacattgaaaatgcccacgtgtgcagtgaatgtgggaaggccttcctgaagctgagccagttcatcgaccaccagagggtgcacactggagagaagccccacgtgtgcagcatgtgtgggaaggccttcagcaggaagagccggctgatggaccaccagaggacccacacagagctgaagcactatgagtgcacagaatgtgacaagaccttcctgaagaagagccagctgaacatccaccagaagacccacatgggcggcaagccctacacctgcagccagtgtgggaaggccttcatcaagaagtgccgcctcatctaccaccagaggacccacactggagagaagccccacggctgcagcgtgtgtgggaaggccttcagcaccaagttcagcctgaccacccaccagaagacccacactggagagaagccctacatctgcagtgaatgtgggaagggcttcatcgagaagaggcggctgacagcccaccacaggacccacactggagagaagcccttcatctgcaacaagtgtgggaagggcttcaccctgaagaacagcctcatcacccaccagcagacccacactggagagaagctgtacacctgcagtgaatgtgggaagggcttctccatgaagcactgcctgatggtgcaccagaggacccacactggagagaagccctacaagtgcaatgaatgtgggaagggctttgccctgaagagccccctcatccgccaccagaggacccacactggagagaagccctacgtgtgcacagaatgtaggaagggcttcaccatgaagagtgacctgattgtgcaccagaggacccacacagctgagaagccctacatctgcaatgactgtgggaagggcttcaccgtgaagagccggctgattgtgcaccagaggacccacactggagagaagccctacgtgtgtggagaatgtgggaagggcttccctgccaagatccggctgatgggccaccagaggacccacactggagagaagccctacatctgcaatgaatgtgggaagggcttcacagagaagagccacctgaatgtgcacaggaggacccacactggagagaagccctacgtgtgcagtgaatgtgggaagggcctgaccgggaagtccatgctgattgcccaccagaggacccacactggagagaagccctacatctgcaatgaatgtgggaagggcttcaccatgaagagcaccctgagcatccaccagcagacccacactggagagaagccctacaagtgcaatgaatgtgacaagaccttcaggaagaagacctgcctgatccagcaccagcgcttccacacaggcaagaccagctttgcctgcacagaatgtgggaagttcagcctgaggaagaatgacctgatcacccaccagaggatccacactggagagaagccctacaagtgcagcgactgtgggaaggccttcaccaccaagagcggcctgaatgtgcaccagaggaagcacactggagagcggccctacggctgcagcgactgtgggaaggcctttgcccacctgagcatcctggtgaagcaccggcgcatccacaggtag

SEQ ID NO: 18211 - DNA, 2229 bp, Artificial Sequence
  Description of Artificial Sequence: Synthetic coding sequence
atgatgcaggcccaggagagcctgaccctggaggatgtggccgtggacttcacctgggaggagtggcagttcctgagccctgcccagaaggacctgtacagagatgtgatgctggagaactacagcaacctggtggccgtgggctaccaggccagcaagccagatgccctgagcaagctggagcggggggaggagacctgcaccacagaagatgagatctacagccgcatctgcagcgacagcggcggggccagcggcggggcctatgcagagatcaggaagattgatgaccccctgcagcaccacctgcagaaccagagcatccagaagtctgtgaagcagtgccacgagcagaacatgtttggaaacatcgtgaaccagaacaagggccacttcctgctgaagcaggactgtgacacctttgacctgcacgagaagcccctgaagagcaacctgagctttgagaaccagaagaggagcagcggcctgaagaacagcgctgagttcaacagagatggcaagagcctcttccacgccaaccacaagcagttctacacagagatgaagtttcctgccatcgccaagcccatcaacaagagccagttcatcaagcagcagaggacccacaacattgaaaatgcccacgtgtgcagtgaatgtgggaaggccttcctgaagctgagccagttcatcgaccaccagagggtgcacactggagagaagccccacgtgtgcagcatgtgtgggaaggccttcagcaggaagagccggctgatggaccaccagaggacccacacagagctgaagcactatgagtgcacagaatgtgacaagaccttcctgaagaagagccagctgaacatccaccagaagacccacatgggcggcaagccctacacctgcagccagtgtgggaaggccttcatcaagaagtgccgcctcatctaccaccagaggacccacactggagagaagccccacggctgcagcgtgtgtgggaaggccttcagcaccaagttcagcctgaccacccaccagaagacccacactggagagaagccctacatctgcagtgaatgtgggaagggcttcatcgagaagaggcggctgacagcccaccacaggacccacactggagagaagcccttcatctgcaacaagtgtgggaagggcttcaccctgaagaacagcctcatcacccaccagcagacccacactggagagaagctgtacacctgcagtgaatgtgggaagggcttctccatgaagcactgcctgatggtgcaccagaggacccacactggagagaagccctacaagtgcaatgaatgtgggaagggctttgccctgaagagccccctcatccgccaccagaggacccacactggagagaagccctacgtgtgcacagaatgtaggaagggcttcaccatgaagagtgacctgattgtgcaccagaggacccacacagctgagaagccctacatctgcaatgactgtgggaagggcttcaccgtgaagagccggctgattgtgcaccagaggacccacactggagagaagccctacgtgtgtggagaatgtgggaagggcttccctgccaagatccggctgatgggccaccagaggacccacactggagagaagccctacatctgcaatgaatgtgggaagggcttcacagagaagagccacctgaatgtgcacaggaggacccacactggagagaagccctacgtgtgcagtgaatgtgggaagggcctgaccgggaagtccatgctgattgcccaccagaggacccacactggagagaagccctacatctgcaatgaatgtgggaagggcttcaccatgaagagcaccctgagcatccaccagcagacccacactggagagaagccctacaagtgcaatgaatgtgacaagaccttcaggaagaagacctgcctgatccagcaccagcgcttccacacaggcaagaccagctttgcctgcacagaatgtgggaagttcagcctgaggaagaatgacctgatcacccaccagaggatccacactggagagaagccctacaagtgcagcgactgtgggaaggccttcaccaccaagagcggcctgaatgtgcaccagaggaagcacactggagagcggccctacggctgcagcgactgtgggaaggcctttgcccacctgagcatcctggtgaagcaccggcgcatccacaggtag

SEQ ID NO: 18212 - DNA, 2346 bp, Artificial Sequence
  Description of Artificial Sequence: Synthetic coding sequence
atggccacccagggccacctgaccttcaaggatgtggccatcgagttcagccaggaggagtggaagtgcctggagcctgtgcagaaggccctgtacaaggatgtgatgctggagaactacagaaacctggtgttcctgggcatcagccccaagtgtgtgatcaaggagctgcccccaacagagaacagcaacacaggagagcgcttccagacagtggccctggagcggcaccagagctatgacattgaaaatctctacttccgggagatccagaagcacctgcatgacctggagttccagtggaaggatggagagaccaatgacaaggaggtgcctgtgccccatgagaacaacctgaccgggaagagggaccagcacagccagggagatgtggagaacaaccacatcgagaaccagctgaccagcaactttgagagccggctggccgagctgcagaaggtgcagacagagggccgcctgtatgagtgcaatgaaacagagaagacaggcaacaacggctgcctggtgagcccccacatccgggagaagacctacgtgtgcaatgaatgtgggaaggccttcaaggccagcagcagcctcatcaaccaccagaggatccacaccacagagaagccctacaagtgcaatgaatgtgggaaggccttccaccgggccagcctgctgactgtgcacaaggtggtgcacacccggggcaagagctaccagtgtgatgtgtgtgggaagatcttcaggaagaacagctactttgtgcgccaccagaggagccacacaggccagaagccctacatctgcaatgaatgtgggaagagcttcagcaagagcagccacctggccgtgcaccagaggatccacactggagagaagccctacaagtgcaacctgtgtgggaagagcttcagccagagggtgcacctgcggctgcaccagacagtgcacactggagagcggcccttcaagtgcaatgaatgtgggaagaccttcaagaggagcagcaacctgactgtgcaccaggtgattcatgctgggaagaagccctacaagtgtgatgtgtgtgggaaggccttccgccacaggagcaacctggtgtgccaccggcgcatccacagcggggagaagcagtacaagtgcaatgaatgtgggaaggtgttcagcaagaggagcagcctggccgtgcaccggcgcatccacacagtggagaagccctgcaagtgcaatgaatgtgggaaggtgttcagcaagaggagcagcctggccgtgcaccagaggatccacacaggccagaagacctacaagtgcaacaagtgtgggaaggtgtacagcaagcacagccacctggccgtgcactggaggatccacactggagagaaggcctacaagtgcaatgaatgtgggaaggtgttcagcatccacagccggctggccgcccaccagaggatccacactggagagaagccctacaagtgcaatgaatgtgggaaggtgttcagccagcacagccggctggccgtgcaccggcgcatccacactggagagaagccctacaagtgcaaggaatgtgggaaggtgttcagtgacagaagtgcctttgcccggcaccggcgcatccacactggagagaagccctacaagtgcaaggaatgtgggaaggtgttcagccagtgcagccggctgactgtgcaccggcgcatccacagcggggagaagccctacaagtgcaatgaatgtgggaaggtgtacagccagtacagccacctggtgggccaccggcgggtgcacactggagagaagccctacaagtgccatgaatgtgggaaggccttcaaccagggcagcaccctgaacagacaccagaggatccacactggagagaagccctacaagtgcaaccagtgtggcaacagcttcagccagagggtgcacctgcggctgcaccagacagtgcacactggagaccggccctacaagtgcaatgaatgtgggaagaccttcaagaggagcagcaacctgacagcccaccagatcatccacgccggcaagaagccctacaagtgtgatgaatgtgggaaggtgttccgccacagcagccacctggtgagccaccagaggatccacactggagagaagcgctacaagtgcattgaatgtgggaaggccttcggccgcctcttcagcctgagcaagcaccagaggatccacagcggcaagaagccctacaagtgcaatgaatgtgggaagagcttcatctgccgcagcggcctgaccaagcaccgcatccgccacactggagagagcctgaccaccaagctgaatgtgacccggccctag

SEQ ID NO: 18213 - DNA, 2346 bp, Artificial Sequence; identical to SEQ ID NO: 18212
  Description of Artificial Sequence: Synthetic coding sequence

SEQ ID NO: 18214 - DNA, 2586 bp, Artificial Sequence
  Description of Artificial Sequence: Synthetic coding sequence
atgaaccagcccggcggggccgccgccccccaggctgatggagccagcgctgctggcaggaagagcacagccagccgggagcggctgaagaggagccagaagagcaccaaggtggagggccctgagcctgtgcctgctgaggccagcctgtctgctgagcagggcaccatgacagaggtgaaggtgaagacagagctgcctgatgactacatccaggaggtgatctggcagggcgaggccaaggaggagaagaaggctgtgtccaaggatggcaccagtgatgtgcctgctgagatctgtgtggtgattggaggagtgaggaaccagcagaccctgggcagctatgaatgtggcatctgtgggaagaagtacaagtactacaactgcttccagacccacgtgcgggcccaccgggacacagaggccaccagcggggagggcgccagccagagcaacaacttccgctacacctgtgacatctgtgggaagaagtacaagtactacagctgcttccaggagcaccgggacctgcatgctgtggatgtgttttctgtggagggcgcccctgagaacagagctgacccctttgaccagggcgtggtggccacagatgaggtgaaggaggagcccccagagcccttccagaagattggccccatgaacaacatcaccagtgacatcttcaagaagaaggaggtgcggcagtgccagaagcgggagactggaaactacacctgtgagttctgtgggaagcagtacaagtactacaccccctaccaggagcacgtggccctgcacgcccccatcaagagcgccttcagcagaagagtggagggcaaggcccagaaccactttgaggagaccaacagcagcagccagaacagcagcgagccctacacctgtggggcctgtggcatccagttccagttctacaacaacctgctggagcacatgcagagccacgccgctgacaatgaaaacaacatcgccagcaaccagagccgcagccccccagctgtggtggaggagaagtggaagccccaggcccagagaaattctgccaacaacaccaccaccagcggcctgacccccaacagcatgatccctgagaaggagcggcagaacattgctgagcggctgctgcgggtgatgtgtgccgacctgggcgccctgtctgtggtgtctgggaaggagttcctgaagctggcccagaccctggtggacagcggggcccgctatggagccttctctgtgacagagatcctgggcaacttcaacaccctggccctgaagcacctgcccaggatgtacaaccaggtgaaggtgaaggtgacctgtgccctgggcagcaatgcctgcctgggcatcggcgtgacctgccacagccagagcgtgggccctgacagctgctacatcctgacagcctaccaggccgagggcaaccacatcaagagctatgtgctgggcgtgaagggagctgacatccgggacagcggggacctggtgcaccactgggtgcagaatgtgctgtctgaatttgtgatgtctgagatcagaacagtgtatgtgacagactgccgggtgtccaccagcgccttcagcaaggccggcatgtgcctgcgctgcagcgcctgtgccctgaacagcgtggtgcagagcgtgctgagcaagaggaccctgcaggcccgctccatgcatgaggtgattgagctgctgaatgtgtgtgaggacctggccggcagcacaggcctggccaaggagaccttcggcagcctggaggagaccagccccccaccctgctggaacagcgtgacagacagcctgctgctggtgcatgaaagatatgagcagatctgtgagttctacagccgggccaagaagatgaacctgatccagagcctgaacaagcacctgctgagcaacctggccgccatcctgacccctgtgaagcaggccgtcatcgagctgagcaatgaaagccagcccaccctgcagctggtgctgcccacctacgtgcggctggagaagctgttcaccgccaaggccaatgatgctggcaccgtgtccaagctgtgccacctgttcctggaggccctgaaggagaacttcaaggtgcacccagcccacaaggtggccatgatcctggacccccagcagaagctgcggcctgtgcccccctaccagcacgaggagatcatcggcaaggtgtgtgagctgatcaatgaggtgaaggagagctgggccgaggaggccgactttgagcctgctgccaagaagcccaggtctgctgctgtggagaacccagctgcccaggaggatgaccggctgggcaagaatgaggtgtatgactacctgcaggagcccctcttccaggccaccccagacctcttccagtactggagctgtgtgacccagaagcacaccaagctggccaagctggccttctggctgctggccgtgcctgctgtgggcgcccggagcggctgtgtgaacatgtgtgagcaggccctgctgatcaagagaagaaggctgctgagccctgaggacatgaacaagctgatgttcctgaagagcaacatgctgtag

SEQ ID NO: 18215 - DNA, 1128 bp, Artificial Sequence
  Description of Artificial Sequence: Synthetic coding sequence
atgaaccagcccggcggggccgccgccccccaggctgatggagccagcgctgctggcaggaagagcacagccagccgggagcggctgaagaggagccagaagagcaccaaggtggagggccctgagcctgtgcctgctgaggccagcctgtctgctgagcagggcaccatgacagaggtgaaggtgaagacagagctgcctgatgactacatccaggaggtgatctggcagggcgaggccaaggaggagaagaaggctgtgtccaaggatggcaccagtgatgtgcctgctgagatctgtgtggtgattggaggagtgaggaaccagcagaccctgggcagctatgaatgtggcatctgtgggaagaagtacaagtactacaactgcttccagacccacgtgcgggcccaccgggacacagaggccaccagcggggagggcgccagccagagcaacaacttccgctacacctgtgacatctgtgggaagaagtacaagtactacagctgcttccaggagcaccgggacctgcatgctgtggatgtgttttctgtggagggcgcccctgagaacagagctgacccctttgaccagggcgtggtggccacagatgaggtgaaggaggagcccccagagcccttccagaagattggccccatgaacaacatcaccagtgacatcttcaagaagaaggaggtgcggcagtgccagaagcgggagactggaaactacacctgtgagttctgtgggaagcagtacaagtactacaccccctaccaggagcacgtggccctgcacgcccccatcagcacagcccctggctgggagcccccagatgatcctgacaccggcagcgagtgcagccaccctgaggtgagccccagccccaggtttgtggccgccaagacccagaccaaccagagcggcaagaaggccccagcctctgtggtgcgctgtgccaccctgctgcacaggaccccaccagccacccagacccagaccttccgcacccccaacagcggcagccctgccagcaaggccacagctgagagcgccttcagcagaagagtggagggcaaggcccagaaccactttgaggagaccaacagcagcagccagaacagctag

SEQ ID NO: 18216 - DNA, 2865 bp, Artificial Sequence
  Description of Artificial Sequence: Synthetic coding sequence
atgaaccagcccggcggggccgccgccccccaggctgatggagccagcgctgctggcaggaagagcacagccagccgggagcggctgaagaggagccagaagagcaccaaggtggagggccctgagcctgtgcctgctgaggccagcctgtctgctgagcagggcaccatgacagaggtgaaggtgaagacagagctgcctgatgactacatccaggaggtgatctggcagggcgaggccaaggaggagaagaaggctgtgtccaaggatggcaccagtgatgtgcctgctgagatctgtgtggtgattggaggagtgaggaaccagcagaccctggatggcaaggcccctgagggcagcccccacggcggctctgtgcgcagccgctacagcggcacctggatctttgaccaggccctgcgctatgccagcggcagctatgaatgtggcatctgtgggaagaagtacaagtactacaactgcttccagacccacgtgcgggcccaccgggacacagaggccaccagcggggagggcgccagccagagcaacaacttccgctacacctgtgacatctgtgggaagaagtacaagtactacagctgcttccaggagcaccgggacctgcatgctgtggatgtgttttctgtggagggcgcccctgagaacagagctgacccctttgaccagggcgtggtggccacagatgaggtgaaggaggagcccccagagcccttccagaagattggccccaagacaggcaactacacctgtgagttctgtgggaagcagtacaagtactacaccccctaccaggagcacgtggccctgcacgcccccatcagcacagcccctggctgggagcccccagatgatcctgacaccggcagcgagtgcagccaccctgaggtgagccccagccccaggtttgtggccgccaagacccagaccaaccagagcggcaagaaggccccagcctctgtggtgcgctgtgccaccctgctgcacaggaccccaccagccacccagacccagaccttccgcacccccaacagcggcagccctgccagcaaggccacagctgctgagagcgccttcagccggcgggtggagggcaaggcccagaaccactttgaggagaccaacagcagcagccagaacagcagcgagccctacacctgtggggcctgtggcatccagttccagttctacaacaacctgctggagcacatgcagagccatgctgctgacaatgaaaacaacatcgccagcaaccagagccgcagccccccagctgtggtggaggagaagtggaagccccaggcccagaggaacagcgccaacaacaccaccaccagcggcctgacccccaacagcatgatccctgagaaggagcggcagaacattgctgagcggctgctgcgggtgatgtgtgccgacctgggcgccctgtctgtggtgtctgggaaggagttcctgaagctggcccagaccctggtggacagcggggcccgctacggggccttctctgtgacagagatcctgggcaacttcaacaccctggccctgaagcacctgcccaggatgtacaaccaggtgaaggtgaaggtgacctgtgccctgggcagcaatgcctgcctgggcattggagtgacctgccacagccagagcgtgggccctgacagctgctacatcctgacagcctaccaggccgagggcaaccacatcaagagctatgtgctgggcgtgaagggagctgacatccgggacagcggggacctggtgcaccactgggtgcagaatgtgctgtctgaatttgtgatgtctgagatcagaacagtgtatgtgacagactgccgggtgtccaccagcgccttcagcaaggccggcatgtgcctgcgctgcagcgcctgtgccctgaacagcgtggtgcagagcgtgctgagcaagaggaccctgcaggcccgctccatgcatgaagtcatcgagctgctgaatgtgtgtgaggacctggccggcagcacaggcctggccaaggagaccttcggcagcctggaggagaccagccccccaccctgctggaacagcgtgacagacagcctgctgctggtgcatgaaagatatgagcagatctgtgagttctacagccgggccaagaagatgaacctgatccagagcctgaacaagcacctgctgagcaacctggccgccatcctgacccctgtgaagcaggccgtgattgagctgagcaatgaaagccagcccaccctgcagctggtgctgcccacctacgtgcggctggagaagctgttcaccgccaaggccaatgatgctggcaccgtgtccaagctgtgccacctgttcctggaggccctgaaggagaacttcaaggtgcacccagcccacaaggtggccatgatcctggacccccagcagaagctgcggcctgtgcccccctaccagcacgaggagatcatcggcaaggtgtgtgagctgatcaatgaggtgaaggagagctgggccgaggaggccgactttgagcctgctgccaagaagcccaggtctgctgctgtggagaacccagctgcccaggaggatgaccggctgggcaagaatgaggtgtatgactacctgcaggagcccctcttccaggccaccccagacctcttccagtactggagctgtgtgacccagaagcacaccaagctggccaagctggccttctggctgctggccgtgcctgctgtgggcgcccggagcggctgtgtgaacatgtgtgagcaggccctgctgatcaagagaagaaggctgctgagccctgaggacatgaacaagctgatgttcctgaagagcaacatgctgtag

SEQ ID NO: 18217 - DNA, 915 bp, Artificial Sequence
  Description of Artificial Sequence: Synthetic coding sequence
atgaaccagcccggcggggccgccgccccccaggctgatggagccagcgctgctggcaggaagagcacagccagccgggagcggctgaagaggagccagaagagcaccaaggtggagggccctgagcctgtgcctgctgaggccagcctgtctgctgagcagggcaccatgacagaggtgaaggtgaagacagagctgcctgatgactacatccaggaggtgatctggcagggcgaggccaaggaggagaagaaggctgtgtccaaggatggcaccagtgatgtgcctgctgagatctgtgtggtgattggaggagtgaggaaccagcagaccctgggcagctatgaatgtggcatctgtgggaagaagtacaagtactacaactgcttccagacccacgtgcgggcccaccgggacacagaggccaccagcggggagggcgccagccagagcaacaacttccgctacacctgtgacatctgtgggaagaagtacaagtactacagctgcttccaggagcaccgggacctgcatgctgtggatgacccctttgaccagggcgtggtggccacagatgaggtgaaggaggagcccccagagcccttccagaagattggccccatgaacaacatcaccagtgacatcttcaagaagaaggaggtgcggcagtgccagaagcgggagactggaaactacacctgtgagttctgtgggaagcagtacaagtactacaccccctaccaggagcacgtggccctgcacgcccccatcaccacccagacccagaccttccgcacccccaacagcggcagccctgccagcaaggccacagctgagagcgccttcagccggcgggtggagggcaaggcccagaaccactttgaggagaccaacagcagcagccagaacagctag

SEQ ID NO: 18218 - DNA, 1683 bp, Artificial Sequence
  Description of Artificial Sequence: Synthetic coding sequence
atgggccagcctgccccctatgcagagggccccatccagggcggagatgctggggagctgtgcaagtgtgacttcctggtgtccatcagcatcccccagaccaggagtgacatcccagctggggcccggcgcagctccatgggccccaggagcctggacacctgctggggccggggccctgagagacatgtgcaccggctggagtgcaatggagtcatcttcacccacaggaacctgtgcctgcccggcggcaagaccaagacagaaaatgaggagaagacagcccagctgaacatcagcaaggagagcgagagccaccggctgattgtggagggcctgctgatggatgtgccccagcacccagacttcaaggaccggctggagaagagccagctgcatgacaccggcaacaagaccaagattggagactgcacagacctgactgtgcaggaccacgagagcagcaccacagagcgggaggagatcgccaggaagctggaggagagctctgtgtccacccacctgatcaccaagcagggctttgccaaggagcaggtgttctacaagtgtggggagtgtggcagctactacaacccccacagcgacttccacctgcaccagagggtgcacaccaatgagaagccctacacctgcaaggaatgtgggaagaccttccgctacaacagcaagctgagccgccaccagaagatccacactggagagaagccctacagctgtgaggagtgtggccaggccttcagccagaacagccacctgctgcagcaccagaagctgcacggcggccagaggccctatgaatgtacagactgtgggaagaccttctcctacaacagcaagctgatccgccaccagaggatccacactggagagaagcccttcaagtgcaaggaatgtgggaaggccttcagctgcagctatgactgcatcatccacgagcgcatccacaatggagagaagccctatgagtgcaaggaatgtgggaagagcctgagcagcaacagcgtgctgatccagcaccagaggatccacactggagagaagccctatgagtgcaaggaatgtgggaaggccttccacaggagctctgtgttcctgcagcaccagcgcttccacactggagagcagctgtacaagtgcaatgaatgctggaagaccttcagctgcagcagccgcttcatcgtgcaccagaggatccacaatggagagaagccctatgagtgccaggagtgtgggaagaccttcagccagaagatcaccctggtgcagcaccagagggtgcacactggagagaagccctatgagtgcaaggaatgtgggaaggccttccgctggaatgccagcttcatccagcaccagaagtggcacaccaggaagaagctgatcaatggaacaggcctgtctgctgtgaagccctactgcccctgtgccatcctgagccccctgcccccccagcacacctgcagcgccctggcccctcctggcccccccctgagcagcagccatgctgtggtgctgcccccatctgtgcccttcttcctgctgctgcccagcagcgagaaggccaaccccagccctgtgcagatcgcccacttcttccaggacctggccttccctgggaagagcagcctgcagagccccaaccccctgagccacagcctgtag

SEQ ID NO: 18219 - DNA, 1731 bp, Artificial Sequence
  Description of Artificial Sequence: Synthetic coding sequence
atgctgcagacagtgtggttccagggcctgggcaggaacctgctcttccaggagcctgtgacctttgaagatgtggccgtgtacttcacccagaatgagtgggccagcctgcaccccacccagagggccctgtaccgggaggtgatgctggagaactatgccaacgtgaccagcctgagcgccttccccttccccaagccagacctgatcttccagctggagcagggcgaggccgcctggggccctgacccctggaccctggccggcggggaggccctgcggggcatgtgcaccggcggcaagaccaagacagaaaatgaggagaagacagcccagctgaacatcagcaaggagagcgagagccaccggctgattgtggagggcctgctgatggatgtgccccagcacccagacttcaaggaccggctggagaagagccagctgcatgacaccggcaacaagaccaagattggagactgcacagacctgactgtgcaggaccacgagagcagcaccacagagcgggaggagatcgccaggaagctggaggagagctctgtgtccacccacctgatcaccaagcagggctttgccaaggagcaggtgttctacaagtgtggggagtgtggcagctactacaacccccacagcgacttccacctgcaccagagggtgcacaccaatgagaagccctacacctgcaaggaatgtgggaagaccttccgctacaacagcaagctgagccgccaccagaagatccacactggagagaagccctacagctgtgaggagtgtggccaggccttcagccagaacagccacctgctgcagcaccagaagctgcacggcggccagaggccctatgaatgtacagactgtgggaagaccttctcctacaacagcaagctgatccgccaccagaggatccacactggagagaagcccttcaagtgcaaggaatgtgggaaggccttcagctgcagctatgactgcatcatccacgagcgcatccacaatggagagaagccctatgagtgcaaggaatgtgggaagagcctgagcagcaacagcgtgctgatccagcaccagaggatccacactggagagaagccctatgagtgcaaggaatgtgggaaggccttccacaggagctctgtgttcctgcagcaccagcgcttccacactggagagcagctgtacaagtgcaatgaatgctggaagaccttcagctgcagcagccgcttcatcgtgcaccagaggatccacaatggagagaagccctatgagtgccaggagtgtgggaagaccttcagccagaagatcaccctggtgcagcaccagagggtgcacactggagagaagccctatgagtgcaaggaatgtgggaaggccttccgctggaatgccagcttcatccagcaccagaagtggcacaccaggaagaagctgatcaatggaacaggcctgtctgctgtgaagccctactgcccctgtgccatcctgagccccctgcccccccagcacacctgcagcgccctggcccctcctggcccccccctgagcagcagccatgctgtggtgctgcccccatctgtgcccttcttcctgctgctgcccagcagcgagaaggccaaccccagccctgtgcagatcgcccacttcttccaggacctggccttccctgggaagagcagcctgcagagccccaaccccctgagccacagcctgtag

SEQ ID NO: 18220 - DNA, 1731 bp, Artificial Sequence; identical to SEQ ID NO: 18219
  Description of Artificial Sequence: Synthetic coding sequence

SEQ ID NO: 18221 - DNA, 594 bp, Artificial Sequence
  Description of Artificial Sequence: Synthetic coding sequence
atgggccagcctgccccctatgcagagggccccatccagggcggagatgctggggagctgtgcaagtgcaatgaatgctggaagaccttcagctgcagcagccgcttcatcgtgcaccagaggatccacaacggggagaagccctatgagtgccaggagtgtgggaagaccttcagccagaagatcaccctggtgcagcaccagagggtgcacactggagagaagccctatgagtgcaaggaatgtgggaaggccttccgctggaatgccagcttcatccagcaccagaagtggcacaccaggaagaagctgatcaatggcaccggcctgtctgctgtgaagccctactgcccctgtgccatcctgagccccctgcccccccagcacacctgcagcgccctggcccctcctggcccccccctgagcagcagccatgctgtggtgctgccccccagcgtgcccttcttcctgctgctgcccagcagcgagaaggccaaccccagccctgtgcagatcgcccacttcttccaggacctggccttccctgggaagagcagcctgcagagccccaaccccctgagccacagcctgtag

SEQ ID NO: 18222 - DNA, 1851 bp, Artificial Sequence
  Description of Artificial Sequence: Synthetic coding sequence
atgctgcagacagtgtggttccagggcctgggcaggaacctgctcttccaggagcctgtgacctttgaagatgtggccgtgtacttcacccagaatgagtgggccagcctgcaccccacccagagggccctgtaccgggaggtgatgctggagaactatgccaacgtgaccagcctgtaccccacagctgggggcttccccctggacacagagaggacagagaaggtgcctggggccctgagcagcttcctgcccagcagcagcagcctggagctgatcctggccctgctgcccatgtctgccttccccttccccaagccagacctgatcttccagctggagcagggcgaggccgcctggggccctgacccctggaccctggccggcggggaggccctgcggggcatgtgcaccggcggcaagaccaagacagaaaatgaggagaagacagcccagctgaacatcagcaaggagagcgagagccaccggctgattgtggagggcctgctgatggatgtgccccagcacccagacttcaaggaccggctggagaagagccagctgcatgacaccggcaacaagaccaagattggagactgcacagacctgactgtgcaggaccacgagagcagcaccacagagcgggaggagatcgccaggaagctggaggagagctctgtgtccacccacctgatcaccaagcagggctttgccaaggagcaggtgttctacaagtgtggggagtgtggcagctactacaacccccacagcgacttccacctgcaccagagggtgcacaccaatgagaagccctacacctgcaaggaatgtgggaagaccttccgctacaacagcaagctgagccgccaccagaagatccacactggagagaagccctacagctgtgaggagtgtggccaggccttcagccagaacagccacctgctgcagcaccagaagctgcacggcggccagaggccctatgaatgtacagactgtgggaagaccttctcctacaacagcaagctgatccgccaccagaggatccacactggagagaagcccttcaagtgcaaggaatgtgggaaggccttcagctgcagctatgactgcatcatccacgagcgcatccacaatggagagaagccctatgagtgcaaggaatgtgggaagagcctgagcagcaacagcgtgctgatccagcaccagaggatccacactggagagaagccctatgagtgcaaggaatgtgggaaggccttccacaggagctctgtgttcctgcagcaccagcgcttccacactggagagcagctgtacaagtgcaatgaatgctggaagaccttcagctgcagcagccgcttcatcgtgcaccagaggatccacaatggagagaagccctatgagtgccaggagtgtgggaagaccttcagccagaagatcaccctggtgcagcaccagagggtgcacactggagagaagccctatgagtgcaaggaatgtgggaaggccttccgctggaatgccagcttcatccagcaccagaagtggcacaccaggaagaagctgatcaatggaacaggcctgtctgctgtgaagccctactgcccctgtgccatcctgagccccctgcccccccagcacacctgcagcgccctggcccctcctggcccccccctgagcagcagccatgctgtggtgctgcccccatctgtgcccttcttcctgctgctgcccagcagcgagaaggccaaccccagccctgtgcagatcgcccacttcttccaggacctggccttccctgggaagagcagcctgcagagccccaaccccctgagccacagcctgtag

SEQ ID NO: 18223 - DNA, 1599 bp, Artificial Sequence
  Description of Artificial Sequence: Synthetic coding sequence
atgaagccaggagtcatcagccacgccccagacagcgtggtgcctgctgccttccccttccccaagccagacctgatcttccagctggagcagggcgaggccgcctggggccctgacccctggaccctggccggcggggaggccctgcggggcatgtgcaccggcggcaagaccaagacagaaaatgaggagaagacagcccagctgaacatcagcaaggagagcgagagccaccggctgattgtggagggcctgctgatggatgtgccccagcacccagacttcaaggaccggctggagaagagccagctgcatgacaccggcaacaagaccaagattggagactgcacagacctgactgtgcaggaccacgagagcagcaccacagagcgggaggagatcgccaggaagctggaggagagctctgtgtccacccacctgatcaccaagcagggctttgccaaggagcaggtgttctacaagtgtggggagtgtggcagctactacaacccccacagcgacttccacctgcaccagagggtgcacaccaatgagaagccctacacctgcaaggaatgtgggaagaccttccgctacaacagcaagctgagccgccaccagaagatccacactggagagaagccctacagctgtgaggagtgtggccaggccttcagccagaacagccacctgctgcagcaccagaagctgcacggcggccagaggccctatgaatgtacagactgtgggaagaccttctcctacaacagcaagctgatccgccaccagaggatccacactggagagaagcccttcaagtgcaaggaatgtgggaaggccttcagctgcagctatgactgcatcatccacgagcgcatccacaatggagagaagccctatgagtgcaaggaatgtgggaagagcctgagcagcaacagcgtgctgatccagcaccagaggatccacactggagagaagccctatgagtgcaaggaatgtgggaaggccttccacaggagctctgtgttcctgcagcaccagcgcttccacactggagagcagctgtacaagtgcaatgaatgctggaagaccttcagctgcagcagccgcttcatcgtgcaccagaggatccacaatggagagaagccctatgagtgccaggagtgtgggaagaccttcagccagaagatcaccctggtgcagcaccagagggtgcacactggagagaagccctatgagtgcaaggaatgtgggaaggccttccgctggaatgccagcttcatccagcaccagaagtggcacaccaggaagaagctgatcaatggaacaggcctgtctgctgtgaagccctactgcccctgtgccatcctgagccccctgcccccccagcacacctgcagcgccctggcccctcctggcccccccctgagcagcagccatgctgtggtgctgcccccatctgtgcccttcttcctgctgctgcccagcagcgagaaggccaaccccagccctgtgcagatcgcccacttcttccaggacctggccttccctgggaagagcagcctgcagagccccaaccccctgagccacagcctgtag

SEQ ID NO: 18224 - DNA, 1851 bp, Artificial Sequence; identical to SEQ ID NO: 18222
  Description of Artificial Sequence: Synthetic coding sequence

SEQ ID NO: 18225 - DNA, 1704 bp, Artificial Sequence
  Description of Artificial Sequence: Synthetic coding sequence
atgggccagcctgccccctatgcagagggccccatccagggcggagatgctggggagctgtgcaagtgtgacttcctggtgtccatcagcatcccccagaccaggagtgacatcccagctggggcccggcgcagctccatgggccccaggagcctggacacctgctggggccggggccctgagagacatgtgcaccgggtgtccctgctgctgccccggctggagtgcaatggagtcatcttcacccacaggaacctgtgcctgcccggcggcaagaccaagacagaaaatgaggagaagacagcccagctgaacatcagcaaggagagcgagagccacaggctcatcgtggagggcctgctgatggatgtgccccagcacccagacttcaaggaccggctggagaagagccagctgcatgacaccggcaacaagaccaagatcggggactgcacagacctgactgtgcaggaccacgagagcagcaccacagagcgggaggagatcgccaggaagctggaggagagctctgtgtccacccacctgatcaccaagcagggctttgccaaggagcaggtgttctacaagtgtggagaatgtggcagctactacaacccccacagcgacttccacctgcaccagagggtgcacaccaatgagaagccctacacctgcaaggaatgtgggaagaccttccgctacaacagcaagctgagccgccaccagaagatccacactggagagaagccctacagctgtgaagaatgtggccaggccttcagccagaacagccacctgctgcagcaccagaagctgcatggaggccagaggccctatgagtgcacagactgtgggaagaccttctcctacaacagcaagctgatccgccaccagaggatccacactggagagaagcccttcaagtgcaaggaatgtgggaaggccttcagctgcagctatgactgcatcatccacgagcgcatccacaacggggagaagccctatgagtgcaaggaatgtgggaagagcctgagcagcaacagcgtgctgatccagcaccagaggatccacactggagagaagccctatgagtgcaaggaatgtgggaaggccttccacaggagcagcgtcttcctgcagcaccagcgcttccacactggagagcagctgtacaagtgcaatgaatgctggaagaccttcagctgcagcagccgcttcatcgtgcaccagaggatccacaacggggagaagccctatgagtgccaggagtgtgggaagaccttcagccagaagatcaccctggtgcagcaccagagggtgcacactggagagaagccctatgagtgcaaggaatgtgggaaggccttccgctggaatgccagcttcatccagcaccagaagtggcacaccaggaagaagctgatcaatggcaccggcctgtctgctgtgaagccctactgcccctgtgccatcctgagccccctgcccccccagcacacctgcagcgccctggcccctcctggcccccccctgagcagcagccatgctgtggtgctgccccccagcgtgcccttcttcctgctgctgcccagcagcgagaaggccaaccccagccctgtgcagatcgcccacttcttccaggacctggccttccctgggaagagcagcctgcagagccccaaccccctgagccacagcctgtag

SEQ ID NO: 18226 - DNA, 474 bp, Artificial Sequence
  Description of Artificial Sequence: Synthetic coding sequence
atgctgcagaccacctggccccaggagagcgtgacctttgaagatgtggccgtgtacttcacccagaaccagtgggccagcctggaccctgcccagagggccctgtatggagaggtgatgctggagaactatgccaacgtggccagcctggtggccttccccttccccaagccagccctgatcagccacctggagcggggggaggccccctggggccctgacccctgggacacagagatcctgcggggcatcagccagggcggggagagctggatcaagaatgaaggcctggtgatcaagcaggaggccagcgaggagacagagctgcacaggatgcctgtgggcggcctgctgagaaatgtgtcccagcactttgacttcaagaggaaggccctgaagcagaccttcaacctgaaccccaacctgatcctgcggggcggctctgtggaggtgcgcagcctgcggcctgcctag

SEQ ID NO: 18227 - DNA, 1320 bp, Artificial Sequence
  Description of Artificial Sequence: Synthetic coding sequence
atgctgcagaccacctggccccaggagagcgtgacctttgaagatgtggccgtgtacttcacccagaaccagtgggccagcctggaccctgcccagagggccctgtatggagaggtgatgctggagaactatgccaacgtggccagcctggtggccttccccttccccaagccagccctgatcagccacctggagcggggggaggccccctggggccctgacccctgggacacagagatcctgcggggcatcagccagggcggggagagctggatcaagaatgaaggcctggtgatcaagcaggaggccagcgaggagacagagctgcacaggatgcctgtgggcggcctgctgagaaatgtgtcccagcactttgacttcaagaggaaggccctgaagcagaccttcaacctgaaccccaacctgatcctgcggggcggcatgaagttctatgagtgcaaggaatgtgggaagatcttccgctacaacagcaagctgatccgccaccagatgagccacactggagagaagcccttcaagtgcaaggaatgtgggaaggccttcaagagcagctatgactgcatcgtgcatgagaagaaccacatcggggagggcccctatgagtgcaaggaatgtgggaagggcctgagcagcaacacagccctgacccagcaccagaggatccacactggagagaagccctatgagtgcaaggaatgtgggaaggccttcagaagatctgctgcctacctgcagcaccagaggctgcacactggagagaagctgtacaagtgcaaggagtgctggaaggccttcggctgccgcagcctcttcatcgtgcaccagaggatccacactggagagaagccctaccagtgcaaggaatgtgggaaggccttcacccagaagatcgccagcatccagcaccagagggtgcacactggagagaagccctatgagtgcaaggtgtgtgggaaggccttcaagtggtacggcagctttgtgcagcaccagaagctgcaccctgtggagaagaagcctgtgaaggtgctgggccccagcctggtgagcccccagtgcagcagccctgccatcccccctgtgctgctgcagggcagctgcagcgccagcgctgtggccgtgcccagcctgaccttcccccatgctgtgctgatccccaccagcggcaacttcttcatgctgctgcccaccagcggcatccccagcagcagcgcccagatcgtgcgggtcttccagggcctgacccccaccgtgaagcccagccctgtgatcctgacccccagcagccacagcagctag

SEQ ID NO: 18228 - DNA, 1320 bp, Artificial Sequence; identical to SEQ ID NO: 18227
  Description of Artificial Sequence: Synthetic coding sequence

SEQ ID NO: 18229 - DNA, 459 bp, Artificial Sequence
  Description of Artificial Sequence: Synthetic coding sequence
atgctgcagaccacctggccccaggagagcgtgacctttgaagatgtggccgtgtacttcacccagaaccagtgggccagcctggaccctgcccagagggccctgtatggagaggtgatgctggagaactatgccaacgtggccagcctggtggccttccccttccccaagccagccctgatcagccacctggagcggggggaggccccctggggccctgacccctgggacacagagatcctgcggggcatcagccagggcggggagagctggatcaagaatgaaggcctggtgatcaagcaggaggccagcgaggagacagagctgcacaggatgcctgtgggcggcctgctgagaaatgtgtcccagcactttgacttcaagaggaaggccctgaagcagaccttcaacctgaaccccaacctgatcctgcggggcggcatgaagttctatgaatag

SEQ ID NO: 18230 - DNA, 1425 bp, Artificial Sequence
  Description of Artificial Sequence: Synthetic coding sequence
atggagctgcccagccctgagagcgaggaggtgcatgagccccggctgggggagctgctgggcaaccctgagggccagagcctgggcagcagccccagccaggaccggggctgcaagcaggtgacagtgacccactggaagatccagacaggagaaacagcccaggtgtgcaccaagagcggcaggaaccacatcctgaacagcgacctgctgctgctgcagcgggagctgattgaaggagaggccaacccctgcaacatctgtgggaagaccttcaccttcaacagcgacctggtgcgccaccgcatcagccacgccggggagaagccctacacctgtgaccagtgtgggaagggcttcggccagagcagccacctgatggagcaccagaggatccacactggagagcggctgtatgtgtgcaatgtgtgtgggaaggacttcatccactacagcggcctgattgagcaccagagggtgcacagcggggagaagcccttcaagtgtgcccagtgtgggaaggccttctgccacagcagtgacctgatccgccaccagagggtgcacacccgggagcggccctttgagtgcaaggaatgtgggaagggcttcagccagagcagcctgctgatccgccaccagaggatccacactggagagcggccctatgagtgcaatgaatgtgggaagagcttcatccgcagcagcagcctcatccgccactaccagatccacacagaggtgaagcagtatgagtgcaaggaatgtgggaaggccttccgccacagaagtgacctgattgagcaccagaggatccacactggagagcggccctttgagtgcaatgaatgtgggaaggccttcatccgcagcagcaagctgatccagcaccagaggatccacactggagagcggccctacgtgtgcaatgaatgtgggaagcgcttcagccagaccagcaacttcacccagcaccagaggatccacactggagagaagctgtatgagtgcaatgaatgtgggaaggccttcttcctgagcagctacctgatccgccaccagaagatccacactggagagcgggtgtatgagtgcaaggaatgtgggaaggccttcctgcagaaggcccacctgacagagcaccagaagatccacagcggggaccggccctttgagtgcaaggactgtgggaaggccttcatccagagcagcaagctgctgctgcaccagatcatccacactggagagaagccctacgtgtgcagctactgtgggaaggccctcttccggggccagaccagcttcaacaccaggaagttcatcctgaagaggagctccatgaatgtggtgtccatgggagagatcctgacccagctgcagaccctgaagatcatcaagggcttcaccaagagggacagcccctag

SEQ ID NO: 18231 - DNA, 1491 bp, Artificial Sequence
  Description of Artificial Sequence: Synthetic coding sequence
atggagctgcccagccctgagagcgaggaggtgcatgagccccggctgggggagctgctgggcaaccctgagggccagagcctgggcagcagccccagccaggaccggggctgcaagcaggtgacagtgacccactggaagatccagacaggagaaacagcccaggtgtgcaccaagagcggcaggaaccacatcctgaacagcgacctgctgctgctgcagcgggagctgattgaaggagaggccaacccctgcaacatctgtgggaagaccttcaccttcaacagcgacctggtgcgccaccgcatcagccacgccggggagaagccctacacctgtgaccagtgtgggaagggcttcggccagagcagccacctgatggagcaccagaggatccacactggagagcggctgtatgtgtgcaatgtgtgtgggaaggacttcatccactacagcggcctgattgagcaccagagggtgcacagcggggagaagcccttcaagtgtgcccagtgtgggaaggccttctgccacagcagtgacctgatccgccaccagagggtgcacacccgggagcggccctttgagtgcaaggaatgtgggaagggcttcagccagagcagcctgctgatccgccaccagaggatccacactggagagcggccctatgagtgcaatgaatgtgggaagagcttcatccgcagcagcagcctcatccgccactaccagatccacacagaggtgaagcagtatgagtgcaaggaatgtgggaaggccttccgccacagaagtgacctgattgagcaccagaggatccacactggagagcggccctttgagtgcaatgaatgtgggaaggccttcatccgcagcagcaagctgatccagcaccagaggatccacactggagagcggccctacgtgtgcaatgaatgtgggaagcgcttcagccagaccagcaacttcacccagcaccagaggatccacactggagagaagctgtatgagtgcaatgaatgtgggaaggccttcttcctgagcagctacctgatccgccaccagaagatccacactggagagcgggtgtatgagtgcaaggaatgtgggaaggccttcctgcagaaggcccacctgacagagcaccagaagatccacagcggggaccggccctttgagtgcaaggactgtgggaaggccttcatccagagcagcaagctgctgctgcaccagatcatccacactggagagaagccctacgtgtgcagctactgtgggaagggcttcatccagaggagcaacttcctgcagcaccagaagatccacacagaggagaagctgtatgagtgcagccagtatggccgggacttcaacagcaccaccaacgtgaagaacaaccagagggtgcaccaggagggcctgagcctgagcaaggcccccatccacctgggggagaggtctgtggacaagggggagcacactggaaacctgtag

SEQ ID NO: 18232 - DNA, 1611 bp, Artificial Sequence
  Description of Artificial Sequence: Synthetic coding sequence
atgatcctgctgagctttgtgtctgacagcaatgtgggcaccggggagaagaaggtgacagaggcctggatcagtgaagatgagaacagccacaggaccaccagtgaccggctgactgtgatggagctgcccagccctgagagcgaggaggtgcatgagccccggctgggggagctgctgggcaaccctgagggccagagcctgggcagcagccccagccaggaccggggctgcaagcaggtgacagtgacccactggaagatccagacaggagaaacagcccaggtgtgcaccaagagcggcaggaaccacatcctgaacagcgacctgctgctgctgcagcgggagctgattgaaggagaggccaacccctgcaacatctgtgggaagaccttcaccttcaacagcgacctggtgcgccaccgcatcagccacgccggggagaagccctacacctgtgaccagtgtgggaagggcttcggccagagcagccacctgatggagcaccagaggatccacactggagagcggctgtatgtgtgcaatgtgtgtgggaaggacttcatccactacagcggcctgattgagcaccagagggtgcacagcggggagaagcccttcaagtgtgcccagtgtgggaaggccttctgccacagcagtgacctgatccgccaccagagggtgcacacccgggagcggccctttgagtgcaaggaatgtgggaagggcttcagccagagcagcctgctgatccgccaccagaggatccacactggagagcggccctatgagtgcaatgaatgtgggaagagcttcatccgcagcagcagcctcatccgccactaccagatccacacagaggtgaagcagtatgagtgcaaggaatgtgggaaggccttccgccacagaagtgacctgattgagcaccagaggatccacactggagagcggccctttgagtgcaatgaatgtgggaaggccttcatccgcagcagcaagctgatccagcaccagaggatccacactggagagcggccctacgtgtgcaatgaatgtgggaagcgcttcagccagaccagcaacttcacccagcaccagaggatccacactggagagaagctgtatgagtgcaatgaatgtgggaaggccttcttcctgagcagctacctgatccgccaccagaagatccacactggagagcgggtgtatgagtgcaaggaatgtgggaaggccttcctgcagaaggcccacctgacagagcaccagaagatccacagcggggaccggccctttgagtgcaaggactgtgggaaggccttcatccagagcagcaagctgctgctgcaccagatcatccacactggagagaagccctacgtgtgcagctactgtgggaagggcttcatccagaggagcaacttcctgcagcaccagaagatccacacagaggagaagctgtatgagtgcagccagtatggccgggacttcaacagcaccaccaacgtgaagaacaaccagagggtgcaccaggagggcctgagcctgagcaaggcccccatccacctgggggagaggtctgtggacaagggggagcacactggaaacctgtag

SEQ ID NO: 18233 - DNA, 1491 bp, Artificial Sequence; identical to SEQ ID NO: 18231
  Description of Artificial Sequence: Synthetic coding sequence

SEQ ID NO: 18234 - DNA, 1611 bp, Artificial Sequence; identical to SEQ ID NO: 18232
  Description of Artificial Sequence: Synthetic coding sequence

SEQ ID NO: 18235 - DNA, 2598 bp, Artificial Sequence
  Description of Artificial Sequence: Synthetic coding sequence
atgagcctgcaggacagcaccctgagccgggagggcaagccagagggggagatcatggctgctgtgttcttctctgtgggccgcctgagccctgaggtgacccagccagatgaggacctgcacctgcaggccgaggagacccagctggtgaaggagagcgtgaccttcaaggatgtggccatcgacttcaccctggaggagtggaggctgatggaccccacccagaggaacctgcacaaggatgtgatgctggagaactacagaaacctggtgtccctgggcctggccgtgtccaagccagacatgatcagccacctggagaatggcaagggcccctgggtgacagtgcgggagatcagccgcatcccctacccagacatggagcccaagccagccaccaagaaggccaccaggaccaaggccatcagcgaggacctgagccaggaggccatcctggagaagctgacagaaaatggcctgtgggacagcaggatggagggcctgtggaagtggaatgaccgcatcctgcggctgcagaacaaccaggagaaccacctgagccagaggatcatccccctgaagaagacccccaccagccagaggggcttccgctttgagagcatcctgatccctgagcccggcatcgccacagaggagctgcacagccgctgccagacccaggaggagaacttcacagagaacctgaacctgatcacagacacccacctgggcaagatcatctgcaaggagatgaagggcagcaaggccatccggcagaccagcgagctgaccctgggcaagaagagcaacaacaaggagaagccctacaagtgcagcacctgtgagaaggccttccactaccgcagcctgctgatccagcaccagaggacccacaccaaggagaagccctatgaatgtaatgaatgtgggaagaccttcagccagcccagctacctgagccagcacaagaagatccacactggagagaagccctacaagtgcaatgaatgtgggaaggccttcatcgccagcagcagcctgatggtgcaccagaggatccacaccaaggagaagccctaccagtgcaatgtgtgtgggaagagcttcagccagtgtgcccggctgaaccagcaccagaggatccagacaggagagaagccctacaagtgcagtgaatgtgggaaggccttcagtgacaagagcaagctggcccggcaccaggagacccacaatggagagaagccctacaagtgtgatgactgtgggaaggccttcaggaacaagagctacctgtctgtgcaccagaagacccacacagaggagaagccctaccagtgcaatgaatgtgggaagagcttcaagaacaccaccatcttcaacgtgcaccagaggatccacactggagagaagcccttccgctgcaatgaatgtgggaaggcctaccgcagcaacagcagcctcatcgtgcacatccgcacccacactggagagaagccctatgaatgtaatgaatgtgggaaggccttcaaccgcatcgccaacttcacagagcaccagaggatccacactggagagaagccctacaagtgcaatgaatgtgggaaggccttcatcaactacagctgcctgactgtgcaccacaggatgcacactggagagaagccctacaagtgcacagaatgtgggaaggccttcatgaggagcagcagcctcatcatccaccagaggatccacacagaggagaagccctacctgtgcaatgaatgtggggagagcttccgcatcaagagccacctgactgtgcaccagaggatccacactggagagaagccctacaagtgcacagactgtgagcgggccttcaccaagatggtgaacctgaaggagcaccagaagatccacactggagtgaagccctacaagtgctatgactgtgggaagagcttccgcaccaagagctacctgattgtgcaccagaggacccacactggagagaagccctacaagtgcaatgaatgtgagaaggccttcaccaacaccagccagctgactgtgcaccagaggaggcacactggagagaagccctacaagtgcaatgaatgtgggaaggtgttcaccagcaacagcggcttcaacacccaccagaggacccacactggagagaagcccttcaagtgcaatgactgtgggaaggccttcagccagatggtgcacgtgacagagcaccagaagatccacagcggggagaagccctacaagtgtgatgtgtgtgggaaggccttccggcggggcagctacctgactgtgcactggaggacccacactggagagaagccctacacctgcaaggaatgtgggaagggctgcatcaccctgagccagctgaccctgcaccagaggatccacactggagagcggccctacaagtgtgaggagtgtgggaaggccttccgcaccaacagcgacttcaccgtgcacctgaggatgcacactggagagaagccctacaagtgcaatgaatgtgggaaggccttccgcagcagcagcagcctgactgtgcaccagaggatccaccagcgggagacccagctgatctag

SEQ ID NO: 18236 - DNA, 336 bp, Artificial Sequence
  Description of Artificial Sequence: Synthetic coding sequence
atgagcctgcaggacagcaccctgagccgggagggcaagccagagggggagatcatggctgctgtgttcttctctgtgggccgcctgagccctgaggtgacccagccagatgaggacctgcacctgcaggccgaggagacccagctggtgaaggagagcgtgaccttcaaggatgtggccatcgacttcaccctggaggagtggaggctgatggaccccacccagaggaacctgcacaaggatgtgatgctggagaactacagaaacctggtgtccctgggcctggccgtgtccaagccagacatgatcagccacctggagaatggcaagggctag

SEQ ID NO: 18237 - DNA, 921 bp, Artificial Sequence
  Description of Artificial Sequence: Synthetic coding sequence
atgggagagcggctgctggagagcaagaaggaccaccagcacggggagatcctgacccaggtgcctgatgacatgctgaagaagaagaccccccgggtgaagagctgtggggaggtgtctgtgggccacgccagcctgaacagacaccacagagctgacaccggccacaagccctatgagtaccaggagtatggccagaagccctacaagtgcacctactgcaagaaggccttcagtgacctgccctacttccgcacccatgagtgggcccacactggaggcaagccctatgactgtgaagaatgtgggaagagcttcatcagccgcagcagcatcagaagacaccgcatcatgcacagcggagatggcccctacaagtgcaacttctgtgggaaggccctgatgtgcctgagcctgtacctgatccacaagaggacccacactggagagaagccctatgagtgcaagcagtgtgggaaggccttcagccacagcggcagcctgcgcatccacgagaggacccacactggagagaagccctatgagtgcagtgaatgtgggaaggccttccacagcagcacctgcctgcacgcccacaagatcacccacactggagagaagccctatgagtgcaagcagtgtgggaaggcctttgtgtccttcaacagcgtgcgctaccacgagaggacccacactggagagaagccctatgagtgcaagcagtgtgggaaggccttccgcagcgccagccacctgcggacccacggccgcacccacactggagagaagccctatgagtgcaagcagtgtgggaaggccttcggctgtgccagctctgtgaagatccacgagaggacccacactggagagaagccctgcagcagcaacaccagcaagggccagggcgagaagatcgcctag

SEQ ID NO: 18238 - DNA, 1119 bp, Artificial Sequence
  Description of Artificial Sequence: Synthetic coding sequence
atggattctgtggtgtttgaagatgtggatgtgaacttcacccaggaggagtgggccctgctggaccccagccagaagaacctgtacagagatgtgatgcaggagaccttcaggaacctggcctctgtgggcaagaagtggaaggaccagaagattgaagatgagtacaagaaccccaggaggaacctgcggggcctgatgggagagcggctgctggagagcaagaaggaccaccagcacggggagatcctgacccaggtgcctgatgacatgctgaagaagaagaccccccgggtgaagagctgtggggaggtgtctgtgggccacgccagcctgaacagacaccacagagctgacaccggccacaagccctatgagtaccaggagtatggccagaagccctacaagtgcacctactgcaagaaggccttcagtgacctgccctacttccgcacccatgagtgggcccacactggaggcaagccctatgactgtgaagaatgtgggaagagcttcatcagccgcagcagcatcagaagacaccgcatcatgcacagcggagatggcccctacaagtgcaacttctgtgggaaggccctgatgtgcctgagcctgtacctgatccacaagaggacccacactggagagaagccctatgagtgcaagcagtgtgggaaggccttcagccacagcggcagcctgcgcatccacgagaggacccacactggagagaagccctatgagtgcagtgaatgtgggaaggccttccacagcagcacctgcctgcacgcccacaagatcacccacactggagagaagccctatgagtgcaagcagtgtgggaaggcctttgtgtccttcaacagcgtgcgctaccacgagaggacccacactggagagaagccctatgagtgcaagcagtgtgggaaggccttccgcagcgccagccacctgcggacccacggccgcacccacactggagagaagccctatgagtgcaagcagtgtgggaaggccttcggctgtgccagctctgtgaagatccacgagaggacccacactggagagaagccctgcagcagcaacaccagcaagggccagggcgagaagatcgcctag

SEQ ID NO: 18239 - DNA, 921 bp, Artificial Sequence; identical to SEQ ID NO: 18237
  Description of Artificial Sequence: Synthetic coding sequence

SEQ ID NO: 18240 - DNA, 279 bp, Artificial Sequence
  Description of Artificial Sequence: Synthetic coding sequence
atgggccccctgcagttcagagatgtggccatcgagttcagcctggaggagtggcactgcctggacacagcccagaggaacctgtacagaaatgtgatgctggagaactacagcaacctggtgttcctgggcatcaccgtgtccaagccagacctgatcacctgcctggagcagggcaggaagcccctgaccatgaagagaaatgagatgattgccaagcccagcgtgtccttcctgcaggtgcacagcgagagccagagccccctgcatgacatctag

SEQ ID NO: 18241 - DNA, 1623 bp, Artificial Sequence
  Description of Artificial Sequence: Synthetic coding sequence
atgggccccctgcagttcagagatgtggccatcgagttcagcctggaggagtggcactgcctggacacagcccagaggaacctgtacagaaatgtgatgctggagaactacagcaacctggtgttcctgggcatcaccgtgtccaagccagacctgatcacctgcctggagcagggcaggaagcccctgaccatgaagagaaatgagatgattgccaagcccagcgtgatgtgcagccactttgcccaggacctgtggccagagcagagcatgaaggacagcttccagaaggtggtgctgcggcgctatgaaaaatgtgaacatgacaacctgcagctgaagaagggctgcatctctgtggatgagtgcaaggtgcacaaggagggctacaatgagctgaaccagtgcctgaccaccacccccaggaagatctgccagtgtgacaagtatgtgaaggtgctgcaccagttccccaacagcaatggccagaagaggggccacacaggcaagaagcccttcaagtacattgaatgtgggaaggccttcaagcagttcagcaccctgaccacccacaagaagatccacactggaggcaagccctacaagtgtgaagaatgtgggaaggccttcaaccacagctgcagcctgaccaggcacaagaagatccacactggagagaagccctacaagtgtgaagaatgtgggaaggccttcaagcacagcagcaccctgaccacccacaagaggaaccacactggagagaagccctacaagtgtgacaagtgtgggaaggccttcatgagcagcagcaccctgagcaagcatgagatcatccacacagagaagaagccctacaagtgtgaagaatgtgggaaggccttcaacagaagcagcaccctgaccacccacaagatcatccacactggagagaagccctacaagtgtgaagaatgtgacaaggccttcaagtacagctacaccctgaccacccacaagaggatccacacagaggacaagccctacaagtgtgaagaatgtgggaaggccttcaagtacagcagcaccctgaccacccacaagaggatccacactggagagaagccctacaagtgtgaagaatgtgggaaggccttcaagaggagcagtgacctgaccacccacaagatcatccacactggagagaagccctacaagtgtgaagaatgtgggaaggccttcaagtacagcagcaacctgaccacccacaagaagatccacactggagagcggccctacaagtgtgaagaatgtgggaaggccttcaaccagagcagcatcctgaccacccaccggcgcatccacactggagagaagttctacaagtgtgaagaatgtgggaaggccttcaagaggagcagccacctgaccacccacaagatcatccacactggagagaagttctacaagtgtgaagaatgtgacaaggccttcaagcacttcagcaacctgaccacccacaagaagatccacacaggcaagaagccctaccgctgtgaagaatgtgggaaggccttcaagcacagcagcaagctgaccacccacaagcgcttccacactggagagaagccctaccgctgtgagtag

SEQ ID NO: 18242 - DNA, 1587 bp, Artificial Sequence
  Description of Artificial Sequence: Synthetic coding sequence
atgggccccctgcagttcagagatgtggccatcgagttcagcctggaggagtggcactgcctggacacagcccagaggaacctgtacagaaatgtgatgctggagaactacagcaacctggtgttcctgggcatcaccgtgtccaagccagacctgatcacctgcctggagcagggcaggaagcccctgaccatgaagagaaatgagatgattgccaagcccagcgtgatgtgcagccactttgcccaggacctgtggccagagcagagcatgaaggacagcttccagaaggtggtgctgcggcgctatgaaaaatgtgaacatgacaacctgcagctgaagaagggctgcatctctgtggatgagtgcaaggtgcacaaggagggctacaatgagctgaaccagtgcctgaccaccacccccaggaagatctgccagtgtgacaagtatgtgaaggtgctgcaccagttccccaacagcaatggccagaagaggggccacacaggcaagaagcccttcaagtacattgaatgtgggaaggccttcaagcagttcagcaccctgaccacccacaagaagatccacactggaggcaagccctacaagtgtgaagaatgtgggaaggccttcaaccacagctgcagcctgaccaggcacaagaagatccacactggagagaagccctacaagtgtgaagaatgtgggaaggccttcaagcacagcagcaccctgaccacccacaagaggaaccacactggagagaagccctacaagtgtgacaagtgtgggaaggccttcatgagcagcagcaccctgagcaagcatgagatcatccacacagagaagaagccctacaagtgtgaagaatgtgggaaggccttcaacagaagcagcaccctgaccacccacaagatcatccacactggagagaagccctacaagtgtgaagaatgtgacaaggccttcaagtacagctacaccctgaccacccacaagaggatccacacagaggacaagccctacaagtgtgaagaatgtgggaaggccttcaagtacagcagcaccctgaccacccacaagaggatccacactggagagaagccctacaagtgtgaagaatgtgggaaggccttcaagaggagcagtgacctgaccacccacaagatcatccacactggagagaagccctacaagtgtgaagaatgtgggaaggccttcaagtacagcagcaacctgaccacccacaagaagatccacactggagagcggccctacaagtgtgaagaatgtgggaaggccttcaaccagagcagcatcctgaccacccaccggcgcatccacactggagagaagttctacaagtgtgaagaatgtgggaaggccttcaagtgcagcagcaacctgaccacccacaagaagatccacactggagagcggccctacaagtgtgaagaatgtgggaaggccttcaaccagagcagcatcctgaccacccatgagcgcatcatcctggagaggaacagcaccaacgtgaagaatgtggccaagcccagcagcggcccccacaccctgctgcacatcagatag

SEQ ID NO: 18243 - DNA, 1359 bp, Artificial Sequence
  Description of Artificial Sequence: Synthetic coding sequence
atgtgcagccactttgcccaggacctgtggccagagcagagcatgaaggacagcttccagaaggtggtgctgcggcgctatgaaaaatgtgaacatgacaacctgcagctgaagaagggctgcatctctgtggatgagtgcaaggtgcacaaggagggctacaatgagctgaaccagtgcctgaccaccacccccaggaagatctgccagtgtgacaagtatgtgaaggtgctgcaccagttccccaacagcaatggccagaagaggggccacacaggcaagaagcccttcaagtacattgaatgtgggaaggccttcaagcagttcagcaccctgaccacccacaagaagatccacactggaggcaagccctacaagtgtgaagaatgtgggaaggccttcaaccacagctgcagcctgaccaggcacaagaagatccacactggagagaagccctacaagtgtgaagaatgtgggaaggccttcaagcacagcagcaccctgaccacccacaagaggaaccacactggagagaagccctacaagtgtgacaagtgtgggaaggccttcatgagcagcagcaccctgagcaagcatgagatcatccacacagagaagaagccctacaagtgtgaagaatgtgggaaggccttcaacagaagcagcaccctgaccacccacaagatcatccacactggagagaagccctacaagtgtgaagaatgtgacaaggccttcaagtacagctacaccctgaccacccacaagaggatccacacagaggacaagccctacaagtgtgaagaatgtgggaaggccttcaagtacagcagcaccctgaccacccacaagaggatccacactggagagaagccctacaagtgtgaagaatgtgggaaggccttcaagaggagcagtgacctgaccacccacaagatcatccacactggagagaagccctacaagtgtgaagaatgtgggaaggccttcaagtacagcagcaacctgaccacccacaagaagatccacactggagagcggccctacaagtgtgaagaatgtgggaaggccttcaaccagagcagcatcctgaccacccaccggcgcatccacactggagagaagttctacaagtgtgaagaatgtgggaaggccttcaagtgcagcagcaacctgaccacccacaagaagatccacactggagagcggccctacaagtgtgaagaatgtgggaaggccttcaaccagagcagcatcctgaccacccatgagcgcatcatcctggagaggaacagcaccaacgtgaagaatgtggccaagcccagcagcggcccccacaccctgctgcacatcagatag

SEQ ID NO: 18244 - DNA, 1587 bp, Artificial Sequence; identical to SEQ ID NO: 18242
  Description of Artificial Sequence: Synthetic coding sequence

SEQ ID NO: 18245 - DNA, 2610 bp, Artificial Sequence
  Description of Artificial Sequence: Synthetic coding sequence
atggagcctgagacagccctgtggggccctgacctgcagggccctgagcagagccccaatgatgcccacagaggagctgagagtgaaaatgaggaggagagcccccggcaggagagcagcggggaggagatcatcatgggagaccctgcccagagccctgagagcaaggacagcacagagatgagcctggagaggagcagccaggaccccagcgtgccccagaacccccccacccccctgggccacagcaaccccctggaccaccagatccccctggaccccccagcccctgaggtggtgcccacccccagcgactggaccaaggcctgtgaggcctcctggcagtggggcgccctgaccacctggaacagcccccctgtggtgcctgccaatgagcccagcctgcgggagctggtgcagggccggcctgctggagctgagaagccctacatctgcaatgaatgtgggaagagcttcagccagtggagcaagctgctgcggcaccagaggatccacactggagagcggcccaacacctgcagtgaatgtgggaagagcttcacccagagcagccacctggtgcagcaccagaggacccacactggagagaagccctacaagtgcccagactgtgggaagtgcttctcctggagcagcaacctggtgcagcaccagaggacccacactggagagaagccctacaagtgcacagaatgtgagaaggccttcacccagagcaccaacctgatcaagcaccagaggagccacactggagagaagccctacaagtgtggggagtgccggcgggccttctaccgcagcagtgacctgatccagcaccaggccacccacactggagagaagccctacaagtgcccagaatgtgggaagagatttggccagaaccacaacctgctgaagcaccagaagatccatgctggggagaagccctaccgctgcacagaatgtgggaagagcttcatccagagcagcgagctgacccagcaccagaggacccacactggagagaagccctatgaatgtctggagtgtgggaagagctttggccacagcagcaccctcatcaagcaccagaggacccacctgcgggaggaccccttcaagtgccctgtgtgtgggaagaccttcaccctgagcgccaccctgctgcggcaccagaggacccacactggagagcggccctacaagtgcccagaatgtgggaagagcttctctgtgagcagcaacctgatcaaccaccagaggatccacagaggagagcggccctacatctgtgccgactgtgggaagagcttcatcatgagcagcaccctcatccgccaccagaggatccacactggagagaagccctacaagtgcagcgactgtgggaagagcttcatccgcagcagccacctgatccagcacaggaggacccacactggagagaagccctacaagtgcccagaatgtgggaagagcttcagccagagcagcaacctgatcacccacgtgaggacccacatggatgagaacctgtttgtgtgcagcgactgtgggaaggccttcctggaggcccacgagctggagcagcacagggtcatccacgagcggggcaagaccccagcccggcgggcccagggcgacagcctgctgggcctgggggaccccagcctgctgaccccacctcctggggccaagccccacaagtgcctggtgtgtgggaagggcttcaatgatgagggcatcttcatgcagcaccagaggatccacatcggggagaacccctacaagaatgctgatggcctcatcgcccatgctgcccccaagccaccccagctgcggagcccccggctgcccttccggggcaacagctacccaggagctgctgagggccgggcagaggcccctggccagcccctgaagcccccagagggccaggagggcttcagccagaggcggggcctgctgagcagcaagacctacatctgcagccactgtggggagagcttcctggacagatctgtgctgctgcagcaccagctgacccacggcaatgagaagcccttcctgttcccagactacagaattggcctgggggagggcgccggccccagccccttcctgagcggcaagcccttcaagtgcccagagtgcaagcagagctttggcctgagcagcgagctgctgctgcaccagaaggtgcatgctgggggcaagagcagccagaagagccctgagctgggcaagagcagctctgtgctgctggagcacctgcggagccccctgggcgcccggccctaccgctgcagcgactgccgggccagcttcctggacagagtggccctgaccaggcaccaggagacccacacccaggagaagccacccaacccagaagatcctcctcctgaggccgtgaccctgagcacagaccaggagggggagggggagacccccacccccacagagagcagcagccatggagagggccagaaccccaagaccctggtggaggagaagccctacctgtgcccagaatgtggggccggcttcacagaggtggccgccctgctgctgcacaggagctgccaccctggggtgtccctgtag

SEQ ID NO: 18246 - DNA, 1458 bp, Artificial Sequence
  Description of Artificial Sequence: Synthetic coding sequence
atgaatgagtaccccaagaagaggaagaggaagaccctgcaccccagccgctacagcgacagcagcggcatcagcagaattgctgatggcttcaacggcatcttcagtgaccactgctacagcgtgtgcagcatgaggcagcctgacctgaagtactttgacaacaaggatgatgacagcgacacagagaccagcaatgacctgcccaagtttgctgatggcatcaaggccaggaacagaaaccagaactacctggtgcccagccctgtgctgcgcatcctggaccacacagccttcagcacagagaagtctgctgacatcgtcatctgtgatgaagaatgtgacagccctgagagcgtgaaccagcagacccaggaggagagccccatcgaggtgcacacagcagaagatgtgcccatcgctgtggaggtgcacgccatcagtgaagattatgacattgaaacagagaacaacagcagcgagagcctgcaggaccagacagatgaggagcccccagccaagctgtgcaagatcctggacaagagccaggccctgaatgtgacagcccagcagaagtggcccctgctgcgggccaacagcagcggcctgtacaagtgtgagctgtgtgagttcaacagcaagtacttcagtgacctgaagcagcacatgatcctgaagcacaagaggacagacagcaatgtgtgccgggtgtgcaaggagagcttcagcaccaacatgctgctgattgaacatgccaagctgcacgaggaggacccctacatctgcaagtactgtgactacaagacagtcatctttgagaacctgagccagcacatcgctgacacccacttcagtgaccacctgtactggtgtgagcagtgtgatgtgcagttcagcagcagcagcgagctgtacctgcacttccaggagcacagctgtgatgagcagtacctgtgccagttctgtgagcacgagaccaatgaccctgaggacctgcacagccacgtggtgaatgagcacgcctgcaagctgattgagctgagtgacaagtacaacaatggagagcacggccagtacagcctgctgagcaagatcacctttgacaagtgcaagaacttctttgtgtgccaggtgtgtggcttccgcagccggctgcacaccaacgtgaacagacatgtggccatcgagcacaccaagatcttcccccacgtgtgtgatgactgtgggaagggcttcagctccatgctggagtactgcaagcacctgaacagccacctgtctgagggcatctacctgtgccagtactgtgagtacagcacaggccagatcgaggacctgaagatccacctggacttcaagcacagcgctgacctgccccacaagtgcagcgactgcctgatgagatttggaaatgaaagagagctgatcagccacctgcctgtgcatgagaccacctag

SEQ ID NO: 18247 - DNA, 867 bp, Artificial Sequence
  Description of Artificial Sequence: Synthetic coding sequence
atgaatgagtaccccaagaagaggaagaggaagaccctgcaccccagccgctacagcgacagcagcggcatcagcagaattgctgatggcttcaacggcatcttcagtgaccactgctacagcgtgtgcagcatgaggcagcctgacctgaagtactttgacaacaaggatgatgacagcgacacagagaccagcaatgacctgcccaagtttgctgatggcatcaaggccaggaacagaaaccagaactacctggtgcccagccctgtgctgcgcatcctggaccacacagccttcagcacagagaagtctgctgacatcgtcatctgtgatgaagaatgtgacagccctgagagcgtgaaccagcagacccaggaggagagccccatcgaggtgcacacagcagaagatgtgcccatcgctgtggaggtgcacgccatcagtgaagattatgacattgaaacagagaacaacagcagcgagagcctgcaggaccagacagatgaggagcccccagccaagctgtgcaagatcctggacaagagccaggccctgaatgtgacagcccagcagaagtggcccctgctgcgggccaacagcagcggcctgtacaagtgtgagctgtgtgagttcaacagcaagtacttcagtgacctgaagcagcacatgatcctgaagcacaagaggacagacagcaatgtgtgccgggtgtgcaaggagagcttcagcaccaacatgctgctgattgaacatgccaagctgcacgaggaggacccctacatctgcaagtactgtgactacaagacagtcatctttgagaacctgagccagcacatcgctgacacccacttcagtgaccacctgtag

SEQ ID NO: 18248 - DNA, 414 bp, Artificial Sequence
  Description of Artificial Sequence: Synthetic coding sequence
atgaatgagtaccccaagaagaggaagaggaagaccctgcaccccagccgctacagcgacagcagcggcatcagcagaattgctgatggcttcaacggcatcttcagtgaccactgctacagcgtgtgcagcatgaggcagcctgacctgaagtactttgacaacaaggatgatgacagcgacacagagaccagcaatgacctgcccaagtttgctgatggcatcaaggccaggaacagaaaccagaactacctggtgcccagccctgtgctgcgcatcctggaccacacagccttcagcacagagaagtctgctgacatcgtcatctgtgatgaagaatgtgacagccctgagagcgtgaaccagcagacccaggaggagagccccatcgaggtgcacacagctgaggactag

SEQ ID NO: 18249 - DNA, 1458 bp, Artificial Sequence; identical to SEQ ID NO: 18246
  Description of Artificial Sequence: Synthetic coding sequence

SEQ ID NO: 18250 - DNA, 651 bp, Artificial Sequence
  Description of Artificial Sequence: Synthetic coding sequence
atgaatgagtaccccaagaagaggaagaggaagaccctgcaccccagccgctacagcgacagcagcggcatcagcagaattgctgatggcttcaacggcatcttcagtgaccactgctacagcgtgtgcagcatgaggcagcctgacctgaagtactttgacaacaaggatgatgacagcgacacagagaccagcaatgacctgcccaagtttgctgatggcatcaaggccaggaacagaaaccagaactacctggtgcccagccctgtgctgcgcatcctggaccacacagccttcagcacagagaagtctgctgacatcgtcatctgtgatgaagaatgtgacagccctgagagcgtgaaccagcagacccaggaggagagccccatcgaggtgcacacagcagaagatgtgcccatcgctgtggaggtgcacgccatcagtgaagattatgacattgaaacagagaacaacagcagcgagagcctgcaggaccagacagatgaggagcccccagccaagctgtgcaagatcctggacaagagccaggccctgaatgtgacagcccagcagaagtggcccctgctgcgggccaacagcagcggcctgtacaagtgtgagctgtgtgagttcaacagcaagtacttctag

SEQ ID NO: 18251 - DNA, 393 bp, Artificial Sequence
  Description of Artificial Sequence: Synthetic coding sequence
atgaatgagtaccccaagaagaggaagaggaagaccctgcaccccagccgctacagcgacagcagcggcatcagcagaattgctgatggcttcaacggcatcttcagtgaccactgctacagcgtgtgcagcatgaggcagcctgacctgaagtactttgacaacaaggatgatgacagcgacacagagaccagcaatgacctgcccaagtttgctgatggcatcaaggccaggaacagaaaccagaactacctggtgcccagccctgtgctgcgcatcctggaccacacagccttcagcacagagaagtctgctgacatcgtcatctgtgatgaagaatgtgacagccctgagagcgtgaaccagcagacccaggaggagagccccatctag

SEQ ID NO: 18252 - DNA, 1458 bp, Artificial Sequence; identical to SEQ ID NO: 18246
  Description of Artificial Sequence: Synthetic coding sequence

SEQ ID NO: 18253 - DNA, 1113 bp, Artificial Sequence
  Description of Artificial Sequence: Synthetic coding sequence
atggctgctgagcggcaggaggccctgcgggagtttgtggccgtgactggagctgaggaggaccgggcccgcttcttcctggagagcgctggctgggacctgcagatcgccctggccagcttctatgaagatggaggagatgaggacatcgtgaccatcagccaggccacccccagctctgtgtcccggggcacagcccccagcgacaacagagtgaccagcttccgggacctgattcatgaccaggatgaagatgaggaggaggaggagggccagcgcttctacgccggcggcagcgagaggagcggccagcagatcgtgggcccccccaggaagaagagccccaatgagctggtggatgacctcttcaagggggccaaggagcacggggctgtggccgtggagcgggtgaccaagagccctggagagaccagcaagccccggccctttgctgggggcggctaccgcctgggcgccgcccctgaggaggagagcgcctacgtggccggggagaagaggcagcacagcagccaggatgtgcacgtggtgctgaagctgtggaagagcggcttcagcctggacaatggagagctgcggagctaccaggaccccagcaatgcccagttcctggagagcatccggcggggggaggtgcctgctgagctgcggcggctggcccatggaggccaggtgaacctggacatggaggaccacagagatgaagattttgtgaagcccaagggggccttcaaggccttcaccggggagggccagaagctgggcagcacagccccccaggtgctgagcaccagcagccctgcccagcaggccgagaatgaggccaaggccagcagcagcatcctgattgatgagagcgagcccaccaccaacatccagatccggctggctgatggcggccgcctggtgcagaagttcaaccacagccaccgcatcagtgacatccgcctcttcatcgtggatgcccggcctgccatggccgccaccagcttcatcctgatgaccaccttccccaacaaggagctggctgatgagagccagaccctgaaggaggccaacctgctgaatgctgtgattgtgcagaggctgacctag

SEQ ID NO: 18254 - DNA, 1884 bp, Artificial Sequence
  Description of Artificial Sequence: Synthetic coding sequence
atgaatgccagcagcgagggggagagctttgctggctctgtgcagatccctgggggcaccaccgtgctggtggagctgaccccagacatccacatctgtggcatctgcaagcagcagttcaacaacctggatgcctttgtggcccacaagcagagcggctgccagctgaccggcaccagcgctgctgcccccagcacagtgcagtttgtgtctgaggagaccgtgcctgccacccagacccagaccaccaccaggaccatcaccagcgagacccagaccatcaccggctgccagttcaagacagcctacggcatgaaggacatggagcggcacctgaagatccacactggagacaagccccacaagtgtgaggtgtgtgggaagtgcttcagcaggaaggacaagctgaagacccacatgcgctgccacactggagtgaagccctacaagtgcaagacctgtgactatgctgctgctgacagcagcagcctgaacaagcacctgcgcatccacagtgatgagcggcccttcaagtgccagatctgcccctatgccagcaggaacagcagccagctgactgtgcacctgcggagccacactggagatgcccccttccagtgctggctgtgcagcgccaagttcaagatcagcagtgacctgaagaggcacatgagggtgcacagcggggagaagcccttcaagtgtgagttctgcaatgtgcgctgcaccatgaagggcaacctgaagagccacatccgcatcaagcacagcggcaacaacttcaagtgcccccactgtgacttcctgggggacagcaaggccaccctgaggaagcacagccgggtgcaccagagcgagcaccctgagaagtgcagtgaatgttcctacagctgcagcagcaaggccgccctgcgcatccacgagcgcatccactgcacagaccggcccttcaagtgcaactactgcagctttgacaccaagcagcccagcaacctgagcaagcacatgaagaagttccacggggacatggtgaagacagaggccctggagaggaaggacaccggccggcagagcagccggcaggtggccaagctggatgccaagaagagcttccactgtgacatctgtgatgccagcttcatgagggaggacagcctgcggagccacaagaggcagcacagcgagtacagcgagagcaagaacagtgatgtgacagtgctgcagttccagattgaccccagcaagcagcctgccacccccctgactgtgggccacctgcaggtgcccctgcagcccagccaggtgccccagttcagcgagggccgggtgaagatcatcgtgggccaccaggtgccccaggccaacaccatcgtgcaggccgctgctgctgctgtgaacatcgtgcccccagccctggtggcccagaaccctgaggagctgcccggcaacagccggctgcagatcctgcggcaggtgtccctgattgccccaccccagagcagccgctgccccagcgaggccggggccatgacccagcctgctgtgctgctgaccacccatgagcagacagatggagccaccctgcaccagaccctcatccccacagccagcggcggcccccaggagggcagcggcaaccagaccttcatcaccagcagcggcatcacctgcacagactttgagggcctgaatgccctgatccaggagggcacagctgaggtgacagtggtgtctgatggcggccagaacattgctgtggccaccacagcccctcctgtgttcagcagcagcagccagcaggagctgcccaagcagacctacagcatcatccagggcgccgcccacccagccctgctgtgcccagctgacagcatcccagactag

SEQ ID NO: 18255 - DNA, 1938 bp, Artificial Sequence
  Description of Artificial Sequence: Synthetic coding sequence
atgaatgccagcagcgagggggagagctttgctggctctgtgcagatccctgggggcaccaccgtgctggtggagctgaccccagacatccacatctgtggcatctgcaagcagcagttcaacaacctggatgcctttgtggcccacaagcagagcggctgccagctgaccggcaccagcgctgctgcccccagcacagtgcagtttgtgtctgaggagaccgtgcctgccacccagacccagaccaccaccaggaccatcaccagcgagacccagaccatcaccgtgtctgcccctgagtttgtgtttgaacatggctaccagacctacctgcccacagagagcaatgaaaaccagacagccaccgtcatcagcctgcctgccaagagcaggaccaagaagcccaccaccccaccagcccagaagaggctgaactgctgctacccaggctgccagttcaagacagcctacggcatgaaggacatggagcggcacctgaagatccacactggagacaagccccacaagtgtgaggtgtgtgggaagtgcttcagcaggaaggacaagctgaagacccacatgcgctgccacactggagtgaagccctacaagtgcaagacctgtgactatgctgctgctgacagcagcagcctgaacaagcacctgcgcatccacagtgatgagcggcccttcaagtgccagatctgcccctatgccagcaggaacagcagccagctgactgtgcacctgcggagccacacagccagcgagctggatgatgatgtgcccaaggccaactgcctgagcacagagagcacagacacccccaaggcccctgtgatcaccctgcccagcgaggcccgggagcagatggccaccctgggggagaggaccttcaactgctgctacccaggctgccacttcaagacagtgcacggcatgaaggacctggacagacacctgcgcatccacactggagacaagccccacaagtgtgagttctgtgacaagtgcttcagcaggaaggacaacctgaccatgcacatgcgctgccacacctctgtgaagccccacaagtgccacctgtgtgactatgctgctgtggacagcagcagcctgaagaagcacctgcgcatccacagtgatgagcggccctacaagtgccagctgtgcccctatgccagcaggaacagcagccagctgactgtgcacctgcggagccacactggagacacccccttccagtgctggctgtgcagcgccaagttcaagatcagcagtgacctgaagaggcacatgattgtgcacagcggggagaagcccttcaagtgtgagttctgtgatgtgcgctgcaccatgaaggccaacctgaagagccacatccgcatcaagcacaccttcaagtgcctgcactgtgccttccagggccgggacagagctgacctgctggagcacagccggctgcaccaggccgaccaccctgagaagtgcccagaatgttcctacagctgcagcagcgctgctgccctgcgggtgcacagccgggtgcactgcaaggaccggcccttcaagtgtgacttctgcagctttgacaccaagaggcccagcagcctggccaagcacgtggacaaggtgcacagagatgaggccaagacagaaaatagagcccccctgggcaaggagggcctgcgggagggcagcagccagcacgtggccaagatcgtgacccagagggccttccgctgtgagacctgtggggccagctttgtgagagatgacagcctgcgctgccacaagaagcagcacagcgaccagagcgagaacaagaacagcgacctggtgaccttccccccagagagcggggccagcggccagctgagcaccctggtgtctgtgggccagctggaggcccccctggagcccagccaggacctgtag

SEQ ID NO: 18256 - DNA, 2040 bp, Artificial Sequence
  Description of Artificial Sequence: Synthetic coding sequence
atgaatgccagcagcgagggggagagctttgctggctctgtgcagagcggcaccaccgtgctggtggagctgaccccagacatccacatctgtggcatctgcaagcagcagttcaacaacctggatgcctttgtggcccacaagcagagcggctgccagctgaccggcaccagcgctgctgcccccagcacagtgcagtttgtgtctgaggagaccgtgcctgccacccagacccagaccaccaccaggaccatcaccagcgagacccagaccatcaccgtgtctgcccctgagtttgtgtttgaacatggctaccagacctacctgcccacagagagcaatgaaaaccagacagccaccgtcatcagcctgcctgccaagagcaggaccaagaagcccaccaccccaccagcccagaagaggctgaactgctgctacccaggctgccagttcaagacagcctacggcatgaaggacatggagcggcacctgaagatccacactggagacaagccccacaagtgtgaggtgtgtgggaagtgcttcagcaggaaggacaagctgaagacccacatgcgctgccacactggagtgaagccctacaagtgcaagacctgtgactatgctgctgctgacagcagcagcctgaacaagcacctgcgcatccacagtgatgagcggcccttcaagtgccagatctgcccctatgccagcaggaacagcagccagctgactgtgcacctgcggagccacactggagatgcccccttccagtgctggctgtgcagcgccaagttcaagatcagcagtgacctgaagaggcacatgagggtgcacagcggggagaagcccttcaagtgtgagttctgcaatgtgcgctgcaccatgaagggcaacctgaagagccacatccgcatcaagcacagcggcaacaacttcaagtgcccccactgtgacttcctgggggacagcaaggccaccctgaggaagcacagccgggtgcaccagagcgagcaccctgagaagtgcagtgaatgttcctacagctgcagcagcaaggccgccctgcgcatccacgagcgcatccactgcacagaccggcccttcaagtgcaactactgcagctttgacaccaagcagcccagcaacctgagcaagcacatgaagaagttccacggggacatggtgaagacagaggccctggagaggaaggacaccggccggcagagcagccggcaggtggccaagctggatgccaagaagagcttccactgtgacatctgtgatgccagcttcatgagggaggacagcctgcggagccacaagaggcagcacagcgagtacagcgagagcaagaacagtgatgtgacagtgctgcagttccagattgaccccagcaagcagcctgccacccccctgactgtgggccacctgcaggtgcccctgcagcccagccaggtgccccagttcagcgagggccgggtgaagatcatcgtgggccaccaggtgccccaggccaacaccatcgtgcaggccgctgctgctgctgtgaacatcgtgcccccagccctggtggcccagaaccctgaggagctgcccggcaacagccggctgcagatcctgcggcaggtgtccctgattgccccaccccagagcagccgctgccccagcgaggccggggccatgacccagcctgctgtgctgctgaccacccatgagcagacagatggagccaccctgcaccagaccctcatccccacagccagcggcggcccccaggagggcagcggcaaccagaccttcatcaccagcagcggcatcacctgcacagactttgagggcctgaatgccctgatccaggagggcacagctgaggtgacagtggtgtctgatggcggccagaacattgctgtggccaccacagcccctcctgtgttcagcagcagcagccagcaggagctgcccaagcagacctacagcatcatccagggcgccgcccacccagccctgctgtgcccagctgacagcatcccagactag

SEQ ID NO: 18257 - DNA, 1932 bp, Artificial Sequence
  Description of Artificial Sequence: Synthetic coding sequence
atgaatgccagcagcgagggggagagctttgctggctctgtgcagatccctgggggcaccaccgtgctggtggagctgaccccagacatccacatctgtggcatctgcaagcagcagttcaacaacctggatgcctttgtggcccacaagcagagcggctgccagctgaccggcaccagcgctgctgcccccagcacagtgcagtttgtgtctgaggagaccgtgcctgccacccagacccagaccaccaccaggaccatcaccagcgagacccagaccatcaccgtgtctgcccctgagtttgtgtttgaacatggctaccagacctacctgcccacagagagcaatgaaaaccagacagccaccgtcatcagcctgcctgccaagagcaggaccaagaagcccaccaccccaccagcccagaagaggctgaactgctgctacccaggcaagggcagcatcatgagctacctgtgccggggcctgggccgctaccccagcgagatcatcagtgatgtgcagaagagctgcaagaactgcaccaagaagaacagccccaacgtgaccatcctgctgtacctgctgtgccacagcctgtacatctacaagctgctgcagtgtgtgttccccaagaaccagaacatcctgctgaacaaccacaggaccatcatcaagagtgactttgtgatcaagtgccacttcatgtccttcatcagcagcaaccaggagcagctgagcatctacctgtccttccggctgtgcagctttggaagaaaccacaagatgacagtgtgcttcagccgcagcagccacatcttccccatcaccgtggtgctgaccctggtgacctggctgaggatgttcctgcccgtcttctccatgctgaagctgtccttcttcttcctgggctgccagttcaagacagcctacggcatgaaggacatggagcggcacctgaagatccacactggagacaagccccacaagtgtgaggtgtgtgggaagtgcttcagcaggaaggacaagctgaagacccacatgcgctgccacactggagtgaagccctacaagtgcaagacctgtgactatgctgctgctgacagcagcagcctgaacaagcacctgcgcatccacagtgatgagcggcccttcaagtgccagatctgcccctatgccagcaggaacagcagccagctgactgtgcacctgcggagccacactggagatgcccccttccagtgctggctgtgcagcgccaagttcaagatcagcagtgacctgaagaggcacatgagggtgcacagcggggagaagcccttcaagtgtgagttctgcaatgtgcgctgcaccatgaagggcaacctgaagagccacatccgcatcaagcacagcggcaacaacttcaagtgcccccactgtgacttcctgggggacagcaaggccaccctgaggaagcacagccgggtgcaccagagcgagcaccctgagaagtgcagcgagtgcagctacagctgcagcagcaaggccgccctgcgcatccacgagcgcatccactgcacagaccggcccttcaagtgcaactactgcagctttgacaccaagcagcccagcaacctgagcaagcacatgaagaagttccatggagacatggtgaagacagaggccctggagaggaaggacaccggccggcagagcagccggcaggtggccaagctggatgccaagaagagcttccactgtgacatctgtgatgccagcttcatgagggaggacagcctgcggagccacaagaggcagcacagcgagtacagcgagagcaagaacagtgatgtgacagtgctgcagttccagattgaccccagcaagcagcctgccacccccctgactgtgggccacctgcaggtgcccctgcagcccagccaggtgccctag

SEQ ID NO: 18258 - DNA, 1281 bp, Artificial Sequence
  Description of Artificial Sequence: Synthetic coding sequence
atgagcaggaggaagcaggccaagccccagcacctgaacagcgaggagcccaggcctgccaggagagaatgtgccgaggtggccccccaggtggccggggagcccgccagcgagctggatgatgatgtgcccaaggccaactgcctgagcacagagagcacagacacccccaaggcccctgtgatcaccctgcccagcgaggcccgggagcagatggccaccctgggggagaggaccttcaactgctgctacccaggctgccacttcaagacagtgcacggcatgaaggacctggacagacacctgcgcatccacactggagacaagccccacaagtgtgagttctgtgacaagtgcttcagcaggaaggacaacctgaccatgcacatgcgctgccacacctctgtgaagccccacaagtgccacctgtgtgactatgctgctgtggacagcagcagcctgaagaagcacctgcgcatccacagtgatgagcggccctacaagtgccagctgtgcccctatgccagcaggaacagcagccagctgactgtgcacctgcggagccacactggagacacccccttccagtgctggctgtgcagcgccaagttcaagatcagcagtgacctgaagaggcacatgattgtgcacagcggggagaagcccttcaagtgtgagttctgtgatgtgcgctgcaccatgaaggccaacctgaagagccacatccgcatcaagcacaccttcaagtgcctgcactgtgccttccagggccgggacagagctgacctgctggagcacagccggctgcaccaggccgaccaccctgagaagtgcccagagtgcagctacagctgcagcagcgctgctgccctgcgggtgcacagccgggtgcactgcaaggaccggcccttcaagtgtgacttctgcagctttgacaccaagaggcccagcagcctggccaagcacgtggacaaggtgcacagagatgaggccaagacagagaacagagcccccctgggcaaggagggcctgcgggagggcagcagccagcacgtggccaagatcgtgacccagagggccttccgctgtgagacctgtggggccagctttgtgagagatgacagcctgcgctgccacaagaagcagcacagcgaccagagcgagaacaagaacagcgacctggtgaccttccccccagagagcggggccagcggccagctgagcaccctggtgtctgtgggccagctggaggcccccctggagcccagccaggacctgtag

SEQ ID NO: 18259 - DNA, 396 bp, Artificial Sequence
  Description of Artificial Sequence: Synthetic coding sequence
atgaggggccaccccagcctgcggcccccctggcactgggccagcgctgcccggctggagggcggcttcctgccctggggctacgtgtccaatgccctgagccgggagggcctgacagaggagaggacctttgagcggcggcctgagggctgggagggcgccagctgtgccgccagcgagctggatgatgatgtgcccaaggccaactgcctgagcacagagagcacagacacccccaaggcccctgtgatcaccctgcccagcgaggcccgggagcagatggccaccctgggggagaggaccttcaactgctgctacccaggctgccacttcaagacagtgcacggcatgaaggacctggacagacacctgcgcatccacacagccagctgctag

SEQ ID NO: 18260 - DNA, 666 bp, Artificial Sequence
  Description of Artificial Sequence: Synthetic coding sequence
atgaggggccaccccagcctgcggcccccctggcactgggccagcgctgcccggctggagggcggcttcctgccctggggctacgtgtccaatgccctgagccgggagggcctgacagaggagaggacctttgagcggcggcctgagggctgggagggcgccagctgtgccgccagcgagctggatgatgatgtgcccaaggccaactgcctgagcacagagagcacagacacccccaaggcccctgtgatcaccctgcccagcgaggcccgggagcagatggccaccctgggggagaggaccttcaactgctgctacccaggctgccacttcaagacagtgcacggcatgaaggacctggacagacacctgcgcatccacactggagacaagccccacaagtgtgagttctgtgacaagtgcttcagcaggaaggacaacctgaccatgcacatgcgctgccacacctctgtgaagccccacaagtgccacctgtgtgactatgctgctgtggacagcagcagcctgaagaagcacctgcgcatccacagtgatgagcggccctacaagtgccagctgtgcccctatgccagcaggaacagcagccagctgactgtgcacctgcggagccacactggagacacccccttccagtgctggctgtag

SEQ ID NO: 18261 - DNA, 363 bp, Artificial Sequence
  Description of Artificial Sequence: Synthetic coding sequence
tgagaaagaaccttcaactgctgctacccaggctgccacttcaagacagtgcacggcatgaaggacctggacagacacctgcgcatccacactggagacaagccccacaagtgtgagttctgtgacaagtgcttcagcaggaaggacaacctgaccatgcacatgcgctgccacacctctgtgaagccccacaagtgccacctgtgtgactatgctgctgtggacagcagcagcctgaagaagcacctgcgcatccacagtgatgagcggccctacaagtgccagctgtgcccctatgccagcaggaacagcagccagctgactgtgcacctgcggagccacactggacctggccctggatag

SEQ ID NO: 18262 - DNA, 1572 bp, Artificial Sequence
  Description of Artificial Sequence: Synthetic coding sequence
atgaaggacatggagcggcacctgaagatccacactggagacaagccccacaagtgtgaggtgtgtgggaagtgcttcagcaggaaggacaagctgaagacccacatgcgctgccacactggagtgaagccctacaagtgcaagacctgtgactatgctgctgctgacagcagcagcctgaacaagcacctgcgcatccacagtgatgagcggcccttcaagtgccagatctgcccctatgccagcaggaacagcagccagctgactgtgcacctgcggagccacactggagatgcccccttccagtgctggctgtgcagcgccaagttcaagatcagcagtgacctgaagaggcacatgagggtgcacagcggggagaagcccttcaagtgtgagttctgcaatgtgcgctgcaccatgaagggcaacctgaagagccacatccgcatcaagcacagcggcaacaacttcaagtgcccccactgtgacttcctgggggacagcaaggccaccctgaggaagcacagccgggtgcaccagagcgagcaccctgagaagtgcagtgaatgttcctacagctgcagcagcaaggccgccctgcgcatccacgagcgcatccactgcacagaccggcccttcaagtgcaactactgcagctttgacaccaagcagcccagcaacctgagcaagcacatgaagaagttccacggggacatggtgaagacagaggccctggagaggaaggacaccggccggcagagcagccggcaggtggccaagctggatgccaagaagagcttccactgtgacatctgtgatgccagcttcatgagggaggacagcctgcggagccacaagaggcagcacagcgagtacagcgagagcaagaacagtgatgtgacagtgctgcagttccagattgaccccagcaagcagcctgccacccccctgactgtgggccacctgcaggtgcccctgcagcccagccaggtgccccagttcagcgagggccgggtgaagatcatcgtgggccaccaggtgccccaggccaacaccatcgtgcaggccgctgctgctgctgtgaacatcgtgcccccagccctggtggcccagaaccctgaggagctgcccggcaacagccggctgcagatcctgcggcaggtgtccctgattgccccaccccagagcagccgctgccccagcgaggccggggccatgacccagcctgctgtgctgctgaccacccatgagcagacagatggagccaccctgcaccagaccctcatccccacagccagcggcggcccccaggagggcagcggcaaccagaccttcatcaccagcagcggcatcacctgcacagactttgagggcctgaatgccctgatccaggagggcacagctgaggtgacagtggtgtctgatggcggccagaacattgctgtggccaccacagcccctcctgtgttcagcagcagcagccagcaggagctgcccaagcagacctacagcatcatccagggcgccgcccacccagccctgctgtgcccagctgacagcatcccagactag

SEQ ID NO: 18263 - DNA, 1581 bp, Artificial Sequence
  Description of Artificial Sequence: Synthetic coding sequence
atgccccagcagctgctgatcaccctgcccacagaggccagcacctgggtgaagctgcagcaccccaagaaggctgtggagggcgcccccctgtgggaggatgtgaccaagatgtttgaaggagaggccctgctgagccaggatgctgaagatgtgaagacccagcgggagagcctggaggatgaggtgaccccaggcctgcccacagctgagagccaggagctgctgaccttcaaggacatcagcattgacttcacccaggaggagtggggccagctggccccagcccaccagaacctgtaccgggaggtgatgctggagaactacagcaacctggtgtctgtgggctaccagctgagcaagcccagcgtcatcagccagctggagaagggggaggagccctggatggccgagaaggagggccctggggaccccagcagtgacctgaagagcaagattgagaccatcgagagcacagccaagagcaccatcagccaggagcggctgtaccacggcatcatgatggagagcttcatgagagatgacatcatctacagcaccctgaggaaggtgtccacctatgatgatgtgctggagcggcaccaggagacctgcatgagagatgtgcggcaggccatcctgacccacaagaagagggtgcaggagaccaacaagtttggagagaacatcatcgtgcacagcaatgtcatcatcgagcagaggcaccacaagtatgacacccccaccaagaggaacacctacaagctggacctgatcaaccaccccaccagctacatccgcaccaagacctatgagtgcaacatctgtgagaagatcttcaagcagcccatccacctgacagagcacatgaggatccacactggagagaagcccttccgctgcaaggaatgtggccgggccttcagccagagcgccagcctgagcacccaccagaggatccacactggagagaagccctttgaatgtgaagaatgtgggaaggccttccgccacaggagcagcctgaaccagcaccacaggacccacactggagagaagccctacgtgtgtgacaagtgccagaaggccttcagccagaacatcagcctggtgcagcacctgcggacccacagcggggagaagcccttcacctgcaatgaatgtgggaagaccttccggcagatccgccacctgtctgagcacatccgcatccacactggagagaagccctatgcctgcacagcctgctgcaagaccttcagccaccgggcctacctgacccaccaccagaggatccacactggagagcggccctacaagtgcaaggaatgtgggaaggccttccggcagaggatccacctgagcaaccacaagacagtgcacactggagtgaaggcctatgagtgcaacagatgtgggaaggcctacagacatgacagcagcttcaagaagcaccagaggcaccacactggagagaagccctatgagtgcaatgaatgtgggaaggccttctcctacaacagcagcctgagccgccaccacgagatccacagaagaaatgccttcaggaacaaggtgtag

SEQ ID NO: 18264 - DNA, 1581 bp, Artificial Sequence; identical to SEQ ID NO: 18263
  Description of Artificial Sequence: Synthetic coding sequence

SEQ ID NO: 18265 - DNA, 1299 bp, Artificial Sequence
  Description of Artificial Sequence: Synthetic coding sequence
atgctggagaactacggcaacctggtgtctgtgggctgccagctgagcaagccaggagtcatcagccagctggagaagggggaggagccctggctgatggagcgggacatcagcggcgtgcccagcagtgacctgaagagcaagaccaagaccaaggagagcgccctgcagaatgacatctcctgggaggagctgcactgcggcctgatgatggagcgcttcaccaagggcagctccatgtacagcaccctgggccgcatcagcaagtgcaacaagctggagagccagcaggagaaccagaggatgggcaagggccagatccccctgatgtgcaagaagaccttcacccaggagcggggccaggagagcaacagatttgagaagaggatcaacgtgaagtctgaggtgatgcctggccccatcggcctgcccaggaagagggacagaaaatatgacacccctgggaagaggagccgctacaacatcgacctggtgaaccacagccgcagctacaccaagatgaagacctttgagtgcaacatctgtgagaagatcttcaagcagctgatccacctgacagagcacatgaggatccacactggagagaagcccttccgctgcaaggaatgtgggaaggccttcagccagagcagcagcctcatcccccaccagaggatccacactggagagaagccctatgagtgcaaggaatgtgggaagaccttccgccaccccagcagcctgacccagcacgtgcgcatccacactggagagaagccctatgagtgccgggtgtgtgagaaggccttcagccagagcatcggcctcatccagcacctgcggacccacgtgcgggagaagcccttcacctgcaaggactgtgggaaggccttcttccagatccgccacctgcggcagcacgagatcatccacactggagtgaagccctacatctgcaatgtgtgcagcaagaccttcagccacagcacctacctgacccagcaccagaggacccacactggagagcggccctacaagtgcaaggaatgtgggaaggccttcagccagaggatccacctgagcatccaccagagggtgcacactggagtgaagccctatgagtgcagccactgtgggaaggccttcagacatgacagcagctttgccaagcaccagaggatccacactggagagaagccctatgactgcaatgaatgtgggaaggccttcagctgcagcagcagcctcatccgccactgcaagacccacctgaggaacaccttcagcaatgtggtgtag

SEQ ID NO: 18266 - DNA, 1605 bp, Artificial Sequence
  Description of Artificial Sequence: Synthetic coding sequence
atgctgcagcagctgctgatcaccctgcccacagaggccagcacctgggtgaagctgcggcaccccaaggccgccacagagcgggtggccctgtgggaggatgtgaccaagatgttcaaggccgaggccctgctgagccaggatgctgatgagacccagggcgagagcctggagagccgggtgaccctgggcagcctgacagctgagagccaggagctgctgaccttcaaggatgtgtctgtggacttcacccaggaggagtggggccagctggccccagcccacaggaacctgtaccgggaggtgatgctggagaactacggcaacctggtgtctgtgggctgccagctgagcaagccaggagtcatcagccagctggagaagggggaggagccctggctgatggagcgggacatcagcggcgtgcccagcagtgacctgaagagcaagaccaagaccaaggagagcgccctgcagaatgacatctcctgggaggagctgcactgcggcctgatgatggagcgcttcaccaagggcagctccatgtacagcaccctgggccgcatcagcaagtgcaacaagctggagagccagcaggagaaccagaggatgggcaagggccagatccccctgatgtgcaagaagaccttcacccaggagcggggccaggagagcaacagatttgagaagaggatcaacgtgaagtctgaggtgatgcctggccccatcggcctgcccaggaagagggacagaaaatatgacacccctgggaagaggagccgctacaacatcgacctggtgaaccacagccgcagctacaccaagatgaagacctttgagtgcaacatctgtgagaagatcttcaagcagctgatccacctgacagagcacatgaggatccacactggagagaagcccttccgctgcaaggaatgtgggaaggccttcagccagagcagcagcctcatcccccaccagaggatccacactggagagaagccctatgagtgcaaggaatgtgggaagaccttccgccaccccagcagcctgacccagcacgtgcgcatccacactggagagaagccctatgagtgccgggtgtgtgagaaggccttcagccagagcatcggcctcatccagcacctgcggacccacgtgcgggagaagcccttcacctgcaaggactgtgggaaggccttcttccagatccgccacctgcggcagcacgagatcatccacactggagtgaagccctacatctgcaatgtgtgcagcaagaccttcagccacagcacctacctgacccagcaccagaggacccacactggagagcggccctacaagtgcaaggaatgtgggaaggccttcagccagaggatccacctgagcatccaccagagggtgcacactggagtgaagccctatgagtgcagccactgtgggaaggccttcagacatgacagcagctttgccaagcaccagaggatccacactggagagaagccctatgactgcaatgaatgtgggaaggccttcagctgcagcagcagcctcatccgccactgcaagacccacctgaggaacaccttcagcaatgtggtgtag

SEQ ID NO: 18267 - DNA, 1398 bp, Artificial Sequence
  Description of Artificial Sequence: Synthetic coding sequence
atgctgttcagcgccctcttcttcctgctgtacagcgccttcttccggcggcctgagtaccagaggaccatcttcaagttcctgggctggctgtgtgacctgagcatctacagcctcttcttccccatcagcaggatgtctgccttccagacctggagggacttccctgtgggggagaggagaagaccctggctgatggagcgggacatctctggagtgcccagcagtgacctgaagagcaagaccaagaccaaggagagcgccctgcagaatgacatctcctgggaggagctgcactgcggcctgatgatggagcgcttcaccaagggcagctccatgtacagcaccctgggccgcatcagcaagtgcaacaagctggagagccagcaggagaaccagaggatgggcaagggccagatccccctgatgtgcaagaagaccttcacccaggagcggggccaggagagcaacagatttgagaagaggatcaacgtgaagtctgaggtgatgcctggccccatcggcctgcccaggaagagggacagaaaatatgacaccccaggcaagaggagccgctacaacatcgacctggtgaaccacagccgcagctacaccaagatgaagacctttgagtgcaacatctgtgagaagatcttcaagcagctgatccacctgacagagcacatgaggatccacactggagagaagcccttccgctgcaaggaatgtgggaaggccttcagccagagcagcagcctcatcccccaccagaggatccacactggagagaagccctatgagtgcaaggaatgtgggaagaccttccgccaccccagcagcctgacccagcacgtgcgcatccacactggagagaagccctatgaatgtcgggtgtgtgagaaggccttcagccagagcatcggcctcatccagcacctgcggacccacgtgcgggagaagcccttcacctgcaaggactgtgggaaggccttcttccagatccgccacctgcggcagcacgagatcatccacactggagtgaagccctacatctgcaatgtgtgcagcaagaccttcagccacagcacctacctgacccagcaccagaggacccacactggagagcggccctacaagtgcaaggaatgtgggaaggccttcagccagaggatccacctgagcatccaccagagggtgcacactggagtgaagccctatgaatgtagccactgcggcaaggccttcagacatgacagcagctttgccaagcaccagaggatccacactggagagaagccctatgactgcaatgaatgtgggaaggccttcagctgcagcagcagcctcatccgccactgcaagacccacctgaggaacaccttcagcaatgtggtgtag

SEQ ID NO: 18268 - DNA, 5499 bp, Artificial Sequence
  Description of Artificial Sequence: Synthetic coding sequence
atggaggacaccccacccagcctgagctgcagcgactgccagaggcacttccccagcctgcctgagctgagccgccaccgggagctgctgcaccccagccccaaccaggacagcgaggaggccgacagcatcccccggccctaccgctgccagcagtgtggccggggctaccgccaccctggcagcctggtgaaccacaggaggacccatgagaccggcctcttcccctgcaccacctgtgggaaggacttcagcaaccccatggccctgaagagccacatgaggacccacgcccctgagggcagaagaagacacaggcctccccggcccaaggaggccaccccccacctgcagggcgagaccgtgtccacagacagctggggccagaggctgggcagcagcgagggctgggagaaccagaccaagcacacagaggagaccccagactgtgagagcgtgcctgacccccgggccgccagcggcacctgggaggacctgcccacccggcagcgggagggcctggccagccaccctggcccagaagatggagcagatggctggggccccagcaccaacagcgcccgggccccacccctgcccatcccagccagcagcctgctgagcaacctggagcagtacctggccgagagcgtggtgaacttcaccggcggccaggagcccacccagagccccccagctgaggaggagcggcgctacaagtgcagccagtgtgggaagacctacaagcatgctggcagcctgaccaaccaccggcagagccacaccctgggcatctacccctgtgccatctgcttcaaggagttcagcaacctgatggccctgaagaaccacagccggctgcacgcccagtaccggccctaccactgcccccactgccccagggtcttccggctgccccgggagctgctggagcaccagcagagccatgaaggagagcggcaggagccccgctgggaggagaagggcatgcccaccaccaacggccacacagatgagagcagccaggaccagctgcccagcgcccagatgctgaatggcagcgctgagctgagcaccagcggggagctggaggacagcggcctggaggagtaccggcccttccgctgtggggactgtggccgcacctacagacatgctggcagcctcatcaaccacaggaagagccaccagacaggagtgtacccctgcagcctgtgcagcaagcagctgttcaatgctgctgccctgaagaaccacgtgcgggcccaccaccggccccggcagggcgtgggggagaatggccagcccagcgtgcccccagcccccctgctgctggccgagaccacccacaaggaggaggaggaccccaccaccaccctggaccaccggccctacaagtgcagtgaatgtggccgggcctaccgccaccggggcagcctggtgaaccaccgccacagccacaggactggagagtaccagtgcagcctgtgccccaggaagtaccccaacctgatggccctgaggaaccacgtgcgggtgcactgcaaggccgccaggagatctgctgacatcggggctgagggcgcccccagccacctgaaggtggagctgcccccagaccctgtggaggccgaggccgccccccacacagaccaggaccacgtgtgcaagcatgaggaggaggccacagacatcaccccagctgctgacaagacagctgcccacatctgcagcatctgtggcctgctgtttgaagatgctgagagcctggagagacatggcctgacccatggagctggggagaaggagaacagcaggacagagaccaccatgagccccccccgggcctttgcctgccgggactgtgggaagagctaccgccacagcggcagcctcatcaaccaccggcagacccaccagacaggagacttcagctgtggggcctgtgccaagcacttccacaccatggccgccatgaagaaccacctgcggcggcacagcagaagaagaagccgccgccacaggaagagagctgggggcgccagcggcggccgggaggccaagctgctggccgctgagagctggacccgggagctggaggacaatgaaggcctggagagcccccaggaccccagcggggagagcccccatggagctgagggcaacctggagagtgatggagactgcctgcaggccgagagcgagggggacaagtgtggcctggagagagatgagacccacttccagggcgacaaggagagcggcggcactggagagggcctggagaggaaggatgccagcctgctggacaacctggacatccctggagaggagggcggcggcacccacttctgtgacagcctgactggagtggatgaggaccagaagccagccaccggccagcccaacagcagcagccacagcgccaatgctgtgacaggctggcaggccggggccgcccacacctgcagcgactgtggccacagcttcccccacgccaccggcctgctgagccaccggccctgccaccccccaggcatctaccagtgcagcctgtgccccaaggagtttgacagcctgcctgccctgcggagccacttccagaaccacaggcctggagaggccaccagcgcccagcccttcctgtgctgcctgtgtggcatgatcttccctggccgggccggctaccgcctgcaccggcggcaggcccacagcagcagcggcatgacagagggcagcgaggaggagggggaggaggagggcgtggccgaggccgccccagcccggagcccccccctgcagctgtctgaggccgagctgctgaaccagctgcagcgggaggtggaggccctggacagcgctggctacggccacatctgtggctgctgcggccagacctatgatgacctgggcagcctggagcggcaccaccagagccagagcagcggcaccacagctgacaaggcccccagccccctgggcgtggccggagatgccatggagatggtggtggacagcgtgctggaggacatcgtgaacagcgtgtctggagagggcggagatgccaagagccaggagggcgccggcacccccctgggggacagcctgtgcatccagggcggggagagcctgctggaggcccagccccggcccttccgctgcaaccagtgtgggaagacctacagacatggaggcagcctggtgaaccacaggaagatccaccagacaggagacttcctgtgccctgtgtgcagccgctgctaccccaacctggccgcctacagaaaccacctgaggaaccacccccgctgcaagggcagcgagccccaggtgggccccatccctgaggccgccggcagcagcgagctgcaggtgggccccatccctgagggcggcagcaacaagccccagcacatggccgaggagggccctggccaggccgaggtggagaagctgcaggaggagctgaaggtggagcccctggaggaggtggcccgggtgaaggaggaggtgtgggaggagaccaccgtgaagggggaggagattgagccccggctggagacagctgagaagggctgccagacagaggccagcagcgagcggcccttcagctgtgaggtgtgtggccgcagctacaagcatgctggcagcctcatcaaccaccggcagagccaccagacaggccacttcggctgccaggcctgcagcaagggcttcagcaacctgatgagcctgaagaaccaccggcgcatccatgctgacccccggcgcttccgctgcagtgaatgtgggaaggccttccggctgaggaagcagctggccagccaccagagggtgcacatggagaggagaggaggcggcggcaccaggaaggccaccagagaagatcggcccttccgctgtggccagtgtggccgcacctacagacatgctggcagcctgctgaaccaccggcgcagccatgaaacaggccagtacagctgccccacctgccccaagacctacagcaacaggatggccctgaaggaccaccagaggctgcacagcgagaacagaagaagaagagctggccgcagcagaagaacagctgtgcgctgtgccctgtgtggccgctccttccctggccggggcagcctggagcggcacctgcgggagcacgaggagacagagcgggagcccgccaacggccagggcggcctggatggaacagctgccagcgaggccaacctgaccggcagccagggcctggagacccagctgggcggcgctgagcctgtgccccacctggaggatggagtgcccaggcctggagagaggagccagagccccatccgggccgccagcagcgaggcccctgagcccctgtcctggggcgccggcaaggccggcggctggcctgtgggcggcggcctgggcaaccacagcggcggctgggtgccccagttcctgaccaggtctgaggagcctgaggacagcgtgcacaggagcccctgccacgccggggactgccagctgaatggccccaccctgagccacatggacagctgggacaacagagacaacagcagccagctgcagcccggcagccacagcagctgcagccagtgtgggaagacctactgccagagcggcagcctgctgaaccacaacaccaacaagacagacagacactactgcctgctgtgcagcaaggagttcctgaaccctgtggccaccaagagccacagccacaaccacattgatgcccagacctttgcctgcccagactgtgggaaggcctttgagagccaccaggagctggccagccacctgcaggcccacgcccggggccacagccaggtgcctgcccagatggaggaggcccgggaccccaaggccggcaccggggaggaccaggtggtgctgcccggccagggcaaggcccaggaggcccccagcgagaccccccggggccctggagagagcgtggagcgggcccggggcggccaggccgtgacctccatggctgctgaggacaaggagcggcccttccgctgcacccagtgtggccgcagctacagacatgctggcagcctgctgaaccaccagaaggcccacaccaccggcctgtacccctgcagcctgtgccccaagctgctgcccaacctgctgagcctgaagaaccacagcaggacccacacagaccccaagaggcactgctgcagcatctgtgggaaggccttcagaacagctgcccggctggagggccacggccgggtgcacgccccccgggagggccccttcacctgcccccactgccccaggcacttcagaagacgcatcagctttgtgcagcaccagcagcagcaccaggaggagtggacagtggccggcagcggggcccctgtggcccctgtgacaggccgcggggacctgcccctgcccccaccacccacccccaccacccccctgctggaccccagcccccagtggccagctgacctgtccttcagcctgtag

SEQ ID NO: 18269 - DNA, 5490 bp, Artificial Sequence
  Description of Artificial Sequence: Synthetic coding sequence
atggaggacaccccacccagcctgagctgcagcgactgccagaggcacttccccagcctgcctgagctgagccgccaccgggagctgctgcaccccagccccaaccaggacagcgaggaggccgacagcatcccccggccctaccgctgccagcagtgtggccggggctaccgccaccctggcagcctggtgaaccacaggaggacccatgagaccggcctcttcccctgcaccacctgtgggaaggacttcagcaaccccatggccctgaagagccacatgaggacccacgcccctgagggcagaagaagacacaggcctccccggcccaaggaggccaccccccacctgcagggcgagaccgtgtccacagacagctggggccagaggctgggcagcagcgagggctgggagaaccagaccaagcacacagaggagaccccagactgtgagagcgtgcctgacccccgggccgccagcggcacctgggaggacctgcccacccggcagcgggagggcctggccagccaccctggcccagaagatggagcagatggctggggccccagcaccaacagcgcccgggccccacccctgcccatcccagccagcagcctgctgagcaacctggagcagtacctggccgagagcgtggtgaacttcaccggcggccaggagcccacccagagccccccagctgaggaggagcggcgctacaagtgcagccagtgtgggaagacctacaagcatgctggcagcctgaccaaccaccggcagagccacaccctgggcatctacccctgtgccatctgcttcaaggagttcagcaacctgatggccctgaagaaccacagccggctgcacgcccagtaccggccctaccactgcccccactgccccagggtcttccggctgccccgggagctgctggagcaccagcagagccatgaaggagagcggcaggagccccgctgggaggagaagggcatgcccaccaccaacggccacacagatgagagcagccaggaccagctgcccagcgcccagatgctgaatggcagcgctgagctgagcaccagcggggagctggaggacagcggcctggaggagtaccggcccttccgctgtggggactgtggccgcacctacagacatgctggcagcctcatcaaccacaggaagagccaccagacaggagtgtacccctgcagcctgtgcagcaagcagctgttcaatgctgctgccctgaagaaccacgtgcgggcccaccaccggccccggcagggcgtgggggagaatggccagcccagcgtgcccccagcccccctgctgctggccgagaccacccacaaggaggaggaggaccccaccaccaccctggaccaccggccctacaagtgcagtgaatgtggccgggcctaccgccaccggggcagcctggtgaaccaccgccacagccacaggactggagagtaccagtgcagcctgtgccccaggaagtaccccaacctgatggccctgaggaaccacgtgcgggtgcactgcaaggccgccaggagatctgctgacatcggggctgagggcgcccccagccacctgaaggtggagctgcccccagaccctgtggaggccgaggccgccccccacacagaccaggaccacgtgtgcaagcatgaggaggaggccacagacatcaccccagctgctgacaagacagctgcccacatctgcagcatctgtggcctgctgtttgaagatgctgagagcctggagagacatggcctgacccatggagctggggagaaggagaacagcaggacagagaccaccatgagccccccccgggcctttgcctgccgggactgtgggaagagctaccgccacagcggcagcctcatcaaccaccggcagacccaccagacaggagacttcagctgtggggcctgtgccaagcacttccacaccatggccgccatgaagaaccacctgcggcggcacagcagaagaagaagccgccgccacaggaagagagctgggggcgccagcggcggccgggaggccaagctgctggccgctgagagctggacccgggagctggaggacaatgaaggcctggagagcccccaggaccccagcggggagagcccccatggagctgagggcaacctggagagtgatggagactgcctgcaggccgagagcgagggggacaagtgtggcctggagagagatgagacccacttccagggcgacaaggagagcggcggcactggagagggcctggagaggaaggatgccagcctgctggacaacctggacatccctggagaggagggcggcggcacccacttctgtgacagcctgactggagtggatgaggaccagaagccagccaccggccagcccaacagcagcagccacagcgccaatgctgtgacaggctggcaggccggggccgcccacacctgcagcgactgtggccacagcttcccccacgccaccggcctgctgagccaccggccctgccaccccccaggcatctaccagtgcagcctgtgccccaaggagtttgacagcctgcctgccctgcggagccacttccagaaccacaggcctggagaggccaccagcgcccagcccttcctgtgctgcctgtgtggcatgatcttccctggccgggccggctaccgcctgcaccggcggcaggcccacagcagcagcggcatgacagagggcagcgaggaggagggggaggaggagggcgtggccgaggccgccccagcccggagcccccccctgcagctgtctgaggccgagctgctgaaccagctgcagcgggaggtggaggccctggacagcgctggctacggccacatctgtggctgctgcggccagacctatgatgacctgggcagcctggagcggcaccaccagagccagagcagcggcaccacagctgacaaggcccccagccccctgggcgtggccggagatgccatggagatggtggtggacagcgtgctggaggacatcgtgaacagcgtgtctggagagggcggagatgccaagagccaggagggcgccggcacccccctgggggacagcctgtgcatccagggcggggagagcctgctggaggcccagccccggcccttccgctgcaaccagtgtgggaagacctacagacatggaggcagcctggtgaaccacaggaagatccaccagacaggagacttcctgtgccctgtgtgcagccgctgctaccccaacctggccgcctacagaaaccacctgaggaaccacccccgctgcaagggcagcgagccccaggtgggccccatccctgaggccgccggcagcagcgagctgcaggtgggccccatccctgagggcggcagcaacaagccccagcacatggccgaggagggccctggccaggccgaggtggagaagctgcaggaggagctgaaggtggagcccctggaggaggtggcccgggtgaaggaggaggtgtgggaggagaccaccgtgaagggggaggagattgagccccggctggagacagctgagaagggctgccagacagaggccagcagcgagcggcccttcagctgtgaggtgtgtggccgcagctacaagcatgctggcagcctcatcaaccaccggcagagccaccagacaggccacttcggctgccaggcctgcagcaagggcttcagcaacctgatgagcctgaagaaccaccggcgcatccatgctgacccccggcgcttccgctgcagtgaatgtgggaaggccttccggctgaggaagcagctggccagccaccagagggtgcacatggagaggagaggaggcggcggcaccaggaaggccaccagagaagatcggcccttccgctgtggccagtgtggccgcacctacagacatgctggcagcctgctgaaccaccggcgcagccatgaaacaggccagtacagctgccccacctgccccaagacctacagcaacaggatggccctgaaggaccaccagaggctgcacagcgagaacagaagaagaagagctggccgcagcagaagaacagctgtgcgctgtgccctgtgtggccgctccttccctggccggggcagcctggagcggcacctgcgggagcacgaggagacagagcgggagcccgccaacggccagggcggcctggatggaacagctgccagcgaggccaacctgaccggcagccagggcctggagacccagctgggcggcgctgagcctgtgccccacctggaggatggagtgcccaggcctggagagaggagccagagccccatccgggccgccagcagcgaggcccctgagcccctgtcctggggcgccggcaaggccggcggctggcctgtgggcggcggcctgggcaaccacagcggcggctgggtgccccagttcctgaccaggtctgaggagcctgaggacagcgtgcacaggagcccctgccacgccggggactgccagctgaatggccccaccctgagccacatggacagctgggacaacagagacaacagcagccagctgcagcccggcagccacagcagctgcagccagtgtgggaagacctactgccagagcggcagcctgctgaaccacaacaccaacaagacagacagacactactgcctgctgtgcagcaaggagttcctgaaccctgtggccaccaagagccacagccacaaccacattgatgcccagacctttgcctgcccagactgtgggaaggcctttgagagccaccaggagctggccagccacctgcaggcccacgcccggggccacagccaggtgcctgcccagatggaggaggcccgggaccccaaggccggcaccggggaggaccaggtggtgctgcccggccagggcaaggcccaggaggcccccagcgagaccccccggggccctggagagagcgtggagcgggcccggggcggccaggccgtgacctccatggctgctgaggacaaggagcggcccttccgctgcacccagtgtggccgcagctacagacatgctggcagcctgctgaaccaccagaaggcccacaccaccggcctgtacccctgcagcctgtgccccaagctgctgcccaacctgctgagcctgaagaaccacagcaggacccacacagaccccaagaggcactgctgcagcatctgtgggaaggccttcagaacagctgcccggctggagggccacggccgggtgcacgccccccgggagggccccttcacctgcccccactgccccaggcacttcagaagacgcatcagctttgtgcagcaccagcagcagcaccaggaggagtggacagtggccggcagcggccggggccacgagggcagccaggaggaggtgggcacccagtggaggggcaagagcagccccaaggtgggcggcggggcccggagtgaaagaagagagccccggggcttctag

SEQ ID NO: 18270 - DNA, 723 bp, Artificial Sequence
  Description of Artificial Sequence: Synthetic coding sequence
atggaggacaccccacccagcctgagctgcagcgactgccagaggcacttccccagcctgcctgagctgagccgccaccgggagctgctgcaccccagccccaaccaggacagcgaggaggccgacagcatcccccggccctaccgctgccagcagtgtggccggggctaccgccaccctggcagcctggtgaaccacaggaggacccatgagaccggcctcttcccctgcaccacctgtgggaaggacttcagcaaccccatggccctgaagagccacatgaggacccacgcccctgagggcagaagaagacacaggcctccccggcccaaggaggccaccccccacctgcagggcgagaccgtgtccacagacagctggggccagaggctgggcagcagcgagggctgggagaaccagaccaagcacacagaggagaccccagactgtgagagcgtgcctgacccccgggccgccagcggcacctgggaggacctgcccacccggcagcgggagggcctggccagccaccctggcccagaagatggagcagatggctggggccccagcaccaacagcgcccgggccccacccctgcccatcccagccagcagcctgctgagcaacctggagcagtacctggccgagagcgtggtgaacttcaccggcggccaggagcccacccagagccccccagctgaggaggagcggcgctacaagtag

SEQ ID NO: 18271 - DNA, 582 bp, Artificial Sequence
  Description of Artificial Sequence: Synthetic coding sequence
gagcggcgctacaagtgcagccagtgtgggaagacctacaagcacgccggcagcctgaccaaccaccggcagagccacaccctgggcatctacccctgtgccatctgcttcaaggagttcagcaacctgatggccctgaagaaccacagccggctgcacgcccagtaccggccctaccactgcccccactgccccagggtcttccggctgccccgggagctgctggagcaccagcagagccatgaagctgcccggcccttcagctgtgaggtgtgtggccgcagctacaagcatgctggcagcctcatcaaccaccggcagagccaccagacaggccacttcggctgccaggcctgcagcaagggcttcagcaacctgatgagcctgaagaaccaccggcgcatccatgctgacccccggcgcttccgctgcagtgaatgtgggaaggccttccggctgaggaagcagctggccagccaccagagggtgcacatggagcggcaccggcccttccgctgtggccagtgtggccgcacctacagacatgctggcagcctgctgaaccaccggcgcagccactag

SEQ ID NO: 18272 - DNA, 1707 bp, Artificial Sequence
  Description of Artificial Sequence: Synthetic coding sequence
atggcccaggtggacagccaggaccgctggggcgaggccagccccctgagcagcctgacagaggaggcccatgacacccagatgctgtccatgaacctggagagtgatgatgaagatggaggagaggccgagaaggagggcacagctgaccctgtggcctgcccccggggcagcagccctgtgacccatgagaacccagacctgccctggccccaccccctgggcaaggaggaggagaagttcagtgacagcagcagcgctgggggcatgggccagaagcctgtggagatgtctgggaaggcctcctggagcagagatgtgaccaagatcaatgagacccagggcagccctggggccagccgggccctgggcagcctgcccagcggcctggcccacaagctgctgggccagatgcagcccctgggggaccggctgcctgctggagatgatggctacagcggggccaaccaggatgctgtgctggatgtgccccccagcttccccagcaatggcaagtacctgtgtgcccacaagtctgtggacaccagcgctggcaacagcagcctgctgtgcttccccaggcctggcagcaactgggacctgcccacccaggagacccacaccccagcccaggccagcgccaccccagccagcctggccgctgctgtgctggccaaggccaggaacagcaggaaggtgcagaaccaggccggcagaagagagggcggggaggccgaggcccggccctaccgctgcctgcggggcggccgggccttccagaagcccagcaagcccctgagccctgctgagacccggggcggggccgccaagagatatgcctgtgagctgtgtgggaaggcctacagccaccggggcaccctgcagcagcaccggcggctgcacactggagagcggccctaccagtgcagcttctgtgacaaggcctacacctggagcagtgaccacaggaagcacatccgcacccacactggagagaagccctacccctgcccagactgtgggaaggcctttgtgcgcagcagtgacctgaggaagcaccagaggaacatgcacagcaacaacaagcccttcccctgcagtgaatgtggcctgaccttcaacaagcccctgagcctgctgcggcaccagaggacccacctgggcgccaagcccttccgctgcccagcctgtgaccgggagtttgctgtggccagcaggatggtggagcaccagagggtgcacagcggggagcggcccttcccctgccccacctgtgggaagtgcttcaccaagagcagcaacctgtctgagcaccagaccctgcacacaggccagaggcccttcaagtgtgccgactgtggggtggcctttgcccagcccagccggctggtgcgccaccagaggatccacactggagagcggcccttcccctgcacccagtgtggccaggcctttgcccggagcagcaccctgaagaggcaccagcagatccacagcggggagaagggcttcctgtgtgccgagtgtggccgggccttcagaattgccagcgagctggcccagcacatccgcatgcacaatggagagcggccctaccagtgtgaggactgtggccaggccttcaccaggagcaaccacctgcagaggcaccgggccaagcacggcacctgcaagaaggagcccatccccagcagcagtgatgaatag

SEQ ID NO: 18273 - DNA, 1821 bp, Artificial Sequence
  Description of Artificial Sequence: Synthetic coding sequence
atgagccacacagccagcagctgccaggagctggtggagaactgtgctgtgcacgtggccggcatggcccaggaggacagccggcggggccaggtgcccagcagcttctaccacggggccaaccaggagctggacctgagcaccaaggtgtacaagcgggagagcggcagcccctacagcgtgctggtggacaccaagatgagcaagccccacctgcatgaaacagaggagcagccctacttccgggagaccagggctgtgtctgatgtgcatgctgtgaaggaggaccgggagaacagtgatgacacagaggaggaggaggaggaggtgtcctacaagcgggagcagatcatcgtggaggtgaacctgaacaaccagaccctgaatgtgtccaagggggagaagggcgtgagcagccagagcaaggagacccctgtgctgaagaccagcagcgaggaggaggaggaggagagcgaggaggaggccacagatgacagcaatgactatggagaaaatgagaagcagaagaagaaggagaagatcgtggagaaggtgtctgtgacccagaggaggaccaggagagctgcctctgtggccgccgccaccaccagccccacccccaggaccacccggggccgcaggaagtctgtggagccccccaagaggaagaagagggccaccaaggagcccaaggcccctgtgcagaaggccaagtgtgaggagaaggagaccctgacctgtgagaagtgccccagggtcttcaacacccgctggtacctggagaagcacatgaatgtgacccacaggaggatgcagatctgtgacaagtgtgggaagaagtttgtgctggagagcgagctgagcctgcaccagcagacagactgtgagaagaacatccagtgtgtgtcctgcaacaagagcttcaagaagctgtggagcctgcacgagcacatcaagatcgtgcacggctatgcagagaagaagttcagctgtgagatctgtgagaagaagttctacaccatggcccacgtgaggaagcacatggtggcccacaccaaggacatgcccttcacctgtgagacctgtgggaagagcttcaagaggtccatgagcctgaaggtgcacagcctgcagcacagcggggagaagcccttccgctgtgagaactgtgatgagcgcttccagtacaagtaccagctgcggagccacatgagcatccacatcggccacaagcagttcatgtgccagtggtgtgggaaggacttcaacatgaagcagtactttgatgagcacatgaagacccacactggagagaagcccttcatctgtgagatctgtgggaagagcttcaccagccggcccaacatgaagaggcacaggaggacccacactggagagaagccctacccctgtgatgtgtgtggccagcgcttccgcttcagcaacatgctgaaggcccacaaggagaagtgcttccgggtgaccagccctgtgaatgtgcccccagctgtgcagatccccctgaccaccagccctgccacccctgtgcccagcgtggtgaacacagccaccacccccaccccacccatcaacatgaaccctgtgtccaccctgcccccccggcccatcccccaccccttcagccacctgcacatccacccccacccccaccacccccaccacctgcccatcccccctgtgccccacctgcccccacctccagccctcttcaagtctgagcccctgaaccaccggggccagagcgaggacaacttcctgcggcacctggccgagaagaacagcagcgcccagcaccactag

SEQ ID NO: 18274 - DNA, 1821 bp, Artificial Sequence; identical to SEQ ID NO: 18273
  Description of Artificial Sequence: Synthetic coding sequence

SEQ ID NO: 18275 - DNA, 1281 bp, Artificial Sequence
  Description of Artificial Sequence: Synthetic coding sequence
atgagccacacagccagcagctgccaggagctggtggagaactgtgctgtgcacgtggccggcatggcccaggaggacagccggcggggccaggtgcccagcagcttctaccacggggccaaccaggagctggacctgagcaccaaggtgtacaagcgggagagcggcagcccctacagcgtgctggtggacaccaagatgagcaagccccacctgcatgaaacagaggagcagccctacttccgggagaccagggctgtgtctgatgtgcatgctgtgaaggaggaccgggagaacagtgatgacacagaggaggaggaggaggaggtgtcctacaagcgggagcagatcatcgtggagtgtgtgtcctgcaacaagagcttcaagaagctgtggagcctgcacgagcacatcaagatcgtgcacggctatgcagagaagaagttcagctgtgagatctgtgagaagaagttctacaccatggcccacgtgaggaagcacatggtggcccacaccaaggacatgcccttcacctgtgagacctgtgggaagagcttcaagaggtccatgagcctgaaggtgcacagcctgcagcacagcggggagaagcccttccgctgtgagaactgtgatgagcgcttccagtacaagtaccagctgcggagccacatgagcatccacatcggccacaagcagttcatgtgccagtggtgtgggaaggacttcaacatgaagcagtactttgatgagcacatgaagacccacactggagagaagcccttcatctgtgagatctgtgggaagagcttcaccagccggcccaacatgaagaggcacaggaggacccacactggagagaagccctacccctgtgatgtgtgtggccagcgcttccgcttcagcaacatgctgaaggcccacaaggagaagtgcttccgggtgaccagccctgtgaatgtgcccccagctgtgcagatccccctgaccaccagccctgccacccctgtgcccagcgtggtgaacacagccaccacccccaccccacccatcaacatgaaccctgtgtccaccctgcccccccggcccatcccccaccccttcagccacctgcacatccacccccacccccaccacccccaccacctgcccatcccccctgtgccccacctgcccccacctccagccctcttcaagtctgagcccctgaaccaccggggccagagcgaggacaacttcctgcggcacctggccgagaagaacagcagcgcccagcaccactag

SEQ ID NO: 18276 - DNA, 1848 bp, Artificial Sequence
  Description of Artificial Sequence: Synthetic coding sequence
atggccgagcgggccctggagcctgaggccgaggccgaggccgaggccggggccggcggggaggccgctgctgaggagggcgctgctggcaggaaggcccggggccggccccggctgacagaaagtgaccgggcccggcggcggctggagagcaggaagaagtatgatgtgcggcgggtgtacctgggggaggcccacggcccctgggtggacctgcggcggcgcagcggctggagcgatgccaagctggccgcctacctgatcagcctggagcggggccagaggagcggcagacatggcaagccctgggagcaggtgcccaagaagcccaagaggaagaagagaagaagaagaaatgtgaactgcctgaagaatgtggtgatctggtatgaggaccacaagcaccgctgcccctatgagccccacctggccgagctggaccccaccttcggcctgtacaccacagctgtgtggcagtgtgaggccggccaccgctacttccaggacctgcacagccccctgaagcccctgagtgacagcgaccctgacagcgacaaggtgggcaatggcctggtggccggcagcagtgacagcagcagcagcggcagcgccagtgacagcgaggagagccctgagggccagcctgtgaaggctgctgctgctgctgctgctgccacccccaccagccctgtgggcagcagcggcctcatcacccaggagggcgtgcacatcccctttgatgtgcaccacgtggagagcctggccgagcagggcacccccctgtgcagcaacccagctggaaatggacctgaggccctggagaccgtggtgtgtgtgcctgtgcctgtgcaggtgggcgccggccccagcgccctgtttgaaaatgtgccccaggaggccctgggggaggtggtggccagctgccccatgcctggcatggtgcccggcagccaggtgatcatcatcgccggccctggctatgatgccctgacagctgagggcatccacctgaacatggctgctggcagcggcgtgcccggcagcggcctgggggaggaggtgccctgtgccatgatggagggcgtggccgcctacacccagacagagcctgagggcagccagcccagcaccatggatgccacagctgtggccggcatcgagaccaagaaggagaaggaggacctgtgcctgctgaagaaggaggagaaggaggagcctgtggcccctgagctggccaccaccgtgcctgagagcgctgagcctgaggccgaggctgatggagaggagctggatggcagtgacatgtctgccatcatctatgagatccccaaggagcctgagaagagaagaagaagcaagaggagccgggtgatggatgctgatggcctgctggagatgttccactgcccctatgagggctgcagccaggtgtatgtggccctgagcagcttccagaaccacgtgaacctggtgcacaggaagggcaagaccaaggtgtgcccccaccctggctgcggcaagaagttctacctgagcaaccacctgcggcggcacatgatcatccacagcggcgtgcgggagttcacctgtgagacctgtgggaagagcttcaagaggaagaaccacctggaggtgcacaggaggacccacactggagagacccccctgcagtgtgagatctgtggctaccagtgccggcagagggccagcctgaactggcacatgaagaagcacacagctgaggtgcagtacaacttcacctgtgacagatgtgggaagagatttgagaagctggacagcgtgaagttccacaccctgaagagccacccagaccacaagcccacctag

SEQ ID NO: 18277 - DNA, 1746 bp, Artificial Sequence
  Description of Artificial Sequence: Synthetic coding sequence
atgctgtgcaacaaggagttcctgggcggccacatcgtgagacatgcccaggcccaccagaagaagggcagctttgcctgtgtgatctgtggcaggaagttcaggaacagaggcctgatgcagaagcacctgaagaaccacgtgaagaagatccagaggcagcagattgctgctgcccagcaggatgaccaggaggtgacagccctggaggagatcaactgcagcagcagcagcatcagctttgaaaatggaaacagcgacagcaaggacctggaggtggagaccctgacagccagcagcgagggcaacaaggaggtgattcctgagcacgtggccgagttcatcgagatccccatctctgtgcctgaagatgtgattgaaaatgtgattgaaaatggcagccccaacaacagcctgaacaacgtgttcaagcccctgacagaatgtggagatgattatgaggaggaggaggatgaggagggggactatgaagaagatgattatgacctgaaccaggagaccagcgtcatccacaagatcaatggaacagtgtgccaccccaaggacatctatgccacagaccaggagggcaacttcaagtgcccagccctgggctgtgtgcgcatcttcaagagaattggcttcctgaacaagcacgccatgacagtgcaccccacagacctgaatgtgcggcagacagtgatgaagtggagcaagggcaagtgcaagttctgccagaggcagtttgaggacagccagcacttcatcgaccacctgaacagacacagctaccccaacgtgtacttctgcctgcacttcaactgcaatgaaagcttcaagctgcccttccagctggcccagcacaccaagagccaccgcatcttccaggcccagtgcagcttcccagaatgtcatgagctgtttgaggacctgcccctgctgtatgaacatgaggcccagcactacctgagcaagaccccagagagcagcgcccagcccagcgagaccatcctgtgggatgtgcagacagacagcaaccccaaccaggagaaggacagcagcagcaatgagaagcagaccatcagcctgcctgtgtccaccagcaagagcaggaaggagagcacagagcccaagacctgcattgaatccatggagaagaagacagacagcctggtgcagaatggaaatgaaagaagtgatgacacagtgagcaacatcagcctgattgaccagaagatgccagacatcgagcccaacagcgagaacaactgcagcagcagtgacatcgtgaatggccacagcgagattgagcagacccccctggtgtccagtgaccctgccctgaagattgacaccaaccgcatcagaacagaaaatggcagcatcctgcccagcgtggtgccccaggagcacaacaccctgcctgtgtcccaggcccccagcaagcccaacctgaccagcgagcacaccagctatggcctcatcctgaccaagccctacgtgcggcccctgcccccatcctacctggatgagcgctacctgtccatgcccaagaggaggaagttcctgacagacagagtggatgcctgcagcgaccaggacaacgtgtacaagaagtctgtgaagaggctgcgctgtgggaagtgcctgaccacctactgcaatgctgaggccctggaggcccacctggcccagaagaagtgccagaccctgtttggatttgacagtgatgatgagagcgcctag

SEQ ID NO: 18278 - DNA, 3180 bp, Artificial Sequence
  Description of Artificial Sequence: Synthetic coding sequence
atgaacatgagccaggcctctgtgtccttccaggatgtgacagtggagttcacccgggaggagtggcagcacctgggccctgtggagaggaccctgtacagagatgtgatgctggagaactacagccacctgatctctgtgggctactgcatcaccaagcccaaggtgatcagcaagctggagaagggggaggagccctggagcctggaggatgagttcctgaaccagcgctacccaggctacttcaaggtggaccacatcaagggcatccgggagaagcaggagaagcccctgtggcaggagatcttcatcagtgatgctgacaagaccctgagcaaggagggccagaaggtgctggagaagcccttcaacctggagatcgcccctgagctgtctgagaagatcagctgcaagtgtgacagccacaggatgaacctgcctgtggccagccagctgatcatcagcgagaggaagtacagcaggaagaagacagagtacatgaatgtgtgtgagaagctgcagctggacatcaagcatgagaaggcccacgccgaggagaagagctatgaacatggagaaaatgccaaggccttctcctacaagaaggaccagcactggaagttccagaccctggaggagagctttgaatgtgatggcagcggccagggcctgtatgacaagaccatctgcatcaccccccagagcttcctgaccggggagaagagctgcaaggatgatgagttcaggaagaactttgacaagatcaccctcttcaaccacatgaggacagacacccggggcaagtgcagcgacctgaatgaatatggcaccagctgtgacaagaccacagctgtggagtacaacaaggtgcacatggccatgacccactatgagtgcaatgaaagaggcatcaacttcagcaggaagagccccctgacccagagccagaggaccatcaccggctggagcgcctttgagagcaacaagtgtgaggagaacttcagccagagcagcgcccacatcgtgcaccagaagacccaggccggggacaagtttggagagcacaatgaatgtacagatgccctgtaccagaagctggacttcaccgcccaccagaggatccacacagaggacaagttctacctgagtgatgagcacggcaagtgcaggaagagcttctacaggaaggcccacctgatccagcaccagaggccccacagcggggagaagacctaccagtatgaggagtgtgccaagagcttctgcagcagcagccaccccatccagcaccctggcacctacgtgggcttcaagctgtatgaatgtaatgaatgtgggaaggccttctgccagaacagcaacctgagcaagcacctgcgcatccacaccaaggagaagccctgtgacaacaacggctgcggccgcagctacaagagccccctcatcggccaccagaagacagatgctgagatggagctgtgtggcggctctgaatatggcaagaccagccacctgaagggccaccagaggatcctgatgggagagaagccctatgaatgtattgaatgtgggaagaccttcagcaagaccagccacctgcgggcccaccagaggatccacactggagagaagccctatgaatgtgtggagtgtgagaagaccttcagccacaagacccacctgtctgtgcaccagagggtgcacactggagagaagccctatgaatgtaatgactgtgggaagagcttcacctacaacagcgccctgcgggcccaccagaggatccacactggagagaagccctatgaatgtagtgactgtgagaagacctttgcccacaacagcgccctgcgggcccaccaccgcatccacactggagagaagccctatgaatgtaatgaatgtggccgcagctttgcccacatctctgtgctgaaggcccaccagaggatccacactggagagaagccctatgaatgtaatgaatgtggccgctccttcacctacaacagcgccctgcgggcccaccagaggatccacactggaaggaagccctatgaatgtagtgactgtgagaagacctttgcccacaacagcgccctgaagatccaccagaggatccacactggagagaagccctatgaatgtaatgaatgtgagaagacctttgcccacaacagcgccctgcgggcccaccagaacatccacactggagagaagctgtatgaatgttctgaatgtgggaagaccttcttccagaagacccggctgagcacccaccggcgcatccacactggagagaagccctatgaatgttccaaatgtgggaagaccttcagccagaagagctacctgagcggccacgagcgcatccacactggagagaagccctatgaatgtaatgtgtgtgggaagacctttgtgtacaaggccgccctgattgtgcaccagaggatccacactggagagaagccctatgagtgcaaccagtgtgggaagaccttcagccagaggacccacctgtgtgcccaccagaggatccacactggagagaagccctatgaatgtaatgaatgtgggaagacctttgctgacaacagcgccctgcgggcccaccaccgcatccacactggagagaagccctatgaatgtaatgactgtgggaagaccttcagcaagaccagccacctgcgggcccacctgcggaccaggtctggagagaagccctatgaatgttctgaatgtgggaagaccttcagcgagaagagctatgtgtctgcccaccagagggtgcacactggagagaagccctatgaatgtaatgtgtgtgggaagccctttgcccacaacagcaccctgcgggtgcaccagaggatccacactggagagaagagctatgaatgtaatgactgtgggaagaccttcagccagaagagccacctgagcgcccaccagaggatccacactggagagaagccctatgaatgtaatgaatgtgggaaggcctttgcccagaacagcaccctgcgggtgcaccagaggatccacactggagagaagccctatgaatgtgatgaatgtgggaagacctttgtgaggaaggccgccctgcgggtgcaccacaccaggatgcacacccgggagaagaccctggcctgcaatggatttgggaagagctag

SEQ ID NO: 18279 - DNA, 1848 bp, Artificial Sequence
  Description of Artificial Sequence: Synthetic coding sequence
atgagccaggcctctgtgtccttccaggatgtgacagtggagttcacccgggaggagtggcagcacctgggccctgtggagaggaccctgtacagagatgtgatgctggagaactacagccacctgatctctgtgggctactgcatcaccaagcccaaggtgatcagcaagctggagaagggggaggagccctggagcctggaggatgagttcctgaaccagcgctacccaggctacttcaaggtggaccacatcaagggcatccgggagaagcaggagaagcccctgtggcaggagatcttcatcagtgatgctgacaagaccctgagcaaggagggccagaaggtgctggagaagcccttcaacctggagatcgcccctgagctgtctgagaagatcagctgcaagtgtgacagccacaggatgaacctgcctgtggccagccagctgatcatcagcgagaggaagtacagcaggaagaagacagagtacatgaatgtgtgtgagaagctgcagctggacatcaagcatgagaaggcccacgccgaggagaagagctatgaacatggagaaaatgccaaggccttctcctacaagaaggaccagcactggaagttccagaccctggaggagagctttgaatgtgatggcagcggccagggcctgtatgacaagaccatctgcatcaccccccagagcttcctgaccggggagaagagctgcaaggatgatgagttcaggaagaactttgacaagatcaccctcttcaaccacatgaggacagacacccggggcaagtgcagcgacctgaatgaatatggcaccagctgtgacaagaccacagctgtggagtacaacaaggtgcacatggccatgacccactatgagtgcaatgaaagaggcatcaacttcagcaggaagagccccctgacccagagccagaggaccatcaccggctggagcgcctttgagagcaacaagtgtgaggagaacttcagccagagcagcgcccacatcgtgcaccagaagacccaggccggggacaagtttggagagcacaatgaatgtacagatgccctgtaccagaagctggacttcaccgcccaccagaggatccacacagaggacaagttctacctgagtgatgagcacggcaagtgcaggaagagcttctacaggaaggcccacctgatccagcaccagaggccccacagcggggagaagacctaccagtatgaggagtgtgccaagagcttctgcagcagcagccaccccatccagcaccctggcacctacgtgggcttcaagctgtatgaatgtaatgaatgtgggaaggccttctgccagaacagcaacctgagcaagcacctgcgcatccacaccaaggagaagccctgtgacaacaacggctgcggccgcagctacaagagccccctcatcggccaccagaagacagatgctgagatggagctgtgtggcggctctgaatatggcaagaccagccacctgaagggccaccagaggatcctgatgggagagaagccctatgaatgtattgaatgtgggaagaccttcagcaagaccagccacctgcgggcccaccagaggatccacactggagagaagccctatgaatgtgtggagtgtgagaagaccttcagccacaagacccacctgtctgtgcaccagagggtgcacactggagagaagccctatgaatgtaatgactgtgggaagagcttcacctacaacagcgccctgcgggcccaccagaggatccacacaggcctggccgtgtgccacgtgggcatcctgatggccaccaagagcctcttccaccagagctag

SEQ ID NO: 18280 - DNA, 996 bp, Artificial Sequence
  Description of Artificial Sequence: Synthetic coding sequence
atgaggaggaagaccaggaacttcaagcacaagacagtgaaggacaacaaggtgctgacagagggcagtgaccaggagagcgagaaggacaacagccagtgctgtgaccctgccaccaatgaaagagtgcaggccgagaagaggcagtatgtgtgcacagaatgtgggaaggccttcagccagagcgccaacctgactgtgcatgagcgcatccacactggagagaagccctacaagtgcaaggaatgtgggaaggccttcagccacagcagcaacctggtggtgcaccggcgcatccacacaggcctgaagccctacacctgcagtgaatgtgggaagagcttcagcggcaagagccacctgatccgccaccagggcatccacagcggggagaagacctatgagtgcaaggaatgtgggaaggccttcagccgcagcagcggcctcatcagccaccaccgggtgcacactggagagaagccctacagctgcattgaatgtgggaaggccttcagccgcagcagcaacctgacccagcaccagaggatgcaccggggcaagaaggtgtacaagtgcaaggaatgtgggaagacctgtggcagcaacaccaagatcatggaccaccagaggatccacactggagagaagccctatgaatgtgatgaatgtgggaagaccttcatcctgaggaagaccctgaatgagcaccagaggctgcacagaagagagaagccctacaagtgcaatgaatgtgggaaggccttcaccagcaacagaaacctggtggaccaccagagggtgcacactggagagaagccctacaagtgcaatgaatgtgggaagaccttccggcagaccagccaggtgatcctgcacctgcggacccacaccaaggagaagccctacaagtgcagtgaatgtgggaaggcctaccgctacagcagccagctgatccagcaccagaggaagcacaatgaggagaaggagaccagctag

SEQ ID NO: 18281 - DNA, 120 bp, Artificial Sequence
  Description of Artificial Sequence: Synthetic coding sequence
atgaggaggaagaccaggaacttcaagcacaagacagtgaaggacaacaaggtgctgacagagggcagtgaccaggagagcgagaaggacaacagccagtgctgtgaccctgccacctag

SEQ ID NO: 18282 - DNA, 105 bp, Artificial Sequence
  Description of Artificial Sequence: Synthetic coding sequence
atgaggaggaagaccaggaacttcaagcacaagacagtgaaggacaacaaggtgctgacagagggcagtgaccaggagagcgagaaggacaacagccagtgctag

SEQ ID NO: 18283 - DNA, 1359 bp, Artificial Sequence
  Description of Artificial Sequence: Synthetic coding sequence
atggctgctgtggccctggccagcggcacccggctgggcctggtgctggagctgctgcccggccagcctgccctgccccgggcccggcgggagagcgtgacctttgaagatgtggccgtgtacttctctgaaaatgagtggattggcctgggccctgcccagagggccctgtacagagatgtgatgctggagaactacggggctgtggccagcctggccttccccttccccaagccagccctgatcagccagctggagcggggggagaccccctggtgcagcgtgcccaggggggccctggatggagaggccccccggggcatcagcagcgagggcgtgctgaagaggaagaaggaggacttcatcctgaaggaggagatcatcgaggaggcccaggacctgatggtgctgagcagcggcccccagtggtgtggcagccaggagctgtggtttgggaagacctgtgaggagaagagccggctgggccgctggccaggctacctgaatggaggccgcatggagagcagcaccaatgacatcattgaagtcatcgtgaaggatgagatgatctctgtggaggagagcagcggcaacacagatgtgaacaacctgctgggcatccaccacaagatcctgaatgagcagatcttctacatctgtgaggagtgtgggaaatgttttgaccagaatgaagattttgaccagcaccagaagacccacaatggagagaaggtgtatggctgcaaggaatgtgggaaggccttctccttccgcagccactgcatcgcccaccagaggatccacagcggcgtgaagccctatgagtgccaggagtgtgccaaggcctttgtgtggaagagcaacctgatccgccaccagaggatccacactggagagaagccctttgagtgcaaggaatgtgggaagggcttcagccagaacaccagcctgacccagcaccagaggatccacactggagagaagccctacacctgcaaggaatgtgggaagagcttcaccagaaatcctgccctgctgcggcaccagaggatgcacactggagagaagccctatgagtgcaaggactgtgggaagggcttcatgtggaacagcgacctgagccagcaccagagggtgcacactggagacaagccccatgaatgtacagactgtgggaagagcttcttctgcaaggcccacctgatccgccaccagaggatccacactggagagcggccctacaagtgcaatgactgtgggaaggccttcagccagaacagcgtgctgatcaagcaccagaggagacatgcccgggacaagccctacaactgccagatcagccacctgctggagcactag

SEQ ID NO: 18284 - DNA, 1281 bp, Artificial Sequence
  Description of Artificial Sequence: Synthetic coding sequence
atgctggagaactatggagctgtggccagcctggccgccttccccttccccaagccagccctgatcagccagctggagcggggggagaccccctggtgcagcgtgcccaggggggccctggatggagaggccccccggggcatcagcagcggctaccccttcctgaagccagctggcatcagccaccctgagcaggtggaggagcccctgaacctgaagctgcagggcgagggccccagcctcatctgcccagagggcgtgctgaagaggaagaaggaggacttcatcctgaaggaggagatcatcgaggaggcccaggacctgatggtgctgagcagcggcccccagtggtgtggcagccaggagctgtggtttgggaagacctgtgaggagaagagccggctgggccgctggccaggctacctgaatggaggccgcatggagagcagcaccaatgacatcattgaagtcatcgtgaaggatgagatgatctctgtggaggagagcagcggcaacacagatgtgaacaacctgctgggcatccaccacaagatcctgaatgagcagatcttctacatctgtgaggagtgtgggaaatgttttgaccagaatgaagattttgaccagcaccagaagacccacaatggagagaaggtgtatggctgcaaggaatgtgggaaggccttctccttccgcagccactgcatcgcccaccagaggatccacagcggcgtgaagccctatgagtgccaggagtgtgccaaggcctttgtgtggaagagcaacctgatccgccaccagaggatccacactggagagaagccctttgagtgcaaggaatgtgggaagggcttcagccagaacaccagcctgacccagcaccagaggatccacactggagagaagccctacacctgcaaggaatgtgggaagagcttcaccagaaatcctgccctgctgcggcaccagaggatgcacactggagagaagccctatgagtgcaaggactgtgggaagggcttcatgtggaacagcgacctgagccagcaccagagggtgcacactggagacaagccccatgaatgtacagactgtgggaagagcttcttctgcaaggcccacctgatccgccaccagaggatccacactggagagcggccctacaagtgcaatgactgtgggaaggccttcagccagaacagcgtgctgatcaagcaccagaggagacatgcccgggacaagccctacaactgccagatcagccacctgctggagcactag

SEQ ID NO: 18285 - DNA, 1281 bp, Artificial Sequence; identical to SEQ ID NO: 18284
  Description of Artificial Sequence: Synthetic coding sequence

SEQ ID NO: 18286 - DNA, 786 bp, Artificial Sequence
  Description of Artificial Sequence: Synthetic coding sequence
atgatctacaagtgccccatgtgccgggagttcttcagcgagagagctgacctcttcatgcaccagaagatccacacagctgagaagccccacaagtgtgacaagtgtgacaagggcttcttccacatcagcgagctgcacatccactggagggaccacactggagagaaggtgtacaagtgtgatgactgtgggaaggacttcagcaccaccaccaagctgaacagacacaagaagatccacacagtggagaagccctacaagtgctatgaatgtgggaaggccttcaactggagcagccacctgcagatccacatgagggtgcacactggagagaagccctacgtgtgcagtgaatgtggccggggcttcagcaacagcagcaacctgtgcatgcaccagagggtgcacactggagagaagcccttcaagtgtgaagaatgtgggaaggccttccgccacaccagcagcctgtgcatgcaccagagggtgcacactggagagaagccctacaagtgctatgaatgtgggaaggccttcagccagagcagcagcctgtgcatccaccagagggtgcacactggagagaagccctaccgctgctgcggctgtgggaaggccttcagccagagcagcagcctgtgcatccaccagagggtgcacactggagagaagcccttcaagtgtgatgaatgtgggaaggccttcagccagagcaccagcctgtgcatccaccagagggtgcacaccaaggagaggaaccacctgaagatcagcgtcatctag

SEQ ID NO: 18287 - DNA, 786 bp, Artificial Sequence; identical to SEQ ID NO: 18286
  Description of Artificial Sequence: Synthetic coding sequence

SEQ ID NO: 18288 - DNA, 600 bp, Artificial Sequence
  Description of Artificial Sequence: Synthetic coding sequence
atgattgtggtgcgcatcctggccctgcagcagaacctgattgacatcaggaagagcacccagtggaggagccccatcaacgtgaccagcggcaaggccttcaactggagcagccacctgcagatccacatgagggtgcacactggagagaagccctacgtgtgcagtgaatgtggccggggcttcagcaacagcagcaacctgtgcatgcaccagagggtgcacactggagagaagcccttcaagtgtgaagaatgtgggaaggccttccgccacaccagcagcctgtgcatgcaccagagggtgcacactggagagaagccctacaagtgctatgaatgtgggaaggccttcagccagagcagcagcctgtgcatccaccagagggtgcacactggagagaagccctaccgctgctgcggctgtgggaaggccttcagccagagcagcagcctgtgcatccaccagagggtgcacactggagagaagcccttcaagtgtgatgaatgtgggaaggccttcagccagagcaccagcctgtgcatccaccagagggtgcacaccaaggagaggaaccacctgaagatcagcgtcatctag

SEQ ID NO: 18289 - DNA, 786 bp, Artificial Sequence; identical to SEQ ID NO: 18286
  Description of Artificial Sequence: Synthetic coding sequence

SEQ ID NO: 18290 - DNA, 786 bp, Artificial Sequence; identical to SEQ ID NO: 18286
  Description of Artificial Sequence: Synthetic coding sequence

SEQ ID NO: 18291 - DNA, 2037 bp, Artificial Sequence
  Description of Artificial Sequence: Synthetic coding sequence
atggccctgccccagggccagctgaccttcaaggatgtggccatcgagttcagccaggaggagtggacctgcctggaccctgcccagaagaccctgtacagagatgtgatgctggagaactacagaaacctggtgtccctggacatcagctgcaagtgtgtgaacacagacctgccccccaagggcaagaacaacatgggagaggccttctacacagtgaagctggagcggctggagagctgtgacacagtgggcctgtccttccaggaggtgcagaagaacacctatgactttgagtgccagtggaaggatgatgagggcaactacaagacagtgctgatgctgcagaaggagaacctgcctggaagaagagcccagagggacagaagagctgctggcaacagacacatcgagaaccagctgggcgtgtccttccagagccacctgcctgagctgcagcagttccagcacgagggcaagatctatgagtacaaccaggtggagaagagccccaacaacagaggcaagcactacaagtgtgatgaatgtgggaaggtgttcagccagaacagccggctgaccagccacaagaggatccacactggagagaagccctaccagtgcaacaagtgtgggaaggccttcaccgtgcgcagcaacctgaccatccaccaggtgatccacactggagagaagccctacaagtgcaatgaatgtgggaaggtgttcagccagcccagcaacctggccggccaccagaggatccacactggagagaagccctacaagtgcaatgaatgtgggaaggccttccgggcccacagcaagctgaccacccaccaggtgatccacactggagagaagccctacaagtgcaaggaatgtgggaagtgcttcacccagaacagccacctggccagccaccggcgcatccacactggagagaagccctacaagtgcaatgaatgtgggaaggccttctctgtgcgcagcagcctgaccacccaccagaccatccacactggagagaagccctacaagtgcaatgaatgtgggaaggtgttccgccacaacagctacctggccaagcaccggcgcatccacactggagagaagccctacaagtgcaatgaatgtgggaaggccttctccatgcacagcaacctgaccaagcaccagatcatccacactggagagaagcccttcaagtgcaatgaatgtgtgaaggtgttcacccagtacagccacctggccaaccaccggcgcatccacactggagagaagccctaccgctgtgatgaatgtgggaaggccttctctgtgcgcagcagcctgaccacccaccaggccatccacactggagagaagccctacaagtgcaatgactgtgggaaggtgttcacccagaacagccacctggccagccaccggggcatccacagcggggagaagccctacaagtgtgatgaatgtgggaaggccttcagccagaccagccagctggcccggcactggagggtgcacactggagagaagccctacaagtgcaatgaatgtgggaaggccttctctgtgcacagcagcctgaccatccaccagaccatccacacaggccagaagccctacaagtgcaatgactgtgggaaggtgttccgccacaacagctacctggccatccaccagaggatccacactggagagaagccctacaagtgcaatgaatgtgggaaggccttctctgtgcacagcaacctggccacccaccaggtgatccacactggagagaagccctacaagtgcaatgaatgtgggaaggtgttcacccagaacagccacctggccaaccaccggcgcatccacactggagagaagccctaccgctgcaatgaatgtgggaaggccttctctgtgcgcagcaccctgaccacccacatggctgtgcacactggagacaagccctacaagtgcaaccagtgtgggaaggtgttcacccagaacagcaacctggccaagcaccggcgcatccacagcggctag

SEQ ID NO: 18292 - DNA, 1860 bp, Artificial Sequence
  Description of Artificial Sequence: Synthetic coding sequence
atggaggtggaggccgctgaggcccggagccctgcccctggctacaagaggagcggccgccgctacaagtgtgtgtcctgcaccaagaccttccccaatgcccccagggctgcccggcatgctgccacccacggccctgctgactgcagcgaggaggtggccgaggtgaagcccaagccagagacagaggccaaggccgaggaggccagcggggagaaggtgtctggcagcgctgccaagccccggccctatgcctgccccctgtgccccaaggcctacaagacagcccctgagctgcggagccacggccgcagccacactggagagaagcccttcccctgcccagaatgtggccgccgcttcatgcagcctgtgtgcctgcgggtgcacctggccagccatgctggggagctgcccttccgctgtgcccactgccccaaggcctatggagccctgagcaagctgaagatccaccagaggggccacactggagagcggccctatgcctgtgccgactgtgggaagagctttgctgaccccagcgtcttcaggaagcacaggaggacccatgctggcctgcggccctacagctgtgagcgctgtgggaaggcctatgcagagctgaaggacctgaggaaccacgagaggagccacactggagagcggcccttcctgtgcagtgaatgtgggaagagcttcagccgcagcagcagcctgacctgccaccagagaattcatgctgcccagaagccctaccgctgcccagcctgtgggaagggcttcacccagctgagcagctaccagagccatgagaggacccacagcggggagaagcccttcctgtgcccccgctgtggccgcatgttcagtgaccccagcagcttccgccgccaccagagggcccacgagggcgtgaagccctaccactgtgagaagtgtgggaaggacttccggcagcctgctgacctggccatgcacagaagagtgcacactggagaccggcccttcaagtgcctgcagtgtgacaagacctttgtggcctcctgggacctgaagagacatgccctggtgcacagcggccagaggcccttccgctgtgaggagtgtggccgggcctttgctgagcgggccagcctgaccaagcacagccgggtgcacagcggggagcggcccttccactgcaatgcctgtgggaagagctttgtggtgagcagcagcctgaggaagcatgagaggacccacaggagcagcgaggccgccggcgtgcccccagcccaggagctggtggtgggcctggccctgcctgtgggcgtggccggggagagcagcgctgccccagctgctggggccggcctgggggaccccccagctggcctgctgggcctgcccccagagagcggcggcgtgatggccacccagtggcaggtggtgggcatgacagtggagcacgtggagtgccaggatgctggggtgcgggaggcccctggccccctggagggcgctggggaggccggcggggaggaggctgatgagaagccaccccagtttgtgtgccgggagtgcaaggagaccttcagcaccatgaccctgctgcggagacatgagaggagccaccctgagctgcggcccttcccctgcacccagtgtgggaagagcttcagtgacagagctggcctgaggaagcacagcaggacccacagctctgtgcggccctacacctgcccccactgccccaaggccttcctgagcgccagtgacctgaggaagcatgagaggacccaccctgtgcccatgggcacccccacccccctggagcccctggtggccctgctgggcatgcctgaggagggccctgcctag

SEQ ID NO: 18293 - DNA, 1860 bp, Artificial Sequence; identical to SEQ ID NO: 18292
  Description of Artificial Sequence: Synthetic coding sequence

SEQ ID NO: 18294 - DNA, 327 bp, Artificial Sequence
  Description of Artificial Sequence: Synthetic coding sequence
atggaggtggaggccgctgaggcccggagccctgcccctggctacaagaggagcggccgccgctacaagtgtgtgtcctgcaccaagaccttccccaatgcccccagggctgcccggcatgctgccacccacggccctgctgactgcagcgaggaggtggccgaggtgccccacagaagagcccccctgcccctgctgcgggtgcgggaggagctgctgcccctcatcctggcccacgtgcccccagcccacccccggggcacagaggccctgcccctgcccggcctgcggcagggcctgcacgccgcccagttcctgcctgagtag

SEQ ID NO: 18295 - DNA, 279 bp, Artificial Sequence
  Description of Artificial Sequence: Synthetic coding sequence
atggaggtggaggccgctgaggcccggagccctgcccctggctacaagaggagcggccgccgctacaagtgtgtgtcctgcaccaagaccttccccaatgcccccagggctgcccggcatgctgccacccacggccctgctgactgcagcgaggaggtggccgaggtgaagcccaagccagagacagaggccaaggccgaggaggccagcggggagaaggtgtctggcagcgctgccaagccccggccctatgcctgccccctgtgccccaaggcctag

SEQ ID NO: 18296 - DNA, 231 bp, Artificial Sequence
  Description of Artificial Sequence: Synthetic coding sequence
atggaggtggaggccgctgaggcccggagccctgcccctggctacaagaggagcggccgccgctacaagtgtgtgtcctgcaccaagaccttccccaatgcccccagggctgcccggcatgctgccacccacggccctgctgactgcagcgaggaggtggccgaggtgaagcccaagccagagacagaggccaaggccgaggaggccagcggggagaaggtgtctggatag

SEQ ID NO: 18297 - DNA, 312 bp, Artificial Sequence
  Description of Artificial Sequence: Synthetic coding sequence
atggaggtggaggccgctgaggcccggagccctgcccctggctacaagaggagcggccgccgctacaagtgtgtgtcctgcaccaagaccttccccaatgcccccagggctgcccggcatgctgccacccacggccctgctgactgcagcgaggaggtggccgaggtgaagcccaagccagagacagaggccaaggccgaggaggccagcggggagaaggtgtctggcagcgctgccaagccccggccctatgcctgccccctgtgccccaaggcctacaagacagcccctgagctgcggagccacggctag

SEQ ID NO: 18298 - DNA, 1860 bp, Artificial Sequence; identical to SEQ ID NO: 18292
  Description of Artificial Sequence: Synthetic coding sequence

SEQ ID NO: 18299 - DNA, 1860 bp, Artificial Sequence; identical to SEQ ID NO: 18292
  Description of Artificial Sequence: Synthetic coding sequence

SEQ ID NO: 18300 - DNA, 1929 bp, Artificial Sequence
  Description of Artificial Sequence: Synthetic coding sequence
atgtctgagcccggcatgctgggcaggaaggatgtgtgggtgccccgggagacccccttcaccaaggccatggaggtggaggccgctgaggcccggagccctgcccctggctacaagaggtctggaagacgctacaagtgtgtgtcctgcaccaagaccttccccaatgccccccgggccgcccggcatgctgccacccacggccctgctgactgcagcgaggaggtggccgaggtgaagcccaagccagagacagaggccaaggccgaggaggccagcggggagaaggtgtctggcagcgctgccaagccccggccctatgcctgccccctgtgccccaaggcctacaagacagcccctgagctgcggagccacggccgcagccacactggagagaagcccttcccctgcccagaatgtggccgccgcttcatgcagcctgtgtgcctgcgggtgcacctggccagccacgccggggagctgcccttccgctgtgcccactgccccaaggcctacggggccctgagcaagctgaagatccaccagaggggccacactggagagcggccctatgcctgtgccgactgtgggaagagctttgctgaccccagcgtcttcaggaagcacaggaggacccacgccggcctgcggccctacagctgtgagcgctgtgggaaggcctatgcagagctgaaggacctgagaaatcatgagaggagccacactggagagcggcccttcctgtgcagtgaatgtgggaagagcttcagccgcagcagcagcctgacctgccaccagagaattcatgctgcccagaagccctaccgctgcccagcctgtgggaagggcttcacccagctgagcagctaccagagccatgagaggacccacagcggggagaagcccttcctgtgcccccgctgtggccgcatgttcagtgaccccagcagcttcagaagacaccagagggcccatgaaggagtgaagccctaccactgtgagaagtgtgggaaggacttccggcagcctgctgacctggccatgcaccggcgggtgcacactggagaccggcccttcaagtgcctgcagtgtgacaagacctttgtggcctcctgggacctgaagagacatgccctggtgcacagcggccagaggcccttccgctgtgaagaatgtggccgggcctttgctgagcgggccagcctgaccaagcacagccgggtgcacagcggggagcggcccttccactgcaatgcctgtgggaagagctttgtggtgagcagcagcctgaggaagcatgagaggacccacaggagcagcgaggccgccggcgtgcccccagcccaggagctggtggtgggcctggccctgcctgtgggcgtggccggggagagcagcgctgccccagctgctggagctggcctgggggaccccccagctggcctgctgggcctgcccccagagagcggaggagtgatggccacccagtggcaggtggtgggcatgacagtggagcacgtggagtgccaggatgctggggtgcgggaggcccctggccccctggagggcgctggggaggccggcggggaggaggctgatgagaagccaccccagtttgtgtgccgggagtgcaaggagaccttcagcaccatgaccctgctgcggagacatgagaggagccaccctgagctgcggcccttcccctgcacccagtgtgggaagagcttcagtgaccgggccggcctgaggaagcacagcaggacccacagctctgtgcggccctacacctgcccccactgccccaaggccttcctgagcgccagtgacctgaggaagcatgagaggacccaccctgtgcccatgggcacccccacccccctggagcccctggtggccctgctgggcatgcctgaggagggccctgcctag

SEQ ID NO: 18301 - DNA, 1395 bp, Artificial Sequence
  Description of Artificial Sequence: Synthetic coding sequence
atggtgtctggcctgcggctggccagccgctctggagaggagggctggctgaagccagctgtggcccggctgggcccccccaggcaccggctgaggaacctgaggacagagagcccctggaggagccggggctctgtgctcttctgcagcggccctggccgggccggccgggctgctgagcccctgcaccctgtgtgcacctgtggccgccacttcagaagacctgagccctgccgggagcccctggccagccccatccaggacagcgtggcctttgaagatgtggccgtgaacttcacccaggaggagtgggccctgctggacagcagccagaagaacctgtaccgggaggtgatgcaggagacctgcaggaacctggcctctgtgggcagccagtggaaggaccagaacatcgaggaccactttgagaagccaggcaaggacatccggaaccacatcgtgcagaggctgtgtgagagcaaggaggatggccagtacggggaggtggtgtcccagatccccaacctggacctgaatgaaaacatcagcacaggcctgaagccctgtgagtgcagcatctgtgggaaggtgtttgtgcgccacagcctgctgaacagacacatcctggcccacagcggctacaagccctatggagagaagcagtacaagtgtgagcagtgtgggaagttctttgtgtctgtgcctggggtgcggcggcacatgatcatgcacagcggcaacccagcctacaagtgcaccatctgtgggaaggccttctacttcctgaacagcgtggagcggcaccagaggacccacactggagagaagccctacaagtgcaagcagtgtgggaaggccttcaccgtgtctggcagctgcctgatccacgagaggacccacactggagagaagccctatgagtgcaaggaatgtgggaagaccttccgcttcagctgcagcttcaagacccatgagaggacccacactggagagcggccctacaagtgcaccaagtgtgacaaggccttcagctgcagcaccagcctgcgctaccacggcagcatccacactggagagcggccctatgagtgcaagcagtgtgggaaggccttcagccggctgagcagcctgtgcaaccacaggagcacccacactggagagaagccctatgagtgcaagcagtgtgaccaggccttcagccggctgagcagcctgcacctgcacgagcgcatccacactggagagaagccctatgagtgcaagaagtgtgggaaggcctacaccaggagcagccacctgaccaggcatgagaggagccatgacatcgaggccggctgcagcgacagcgcctacaaccccagcaccctgggcggccagggcgtgtggatcgcctag

SEQ ID NO: 18302 - DNA, 474 bp, Artificial Sequence
  Description of Artificial Sequence: Synthetic coding sequence
atggtgtctggcctgcggctggccagccgctctggagaggagggctggctgaagccagctgtggcccggctgggcccccccaggcaccggctgaggaacctgaggacagagagcccctggaggagccggggctctgtgctcttctgcagcggccctggccgggccggccgggctgctgagcccctgcaccctgtgtgcacctgtggccgccacttcagaagacctgagccctgccgggagcccctggccagccccatccaggacagcgtggcctttgaagatgtggccgtgaacttcacccaggaggagtgggccctgctggacagcagccagaagaacctgtaccgggaggtgatgcaggagacctgcaggaacctggcctctgtggagatcatctcctacagagactgtgtgaaggtgaagaagatggtgtccatggagaagctgagcgccaagttccagatcctgatctag

SEQ ID NO: 18303 - DNA, 216 bp, Artificial Sequence
  Description of Artificial Sequence: Synthetic coding sequence
atggattctgtggcctttgaagatgtggccgtgaacttcacccaggaggagtgggccctgctggacagcagccagaagaacctgtaccgggaggtgatgcaggagacctgcaggaacctggcctctgtggagatcatctcctacagagactgtgtgaaggtgaagaagatggtgtccatggagaagctgagcgccaagttccagatcctgatctag

SEQ ID NO: 18304 - DNA, 186 bp, Artificial Sequence
  Description of Artificial Sequence: Synthetic coding sequence
atggattctgtggcctttgaagatgtggccgtgaacttcacccaggaggagtgggccctgctggacagcagccagaagaacctgtaccgggaggtgatgcaggagacctgcaggaacctggccagcgaggccaacgggaagacccgcatcctgaagatcaccagcaagaacctgggcaagatctag

SEQ ID NO: 18305 - DNA, 1137 bp, Artificial Sequence
  Description of Artificial Sequence: Synthetic coding sequence
atggattctgtggcctttgaagatgtggccgtgaacttcacccaggaggagtgggccctgctggacagcagccagaagaacctgtaccgggaggtgatgcaggagacctgcaggaacctggcctctgtgggcagccagtggaaggaccagaacatcgaggaccactttgagaagccaggcaaggacatccggaaccacatcgtgcagaggctgtgtgagagcaaggaggatggccagtacggggaggtggtgtcccagatccccaacctggacctgaatgaaaacatcagcacaggcctgaagccctgtgagtgcagcatctgtgggaaggtgtttgtgcgccacagcctgctgaacagacacatcctggcccacagcggctacaagccctatggagagaagcagtacaagtgtgagcagtgtgggaagttctttgtgtctgtgcctggggtgcggcggcacatgatcatgcacagcggcaacccagcctacaagtgcaccatctgtgggaaggccttctacttcctgaacagcgtggagcggcaccagaggacccacactggagagaagccctacaagtgcaagcagtgtgggaaggccttcaccgtgtctggcagctgcctgatccacgagaggacccacactggagagaagccctatgagtgcaaggaatgtgggaagaccttccgcttcagctgcagcttcaagacccatgagaggacccacactggagagcggccctacaagtgcaccaagtgtgacaaggccttcagctgcagcaccagcctgcgctaccacggcagcatccacactggagagcggccctatgagtgcaagcagtgtgggaaggccttcagccggctgagcagcctgtgcaaccacaggagcacccacactggagagaagccctatgagtgcaagcagtgtgaccaggccttcagccggctgagcagcctgcacctgcacgagcgcatccacactggagagaagccctatgagtgcaagaagtgtgggaaggcctacaccaggagcagccacctgaccaggcatgagaggagccatgacatcgaggccggctgcagcgacagcgcctacaaccccagcaccctgggcggccagggcgtgtggatcgcctag

SEQ ID NO: 18306 - DNA, 1137 bp, Artificial Sequence; identical to SEQ ID NO: 18305
  Description of Artificial Sequence: Synthetic coding sequence

SEQ ID NO: 18307 - DNA, 1170 bp, Artificial Sequence
  Description of Artificial Sequence: Synthetic coding sequence
atggattctgtgtcctttgaagatgtggccgtggccttcacccaggaggagtgggccctgctggaccccagccagaagaacctgtacagagatgtgatgcaggagatcttcaggaacctggcctctgtgggcaacaagtctgaggaccagaacatccaggatgacttcaagaaccctggaagaaacctgagcagccacgtggtggagcggctgtttgagatcaaggagggcagccagtacggggagaccttcagccaggacagcaacctgaacctgaacaagaaggtgtccactggagtgaagccctgtgagtgcagcgtgtgtgggaaggtgttcatctgccacagcgccctgcaccgccacatcctgagccacatcggcaacaagctgtttgaatgtgaagaatgtcctgagaagctgtaccactgcaagcagtgtgggaaggccttcatcagcctgacctctgtggacagacacatggtgacccacaccagcaatggcccctacaagggccctgtgtatgagaagccctttgacttccccagcgtcttccagatgccccagagcacctacaccggggagaagacctacaagtgcaagcactgtgacaaggccttcaactacagcagctacctgcgggagcacgagaggacccacactggagagaagccctatgcctgcaagaagtgtgggaagagcttcaccttcagcagcagcctgcggcagcacgagaggagccacactggagagaagccctatgagtgcaaggaatgtgggaaggccttcagccgcagcacctacctgggcatccacgagaggacccacactggagagaagccctatgagtgcatcaagtgtgggaaggccttccgctgcagccgggtgctgcgggtgcatgagaggacccacagcggggagaagccctatgagtgcaagcagtgtgggaaggccttcaagtacagcagcaacctgtgtgaacatgagaggacccacactggagtgaagccctacggctgcaaggaatgtgggaagagcttcaccagcagcagcgccctgcggagccatgagaggacccacactggagagaagccctatgagtgcaagaagtgtgggaaggccttcagctgcagcagcagcctgaggaagcatgagcgggcctacatgtggtag

SEQ ID NO: 18308 - DNA, 357 bp, Artificial Sequence
  Description of Artificial Sequence: Synthetic coding sequence
atgggcctgctggccttcagagatgtggccctggagttcagccctgaggagtgggagtgcctggaccctgcccagaggagcctgtacagagatgtgatgctggagaactacagaaacctgatcagcctgggcctggccatgagcaagccagagctgatcatctgcctggaggccaggaaggagccctggaatgtgaacacagagaagacagcccggcacagcgtggagacccgcttcagacatgtgggccaggccggcctgaagctgctgaccagcggggaccccccagccctggccagccagagcgctggcatcaccggcaccggccaccactgccagcccatctgtgtgttctag

SEQ ID NO: 18309 - DNA, 1605 bp, Artificial Sequence
  Description of Artificial Sequence: Synthetic coding sequence
atgctgagccctgtgtccagagatgccagtgatgccctgcagggcaggaagtgcctgcggcccaggagccggcggctgcccctgcctgctgctgtgcgggcccacggccccatggccgagctgacagacagcgcccggggctgtgtggtgtttgaagatgtgtttgtgtacttcagccgggaggagtgggagctgctggatgatgcccagaggctgctgtaccatgatgtgatgctggagaactttgccctgctggccagcctgggcatcgccttcagccgcagcagagctgtgatgaagctggagcggggggaggagccctgggtgtatgaccaggtggacatgaccagcgccacagagcgggaggcccagaggggcctgcggcccggctgctggcatggagtggaggatgaggaggtgagcagcgagcagagcatctttgtggccggcgtgtctgaggtgaggaccctgatggccgagctggagagccacccctgtgacatctgtggccccatcctgaaggacaccctgcacctggccaagtaccatggaggcaaggcccggcagaagccctacctgtgtggggcctgtgggaagcagttctggttcagcacagactttgaccagcaccagaaccagcccaatggaggcaagctgttccccaggaaggagggccgggacagcgtgaagagctgccgggtgcacgtgcctgagaagaccctgacctgtgggaaaggaagaagagacttcagcgccaccagcggcctgctgcagcaccaggccagcctgagctccatgaagccccacaagagcaccaagctggtgtctggcttcctgatgggccagcgctaccaccgctgtggagaatgtgggaaggccttcaccaggaaggacaccctggcccggcaccagaggatccacactggagagcggccctatgagtgcaatgaatgtgggaagttcttcagccagagctatgacctcttcaagcaccagacagtgcacactggagagcggccctatgagtgcagtgaatgtgggaagttcttccggcagatcagcggcctgattgagcaccggcgggtgcacactggagagcggctgtaccagtgtgggaaatgtgggaagttcttcagcagcaagagcaacctgatccgccaccaggaggtgcacactggagcccggccctacgtgtgcagtgaatgtgggaaggagttcagcaggaagcacaccctggtgctgcaccagaggacccacactggagagcggccctatgagtgcagtgaatgtgggaaggccttcagccagagcagccacctgaatgtgcactggaggatccacagcagtgactatgagtgcagccgctgtgggaaggccttcagctgcatcagcaagctgatccagcaccagaaggtgcacagcggggagaagccctatgagtgcagcaaatgtgggaaggccttcacccagaggcccaacctgatccgccactggaaggtgcacactggagagcggccctacgtgtgcagtgaatgtggccgggagttcatcaggaagcagaccctggtgctgcaccagagggtgcacgccggggagaagctgtag

SEQ ID NO: 18310 - DNA, 1311 bp, Artificial Sequence
  Description of Artificial Sequence: Synthetic coding sequence
atgaagctggagcggggggaggagccctgggtgtatgaccaggtggacatgaccagcgccacagagcgggaggcccagaggggcctgcggcccggctgctggcatggagtggaggatgaggaggtgagcagcgagcagagcatctttgtggccggcgtgtctgaggtgaggaccctgatggccgagctggagagccacccctgtgacatctgtggccccatcctgaaggacaccctgcacctggccaagtaccatggaggcaaggcccggcagaagccctacctgtgtggggcctgtgggaagcagttctggttcagcacagactttgaccagcaccagaaccagcccaatggaggcaagctgttccccaggaaggagggccgggacagcgtgaagagctgccgggtgcacgtgcctgagaagaccctgacctgtgggaaaggaagaagagacttcagcgccaccagcggcctgctgcagcaccaggccagcctgagctccatgaagccccacaagagcaccaagctggtgtctggcttcctgatgggccagcgctaccaccgctgtggagaatgtgggaaggccttcaccaggaaggacaccctggcccggcaccagaggatccacactggagagcggccctatgagtgcaatgaatgtgggaagttcttcagccagagctatgacctcttcaagcaccagacagtgcacactggagagcggccctatgagtgcagtgaatgtgggaagttcttccggcagatcagcggcctgattgagcaccggcgggtgcacactggagagcggctgtaccagtgtgggaaatgtgggaagttcttcagcagcaagagcaacctgatccgccaccaggaggtgcacactggagcccggccctacgtgtgcagtgaatgtgggaaggagttcagcaggaagcacaccctggtgctgcaccagaggacccacactggagagcggccctatgagtgcagtgaatgtgggaaggccttcagccagagcagccacctgaatgtgcactggaggatccacagcagtgactatgagtgcagccgctgtgggaaggccttcagctgcatcagcaagctgatccagcaccagaaggtgcacagcggggagaagccctatgagtgcagcaaatgtgggaaggccttcacccagaggcccaacctgatccgccactggaaggtgcacactggagagcggccctacgtgtgcagtgaatgtggccgggagttcatcaggaagcagaccctggtgctgcaccagagggtgcacgccggggagaagctgtag

SEQ ID NO: 18311 - DNA, 1359 bp, Artificial Sequence
  Description of Artificial Sequence: Synthetic coding sequence
atgtttgccaccagcggggctgtggccgccggcaagccctacagctgcagtgaatgtgggaagagcttctgctacagctctgtgctgctgcggcatgagcgggcccacggcggagatggccgcttccgctgcctggagtgtggggagcgctgtgcccgggctgctgacctgcgggcccacaggaggacccatgctggccagaccctgtacatctgcagtgaatgtggccagagcttccgccacagcggccgcctggacctgcacctgggcgcccaccggcagcgctgcaggacctgcccctgcaggacctgtggccgccgcttcccccacctgcctgccctgctgctgcacagaagacggcagcacctgcctgagcggccccggcgctgccccctgtgtgcccggaccttccggcagagcgccctgctcttccaccaggcccgggcccaccccctgggcaccaccagtgaccctgctgccccaccccaccgctgtgcccagtgcccccgggccttccgcagcggggccggcctgcggagccacgcccgcatccacgtgagccgcagccccacccggccccgggtgtctgatgcccaccagtgtggggtgtgtgggaagtgcttcggcaagagcagcaccctgaccaggcacctgcagacccacagcggggagaagcccttcaagtgcccagaatgtgggaagggcttcctggagagcgccaccctggtgcgccaccagaggacccacactggagagaagccctatgcctgtggggactgtggccgctgcttcagcgagagcagcaccctgctgcggcaccggcgcagccaccagggcgagcggccccacgcctgtgccacctgtgggaagggcttcggccagaggagtgacctggtggtgcaccagaggatccacactggagagaagccctttgcctgcccagaatgtggccgccgcttcagtgacagaagtgacctgaccaagcacaggaggacccacactggagagaagccctaccgctgtgagctgtgtgggaagcgcttcacctgtgtgagcaacctgaatgtgcacagaagaaatcatgctggccacaagccccacaagtgcccagaatgttccaaggccttctctgtggccagcaagctggccctgcacaggaagacccacctgggggagaggcctgcagaatgtgctgaatgtgggaagtgcttcagccacagccgcagcctgagccagcaccagagggcccacacccgggccaggacagctgctgctgtggccatccagagcgctgtgggcacagccctggtgtttgagggccctgctgagcaggagaagccaggcttctctgtgtcctag

SEQ ID NO: 18312 - DNA, 672 bp, Artificial Sequence
  Description of Artificial Sequence: Synthetic coding sequence
atgtttgccaccagcggggctgtggccgccggcaagccctacagctgcagtgaatgtgggaagagcttctgctacagctctgtgctgctgcggcatgagcgggcccacggcggagatggccgcttccgctgcctggagtgtggggagcgctgtgcccgggctgctgacctgcgggcccacaggaggacccatgctggccagaccctgtacatctgcagtgaatgtggccagagcttccgccacagcggccgcctggacctgcacctgggcgcccaccggcagcgctgcaggacctgcccctgcaggacctgtggccgccgcttcccccacctgcctgccctgctgctgcacagaagacggcagcacctgcctgagcggcccctgctgccctgctgcccccgcatcacccgcatcctgagcagtggagtgggcgccggcagccagggcaccctgcggctgccctgtgtgcaggagccccgctgctggtgtgtgcccctgatgctgctgtgcagcctggtgttcctgatcttcctgcccctcttctgcctgctgctgagctacctgatcccagcccacatcttctccttcccagactacttctgctgcccagccagcagtggaaatggccaccgcttcggctgccgccacgtgaccagccctgtggccagctag

SEQ ID NO: 18313 - DNA, 114 bp, Artificial Sequence
  Description of Artificial Sequence: Synthetic coding sequence
atgtttgccaccagcggggctgtggccgccggcaagccctacagctgcagtgaatgtgggaagagcttctgctacagctctgtgctgctgcggcatgagcgggcccacggctag

SEQ ID NO: 18314 - DNA, 210 bp, Artificial Sequence
  Description of Artificial Sequence: Synthetic coding sequence
atgtttgccaccagcggggctgtggccgccggcaagccctacagctgcagtgaatgtgggaagagcttctgctacagctctgtgctgctgcggcatgagcgggcccacggcggagatggccgcttccgctgcctggagtgtggggagcgctgtgcccgggctgctgacctgcgggcccacaggaggacccatgctggccagaccctgtag

SEQ ID NO: 18315 - DNA, 15 bp, Artificial Sequence
  Description of Artificial Sequence: Synthetic coding sequence
atgtttgccacctag

SEQ ID NO: 18316 - DNA, 1767 bp, Artificial Sequence
  Description of Artificial Sequence: Synthetic coding sequence
atgctggagaactacagaaacctggtgttcctgggcattgctgccttcaagccagacctgatcatcttcctggagcagggcaaggagccctggaacatgaagagacatgagatggtggaggagccccctgtgatctgcagccacttcagccaggagttctggccagagcagggcatcgaggacagcttccagaagatgatcctgcggcgctatgacaagtgtggccacgagaacctgcacctgaagatcagctgcaccaacgtggatgagtgcaatgtgcacaaggagggctacaacaagctgaaccagagcctgaccaccacccagagcaaggtgttccagtgtgggaagtatgccaacgtgttccacaagtgcagcaacagcaacagacacaagatccgccacactggagagaagggcctgaagtgcaaggagtatgtgcgctccttctgcatgctgagccacctgagccagcacgagcgcatctacacccgggagaacagctacaagtgtgaagaaaatggcaaggccttcaactggagcagcaccctgacctactacaagagcatccacactggagagaagccctacaagtgtgaagaatgtgggaaggccttcagcaagttcagcatcctgaccaagcacaaggtgatccacactggagagaagccctacaagtgtgaagaatgtgggaaggccttcaacagaagcagcatcctgaccaagcacaagatcatccacactggagagaagccctacaagtgtgaagaatgtgggaagggcttcagctctgtgtccaccctgaacacccacaaggccatccacgccgaggagaagccctacaagtgtgaagaatgtgggaaggccagcaacagcagcagcaagctgatggagcacaagaggatccacactggagagaagccctacaagtgtgaagaatgtgggaaggccttctcctggagcagcagcctgacagagcacaagagaattcatgctggggagaagccctacaagtgtgaagaatgtgggaaggccttcaacagaagcagcatcctgaccaagcacaagatcatccacactggagagaagccctacaagtgtgagggctgtgggaaggccttcagcaaggtgtccaccctgaacacccacaaggccatccacgccgaggagaagccctacaagtgtgaagaatgtgggaaggccagcaacagcagcagcaagctgatggagcacaagaggatccacactggagagaagccctacaagtgtgaagaatgtgggaaggccttctcctggagcagcagcctgacagagcacaagagaattcatgctggggagaagccctacaagtgtgaagaatgtgggaaggccttcacctggagcagcagcttcaccaagcacaagagaattcatgctgctgagaagccctacaagtgtgaagaatgtgggaagggcttcagcaccttcagcatcctgaccaagcacaagatcatccacactggagagaagcgctacaagtgtgaagaatgtgggaaggccttctcctggagcagcatcctgacagagcacaagatcatccacactggagagaagccctacaagtgtgaagaatgtgggaaggccttcagccgcagcagcagcctgaccaggcacaagaggatccacactggagagaagccctacaagtgtgaagaatgtgggaaggccttcaagagcagcagcacagtgtcctaccacaagaagatccacactggagagaacccctag

SEQ ID NO: 18317 - DNA, 1755 bp, Artificial Sequence
  Description of Artificial Sequence: Synthetic coding sequence
atggccctgagccagggcctcttcaccttcaaggatgtggccatcgagttcagccaggaggagtgggagtgcctggaccctgcccagagggccctgtacagagatgtgatgctggagaactacagaaacctgctgagcctggatgaggacaacatccccccagaagatgacatctctgtgggcttcaccagcaagggcctgagccccaaggagaacaacaaggaggagctgtaccacctggtgatcctggagaggaaggagagccacggcatcaacaactttgacctgaaggaggtgtgggagaacatgcccaagtttgacagcctgtgggactatgatgtgaagaactacaagggcatgcccctgacctgcaacaagaacctgacccacaggaaggaccagcagcacaacaagagcagcatccacttcagcctgaagcagagcgtgtccatccgggacagcgcccaccagtacttcatccatgacaagcccttcatccggaacctgctgaagctgaagaacaacatccgctatgccggcaacaagtatgtgaagtgctttgagaacaagattggcctgagcctgcaggcccagctggccgagctgcagcgcttccagacaggagagaagatgtatgagtgcaaccctgtggagaagagcatcaacagcagctctgtgagccccctgcccccctgtgtgaagaacatctgcaacaagtacaggaagatcctgaagtaccccctgctgcacacccagtatggccgcacccacatccgggagaagagctacaagtgcaatgactgtgggaaggccttcagcaagagcagcaacctgaccaaccaccagaggatccacagcggccagaggccctacaagtgcaatgaatgtgggaaggccttcaaccagtgcagcaacctgaccaggcaccagagggtgcacactggagagaagccctaccagtgcaacatctgtgggaaggtgtgcagccagaacagcaacctggccagccaccagaggatgcacactggagagaagccctacaagtgcaatgaatgtgggaaggccttcatccagaggagccacctgtggggccacgagcgcatccacactggagagaagccctacaagtgcaatgaatgtgacaaggcctttgctgagaggagcagcctgacccagcacaagaggatccacactggagagaagccctacatctgcaatgaatgtgggaaggccttcaagcagtgcagccacctgaccaggcaccagaacatccaccctggagagaagccccacaagtgcaatgtgtgtggccgggccttcatccagagcagcagcctggtggagcaccagaggatccacactggagagaagccctacaagtgcaacaagtgtgacaaggccttcatcaagaggagccacctgtggggccaccagaggacccacactggagagaagccctacaagtgcacagaatgtgggaaggccttcacagagaggagcaacctgacccagcacaagaagatccacactggagagaagccctacaagtgcacagaatgtgggaaggccttcacccagtttgccaacctgaccaggcaccagaagatccacatcgagaagaagcactgcaagcacaacatccacggcaatgccctcttccagagcagcaacctgggggaccaccagaagagctacaaccgggagaagcacatcaagtacaatgagaccaagatcaagtacagcagctgcacctag

SEQ ID NO: 18318 - DNA, 540 bp, Artificial Sequence
  Description of Artificial Sequence: Synthetic coding sequence
atggccctgagccagggcctcttcaccttcaaggatgtggccatcgagttcagccaggaggagtgggagtgcctggaccctgcccagagggccctgtacagagatgtgatgctggagaactacagaaacctgctgagcctggatgaggacaacatccccccagaagatgacatctctgtgggcttcaccagcaagggcctgagccccaaggagaacaacaaggaggagctgtaccacctggtgatcctggagaggaaggagagccacggcatcaacaactttgacctgaaggaggtgtgggagaacatgcccaagtttgacagcctgtgggactatgatgtgaagaactacaagggcatgcccctgacctgcaacaagaacctgacccacaggaaggaccagcagcacaacaagagcagcatccacttcagcctgaagaagaagaagaagaagaagaagaagcagaacaagaccaagcccaaggccaccaaggagaagaggaggaagaacaagggcaagaacaagaccaacaccaagtag

SEQ ID NO: 18319 - DNA, 1578 bp, Artificial Sequence
  Description of Artificial Sequence: Synthetic coding sequence
atgggcaccatcagcctgtgcatcggcgtgtgtgcctttgaaggagccaacaccagcaccagcttctacaagctggtgtacacagccatcctgagctacagcatccaggacctgctgcctgagcaggacatgaaggacctgtgccagaaggtgaccctgaccaggcaccgctcctggggcctggacaacctgcacctggtgaaggactggaggacagtgaatgaaggcaagggccagaaggagtactgcaaccggctgacccagtgcagcagcaccaagagcaagatcttccagtgcattgaatgtggcaggaacttctcctggaggagcatcctgacagagcacaagaggatccacactggagagaagccctacaagtgtgaagaatgtgggaaggtgttcaaccgctgcagcaacctgaccaagcacaagaggatccacactggagagaagccctacaagtgtgatgaatgtgggaaggtgttcaactggtggagccagctgaccaaccacaagaagatccacactggagagaagccctacaagtgtgatgaatgtgacaaggtgttcaactggtggagccagctgaccagccacaagaagatccacagcggggagaagccctacccctgtgaagaatgtgggaaggccttcacccagttcagcaacctgacccagcacaagaggatccacactggagagaagccctacaagtgcaaggagtgctgcaaggccttcaacaagttcagcaacctgacccagcacaagaggatccacactggagagaagccctacaagtgtgaagaatgtggaaatgtgttcaatgaatgtagccacctgaccaggcaccggcgcatccacactggagagaagccctacaagtgtgaagaatgtgggaaggccttcacccagtttgccagcctgaccaggcacaagaggatccacactggagagaagccctaccagtgtgaagaatgtgggaagaccttcaaccgctgcagccacctgagcagccacaagaggatccacactggagagaagccctacaagtgtgaagaatgtggccgcaccttcacccagttcagcaacctgacccagcacaagaggatccacactggagagaagccctacaagtgcaaggaatgtgggaaggccttcaacaagttcagcagcctgacccagcaccggcgcatccacactggagtgaagccctacaagtgtgaagaatgtgggaaggtgttcaagcagtgcagccacctgaccagccacaagaggatccacactggagagaagccctacaagtgcaaggaatgtgggaaggccttctaccagagcagcatcctgagcaagcacaagaggatccacacagaggagaagccctacaagtgtgaagaatgtgggaaggccttcaaccagttcagcagcctgaccaggcacaagaggatccacactggagagaagcgctacaagtgcaaggaatgtgggaagggcttctaccagagcagcatccacagcaagtacaagaggatctacaccggggaggagccagacaagtgcaagaagtgtggcagcctgtag

SEQ ID NO: 18320 - DNA, 1743 bp, Artificial Sequence
  Description of Artificial Sequence: Synthetic coding sequence
atgcctggccaccctgagagcaggaagacccggcgcatcctgaccatgctgccccggctggtgctgaacagcttcccccaggtgatcctgctgcccaacccccccaaggtgctgcggctgcagggcctgctggccttcagtgatgtggtgattgagttcagccctgaggagtgggcctgcctggaccctgcccagaggaacctgtacagagatgtgatgtttgagaactacagaaacctggtgtccctggccatcctgagctacagcatccaggacctgctgcctgagcaggacatgaaggacctgtgccagaaggtgaccctgaccaggcaccgctcctggggcctggacaacctgcacctggtgaaggactggaggacagtgaatgaaggcaagggccagaaggagtactgcaaccggctgacccagtgcagcagcaccaagagcaagatcttccagtgcattgaatgtggcaggaacttctcctggaggagcatcctgacagagcacaagaggatccacactggagagaagccctacaagtgtgaggagtgtgggaaggtgttcaaccgctgcagcaacctgaccaagcacaagaggatccacactggagagaagccctacaagtgtgatgaatgtgggaaggtgttcaactggtggagccagctgaccaaccacaagaagatccacactggagagaagccctacaagtgtgatgaatgtgacaaggtgttcaactggtggagccagctgaccagccacaagaagatccacagcggggagaagccctacccctgtgaggagtgtgggaaggccttcacccagttcagcaacctgacccagcacaagaggatccacactggagagaagccctacaagtgcaaggagtgctgcaaggccttcaacaagttcagcaacctgacccagcacaagaggatccacactggagagaagccctacaagtgtgaggagtgtggaaatgtgttcaatgaatgtagccacctgaccaggcaccggcgcatccacactggagagaagccctacaagtgtgaggagtgtgggaaggccttcacccagtttgccagcctgaccaggcacaagaggatccacactggagagaagccctaccagtgtgaggagtgtgggaagaccttcaaccgctgcagccacctgagcagccacaagaggatccacactggagagaagccctacaagtgtgaggagtgtggccgcaccttcacccagttcagcaacctgacccagcacaagaggatccacactggagagaagccctacaagtgcaaggaatgtgggaaggccttcaacaagttcagcagcctgacccagcaccggcgcatccacactggagtgaagccctacaagtgtgaggagtgtgggaaggtgttcaagcagtgcagccacctgaccagccacaagaggatccacactggagagaagccctacaagtgcaaggaatgtgggaaggccttctaccagagcagcatcctgagcaagcacaagaggatccacacagaggagaagccctacaagtgtgaggagtgtgggaaggccttcaaccagttcagcagcctgaccaggcacaagaggatccacactggagagaagcgctacaagtgcaaggaatgtgggaagggcttctaccagagcagcatccacagcaagtacaagaggatctacacaggagaggagccagacaagtgcaagaagtgtggcagcctgtag

SEQ ID NO: 18321 - DNA, 684 bp, Artificial Sequence
  Description of Artificial Sequence: Synthetic coding sequence
atgcctggccaccctgagagcaggaagacccggcgcatcctgaccatgctgccccggctggtgctgaacagcttcccccaggtgatcctgctgcccaacccccccaaggtgctgcggctgcagggcctgctggccttcagtgatgtggtgattgagttcagccctgaggagtgggcctgcctggaccctgcccagaggaacctgtacagagatgtgatgtttgagaactacagaaacctggtgtccctggccatcctgagctacagcatccaggacctgctgcctgagcaggacatgaaggacctgtgccagaaggtgaccctgaccaggcaccgctcctggggcctggacaacctgcacctggtgaaggactggaggacagtgaatgaaggcaagggccagaaggagtactgcaaccggctgacccagtgcagcagcaccaagagcaagatcttccagtgcattgaatgtggcaggaacttctcctggaggagcatcctgacagagcacaagaggatccacactggagagaagccctacaagtgtgaggagtgtgggaaggtgttcaaccgctgcagcaacctgaccaagcacaagaggatccacactggagagaagccctacaagtgtgatgaatgtgggaaggtgttcaactggtggagccagctgaccaaccacaagtag

SEQ ID NO: 18322 - DNA, 1236 bp, Artificial Sequence
  Description of Artificial Sequence: Synthetic coding sequence
atggccaagaggcctggcagccctggcagccgggagatgggcctgctgaccttcagagatgtggtgattgagttcagcctggaggagtggcagtgcctggaccacgcccagcagaacctgtacagagatgtgatgctggagaactacagaaacctggtgtccctgggcattgctgtgtccaagccagacctgatcacctgcctggagcagaacaaggagccctggaacatcaagagaaatgagatggtgaccaagcaccctgtgatgtgcagccacttcacccaggacctgcccccagagctgggcatcaaggacagcctgcagaaggtgatccccaggagatatggcaagagcggccatgacaacctgcaggtgaagacctgcaagtccatgggagaatgtgaggtgcagaagggcggctgcaatgaggtgaaccagtgcctgagcaccacccagaacaagatcttccagacccacaagtgtgtgaaggtgtttgggaagttcagcaacagcaacagacacaagaccaggcacacaggcaagaagcacttcaagtgcaagaagtatggcaagagcttctgcatggtgtcccagctgcaccagcaccagatcatccacaccagagaaaattcctaccagtgtgaggagtgtgggaagcccttcaactgcagcagcaccctgagcaagcacaagaggatccacactggagagaagccctaccgctgtgaggagtgtgggaaggccttcacctggagcagcaccctgaccaagcaccggcgcatccacactggagagaagccctacacctgtgaggagtgtggccaggccttcagccgcagcagcaccctggccaaccacaagaggatccacactggagagaagccctacacctgtgaggagtgtgggaaggccttcagcctgagcagcagcctgacctaccacaagaggatccacactggagagaagccctacacctgtgaggagtgtgggaaggccttcaactgcagcagcaccctgaagaagcacaagatcatccacactggagagaagccctacaagtgcaaggaatgtgggaaggcctttgccttcagcagcaccctgaacacccacaagaggatccacactggagaggagccctacaagtgtgaggagtgtgacaaggccttcaagtggagcagcagcctggccaaccacaagtccatgcacactggagagaagccctacaagtgtgagtag

SEQ ID NO: 18323 - DNA, 1236 bp, Artificial Sequence; identical to SEQ ID NO: 18322
  Description of Artificial Sequence: Synthetic coding sequence

SEQ ID NO: 18324 - DNA, 1593 bp, Artificial Sequence
  Description of Artificial Sequence: Synthetic coding sequence
atgcctggccccccaggcagcctggagatgggccccctgaccttcagagatgtggccatcgagttcagcctggaggagtggcagtgcctggacacagcccagaggaacctgtacaggaaggtgatgtttgagaactacagaaacctggtgttcctgggcattgctgtgtccaagccccacctgatcacctgcctggagcagggcaaggagccctggaacaggaagaggcaggagatggtggccaagccccctgtgatctacagccacttcacagaggacctgtggccagagcacagcatcaaggacagcttccagaaggtgatcctgcggggctacggcaaatgtggccacgagaacctgcagctgcgcatcagctgcaagtctgtggatgagagcaaggtgttcaaggagggctacaatgagctgaaccagtgcctgcggaccacccagagcaagatcttccagtgtgacaagtatgtgaaggtgttccacaagttcagcaacagcaacagccacaagaagaggaacacaggcaagaaggtgttcaagtgcaaggaatgtgggaagagcttctgcatgctgagccacctgacccagcacatccgcatccacaccagagaaaattcctacaagtgtgaggagtgtgggaaggtgctgaactggttcagcgagctgatcaagcacaagggcatccacatgggagagaagccctacaagtgtgaggagtgtgggaaggccttcaaccagagcagcaccctcatcaagcacaagaagatccacatcgaggagaagcccttcaagtgtgaggagtgtgggaaggccttcagcctcttcagcatcctgagcaagcacaagatcatccacactggagacaagccctacaagtgtgatgagtgccacaaggccttcaactggtttgccaccctgaccaaccacaagaggatccacactggagagaagcccttcaagtgtgaggagtgtgggaaggacttcaaccagttcagcaacctgaccaagcacaagaagatccacactggagagaagccctacaagtgtgaggagtgtgggaaggccttcaaccagtttgccaacctgaccaggcacaagaagatccacactggagagaagagctacaagtgtgaggagtgtgggaaggccttcatccagagcagcaacctgacagagcacatgaggatccacactggagagaagccctacaagtgtgaggagtgtgggaaggccttcaacggctgcagcagcctgaccaggcacaagaggatccacacccgggagaacacctacaagtgtgaggagtgtgggaagggcttcaccctcttcagcaccctgaccaaccacaaggtgatccacactggagagaagagctacaagtgtgatgaatgtggaaatgtgttcaactggccagccaccctggccaaccacaagaggatccacgcccgggagaagccctacaagtgtgaggagtgtgggaaggccttcaacagaagcagccacctgaccaggcacaagaagatccacactggagagaagctgtacaagccagagaagtgtgacaacaactttgacaacacctag

SEQ ID NO: 18325 - DNA, 372 bp, Artificial Sequence
  Description of Artificial Sequence: Synthetic coding sequence
atgcctggccccccaggcagcctggagatgggccccctgaccttcagagatgtggccatcgagttcagcctggaggagtggcagtgcctggacacagcccagaggaacctgtacaggaaggtgatgtttgagaactacagaaacctggtgttcctgggcattgctgtgtccaagccccacctgatcacctgcctggagcagggcaaggagccctggaacaggaagaggcaggagatggtggccaagcccccagagagctactgtgtggcccaggccgacctggagctgctggtgagcagctacctgacagccctggccagcctgaagatgtgggactacagaaacaaccccctgtgccaggccaccatgtag

SEQ ID NO: 18326 - DNA, 1731 bp, Artificial Sequence
  Description of Artificial Sequence: Synthetic coding sequence
atggtggccgagccccctgtgatctgcagccactttgcccaggacttcagccctgagcagaacatcaaggacagcttccagaaggtgaccccccggcgctatggaaaatgtgaacatgagaacctgcagctgagcaagtctgtggatgagtgcaaggtgcagaagggcggctacaacggcctgaaccagtgcctgcccaccacccagagcaagatcttccagtgtgacaagtacatgaagatcttccacaagttcagcaacctgaatggccacaaggtgcgccacaccaggaagaagcccttcaagtacaaggagtttgggaagagcttctgcatcttcagcaacctgacccagcacaagatcatctgcaccagggtgaacttctacaagtgtgaggactgtgggaaggccttcaacggcagcagcatcttcaccaagcacaagaggatccacatcggggagaagagctacatctgtgaagaatgtgggaaggcctgcaaccagttcaccaacctgaccacccacaagatcatctacacccgggacaagctgtacaagcgggaggagtgcagcaaggccttcaacctgagcagccacatcaccacccacaccatcatccacactggagagaacccctacaagcgggaggagtgtgacaaggccttcaaccagagcctgaccctgaccacccacaagatcatccacacccgggagaagctgaatgagtacaaggaatgtgggaaggccttcaaccagagcagccacctgaccaggcacaagatcatccacactggagagaagccctacaagtgtgaagaatgtgggaaggccttcaaccagagcagccacctgaccaggcacaagatcatccacactggagagaagccctaccgctgtgaagaatgtgggaaggccttccggcagagcagccacctgaccacccacaagatcatccacactggagagaagccctacaagtgtgaagaatgtgggaaggccttcaacaagagcagccacctgaccaggcacaagagcatccacactggagagaagccctaccagtgtgagaagtgtgggaaggccagcaaccagagcagcaacctgacagagcacaagaacatccacacagaggagaagccctacaagtgtgaagaatgtgggaaggccttcaaccagttcagcaacctgaccacccacaagaggatccacactggagagaagccctacaagtgtgaagaatgtgggaaggccttcaaccagagcagcatcctgaccacccacaagaggatccacactggagagaagagctacaagtgtgaagaatgtgggaaggccttctaccgcagcagcaagctgacagagcacaagaagatccacactggagagaagccctacacctgtgaagaatgtgggaaggccttcaaccacagcagccacctggccacccacaaggtgatccacactggagagaagccctaccagtgtgaagaatgtgggaaggccttcaaccagagcagccacctgaccaggcacaagaggatccacactggagagaagccctaccagtgtgagaagtgtgggaaggccttcaaccagagcagcaacctgaccggccacaagaagatccacactggagagaagctgtacaagcccaagcgctgcaacagcgactttgagaacaccagcaagttcagcaagcacaagagaaattatgctggggagaagagctag

SEQ ID NO: 18327 - DNA, 1938 bp, Artificial Sequence
  Description of Artificial Sequence: Synthetic coding sequence
atggagcccctgaagttcagagatgtggccatcgagttcagcctggaggagtggcagtgcctggacaccatccagcagaacctgtacagaaatgtgatgctggagaactacagaaacctggtgttcctgggcatcgtggtgtccaagccagacctgatcacctgcctggagcaggagaaggagccctggaccaggaagaggcacaggatggtggccgagccccctgtgatctgcagccactttgcccaggacttcagccctgagcagaacatcaaggacagcttccagaaggtgaccccaagaagatatggaaaatgtgaacatgagaacctgcagctgagcaagtctgtggatgagtgcaaggtgcagaagggcggctacaacggcctgaaccagtgcctgcccaccacccagagcaagatcttccagtgtgacaagtacatgaagatcttccacaagttcagcaacctgaatggccacaaggtgcgccacaccaggaagaagcccttcaagtacaaggagtttgggaagagcttctgcatcttcagcaacctgacccagcacaagatcatctgcaccagggtgaacttctacaagtgtgaggactgtgggaaggccttcaacggcagcagcatcttcaccaagcacaagaggatccacatcggggagaagagctacatctgtgaggagtgtgggaaggcctgcaaccagttcaccaacctgaccacccacaagatcatctacacccgggacaagctgtacaagcgggaggagtgcagcaaggccttcaacctgagcagccacatcaccacccacaccatcatccacactggagagaacccctacaagcgggaggagtgtgacaaggccttcaaccagagcctgaccctgaccacccacaagatcatccacacccgggagaagctgaatgagtacaaggaatgtgggaaggccttcaaccagagcagccacctgaccaggcacaagatcatccacactggagagaagccctacaagtgtgaggagtgtgggaaggccttcaaccagagcagccacctgaccaggcacaagatcatccacactggagagaagccctaccgctgtgaggagtgtgggaaggccttccggcagagcagccacctgaccacccacaagatcatccacactggagagaagccctacaagtgtgaggagtgtgggaaggccttcaacaagagcagccacctgaccaggcacaagagcatccacactggagagaagccctaccagtgtgagaagtgtgggaaggccagcaaccagagcagcaacctgacagagcacaagaacatccacacagaggagaagccctacaagtgtgaggagtgtgggaaggccttcaaccagttcagcaacctgaccacccacaagaggatccacactggagagaagccctacaagtgtgaggagtgtgggaaggccttcaaccagagcagcatcctgaccacccacaagaggatccacactggagagaagagctacaagtgtgaggagtgtgggaaggccttctaccgcagcagcaagctgacagagcacaagaagatccacactggagagaagccctacacctgtgaggagtgtgggaaggccttcaaccacagcagccacctggccacccacaaggtgatccacactggagagaagccctaccagtgtgaggagtgtgggaaggccttcaaccagagcagccacctgaccaggcacaagaggatccacactggagagaagccctaccagtgtgagaagtgtgggaaggccttcaaccagagcagcaacctgaccggccacaagaagatccacactggagagaagctgtacaagcccaagcgctgcaacagcgactttgagaacaccagcaagttcagcaagcacaagaggaactatgctggggagaagagctag

SEQ ID NO: 18328 - DNA, 504 bp, Artificial Sequence
  Description of Artificial Sequence: Synthetic coding sequence
atgaggacccacactggagagaagccctacaagtgtgaggagtgtgggaaggccttcaacagcagcagcatcctgacagagcacaaggtgatccacagcggggagaagccctacaagtgtgagaagtgtgacaaggtgttcaagcgcttctcctacctgaccaagcacaagaggatccacactggagagaagccctacaagtgtgaggagtgtgggaaggccttcaactggagcagcatcctgacagagcacaagaggatccacactggagagaagccctacaactgtgaggagtgtgggaaggccttcaaccgctgcagccacctgaccaggcacaagaagatccacacagctgtgaagcgctacaagtgtgaggagtgtgggaaggccttcaagcgctgcagccacctgaatgagcacaagagggtgcagagaggagagaagagctgcaagtacaagaagtgtggggaggccttcaaccactgcagcaacctgaccacctag

SEQ ID NO: 18329 - DNA, 1401 bp, Artificial Sequence
  Description of Artificial Sequence: Synthetic coding sequence
atgctggagaactacagaaacctggtgtccctgggcctgactgtgtccaagccagagctgatcagccggctggagcagaggcaggagccctggaatgtgaagagacatgagaccatcgccaagcccccagccatgagcagccactacacagaggacctgctgcctgagcagtgcatgcaggacagcttccagaaggtgatcctgcggcgctatggcagctgtggcctggaggacctgcacctgaggaaggatggagaaaatgtgggggagtgcaaggaccagaaggagatctacaacggcctgaaccagtgcctgagcaccctgcccagcaagatcttcccctacaacaagtgtgtgaaggtgttcagcaagagcagcaacctgaaccgggagaacatccgccacaccacagagaagctgttcaagtgcatgcagtgtgggaaggtgttcaagagccacagcggcctgagctaccacaagatcatccacacagaggagaagctgtgcatctgtgaagaatgtgggaagaccttcaagtggttctcctacctgaccaagcacaagaggatccacactggagagaagccctacaagtgtgaagaatgtgggaaggccttcaactggtgcagcagcctgaccaagcacaagaggatccacactggagagaagccctacaagtgtgaagaatgtgggaaggccttccactggtgcagcccctttgtgcgccacaagaagatccacactggagagaagccctacacctgtgaggactgtggccgggccttcaacagacacagccacctgaccaagcacaagaccatccacacaggcaagaagccctacaagtgcaaggaatgtgggaaggccttcaaccactgcagcctgctgaccatccacgagaggacccacactggagagaagccctacaagtgtgaagaatgtgggaaggccttcaacagcagcagcatcctgacagagcacaaggtgatccacagcggggagaagccctacaagtgtgagaagtgtgacaaggtgttcaagcgcttctcctacctgaccaagcacaagaggatccacactggagagaagccctacaagtgtgaagaatgtgggaaggccttcaactggagcagcatcctgacagagcacaagaggatccacactggagagaagccctacaactgtgaagaatgtgggaaggccttcaaccgctgcagccacctgaccaggcacaagaagatccacacagctgtgaagcgctacaagtgtgaagaatgtgggaaggccttcaagcgctgcagccacctgaatgagcacaagagggtgcagagaggagagaagagctgcaagtacaagaagtgtggggaggccttcaaccactgcagcaacctgaccacctag

SEQ ID NO: 18330 - DNA, 1401 bp, Artificial Sequence; identical to SEQ ID NO: 18329
  Description of Artificial Sequence: Synthetic coding sequence

SEQ ID NO: 18331 - DNA, 1497 bp, Artificial Sequence
  Description of Artificial Sequence: Synthetic coding sequence
atggagctgctgaccttcagagatgtgaccatcgagttcagcctggaggagtgggagttcctgaacccagcccagcagagcctgtacaggaaggtgatgctggagaactacagaaacctggtgtccctgggcctgactgtgtccaagccagagctgatcagccggctggagcagaggcaggagccctggaatgtgaagagacatgagaccatcgccaagcccccagccatgagcagccactacacagaggacctgctgcctgagcagtgcatgcaggacagcttccagaaggtgatcctgcggcgctatggcagctgtggcctggaggacctgcacctgaggaaggatggagaaaatgtgggggagtgcaaggaccagaaggagatctacaacggcctgaaccagtgcctgagcaccctgcccagcaagatcttcccctacaacaagtgtgtgaaggtgttcagcaagagcagcaacctgaaccgggagaacatccgccacaccacagagaagctgttcaagtgcatgcagtgtgggaaggtgttcaagagccacagcggcctgagctaccacaagatcatccacacagaggagaagctgtgcatctgtgaagaatgtgggaagaccttcaagtggttctcctacctgaccaagcacaagaggatccacactggagagaagccctacaagtgtgaagaatgtgggaaggccttcaactggtgcagcagcctgaccaagcacaagaggatccacactggagagaagccctacaagtgtgaagaatgtgggaaggccttccactggtgcagcccctttgtgcgccacaagaagatccacactggagagaagccctacacctgtgaggactgtggccgggccttcaacagacacagccacctgaccaagcacaagaccatccacacaggcaagaagccctacaagtgcaaggaatgtgggaaggccttcaaccactgcagcctgctgaccatccacgagaggacccacactggagagaagccctacaagtgtgaagaatgtgggaaggccttcaacagcagcagcatcctgacagagcacaaggtgatccacagcggggagaagccctacaagtgtgagaagtgtgacaaggtgttcaagcgcttctcctacctgaccaagcacaagaggatccacactggagagaagccctacaagtgtgaagaatgtgggaaggccttcaactggagcagcatcctgacagagcacaagaggatccacactggagagaagccctacaactgtgaagaatgtgggaaggccttcaaccgctgcagccacctgaccaggcacaagaagatccacacagctgtgaagcgctacaagtgtgaagaatgtgggaaggccttcaagcgctgcagccacctgaatgagcacaagagggtgcagagaggagagaagagctgcaagtacaagaagtgtggggaggccttcaaccactgcagcaacctgaccacctag

SEQ ID NO: 18332 - DNA, 1515 bp, Artificial Sequence
  Description of Artificial Sequence: Synthetic coding sequence
atgaaggaggagagcgctgcccagctgggctgctgccaccggcccatggccctgggcggcactggaggcagcctgagccccagcctggacttccagctgttccggggggaccaggtgttttctgcctgccggcccctgcctgacatggtggatgcccacggccccagctgtgcctcctggctgtgccccctgcccctggcccctggccgcagcgccctgctggcctgcctgcaggacctggacctgaacctgtgcaccccccagcctgcccccctgggcacagacctgcagggcctgcaggaggatgccctgtccatgaagcatgagcccccaggcctgcaggccagcagcacagatgacaagaagttcaccgtgaagtacccccagaacaaggacaagctgggcaagcagcctgagagagctggggagggcgccccctgcccagccttcagcagccacaacagcagcagccccccacccctgcagaacaggaagagccccagccccctggccttctgcccctgcccccctgtgaacagcatcagcaaggagctgcccttcctgctgcacgccttctacccaggctaccccctgctgctgcccccaccccacctgttcacctacggggccctgcccagcgaccagtgcccccacctgctgatgctgccccaggaccccagctaccccaccatggccatgcccagcctgctgatgatggtgaatgagctgggccaccccagcgcccgctgggagaccctgctgccctacccaggggccttccaggccagcggccaggccctgcccagccaggccaggaaccctggggccggggccgcccccacagacagccctggcctggagcggggcggcatggccagccctgccaagagggtgcccctgagcagccagacaggaacagctgccctgccctaccccctgaagaagaagaatggcaagatcctgtatgagtgcaacatctgtgggaagagctttggccagctgagcaacctgaaggtgcacctgcgggtgcacagcggggagcggcccttccagtgtgccctgtgccagaagagcttcacccagctggcccacctgcagaagcaccacctggtgcacactggagagcggccccacaagtgcagcgtgtgccacaagcgcttcagcagcagcagcaacctgaagacccacctgcggctgcacagcggggcccggcccttccagtgcagcgtgtgccgcagccgcttcacccagcacatccacctgaagctgcaccaccggctgcacgccccccagccctgtggcctggtgcacacccagctgcccctggccagcctggcctgcctggcccagtggcaccagggcgccctggacctgatggctgtggccagcgagaagcacatgggctatgacattgatgaggtgaaggtgagcagcaccagccagggcaaggcccgggctgtgtccctgagcagcgctggcacccccctggtgatgggccaggaccagaacaactag

SEQ ID NO: 18333 - DNA, 507 bp, Artificial Sequence
  Description of Artificial Sequence: Synthetic coding sequence
atgaaggaggagagcgctgcccagctgggctgctgccaccggcccatggccctgggcggcactggaggcagcctgagccccagcctggacttccagctgttccggggggaccagagcaccagccaccagggctgcaggcctgccccacccatgaccaggaacagccagagcagcacccacaggaccaggacctcctgggagaacagccagaaggagctggcccggggccccccagcccagcccagccccctcatcacagccctgccccaccaccgctgcaggacagagcgggccccagccccctggctgagcgcccctgtgcccctgagcacccccagccccaggagcagccacttcagcagcacccccagcaccctggacacccacttcagctgcctgcaccccacctgcagccccatgggcccctacctgctgaccaacgtgcccaccagcagctgctgccccaagaccccacccaccccaccctggctgtgcctggcctgctag

SEQ ID NO: 18334 - DNA, 1515 bp, Artificial Sequence; identical to SEQ ID NO: 18332
  Description of Artificial Sequence: Synthetic coding sequence

SEQ ID NO: 18335 - DNA, 1575 bp, Artificial Sequence
  Description of Artificial Sequence: Synthetic coding sequence
atgaaggaggagagcgctgcccagctgggctgctgccaccggcccatggccctgggcggcactggaggcagcctgagccccagcctggacttccagctgttccggggggaccaggtgttttctgcctgccggcccctgcctgacatggtggatgcccacggccccagctgtgcctcctggctgtgccccctgcccctggcccctggccgcagcgccctgctggcctgcctgcaggacctggacctgaacctgtgcaccccccagcctgcccccctgggcacagacctgcagggcctgcaggaggatgccctgtccatgaagcatgagcccccaggcctgcaggccagcagcacagatgacaagaagttcaccgtgaagtacccccagaacaaggacaagctgggcaagcagcctgagagagctggggagggcgccccctgcccagccttcagcagccacaacagcagcagccccccacccctgcagaacaggaagagccccagccccctggccttctgcccctgcccccctgtgaacagcatcagcaaggagctgcccttcctgctgcacgccttctacccaggctaccccctgctgctgcccccaccccacctgttcacctacggggccctgcccagcgaccagtgcccccacctgctgatgctgccccaggaccccagctaccccaccatggccatgcccagcctgctgatgatggtgaatgagctgggccaccccagcgcccgctgggagaccctgctgccctacccaggggccttccaggccagcggccaggccctgcccagccaggccaggaaccctggggccggggccgcccccacagacagccctggcctggagcggggcggcatggccagccctgccaagagggtgcccctgagcagccagacaggaacagctgccctgccctaccccctgaagaagaagaatggcaagatcctgtatgagtgcaacatctgtgggaagagctttggccagctgagcaacctgaaggtgcacctgcgggtgcacagcggggagcggcccttccagtgtgccctgtgccagaagagcttcacccagctggcccacctgcagaagcaccacctggtgcacactggagagcggccccacaagtgcagcatcccctgggtgcccggcaggaaccactggaagagcttccaggcctggagggagcgggaggtgtgccacaagcgcttcagcagcagcagcaacctgaagacccacctgcggctgcacagcggggcccggcccttccagtgcagcgtgtgccgcagccgcttcacccagcacatccacctgaagctgcaccaccggctgcacgccccccagccctgtggcctggtgcacacccagctgcccctggccagcctggcctgcctggcccagtggcaccagggcgccctggacctgatggctgtggccagcgagaagcacatgggctatgacattgatgaggtgaaggtgagcagcaccagccagggcaaggcccgggctgtgtccctgagcagcgctggcacccccctggtgatgggccaggaccagaacaactag

SEQ ID NO: 18336 - DNA, 570 bp, Artificial Sequence
  Description of Artificial Sequence: Synthetic coding sequence
atgaaggaggagagcgctgcccagctgggctgctgccaccggcccatggccctgggcggcactggaggcagcctgagccccagcctggacttccagctgttccggggggaccaggtgttttctgcctgccggcccctgcctgacatggtggatgcccacggccccagctgtgcctcctggctgtgccccctgcccctggcccctggccgcagcgccctgctggcctgcctgcaggacctggacctgaacctgtgcaccccccagcctgcccccctgggcacagacctgcagggcctgcaggaggatgccctgtccatgaagcatgagcccccaggcctgcaggccagcagcacagatgacaagaagttcaccgtgaagtacccccagaacaaggacaagctgggcaagcagcctgagagagctggggagggcgccccctgcccagccttcagcagccacaacagcagcagccccccacccctgcagaacaggaagagccccagccccctggccttctgcccctgcccccctgtgaacagcatcagcaaggagctgcccttcctgctgtag

SEQ ID NO: 18337 - DNA, 1575 bp, Artificial Sequence; identical to SEQ ID NO: 18335
  Description of Artificial Sequence: Synthetic coding sequence

SEQ ID NO: 18338 - DNA, 810 bp, Artificial Sequence
  Description of Artificial Sequence: Synthetic coding sequence
atgaaggaggagagcgctgcccagctgggctgctgccaccggcccatggccctgggcggcactggaggcagcctgagccccagcctggacttccagctgttccggggggaccaggtgttttctgcctgccggcccctgcctgacatggtggatgcccacggccccagctgtgcctcctggctgtgccccctgcccctggcccctggccgcagcgccctgctggcctgcctgcaggacctggacctgaacctgtgcaccccccagcctgcccccctgggcacagacctgcagggcctgcaggaggatgccctgtccatgaagcatgagcccccaggcctgcaggccagcagcacagatgacaagaagttcaccgtgaagtacccccagaacaaggacaagctgggcaagcagcctgagagagctggggagggcgccccctgcccagccttcagcagccacaacagcagcagccccccacccctgcagaacaggaagagccccagccccctggccttctgcccctgcccccctgtgaacagcatcagcaaggagctgcccttcctgctgcacgccttctacccaggctaccccctgctgctgcccccaccccacctgttcacctacggggccctgcccagcgaccagtgcccccacctgctgatgctgccccaggaccccagctaccccaccatggccatgcccagcctgctgatgatggtgaatgagctgggccaccccagcgcccgctgggagaccctgctgccctacccaggggccttccaggccagcggccaggccctgcccagctag

SEQ ID NO: 18339 - DNA, 279 bp, Artificial Sequence
  Description of Artificial Sequence: Synthetic coding sequence
atgatctccttccaggagagcgtgaccttccaggatgtggccgtggacttcaccgctgaggagtggcagctgctggactgtgccgagaggaccctgtactgggatgtgatgctggagaactacagaaacctgatctctgtgggctgccccatcaccaagaccaaggtgatcctgaaggtggagcagggccaggagccctggatggtggagggcgccaacccccatgagagcagccctggctggagcgctgtggcccagagccagctgggcttcaagtag

SEQ ID NO: 18340 - DNA, 360 bp, Artificial Sequence
  Description of Artificial Sequence: Synthetic coding sequence
atgatctccttccaggagagcgtgaccttccaggatgtggccgtggacttcaccgctgaggagtggcagctgctggactgtgccgagaggaccctgtactgggatgtgatgctggagaactacagaaacctgatctctgtgggctgccccatcaccaagaccaaggtgatcctgaaggtggagcagggccaggagccctggatggtggagggcgccaacccccatgagagcagccctgagagccgctctgtggcccggctggagtgcagcggggccatcagcgcccgggtgcaggtgatcctgctgccccagcccccagaggagctggagctgcaggccccagccaccatgcctggatag

SEQ ID NO: 18341 - DNA, 1137 bp, Artificial Sequence
  Description of Artificial Sequence: Synthetic coding sequence
atgatctccttccaggagagcgtgaccttccaggatgtggccgtggacttcaccgctgaggagtggcagctgctggactgtgccgagaggaccctgtactgggatgtgatgctggagaactacagaaacctgatctctgtgggctgccccatcaccaagaccaaggtgatcctgaaggtggagcagggccaggagccctggatggtggagggcgccaacccccatgagagcagccctgagagtgactaccccctggtggatgagcccgggaagcaccgggagagcaaggacaacttcctgaagtctgtgctgctgaccttcaacaagatcctgaccatggagcgcatccaccactacaacatgagcaccagcctgaaccccatgaggaagaagagctacaagagctttgagaagtgcctgccccccaacctggacctgctgaagtacaacagaagctacacagtggagaatgcctatgagtgcagtgaatgtgggaaggccttcaagaagaagttccacttcatcagacatgagaagaaccacaccaggaagaagccctttgagtgcaatgactgtgggaaggcctacagcaggaaggcccacctggccacccaccagaagatccacaacggggagcggccctttgtgtgcaatgactgtgggaaggccttcatgcacaaggcccagctggtggtgcaccagaggctgcacactggagagaagccctatgagtgcagccagtgtgggaagaccttcacctggaacagcagcttcaaccagcacgtgaagagccacaccctggagaagagctttgagtgcaaggaatgtgggaagaccttccgctacagcagcagcctgtacaagcacagccgcttccacactggagagaagccctaccagtgcatcatctgtgggaaggccttcggcaacacctctgtgctggtgacccaccagaggatccacactggagagaagccctacagctgcattgaatgtgggaaggccttcatcaagaagagccacctgctgcggcaccagatcacccacactggagagaagccctatgagtgcaacagatgtgggaaggccttcagccagaagagcaacctgattgtgcaccagaagatccacacctag

SEQ ID NO: 18342 - DNA, 2052 bp, Artificial Sequence; identical to SEQ ID NO: 18009
  Description of Artificial Sequence: Synthetic coding sequence

SEQ ID NO: 18343 - DNA, 789 bp, Artificial Sequence
  Description of Artificial Sequence: Synthetic coding sequence
atgcccaggagccccctgcggagcagcctgagcacagaggccagcggcccccggggccccttcaagtgcccagccagcccccggcccatcacagcccagctgctgcccggcagcagccccatcatcggccgctgtgtgctgcgggtgcagaggggcttccctggccccaagccagccctgatctcctggatggagcaggagagcgaggcctggagccctgctgcccaggaccctgagaagggggagcggctgggcggggccaggagaggagatgtgcccaacaggaaggaggaggagcctgaggaggtgccccgggccaagggccccaggaaggcccctgtgaaggagagccctgaggtgctggtggagaggaacccagaccctgccatctctgtggccccagcccgggcccagccccccaagaatgctgcctgggaccccaccactggagcccagcccccagcccccatccccagcatggatgcccaggccggccagaggagacatgtgtgcacagactgtggccgccgcttcacctaccccagcctgctggtgagccacaggaggatgcacagcggggagcggcccttcccctgcccagaatgtggcatgaggttcaagaggaagtttgctgtggaggcccaccagtggatccacaggagctgcagcggcggccggcggggcagaagacctggcatccgggctgtgccccgggcccctgtgcggggggaccgggacccccctgtgctcttccgccactacccagacatctttgaggagtgtggctag

SEQ ID NO: 18344 - DNA, 1503 bp, Artificial Sequence
  Description of Artificial Sequence: Synthetic coding sequence
atggcccctccttctgcccccctgcctgcccagggccctgggaaggcccggcccagcaggaagaggggccggcggccccgggccctgaagtttgtggatgtggccgtgtacttcagccctgaggagtggggctgcctgcggcctgcccagagggccctgtacagagatgtgatgagggagacctacggccacctgggcgccctgggctgtgccggccccaagccagccctgatctcctggctggagaggaacacagatgactgggagcctgctgccctggacccccaggagtacccccggggcctgactgtgcagaggaagagcaggaccaggaagaagaatggagagaaggaggtgtttcctcccaaggaggcccccaggaagggcaagagaggaagaagacccagcaagcccaggctcatcccccggcagaccagcggcggccccatctgcccagactgtggctgcaccttcccagaccaccaggccctggagagccacaagtgtgcccagaacctgaagaagccctacccctgcccagactgtggccgccgcttctcctaccccagcctgctggtgagccaccggcgggcccacagcggggagtgcccctacgtgtgtgaccagtgtgggaagcgcttcagccagaggaagaacctgagccagcaccaggtgatccacactggagagaagccctaccactgcccagactgtggccgctgcttcagaagaagccgcagcctggccaaccacaggaccacccacactggagagaagccccaccagtgccccagctgtggccgccgctttgcctaccccagcctgctggccatccaccagaggacccacactggagagaagccctacacctgcctggagtgcaacagacgcttccggcagaggacagccctggtgatccaccagaggatccacactggagagaagccctacccctgcccagactgtgagcggcgcttcagcagcagcagccggctggtgagccaccggcgggtgcacagcggggagcggccctatgcctgtgagcactgtgaggcccgcttcagccagaggagcaccctgctgcagcaccagctgctgcacactggagagaagccctacccctgcccagactgtggccgggccttcagaagaagtggcagcctggccatccacaggagcacccacacagaggagaagctgcacgcctgtgatgactgtggccgccgctttgcctaccccagcctgctggccagccaccggcgggtgcacagcggggagcggccctatgcctgtgacctgtgcagcaagagatttgcccagtggagccacctggcccagcaccagctgctgcacactggagagaagcccttcccctgcctggagtgtggccgctgcttccggcagcgctggagcctggccgtgcacaagtgcagccccaaggcccccaactgcagccccaggtctgccatcggcggcagcagccagagaggaaatgcccactag

SEQ ID NO: 18345 - DNA, 1497 bp, Artificial Sequence
  Description of Artificial Sequence: Synthetic coding sequence
atggcccctccttctgcccccctgcctgcccagggccctgggaaggcccggcccagcaggaagaggggccggcggccccgggccctgaagtttgtggatgtggccgtgtacttcagccctgaggagtggggctgcctgcggcctgcccagagggccctgtacagagatgtgatgagggagacctacggccacctgggcgccctgggctgtgccggccccaagccagccctgatctcctggctggagaggaacacagatgactgggagcctgctgccctggacccccaggagtacccccggggcctgactgtgcagaggaagagcaggaccaggaagaagaatggagagaaggaggtgtttcctcccaaggaggcccccaggaagggcaagagaggaagaagacccagcaagcccaggctcatcccccggcagaccagcggcggccccatctgcccagactgtggctgcaccttcccagaccaccaggccctggagagccacaagtgtgcccagaacctgaagaagccctacccctgcccagactgtggccgccgcttctcctaccccagcctgctggtgagccaccggcgggcccacagcggggagtgcccctacgtgtgtgaccagtgtgggaagcgcttcagccagaggaagaacctgagccagcaccaggtgatccacactggagagaagccctaccactgcccagactgtggccgctgcttcagaagaagccgcagcctggccaaccacaggaccacccacactggagagaagccccaccagtgccccagctgtggccgccgctttgcctaccccagcctgctggccatccaccagaggacccacactggagagaagccctacacctgcctggagtgcaacagacgcttccggcagaggacagccctggtgatccaccagaggatccacactggagagaagccctacccctgcccagactgtgagcggcgcttcagcagcagcagccggctggtgagccaccggcgggtgcacagcggggagcggccctatgcctgtgagcactgtgaggcccgcttcagccagaggagcaccctgctgcagcaccagctgctgcacactggagagaagccctacccctgcccagactgtggccgggccttcagaagaagtggcagcctggccatccacaggagcacccacacagaggagaagctgcacgcctgtgatgactgtggccgccgctttgcctaccccagcctgctggccagccaccggcgggtgcacagcggggagcggccctatgcctgtgacctgtgcagcaagagatttgcccagtggagccacctggcccagcaccagctgctgcacactggagagaagcccttcccctgcctggagcctgtgctgcccccagaggtggtgtctgctgtgcacaagtgcagccccaaggcccccaactgcagccccaggtctgccatcggcggcagcagccagagaggaaatgcccactag

SEQ ID NO: 18346 - DNA, 921 bp, Artificial Sequence
  Description of Artificial Sequence: Synthetic coding sequence
atggcccagatcagcagcggcggcggcggccagagccgctgcctgctgtttgccctgggcagcgagatgggcagcgagaaggagcagagccctgagccccacctgcctgaggagggggagggcggcaagccctggagggtggatgacagcgagggctcctggatccccccaggagagaaggagcacggccaggagagcctgagtgatgagctgcaggagacccaccccaagaagccctggcagaaggtgacagtgcgggcccgggagctgggggaccccatcgcccaccccaggcatgaagcagatgagaagcccttcatctgtgcccagtgtgggaagaccttcaacaacaccagcaacctgcggacccaccagaggatccacactggagagaagccctacaagtgcagtgaatgtgggaagagcttcagccgcagcagcaaccgcatcagacatgagcgcatccacctggaggagaagcactacaagtgccccaagtgccaggagagcttcagaagaagaagtgacctgaccacccaccagcaggaccacctgggcaagaggccctaccgctgtgacatctgtgggaagagcttcagccagagcgccaccctggccgtgcaccacaggacccacctggagcccgccccctacatctgctgtgaatgtgggaagagcttcagcaacagcagcagctttggagtgcaccacaggacccacactggagagcggccctatgaatgtacagaatgtggccgcaccttcagtgacatcagcaactttggagcccaccagaggacccacagaggagagaagccctaccgctgcaccgtgtgtgggaagcacttcagccgcagcagcaacctgatccgccaccagaagacccacctgggggagcaggccggcaaggacagcagctag

SEQ ID NO: 18347 - DNA, 939 bp, Artificial Sequence
  Description of Artificial Sequence: Synthetic coding sequence
atgagcctgtgcagccccacccacagcgctgagatgagcctcttcctgcagggccctgaggagatgctgcccctgagcagcgagggcagcgagatgggcagcgagaaggagcagagccctgagccccacctgcctgaggagggggagggcggcaagccctggagggtggatgattctgagggctcctggatccccccaggagagaaggagcacggccaggagagcctgagtgatgagctgcaggagacccaccccaagaagccctggcagaaggtgacagtgcgggcccgggagctgggggaccccatcgcccaccccaggcatgaagcagatgagaagcccttcatctgtgcccagtgtgggaagaccttcaacaacaccagcaacctgcggacccaccagaggatccacactggagagaagccctacaagtgcagtgaatgtgggaagagcttcagccgcagcagcaaccgcatcagacatgagcgcatccacctggaggagaagcactacaagtgccccaagtgccaggagagcttcagaagaagaagtgacctgaccacccaccagcaggaccacctgggcaagaggccctaccgctgtgacatctgtgggaagagcttcagccagagcgccaccctggccgtgcaccacaggacccacctggagcccgccccctacatctgctgtgaatgtgggaagagcttcagcaacagcagcagctttggagtgcaccacaggacccacactggagagcggccctatgagtgcacagaatgtggccgcaccttcagtgacatcagcaactttggagcccaccagaggacccacagaggagagaagccctaccgctgcaccgtgtgtgggaagcacttcagccgcagcagcaacctgaagcccttcatccccctgtggaggatggtgctgtacagcctgtag

SEQ ID NO: 18348 - DNA, 921 bp, Artificial Sequence; identical to SEQ ID NO: 18346
  Description of Artificial Sequence: Synthetic coding sequence

SEQ ID NO: 18349 - DNA, 855 bp, Artificial Sequence
  Description of Artificial Sequence: Synthetic coding sequence
atgggcagcgagaaggagcagagccctgagccccacctgcctgaggagggggagggcggcaagccctggagggtggatgacagcgagggctcctggatccccccaggagagaaggagcacggccaggagagcctgagtgatgagctgcaggagacccaccccaagaagccctggcagaaggtgacagtgcgggcccgggagctgggggaccccatcgcccaccccaggcatgaagcagatgagaagcccttcatctgtgcccagtgtgggaagaccttcaacaacaccagcaacctgcggacccaccagaggatccacactggagagaagccctacaagtgcagtgaatgtgggaagagcttcagccgcagcagcaaccgcatcagacatgagcgcatccacctggaggagaagcactacaagtgccccaagtgccaggagagcttcagaagaagaagtgacctgaccacccaccagcaggaccacctgggcaagaggccctaccgctgtgacatctgtgggaagagcttcagccagagcgccaccctggccgtgcaccacaggacccacctggagcccgccccctacatctgctgtgaatgtgggaagagcttcagcaacagcagcagctttggagtgcaccacaggacccacactggagagcggccctatgaatgtacagaatgtggccgcaccttcagtgacatcagcaactttggagcccaccagaggacccacagaggagagaagccctaccgctgcaccgtgtgtgggaagcacttcagccgcagcagcaacctgatccgccaccagaagacccacctgggggagcaggccggcaaggacagcagctag

SEQ ID NO: 18350 - DNA, 855 bp, Artificial Sequence; identical to SEQ ID NO: 18349
  Description of Artificial Sequence: Synthetic coding sequence

SEQ ID NO: 18351 - DNA, 855 bp, Artificial Sequence; identical to SEQ ID NO: 18349
  Description of Artificial Sequence: Synthetic coding sequence

SEQ ID NO: 18352 - DNA, 402 bp, Artificial Sequence
  Description of Artificial Sequence: Synthetic coding sequence
atggcccagatcagcagcggcggcggcggccagagccgctgcctgctgtttgccctggtgctggccatctgtgtgcacagccagggcagcgagatgggcagcgagaaggagcagagccctgagccccacctgcctgaggagggggagggcggcaagccctggagggtggatgattctgagggctcctggatccccccaggagagaaggagcacggccaggagagcctgagtgatgagctgcaggagacccaccccaagaagccctggcagaaggtgacagtgcgggcccgggagctgggggaccccatcgcccaccccaggcatgaagcagatgagaagcccttcatctgtgcccagtgtgggaagaccttcaacaacaccagcaacctgcggacccactag

SEQ ID NO: 18353 - DNA, 948 bp, Artificial Sequence
  Description of Artificial Sequence: Synthetic coding sequence
atgagcctgtgcagccccacccacagcgctgagatgagcctcttcctgcagggccctgaggagatgctgcccctgagcagcgagggcagcgagatgggcagcgagaaggagcagagccctgagccccacctgcctgaggagggggagggcggcaagccctggagggtggatgattctgagggctcctggatccccccaggagagaaggagcacggccaggagagcctgagtgatgagctgcaggagacccaccccaagaagccctggcagaaggtgacagtgcgggcccgggagctgggggaccccatcgcccaccccaggcatgaagcagatgagaagcccttcatctgtgcccagtgtgggaagaccttcaacaacaccagcaacctgcggacccaccagaggatccacactggagagaagccctacaagtgcagtgaatgtgggaagagcttcagccgcagcagcaaccgcatcagacatgagcgcatccacctggaggagaagcactacaagtgccccaagtgccaggagagcttcagaagaagaagtgacctgaccacccaccagcaggaccacctgggcaagaggccctaccgctgtgacatctgtgggaagagcttcagccagagcgccaccctggccgtgcaccacaggacccacctggagcccgccccctacatctgctgtgaatgtgggaagagcttcagcaacagcagcagctttggagtgcaccacaggacccacactggagagcggccctatgagtgcacagaatgtggccgcaccttcagtgacatcagcaactttggagcccaccagaggacccacagaggagagaagccctaccgctgcaccgtgtgtgggaagcacttcagccgcagcagcaacctgatccgccaccagaagacccacctgggggagcaggccggcaaggacagcagctag

SEQ ID NO: 18354 - DNA, 1560 bp, Artificial Sequence
  Description of Artificial Sequence: Synthetic coding sequence
atggccagcagccctgctgtggatgtgtcctgcagaagaagagagaagaggcggcagctggatgcccggcgcagcaagtgccgcatccggctgggcggccacatggagcagtggtgcctgctgaaggagcggctgggcttcagcctgcacagccagctggccaagttcctgctggaccgctacaccagcagcggctgtgtgctgtgtgccggccctgagcccctgccccccaagggcctgcagtacctggtgctgctgagccacgcccacagcagagaatgttccctggtgcccggcctgcggggccctgggggccaggacggcggcctggtgtgggagtgcagcgctggccacaccttctcctggggccccagcctgagccccaccccatctgaggcccccaagccagccagcctgccccacaccacccggcgctcctggtgcagcgaggccaccagcggccaggagctggccgacctggagagcgagcatgatgagaggacccaggaggcccggctgcccaggagagtgggccccccacctgagaccttccccccacctggagaggaggagggggaggaggaggaggacaatgatgaagatgaggaggagatgctgagtgatgccagcctgtggacctacagcagcagcccagatgattctgagccagatgccccccggctgctgcccagccctgtgacctgcacccccaaggagggggagaccccaccagccccagctgccctgagcagccccctggccgtgcctgccctgagcgccagcagcctgagcagccgggcccctcctcctgctgaggtgcgggtgcagccccagctgagcaggaccccccaggccgcccagcagacagaggccctggccagcacaggcagccaggcccagagcgcccccaccccagcctgggatgaggacacagcccagatcggccccaagaggatcaggaaggccgccaagcgggagctgatgccctgtgacttccctggctgcggccgcatcttcagcaaccggcagtacctgaaccaccacaagaagtaccagcacatccaccagaagagcttcagctgcccagagcccgcctgtgggaagagcttcaacttcaagaagcacctgaaggagcacatgaagctgcacagcgacacccgggactacatctgtgagttctgtgcccgctccttccgcaccagcagcaacctggtgatccaccggcgcatccacactggagagaagcccctgcagtgtgagatctgtggcttcacctgccggcagaaggccagcctgaactggcaccagaggaagcacgccgagaccgtggccgccctgcgcttcccctgtgagttctgtgggaagagatttgagaagccagacagcgtggccgcccacaggagcaagagccacccagccctgctgctggccccccaggagagccccagcggccccctggagccctgccccagcatcagcgcccctggccccctgggcagcagcgagggcagccggcccagcgccagcccccaggcccccaccctgctgccccagcagtag

SEQ ID NO: 18355 - DNA, 1044 bp, Artificial Sequence
  Description of Artificial Sequence: Synthetic coding sequence
atggccagcagccctgctgtggatgtgtcctgcagaagaagagagaagaggcggcagctggatgcccggcgcagcaagtgccgcatccggctgggcggccacatggagcagtggtgcctgctgaaggagcggctgggcttcagcctgcacagccagctggccaagttcctgctggaccgctacaccagcagcggctgtgtgctgtgtgccggccctgagcccctgccccccaagggcctgcagtacctggtgctgctgagccccagcagcctgagcagccgggcccctcctcctgctgaggtgcgggtgcagccccagctgagcaggaccccccaggccgcccagcagacagaggccctggccagcacaggcagccaggcccagagcgcccccaccccagcctgggatgaggacacagcccagatcggccccaagaggatcaggaaggccgccaagcgggagctgatgccctgtgacttccctggctgcggccgcatcttcagcaaccggcagtacctgaaccaccacaagaagtaccagcacatccaccagaagagcttcagctgcccagagcccgcctgtgggaagagcttcaacttcaagaagcacctgaaggagcacatgaagctgcacagcgacacccgggactacatctgtgagttctgtgcccgctccttccgcaccagcagcaacctggtgatccaccggcgcatccacactggagagaagcccctgcagtgtgagatctgtggcttcacctgccggcagaaggccagcctgaactggcaccagaggaagcacgccgagaccgtggccgccctgcgcttcccctgtgagttctgtgggaagagatttgagaagccagacagcgtggccgcccacaggagcaagagccacccagccctgctgctggccccccaggagagccccagcggccccctggagccctgccccagcatcagcgcccctggccccctgggcagcagcgagggcagccggcccagcgccagcccccaggcccccaccctgctgccccagcagtag

SEQ ID NO: 18356 - DNA, 1425 bp, Artificial Sequence
  Description of Artificial Sequence: Synthetic coding sequence
atggccagcagccctgctgtggatgtgtcctgcagaagaagagagaagaggcggcagctggatgcccggcgcagcaagtgccgcatccggctgggcggccacatggagcagtggtgcctgctgaaggagcggctgggcttcagcctgcacagccagctggccaagttcctgctggaccgctacaccagcagcggctgtgtgctgtgtgccggccctgagcccctgccccccaagggcctgcagtacctggtgctgctgagccacgcccacagcagagaatgttccctggtgcccggcctgcggggccctgggggccaggacggcggcctggtgtgggagtgcagcgctggccacaccttctcctggggccccagcctgagccccaccccatctgaggcccccaagccagccagcctgccccacaccacccggcgctcctggtgcagcgaggccaccagcggccaggagctggccgacctggagagcgagcatgatgagaggacccaggaggcccggctgcccagcagcgagccagatgccccccggctgctgcccagccctgtgacctgcacccccaaggagggggagaccccaccagccccagctgccctgagcagccccctggccgtgcctgccctgagcgccagcagcctgagcagccgggcccctcctcctgctgaggtgcgggtgcagccccagctgagcaggaccccccaggccgcccagcagacagaggccctggccagcacaggcagccaggcccagagcgcccccaccccagcctgggatgaggacacagcccagatcggccccaagaggatcaggaaggccgccaagcgggagctgatgccctgtgacttccctggctgcggccgcatcttcagcaaccggcagtacctgaaccaccacaagaagtaccagcacatccaccagaagagcttcagctgcccagagcccgcctgtgggaagagcttcaacttcaagaagcacctgaaggagcacatgaagctgcacagcgacacccgggactacatctgtgagttctgtgcccggagcttccgcaccagcagcaacctggtgatccaccggcgcatccacactggagagaagcccctgcagtgtgagatctgtggcttcacctgccggcagaaggccagcctgaactggcaccagaggaagcatgctgagaccgtggccgccctgcgcttcccctgtgagttctgtgggaagagatttgagaagccagattctgtggccgcccacaggagcaagagccacccagccctgctgctggccccccaggagagccccagcggccccctggagccctgccccagcatcagcgcccctggccccctgggcagcagcgagggcagccggcccagcgccagcccccaggcccccaccctgctgccccagcagtag

SEQ ID NO: 18357 - DNA, 291 bp, Artificial Sequence
  Description of Artificial Sequence: Synthetic coding sequence
atggccagcagccctgctgtggatgtgtcctgcagaagaagagagaagaggcggcagctggatgcccggcgcagcaagtgccgcatccggctgggcggccacatggagcagtggtgcctgctgaaggagcggctgggcttcagcctgcacagccagctggccaagttcctgctggaccgggcctgcccagctgccctcttccacccccaggtgagccacttcaccaggacagcctgtgtgacctgtggcctgcggggcagctgcagccccccccacggcctgtctgagtag

SEQ ID NO: 18358 - DNA, 1425 bp, Artificial Sequence; identical to SEQ ID NO: 18356
  Description of Artificial Sequence: Synthetic coding sequence

SEQ ID NO: 18359 - DNA, 1575 bp, Artificial Sequence
  Description of Artificial Sequence: Synthetic coding sequence
atgcccctggtgcacatggccagcagccctgctgtggatgtgtcctgcagaagaagagagaagaggcggcagctggatgcccggcgcagcaaatgtcgcatccggctgggcggccacatggagcagtggtgcctgctgaaggagcggctgggcttcagcctgcacagccagctggccaagttcctgctggaccgctacaccagcagcggctgtgtgctgtgtgccggccctgagcccctgccccccaagggcctgcagtacctggtgctgctgagccacgcccacagccgggagtgcagcctggtgcccggcctgcggggccctgggggccaggacggcggcctggtgtgggagtgcagcgctggccacaccttctcctggggccccagcctgagccccacccccagcgaggcccccaagccagccagcctgccccacaccaccaggaggtcctggtgcagcgaggccaccagcggccaggagctggccgacctggagagcgagcatgatgagaggacccaggaggcccggctgccccggcgggtgggccccccacctgagaccttccccccacctggagaggaggagggggaggaggaggaggacaatgatgaagatgaggaggagatgctgagtgatgccagcctgtggacctacagcagcagcccagatgacagcgagccagatgccccccggctgctgcccagccctgtgacctgcacccccaaggagggggagaccccaccagccccagctgccctgagcagccccctggccgtgcctgccctgagcgccagcagcctgagcagccgggcccctcctcctgctgaggtgcgggtgcagccccagctgagcaggaccccccaggccgcccagcagacagaggccctggccagcacaggcagccaggcccagagcgcccccaccccagcctgggatgaggacacagcccagatcggccccaagaggatcaggaaggccgccaagcgggagctgatgccctgtgacttccctggctgcggccgcatcttcagcaaccggcagtacctgaaccaccacaagaagtaccagcacatccaccagaagagcttcagctgcccagagcccgcctgtgggaagagcttcaacttcaagaagcacctgaaggagcacatgaagctgcacagcgacacccgggactacatctgtgagttctgtgcccggagcttccgcaccagcagcaacctggtgatccaccggcgcatccacactggagagaagcccctgcagtgtgagatctgtggcttcacctgccggcagaaggccagcctgaactggcaccagaggaagcatgctgagaccgtggccgccctgcgcttcccctgtgagttctgtgggaagagatttgagaagccagattctgtggccgcccacaggagcaagagccacccagccctgctgctggccccccaggagagccccagcggccccctggagccctgccccagcatcagcgcccctggccccctgggcagcagcgagggcagccggcccagcgccagcccccaggcccccaccctgctgccccagcagtag

SEQ ID NO: 18360 - DNA, 399 bp, Artificial Sequence
  Description of Artificial Sequence: Synthetic coding sequence
atggccagcagccctgctgtggatgtgtcctgcagaagaagagagaagaggcggcagctggatgcccggcgcagcaagtgccgcatccggctgggcggccacatggagcagtggtgcctgctgaaggagcggctgggcttcagcctgcacagccagctggccaagttcctgctggaccgctacaccagcagcggctgtgtgctgtgtgccggccctgagcccctgccccccaagggcctgcagtacctggtgctgctgagccacgcccacagcagagaatgttccctggtgcccggcctgcggggccctgggggccaggacggcggcctggtgtgggagtgcagcgctggccacaccttctcctggggccccagcctgagccccaccccatctgagtag

SEQ ID NO: 18361 - DNA, 1548 bp, Artificial Sequence
  Description of Artificial Sequence: Synthetic coding sequence
atgggcctgctggccttcagagatgtggccctggagttcagccctgaggagtgggagtgcctggaccctgcccagaggagcctgtacagagatgtgatgctggagaactacagaaacctgatcagcctgggagaagattccttcaacatgcagttcctgttccacagcctggccatgagcaagccagagctgatcatctgcctggaggccaggaaggagccctggaatgtgaacacagagaagacagcccggcacagcgtgctgagcagctacctgacagaggacatcctgcctgagcagggcctgcaggtgtccttccagaaggtgatgctgcggcgctatgagcgctgctgcctggagaagctgcggctgagaaatgactgggagatcgtgggggagtggaagggccagaaggccagctacaacggcctggacctgtgcagcgccaccacccacagcaagaacttccagtgcaacaagtgtgtgaagggcttcagcaagtttgccaacctgaacaagtgcaagatcagccacactggagagaagcccttcaagtgcaaggaatgtggaaatgtgtcctgcatgagcctcatcatgacccagcagcagaggatccacatcggggagaacccctaccagtgcaagaagtgtgggaaggccttcaatgaatgtagctgcttcacagactgcaagaggatccacgtgggggagaagcactgcaagtgtgaggagtgcaacaacatcttcaagagctgcagcagcctggccgtggtggagaagaaccacacagagaagaagacctaccgctgtgaggagtgtgggaaggccttcaacctgtgcagcgtgctgaccaagcacaagaagatccacactggagagaagccctacaagtgtgaggagtgtgggaagagcttcaagctgttcccctacctgacccagcacaagaggatccacagccgggagaagccctacaagtgtgaggagtgtgggaaggtgttcaagctgctgagctacctgacccagcaccggcgcatccacactggagagaagaccttccgctgtgaggagtgtgggaaggccttcaaccagagcagccacctgacagagcaccggcgcatccacactggagagaagccctacaagtgtgaggagtgtgggaaggccttcacctggttctcctacctgatccagcacaagaggatccacacaggccagaagccctacaagtgtgaggagtgtgggaaggccttcacctggttctcctacctgacccagcacaagaggatccacactggagagaagccctacaagtgtgatgaatgtgggaaggccttcaactggttctcctacctgaccaaccacaagaggatccacactggagagaagccctacaagtgtgaggagtgtgggaaggccttcggccagagcagccacctgagcaagcacaagaccatccacacccgggagaagccctacaagtgtgaggagtgtgggaaggccttcaaccacagcgcccagctggccgtgcatgagaagacccacacctag

SEQ ID NO: 18362 - DNA, 519 bp, Artificial Sequence
  Description of Artificial Sequence: Synthetic coding sequence
atgggcctgctggccttcagagatgtggccctggagttcagccctgaggagtgggagtgcctggaccctgcccagaggagcctgtacagagatgtgatgctggagaactacagaaacctgatcagcctgggagaagattccttcaacatgcagttcctgttccacagcctggccatgagcaagccagagctgatcatctgcctggaggccaggaaggagccctggaatgtgaacacagagaagacagcccggcacagcgtgctgagcagctacctgacagaggacatcctgcctgagcagggcctgcaggtgtccttccagaaggtgatgctgcggcgctatgagcgctgctgcctggagaagctgcggctgagaaatgactgggagatcccctgtgaagatgtgctggccagccccctgcccagcgccatgatcctgtccttcctgcggcccccccagaagcagaagcacgtgaagcccacagagcccatccagagcaagaccctgcagtggctgtag

SEQ ID NO: 18363 - DNA, 519 bp, Artificial Sequence
  Description of Artificial Sequence: Synthetic coding sequence
atgggcctgctggccttcagagatgtggccctggagttcagccctgaggagtgggagtgcctggaccctgcccagaggagcctgtacagagatgtgatgctggagaactacagaaacctgatcagcctgggagaagattccttcaacatgcagttcctgttccacagcctggccatgagcaagccagagctgatcatctgcctggaggccaggaaggagccctggaatgtgaacacagagaagacagcccggcacagcgtgctgagcagctacctgacagaggacatcctgcctgagcagggcctgcaggtgtccttccagaaggtgatgctgcggcgctatgagcgctgctgcctggagaagctgcggctgagaaatgactgggagatcccctgtgaagatgtgctggccagccccctgcccagcgccatgatcctgtccttcctgcggcccccccagaagcagaagcacgtgaagcccacagagcctgtgcagagcagcaccatcgagctgctgtag

SEQ ID NO: 18364 - DNA, 1125 bp, Artificial Sequence
  Description of Artificial Sequence: Synthetic coding sequence
atggagcctggaggagagcccaccggggccaaggagagcagcaccctgatggagagcctggccgctgtgaaggccgccttcctggcccaggcccccagcggcagccgctctgctgaggtgcaggccgcccagagcacagagcctgctgctgaggccggggcccctgagggggagggccaccggggcggccccccccgggccctgggcagcctgggcctgtgtgagaaccaggaggcccgggagaggcctgggggcagcccccggggccctgtgaccagcgagaagacaggaggccagagcggcctggagagtgatgtgcccccaaatgccggccctggagctgagggcggcggctcctggaagggccggcccttcccctgtggggcctgtggccgctccttcaagtgcagcagtgatgctgccaagcacaggagcatccacagcggggagaagccctatgagtgcagcgactgtgggaaggccttcatccacagcagccacgtggtgcgccaccagagggcccacagcggggagcggccctatgcctgtgctgaatgtgggaaggccttcggccagagcttcaacctgctgcggcaccagagggtgcacactggagagaagccctatgcctgtgccgactgtgggaaggccttcggccagaggagtgatgctgccaagcacaggaggacccacactggagagcggctgtatgcctgtggagaatgtgggaagcgcttcctgcacagcagcaatgtggtgcgccacaggaggacccaccacggggagaacccctatgagtgcagagaatgtggccaggccttcagccagagcagcaacctgctgcagcaccagagggtgcacactggagagcggccctttgcctgccaggactgtggccgggccttcagccgcagcagcttcctgcgggagcaccggcgcatccacactggagagaagccccaccagtgtggccactgcggccgggccttccgggccctgagcggcttcttccgccaccagaggctgcacactggagagaagcccttccgctgcacagaatgtggccgggccttccggctgtccttccacctgatccagcaccggcgggtgcatggagctgagtag

SEQ ID NO: 18365 - DNA, 324 bp, Artificial Sequence
  Description of Artificial Sequence: Synthetic coding sequence
atggagcctggaggagagcccaccggggccaaggagagcagcaccctgatggagagcctggccgctgtgaaggccgccttcctggcccaggcccccagcggcagccgctctgctgaggtgcaggccgcccagagcacagagcctgctgctgaggccggggcccctgagggggagggccaccggggcggccccccccgggccctgggcagcctgggcctgtgtgagaaccaggaggcccgggagaggcctgggggcagcccccggggccctgtgaccagcgagaagacaggaggccagagcggcctggagagtgatgtgccctag

SEQ ID NO: 18366 - DNA, 615 bp, Artificial Sequence
  Description of Artificial Sequence: Synthetic coding sequence
atggagcctggaggagagcccaccggggccaaggagagcagcaccctgatggagagcctggccgctgtgaaggccgccttcctggcccaggcccccagcggcagccgctctgctgaggtgcaggccgcccagagcacagagcctgctgctgaggccggggcccctgagggggagggccaccggggcggccccccccgggccctgggcagcctgggcctgtgtgagaaccaggaggcccgggagaggcctgggggcagcccccggggccctgtgaccagcgagaagacaggaggccagagcggcctggagagtgatgtgcccccaaatgccggccctggagctgagggcggcggctcctggaagggccggcccttcccctgtggggcctgtggccgctccttcaagtgcagcagtgatgctgccaagcacaggagcatccacagcggggagaagccctatgagtgcagcgactgtgggaaggccttcatccacagcagccacgtggtgcgccaccagagggcccacagcggggagcggccctatgcctgtgctgaatgtgggaaggccttcggccagagcttcaacctgctgcggcaccagagggtgcacacctag

SEQ ID NO: 18367 - DNA, 1638 bp, Artificial Sequence
  Description of Artificial Sequence: Synthetic coding sequence
atgaagcaggaggacaaccagggcgtgtgtgcccaccaggacagcgaggacaagggcatgggcagtgactttgaagattctgaggaccgggagggggaccctgaggagcgggagatgggcagcaacccccatgacaccaacaagcgggagggccaccctgagcctgagatgggcagcaacccccaggacagccgccaccgggaggccgtgcctgacatctgcacagagggccagctgtctgaggaggagggcgtgtctgtgcggggggaggaggatgaccagagcggcgtggccgacatggccatgtttcctggcctgtctgagagtgacagcatcagccgcagcctgcgggaggatgatgatgaatctgctggggagaaccggctggaggaggaggaggagcagcctgcccctcctgtgctgccctggaggaggcacctgagcctgggcagccgccacagaggagacaagccagcccaccggcgcttccaccggctgcaccaccccatggctgtggacctgggggagctggacagcctggtggccagcatcatggatgcccccaccatctgcccagactgtggggagagcttcagccctggggccgccttcctgcagcaccagaggatccaccggctggccgaggccgctgctgctgccagcctggagcccttcggcctggccggggagtgtgatgccatggtgggcatgatgggcgtgggcgtggccggcggctttggagctggcccccccctggcccggcccccccgggagaagcccttccgctgtggagaatgtgggaagggcttcagcaggaacacctacctgaccaaccacctgcggctgcacactggagagcggcccaacctgtgtgccgactgtgggaagagcttctcctggagggctgacctgctgaagcaccggcggctgcacactggagagaagccctacccctgcccagaatgtggggaggccttcagcctgagcagccacctgctgagccaccggcgggcccacgccgccgccagcggggccggggccgccgccctgcggccctttgcctgtggagaatgtgggaagggctttgtgcggcgcagccacctggccaaccaccagaggatccacactggagagaagccccacggctgtggagaatgtgggaagcgcttctcctggaggagtgacctggtgaagcaccagagggtgcacactggagagaagccctacatgtgcagtgaatgtggggagaccttctctgtgagcagccacctgttcacccacaagaggacccacagcggggagcggccctacgtgtgcagagaatgtgggaagggcttcggcaggaacagccacctggtgaaccacctgcgggtgcacactggagagaagcccttccgctgtggccagtgtgagaagcgcttcagtgacttcagcaccctgacccagcaccagaggacccacactggagagaagccctacacctgcattgaatgtgggaagagcttcatccagagcagccacctgatccgccaccggcgcatccacacaggcaacaagccccacaagtgtgccggctgtgggaagggcttccgctacaagacccacctggcccagcaccagaagctgcacctgtgctag

SEQ ID NO: 18368 - DNA, 1929 bp, Artificial Sequence
  Description of Artificial Sequence: Synthetic coding sequence
atggaggaggagaggaagacagctgagctgcagaagaaccgcatccaggacagcgtggtgtttgaagatgtggccgtggacttcacccaggaggagtgggccctgctggacctggcccagaggaacctgtacagagatgtgatgctggagaacttccagaacctggccagcctgggctaccccctgcacaccccccacctgatcagccagtgggagcaggaggaggacctgcagacagtgaagcgggagctgatccagggcatcttcatgggagagcaccgggagggctttgagacccagctgaagaccaatgaatctgtggccagccaggacatctgtggggagaagatcagcaatgagcagaagatcgtgcgcttcaagagaaatgacagctggttcagcagcctgcacgagaaccaggagagctgtggcatcgactaccagaacaagagccatgagcggcacctgaggaaccacatggtggagaacatctatgagtgctatgaggagaaccaggacggccagaccttcagccaggtgcccaacctggacagcctgaagaggaacacagaggtgaagagctgtgagtgccatgaatgtgggaaggcctttgtggaccacagcagcctgaagagccacatccgcagccacacaggcagcaagccctaccagtgcaaggaatgtgggaaggccttccacttcctggcctgcttcaagaagcacatgaagacccccacagaggagaagccctatgagtgcaaggaatgtaccaaggccttcagctgcagcagcttcttccgggcccacatgaagatccacatcggcaagaccaactatgagtgcaaggaatgtgggaagggcttcagctgcagcagcagcctgacagagcacaagaggatccacagcggggacaagccctatgagtgcaaggaatgtgggaaggccttcagctgcagcagcagcctgagcaagcacaagaggatccacagcggggacaagccctatgagtgcaaggaatgtgggaaggccttcagcagcagcagccacctgatcatccacatccgcatccacactggagagaagccctatgagtgcaaggaatgtgggaaggccttcagcgagagcagcaagctgactgtgcacggccgcacccacactggagagaagccctacaagtgcaaggaatgtgggaaggcctacaactgccccagcagcctgagcatccacatgaggaagcacactggagagaagccctatgagtgcctggagtgtgggaaggccttctacctgcccaccagcctgaacacccacgtgaagaaccagagccgggagaagccctatgagtgcaaggaatgtgggaaggccttcagctgccccagcagcttccgggcccacgtgcgggaccacacaggcaagatccagtatgagtgcaaggaatgtgggaagaccttcagccgcagcagcagcctgacagagcacctgcggacccacagcggggagaagccctatgagtgcaaggaatgtgggaaggccttcatcagcagcagccacctgactgtgcacatccgcacccacactggagagaagccctatgagtgcaagaagtgtgggaaggccttcatctaccccagcgccctgcgcatccacatgaggacccacactggagagaagccctatgagtgcaaggaatgtgggaaggccttccgccacagcagctacctgactgtgcacgccaggatgcacactggagagaagccctttgagtgcctggagtgtgggaaggccttcagctgccccagcagcttcagaagacatgtgcgcagccacactggagagaagccctatgagtgcaaggaatgtgggaaggcctttgtgtgcccagcctacttcagaagacatgtgaagacccacacccgggagaacatctag

SEQ ID NO: 18369 - DNA, 2229 bp, Artificial Sequence
  Description of Artificial Sequence: Synthetic coding sequence
atgccctgctgcagccacaggagctgcagagaagatcctggcaccagcgagagccgggagatggaccctgtggcctttgaagatgtggccgtgaacttcacccaggaggagtggaccctgctggacatcagccagaagaacctcttccgggaggtgatgctggagaccttcaggaacctgaccagcatcggcaagaagtggagcgaccagaacatcgagtatgagtaccagaacccccggcgctccttccgcagcctgattgaggagaaggtgaatgagatcaaggaggacagccactgtggggagaccttcacccaggtgcctgatgaccggctgaacttccaggagaagaaggccagccctgaggtgaagagctgtgacagctttgtgtgtgccgaggtgggcatcggcaacagcagcttcaacatgagcatccggggggacaccggccacaaggcctatgagtaccaggagtatggccccaagccctacaagtgccagcagcccaagaacaagaaggccttccgctaccggcccagcatccgcacccaggagcgggaccacactggagagaagccctatgcctgcaaggtgtgtgggaagaccttcatcttccacagcagcatccgccgccacatggtgatgcacagcggagatggcacctacaagtgcaagttctgtgggaaggccttccacagcttcagcctgtacctgatccacgagaggacccacactggagagaagccctatgagtgcaagcagtgtgggaagagcttcacctacagcgccaccctgcagatccacgagaggacccacactggagagaagccctatgaatgttccaaatgtgacaaggccttccacagcagcagcagctaccacagacatgagaggagccacatgggagagaagccctaccagtgcaaggaatgtgggaaggcctttgcctacaccagcagcctgcggagacatgagaggacccacagcggcaagaagccctatgagtgcaagcagtatggagagggcctgagctacctgatctccttccagacccacatccgcatgaacagcggggagcggccctacaagtgcaagatctgtgggaagggcttctacagcgccaagagcttccagacccatgagaagacccacactggagagaagcgctacaagtgcaagcagtgtgggaaggccttcaacctgagcagcagcttccgctaccacgagcgcatccacactggagagaagccctatgagtgcaagcagtgtgggaaggccttccgcagcgccagccagctgcgggtgcacggcggcacccacactggagagaagccctatgagtgcaaggaatgtgggaaggccttccgcagcaccagccacctgcgggtgcacggccgcacccacactggagagaagccctatgagtgcaaggaatgtgggaaggccttccgctacgtgaagcacctgcagatccacgagaggacagagaagcacatccgcatgcccagcggggagcggccctacaagtgcagcatctgtgagaagggcttctacagcgccaagagcttccagacccatgagaagacccacactggagagaagccctatgagtgcaaccagtgtgggaaggccttccgctgctgcaacagcctgcgctaccacgagaggacccacactggagagaagccctatgagtgcaagcagtgtgggaaggccttccgcagcgccagccacctgaggatgcatgagaggacccacactggagagaagccctatgagtgcaagcagtgtgggaaggccttcagctgtgccagcaacctgaggaagcacggccgcacccacactggagagaagccctatgagtgcaagcagtgtgggaaggccttccgcagcgccagcaacctgcagatgcatgagaggacccacactggagagaagccctatgagtgcaaggaatgtgagaaggccttctgcaagttcagcagcttccagatccacgagaggaagcacagaggagagaagccctatgagtgcaagcactgtggaaatggcttcaccagcgccaagatcctgcagatccacgcccggacccacatcggggagaagcactatgagtgcaaggaatgtgggaaggccttcaactacttcagcagcctgcacatccacgcccggacccacatgggagagaagccctatgagtgcaaggactgtgggaaggccttctcctag

SEQ ID NO: 18370 - DNA, 1596 bp, Artificial Sequence
  Description of Artificial Sequence: Synthetic coding sequence
atgggcttcctgcacgtgggccaggacggcctggagctgcccaccagcggggaccccccagccagcgccagccagagcgctggcatcaccggggtgagccacaggacccagcccccctgctttgagggcctgaccagcaaggacctggtgcgggaggagaagaccaggaagaggaagaggaaggccaaggagagcggcatggccctgctgcagggcctgctgaccttcagagatgtggccatcgagttcagccaggaggagtggaagtgcctggaccctgcccagaggaccctgtacagagatgtgatgctggagaactacagaaacctggtgtccctggacaccagcagcaagtgcatgatgaagatgttcagcagcacaggccagggcaacacagaggtggtgcacacaggcaccctgcagatccacgccagccaccacatcggggacacctgcttccaggagattgagaaggacatccatgactttgtgttccagtggcaggagaatgagaccaatggacatgaggccctgatgaccaagaccaagaagctgatgagcagcacagaaagacatgaccagagacatgctggcaacaagcccatcaagaatgagctgggcagcagcttccacagccacctgcctgaggtgcacatcttccaccctgagggcaagattggcaaccaggtggagaaggccatcaatgatgccttctctgtgtctgccagccagaggatcagctgccggcccaagacccgcatcagcaacaagtacagaaacaacttcctgcagagcagcctgctgacccagaagcgggaggtgcacacccgggagaagagcttccagagaaatgaaagtggcaaggccttcaacggcagcagcctgctgaagaagcaccagatcatccacctgggggacaagcagtacaagtgtgatgtgtgtgggaaggacttccaccagaagcgctacctggcctgccaccgctgccacactggagagaacccctacacctgcaatgaatgtgggaagaccttcagccacaacagcgccctgctggtgcacaaggccatccacactggagagaagccctacaagtgcaatgaatgtgggaaggtgttcaaccagcagagcaacctggcccggcaccaccgggtgcacactggagagaagccctacaagtgtgaggagtgtgacaaggtgttcagcaggaagagccacctggagcggcaccggcgcatccacactggagagaagccctacaagtgcaaggtgtgtgacaaggccttccggcgggacagccacctggcccagcacacagtcatccacactggagagaagccctacaagtgcaatgaatgtgggaagacctttgtgcagaacagcagcctggtgatgcacaaggtgatccacactggagagaagcgctacaagtgcaatgaatgtgggaaggtgttcaaccacaagagcaacctggcctgccaccggcggctgcacactggagagaagccctacaagtgcaatgaatgtgggaaggtgttcaacaggaagagcaacctggagcggcaccaccggctgcacacaggcaagaagagctag

SEQ ID NO: 18371 - DNA, 1398 bp, Artificial Sequence
  Description of Artificial Sequence: Synthetic coding sequence
atggccctgctgcagggcctgctgaccttcagagatgtggccatcgagttcagccaggaggagtggaagtgcctggaccctgcccagaggaccctgtacagagatgtgatgctggagaactacagaaacctggtgtccctggacaccagcagcaagtgcatgatgaagatgttcagcagcacaggccagggcaacacagaggtggtgcacacaggcaccctgcagatccacgccagccaccacatcggggacacctgcttccaggagattgagaaggacatccatgactttgtgttccagtggcaggagaatgagaccaatggacatgaggccctgatgaccaagaccaagaagctgatgagcagcacagaaagacatgaccagagacatgctggcaacaagcccatcaagaatgagctgggcagcagcttccacagccacctgcctgaggtgcacatcttccaccctgagggcaagattggcaaccaggtggagaaggccatcaatgatgccttctctgtgtctgccagccagaggatcagctgccggcccaagacccgcatcagcaacaagtacagaaacaacttcctgcagagcagcctgctgacccagaagcgggaggtgcacacccgggagaagagcttccagagaaatgaaagtggcaaggccttcaacggcagcagcctgctgaagaagcaccagatcatccacctgggggacaagcagtacaagtgtgatgtgtgtgggaaggacttccaccagaagcgctacctggcctgccaccgctgccacactggagagaacccctacacctgcaatgaatgtgggaagaccttcagccacaacagcgccctgctggtgcacaaggccatccacactggagagaagccctacaagtgcaatgaatgtgggaaggtgttcaaccagcagagcaacctggcccggcaccaccgggtgcacactggagagaagccctacaagtgtgaggagtgtgacaaggtgttcagcaggaagagccacctggagcggcaccggcgcatccacactggagagaagccctacaagtgcaaggtgtgtgacaaggccttccggcgggacagccacctggcccagcacacagtcatccacactggagagaagccctacaagtgcaatgaatgtgggaagacctttgtgcagaacagcagcctggtgatgcacaaggtgatccacactggagagaagcgctacaagtgcaatgaatgtgggaaggtgttcaaccacaagagcaacctggcctgccaccggcggctgcacactggagagaagccctacaagtgcaatgaatgtgggaaggtgttcaacaggaagagcaacctggagcggcaccaccggctgcacacaggcaagaagagctag

SEQ ID NO: 18372 - DNA, 1596 bp, Artificial Sequence; identical to SEQ ID NO: 18370
  Description of Artificial Sequence: Synthetic coding sequence

SEQ ID NO: 18373 - DNA, 903 bp, Artificial Sequence
  Description of Artificial Sequence: Synthetic coding sequence
atgcacagcctgaagaaggtgacctttgaagatgtggccatcgacttcacccaggaggagtgggccatgatggacaccagcaagaggaagctgtacagagatgtgatgctggagaacatcagccacctggtgtccctgggctaccagatcagcaagagctacatcatcctgcagctggagcagggcaaggagctgtggagggagggccgggagttcctgcaggaccagaacccagaccgggagagcgccctgaagaagaagcacatgatctccatgcaccccatcaccaggaaggatgccagcacctccatgaccatggagaacagcctcatcctggaggacccctttgaatgtaatgattctggagaggactgcacccacagcagcaccatcacccagaggctgctgacccacagcggcaagaagccctacgtgtccaagcagtgtgggaagagcctgaggaacctcttcagccccaagccccacaagcagatccacaccaagggcaagagctaccagtgcaacctgtgtgagaaggcctacaccaactgcttccggctgcggcggcacaagatgacccacactggagagcggccctatgcctgccacctgtgtgggaaggccttcacccagtgcagccacctgcggagacatgagaagacccacactggagagcggccctacaagtgccaccagtgtgggaaggccttcatccagagcttcaacctgcggagacatgagaggacccacctgggcaagaagtgctatgaatgtgacaagagcggcaaggccttcagccagagcagcggcttccggggcaacaagatcatccacactggagagaagccccacgcctgcctgctgtgtgggaaggccttcagcctgagcagtgacctgaggtag

SEQ ID NO: 18374 - DNA, 624 bp, Artificial Sequence
  Description of Artificial Sequence: Synthetic coding sequence
atgcacagcctgaagaaggtgacctttgaagatgtggccatcgacttcacccaggaggagtgggccatgatggacaccagcaagaggaagctgtacagagatgtgatgctggagaacatcagccacctggtgtccctgggctaccagatcagcaagagctacatcatcctgcagctggagcagggcaaggagctgtggagggagggccgggagttcctgcaggaccagaacccagaccgggagagcgccctgaagaagaagcacatgatctccatgcaccccatcaccaggaaggatgccagcacctccatgaccatggagaacagcctcatcctggaggacccctttgaatgtaatgattctggagaggactgcacccacagcagcaccatcacccagaggctgctgacccacagcggcaagaagccctacgtgtccaagcagtgtgggaagagcctgaggaacctcttcagccccaagccccacaagcagatccacaccaagggcaagagctaccagtgcaacctgtgtgagaaggcctacaccaactgcttccggctgcggcggcacaagatgacccacactggagagcggccctatgcctgccacctgtgtgggaagtag

SEQ ID NO: 18375 - DNA, 234 bp, Artificial Sequence
  Description of Artificial Sequence: Synthetic coding sequence
atgcacagcctgaagaaggtgacctttgaagatgtggccatcgacttcacccaggaggagtgggccatgatggacaccagcaagaggaagctgtacagagatgtgatgctggagaacatcagccacctggtgtccctgggctaccagatcagcaagagctacatcatcctgcagctggagcagggcaaggagctgtggagggagggccgggagttcctgcaggaccagaactag

SEQ ID NO: 18376 - DNA, 903 bp, Artificial Sequence
  Description of Artificial Sequence: Synthetic coding sequence
atgcacagcctggagaaggtgacctttgaagatgtggccatcgacttcacccaggaggagtgggacatgatggacaccagcaagaggaagctgtacagagatgtgatgctggagaacatcagccacctggtgtccctgggctaccagatcagcaagagctacatcatcctgcagctggagcagggcaaggagctgtggagggagggccgggtcttcctgcaggaccagaacccagaccgggagagcgccctgaagaagaagcacatgatctccatgcaccccatcatcaggaaggatgccagcacctccatgaccatggagaacagcctcatcctggaggacccctttgagtacaatgattctggagaggactgcacccacagcagcaccatcacccagtgcctgctgacccacagcggcaagaagccctgtgtgtccaagcagtgtgggaagagcctgaggaacctgctgagccccaagcccaggaagcagatccacaccaagggcaagagctaccagtgcaacctgtgtgagaaggcctacaccaactgcttctacctgcggcggcacaagatgacccacactggagagcggccctatgcctgccacctgtgtgggaaggccttcacccagtgcagccacctgcggagacatgagaagacccacactggagagcggccctacaagtgccaccagtgtgggaaggccttcatccagagcttcaacctgcggagacatgagaggacccacctgggccagaagtgctatgaatgtgacaagagcggcaaggccttcagccagagcagcggcttccggggcaacaagatcatccacatcggggagaagccccacgcctgcctgctgtgtgggaaggccttcagcctgagcagtgacctgaggtag

SEQ ID NO: 18377 - DNA, 1116 bp, Artificial Sequence
  Description of Artificial Sequence: Synthetic coding sequence
atggacatggcccaggagcctgtgaccttcagagatgtggccatctacttcagccgggaggagtgggcctgcctggagcccagccagagggccctgtacagagatgtgatgctggacaacttcagctctgtggccgccctgggcttctgcagccccaggccagacctggtgtcccggctggagcagtgggaggagccctgggtggaggaccgggagaggcctgagttccaggccgtgcagaggggccccaggcctggggccaggaagtctgctgaccccaagaggccctgtgaccacccagcctgggcccacaagaagacccacgtgcggcgggagcgggcccgggagggcagcagcttcaggaagggcttccggctggacacagatgatggccagctgccccgggccgcccctgagaggacagatgccaagcccacagccttcccctgccaggtgctgacccagagatgtggcagaagacctggaagaagagagaggaggaagcagagagctgtggagctgtccttcatctgtggcacctgtgggaaggccctgagctgccacagccggctgctggcccaccagacagtgcacacaggcaccaaggcctttgaatgtccagaatgtggccagaccttccgctgggccagcaacctgcagaggcaccagaagaaccacacccgggagaagcccttctgctgtgaggcctgtggccaggccttcagcctgaaggaccggctggcccagcacaggaaggtgcacacagagcaccggccctacagctgtggggactgtgggaaggccttcaagcagaagagcaacctgctgcggcaccagctggtgcacactggagagcggcccttctactgtgccgactgtgggaaggccttccgcaccaaggagaacctgagccaccaccagagggtgcacagcggggagaagccctacacctgtgccgagtgtgggaagagcttccgctggcccaagggcttcagcatccaccggcggctgcacctgaccaagcgcttctatgaatgtggccactgtgggaagggcttccgccacctgggcttcttcaccaggcaccagaggacccaccgccacggggaggtgtag

SEQ ID NO: 18378 - DNA, 1116 bp, Artificial Sequence; identical to SEQ ID NO: 18377
  Description of Artificial Sequence: Synthetic coding sequence

SEQ ID NO: 18379 - DNA, 1116 bp, Artificial Sequence; identical to SEQ ID NO: 18377
  Description of Artificial Sequence: Synthetic coding sequence

SEQ ID NO: 18380 - DNA, 144 bp, Artificial Sequence
  Description of Artificial Sequence: Synthetic coding sequence
atggacatggcccaggagcctgtgaccttcagagatgtggccatctacttcagccgggaggagtgggcctgcctggagcccagccagagggccctgtacagagatgtgatgctggacaacttcagctctgtggccgccctgtag

SEQ ID NO: 18381 - DNA, 240 bp, Artificial Sequence
  Description of Artificial Sequence: Synthetic coding sequence
atggacatggcccaggagcctgtgaccttcagagatgtggccatctacttcagccgggaggagtgggcctgcctggagcccagccagagggccctgtacagagatgtgatgctggacaacttcagctctgtggccgccctgggcttctgcagccccaggccagacctggtgtcccggctggagcagtgggaggagccctgggtggaggaccgggagaggcctgagttccaggccgtgtag

SEQ ID NO: 18382 - DNA, 1116 bp, Artificial Sequence; identical to SEQ ID NO: 18377
  Description of Artificial Sequence: Synthetic coding sequence

SEQ ID NO: 18383 - DNA, 1116 bp, Artificial Sequence; identical to SEQ ID NO: 18377
  Description of Artificial Sequence: Synthetic coding sequence

SEQ ID NO: 18384 - DNA, 426 bp, Artificial Sequence
  Description of Artificial Sequence: Synthetic coding sequence
atggacatggcccaggagcctgtgaccttcagagatgtggccatctacttcagccgggaggagtgggcctgcctggagcccagccagagggccctgtacagagatgtgatgctggacaacttcagctctgtggccgccctgggcttctgcagccccaggccagacctggtgtcccggctggagcagtgggaggagccctgggtggaggaccgggagaggcctgagttccaggccgtgcagaggggccccaggcctggggccaggaagtctgctgaccccaagaggccctgtgaccacccagcctgggcccacaagaagacccacgtgcggcgggagcgggcccgggagggcagcagcttcaggaagggcttccggctggacacagatgatggccagctgccccgggccgcccctgagaggacatag

SEQ ID NO: 18385 - DNA, 1692 bp, Artificial Sequence
  Description of Artificial Sequence: Synthetic coding sequence
atgggccccctgaccttcatggatgtggccatcgagttcagcctggaggagtggcagtgcctggacacagcccagcagaacctgtacagaaatgtgatgctggagaactacagaaacctggtgttcctgggcattgctgtgagcaacctggacctgatcacctgcctggagcagggcaaggagccctggaacatgaagagacatgagatggccgccaagcccccagccatgtgcagccactttgccaaggacctgcggcctgagcagtacatcaagaacagcttccagcaggtgatcctgcggcgctatggaaaatgtggctaccagaagggctgcaagtctgtggatgagcacaagctgcacaagggcggccacaagggcctgaacagatgtgtgaccaccacccagagcaagatcgtgcagtgtgacaagtatgtgaaggtgttccacaagtacagcaatgccaagaggcacaagatccgccacacaggcaagaaccccttcaagtgcaaggaatgtgggaagagcttctgcatgctgagccagctgacccagcacgagatcatccacactggagagaagccctacaagtgtgaggagtgtgggaaggccttcaagaagagcagcaacctgaccaaccacaagatcatccacactggagagaagccctacaagtgtgaggagtgtgggaaggccttcaaccagagcagcaccctgaccaggcacaagatcatccacactggagagaagctgtacaagtgtgaggagtgtgggaaggccttcaacagaagcagcaacctgaccaagcacaagatcgtgcacactggagagaagccctacaagtgtgaggagtgtgggaaggccttcaagcagagcagcaacctgaccaaccacaagaagatccacactggagagaagccctacaagtgtggggagtgtgggaaggccttcaccctgagcagccacctgaccacccacaagaggatccacactggagagaagccctacaagtgtgaggagtgtgggaaggccttcagcgtcttcagcaccctgaccaagcacaagatcatccacacagaggagaagccctacaagtgtgaggagtgtgggaaggccttcaacagaagcagccacctgaccaaccacaaggtgatccacactggagagaagccctacaagtgtgaggagtgtgggaaggccttcaccaagagcagcaccctgacctaccacaaggtgatccacacaggcaagaagccctacaagtgtgaggagtgtgggaaggccttcagcatcttcagcatcctgaccaagcacaaggtgatccacacagaggacaagccctacaagtgtgaggagtgtgggaagaccttcaactacagcagcaacttcaccaaccacaagaagatccacactggagagaagccctacaagtgtgaggagtgtgggaagagcttcatcctgagcagccacctgaccacccacaagatcatccacactggagagaagccctacaagtgcaaggaatgtgggaaggccttcaaccagagcagcaccctgatgaagcacaagatcatccacactggagagaagccctacaagtgtgaggagtgtgggaaggccttcaaccagagccccaacctgaccaagcacaagaggatccacaccaaggagaagccctacaagtgcaagtag

SEQ ID NO: 18386 - DNA, 1926 bp, Artificial Sequence
  Description of Artificial Sequence: Synthetic coding sequence
atggattctgtggtgtttgaagatgtggccgtgaacttcacccaggaggagtgggccctgctgggccccagccagaagaagctgtacagagatgtgatgcaggagacctttgtgaacctggccagcattggagagaactgggaggagaagaacatcgaggaccacaagaaccagggcaggaagctgcggagccacatggtggagcggctgtgtgagaggaaggagggcagccagtttggagagaccatcagccagacccccaaccccaagcccaacaagaagaccttcaccagggtgaagccctatgaatgttctgtgtgtgggaaggactacatgtgccacagcagcctgaacagacacatgaggagccacacagagcacaggagctatgagtaccacaagtatggagagaagagctatgagtgcaaggaatgtgggaagcgcttctccttccgcagcagcttccgcatccacgagaggacccacactggagagaagccctacaagtgcaagcagtgtgggaaggccttctcctggcccagcagcttccagatccacgagaggacccacactggagagaagccctatgagtgcaaggaatgtgggaaggccttcatctaccacaccaccttccggggccacatgaggatgcacactggagagaagccctacaagtgcaaggaatgtgggaagaccttcagccaccccagcagcttcaggaaccacgagaggacccacagcggggagaagccctatgagtgcaagcagtgtgggaaggccttccgctactaccagaccttccagatccacgagaggacccacactggagagaagccctaccagtgcaagcagtgtgggaaggccctgagctgccccaccagcttccgcagccatgagcgcatccacactggagagaagccctacaagtgcaagaagtgtgggaaggccttctccttccccagcagcttcaggaagcatgagcgcatccacactggagagaagccctatgactgcaaggaatgtgggaaggccttcatcagcctgcccagctaccgccgccacatgatcatgcacactggaaatggcccctacaagtgcaaggaatgtgggaaggcctttgactgccccagcagcttccagatccacgagaggacccacactggagagaagccctatgagtgcaagcagtgtgggaaggccttcagctgcagcagcagcttcaggatgcatgagaggacccacactggagagaagccccatgagtgcaagcagtgtgggaaggccttcagctgcagcagctctgtgcgcatccacgagaggacccacactggagagaagccctatgagtgcaagcagtgtgggaaggccttcagctgcagcagcagcttcaggatgcatgagcgcatccacactggagagaagccctatgagtgcaagcagtgtgggaaggccttctccttcagcagcagcttcaggatgcatgagaggacccacactggagagaagccctatgagtgcaagcagtgtgggaaggccttcagctgcagcagcagcttcaggatgcatgagaggacccacactggagagaagccctatgagtgcaagcagtgtgggaaggccttcagctgcagcagcagcatccgcatccacgagaggacccacactggagagaagccctatgagtgcaagcagtgtgggaaggccttcagctgcagcagctctgtgaggatgcatgagaggacccacactggagtgaagccctatgagtgcaagcagtgtgacaaggccttcagctgcagccgctccttccgcatccacgagaggacccacactggagagaagccctatgcctgccagcagtgtgggaaggccttcaagtgcagccgctccttccgcatccacgagcgggtgcacagcggggagtag

SEQ ID NO: 18387 - DNA, 1926 bp, Artificial Sequence; identical to SEQ ID NO: 18386
  Description of Artificial Sequence: Synthetic coding sequence

SEQ ID NO: 18388 - DNA, 1995 bp, Artificial Sequence
  Description of Artificial Sequence: Synthetic coding sequence
atggagggcttcatggattctggcacccagacagatgctgtggtggtgctgagcctggcccaggccgctgtgctgggcctggtgtctgaaaatgagctgtttggagccaccatctctgctgaggccttctacccagacctgggccctgagctgagcggggccgccatgggagagcctgagcccccaggcccagatgtgtaccagctggcctgcaatggccgggccctggaggagcctgctgaggaggaggtgctggaggtggaggccgcctgtgagaagcacaccaggaggaagaccaggcctcctgtgcggctggtgcccaaggtgaagtttgagaaggtggaggaggaggagcaggaggtgtatgaggtgtctgtgcctggagatgacaaggatgctggccctgctgaggccccagctgaggccgccagcggcggctgtgatgccctggtgcagagcagcgctgtgaagatgattgacctgagcgccttcagcaggaagcccaggaccctgcggcacctgcccaggacccccaggcctgagctgaatgtggccccctatgacccccacttccctgccccagccagagatggcttccctgagcccagcatggccctgcccggccctgaggccctgcccacagaatgtggctttgagcccccccacctggcccccctgagtgaccctgaggcccccagcatggagagccctgagcctgtgaagccagagcagggctttgtgtggcaggaggccagcgagtttgaggccgacacagctggcagcacagtggagcggcacaagaaggcccagctggaccggctggacatcaacgtgcagattgatgacagctacctggtggaggccggggaccggcagaagcgctggcagtgcaggatgtgtgagaagagctacaccagcaagtacaacctggtgacccacatcctgggccacaacggcatcaagccccacagctgcccccactgcagcaagctgttcaagcagcccagccacctgcagacccacctgctgacccaccagggcacccggccccacaagtgccaggtgtgccacaaggccttcacccagaccagccacctgaagaggcacatgctgctgcacagcgaggtgaagccctacagctgccacttctgtggccggggctttgcctaccccagcgagctgaaggcccacgaggtgaagcatgaaagtggccgctgccacgtgtgtgtggagtgtggcctggacttcagcaccctgacccagctgaagaggcacctggccagccaccagggccccaccctgtaccagtgcctggagtgtgacaagagcttccactaccgcagccagctgcagaaccacatgctgaagcaccagaatgtgcggccctttgtgtgcacagaatgtggcatggagttcagccagatccaccacctgaagcagcacagcctgacccacaagggcgtgaaggagttcaagtgtgaggtgtgtggccgggagttcaccctgcaggccaacatgaagaggcacatgctgatccacacctctgtgcggccctaccagtgccacatctgcttcaagacctttgtgcagaagcagaccctgaagacccacatgattgtgcacagccctgtgaagcccttcaagtgcaaggtgtgtgggaagagcttcaacaggatgtacaacctgctgggccacatgcacctgcacgccggcagcaagcccttcaagtgcccctactgcagcagcaagttcaacctgaagggcaacctgagccgccacatgaaggtgaagcacggcgtgatggacatcggcctggacagccaggaccccatgatggagctgactggaacagaccccagcgagctggatggccagcaggagatggaggactttgaagaaaatgcctacagctatgcctctgtggacagcagcgctgaggcctctgtgctgacagagcaggccatgaaggagatggcctactacaacgtgctgtag

SEQ ID NO: 18389 - DNA, 240 bp, Artificial Sequence
  Description of Artificial Sequence: Synthetic coding sequence
atggagggcttcatggattctggcacccagacagatgctgtggtggtgctgagcctggcccaggccgctgtgctgggcctggtgtctgaaaatgagctgtttggagccaccatctctgctgaggccttctacccagacctgggccctgagctgagcggggccgccatgggagagcctgagcccccaggcccagatgtgtaccagctggcctgcaatggccgggccctggaggagccctag

SEQ ID NO: 18390 - DNA, 1293 bp, Artificial Sequence
  Description of Artificial Sequence: Synthetic coding sequence
atggaggaggaggagatgaatgatggcagccagatggtgcgcagccaggagagcctgaccttccaggatgtggccgtggacttcacccgggaggagtgggaccagctgtacccagcccagaagaacctgtacagagatgtgatgctggagaactacagaaacctggtggccctgggctaccagctgtgcaagccagaggtgattgcccagctggagctggaggaggagtgggtgattgagcgggacagcctgctggacacccacccagatggagagaacagacctgagatcaagaagagcaccaccagccagaacatcagtgatgagaaccagacccatgagatgatcatggagcggctggccggggacagcttctggtacagcatcctgggcggcctgtgggactttgactaccaccctgagttcaaccaggagaaccacaagcgctacctgggccaggtgaccctgacccacaagaagatcacccaggagaggagcctggagtgcaacaagtttgctgagaactgcaacctgaacagcaacctgatgcagcagaggatccccagcatcaagatccccctgaacagcgacacccagggcaacagcatcaagcacaacagcgacctgatctactaccagggcaactacgtgcgggagaccccctatgagtacagtgaatgtgggaagatcttcaaccagcacatcctgctgacagaccacatccacacagctgagaagcccagtgaatgtgggaaggccttcagccacaccagcagcctgagccagccccagatgctgctgaccggggagaagccctacaagtgtgatgaatgtgggaagcgcttcagccagaggatccacctgatccagcaccagaggatccacactggagagaagcccttcatctgcaatggctgtgggaaggccttccggcagcacagcagcttcacccagcacctgcgcatccacactggagagaagccctacaagtgcaaccagtgtgggaaggccttcagccgcatcaccagcctgacagagcaccaccggctgcacactggagagaagccctatgaatgtggcttctgtgggaaggccttcagccagaggacccacctgaaccagcacgagaggacccacactggagagaagccctacaagtgcaatgaatgtgggaaggccttcagccagagcgcccacctgaaccagcacaggaagatccacacccgggagaagctgtgtgagtacaagtgtgagcagacagtgcgccacagccccagcttcagcagcacctag

SEQ ID NO: 18391 - DNA, 2736 bp, Artificial Sequence
  Description of Artificial Sequence: Synthetic coding sequence
atgtgcagccacttcacccaggacttcctgcctgtgcagggcatcgaggacagcttccacaagctgatcctgcggcgctatgaaaaatgtggccatgacaacctgcagctgaggaagggctgcaagtccatgaatgtgtgcaaggtgcagaagggcgtgtacaacggcatcaacaagtgcctgagcaacacccagagcaagatcttccagtgcaatgcccgggtgaaggtgttcagcaagtttgccaacagcaacaaggacaagaccaggcacactggagagaagcacttcaagtgcaatgaatgtgggaagagcttccagaagttcagtgacctgacccagcacaagggcatccacgccggggagaagccctacacctgtgaggagcggggcaaggactttggctggtacacagacctgaaccagcacaagaagatccacactggagagaagccctacaagtgtgaagaatgtgggaaggccttcaacagaagcaccaacctgacagcccacaagaggatccacaaccgggagaaggcctacaccggggaggaccgggaccgggccttcggctggagcaccaacctgaatgagtacaagaagatccacactggagacaagccctacaagtgcaaggaatgtgggaaggccttcatgcacagcagccacctgaacaagcatgagaagatccacactggagagaagccctacaagtgcaaggaatgtgggaaggtgatcagcagcagcagcagctttgccaagcacaagaggatccacactggagagaagcccttcaagtgcctggagtgtgggaaggccttcaacatcagcaccaccctgaccaagcaccggcgcatccacactggagagaagccctacacctgtgaggtgtgtgggaaggccttccggcagagcgccaacctgtatgtgcaccggcgcatccacactggagagaagccctacacctgtggagaatgtgggaagaccttccggcagagcgccaacctgtatgtgcaccggcgcatccacactggagagaagccctacaagtgtgaggactgtgggaaggccttcggccgctacacagccctgaaccagcacaagaagatccacactggagagaagccctacaagtgtgaagaatgtgggaaggccttcaacagcagcaccaacctgacagcccacaagaggatccacacccgggagaagccctacacctgtgaggaccggggccgggccttcggcctgagcaccaacctgaatgagtacaagaagatccacactggagacaagccctacaagtgcaaggaatgtgggaaggccttcatccacagcctgcacctgaacaagcatgagaagatccacacaggcaagaagccctacaagtgcaagcagtgtgggaaggtgatcaccagcagcagcagctttgccaagcacaagaggatccacactggagagaagccctttgagtgcctggagtgtgggaaggccttcaccagcagcaccaccctgaccaagcaccggcgcatccacactggagagaagccctacacctgtgaggtgtgtgggaaggccttccggcagagcgccatcctgtatgtgcaccggcgcatccacactggagagaagccctacacctgtgaagaatgtgggaagaccttccggcagagcgccaacctgtatgtgcaccggcgcatccacactggagagaagccctacaagtgtgaagaatgtgggaaggccttcggccgctacacagacctgaaccagcacaagaagatccacactggagagaagctgtacaagtgtgaagaatgtgggaaggactttgtgtggtacacagacctgaaccagcagaagaagatctacaccggggagaagccctacaagtgtgaagaatgtgggaaggcctttgcccccagcacagacctgaaccagcacaccaagatcctgaccggggagcagagctacaagtgtgaagaatgtgggaaggccttcggctggagcatcgccctgaaccagcacaagaagatccacactggagagaagccctacaagtgtgaagaatgtgggaaggccttcagccgcagcaggaacctgaccacccaccggcgggtgcacacccgggagaagccctacaagtgtgaggaccggggccgcagctttggctggagcaccaacctgaatgagtacaagaagatccacactggagacaagctgtacaagtgcaaggaatgtgggaaggtgttcaagcagagcagccacctgaacagacatgagaagatccacacaggcaagaagccctacaagtgcaaggaatgtgggaaggtgatcaccagcagcagcagctttgccaagcacaagaggatccacactggagagaagcccttcaagtgcctggagtgtgggaaggccttcaccagcagcaccaccctgaccaagcaccggcgcatccacactggagagaagccctacacctgtgaagaatgtgggaaggccttccggcagagcgccatcctgtatgtgcaccggcgcatccacactggagagaagccctacacctgtggagaatgtgggaagaccttccggcagagcgccaacctgtatgcccacaagaagatccacactggagagaagccctacacctgtggggactgtgggaagaccttccggcagagcgccaacctgtatgcccacaagaagatccacactggagacaagaccatccaggtgtag

SEQ ID NO: 18392 - DNA, 399 bp, Artificial Sequence
  Description of Artificial Sequence: Synthetic coding sequence
atggagcccctgaccttcagagatgtggccatcgagttcagccctgaggagtggaagtgcctggaccctgcccagcagaacctgtacagagatgtgatgctggagaactacagaaacctggtgtccctggccatgtgcagccacttcacccaggacttcctgcctgtgcagggcatcgaggacagcttccacaagctgatcctgcggcgctatgagaagttcagcagcctcatcagcagctgcagggtcatcagccacggcctgagccggggcaggaacagagccacagagaagaatgacctgctgaccacagaggagcctgtggtgaagcacagatttgacctgcagtacccagaggagatgtggaggaacacagtggtgcagaagggcaggaagtag

SEQ ID NO: 18393 - DNA, 2772 bp, Artificial Sequence
  Description of Artificial Sequence: Synthetic coding sequence
atgctggagaactacagaaacctggtgtccctggccatgtgcagccacttcacccaggacttcctgcctgtgcagggcatcgaggacagcttccacaagctgatcctgcggcgctatgaaaaatgtggccatgacaacctgcagctgaggaagggctgcaagtccatgaatgtgtgcaaggtgcagaagggcgtgtacaacggcatcaacaagtgcctgagcaacacccagagcaagatcttccagtgcaatgcccgggtgaaggtgttcagcaagtttgccaacagcaacaaggacaagaccaggcacactggagagaagcacttcaagtgcaatgaatgtgggaagagcttccagaagttcagtgacctgacccagcacaagggcatccacgccggggagaagccctacacctgtgaggagcggggcaaggactttggctggtacacagacctgaaccagcacaagaagatccacactggagagaagccctacaagtgtgaagaatgtgggaaggccttcaacagaagcaccaacctgacagcccacaagaggatccacaaccgggagaaggcctacaccggggaggaccgggaccgggccttcggctggagcaccaacctgaatgagtacaagaagatccacactggagacaagccctacaagtgcaaggaatgtgggaaggccttcatgcacagcagccacctgaacaagcatgagaagatccacactggagagaagccctacaagtgcaaggaatgtgggaaggtgatcagcagcagcagcagctttgccaagcacaagaggatccacactggagagaagcccttcaagtgcctggagtgtgggaaggccttcaacatcagcaccaccctgaccaagcaccggcgcatccacactggagagaagccctacacctgtgaggtgtgtgggaaggccttccggcagagcgccaacctgtatgtgcaccggcgcatccacactggagagaagccctacacctgtggagaatgtgggaagaccttccggcagagcgccaacctgtatgtgcaccggcgcatccacactggagagaagccctacaagtgtgaggactgtgggaaggccttcggccgctacacagccctgaaccagcacaagaagatccacactggagagaagccctacaagtgtgaagaatgtgggaaggccttcaacagcagcaccaacctgacagcccacaagaggatccacacccgggagaagccctacacctgtgaggaccggggccgggccttcggcctgagcaccaacctgaatgagtacaagaagatccacactggagacaagccctacaagtgcaaggaatgtgggaaggccttcatccacagcctgcacctgaacaagcatgagaagatccacacaggcaagaagccctacaagtgcaagcagtgtgggaaggtgatcaccagcagcagcagctttgccaagcacaagaggatccacactggagagaagccctttgagtgcctggagtgtgggaaggccttcaccagcagcaccaccctgaccaagcaccggcgcatccacactggagagaagccctacacctgtgaggtgtgtgggaaggccttccggcagagcgccatcctgtatgtgcaccggcgcatccacactggagagaagccctacacctgtgaagaatgtgggaagaccttccggcagagcgccaacctgtatgtgcaccggcgcatccacactggagagaagccctacaagtgtgaagaatgtgggaaggccttcggccgctacacagacctgaaccagcacaagaagatccacactggagagaagctgtacaagtgtgaagaatgtgggaaggactttgtgtggtacacagacctgaaccagcagaagaagatctacaccggggagaagccctacaagtgtgaagaatgtgggaaggcctttgcccccagcacagacctgaaccagcacaccaagatcctgaccggggagcagagctacaagtgtgaagaatgtgggaaggccttcggctggagcatcgccctgaaccagcacaagaagatccacactggagagaagccctacaagtgtgaagaatgtgggaaggccttcagccgcagcaggaacctgaccacccaccggcgggtgcacacccgggagaagccctacaagtgtgaggaccggggccgcagctttggctggagcaccaacctgaatgagtacaagaagatccacactggagacaagctgtacaagtgcaaggaatgtgggaaggtgttcaagcagagcagccacctgaacagacatgagaagatccacacaggcaagaagccctacaagtgcaaggaatgtgggaaggtgatcaccagcagcagcagctttgccaagcacaagaggatccacactggagagaagcccttcaagtgcctggagtgtgggaaggccttcaccagcagcaccaccctgaccaagcaccggcgcatccacactggagagaagccctacacctgtgaagaatgtgggaaggccttccggcagagcgccatcctgtatgtgcaccggcgcatccacactggagagaagccctacacctgtggagaatgtgggaagaccttccggcagagcgccaacctgtatgcccacaagaagatccacactggagagaagccctacacctgtggggactgtgggaagaccttccggcagagcgccaacctgtatgcccacaagaagatccacactggagacaagaccatccaggtgtag

SEQ ID NO: 18394 - DNA, 2217 bp, Artificial Sequence
  Description of Artificial Sequence: Synthetic coding sequence
atgggcctgctgaccttcagagatgtggccatcgagttcagcctggaggagtggcagtgcctggacacagcccagaagaacctgtacagaaatgtgatgctggagaactacagaaacctggccttcctgggcattgctgtgtccaagccagacctgatcatctgcctggagaaggagaaggagccctggaacatgaagagagatgagatggtggatgagcccccaggcatctgcccccactttgcccaggacatctggccagagcagggcgtggaggacagcttccagaaggtgatcctgcggagatttgagaagtgtggccacgagaacctgcagctgaggaagggctgcaagtctgtggatgagtgcaaggtgcacaaggagggctacaacggcctgaaccagtgcttcaccaccacccagggcaaggccagccagtgtgggaagtacctgaaggtgttctacaagttcatcaacctgaaccgctacaagatccgccacaccaggaagaagcccttcaagtgcaagaactgtgtgaagagcttctgcatgttcagccacaagacccagcacaagagcatctacaccacagagaagagctacaagtgcaaggaatgtgggaagaccttcaactggagcagcaccctgaccaaccacaagaagacccacacagaggagaagccctacaagtgtgaggagtatggcaaggccttcaaccagagcagcaactacaccacccacaaggtgacccacactggagagaagccctacaagtgtgaagaatgtgggaaggccttcagccagagcagcaccctgaccatccacaagaggatccacactggagagaagccctgcaagtgtgaagaatgtgggaaggccttcagccagcccagcgccctgaccatccacaagaggatgcacatcggggagaagccctacaagtgtgaagaatgtgggaaggcctttgtgtggagcagcaccctgaccaggcacaagaggctgcacagcggggagaagccctacaagtgtgaagaatgtgccaaggccttcagccagtttggccacctgaccacccaccgcatcatccacactggagagaagccctacaagtgtgaagaatgtgggaaggccttcatctggcccagcaccctgaccaagcacaagaggatccacactggagagaagccctacaagtgtgaagaatgtgggaaggccttccacaggagcagcaacctgaccaagcacaagatcatccacactggagagaagccctacaagtgtgaagaatgtgggaaggccttcatctggagcagcaacctgacagagcacaagaagatccacacccgggagaagccctacaagtgtgaagaatgttccaaggccttcagccgcagcagcgccctgaccacccacaagaggatgcacactggagagaagccctacaagtgtgaagaatgtgggaaggccttcagccagagcagcaccctgacagcccacaagatcatccacactggagagaagccctacaagtgtgaagaatgtgggaaggccttcatcctgagcagcaccctgagcaagcacaagaggatccacactggagagaagccctacaagtgtgaagaatgtgggaagaccttcaaccagagcagcaacctgagcacccacaagatcatccacactggagagaagccctacaagtgtgaagaatgtgggaaggccttcaacagaagcagcaacctgagcacccacaagatcatccacactggagagaagccctacaagtgtgatgaatgtgggaagagcttcatctggagcagcaccctcttcaagcacaagatcatccacactggagagaagccctacaagtgtgaagaatgtgggaaggccttcaaccacagccagatcctgctgcacatccgccacaagaggatgcacactggagagaagccctacaagtgtgaagaatgtgggaagagcttcaacctgagcagcaccttcatcaagcacaaggtgatccacactggagtgaagctgtacaagtgtgaagaatgtgggaaggtgttcttctggagcagcgccctgaccaggcacaagaagatccacgccggccagcagccctacaagtgggagaagattggcaaggccttcaaccagagcagccacctgaccacagacaagatcacccacatcggggagaagagctacaagtgtgagtag

SEQ ID NO: 18395 - DNA, 327 bp, Artificial Sequence
  Description of Artificial Sequence: Synthetic coding sequence
atgggcctgctgaccttcagagatgtggccatcgagttcagcctggaggagtggcagtgcctggacacagcccagaagaacctgtacagaaatgtgatgctggagaactacagaaacctggccttcctgggcattgctgtgtccaagccagacctgatcatctgcctggagaaggagaaggagccctggaacatgaagagagatgagatggtggatgagcccccaggcctggccgtgagcaacccagacctgatcagctgcctggagcagatcaaggagccctggaatgtgaagagacatgagaccgtggtgaagtacagcggctag

SEQ ID NO: 18396 - DNA, 270 bp, Artificial Sequence
  Description of Artificial Sequence: Synthetic coding sequence
atgggcctgctgaccttcagagatgtggccatcgagttcagcctggaggagtggcagtgcctggacacagcccagaagaacctgtacagaaatgtgatgctggagaactacagaaacctggccttcctgggcattgctgtgtccaagccagacctgatcatctgcctggagaaggagaaggagccctggaacatgaagagagatgagatggtggatgagcccccagatggagtgtccctgtgccaccctggctggagcgctgtggcctag

SEQ ID NO: 18397 - DNA, 234 bp, Artificial Sequence
  Description of Artificial Sequence: Synthetic coding sequence
atgggcctgctgaccttcagagatgtggccatcgagttcagcctggaggagtggcagtgcctggacacagcccagaagaacctgtacagaaatgtgatgctggagaactacagaaacctggccttcctgggcattgctgtgtccaagccagacctgatcatctgcctggagaaggagaaggagccctggaacatgaagagagatgagatggtggatgagcccccaggaagatag

SEQ ID NO: 18398 - DNA, 1851 bp, Artificial Sequence
  Description of Artificial Sequence: Synthetic coding sequence
atgggcctgctgaccttcagagatgtggccatcgagttcagcctggaggagtggcagtgcctggacacagcccagaagaacctgtacagaaatgtgatgctggagaactacagaaacctggccttcctgggcattgctgtgtccaagccagacctgatcatctgcctggagaaggagaaggagccctggaacatgaagagagatgagatggtggatgagcccccaggcatctgcccccactttgcccaggacatctggccagagcagggcgtggaggacagcttccagaaggtgatcctgcggagatttgagaagtgtggccacgagaacctgcagctgaggaagggctgcaagtctgtggatgagtgcaaggtgcacaaggagggctacaacggcctgaaccagtgcttcaccaccacccagggcaaggccagccagtgtgggaagtacctgaaggtgttctacaagttcatcaacctgaaccgctacaagatccgccacaccaggaagaagcccttcaagtgcaagaactgtgtgaagagcttctgcatgttcagccacaagacccagcacaagagcatctacaccacagagaagagctacaagtgcaaggaatgtgggaagaccttcaactggagcagcaccctgaccaaccacaagaagacccacacagaggagaagccctacaagtgtgaggagtatggcaaggccttcaaccagagcagcaactacaccacccacaaggtgacccacactggagagaagccctacaagtgtgaagaatgtgggaaggccttcagccagagcagcaccctgaccatccacaagaggatccacactggagagaagccctgcaagtgtgaagaatgtgggaaggccttcagccagcccagcgccctgaccatccacaagaggatgcacatcggggagaagccctacaagtgtgaagaatgtgggaaggcctttgtgtggagcagcaccctgaccaggcacaagaggctgcacagcggggagaagccctacaagtgtgaagaatgtgccaaggccttcagccagtttggccacctgaccacccaccgcatcatccacactggagagaagccctacaagtgtgaagaatgtgggaaggccttcatctggcccagcaccctgaccaagcacaagaggatccacactggagagaagccctacaagtgtgaagaatgtgggaaggccttccacaggagcagcaacctgaccaagcacaagatcatccacactggagagaagccctacaagtgtgaagaatgtgggaaggccttcatctggagcagcaacctgacagagcacaagaagatccacacccgggagaagccctacaagtgtgaagaatgttccaaggccttcagccgcagcagcgccctgaccacccacaagaggatgcacactggagagaagccctacaagtgtgaagaatgtgggaaggccttcagccagagcagcaccctgacagcccacaagatcatccacactggagagaagccctacaagtgtgaagaatgtgggaaggccttcatcctgagcagcaccctgagcaagcacaagaggatccacactggagagaagccctacaagtgtgaagaatgtgggaagaccttcaaccagagcagcaacctgagcacccacaagatcatccacactggagagaagccctacaagtgtgaagaatgtgggaaggccttcaacagaagcagcaacctgagcacccacaagatcatccacactggagagaagccctacaagtgtgatgaatgtgggaagagcttcatctggagcagcaccctcttcaagcacaagaggatccacacctag

SEQ ID NO: 18399 - DNA, 3759 bp, Artificial Sequence
  Description of Artificial Sequence: Synthetic coding sequence
atgcctggggcccctggcagcctggagatgggccccctgaccttcagagatgtgaccatcgagttcagcctggaggagtggcagtgcctggacacagtgcagcagaacctgtacagagatgtgatgctggagaactacagaaacctggtgttcctgggcatggctgtgttcaagccagacctgatcacctgcctgaagcagggcaaggagccctggaacatgaagagacatgagatggtgaccaagccccctgtgatgaggagccacttcacccaggacctgtggccagaccagagcaccaaggacagcttccaggaggtgatcctgcggacctacgcccgctgtggccacaagaacctgcggctgaggaaggactgcaagagcgccaatgaaggcaagatgcacaaggagggctacaacaagctgaaccagtgcaggacagccacccagaggaagatcttccagtgcaacaagcacatgaaggtgttccacaagtacagcaacagaaacaaggtgcgccacaccaagaagaagaccttcaagtgcatcaagtgcagcaagagcttcttcatgctgagctgcctgatccgccacaagaggatccacatccggcagaacatctacaagtgtgaggagcggggcaaggccttcaagagcttcagcaccctgaccaagcacaagatcatccacacagaggacaagccctacaagtacaagaagtgtggaaatgccttcaagttcagcagcaccttcaccaagcacaagaggatccacactggagagacccccttccgctgtgaggagtgtgggaaggccttcaaccagagcagcaacctgacagaccacaagaggatccacactggagagaagacctacaagtgtgaggagtgtgggaaggccttcaagggcagcagcaacttcaatgcccacaaggtgatccacacagctgagaagccctacaagtgtgaggactgtgggaagaccttcaaccacttcagcgccctgaggaagcacaagatcatccacacaggcaagaagccctacaagcgggaggagtgtgggaaggccttcagccagagcagcaccctgaggaagcatgagatcatccacactggagagaagccctacaagtgtgaggagtgtgggaaggccttcaagtggagcagcaagctgactgtgcacaaggtggtgcacactggagagaagccctacaagtgtgaggagtgtgggaaggccttcagccagttcagcaccctgaagaagcacaagatcatccacacaggcaagaagccctacaagtgtgaggagtgtgggaaggccttcaacagcagcagcaccctgatgaagcacaagatcatccacactggagagaagccctacaagtgtgaggagtgtgggaaggccttccggcagagcagccacctgaccaggcacaaggccatccacactggagagaagccctacaagtgtgaggagtgtgggaaggccttcaaccacttcagtgacctgcggcggcacaagatcatccacacaggcaagaagccctacaagtgtgaggagtgtgggaaggccttcagccagagcagcaccctgaggaaccaccagatcatccacactggagagaagccctacaagtgtgaggagtgtgggaaggccttcaagtggagcagcaagctgactgtgcacaaggtgatccacactggagagaagccctgcaagtgtgaggagtgtgggaaggccttcaagcacttcagcgccctgaggaagcacaaggtgatccacacccgggagaagctgtacaagtgtgaggagtgtgggaaggccttcaacaacagcagcatcctggccaagcacaagatcatccacacaggcaagaagccctacaagtgtgaggagtgtgggaaggccttccggcagagcagccacctgaccaggcacaaggccatccacactggagagaagccctacaagtgtgaggagtgtgggaaggccttcagccacttcagcgccctgcggcggcacaagatcatccacacaggcaagaagccctacaagtgtgaggagtgtgggaaggccttcagccacttcagcgccctgcggcggcacaagatcatccacactggagagaagccctacaagtgtgaggagtgtgggaaggccttcaagtggagcagcaagctgactgtgcacaaggtgatccacacagctgagaagccctgcaagtgtgaggagtgtgggaagagcttcaagcacttcagcgccctgaggaagcacaaggtgatccacacccgggagaagctgtacaagtgtgaggagtgtgtgaaggccttcaacagcttcagcgccctgatgaagcacaaggtgatccacactggagagaagccctacaagtgtgaggagtgtgggaaggccttcaagtggagcagcaagctgactgtgcacaaggtgatccacactggagagaagccctgcaagtgtgaggagtgtgggaaggccttcaagcacttcagcgccctgaggaagcacaaggtgatccacacaggcaagaagccctacaagtgtgaggagtgtgggaaggccttcagccagagcagcagcctgaggaagcatgagatcatccacagcggggagaagccctacaagtgtgaggagtgtgggaaggccttcaagtggctgagcaagctgactgtgcacaaggtgatccacacagctgagaagccctgcaagtgtgaggagtgtgggaaggccttcaagcacttcagcgccctgaggaagcacaagatcatccacacaggcaagaagccctacaagtgtgaggagtgtgggaaggccttcaatgacagcagcaccctgatgaagcacaagatcatccacacaggcaagaagccctacaagtgtgccgagtgtgggaaggccttcaagcagagcagccacctgaccaggcacaaggccatccacactggagagaagccctacaagtgtgaggagtgtgggaaggacttcaacaacagcagcaccctgaagaagcacaagctgatccacacccgggagaagctgtacaagtgtgaggagtgtgtgaaggccttcaacaacttcagcgccctgatgaagcacaagatcatccacactggagagaagccctacaagtgtgaggagtgtgggaaggccttcaagtggagcagcaagctgacagagcacaaggtgatccacactggagagaagccctgcaagtgtgaggagtgtgacaaggccttcaagcacttcagcgccctgaggaagcacaaggtgatccacacaggcaagaagccctaccagtgtgatgaatgtgggaaggccttcaacaacagcagcaccctgaccaagcacaagatcatccacactggagagaagccctacaagtgtgaggagtgtgggaaggccttcagccagagcagcatcctgaccaagcacaagatcatccacagcgtggagaagccctacaagtgtgaggagtgtgggaaggccttcaaccagagcagccacctgaccaggcacaagaccatccacactggagagaagccctacaagtgtgaggagtgtgggaaggccttcatccagtgcagctacctgatccgccacaagaccatccacacccgggagaagcccaccaacgtgaagaaggtgcccaagctgctgagcaacccccacaccctgctggacaagaccatccacactggagagaagccctacaagtgtgaagaatgtgccaaggccttctag

SEQ ID NO: 18400 - DNA, 1512 bp, Artificial Sequence
  Description of Artificial Sequence: Synthetic coding sequence
atgggcgccctgaccttcagagatgtggccatcgagttcagcctggaggagtggcagtgcctggacacagagcagcagaacctgtacagaaatgtgatgctggacaactacagaaacctggtgttcctgggcattgctgtgtccaagccagacctgatcacctgcctggagcaggagaaggagccctggaacctgaagacccatgacatggtggccaagccccctgtgatctgcagccacatcgcccaggacctgtggccagagcagggcatcaaggactacttccaggaggtgatcctgcggcagtacaagaagtgcagacatgagaacctgctgctgaggaagggctgcaagaatgtggatgagttcaagatgcacaagaagggctacaacagacacaaccagtgcctgaccaccagccacagcaagatcttccagtgtgacaagtatgtgaaggtgttccacaagttcagcaacagcaacagacacaagatccgccacaccagcaagaagcccttcaagtgcaaggaatgtgggaagctgttctgcatcctgagccacctggcccagcacaagaagatccacactggagagaagagctacaagtgtgaggagtatggcaaggccttcaatgaaagcagcaactgcaccacccacaagaggatcacagagaagaagccctacaagtgcaaggaatgtgggaaggccttcaactggttcagccacttcaccacccacaagaggatccacactggagagaagccctaccagtgtgagaagtgtgggaagttcttcaaccagagcaccaacctgaccacccacaagaggatccacactggagagaagccctacaagtgtgaggagtgtgggaaggccttcaaccagagcagcaacctgacagagcacaagaagatccacaccaaggagcagccctacaagtgtgagaagtgtgggaaggccttcaagtggagcagcaccctgaccaagcacaagaggatccacaatggagagaagccctacaagtgtgaggagtgtgggaaggccttcaacagaagcagcaccctgaacagacacaagatcacccacactggaggcaagccctacaagtacaaggaatgtgggaaggccttcaaccagagcagcaccctgaccatccacaagatcatccacacagtggagaagttctacaagtgtgaggagtgtgggaaggccttcagccgcatcagccacctgaccacccacaagaggatccacactggagagaagccctacaagtgtgaggagtgtggccgggccttcaaccagagcagcaccctgaccacccacaagaggatccacactggagagaagccctatgaatgtgaggagtgtgggaaggccttcaacagaagcagcaccctgaccacccacaagatcatccacagcggggagaagatctacaagtgcaaggaatgtgggaaggccttccgccgcttcagccacctgaccaggcacaagaccatccacacctag

SEQ ID NO: 18401 - DNA, 1758 bp, Artificial Sequence
  Description of Artificial Sequence: Synthetic coding sequence
atggagctgctgaccttcagagatgtggccatcgagttcagccctgaggagtggaagtgcctggaccctgcccagcagaacctgtacagagatgtgatgctggagaactacagaaacctgatcagcctgggcgtggccatcagcaacccagacctggtgatctacctggagcagaggaaggagccctacaaggtgaagatccacgagaccgtggccaagcaccctgctgtgtgcagccacttcacccaggacttcctgcctgtgcagggcatcgaggacagcttccacaagctgatcctgcggcgctatgaaaaatgtggccacgagaacctggagctgaggaagagctgcaagaggaaggtgcagaagggcggctacaatgagttcaaccagtgcctgagcaccatccagagcaagatcttccagtgcaatgtgcacgtgaaggtgttcagcaccttcagcaacagcaaccagaggcgcatccgccacactggagagaagcacttcaaggaatgtgggaagagcttccagaagttcagtgacctgacccagcaccagggcatccacgccggggagaagccctacacctgtgaagaatgtgggaaggacttcaagtggtacctgatcttcaatgaatatgagatcatccacactggagagaagcccttcacctgtgaagaatgtggcaacatcttcaccaccagcagcaactttgccaagcacaaggtgcacactggagagaagagctacaagtatgaggagtgtgggaaggccttcaacagaagcagcaccctgaccaagcacaagagaattcatgctgaggagaagcccttcacctgtgaggagtgtgggaagatcatcaccagcagcagcaatgtggccaagcacaagaagatccacactggagagaagctgtacaagtgccaggagtgtgggaaggtgttcaacagaagcaccaccctgaccaagcacaaccgcatccacactggagagaagccctacacctgtgaggagtgtgggaaggccttcagccgcagctctgtgctgaatgagcacaagaggatccacactggagagaagccctacaagtgtgagcagtgtgggaaggccttccggcagagcgccaccctgaacaagcacaagagcatccacactggagagaagccctacacctgtgaggagtgtgggaaggccttcagccgcttcaccaccctgaatgagcacaagaggatccacactggagagcggccccacaagtgtgaggagtgtgggaaggccttcggctggagcacagacctgaacaagcacaagatcatccacactggagagaagccctacaagtgtgaggagtgtgggaaggccttcggctggagcgcctacctgagcaagcacaagaagatccacactggagagaagccctaccgctgtgaggagtgtgggaaggccttcctgtgcagccgggccctgaacaagcacaagaccatccacactggagagaagccctatgaatgtgaggagtgtgggaaggccttcggctggagcacctacctgagcaagcacaagaagatccacactggagagaagccctaccgctgtgaggagtgtgggaaggccttccgccgcagccgggtgctgaacaagtacaagaccatccacactggagacaagacccccaagtgcaagggctgcggcaaggccttcaagtggagcagctacctgaaccagcacaacaagatctacacaggagagaagctgtag

SEQ ID NO: 18402 - DNA, 1284 bp, Artificial Sequence
  Description of Artificial Sequence: Synthetic coding sequence
atgggcgtgctgaccttcagagatgtggccgtggagttcagccctgaggagtgggagtgcctggacagcgcccagcagaggctgtacagagatgtgatgctggagaactacggcaacctggtgtccctgggcctggccatcttcaagccagacctgatgacctgcctggagcagaggaaggagccctggaaggtgaagaggcaggaggccgtggccaagcaccctgctggcagcttccacttcaccgctgagatcctgcctgaccatgacatcaaggacagcttccagaaggtgatcctgaggaaatatggcagctgtgacctgaacaacctgcacctgaagaaggactaccagagcgtgggcaactgcaagggccagaagagcagctacaacggcctgcaccagtgcctgagcgccacccacagcaagacctgccagtgcaacaagtgtggccggggcttccagctgtgcagcatcttcacagagcacaaggacatcttcagccgggagaagtgccacaagtgtgaagaatgtgggaaggactgccgcctcttcagtgacttcaccaggcacaagaagatccacacagtggagcgctgctacaagtgtgaagaatgtgggaaggccttcaagaagttcagcaacctgacagagcacaagagggtgcacactggagagaagccctacaagtgtgagggctgtgggaagaccttcacctgcagcagcaccctggtgaagcacaagaggaaccacactggagaccggccctacaagtgtgaagaatgtgggaaggccttcaagtgcttcagtgacctgaccaaccacaagaggatccacactggagagaagccctacaagtgtgaggagtgcaacaaggcctaccgctggttcagtgacctggccaagcacaagatcatccacactggagacaagccctacacctgcaatgaatgtgggaaggccttcaagtggttcagcgccctgagcaagcacaagaggatccacactggagagaagccctacatctgtgaagaatgtgggaaggccttcaccaggagcagcaccctcttcaaccacaagaggatccacatggaggagcggccctacaagtgtgaagaatgttccaagaccttcaagtgcttcagtgacctgaccaaccacaagaggatccacactggagagaagccctacaagtgtgaagaatgtgggaaggccagctcctggttcagccacctgatccgccacaagaggatccacacccgggagaagctgcacaagtgctag

SEQ ID NO: 18403 - DNA, 1284 bp, Artificial Sequence; identical to SEQ ID NO: 18402
  Description of Artificial Sequence: Synthetic coding sequence

SEQ ID NO: 18404 - DNA, 414 bp, Artificial Sequence
  Description of Artificial Sequence: Synthetic coding sequence
atggatgacctgcgctatggagtgtaccctgtgaagggggccagcggctacccaggagctgagaggaacctgctggagtacagctactttgagaagggccccctgaccttcagagatgtggtgattgagttcagccaggaggagtggcagtgcctggacacagcccagcaggacctgtacaggaaggtgatgctggagaacttcaggaacctggtgttcctgggcattgatgtgtccaagccagacctgatcacctgcctggagcagggcaaggacccctggaacatgaagaggcacagcatggtggccaccccacctgagagcggcgtgctgaagttccccaccatcatcatcctgctgagccgctgcttcttccagagcgtgaacatctgcttcatctacctggagccctag

SEQ ID NO: 18405 - DNA, 354 bp, Artificial Sequence
  Description of Artificial Sequence: Synthetic coding sequence
atggatgacctgcgctatggagtgtaccctgtgaagggggccagcggctacccaggagctgagaggaacctgctggagtacagctactttgagaagggccccctgaccttcagagatgtggtgattgagttcagccaggaggagtggcagtgcctggacacagcccagcaggacctgtacaggaaggtgatgctggagaacttcaggaacctggtgttcctgggcattgatgtgtccaagccagacctgatcacctgcctggagcagggcaaggacccctggaacatgaagaggcacagcatggtggccaccccaccagatggagtgtccctgctcttccccaggcctgagtag

SEQ ID NO: 18406 - DNA, 582 bp, Artificial Sequence
  Description of Artificial Sequence: Synthetic coding sequence
atggcccaggccagcctgctggcctgtgagggcctggccggcgtgtccctggtgcccacagctgccagcaagaagatgatgctgagccagatcgccagcaagcaggctgaaaatggagagcgggccggcagcccagatgtgctgcgctgcagcagccagggccacaggaaggacagcgacaagagccgcagcaggaaggatgatgacagcctgtctgaggccagccacagcaagaagacagtgaagaaggtggtggtggtggagcagaatggcagcttccaggtgaagatccccaagaactttgtgtgtgagcactgctttggagccttccgcagcagctaccacctgaagaggcacatcctgatccacactggagagaagccctttgaatgtgacatctgtgacatgaggttcatccagaagtaccacctggagcggcacaagagggtgcacagcggggagaagccctaccagtgtgagcgctgccaccagtgcttcagcaggacagaccggctgctgcggcacaagaggatgtgccagggctgccagagcaagaccagtgatggccagttcagcctgtag

SEQ ID NO: 18407 - DNA, 2337 bp, Artificial Sequence
  Description of Artificial Sequence: Synthetic coding sequence
atgaacctgacagaggactgcatggtgtttgaagatgtggccatctacttcagccaggaggagtggggcatcctgaatgatgcccagaggcacctgcacagcaatgtgatgctggagaactttgccctgctgagctctgtgggctgctggcatggagccaaggatgaggaggtgcccagcaagcagtgtgtgtctgtgcgggtgctgcaggtgaccatccccaagccagccctgagcaccctgaaggcccagccctgcaagatgtgcagcagcatcctgaaggacatcctgcacctggccgagcatgatggcacccaccctgagcagggcctgtacacctgtgccgctgagcatgacctgcaccagaaggagcagatccgggagaagctgaccaggagtgatgagtggaggcccagctttgtgaaccacagcgcccacgtgggggagaggaacttcacctgcacccagggcggcaaggacttcaccgccagcagtgacctgctgcagcagcaggtgctgaacagcggctggaagctgtacagagacacccaggatggagaggccttccagggcgagcagaatgacttcaacagcagccagggcggcaaggacttctgccaccagcacggcctgtttgagcaccagaagacccacaatggagagcggccctatgagttctctgaatgtggggagctgttccgctacaacagcaacctgatcaagtaccagcagaaccacgccggggagcggccctatgagggcacagaatatggcaagaccttcatcaggaagagcaacctggtgcagcaccagaagatccacagcgagggcttcctgagcaagagaagtgaccccatcgagcaccaggagatcctgagccggcccaccccctatgaatgtacccagtgtgggaaggccttcctgacccaggcccacctggtgggccaccagaagacccacactggagagcagccctatgagtgcaacaagtgtgggaagttcttcatgtacaacagcaagctgatccgccaccagaaggtgcacactggagagcggcgctatgaatgttctgaatgtgggaagctgttcatggacagcttcaccctgggccgccaccagagggtgcacactggagagcggccctttgaatgttccatctgtgggaagttcttcagccacaggagcaccctgaacatgcaccagagggtgcatgctgggaagaggctgtacaagtgcagtgaatgtgggaaggccttcagcctgaagcacaacgtggtgcagcacctgaagatccacactggagagcggccctatgaatgtacagaatgtgagaaggcctttgtgaggaagagccacctggtgcagcaccagaagatccacacagatgccttcagcaagagaagtgacctgatccagcacaagagaattgacatccggccccggccctacacctgcagtgaatgtgggaaggccttcctgacccaggcccacctggtgggccaccagaagatccacactggagagcggccctatgagtgcacccagtgtgccaaggcctttgtgaggaagagccacctggtgcagcacgagaagatccacacagatgccttcagcaagagaagtgacctgatccagcacaagagaattgacctgcggccccggccctacgtgtgcagtgaatgtgggaaggccttcctgacccaggcccacctggatggccaccagaagatccagacaggagagcggcgctatgaatgtaatgaatgtgggaagttcttcctggacagctacaagctggtgatccaccagaggatccacactggagagaagccctacaagtgcagcaaatgtgggaagttcttccgctaccgctgcaccctgagccgccaccagaaggtgcacactggagagcggccctatgaatgttctgaatgtgggaagttcttccgggacagctacaagctgatcatccaccagagggtgcacactggagagaagccctatgaatgtagcaactgtgggaagttcctgcgctaccgcagcaccttcatcaagcaccacaaggtgtgcacaggagagaagccccatgaatgttccaagtgccgggagctgttccgcaccaagagcagcctcatcatccaccagcagagccacactggagagagccccttcaagctgcgggagtgtgggaaggacttcaacaagtgcaacacaggccagaggcagaagacccacactggagagaggagctatgaatgtggggagagcagcaaggtgttcaagtacaacagcagcctcatcaagcaccagatcatccacacaggcaagaggccctag

SEQ ID NO: 18408 - DNA, 1194 bp, Artificial Sequence
  Description of Artificial Sequence: Synthetic coding sequence
atgatgttccaggaccctgtggcctgtgaagatgtggccgtgaacttcacccaggaggagtgggccctgctggacatcagccagaggaagctgtaccgggaggtgatgctggagaccttcaggaacctgaccagcatcggcaagaagtggaaggaccagaacattgaatatgagtaccagaaccccaggaggaacttccgcagcctcatcgagggcaatgtgaatgagatcaaggaggacagccactgtggggagaccttcacccaggtgcctgatgaccggctgaacttccaggagaagaaggccagccctgaggccaagagctgtgacaactttgtgtgtggggaggtgggcatcggcaacagcagcttcaacatgaacatccggggggacatcggccacaaggcctatgagtaccaggactatgcccccaagccctacaagtgccagcagcccaagaaggccttccgctaccaccccagcttccgcacccaggagaggaaccacactggagagaagccctatgcctgcaaggaatgtgggaagaccttcatcagccacagcggcatcagaagaaggatggtgatgcacagcggagatggcccctacaagtgcaagttctgtgggaaggctgtgcactgcctgcggctgtacctgattcatgagaggacccacactggagagaagccctatgagtgcaagcagtgtgtgaagagcttctcctacagcgccacccaccgcatccacgagaggacccacactggagagaagccctatgagtgccagcagtgtgggaaggccttccacagcagcagcagcttccaggcccacaagaggacccacactggaggcaagccctatgagtgcaagcagtgtgggaagagcttctcctggtgccacagcttccagatccacgagaggacccacactggagagaagccctgtgagtgcagcaagtgcaacaaggccttccgcagctaccgcagctacctgcggcacaagaggagccacactggagagaagccctaccagtgcaaggaatgtaggaaggccttcacctaccccagcagcctgcggagacatgagaggacccacagcgccaagaagccctatgagtgcaagcagtgtgggaaggccctgagctacaagttcagcaacacccccaagaatgccctgtggaggaagaccctgtag

SEQ ID NO: 18409 - DNA, 1185 bp, Artificial Sequence
  Description of Artificial Sequence: Synthetic coding sequence
atggaccctgtggcctgtgaagatgtggccgtgaacttcacccaggaggagtgggccctgctggacatcagccagaggaagctgtaccgggaggtgatgctggagaccttcaggaacctgaccagcatcggcaagaagtggaaggaccagaacatcgagtatgagtaccagaaccccaggaggaacttccgcagcctgattgagggcaatgtgaatgagatcaaggaggacagccactgtggggagaccttcacccaggtgcctgatgaccggctgaacttccaggagaagaaggccagccctgaggccaagagctgtgacaactttgtgtgtggggaggtgggcatcggcaacagcagcttcaacatgaacatccggggggacatcggccacaaggcctatgagtaccaggactatgcccccaagccctacaagtgccagcagcccaagaaggccttccgctaccaccccagcttccgcacccaggagaggaaccacactggagagaagccctatgcctgcaaggaatgtgggaagaccttcatcagccacagcggcatcagaagaaggatggtgatgcacagcggagatggcccctacaagtgcaagttctgtgggaaggctgtgcactgcctgcggctgtacctgatccacgagaggacccacactggagagaagccctatgagtgcaagcagtgtgtgaagagcttctcctacagcgccacccaccgcatccacgagaggacccacactggagagaagccctatgagtgccagcagtgtgggaaggccttccacagcagcagcagcttccaggcccacaagaggacccacactggaggcaagccctatgagtgcaagcagtgtgggaagagcttctcctggtgccacagcttccagatccacgagaggacccacactggagagaagccctgtgaatgttccaagtgcaacaaggccttccgcagctaccgcagctacctgcggcacaagaggagccacactggagagaagccctaccagtgcaaggagtgcaggaaggccttcacctaccccagcagcctgcggagacatgagaggacccacagcgccaagaagccctatgagtgcaagcagtgtgggaaggccctgagctacaagttcagcaacacccccaagaatgccctgtggaggaagaccctgtag

SEQ ID NO: 18410 - DNA, 1245 bp, Artificial Sequence
  Description of Artificial Sequence: Synthetic coding sequence
atgccctgctgcagccacaggagctgcagagaagatcctggcaccagcgagagccgggagatggaccctgtggcctgtgaagatgtggccgtgaacttcacccaggaggagtgggccctgctggacatcagccagaggaagctgtaccgggaggtgatgctggagaccttcaggaacctgaccagcatcggcaagaagtggaaggaccagaacatcgagtatgagtaccagaaccccaggaggaacttccgcagcctgattgagggcaatgtgaatgagatcaaggaggacagccactgtggggagaccttcacccaggtgcctgatgaccggctgaacttccaggagaagaaggccagccctgaggccaagagctgtgacaactttgtgtgtggggaggtgggcatcggcaacagcagcttcaacatgaacatccggggggacatcggccacaaggcctatgagtaccaggactatgcccccaagccctacaagtgccagcagcccaagaaggccttccgctaccaccccagcttccgcacccaggagaggaaccacactggagagaagccctatgcctgcaaggaatgtgggaagaccttcatcagccacagcggcatcagaagaaggatggtgatgcacagcggagatggcccctacaagtgcaagttctgtgggaaggctgtgcactgcctgcggctgtacctgatccacgagaggacccacactggagagaagccctatgagtgcaagcagtgtgtgaagagcttctcctacagcgccacccaccgcatccacgagaggacccacactggagagaagccctatgagtgccagcagtgtgggaaggccttccacagcagcagcagcttccaggcccacaagaggacccacactggaggcaagccctatgagtgcaagcagtgtgggaagagcttctcctggtgccacagcttccagatccacgagaggacccacactggagagaagccctgtgaatgttccaagtgcaacaaggccttccgcagctaccgcagctacctgcggcacaagaggagccacactggagagaagccctaccagtgcaaggagtgcaggaaggccttcacctaccccagcagcctgcggagacatgagaggacccacagcgccaagaagccctatgagtgcaagcagtgtgggaaggccctgagctacaagttcagcaacacccccaagaatgccctgtggaggaagaccctgtag

SEQ ID NO: 18411 - DNA, 819 bp, Artificial Sequence
  Description of Artificial Sequence: Synthetic coding sequence
atgaacatccggggggacatcggccacaaggcctatgagtaccaggactatgcccccaagccctacaagtgccagcagcccaagaaggccttccgctaccaccccagcttccgcacccaggagaggaaccacactggagagaagccctatgcctgcaaggaatgtgggaagaccttcatcagccacagcggcatcagaagaaggatggtgatgcacagcggagatggcccctacaagtgcaagttctgtgggaaggctgtgcactgcctgcggctgtacctgatccacgagaggacccacactggagagaagccctatgagtgcaagcagtgtgtgaagagcttctcctacagcgccacccaccgcatccacgagaggacccacactggagagaagccctatgagtgccagcagtgtgggaaggccttccacagcagcagcagcttccaggcccacaagaggacccacactggaggcaagccctatgagtgcaagcagtgtgggaagagcttctcctggtgccacagcttccagatccacgagaggacccacactggagagaagccctgtgaatgttccaagtgcaacaaggccttccgcagctaccgcagctacctgcggcacaagaggagccacactggagagaagccctaccagtgcaaggagtgcaggaaggccttcacctaccccagcagcctgcggagacatgagaggacccacagcgccaagaagccctatgagtgcaagcagtgtgggaaggccctgagctacaagttcagcaacacccccaagaatgccctgtggaggaagaccctgtag

SEQ ID NO: 18412 - DNA, 1227 bp, Artificial Sequence
  Description of Artificial Sequence: Synthetic coding sequence
atggccccacccctggcccccctgcccccccgggaccccaacggggccggccctgagtggagggagcctggagctgtgtcctttgctgatgtggccgtgtacttctgccgggaggagtggggctgcctgcggcctgcccagagggccctgtacagagatgtgatgagggagacctacggccacctgagcgccctgggcattggaggcaacaagccagccctgatctcctgggtggaggaggaggccgagctgtggggccctgctgcccaggaccctgaggtggccaagtgccagacccagacagatcctgctgacagcaggaacaagaagaaggagcggcagcgggagggcaccggggccctggagaagccagaccctgtggccgccggcagccctggcctgaagagcccccaggcccccagcgctggccccccctacggctgggagcagctgagcaaggccccccaccggggccggcccagcctgtgtgcccacccccctgtgcccagggctgaccagagacatggctgctacgtgtgtgggaagagctttgcctggaggagcaccctggtggagcacgtgtacagccacactggagagaagcccttccactgcacagactgtgggaagggcttcggccacgccagcagcctgagcaagcaccgggccatccacagaggagagcggccccaccgctgcctggagtgtggccgggccttcacccagaggtctgccctgaccagccacctgcgggtgcacactggagagaagccctacggctgtgccgactgtggccgccgcttcagccagagcagcgccctgtaccagcaccggcgggtgcacagcggggagacccccttcccctgcccagactgtggccgggcctttgcctaccccagcgacctgcggagacatgtgaggacccacactggagagaagccctacccctgcccagactgtggccgctgcttccggcagagcagcgagatggccgcccacaggaggacccacagcggggagaagccctacccctgcccccagtgtggccgccgcttcggccagaagtctgctgtggccaagcaccagtgggtgcacaggcctggagctgggggccaccggggccgggtggccggccgcctgtctgtgaccctgaccccaggccacggggacctggacccccctgtgggcttccagctgtacccagagatcttccaggagtgtggctag

SEQ ID NO: 18413 - DNA, 1224 bp, Artificial Sequence
  Description of Artificial Sequence: Synthetic coding sequence
atggccccacccctggcccccctgcccccccgggaccccaacggggccggccctgagtggagggagcctggagctgtgtcctttgctgatgtggccgtgtacttctgccgggaggagtggggctgcctgcggcctgcccagagggccctgtacagagatgtgatgagggagacctacggccacctgagcgccctgggcattggaggcaacaagccagccctgatctcctgggtggaggaggaggccgagctgtggggccctgctgcccaggaccctgaggtggccaagtgccagacccagacagatcctgacagcaggaacaagaagaaggagcggcagcgggagggcactggagccctggagaagccagaccctgtggccgccggcagccctggcctgaagagcccccaggcccccagcgctggccccccctacggctgggagcagctgagcaaggccccccaccggggccggcccagcctgtgtgcccacccccctgtgcccagggctgaccagagacatggctgctacgtgtgtgggaagagctttgcctggaggagcaccctggtggagcacgtgtacagccacactggagagaagcccttccactgcacagactgtgggaaaggatttggacatgccagcagcctgagcaagcaccgggccatccacagaggagagcggccccaccgctgcctggagtgtggccgggccttcacccagaggtctgccctgaccagccacctgcgggtgcacactggagagaagccctacggctgtgccgactgtggccgccgcttcagccagagcagcgccctgtaccagcacagaagagtgcacagcggggagacccccttcccctgcccagactgtggccgggcctttgcctaccccagcgacctgcggcggcacgtgaggacccacactggagagaagccctacccctgcccagactgtggccgctgcttccggcagagcagcgagatggccgcccacaggaggacccacagcggggagaagccctacccctgcccccagtgtggcagaagatttggccagaagtctgctgtggccaagcaccagtgggtgcacaggcctggggccggcggccaccggggccgggtggccggccgcctgtctgtgaccctgaccccaggccatggagacctggacccccctgtgggcttccagctgtacccagagatcttccaggagtgtggctag

SEQ ID NO: 18414 - DNA, 21 bp, Artificial Sequence
  Description of Artificial Sequence: Synthetic coding sequence
atgatgaaggagttctcctag

SEQ ID NO: 18415 - DNA, 1572 bp, Artificial Sequence
  Description of Artificial Sequence: Synthetic coding sequence
atggccctgccccagggcctgctgaccttcagagatgtggccatcgagttcagccaggaggagtggaagtgcctggaccctgcccagaggaccctgtacagagatgtgatgctggagaactacagaaacctggtgtccctggacatcagcagcaagtgcatgatgaaggagttcagcagcacagcccagggcaaccgggaggtgttccacgccggcaccagccagagacatgagagccaccacaacggggacttctgcttccaggacatcgacaaggacatccatgacatcgagttccagtggcaggaggatgaaagaaatggacatgaggccctgatgaccaagatcaagaagctgaccggcagcacagaaagatatgaccagaactatgccggcaacaagcctgtgaagtaccagctgggcttctccttccacagccacctgcctgagctgcacatcttccacacagaggagaagattgacaaccaggtggtgaagagcatccatgatgccagcctggtgtccacagcccagaggatcagctgcaggcctgagacccacatcagcaatgactatggcaacaacttcctgaacagcagcctcttcacccagaagcaggaggtgcacatgagggagaagagcttccagtgcaatgacagcggcaaggcctacaactgcagcagcctgctgaggaagcaccagctgatccacctgggggagaagcagtacaagtgtgacatctgtgggaaggtgttcaacagcaagagatatgtggcccggcaccggcgctgccacactggagagaagccctacaagtgcaatgaatgtgggaagaccttcagccagacctactacctgacctgccaccggcggctgcacactggagagaagccctacaagtgtgaagaatgtgacaaggccttccacttcaagagcaagctgcagatccaccggcgcatccacactggagagaagccctacaagtgcaatgaatgtgggaagaccttcagccagaagagctacctgacctgccaccggcggctgcacactggagagaagccctacaagtgcaatgaatgtgggaagaccttcagcaggaagagccacttcacctgccaccaccgggtgcacactggagagaagccctacaagtgcaatgaatgttccaagaccttcagccacaagagcagcctgacctaccaccggcggctgcacacagaggagaagccctacaagtgcaatgaatgtgggaagaccttcaaccagcagctgaccctgaacatctgccgcctgcacagcggggagaagccctacaagtgtgaggagtgtgacaaggcctacagcttcaagagcaacctggagatccaccagaagatccacacagaggagaacccctacaagtgcaatgaatgtgggaagaccttcagcaggaccagcagcctgacctaccaccaccggctgcacacaggccagaagccctacaagtgtgaggactgtgatgaggccttctccttcaagagcaacctggagcggcaccggcgcatctacacaggagagaagctgcacgtgtag

SEQ ID NO: 18416 - DNA, 387 bp, Artificial Sequence
  Description of Artificial Sequence: Synthetic coding sequence
atgatgaaggagttcagcagcacagcccagggcaaccgggaggtgttccacgccggcaccagccagagacatgagagccaccacaatggagacttctgcttccaggacatcgacaaggacatccatgacatcgagttccagtggcaggaggatgaaagaaatggccacgaggccctgatgaccaagatcaagaagctgaccggcagcacagaaagatatgaccagaactatgccggcaacaagcctgtgaagtaccagctgggcttctccttccacagccacctgcctgagctgcacatcttccacacagaggagaagattgacaaccaggtggtgaagagcatccatgatgccagcctggtgtccacagcccagaggatctcctag

SEQ ID NO: 18417 - DNA, 1416 bp, Artificial Sequence
  Description of Artificial Sequence: Synthetic coding sequence
atgctgtgtgagggggaggcccagaagaggaaggccgaggagagcggcatgcccctgacccagggccacctgaccttcagagatgtggccatcgagttcagccaggaggagtggaagtgcctggaccctgtgcagaaggccctgtacagagatgtgatgctggagaactacagaaacctggtgtccctgggcatctgcctgcctgacctgagcatcatctccatgatgaagcagaggacagagccctggacagtggagaatgagatgaaggtggccaagaacccagaccgctgggagggcatcaaggacatcaacacaggccgcagctgtgctgtgcgcagcaaggccggcaacaagcccatcaccaaccagctgggcctgaccttccagctgcccctgcctgagctggagatcttccagggcgagggcaagatctatgagtgcaaccaggtgcagaagttcatcagccacagcagctctgtgagccccctgcagaggatctacagcggcgtgaagacccacatcttcaacaagcacagaaatgactttgtggacttccccctgctgagccaggagcagaaggcccacatccggaggaagccctatgaatgtaatgagcagggcaaggtgttccgggtgagcagcagcctgcccaaccaccaggtgatccacacagctgacaagcccaaccgctgccatgaatgtgggaagacagtgcgggacaagagcggcctggccgagcactggaggatcagaactggagagaagccctacaagtgcaaggaatgtgggaagctgttcaaccgcatcgcctacctggcccggcatgagaaggtgcacactggagagagcccctacaagtgcaatgaatgtgggaaggtgttcagccgcatcacctacctggtgcgccaccagaagatccacacccgggagaagccccacaagtgcaacaagtgtgggaaggtgtacagcagcagcagctacctggcccagcactggaggatccacactggagagaagctgtacaagtgcaacaagtgtgggaaggagttcagcggccacagcagcctgaccacccacctgctgatccacactggagagaagccctacaagtgcaaggaatgtgacaaggccttccgccacaagttcagcctgactgtgcaccagaggaaccacaatggagagaagccctacaagtgccatgaatgtgggaaggtgttcacccaggtgagccacctggcccggcaccagaagatccacactggagagaagccctacaagtgcaatgaatgtgggaaggtgttcacccagaacagccacctggccaaccaccagaggatccacactggagagaagccctacaagtgccacgtgtgtggcctgagcctgtggagcggcaaggagagcgtgaggtag

SEQ ID NO: 18418 - DNA, 1407 bp, Artificial Sequence
  Description of Artificial Sequence: Synthetic coding sequence
atggcccagctgcggcggggccacctgaccttcagagatgtggccatcgagttcagccaggaggagtggaagtgcctggaccctgtgcagaaggccctgtacagagatgtgatgctggagaactacagaaacctggtgtccctgggcatctgcctgcctgacctgagcatcatctccatgatgaagcagaggacagagccctggacagtggagaatgagatgaaggtggccaagaacccagaccgctgggagggcatcaaggacatcaacacaggccgcagctgtgctgtgcgcagcaaggccggcaacaagcccatcaccaaccagctgggcctgaccttccagctgcccctgcctgagctggagatcttccagggcgagggcaagatctatgagtgcaaccaggtgcagaagttcatcagccacagcagctctgtgagccccctgcagaggatctacagcggcgtgaagacccacatcttcaacaagcacagaaatgactttgtggacttccccctgctgagccaggagcagaaggcccacatccggaggaagccctatgagtgcaatgagcagggcaaggtgttccgggtgagcagcagcctgcccaaccaccaggtgatccacacagctgacaagcccaaccgctgccatgaatgtgggaagacagtgcgggacaagagcggcctggccgagcactggaggatcagaactggagagaagccctacaagtgcaaggaatgtgggaagctgttcaacagaattgcctacctggcccggcatgagaaggtgcacactggagagagcccctacaagtgcaatgaatgtgggaaggtgttcagccgcatcacctacctggtgcgccaccagaagatccacacccgggagaagccccacaagtgcaacaagtgtgggaaggtgtacagcagcagcagctacctggcccagcactggaggatccacactggagagaagctgtacaagtgcaacaagtgtgggaaggagttcagcggccacagcagcctgaccacccacctgctgatccacactggagagaagccctacaagtgcaaggaatgtgacaaggccttccgccacaagttcagcctgactgtgcaccagaggaaccacaacggggagaagccctacaagtgccatgaatgtgggaaggtgttcacccaggtgagccacctggcccggcaccagaagatccacactggagagaagccctacaagtgcaatgaatgtgggaaggtgttcacccagaacagccacctggccaaccaccagaggatccacactggagagaagccctacaagtgccacgtgtgtgggaaggtgttccgccacagctcctggtttgtgcagcaccagaggtctgtgcatgagcgggtgctgaccaactag

SEQ ID NO: 18419 - DNA, 1623 bp, Artificial Sequence
  Description of Artificial Sequence: Synthetic coding sequence
atggagcgggaggccctgccctggggcctggagccccaggatgtgcagagcagtgatgagatgaggagccctgagggctacctgcggggcaacatgtctgaaaatgaggaggaggagatcagccagcaggagggcagcggggactatgaggtggaggagatccccttcggcctggagccccagagccctggctttgagccccagagccctgagtttgagccccagagccccaggtttgagcctgagagccctggctttgagagccgcagccctggcctggtgccccccagccctgagtttgcccccaggagccctgagagtgacagccagagccctgagtttgagagccagagccccaggtatgagccccagagccctggctatgagcccaggagccctggctatgagcccaggagccctggctatgagagcgagagcagccgctatgagagccagaacacagagctgaagacccagagccctgagtttgaggcccagagcagcaagttccaggagggcgctgagatgctgctgaaccctgaggagaagagccccctgaacatctctgtgggcgtgcaccccctggacagcttcacccagggctttggagagcagcccactggagacctgcccatcggccccccatttgagatgcccaccggggccctgctgagcaccccccagtttgagatgctgcagaaccccctgggcctgactggagccctgcggggccctggaagaagaggaggccgggcccggggcggccagggcccccggcccaacatctgtggcatctgtgggaagagctttggccggggcagcaccctcatccagcaccagaggatccacactggagagaagccctacaagtgtgaggtgtgcagcaaggccttcagccagagcagtgacctgatcaagcaccagaggacccacactggagagcggccctacaagtgcccccgctgtgggaaggcctttgctgacagcagctacctgctgcggcaccagaggacccacagcggccagaagccctacaagtgcccccactgtgggaaggccttcggggacagcagctacctgctgcggcaccagaggacccacagccatgagcggccctacagctgcacagaatgtgggaagtgctacagccagaacagcagcctgcggagccaccagagggtgcacacaggccagaggcccttcagctgtggcatctgtgggaagagcttcagccagaggtctgccctgatcccccacgcccggagccacgcccgggagaagcccttcaagtgcccagaatgtgggaagcgcttcggccagagctctgtgctggccatccacgcccggacccacctgcccggccgcacctacagctgcccagactgtgggaagaccttcaacagaagcagcaccctcatccagcaccagaggagccacactggagagcggccctaccgctgtgctgtgtgtgggaagggcttctgccgcagcagcaccctgctgcagcaccaccgggtgcacagcggggagcggccctacaagtgtgatgactgtgggaaggccttcagccagagcagtgacctgatccgccaccagaggacccacgccgccggcagaagatag

SEQ ID NO: 18420 - DNA, 1362 bp, Artificial Sequence
  Description of Artificial Sequence: Synthetic coding sequence
atgtctgaaaatgaggaggaggagatcagccagcaggagggcagcggggactatgaggtggaggagatccccttcggcctggagccccagagccctggctttgagccccagagccctgagtttgagccccagagccccaggtttgagcctgagagccctggctttgagagccgcagccctggcctggtgccccccagccctgagtttgcccccaggagccctgagagtgacagccagagccctgagtttgagagccagagccccaggtatgagccccagagccctggctatgagcccaggagccctggctatgagcccaggagccctggctatgaaagtgagagcagccgctatgagagccagaacacagagctgaagacccagagccctgagtttgaggcccagagcagcaagttccaggagggcgctgagatgctgctgaaccctgaggagaagagccccctgaacatctctgtgggcgtgcaccccctggacagcttcacccagggctttggagagcagcccaccggggacctgcccatcggccccccatttgagatgcccactggagccctgctgagcaccccccagtttgagatgctgcagaaccccctgggcctgaccggggccctgcggggccctggccggcggggcggccgggcccggggcggccagggcccccggcccaacatctgtggcatctgtgggaagagctttggccggggcagcaccctcatccagcaccagaggacccacagcggccagaagccctacaagtgcccccactgcggcaaggcctttggagacagcagctacctgctgcggcaccagaggacccacagccatgagcggccctacagctgcacagaatgtgggaagtgctacagccagaacagcagcctgcggagccaccagagggtgcacacaggccagaggcccttcagctgtggcatctgtgggaagagcttcagccagaggtctgccctgatcccccacgcccggagccacgcccgggagaagcccttcaagtgcccagaatgtgggaagagatttggccagagctctgtgctggccatccacgcccggacccacctgcccggccgcacctacagctgcccagactgtgggaagaccttcaacagaagcagcaccctcatccagcaccagaggagccacactggagagcggccctaccgctgtgctgtgtgtgggaagggcttctgccgcagcagcaccctgctgcagcaccaccgggtgcacagcggggagcggccctacaagtgtgatgactgtgggaaggccttcagccagagcagtgacctgatccgccaccagaggacccatgctgctggaagaagatag

SEQ ID NO: 18421 - DNA, 2076 bp, Artificial Sequence
  Description of Artificial Sequence: Synthetic coding sequence
atgatggccgagaacaacctgaagatgctgaagatccagcagtgtgtggtggccaacaagctgcccaggaaccggccctacgtgtgcaacatctgcttcaagcactttgagacccccagcaagctggcccggcactacctgatccacacaggccagaagccctttgaatgtgatgtgtgccacaagaccttccggcagctggtgcacctggagcggcaccagctgacccacagcctgcccttcaagtgcagcatctgccagaggcacttcaagaacctgaagacctttgtgaagcaccagcagctgcacaatgagacctaccagaacaacgtgaagcaggtgcggcggctgctggaggccaagcaggagaagtccatgtatggagtgtacaacaccttcaccacagaggagcgctgggccctgcacccctgcagcaagagtgaccccatgtacagcatgaagaggaggaagaacatccacgcctgcaccatctgtgggaagatgttccccagccagagcaagctggacagacatgtgctgatccacacaggccagaggcccttcaagtgtgtgctgtgcaccaagagcttccggcagagcacccacctgaagatccaccagctgacccacagcgaggagcggcccttccagtgctgcttctgccagaagggcttcaagatccagagcaagctgctgaagcacaagcagatccacaccaggaacaaggccttccgggccctgctgctgaagaagagaagaacagagagccggcccctgcccaacaagctgaatgccaaccagggcggctttgaaaatggagaaattggagagagcgaggagaacaaccccctggatgtgcacagcatctacatcgtgcccttccagtgccccaagtgtgagaagtgctttgaaagtgagcagatcctgaatgagcacagctgctttgctgcccggagcggcaagatccccagccgcttcaagaggagctacaactacaagaccatcgtgaagaagatcctggccaagctgaagagggcccggagcaagaagctggacaacttccagagcgagaagaaggtgttcaagaagagcttcctgaggaactgtgacctgatctctggagagcagagcagcgagcagacccagaggacctttgtgggcagcctgggcaagcacggcacctacaagaccatcggcaacaggaagaagaagaccctgaccctgcccttctcctggcagaacatgggcaagaacctgaagggcatcctgaccacagagaacatcctgagcattgacaacagcgtgaacaagaaggacctgagcatctgtggcagcagcggggaggagttcttcaacaactgtgaggtgctgcagtgtggcttctctgtgccccgggagaacatccgcaccaggcacaagatctgcccctgtgacaagtgtgagaaggtgttccccagcatcagcaagctgaagaggcactacctgatccacacaggccagaggcccttcggctgcaacatctgtgggaagagcttccggcagagcgcccacctgaagagacatgagcagacccacaatgagaagagcccctatgccagcctgtgccaggtggagtttggaaacttcaacaacctgagcaaccacagcggcaacaacgtgaactacaatgccagccagcagtgccaggcccctggggtgcagaagtatgaggtgtctgagagtgaccagatgtctggagtgaaggccgagagccaggacttcatccctggcagcacaggccagccctgcctgcccaacgtgctgctggagagcgagcagagcaaccccttctgcagctacagcgagcaccaggagaagaatgatgtgttcctgtaccgctgcagcgtgtgtgccaagagcttccgcagccccagcaagctggagcggcactacctgattcatgctggccagaagccctttgagtgcagcgtgtgtgggaagaccttccggcaggccccccactggaagaggcaccagctgacccacttcaaggagcggccccagggcaaggtggtggccctggacagcgtgatgtag

SEQ ID NO: 18422 - DNA, 399 bp, Artificial Sequence
  Description of Artificial Sequence: Synthetic coding sequence
atgatggccgagaacaacctgaagatgctgaagatccagcagtgtgtggtggccaacaagctgcccaggaaccggccctacgtgtgcaacatctgcttcaagcactttgagacccccagcaagctggcccggcactacctgatccacacaggccagaagccctttgaatgtgatgtgtgccacaagaccttccggcagctggtgcacctggagcggcaccagctgacccacagcctgcccttcaagtgcagcatctgccagaggcacttcaagaacctgaagacctttgtgaagcaccagcagctgcacaatgagacctaccagaacaacgtgaagcaggtgcggcggctgctggaggccaagcaggagaagtccatgtatggagtgtacaacacctag

SEQ ID NO: 18423 - DNA, 954 bp, Artificial Sequence
  Description of Artificial Sequence: Synthetic coding sequence
atgcctggagagcagcaggccgaggaggaggaggaggaggagatgcaggaggagatggtgctgctggtgaagggggaggaggatgaaggagaggagaagtatgaggtggtgaagctgaagatccccatggacaacaaggaggtgcctggagaggccccagcccccagcgctgaccctgcccggccccacgcctgcccagactgtggccgggcctttgcccggcgcagcaccctggccaagcacgcccggacccacactggagagcggcccttcggctgcacagaatgtggccgccgcttcagccagaagagcgccctgaccaagcacggccgcacccacactggagagcggccctatgagtgcccagaatgtgacaagcgcttctctgctgccagcaacctgcggcagcacagaagaagacacactggagagaagccctatgcctgtgcccactgcggccgccgctttgcccagagcagcaactatgcccagcacctgcgggtgcacactggagagaagccctatgcctgcccagactgtggccgggccttcggcggcagcagctgcctggcccggcacaggaggacccacactggagagcggccctatgcctgtgccgactgtggcaccaggtttgcccagagcagcgccctggccaagcaccggcgggtgcacactggagagaagccccaccgctgtgctgtgtgtggccgccgcttcggccacaggagcaacctggccgagcacgcccggacccacactggagagcggccctacccctgtgctgaatgtggccgccgcttccggctgagcagccacttcatccgccaccggcgggcccacatgagaagaaggctgtacatctgtgccggctgcggccgggacttcaagctgcccccaggggccacagctgccacagccacagagcgctgcccagaatgtgagggcagctag

SEQ ID NO: 18424 - DNA, 954 bp, Artificial Sequence; identical to SEQ ID NO: 18423
  Description of Artificial Sequence: Synthetic coding sequence

SEQ ID NO: 18425 - DNA, 1245 bp, Artificial Sequence
  Description of Artificial Sequence: Synthetic coding sequence
atgaacagcgaggtgattgtggaccccatccagggccaggtgaactttgaagatgtgtttgtgtacttcagccaggaggagtgggtgctgctggatgaggcccagaggctgctgtacagagatgtgatgctggagaactttgccctgatggccagcctgggccacaccagcttcatgagccacatcgtggccagcctggtgatgggcagcgagccctgggtgcctgactgggtggacatgaccctggccgtggccaccggctgctggcacggcatggaggatgaggagatcccctttgagcagagcttcagcatcggcatcttcagcgccaacctgcaccagcaccagaagcagcacagcggggagaagcccttcagaagtgacaagagccggcccttcctgctgaacaactgtgctgtgcagagcatggagatgagctttgtgactggagaggcctgcaaggacttcctggccagcagcagcatctttgagcaccacgccccccacaatgagtggaagccccacagcaacaccaagtgtgaggaggccagccactgtgggaagaggcactacaagtgcagtgaatgtgggaagaccttcagcaggaaggacagcctggtgcagcaccagagggtgcacactggagagcggccctatgaatgtggagaatgtgggaagaccttcagcaggaagcccatcctggcccagcaccagaggatccacactggagagatgccctatgaatgtggcatctgtgggaaggtgttcaaccacagcagcaacctgattgtgcaccagagggtgcacactggagcccggccctacaagtgcagtgaatgtgggaaggcctacagccacaagagcaccctggtgcagcacgagagcatccacactggagagcggccctatgagtgcagtgaatgtgggaagtacttcggccacaagtaccgcctcatcaagcactggagcgtgcacactggagcccggccctatgagtgcatcgcctgtgggaagttcttcagccagagcagtgacctgattgcccaccagagggtgcacaacggggagaagccctacgtgtgcagtgaatgtgggaaggccttcagccacaagcacgtgctggtgcagcaccaccgcatccacactggagagcggccctacaagtgcagtgaatgtgggaaggccttccggcagagggccagcctcatccgccactggaagatccacactggagagcggccctag

SEQ ID NO: 18426 - DNA, 735 bp, Artificial Sequence
  Description of Artificial Sequence: Synthetic coding sequence
atggctgctgctgagcccatgggccctgcccagggccaggtgaactttgaagatgtgtttgtgtacttcagccaggaggagtgggtgctgctggatgaggcccagaggctgctgtacagagatgtgatgctggagaactttgccctgatggccagcctgggctgctggcacggcatggaggatgaggagatcccctttgagcagagcttcagcatcggcatgagccagatccgcatccccaagggcggccccagcacccagaaggcctacccctgtggcacctgtggcctggtgctgaaggacatcctgcacctggccgagcaccaggagacccaccctggccagaagccctacatgtgtgtgctgtgtgggaagcagttctgcttcagcgccaacctgcaccagcaccagaagcagcacagcggggagaagcccttcagaagtgacaagagccggcccttcctgctgaacaactgtgctgtgcagagcatggagatgagctttgtgactggagaggcctgcaaggacttcctggccagcagcagcatctttgagcaccacgccccccacaatgagtggaagccccacagcaacaccaagtgtgaggaggccagccactgcggcaagaggcactacaagtgcagtgaatgtgagaagacagctgccaactaccgggagtatgaccccagcaagggcaccagcacctgtgtgtccatcaccctggcccccctgtag

SEQ ID NO: 18427 - DNA, 1470 bp, Artificial Sequence
  Description of Artificial Sequence: Synthetic coding sequence
atggctgctgctgagcccatgggccctgcccaggtgcccatgaacagcgaggtgattgtggaccccatccagggccaggtgaactttgaagatgtgtttgtgtacttcagccaggaggagtgggtgctgctggatgaggcccagaggctgctgtacagagatgtgatgctggagaactttgccctgatggccagcctgggccacaccagcttcatgagccacatcgtggccagcctggtgatgggcagcgagccctgggtgcctgactgggtggacatgaccctggccgtggccacagagacccctgggggcagtgaccccggctgctggcacggcatggaggatgaggagatcccctttgagcagagcttcagcatcggcatgagccagatccgcatccccaagggcggccccagcacccagaaggcctacccctgtggcacctgtggcctggtgctgaaggacatcctgcacctggccgagcaccaggagacccaccctggccagaagccctacatgtgtgtgctgtgtgggaagcagttctgcttcagcgccaacctgcaccagcaccagaagcagcacagcggggagaagcccttcagaagtgacaagagccggcccttcctgctgaacaactgtgctgtgcagagcatggagatgagctttgtgactggagaggcctgcaaggacttcctggccagcagcagcatctttgagcaccacgccccccacaatgagtggaagccccacagcaacaccaagtgtgaggaggccagccactgcggcaagaggcactacaagtgcagtgaatgtgggaagaccttcagcaggaaggacagcctggtgcagcaccagagggtgcacactggagagcggccctatgaatgtggggagtgtgggaagaccttcagcaggaagcccatcctggcccagcaccagaggatccacactggagagatgccctatgaatgtggcatctgtgggaaggtgttcaaccacagcagcaacctgattgtgcaccagagggtgcacactggagcccggccctacaagtgcagtgaatgtgggaaggcctacagccacaagagcaccctggtgcagcacgagagcatccacactggagagcggccctatgaatgttctgaatgtgggaagtacttcggccacaagtaccgcctcatcaagcactggagcgtgcacactggagcccggccctatgaatgtattgcctgtgggaagttcttcagccagagcagtgacctgattgcccaccagagggtgcacaatggagagaagccctacgtgtgcagtgaatgtgggaaggccttcagccacaagcacgtgctggtgcagcaccaccgcatccacactggagagcggccctacaagtgcagtgaatgtgggaaggccttccggcagagggccagcctcatccgccactggaagatccacactggagagcggccctag

SEQ ID NO: 18428 - DNA, 1347 bp, Artificial Sequence
  Description of Artificial Sequence: Synthetic coding sequence
atggctgctgctgagcccatgggccctgcccaggtgcccatgaacagcgaggtgattgtggaccccatccagggccaggtgaactttgaagatgtgtttgtgtacttcagccaggaggagtgggtgctgctggatgaggcccagaggctgctgtacagagatgtgatgctggagaactttgccctgatggccagcctgggctgctggcacggcatggaggatgaggagatcccctttgagcagagcttcagcatcggcatgagccagatccgcatccccaagggcggccccagcacccagaaggcctacccctgtggcacctgtggcctggtgctgaaggacatcctgcacctggccgagcaccaggagacccaccctggccagaagccctacatgtgtgtgctgtgtgggaagcagttctgcttcagcgccaacctgcaccagcaccagaagcagcacagcggggagaagcccttcagaagtgacaagagccggcccttcctgctgaacaactgtgctgtgcagagcatggagatgagctttgtgactggagaggcctgcaaggacttcctggccagcagcagcatctttgagcaccacgccccccacaatgagtggaagccccacagcaacaccaagtgtgaggaggccagccactgtgggaagaggcactacaagtgcagtgaatgtgggaagaccttcagcaggaaggacagcctggtgcagcaccagagggtgcacactggagagcggccctatgaatgtggagaatgtgggaagaccttcagcaggaagcccatcctggcccagcaccagaggatccacactggagagatgccctatgaatgtggcatctgtgggaaggtgttcaaccacagcagcaacctgattgtgcaccagagggtgcacactggagcccggccctacaagtgcagtgaatgtgggaaggcctacagccacaagagcaccctggtgcagcacgagagcatccacactggagagcggccctatgagtgcagtgaatgtgggaagtacttcggccacaagtaccgcctcatcaagcactggagcgtgcacactggagcccggccctatgagtgcatcgcctgtgggaagttcttcagccagagcagtgacctgattgcccaccagagggtgcacaacggggagaagccctacgtgtgcagtgaatgtgggaaggccttcagccacaagcacgtgctggtgcagcaccaccgcatccacactggagagcggccctacaagtgcagtgaatgtgggaaggccttccggcagagggccagcctcatccgccactggaagatccacactggagagcggccctag

SEQ ID NO: 18429 - DNA, 1134 bp, Artificial Sequence
  Description of Artificial Sequence: Synthetic coding sequence
atggaggatgaggagatcccctttgagcagagcttcagcatcggcatgagccagatccgcatccccaagggcggccccagcacccagaaggcctacccctgtggcacctgtggcctggtgctgaaggacatcctgcacctggccgagcaccaggagacccaccctggccagaagccctacatgtgtgtgctgtgtgggaagcagttctgcttcagcgccaacctgcaccagcaccagaagcagcacagcggggagaagcccttcagaagtgacaagagccggcccttcctgctgaacaactgtgctgtgcagagcatggagatgagctttgtgactggagaggcctgcaaggacttcctggccagcagcagcatctttgagcaccacgccccccacaatgagtggaagccccacagcaacaccaagtgtgaggaggccagccactgcggcaagaggcactacaagtgcagtgaatgtgggaagaccttcagcaggaaggacagcctggtgcagcaccagagggtgcacactggagagcggccctatgaatgtggggagtgtgggaagaccttcagcaggaagcccatcctggcccagcaccagaggatccacactggagagatgccctatgaatgtggcatctgtgggaaggtgttcaaccacagcagcaacctgattgtgcaccagagggtgcacactggagcccggccctacaagtgcagtgaatgtgggaaggcctacagccacaagagcaccctggtgcagcacgagagcatccacactggagagcggccctatgaatgttctgaatgtgggaagtacttcggccacaagtaccgcctcatcaagcactggagcgtgcacactggagcccggccctatgaatgtattgcctgtgggaagttcttcagccagagcagtgacctgattgcccaccagagggtgcacaatggagagaagccctacgtgtgcagtgaatgtgggaaggccttcagccacaagcacgtgctggtgcagcaccaccgcatccacactggagagcggccctacaagtgcagtgaatgtgggaaggccttccggcagagggccagcctcatccgccactggaagatccacactggagagcggccctag

SEQ ID NO: 18430 - DNA, 1329 bp, Artificial Sequence
  Description of Artificial Sequence: Synthetic coding sequence
atggctgctgccaccctgcgggaccctgcccagcagggctacgtgacctttgaagatgtggccgtgtacttcagccaggaggagtggaggctgctggatgatgcccagaggctgctgtacagaaatgtgatgctggagaacttcaccctgctggccagcctgggcctggccagcagcaagacccatgagatcacccagctggagagctgggaggagcccttcatgcctgcctgggaggtggtgaccagcgccatcctgcggggctcctggcagggcgccaaggccgaggccgctgctgagcagagcgcctctgtggaggtgcccagcagcaatgtgcagcagcaccagaagcagcactgtggggagaagcccctgaagaggcaggagggccgggtgcctgtgctgcggagctgccgggtgcacctgtctgagaagagcctgcagagccgggaggtgggcaaggacctgctgaccagcagcggcgtgctgaagcaccaggtgacccacactggagagaagagccacaggagcagcaagagccgggaggccttccacgccggcaagaggcactacaagtgcagtgaatgtgggaaggccttcggccagaagtacctgctggtgcagcaccagaggctgcacactggagagaagccctatgagtgcagtgaatgtgggaagctgttcagccacaagagcaacctcttcatccaccagatcgtgcacactggagagcggccctacggctgcagcgactgtgggaagagcttcagcagaaatgctgacctgatccagcaccagagggtgcacactggagagaagcccttcacctgcagtgaatgtgggaaggccttccgccacaacagcaccctggtgcagcaccaccgcatccacactggagtgcggccctatgagtgcagtgaatgtgggaagctgttctccttcaacagcagcctgatgaagcaccagagggtgcacactggagagcggccctacaagtgcagtgaatgtgggaagttctacagccacaagagcagcctcatcaaccactggagggtgcacactggagagcggccctatgagtgcagtgaatgtgggaagttcttcagccagagcagcagcctgatgcagcacaggaaggtgcacactggagagaagcccttcaagtgcaatgaatgtggccgcttcttcagcgagaacagcagcctggtgaagcaccagagggtgcacactggagccaagccctatgagtgcagagaatgtgggaagttcttccgccacagcagcagcctggtgaagcaccggcgcatccacactggagagatccagtag

SEQ ID NO: 18431 - DNA, 423 bp, Artificial Sequence
  Description of Artificial Sequence: Synthetic coding sequence
ggctctgtggccgccccccgggtggcccgggccctgagctctgtggtggtgtccccaccccaggcccccatggccgccgccaccctgcgggaccctgcccagcagggctacgtgacctttgaagatgtggccgtgtacttcagccaggaggagtggaggctgctggatgatgcccagaggctgctgtacagaaatgtgatgctggagaacttcaccctgctggccagcctgggcctggccagcagcaagacccatgagatcacccagctggagagctgggaggagcccttcatgcctgcctgggaggtggtgaccagcgccatcctgcgggtgtggctgaggaacagaagtgccaacctgctgacccagatcttcttccccaaccggcagccccaggtggcccctgagcagggccgggagtag

SEQ ID NO: 18432 - DNA, 1452 bp, Artificial Sequence
  Description of Artificial Sequence: Synthetic coding sequence
atgtggctgggcaccagcggcaagagcggcctgcccggccactgcctggagaaccccctgcaggagtgccacccagcccagctggaggagtgggccctgaagggcatcagccggcccagcgtcatcagccagcctgagcagaaggaggagccctgggtgctgcccctgcagaactttgaggccaggaagatcccccgggagagccacacagactgtgagcaccaggtggccaagctgaaccaggacaacagcgagacagctgagcagtgtggcaccagcagcgagaggaccaacaaggacctgagccacaccctgtcctggggcggcaactgggagcagggcctggagctggagggccagcacggcaccctgcctggagagggccagctggagagcttcagccaggagcgggacctgaacaagctgctggatggctacgtgggggagaagcccatgtgtgctgaatgtgggaagagcttcaaccagagcagctacctgatccgccacctgcggacccacactggagagcggccctacacctgcattgaatgtgggaagggcttcaagcagagcagtgacctggtgacccacaggaggacccacactggagagaagccctaccagtgcaagggctgtgagaagaagttcagtgacagcagcaccctcatcaagcaccagaggacccacactggagagcggccctatgagtgcccagaatgtgggaagaccttcggcaggaagccccacctgatcatgcaccagaggacccacactggagagaagccctatgcctgcctggagtgccacaagagcttcagccgcagcagcaacttcatcacccaccagaggacccacactggagtgaagccctaccgctgcaatgactgtggggagagcttcagccagagcagtgacctgatcaagcaccagaggacccacactggagagcggcccttcaagtgcccagaatgtgggaagggcttccgggacagcagccactttgtggcccacatgagcacccacagcggggagcggcccttcagctgcccagactgccacaagagcttcagccagagcagccacctggtgacccaccagaggacccacactggagagcggcccttcaagtgtgagaactgtgggaagggctttgctgacagcagcgccctgatcaagcaccagaggatccacactggagagcggccctacaagtgtggagaatgtgggaagagcttcaaccagagcagccacttcatcacccaccagaggatccacctgggggaccggccctaccgctgcccagaatgtgggaagaccttcaaccagaggagccacttcctgacccaccagaggacccacactggagagaagcccttccactgcagcaagtgcaacaagagcttccggcagaaggcccacctgctgtgccaccagaacacccacctgatctag

SEQ ID NO: 18433 - DNA, 240 bp, Artificial Sequence
  Description of Artificial Sequence: Synthetic coding sequence
atgtggctgggcaccagcggcaagagcggcctgcccggccactgcctggagaaccccctgcaggagtgccacccagcccagctggaggagtgggccctgaagggcatcagccggcccagcgtcatcagccagcctgagcagaaggaggagccctgggtgctgcccctgcagaactttgaggccaggaagatcccccgggagagccacacagactgtgagcaccaggtggccaagctgtag

SEQ ID NO: 18434 - DNA, 1614 bp, Artificial Sequence
  Description of Artificial Sequence: Synthetic coding sequence
atggagagcggcctggccggaaatggcaccggggccggcctggtgatgaaggtgaagcaggagaagccagagcggctgctgcagaccctggccccccaggccatgctggtggagaaggacaaggagaacatcttccagcagcaccggggcctgcccccccggcagaccatgggccggccccgggccctgggcggccaggaggagagcggcagcccccgctgggccccacccacagagcaggatgctggcctggccggccgggcccctggcagcgccagcggccccctgagccccagcctgagcagcggggagggccactttgtgtgcctggactgtgggaagcgcttctcctggtggagcagcctgaagatccaccagaggacccacactggagagaagccctacctgtgtgggaaatgtgggaagagcttcagccagaagcccaacctggcccggcaccagaggcaccacactggagagcggcccttctgctgcccagaatgtgcccggcgcttcagccagaagcagcacctgctgaagcaccagaagacccacagcaggcctgccacccacagctgcccagaatgtgagcgctgcttccgccaccaggtgggcctgcgcatccaccagagggcccacgcccgggaccggcagggcagccgggccggcctgcacgagctgatccaggatgctgctgcccggcgggcctgccgcctgcagcccggccccccccggggccggcctgagtgggcctggctgggcctgtgccagggctggtggggccagcccggggcccgggctgctgtgtctggccctgagggccctggagagccccggcagttcatctgcaatgaatgtgggaagagcttcacctggtggagcagcctgaacatccaccagaggatccacactggagagcggccctatgcctgcccagaatgtggccgccgcttcagccagaagcccaacctgaccaggcacctgaggaaccacactggagagcggccccacccctgcccccactgcggccggggcttccggcagaagcagcacctgctgaagcacctgcggacccacctgcccggggcccaggccgccccctgccccagctgtgggaagagctgccgcagcagagctgccctgcgggcccaccagagggcccatgctgtggccgagcctgctgtgcctgctggggagcccggggaccagccccaggccgaggccatccctggcctggccgcccggcccaggagcagccagaggagccctggggcccgggacaccctgtggggccggggccaggccggcctggccggccctggagagccccggcagttcatctgcaatgaatgtgggaagagcttctcctggtggagcgccctgaccatccaccagaggatccacactggagagcggccctacccctgcccagaatgtggccgccgcttcagccagaagcccaacctgaccaggcacagaagaaaccacactggagagcggccctacctgtgcccagcctgtggccggggcttcagccagaagcagcacctgctgaagcaccagagggtgcaccgggccgccccagcctgcagccccaaggaggaggccaggtag

SEQ ID NO: 18435 - DNA, 435 bp, Artificial Sequence
  Description of Artificial Sequence: Synthetic coding sequence
atggagagcggcctggccggaaatggcaccggggccggcctggtgatgaaggtgaagcaggagaagccagagcggctgctgcagaccctggccccccaggccatgctggtggagaaggacaaggagaacatcttccagcagcaccggggcctgcccccccggcagaccatgggccggccccgggccctgggcggccaggaggagagcggcagcccccgctgggccccacccacagagcaggatgctggcctggccggccgggcccctggcagcgccagcggccccctgagccccagcctgagcagcggggagggccactttgtgtgcctggactgtgggaagcgcttctcctggtggagcagcctgaagatccaccagaggacccacactggagagaagccctacctgtgtgggaaatgtgggaagagcttctag

SEQ ID NO: 18436 - DNA, 501 bp, Artificial Sequence
  Description of Artificial Sequence: Synthetic coding sequence
atggagagcggcctggccggaaatggcaccggggccggcctggtgatgaaggtgaagcaggagaagccagagcggctgctgcagaccctggccccccaggccatgctggtggagaaggacaaggagaacatcttccagcagcaccggggcctgcccccccggcagaccatgggccggccccgggccctgggcggccaggaggagagcggcagcccccgctgggccccacccacagagcaggatgctggcctggccggccgggcccctggcagcgccagcggccccctgagccccagcctgagcagcggggagggccactttgtgtgcctggactgtgggaagcgcttctcctggtggagcagcctgaagatccaccagaggacccacactggagagaagccctacctgtgtgggaaatgtgggaagagcttcagccagaagcccaacctggcccggcaccagaggcaccacactggagagcggcccttctgctgcccctag

SEQ ID NO: 18437 - DNA, 1557 bp, Artificial Sequence
  Description of Artificial Sequence: Synthetic coding sequence
atggctgctgctgccctgcggcccccagcccagggcaccgtgacctttgaagatgtggccgtgaacttcagccaggaggagtggagcctgctgtctgaggcccagcgctgcctgtaccatgatgtgatgctggagaacctgaccctcatcagcagcctgggctgctggtatggagccaaggatgagacccccagcaagcagaccctgagcatccagcaggagagccccctgcggacccactggacaggagtgtgcaccaagaaggtgcacctgtggggcatgtgtggccccctgctgggggacatcctgcaccagggcacccagcacaaccagaagctgaatggatttggagcctatgagaagaagctggatgatgatgccaaccaccaccaggaccagaagcagcacatcggggagaagagctaccgcagcaatgccaagggcaccagctttgtgaagaactgcaagttccacatgagccatgagcccttcatcttccacgaggtgggcaaggacttcctgagcagcctgcggctgctgcagcaggaggacatccacaccagcggcaagagcaactttgagaccaagcacggcatccccctgcagggcggcaagacccactacatctgtggggagagcaccatccccttcagcaacaagcacagcctggtgctgcaccagaggctgctgccccgggagggcccctacgtgtgcagcgacagcggcaagttcaccagcaagagcaacagcttcaacaaccaccagggcgtgaggacaggcaagaggccctaccagtgtggccagtgtgatgagagcttctggtacaaggcccacctgacagagcaccagagggtgcacactggagagcggccctatgaatgtggggagtgtgacaagagcttcagccacaagcacagcctggtggaccaccagagggtgcacactggagagcggccctatgaatgtgatgaatgtgggaagagcttcagccacaagaggagcctggtgcaccaccagagggtgcacactggagagcggccctaccagtgtggggagtgtgggaagagcttcaaccacaagtgcaacctgatccagcaccagagggtgcacactggagagcggccctttgaatgtacagcctgtgggaagctgttccgcagcaacagccacctgaaggagcaccagagggtgcacactggagagcggccctatgagtgcaaggagtgcaggaagagcttccgctacaagagccacctgacagagcaccagagggtgcacactggagagcggccctatgaatgtcgggagtgtgggaagtgcttccaccagaagggcagcctcatccagcaccagcagatccacagcggggagcggccccatgaatgtggggagtgtgggaagtgcttccaccagaagggcagcctcatccgccaccagcagatccacagcggggagcggccccatgaatgtggggagtgtgggaagtgcttccggcagaagggcaacctgatcaagcaccagagggtgcacactggagagcggcaccatgaatgttag

SEQ ID NO: 18438 - DNA, 2064 bp, Artificial Sequence
  Description of Artificial Sequence: Synthetic coding sequence
atgctggagaactatgagaacctggcctctgtgggccaccacctgttccagcccagcgtcatctactggctggagcaggaggaggagctgcgggccggccggcgggctgtgctgcaggagtggaggctgaagaccaagggccctgccctgcggcaggaccgctcctggttccgggccagcaatgagacccagacagcccggagccacaacggcggccagctgtgtgacaggacccagtgtggggaggccttcagcgagcacagcggcctgagcacccacgtgaggacccagaacacaggagacagctgtgtgagcaaccactatgaaagagacttcttcatcccctgccagaagaccctcttcaagattggagagcagttctctgtgctgggccagtgtgggaaggccttcagcagcacccccaacgtggtgtcccagcaggcctgcacccgggacaggagcctggactacagcagctgtggggaggtgttcctgaaccagagctacctgcaggcccgggccggcagccacaacggggaggagacctggaagtggaagccctgtgggaaggccctgacccacagcatgggctgtgccacccctgtggagatgcatgctgtgaggaacccccacgtgtgcagagaatgtgggaaggccttccgctacacagcctacctgaccggccgggtgcaggtgcaccctggagagaagccctgtgagctggaggagtgtgggaaggccagccctgtgagcagcagcctgacccagcacgtgcgcatccacgccgctgagaagccctgtgagtgcaaggaatgtgggaaggccttcaccggcctgagcggcctgagcaagcacgtgcagacagaccccggccagaagccctatgagtgcaaggactgtgggaaggcctgtggcggcttctacctgctgaatgaacatggcaagacccacacccgggagaagccctttgcctgtgtggtgtgtgggaagtacttcaggaacagcagctgcctgaacaaccacgtgcgcatccacacaggcatcaagccctacacctgcagctactgtgggaaggccttcaccgtgcgctgtggcctgaccaggcatgtgaggacccacactggagagaagccctacacctgcaaggactgtgggaaggccttctgcaccagcagcggcctgacagaacatgtgaggacccacactggagagaagccctatgagtgcaaggactgtgggaagagcttcaccgtgagcagcagcctgacagaacatgcccgcatccacactggagagaagccctatgagtgcaagcagtgtgggaaggccttcaccggccgcagcggcctgaccaagcacatgaggacccacactggagagaagccctatgagtgcaaggactgtgggaaggcctacaacagagtgtacctgctgaatgaacatgtgaagacccacacagaggagaagcccttcatctgcaccgtgtgcaggaagagcttcaggaacagcagctgcctgaacaagcacatccagatccacacaggcatcaagccctatgagtgcaaggactgtgggaagaccttcaccgtgagcagcagcctgacagagcacatccgcacccacactggagagaagccctatgagtgcaaggtgtgtgggaaggccttcaccaccagcagccacctgattgtgcacatccgcacccacactggagagaagccctacatctgcaaggaatgtgggaaggcctttgccagcagcagccacctgattgagcacaggaggacccacactggagagaagccctacatctgcaatgaatgtgggaaggccttccgggccagcagccacctgcacaagcacggccgcatccacacaggccagaagccctacaagtgcaaggaatgtgggaaggcctacaaccgcttctacctgctgaaggagcacctgaagacctacacagaggagcaggtgtttgtgtgcaaggactgtgggaagagcttcaagaacagcagctgcctgaaccaccacacccagatccacacagatgagaagcccttctag

SEQ ID NO: 18439 - DNA, 2190 bp, Artificial Sequence
  Description of Artificial Sequence: Synthetic coding sequence
atggccgccccagacctggcccacggcggccacgtgtcccgggacagcgtgtgcctgcacgaggagcagacccaggccgccggcatggtggccggctggctgatcaactgctaccaggatgctgtgacctttgatgatgtggccgtggacttcacccaggaggagtggaccctgctggaccccagccagagggacctgtacagagatgtgatgctggagaactatgagaacctggcctctgtggagtggaggctgaagaccaagggccctgccctgcggcaggaccgctcctggttccgggccagcaatgagacccagacagcccggagccacaacggcggccagctgtgtgacaggacccagtgtggggaggccttcagcgagcacagcggcctgagcacccacgtgaggacccagaacacaggagacagctgtgtgagcaaccactatgaaagagacttcttcatcccctgccagaagaccctcttcaagattggagagcagttctctgtgctgggccagtgtgggaaggccttcagcagcacccccaacgtggtgtcccagcaggcctgcacccgggacaggagcctggactacagcagctgtggggaggtgttcctgaaccagagctacctgcaggcccgggccggcagccacaacggggaggagacctggaagtggaagccctgtgggaaggccctgacccacagcatgggctgtgccacccctgtggagatgcatgctgtgaggaacccccacgtgtgcagagaatgtgggaaggccttccgctacacagcctacctgaccggccgggtgcaggtgcaccctggagagaagccctgtgagctggaggagtgtgggaaggccagccctgtgagcagcagcctgacccagcacgtgcgcatccacgccgctgagaagccctgtgagtgcaaggaatgtgggaaggccttcaccggcctgagcggcctgagcaagcacgtgcagacagaccccggccagaagccctatgagtgcaaggactgtgggaaggcctgtggcggcttctacctgctgaatgaacatggcaagacccacacccgggagaagccctttgcctgtgtggtgtgtgggaagtacttcaggaacagcagctgcctgaacaaccacgtgcgcatccacacaggcatcaagccctacacctgcagctactgtgggaaggccttcaccgtgcgctgtggcctgaccaggcatgtgaggacccacactggagagaagccctacacctgcaaggactgtgggaaggccttctgcaccagcagcggcctgacagaacatgtgaggacccacactggagagaagccctatgagtgcaaggactgtgggaagagcttcaccgtgagcagcagcctgacagaacatgcccgcatccacactggagagaagccctatgagtgcaagcagtgtgggaaggccttcaccggccgcagcggcctgaccaagcacatgaggacccacactggagagaagccctatgagtgcaaggactgtgggaaggcctacaacagagtgtacctgctgaatgaacatgtgaagacccacacagaggagaagcccttcatctgcaccgtgtgcaggaagagcttcaggaacagcagctgcctgaacaagcacatccagatccacacaggcatcaagccctatgagtgcaaggactgtgggaagaccttcaccgtgagcagcagcctgacagagcacatccgcacccacactggagagaagccctatgagtgcaaggtgtgtgggaaggccttcaccaccagcagccacctgattgtgcacatccgcacccacactggagagaagccctacatctgcaaggaatgtgggaaggcctttgccagcagcagccacctgattgagcacaggaggacccacactggagagaagccctacatctgcaatgaatgtgggaaggccttccgggccagcagccacctgcacaagcacggccgcatccacacaggccagaagccctacaagtgcaaggaatgtgggaaggcctacaaccgcttctacctgctgaaggagcacctgaagacctacacagaggagcaggtgtttgtgtgcaaggactgtgggaagagcttcaagaacagcagctgcctgaaccaccacacccagatccacacagatgagaagcccttctag

SEQ ID NO: 18440 - DNA, 1926 bp, Artificial Sequence
  Description of Artificial Sequence: Synthetic coding sequence
atggtgcacggctctgtgaccttcagagatgtggccatcgacttcagccaggaggagtgggagtgcctgcagcctgaccagaggaccctgtacagagatgtgatgctggagaactacagccacctgatcagcctgggcagcagcatcagcaagccagatgtgatcaccctgctggagcaggagaaggagccctggatggtggtgaggaaggagaccagccgccgctacccagacctggagctgaagtatggccctgagaaggtgtccccagaaaatgacaccagcgaggtgaacctgcccaagcaggtgatcaagcagatcagcaccaccctgggcatcgaggccttctacttcagaaatgacagcgagtaccggcagtttgagggcctgcagggctaccaggagggcaacatcaaccagaagatgatctcctatgagaagctgcccacccacaccccccacgccagcctcatctgcaacacccacaagccctatgagtgcaaggaatgtgggaagtacttcagccgcagcgccaacctgatccagcaccagagcatccacactggagagaagccctttgagtgcaaggaatgtgggaaggccttccggctgcacatccagttcaccaggcaccagaagttccacactggagagaagccctttgagtgcaatgaatgtgggaaggccttcagcctgctgaccctgctgaacagacacaagaacatccacactggagagaagctgtttgagtgcaaggaatgtgggaagagcttcaacagaagcagcaacctggtgcagcaccagagcatccacagcggcgtgaagccctatgagtgcaaggaatgtgggaagggcttcaacagaggagcccacctgatccagcaccagaagatccacagcaatgagaagccctttgtgtgcaaggaatgtggcatggccttccgctaccactaccagctgattgagcactgccagatccacactggagagaagccctttgagtgcaaggaatgtgggaaggccttcaccctgctgaccaagctggtgcgccaccagaagatccacactggagagaagccctttgagtgcagagaatgtgggaaggccttcagcctgctgaaccagctgaacagacacaagaacatccacactggagagaagccctttgagtgcaaggaatgtgggaagagcttcaacagaagcagcaacctggtgcagcaccagagcatccacgccggcatcaagccctatgagtgcaaggaatgtgggaagggcttcaacagaggagcccacctgatccagcaccagaagatccacagcaatgagaagccctttgtgtgcagagaatgtgagatggccttccgctaccactgccagctgattgagcacagccgcatccacactggagacaagccctttgagtgccaggactgtgggaaggccttcaacagaggcagcagcctggtgcagcaccagagcatccacactggagagaagccctatgagtgcaaggaatgtgggaaggccttccggctgtacctgcagctgagccagcaccagaagacccacactggagagaagccctttgagtgcaaggaatgtgggaagttcttcagaagaggcagcaacctgaaccagcacaggagcatccacacaggcaagaagccctttgagtgcaaggaatgtgggaaggccttccggctgcacatgcacctgatccgccaccagaagctgcacactggagagaagccctttgagtgcaaggaatgtgggaaggccttccggctgcacatgcagctgatccgccaccagaagctgcacactggagagaagccctttgagtgcaaggaatgtgggaaggtgttcagcctgcccacccagctgaacagacacaagaacatccacactggagagaaggccagctag

SEQ ID NO: 18441 - DNA, 477 bp, Artificial Sequence
  Description of Artificial Sequence: Synthetic coding sequence
atgggccgcagccccaggaagattgaccagttctgcaacagcagcaacatggtgcacggctctgtgaccttcagagatgtggccatcgacttcagccaggaggagtgggagtgcctgcagcctgaccagaggaccctgtacagagatgtgatgctggagaactacagccacctgatcagcctgggcagcagcatcagcaagccagatgtgatcaccctgctggagcaggagaaggagccctggatggtggtgaggaaggagaccagccgccgctacccagacctggagctgaagtatggccctgagaaggtgtccccagaaaatgacaccagcgaggtgaacctgcccaagcagatcagcagcctggccagcaagcccagcttcaccgccatccacatccagaggcgcatccactgccgcatctgcatcgccttcggctacctgagcctggtgtactgcagcctggagatcctgtag

SEQ ID NO: 18442 - DNA, 348 bp, Artificial Sequence
  Description of Artificial Sequence: Synthetic coding sequence
atggtgcacggctctgtgaccttcagagatgtggccatcgacttcagccaggaggagtgggagtgcctgcagcctgaccagaggaccctgtacagagatgtgatgctggagaactacagccacctgatcagcctgggcagcagcatcagcaagccagatgtgatcaccctgctggagcaggagaaggagccctggatggtggtgaggaaggagaccagccgccgctacccagacctggagctgaagtatggccctgagaaggtgtccccagaaaatgacaccagcgaggtgaacctgcccaagcaggtgatcaagcagaagaagggcaagaagaagaagaagaagtag

SEQ ID NO: 18443 - DNA, 1926 bp, Artificial Sequence; identical to SEQ ID NO: 18440
  Description of Artificial Sequence: Synthetic coding sequence

SEQ ID NO: 18444 - DNA, 1929 bp, Artificial Sequence
  Description of Artificial Sequence: Synthetic coding sequence
atggtgcacggctctgtgaccttcagagatgtggccatcgacttcagccaggaggagtgggagtgcctgcagcctgaccagaggaccctgtacagagatgtgatgctggagaactacagccacctgatcagcctggccggcagcagcatcagcaagccagatgtgatcaccctgctggagcaggagaaggagccctggatggtggtgaggaaggagaccagccgccgctacccagacctggagctgaagtatggccctgagaaggtgtccccagaaaatgacaccagcgaggtgaacctgcccaagcaggtgatcaagcagatcagcaccaccctgggcatcgaggccttctacttcagaaatgattctgagtaccggcagtttgagggcctgcagggctaccaggagggcaacatcaaccagaagatgatctcctatgagaagctgcccacccacacccctcatgccagcctcatctgcaacacccacaagccctatgagtgcaaggaatgtgggaagtacttcagccgcagcgccaacctgatccagcaccagagcatccacactggagagaagccctttgagtgcaaggaatgtgggaaggccttccggctgcacatccagttcaccaggcaccagaagttccacactggagagaagccctttgaatgtaatgaatgtgggaaggccttcagcctgctgaccctgctgaacagacacaagaacatccacactggagagaagctgtttgagtgcaaggaatgtgggaagagcttcaacagaagcagcaacctggtgcagcaccagagcatccacagcggcgtgaagccctatgagtgcaaggaatgtgggaagggcttcaacagaggagcccacctgatccagcaccagaagatccacagcaatgagaagccctttgtgtgcaaggaatgtggcatggccttccgctaccactaccagctgattgagcactgccagatccacactggagagaagccctttgagtgcaaggaatgtgggaaggccttcaccctgctgaccaagctggtgcgccaccagaagatccacactggagagaagccctttgaatgtcgggagtgtgggaaggccttcagcctgctgaaccagctgaacagacacaagaacatccacactggagagaagccctttgagtgcaaggaatgtgggaagagcttcaacagaagcagcaacctggtgcagcaccagagcatccatgctggcatcaagccctatgagtgcaaggaatgtgggaagggcttcaacagaggagcccacctgatccagcaccagaagatccacagcaatgagaagccctttgtgtgccgggagtgtgagatggccttccgctaccactgccagctgattgagcacagccgcatccacactggagacaagccctttgagtgccaggactgtgggaaggccttcaacagaggcagcagcctggtgcagcaccagagcatccacactggagagaagccctatgagtgcaaggaatgtgggaaggccttccggctgtacctgcagctgagccagcaccagaagacccacactggagagaagccctttgagtgcaaggaatgtgggaagttcttccggcggggcagcaacctgaaccagcacaggagcatccacacaggcaagaagccctttgagtgcaaggaatgtgggaaggccttccggctgcacatgcacctgatccgccaccagaagctgcacactggagagaagccctttgagtgcaaggaatgtgggaaggccttccggctgcacatgcagctgatccgccaccagaagctgcacactggagagaagccctttgagtgcaaggaatgtgggaaggtgttcagcctgcccacccagctgaacagacacaagaacatccacactggagagaaggccagctag

SEQ ID NO: 18445 - DNA, 1926 bp, Artificial Sequence; identical to SEQ ID NO: 18440
  Description of Artificial Sequence: Synthetic coding sequence

SEQ ID NO: 18446 - DNA, 16218 bp, Artificial Sequence
  Description of Artificial Sequence: Synthetic coding sequence
atgggcgccctgtggagctggtggatcctgtgggccggggccaccctgctgtggggcctgacccaggaggcctctgtggacctgaagaacacaggccgggaggagttcctgacagccttcctgcagaactaccagctggcctacagcaaggcctacccccggctgctgatcagcagcctgtctgagagccctgcctctgtgtccatcctgagccaggccgacaacaccagcaagaaggtgacagtgcggcctggagagagcgtgatggtgaacatcagcgccaaggccgagatgattggcagcaagatcttccagcacgctgtggtgatccacagcgactatgccatctctgtgcaggccctgaatgccaagccagacacagctgagctgaccctgctgcggcccatccaggccctgggcacagagtactttgtgctgaccccacctggcaccagcgccagaaatgtgaaggagtttgctgtggtggccggggccgccggggcctctgtgtctgtgaccctgaagggctctgtgaccttcaacgggaagttctacccagctggagatgtgctgcgggtgaccctgcagccctacaacgtggcccagctgcagagctctgtggacctgagcggcagcaaggtgacagccagcagccctgtggccgtgctgagcggccacagctgtgcccagaagcacaccacctgcaaccacgtggtggagcagctgctgcccaccagcgcctggggcacccactacgtggtgcccaccctggccagccagagccgctatgacctggcctttgtggtggccagccaggccaccaagctgacctacaaccacggcggcatcaccggcagccggggcctgcaggccggagatgtggtggagtttgaggtgcggcccagctggcccctgtacctgagcgccaacgtgggcatccaggtgctgctgtttggcaccggggccatcagaaatgaggtgacctatgacccctacctggtgctgatcccagatgtggccgcctactgcccagcctacgtggtgaagtctgtgcccggctgtgagggcgtggccctggtggtggcccagaccaaggccatcagcggcctgaccattgatggccatgctgtgggcgccaagctgacctgggaggccgtgcccggcagcgagttctcctatgcagaggtggagctgggcacagctgacatgatccacacagctgaggccaccaccaacctgggcctgctgaccttcggcctggccaaggccatcggctacgccacagctgctgactgtggccgcacagtgctgagccctgtggagcccagctgtgagggcatgcagtgtgccgccggccagcgctgccaggtggtgggcggcaaggccggctgtgtggccgagagcacagctgtgtgccgggcccagggcgacccccactacaccacctttgatggccgccgctatgacatgatgggcacctgcagctacaccatggtggagctgtgcagtgaagatgacaccctgcctgccttctctgtggaggccaagaatgagcaccggggcagcagaagagtgtcctatgtgggcctggtgacagtgcgggcctacagccacagcgtgtccctgaccagaggagaggtgggctttgtgctggtggacaaccagaggagccggctgcctgtgtccctgtctgagggccgcctgcgggtgtaccagagcggccccagggctgtggtggagctggtgtttggcctggtggtgacctatgactgggactgccagctggccctgagcctgcctgcccgcttccaggaccaggtgtgtggcctgtgtggcaactacaatggagaccctgcagatgacttcctgaccccagatggagccctggccccagatgctgtggagtttgccagctcctggaagctggatgatggagactacctgtgtgaagatggctgccagaacaactgcccagcctgcaccccaggccaggcccagcactatgaaggagaccggctgtgtggcatgctgaccaagctggatggcccctttgctgtgtgccacgacaccctggacccccggcccttcctggagcagtgtgtgtatgacctgtgtgtggtgggcggggagcggctgagcctgtgccggggcctgagcgcctatgcccaggcctgcctggagctgggcatctctgtgggggactggaggagccctgccaactgccccctgagctgcccagccaacagccgctatgagctgtgtggccctgcctgccccaccagctgcaatggagctgctgcccccagcaactgcagcggccggccctgtgtggagggctgtgtgtgcctgcccggctttgtggccagcggcggggcctgtgtgcctgccagcagctgtggctgcaccttccagggcctgcagctggcccctggccaggaggtgtgggcagatgagctgtgccagaggcgctgcacctgcaatggagccacccaccaggtgacctgccgggacaagcagagctgcccagctggggagcgctgcagcgtgcagaatggcctgctgggctgctacccagacagatttggcacctgccagggcagcggggacccccactacgtgtcctttgatggccgccgctttgacttcatgggcacctgcacctacctgctggtgggcagctgtggccagaatgctgccctgcctgccttccgggtgctggtggagaatgagcaccggggcagccagacagtgtcctacaccagggctgtgcgggtggaggcccggggcgtgaaggtggccgtgagaagagagtacccaggccaggtgctggtggatgatgtgctgcagtacctgcccttccaggccgcagatggccaggtgcaggtgttccggcagggcagagatgctgtggtgaggacagactttggcctgactgtgacctatgactggaatgcccgggtgacagccaaggtgcccagcagctatgcagaggccctgtgtggcctgtgtggcaacttcaatggagaccctgcagatgacctggccctgcggggcggcggccaggccgccaatgccctggccttcggcaacagctggcaggaggagacccggcccggctgtggggccacagagcccggggactgccccaagctggacagcctggtggcccagcagctgcagagcaagaatgaatgtggcatcctggccgaccccaagggccccttccgggagtgccacagcaagctggacccccagggcgctgtgcgggactgtgtgtatgaccgctgcctgctgcccggccagagcggccccctgtgtgatgccctggccacctatgctgctgcctgccaggccgccggggccaccgtgcacccctggaggtctgaggagctgtgccccctgagctgccccccccacagccactatgaggcctgcagctatggctgccccctgagctgtggggacctgcctgtgcctgggggctgcggctctgaatgtcatgagggctgtgtgtgtgatgagggctttgccctgtctggagagagctgcctgcccctggccagctgtggctgtgtgcaccagggcacctaccaccccccaggccagaccttctacccaggccctggctgtgacagcctgtgccactgccaggagggcggcctggtgtcctgtgagagcagcagctgtggcccccatgaggcctgccagcccagcggcggcagcctgggctgtgtggccgtgggcagcagcacctgccaggccagcggggacccccactacaccacctttgatggccgccgctttgacttcatgggcacctgtgtgtatgtgctggcccagacctgtggcacccggcccggcctgcacagatttgctgtgctgcaggagaatgtggcctggggcaatggccgggtgtctgtgaccagggtcatcaccgtgcaggtggccaacttcaccctgcggctggagcagaggcagtggaaggtgacagtgaatggagtggacatgaagctgcctgtggtgctggccaacggccagatccgggccagccagcacggcagtgatgtggtgattgaaacagactttggcctgcgggtggcctatgacctggtgtactacgtgcgggtgacagtgcccggcaactactaccagcagatgtgtggcctgtgtggcaactacaacggggaccccaaggatgacttccagaagcccaacggcagccaggccggaaatgccaatgaatttggaaacagctgggaggaggtggtgcctgacagcccctgcctgccccccaccccctgccccccaggcagcgaggactgcatccccagccacaagtgccccccagagctggagaagaagtaccagaaggaggagttctgtggcctgctgagcagccccaccggccccctgagcagctgccacaagctggtggacccccagggccccctgaaggactgcatctttgacctgtgcctgggcggcggcaacctgagcatcctgtgcagcaacatccacgcctacgtgtctgcctgccaggccgccggcggccacgtggagccctggaggacagagaccttctgccccatggagtgcccccccaacagccactatgagctgtgtgccgacacctgcagcctgggctgcagcgccctgagcgccccaccccagtgccaggacggctgtgccgagggctgccagtgtgacagcggcttcctgtacaacggccaggcctgtgtgcccatccagcagtgtggctgctaccacaacggggtgtactatgagcctgagcagacagtgctgattgacaactgccggcagcagtgcacctgccacgccggcaagggcatggtgtgccaggagcacagctgcaagccaggccaggtgtgccagcccagcggcggcatcctgagctgtgtgaccaaggacccctgccacggcgtgacctgccggccccaggagacctgcaaggagcagggcggccagggcgtgtgcctgcccaactatgaggccacctgctggctgtggggagacccccactaccacagctttgatggcaggaagtttgacttccagggcacctgcaactacgtgctggccaccaccggctgccctggggtgtccacccagggcctgacccccttcaccgtgaccaccaagaaccagaacagaggcaacccagctgtgtcctatgtgcgggtggtgacagtggccgccctgggcaccaacatcagcatccacaaggatgaaattggcaaggtgcgggtgaatggagtgctgacagccctgcctgtgtctgtggctgatggccgcatctctgtgacccagggcgccagcaaggccctgctggtggccgactttggcctgcaggtgtcctatgactggaactggagggtggatgtgaccctgcccagcagctaccacggggctgtgtgtggcctgtgtggcaacatggacaggaaccccaacaatgaccaggtgttccccaacggcaccctggcccccagcatccccatctggggcggctcctggagggcccctggctgggaccccctgtgctgggatgagtgccggggcagctgccccacctgcccagaggaccggctggagcagtatgagggccctggcttctgtggccccctggcccctggcactggaggccccttcaccacctgccacgcccacgtgcccccagagagcttcttcaagggctgtgtgctggatgtgtgcatgggcggcggggaccgggacatcctgtgcaaggccctggccagctatgtggccgcctgccaggccgccggcgtggtgattgaggactggagggcccaggtgggctgtgagatcacctgcccagagaacagccactatgaggtgtgtggcagcccctgcccagccagctgccccagccctgcccccctgaccaccccagctgtgtgtgagggcccctgtgtggagggctgccagtgtgatgctggctttgtgctgtctgctgacagatgtgtgcccctgaacaacggctgcggctgctgggccaacggcacctaccacgaggccggcagcgagttctgggcagatggcacctgcagccagtggtgccgctgtggccctgggggcggcagcctggtgtgcaccccagccagctgtggcctgggggaggtgtgtggcctgctgcccagcggccagcacggctgccagcctgtgtccacagctgagtgccaggcctggggagacccccactacgtgaccctggatggccaccgcttcaacttccagggcacctgtgagtacctgctgagcgccccctgccacggcccccccctgggcgctgagaacttcaccgtgacagtggccaatgagcaccggggcagccaggccgtgtcctacaccaggtctgtgaccctgcagatctacaaccacagcctgaccctgagcgcccgctggcccaggaagctgcaggtggatggagtgtttgtgaccctgcccttccagctggacagcctgctgcacgcccacctgtctggagcagatgtggtggtgaccaccaccagcggcctgagcctggcctttgatggagacagctttgtgcggctgcgggtgcctgctgcctatgccggcagcctgtgtggcctgtgtggcaactacaaccaggaccctgcagatgacctgaaggctgtgggcggcaagccagctggctggcaggtgggcggggcccagggctgtggggagtgtgtgtccaagccctgccccagcccctgcaccccagagcagcaggagagctttggaggcccagatgcctgtggggtcatcagcgccacagatggccccctggccccctgccacggcctggtgcccccagcccagtacttccagggctgcctgctggatgcctgccaggtgcagggccaccctgggggcctgtgcccagctgtggccacctacgtggccgcctgccaggccgccggggcccagctgcgggagtggaggaggccagacttctgccccttccagtgcccagcccacagccactatgagctgtgtggggacagctgccccggcagctgccccagcctgagcgcccctgagggctgtgagagcgcctgccgggagggctgtgtgtgtgatgctggctttgtgctgagcggggacacctgtgtgcctgtgggccagtgtggctgcctgcatgatgaccgctactaccccctgggccagaccttctacccaggccctggctgtgacagcctgtgccgctgccgggagggcggggaggtgtcctgtgagcccagcagctgtggcccccatgagacctgccggcccagcggcggcagcctgggctgtgtggccgtgggcagcaccacctgccaggccagcggggacccccactacaccacctttgatggaagaagatttgacttcatgggcacctgtgtgtatgtgctggcccagacctgtggcaccaggcctggcctgcacagatttgctgtgctgcaggagaatgtggcctggggcaatggccgggtgtctgtgaccagggtcatcaccgtgcaggtggccaacttcaccctgcggctggagcagaggcagtggaaggtgacagtgaatggagtggacatgaagctgcctgtggtgctggccaacggccagatccgggccagccagcacggcagtgatgtggtgattgaaacagactttggcctgcgggtggcctatgacctggtgtactacgtgcgggtgacagtgcccggcaactactaccagctgatgtgtggcctgtgtggcaactacaatggagaccccaaggatgacttccagaagcccaacggcagccaggccggaaatgccaatgaatttggaaacagctgggaggaggtggtgcctgacagcccctgcctgcccccacccacctgccccccaggcagcgagggctgcatccccagtgaagaatgtcctcctgagctggagaagaagtaccagaaggaggagttctgtggcctgctgagcagccccaccggccccctgagcagctgccacaagctggtggacccccagggccccctgaaggactgcatctttgacctgtgcctgggcggcggcaacctgagcatcctgtgcagcaacatccacgcctacgtgtctgcctgccaggccgccggcggccaggtggagccctggagaaatgagaccttctgccccatggagtgcccccagaacagccactatgagctgtgtgccgacacctgcagcctgggctgcagcgccctgagcgcccccctgcagtgcccagatggctgtgccgagggctgccagtgtgacagcggcttcctgtacaacggccaggcctgtgtgcccatccagcagtgtggctgctaccacaatggagcctactatgagcctgagcagacagtgctgattgacaactgccggcagcagtgcacctgccacgtgggcaaggtggtggtgtgccaggagcacagctgcaagccaggccaggtgtgccagcccagcggcggcatcctgagctgtgtgaacaaggacccctgccacggcgtgacctgccggccccaggagacctgcaaggagcagggcggccagggcgtgtgcctgcccaactatgaggccacctgctggctgtggggagacccccactaccacagctttgatggcaggaagtttgacttccagggcacctgcaactacgtgctggccaccaccggctgccctggggtgtccacccagggcctgacccccttcaccgtgaccaccaagaaccagaacagaggcaacccagctgtgtcctatgtgcgggtggtgacagtggccgccctgggcaccaacatcagcatccacaaggatgagatcggcaaggtgcgggtgaatggagtgctgacagccctgcctgtgtctgtggctgatggccgcatctctgtgacccagggcgccagcaaggccctgctggtggccgactttggcctgcaggtgtcctatgactggaactggagggtggatgtgaccctgcccagcagctaccatggagctgtgtgtggcctgtgtggcaacatggacaggaaccccaacaatgaccaggtgttccccaacggcaccctggcccccagcatccccatctggggcggctcctggagggcccctggctgggaccccctgtgctgggatgaatgtcggggcagctgccccacctgcccagaagatcggctggagcagtatgagggccctggcttctgtggccccctggcccctggcaccggcggccccttcaccacctgccacgcccacgtgcccccagagagcttcttcaagggctgtgtgctggatgtgtgcatgggcggcggggaccgggacatcctgtgcaaggccctggccagctatgtggccgcctgccaggccgccggcgtggtgattgaggactggagggcccaggtgggctgtgagatcacctgcccagagaacagccactatgaggtgtgtggccccccctgcccagccagctgccccagccctgcccccctgaccaccccagctgtgtgtgagggcccctgtgtggagggctgccagtgtgatgctggctttgtgctgtctgctgacagatgtgtgcccctgaacaacggctgcggctgctgggccaacggcacctaccatgaagctggcagcgagttctgggcagatggcacctgcagccagtggtgccgctgtggccctgggggcggcagcctggtgtgcaccccagccagctgtggcctgggggaggtgtgtggcctgctgcccagcggccagcacggctgccagcctgtgtccacagctgagtgccaggcctggggagacccccactacgtgaccctggatggccacagatttgacttccagggcacctgtgagtacctgctgagcgccccctgccacggcccccccctgggcgctgagaacttcaccgtgacagtggccaatgagcaccggggcagccaggccgtgtcctacaccaggtctgtgaccctgcagatctacaaccacagcctgaccctgagcgcccgctggcccaggaagctgcaggtggatggagtgtttgtgaccctgcccttccagctggacagcctgctgcacgcccacctgagcggggctgatgtggtggtgaccaccaccagcggcctgagcctggcctttgatggagacagctttgtgcggctgcgggtgcctgctgcctatgccggcagcctgtgtggcctgtgtggcaactacaaccaggaccctgcagatgacctgaaggctgtgggcggcaagccagctggctggcaggtgggcggggcccagggctgtggagaatgtgtgtccaagccctgccccagcccctgcaccccagagcagcaggagagctttggaggcccagatgcctgtggggtcatcagcgccacagatggccccctggccccctgccacggcctggtgcccccagcccagtacttccagggctgcctgctggatgcctgccaggtgcagggccaccctgggggcctgtgcccagctgtggccacctacgtggccgcctgccaggccgccggggcccagctgcgggagtggaggaggccagacttctgccccttccagtgcccagcccacagccactatgagctgtgtggggacagctgccccggcagctgccccagcctgagcgcccctgagggctgtgagagcgcctgccgggagggctgtgtgtgtgatgctggctttgtgctgagcggggacacctgtgtgcctgtgggccagtgtggctgcctgcatgatgaccgctactaccccctgggccagaccttctacccaggccctggctgtgacagcctgtgccgctgccgggagggcggggaggtgtcctgtgagcccagcagctgtggcccccatgagacctgccggcccagcggcggcagcctgggctgtgtggccgtgggcagcaccacctgccaggccagcggggacccccactacaccacctttgatggccacagatttgacttcatgggcacctgtgtgtatgtgctggcccagacctgtggcacccggcccggcctgcacagatttgctgtgctgcaggagaatgtggcctggggcaatggccgggtgtctgtgaccagggtcatcaccgtgcaggtggccaacttcaccctgcggctggagcagaggcagtggaaggtgacagtgaatggagtggacatgaagctgcctgtggtgctggccaacggccagatccgggccagccagcacggcagtgatgtggtgattgaaacagactttggcctgcgggtggcctatgacctggtgtactacgtgcgggtgacagtgcccggcaactactaccagctgatgtgtggcctgtgtggcaactacaacggggaccccaaggatgacttccagaagcccaacggcagccaggccggaaatgccaatgaatttggaaacagctgggaggaggtggtgcctgacagcccctgcctgcccccacccacctgccccccaggcagcgctggctgcatccccagcgacaagtgccccccagagctggagaagaagtaccagaaggaggagttctgtggcctgctgagcagccccaccggccccctgagcagctgccacaagctggtggacccccagggccccctgaaggactgcatctttgacctgtgcctgggcggcggcaacctgagcatcctgtgcagcaacatccacgcctacgtgtctgcctgccaggccgccggcggccacgtggagccctggagaaatgagaccttctgccccatggagtgcccccagaacagccactatgagctgtgtgccgacacctgcagcctgggctgcagcgccctgagcgcccccctgcagtgcccagatggctgtgccgagggctgccagtgtgacagcggcttcctgtacaacggccaggcctgtgtgcccatccagcagtgtggctgctaccacaacggggtgtactatgagcctgagcagacagtgctgattgacaactgccggcagcagtgcacctgccacgtgggcaaggtggtggtgtgccaggagcacagctgcaagccaggccaggtgtgccagcccagcggcggcatcctgagctgtgtgaccaaggacccctgccacggcgtgacctgccggccccaggagacctgcaaggagcagggcggccagggcgtgtgcctgcccaactatgaggccacctgctggctgtggggagacccccactaccacagctttgatggcaggaagtttgacttccagggcacctgcaactacgtgctggccaccaccggctgccctggggtgtccacccagggcctgacccccttcaccgtgaccaccaagaaccagaacagaggcaacccagctgtgtcctatgtgcgggtggtgacagtggccgccctgggcaccaacatcagcatccacaaggatgaaattggcaaggtgcgggtgaatggagtgctgacagccctgcctgtgtctgtggctgatggccgcatctctgtggcccagggcgccagcaaggccctgctggtggccgactttggcctgcaggtgtcctatgactggaactggagggtggatgtgaccctgcccagcagctaccacggggctgtgtgtggcctgtgtggcaacatggacaggaaccccaacaatgaccaggtgttccccaacggcaccctggcccccagcatccccatctggggcggctcctggagggcccctggctgggaccccctgtgctgggatgagtgccggggcagctgccccacctgcccagaggaccggctggagcagtatgagggccctggcttctgtggccccctgagcagcggcactggaggccccttcaccacctgccacgcccacgtgcccccagagagcttcttcaagggctgtgtgctggatgtgtgcatgggcggcggggaccgggacatcctgtgcaaggccctggccagctatgtggccgcctgccaggccgccggcgtggtgattgaggactggagggcccaggtgggctgtgagatcacctgcccagagaacagccactatgaggtgtgtggccccccctgcccagccagctgccccagccctgcccccctgaccaccccagctgtgtgtgagggcccctgtgtggagggctgccagtgtgatgctggctttgtgctgtctgctgacagatgtgtgcccctgaacaacggctgcggctgctgggccaacggcacctaccacgaggccggcagcgagttctgggcagatggcacctgcagccagtggtgccgctgtggccctgggggcggcagcctggtgtgcaccccagccagctgtggcctgggggaggtgtgtggcctgctgcccagcggccagcacggctgccagcctgtgtccacagctgagtgccaggcctggggagacccccactacgtgaccctggatggccacagatttgacttccagggcacctgtgagtacctgctgagcgccccctgccacggcccccccctgggcgctgagaacttcaccgtgacagtggccaatgagcaccggggcagccaggccgtgtcctacaccaggtctgtgaccctgcagatctacaaccacagcctgaccctgagcgcccgctggcccaggaagctgcaggtggatggagtgtttgtggccctgcccttccagctggacagcctgctgcacgcccacctgtctggagcagatgtggtggtgaccaccaccagcggcctgagcctggcctttgatggagacagctttgtgcggctgcgggtgcctgctgcctatgctgccagcctgtgtggcctgtgtggcaactacaaccaggaccctgcagatgacctgaaggctgtgggcggcaagccagctggctggcaggtgggcggggcccagggctgtggggagtgtgtgtccaagccctgccccagcccctgcaccccagagcagcaggagagctttggaggcccagatgcctgtggggtcatcagcgccacagatggccccctggccccctgccacggcctggtgcccccagcccagtacttccagggctgcctgctggatgcctgccaggtgcagggccaccctgggggcctgtgcccagctgtggccacctacgtggccgcctgccaggccgccggggcccagctgggggagtggaggaggccagacttctgccccctgcagtgcccagcccacagccactatgagctgtgtggggacagctgccctgtgtcctgccccagcctgagcgcccctgagggctgtgagagcgcctgccgggagggctgtgtgtgtgatgctggctttgtgctgagcggggacacctgtgtgcctgtgggccagtgtggctgcctgcatgatggccgctactaccccctgggggaggtgttctacccaggcccagaatgtgaaagaagatgtgaatgtggccctgggggccacgtgacctgccaggagggcgccgcctgtggcccccatgaggagtgccgcctggaggatggagtgcaggcctgccacgccaccggctgcggccgctgcctggccaatggaggcatccactacatcaccctggatggccgggtgtatgacctgcacggcagctgcagctatgtgctggcccaggtgtgccaccccaagccaggagatgaggacttcagcatcgtgctggagaagaatgctgctggggacctgcagaggctgctggtgacagtggccggccaggtggtgtccctggcccagggccagcaggtgacagtggatggagaggccgtggccctgcctgtggccgtgggccgggtgcgggtgacagctgagggcaggaacatggtgctgcagaccaccaagggcctgcggctgctgtttgatggagatgcccacctgctgatgagcatccccagccccttccggggccgcctgtgtggcctgtgtggcaacttcaacggcaactggagcgatgactttgtgctgcccaatggatctgctgccagctctgtggagacctttggagctgcctggagggcccctggcagcagcaagggctgtggggagggctgcggcccccagggctgccctgtgtgcctggccgaggagacagccccctatgagagcaatgaggcctgtggccagctgaggaacccccagggcccctttgccacctgccaggccgtgctgagccccagcgagtacttccggcagtgtgtgtatgacctgtgtgcccagaagggggacaaggccttcctgtgccgcagcctggccgcctacacagctgcctgccaggccgccggcgtggccgtgaagccctggaggacagacagcttctgccccctgcactgcccagcccacagccactacagcatctgcaccaggacctgccagggcagctgtgccgccctgagcggcctgaccggctgcaccacccgctgctttgagggctgtgaatgtgatgaccgcttcctgctgagccagggcgtgtgcatccctgtgcaggactgtggctgcacccacaacggccgctacctgcctgtgaacagcagcctgctgaccagtgactgcagcgagcgctgcagctgcagcagcagcagcggcctgacctgccaggccgccggctgccccccaggccgggtgtgtgaggtgaaggccgaggccaggaactgctgggccacccggggcctgtgtgtgctgtctgtgggcgccaacctgaccacctttgatggagcccggggggccaccaccagccctggggtgtatgagctgagcagccgctgccccggcctgcagaacaccatcccctggtacagagtggtggccgaggtgcagatctgccacggcaagacagaggccgtgggccaggtgcacatcttcttccaggacggcatggtgaccctgacccccaacaagggcgtgtgggtgaatggcctgcgggtggacctgcctgctgagaagctggcctctgtgtctgtgtccaggaccccagatggcagcctgctggtgcggcagaaggccggcgtgcaggtgtggctgggcgccaacgggaaggtggccgtgattgtgtccaatgaccatgctgggaagctgtgtggggcctgtggcaactttgatggagaccagaccaatgactggcatgacagccaggagaagccagccatggagaagtggagggcccaggacttcagcccctgctacggctag

SEQ ID NO: 18447 - DNA, 2502 bp, Artificial Sequence
  Description of Artificial Sequence: Synthetic coding sequence
atggtgcacggctctgtgaccttcagagatgtggccatcgacttcagccaggaggagtgggagtgcctgcagcctgaccagaggaccctgtacagagatgtgatgctggagaactacagccacctgatcagcctgggcagcagcatcagcaagccagatgtgatcaccctgctggagcaggagaaggagccctggatcgtggtgtccaaggagaccagccgctggtacccagacctggagagcaaatatggccctgagaagatcagcccagaaaatgacatctttgagatcaacctgcccaagcacgtgatcaagcagatcagcaagaccctgggcctggaggccttctacttcagaaatgacagcgagtaccgcagcagatttgagggccggcagggccaccaggagggctacatcaaccagaagatcatctcctatgaggagatgcctgcctacacccacgccagccccatccacaacacccacaagccctatgagtgcaaggaatgtgggaagtacttcagctgtggcagcaacctgatccagcaccagagcatccacactggagagaagccctacaagtgcaaggaatgtgggaaggccttccagctgcacatccagctgaccaggcaccagaagttccacactggagagaagacctttgagtgcaaggaatgtgggaaggccttcaacctgcccacccagctgaacagacacaagaacatccacacagtgaagaagctgtttgagtgcaaggaatgtgggaagagcttcaacagaagcagcaacctgacccagcaccagagcatccacgccggcgtgaagccctaccagtgcaaggaatgtgggaaggccttcaacagaggcagcaacctgatccagcaccagaagatccacagcaatgagaagccctttgtgtgcagagaatgtgagatggccttccgctaccactaccagctgattgagcactgccgcatccacactggagagaagccctttgagtgcaaggaatgtaggaaggccttcaccctgctgaccaagctggtgcgccaccagaagatccacatgggagagaagccctttgagtgcagagaatgtgggaaggccttcagcctgctgaaccagctgaacagacacaagaacatccacactggagagaagccctttgagtgcaaggaatgtgggaagagcttcaacagaagcagcaacctgatccagcaccagagcatccacgcagatgtgaagccctatgagtgcaaggaatgtgggaagggcttcaacagaggagccaacctgatccagcaccagaagatccacagcaatgagaagccctttgtgtgcagagaatgtgagatggccttccgctaccactaccagctgatccagcactgccagatccacactggaggcaagccctttgagtgcaaggaatgtgggaaggccttcagcctgctgacccagctggcccggcacaagaacatccacactggagagaagccctttgagtgcaaggactgtgggaaggccttcaacagaggcagcaacctggtgcagcaccagagcatccacactggagagaagccctatgagtgcaaggaatgtgggaaggccttccggctgcacctgcagctgagccagcacgagaagacccacactggagagaagccctttgagtgcaaggaatgtgggaagttcttcagaagaggcagcaacctgaaccagcacaggagcatccacacaggcaagaagccctttgagtgcaaggaatgtgggaaggccttccggctgcacatgcacctgatccgccaccagaagttccacactggagagaagccctttgagtgcaaggaatgtgggaaggccttcagcctgcacacccagctgaaccaccacaagaacatccacactggagagaagcccttcaagtgcaaggaatgtgggaagagcttcaacagagtgagcaacctggtgcagcaccagagcatccacgccggcgtgaagccctatgagtgcaaggaatgtgggaagggcttcagccgggtgagcaacctgatccagcaccagaagacccacagcagcgccaagccctttgtgtgcaaggaatgtaggaagaccttccgctaccactaccagctgacagagcactaccgcatccacactggagagaagccctttgagtgcaaggaatgtgggaaggccttcggcctgctgacccagctggcccagcaccagatcatccacactggagagaagcccttcaagtgcaaggaatgtgggaaggccttcaacagaggcagcaacctggtgcagccccagagcatccacactggagagaagccctatgagtgcaaggaatgtgggaaggccttccggctgcacctgcagctgagcctgcaccagaagctggtgcaggtgaggaaccccctgaatgtgagaaatgtgggccagcccagcgacatcagcagcaacctgctgaacatcaggaagttcatcctgggctag

SEQ ID NO: 18448 - DNA, 618 bp, Artificial Sequence
  Description of Artificial Sequence: Synthetic coding sequence
atgaacaccttccaggcctctgtgtccttccaggatgtgacagtggagttcagccaggaggagtggcagcacatgggccctgtggagaggaccctgtacagagatgtgatgctggagaactacagccacctggtgtctgtgggctactgcttcaccaagccagagctgatcttcaccctggagcagggcgaggacccctggctgctggagaaggagaagggcttcctgagcaggaacagccctgaggacagccagccagatgagatcagcgagaagagccctgagaaccagggcaagcacctgctgcaggtgctcttcaccaacaagctgctgaccacagagcaggagatcagcggcaagccccacaacagagacatcaacatcttccgggccaggatgatgccctgcaagtgtgacattgctggcagcgcctgccagggcctgagcctgatggccccccactgccagtacagcaaggagaaggcccatgaaagaaatgtgtgtgacaagtggctgatcagcatcaaggatggccgcaccaacacccaggagaagagctttgcctacagcaagatcgtgaagaccctgcaccacaaggaggaggtgatccagcactag

SEQ ID NO: 18449 - DNA, 2100 bp, Artificial Sequence
  Description of Artificial Sequence: Synthetic coding sequence
atgaacaccttccaggcctctgtgtccttccaggatgtgacagtggagttcagccaggaggagtggcagcacatgggccctgtggagaggaccctgtacagagatgtgatgctggagaactacagccacctggtgtctgtgggctactgcttcaccaagccagagctgatcttcaccctggagcagggcgaggacccctggctgctggagaaggagaagggcttcctgagcaggaacagccctgaggacagccagccagatgagatcagcgagaagagccctgagaaccagggcaagcacctgctgcaggtgctcttcaccaacaagctgctgaccacagagcaggagatcagcggcaagccccacaacagagacatcaacatcttccgggccaggatgatgccctgcaagtgtgacattgctggcagcgcctgccagggcctgagcctgatggccccccactgccagtacagcaaggagaaggcccatgaaagaaatgtgtgtgacaagtggctgatcagcatcaaggatggccgcaccaacacccaggagaagagctttgcctacagcaagatcgtgaagaccctgcaccacaaggaggaggtgatccagcaccagaccatccagaccctgggccaggactttgagtacaatgaaagcaggaaggccttcctggagaaggccgccctggtgaccagcaacagcacccaccccaagggcaagagctacaacttcaacaagtttggagagaacaagtatgacaagagcaccttcatcatcccccagaacatgaaccctgagaagagccactatgagttcaatgacaccggcaactgcttctgccgcatcacccacaagaccctgactggaggcaagagcttcagccagaagagccacatccgggagcaccaccgggtgcacatcggcgtgaagccctttgaatatggcaagagcttcaacagaaacagcaccctgcctgtgcaccagaggacccacgccacagacaagtacagcgactaccacccctgcacagagaccttctcctaccagagcaccttctctgtgcaccagaaggtgcacatccgggccaagccctatgagtacaatgaatgtgggaagagctgcagcatgaacagccacctgatctggccccagaagagccacactggagagaagccctatgaatgtccagaatgtgggaaggccttcagcgagaagagccggctgaggaagcaccagaggacccacactggagagaagccctacaagtgtgatggctgtgacaaggccttcagcgccaagagcggcctgcgcatccaccagaggacccacactggagagaagccctttgaatgtcatgaatgtgggaagagcttcaactacaagagcatcctgattgtgcaccagaggacccacactggagagaagccctttgaatgtaatgaatgtgggaagagcttcagccacatgagcggcctgaggaaccacaggaggacccacactggagagcggccctacaagtgtgatgaatgtgggaaggccttcaagctgaagagcggcctgaggaagcaccacaggacccacactggagagaagccctacaagtgcaaccagtgtgggaaggccttcggccagaagagccagctgcggggccaccaccgcatccacactggagagaagccctacaagtgcaaccactgtggggaggccttcagccagaagagcaacctgcgggtgcaccacaggacccacactggagagaagccctaccagtgtgaggagtgtgggaagaccttccggcagaagagcaacctgcggggccaccagaggacccacactggagagaagccctatgaatgtaatgaatgtgggaaggccttcagcgagaagtctgtgctgaggaagcaccagaggacccacactggagagaagccctacaactgcaaccagtgtggggaggccttcagccagaagagcaacctgcgggtgcaccagaggacccacactggagagaagccctacaagtgtgacaagtgtggccgcaccttcagccagaagagcagcctgcgggagcaccagaaggcccaccctggggactag

SEQ ID NO: 18450 - DNA, 1704 bp, Artificial Sequence
  Description of Artificial Sequence: Synthetic coding sequence
atgatgccctgcaagtgtgacattgctggcagcgcctgccagggcctgagcctgatggccccccactgccagtacagcaaggagaaggcccatgaaagaaatgtgtgtgacaagtggctgatcagcatcaaggatggccgcaccaacacccaggagaagagctttgcctacagcaagatcgtgaagaccctgcaccacaaggaggaggtgatccagcaccagaccatccagaccctgggccaggactttgagtacaatgaaagcaggaaggccttcctggagaaggccgccctggtgaccagcaacagcacccaccccaagggcaagagctacaacttcaacaagtttggagagaacaagtatgacaagagcaccttcatcatcccccagaacatgaaccctgagaagagccactatgagttcaatgacaccggcaactgcttctgccgcatcacccacaagaccctgactggaggcaagagcttcagccagaagagccacatccgggagcaccaccgggtgcacatcggcgtgaagccctttgaatatggcaagagcttcaacagaaacagcaccctgcctgtgcaccagaggacccacgccacagacaagtacagcgactaccacccctgcacagagaccttctcctaccagagcaccttctctgtgcaccagaaggtgcacatccgggccaagccctatgagtacaatgaatgtgggaagagctgcagcatgaacagccacctgatctggccccagaagagccacactggagagaagccctatgaatgtccagaatgtgggaaggccttcagcgagaagagccggctgaggaagcaccagaggacccacactggagagaagccctacaagtgtgatggctgtgacaaggccttcagcgccaagagcggcctgcgcatccaccagaggacccacactggagagaagccctttgaatgtcatgaatgtgggaagagcttcaactacaagagcatcctgattgtgcaccagaggacccacactggagagaagccctttgaatgtaatgaatgtgggaagagcttcagccacatgagcggcctgaggaaccacaggaggacccacactggagagcggccctacaagtgtgatgaatgtgggaaggccttcaagctgaagagcggcctgaggaagcaccacaggacccacactggagagaagccctacaagtgcaaccagtgtgggaaggccttcggccagaagagccagctgcggggccaccaccgcatccacactggagagaagccctacaagtgcaaccactgtggggaggccttcagccagaagagcaacctgcgggtgcaccacaggacccacactggagagaagccctaccagtgtgaggagtgtgggaagaccttccggcagaagagcaacctgcggggccaccagaggacccacactggagagaagccctatgaatgtaatgaatgtgggaaggccttcagcgagaagtctgtgctgaggaagcaccagaggacccacactggagagaagccctacaactgcaaccagtgtggggaggccttcagccagaagagcaacctgcgggtgcaccagaggacccacactggagagaagccctacaagtgtgacaagtgtggccgcaccttcagccagaagagcagcctgcgggagcaccagaaggcccaccctggggactag

SEQ ID NO: 18451 - DNA, 972 bp, Artificial Sequence
  Description of Artificial Sequence: Synthetic coding sequence
atggctgctgcccggcctgaggcccagagccgcagcagccccaccccagagagccgcagccaggagcccctggacctggtgctggtgcctgatgactgcaggcctggcaccccacccagcgacctgattgagatccaggtggtgaaggtgacagacaccaccctggtgcctgagcccccagagcccggcagcttccactgtgccctgtgcccagctgccttccggctggtgtctgagctgctcttccatgaacatggccacctggccggggctgagggcggcggccagggcggggaccccagccgctgccacgtgtgtggccacagctgccccggccctgccagcctgcgggcccactacagcctgcacactggagagcggccctaccgctgtgccctgtgcccccgggccttcaaggccctggcccccctgctgcggcaccagcacagacatggagtggagcccggcaccagcagaagacctccagacacagctgctgtggccgagcagaggcctggggtggcccctgagagagctgaggtggtgatggctgctgctgctgctggagctgctgtgggcaagccctttgcctgccgcttctgtgccaagcccttccgccgcagcagtgacatgagggaccacgagcgggtgcacactggagagcggccctaccactgcggcatctgtgggaagggcttcacccagagctctgtgctgagcggccacgcccgcatccacactggagagcggcccttccgctgcaccctgtgtgacaggaccttcaacaacagcagcaacttcaggaagcaccagaggacccacttccacggccctggccctggcctgggggacagcggcggccagctgggcagcagcgctgctgagggcagcggcagcggctgcggcgtgggggaccctgctgaggagggccgcggggagacagccaaggtgaaggtggaggccgaccagtag

SEQ ID NO: 18452 - DNA, 1218 bp, Artificial Sequence
  Description of Artificial Sequence: Synthetic coding sequence
atgggcccccccctggcccccaggcctgcccacgtgcctggagaggccggccccaggaggacccgggagagcaggcctggagctgtgtcctttgctgatgtggccgtgtacttcagccctgaggagtgggagtgcctgcggcctgcccagagggccctgtacagagatgtgatgagggagaccttcggccacctgggcgccctgggcttctctgtgcccaagccagccttcatctcctgggtggagggggaggtggaggcctggagccctgaggcccaggaccctgatggagagagcagcgctgccttcagccggggccagggccaggaggccggcagcagagatggaaatgaggagaaggagcggctgaagaagtgccccaagcagaaggaggtggcccacgaggtggccgtgaaggagtggtggcccagcgtggcctgcccagagttctgcaacccccggcagagccccatgaacccctggctgaaggacaccctgacccggcggctgccccacagctgcccagactgtggcaggaacttctcctaccccagcctgctggccagccaccagagggtgcacagcggggagcggcccttcagctgtggccagtgccaggcccgcttcagccagaggcgctacctgctgcagcaccagttcatccacactggagagaagccctacccctgcccagactgtggccgccgcttccggcagaggggcagcctggccatccacagaagagcccacactggagagaagccctatgcctgcagcgactgcaagagccgcttcacctacccctacctgctggccatccaccagaggaagcacactggagagaagccctacagctgcccagactgcagcctgcgctttgcctacaccagcctgctggccatccaccggcgcatccacactggagagaagccctacccctgcccagactgtggccgccgcttcacctacagcagcctgctgctgagccaccggcgcatccacagcgacagccggcccttcccctgtgtggagtgtgggaagggcttcaagaggaagacagccctggaggcccaccgctggatccacaggagctgcagcgagcggcgggcctggcagcaggccgtggtgggccgctctgagcccatccctgtgctgggcggcaaggacccccctgtgcacttccgccacttcccagacatcttccaggagtgtggctag

SEQ ID NO: 18453 - DNA, 1113 bp, Artificial Sequence
  Description of Artificial Sequence: Synthetic coding sequence
atgcctgctgccagcgctgagggccctgtgcccggcagagatgctggggacctgcggcccccaggccgggccggccgggcccactgcttctcctttgctggcttctctgtgcccaagccagccttcatctcctgggtggagggggaggtggaggcctggagccctgaggcccaggaccctgatggagagagcagcgctgccttcagccggggccagggccaggaggccggcagcagagatggaaatgaggagaaggagcggctgaagaagtgccccaagcagaaggaggtggcccacgaggtggccgtgaaggagtggtggcccagcgtggcctgcccagagttctgcaacccccggcagagccccatgaacccctggctgaaggacaccctgacccggcggctgccccacagctgcccagactgtggcaggaacttctcctaccccagcctgctggccagccaccagagggtgcacagcggggagcggcccttcagctgtggccagtgccaggcccgcttcagccagaggcgctacctgctgcagcaccagttcatccacactggagagaagccctacccctgcccagactgtggccgccgcttccggcagaggggcagcctggccatccaccggcgggcccacactggagagaagccctatgcctgcagcgactgcaagagccgcttcacctacccctacctgctggccatccaccagaggaagcacactggagagaagccctacagctgcccagactgcagcctgcgctttgcctacaccagcctgctggccatccaccggcgcatccacactggagagaagccctacccctgcccagactgtggccgccgcttcacctacagcagcctgctgctgagccaccggcgcatccacagcgacagccggcccttcccctgtgtggagtgtgggaagggcttcaagaggaagacagccctggaggcccaccgctggatccacaggagctgcagcgagcggcgggcctggcagcaggccgtggtgggccgctctgagcccatccctgtgctgggcggcaaggacccccctgtgcacttccgccacttcccagacatcttccaggagtgtggctag

SEQ ID NO: 18454 - DNA, 1173 bp, Artificial Sequence
  Description of Artificial Sequence: Synthetic coding sequence
atgggcccccccctggcccccaggcctgcccacgtgcctggagaggccggccccaggaggacccgggagagcaggcctggagctgtgtcctttgctgatgtggccgtgtacttcagccctgaggagtgggagtgcctgcggcctgcccagagggccctgtacagagatgtgatgagggagaccttcggccacctgggcgccctgggcttctctgtgcccaagccagccttcatctcctgggtggagggggaggtggaggcctggagccctgaggcccaggaccctgatggcagcagagatggaaatgaggagaaggagcggctgaagaagtgccccaagcagaaggaggtggcccacgaggtggccgtgaaggagtggtggcccagcgtggcctgcccagagttctgcaacccccggcagagccccatgaacccctggctgaaggacaccctgacccggcggctgccccacagctgcccagactgtggcaggaacttctcctaccccagcctgctggccagccaccagagggtgcacagcggggagcggcccttcagctgtggccagtgccaggcccgcttcagccagaggcgctacctgctgcagcaccagttcatccacactggagagaagccctacccctgcccagactgtggccgccgcttccggcagaggggcagcctggccatccaccggcgggcccacactggagagaagccctatgcctgcagcgactgcaagagccgcttcacctacccctacctgctggccatccaccagaggaagcacactggagagaagccctacagctgcccagactgcagcctgcgctttgcctacaccagcctgctggccatccaccggcgcatccacactggagagaagccctacccctgcccagactgtggccgccgcttcacctacagcagcctgctgctgagccaccggcgcatccacagcgacagccggcccttcccctgtgtggagtgtgggaagggcttcaagaggaagacagccctggaggcccaccgctggatccacaggagctgcagcgagcggcgggcctggcagcaggccgtggtgggccgctctgagcccatccctgtgctgggcggcaaggacccccctgtgcacttccgccacttcccagacatcttccaggagtgtggctag

SEQ ID NO: 18455 - DNA, 2238 bp, Artificial Sequence
  Description of Artificial Sequence: Synthetic coding sequence
atgaggagcaactatgagaccctggtgtccctggatgatggcctgcccaagccagagctgatctcctggattgagcacggcggggagcccttcaggaagtggagggagagccagaagagcggcaacatcatctgcagctctgtggacatgcactttgaccccggctttgaggagcagctgttctggggcagccagcaggccatgaacagcggcaagaccaagagccacttccagctggaccctgagagccagtgcagctttggcagctttgtgtccttccggccagaccagggcatcaccctgggcagcccccagagacatgatgcccgggcccccccacccctggcctgtggccccagcgagagcaccctgaaggagggcatccctggccccaggaacctggacctgcccggcctgtgggatgtgcctgcctgggagagcacccagcacccctggcctgtgtgtggggagagctgctgggagaacaaccacctggtgatgcaccagaggggccacagcaaggacaggacccggcgggcctgggagaagttcaacaagagagctgagacccagatgccctggagcagcccccgggtgcagaggcacttccgctgtggggtgtgtgggaagagcttccggaggaagctgtgcctgctgcggcacctggccgcccacacaggccggggccccttcagaaatgctgatggagagatgtgcttcagacatgagctgacccaccccagccaccggctgccccagcagggcgagaagccagcccagtgcaccccctgtgggaagaggagcctgcctgtggacagcacccaggcccggcgctgccagcacagccgggagggccctgcctcctggagggagggccgcggggccagcagctctgtgcacagcggccagaagccaggcagccggctgccccaggagggcaacagccaccaggagggggacacagaggccctgcagcacggggctgagggcccctgcagctgcagtgaatgtggggagaggagccccatgtctgcccggctggccagcccctgccgggcccacactggagagaagcccttccagtgtgcccactgcaccaagcgcttccggctgcggcggctgctgcaggtgcaccagcacgcccacggcggggagcggcccttcagctgcaggaaatgtgggaaaggatttgccaagcagtgcaagctgacagagcacatccgggtgcacagcggggagaagcccttccgctgtgccaagtgtggcaggaacttccggcagaggggccagctgctgcggcaccagaggctgcacacagatgagaagcccttccagtgcccagaatgtggcctgtccttccggctggagagcatgctgcgggcccaccggctgcggcacggcggggagcggcccttcagctgcagtgaatgtggccggggcttcacccaccagtgcaagctgcgggagcacctgcgggtgcacagcggggagcggcccttccagtgcctgaagtgtgacaagcgcttccggctgaagggcatcctgaaggcccaccagcacacccacagcaaggagcggcccttcagctgtggggagtgtgggaagggcttcacccggcagagcaagctgacagagcacctgcgggtgcacagcggggagcggcccttccagtgcccagagtgcaacagaagcttccggctgaagggccagctgctgagccaccagaggctgcacactggagagcggcccttccagtgcccagaatgtgacaagcgctacagagtgaaggctgacatgaaggcccaccagctgctgcacagcggggagatgcccttcagctgtgaatgtgggaagggctttgtgaagcacagcaagctgattgagcacatccgcacccacactggagagaagcccttccagtgccccaagtgtgacaagagcttccggctgaaggcccagctgctgagccaccagggcctgcacactggagagcggcccttccactgcccagaatgtgacaagaacttccgggagcggggccacatgctgcggcaccagaggatccacaggcctgagcggccctttgcctgtggggactgtgggaagggcttcatctacaagagcaagctggccgagcacatccgggtgcacaccaagagctgcccagccccaaatgagctggacatcaagaagaggctgagccagctgtttgccatgattgaggccgactggagctag

SEQ ID NO: 18456 - DNA, 2349 bp, Artificial Sequence
  Description of Artificial Sequence: Synthetic coding sequence
atggccgagcccccccggctgcccctgacctttgaagatgtggccatctacttcagcgagcaggagtggcaggacctggaggcctggcagaaggagctgtacaagcacgtgatgaggagcaactatgagaccctggtgtccctggatgatggcctgcccaagccagagctgatctcctggattgaacatggaggagagcccttcaggaagtggagggagagccagaagagcggcaacatcatctgcagctctgtggacatgcactttgatcctggctttgaggagcagctgttctggggcagccagcaggccatgaacagcggcaagaccaagagccacttccagctggaccctgagagccagtgcagctttggcagctttgtgtccttccggccagaccagggcatcaccctgggcagcccccagagacatgatgcccgggcccccccacccctggcctgtggccccagcgagagcaccctgaaggagggcatccctggccccaggaacctggacctgcccggcctgtgggatgtgcctgcctgggagagcacccagcacccctggcctgtgtgtggggagagctgctgggagaacaaccacctggtgatgcaccagaggggccacagcaaggacaggacccggcgggcctgggagaagttcaacaagagagctgagacccagatgccctggagcagcccccgggtgcagaggcacttccgctgtggggtgtgtgggaagagcttccggaggaagctgtgcctgctgcggcacctggccgcccacacaggccggggccccttcagaaatgctgatggagagatgtgcttcagacatgagctgacccaccccagccaccggctgccccagcagggcgagaagccagcccagtgcaccccctgtgggaagaggagcctgcctgtggacagcacccaggcccggcgctgccagcacagccgggagggccctgcctcctggagggagggccgcggggccagcagctctgtgcacagcggccagaagccaggcagccggctgccccaggagggcaacagccaccaggagggggacacagaggccctgcagcacggggctgagggcccctgcagctgcagtgaatgtggggagaggagccccatgtctgcccggctggccagcccctgccgggcccacactggagagaagcccttccagtgtgcccactgcaccaagcgcttccggctgcggcggctgctgcaggtgcaccagcacgcccatggaggagagcggcccttcagctgcaggaaatgtgggaagggctttgccaagcagtgcaagctgacagagcacatccgggtgcacagcggggagaagcccttccgctgtgccaagtgtggcaggaacttccggcagaggggccagctgctgcggcaccagaggctgcacacagatgagaagcccttccagtgcccagaatgtggcctgtccttccggctggagagcatgctgcgggcccaccggctgcggcatggaggagagcggcccttcagctgcagtgaatgtggccggggcttcacccaccagtgcaagctgcgggagcacctgcgggtgcacagcggggagcggcccttccagtgcctgaagtgtgacaagcgcttccggctgaagggcatcctgaaggcccaccagcacacccacagcaaggagcggcccttcagctgtggagaatgtgggaagggcttcacccggcagagcaagctgacagagcacctgcgggtgcacagcggggagcggcccttccagtgcccagagtgcaacagaagcttccggctgaagggccagctgctgagccaccagaggctgcacactggagagcggcccttccagtgcccagaatgtgacaagcgctacagagtgaaggctgacatgaaggcccaccagctgctgcacagcggggagatgcccttcagctgtgaatgtgggaaaggatttgtgaagcacagcaagctgattgagcacatccgcacccacactggagagaagcccttccagtgccccaagtgtgacaagagcttccggctgaaggcccagctgctgagccaccagggcctgcacactggagagcggcccttccactgcccagaatgtgacaagaacttccgggagcggggccacatgctgcggcaccagaggatccacaggcctgagcggccctttgcctgtggggactgtgggaagggcttcatctacaagagcaagctggccgagcacatccgggtgcacaccaagagctgcccagccccaaatgagctggacatcaagaagaggctgagccagctgtttgccatgattgaagctgactggagctag

SEQ ID NO: 18457 - DNA, 1056 bp, Artificial Sequence
  Description of Artificial Sequence: Synthetic coding sequence
atgcactttgatcctggctttgaggagcagctgttctggggcagccagcaggccatgaacagcggcaagaccaagagccacttccagctggaccctgagagccagtgcagctttggcagctttgtgtccttccggccagaccagggcatcaccctgggcagcccccagagacatgatgcccgggcccccccacccctggcctgtggccccagcgagagcaccctgaaggagggcatccctggccccaggaacctggacctgcccggcctgtgggatgtgcctgcctgggagagcacccagcacccctggcctgtgtgtggggagagctgctgggagaacaaccacctggtgatgcaccagaggggccacagcaaggacaggacccggcgggcctgggagaagttcaacaagagagctgagacccagatgccctggagcagcccccgggtgcagaggcacttccgctgtggggtgtgtgggaagagcttccggaggaagctgtgcctgctgcggcacctggccgcccacacaggccggggccccttcagaaatgctgatggagagatgtgcttcagacatgagctgacccaccccagccaccggctgccccagcagggcgagaagccagcccagtgcaccccctgtgggaagaggagcctgcctgtggacagcacccaggcccggcgctgccagcacagccgggagggccctgcctcctggagggagggccgcggggccagcagctctgtgcacagcggccagaagccaggcagccggctgccccaggagggcaacagccaccaggagggggacacagaggccctgcagcacggggctgagggcccctgcagctgcagtgaatgtggggagaggagccccatgtctgcccggctggccagcccctgccgggcccacactggagagaagcccttccagtgtgcccactgcaccaagcgcttccggctgcggcggctgctgcaggtgcaccagcacgcccatggaggagaaacagtgctgctgcaggaggtgtggcagggcctgcggcaggccgtgtag

SEQ ID NO: 18458 - DNA, 1152 bp, Artificial Sequence
  Description of Artificial Sequence: Synthetic coding sequence
atggagctgcgggaggaggcctggagccctggccccctggacagcgaggaccagcagatggccagccatgagaaccctgtggacatcctgatcatggatgatgatgatgtgcccagctggccacccaccaagctgagccccccccagagcgcccccccagctggccccccaccccggccccggcccccagccccctacatctgcaatgaatgtgggaagagcttcagccactggagcaagctgaccaggcaccagaggacccacactggagagcggcccaatgcctgtgccgactgtgggaagaccttcagccagagcagccacctggtgcagcaccggcgcatccacactggagagaagccctatgcctgcctggagtgtgggaagcgcttctcctggagcagcaacctgatgcagcaccagaggatccacactggagagaagccctacacctgcccagactgtggccgctccttcacccagagcaagagcctggccaagcacagaagaagccacagcggcctgaagccctttgtgtgcccccgctgtggccggggcttcagccagcccaagagcctggcccggcacctgcggctgcaccctgagctgagcggccctggggtggccgccaaggtgctggccgcctctgtgcggcgggccaagggccctgaggaggccgtggccgcagatggagaaattgccatccctgtgggagatggagagggcatcatcgtggtgggcgcccctggagagggcgctgctgctgctgctgccatggccggggccggggccaaggctgctggccccaggagccggcgggccccagcccccaagccctacgtgtgcctggagtgtgggaaaggatttggacatggagctggcctgctggcccaccagagggcccagcacggagatggcctgggcgccgccggcggggaggagcccgcccacatctgtgtggagtgtggggagggctttgtgcagggcgccgccctgcggcggcacaagaagatccatgctgtgggcgcccccagcgtgtgcagcagctgtggccagagctactacagagctggaggagaggaggaggatgatgatgatgatgaagctgctgggggccgctgcccagagtgccggggcggggagggccgctag

SEQ ID NO: 18459 - DNA, 1848 bp, Artificial Sequence
  Description of Artificial Sequence: Synthetic coding sequence
atgaatgtgcgcatcctgcggcggcacctggtgttccccttcatcttcatcgtcatcaaggagctgaccctggagggcacccccatgaatgtgaacaacctggagaaccccctggatgccccccagaacttcaagtgcatgcagggcctgtctgtggagaagccctacaagtgcaagaagtgtgagaaggccttcaacaacctgagcagcttccagatccacgagaggatgcaccggggcggcaagtaccacgcctgcaagggcagcggcaacacctaccgcttcagcggcttctaccaccgccacaagatgcctcatgctgggggcaagttctacggctgcaagaagtgtgggaaggccttcatctccttctgtgccttccgctaccaccagaggacccacaccaaggagaagccctatgcctgcaagcagtgtgggaaggcctacatctcctacaccagcttccagtaccaccagctgaaccacactggagccaagtgctatgagtgcaagcagtgtgggaaaggatttgacctgcccaacagcatccgctaccacgagatgacccacactggagagaagccccatgagtgcaagcagtgtgggaagaccttccgctgtgccagcagcctgcgcatccacggccgcacccacactggagagaagccctatgagtgcaagcagtgtgggaaggtgagccgctactggagcggcctgcaggtgcatgaggtgacccacatcggcaagaagctgtatgagtgcaaggaatgtgggaagagctactacagcagcggcagcttcctgaaccacaagaggatccacacccgggagaagagctatgagtgcaaggaatgtgggaaggcctttggaaaccccatctccttccagaagcatgagggcagccacaggaagtggaagccctatgagtgcaaggaatgtgggaaggtgttctccttcagcagcagcctgcggagacatgagaggacccacacagagaagctgtgtgagtgcaagcagcacggcaagggcttcttccacaggagctgccccaggcacatgaagattgacacaggagagatcctgcacaagaggaagatccggggcaaggtgttccacagccccagcagcttccagacctgtgagaggagccacacccgggagaagcgctacaagtgcaagcagtgtgggaagcccttcatctacttcaatgccttccagaggcaccagaggagccacactggagagaacccctatgagtgcaagcagtgtgggaaggcctgcatcagcagcacagccttccagtgccgggagctgagccacactggagccaagcgctacaagtgcaagcagtgtgggaagggcttcaacctgcccagcagcatccgctaccacgagatgacccacactggagagaagccctatgagtgcaagcagtgtggccgggccttccgcagcgccagccacctgcggacccatgagaggacccacatcggggagaagccctatgagtgcaagcagtgtgggaaggtgtaccgctactggagcggcctgcgcatccacggcctgacccacatcggcaagaagccctatgagttcaatgaccggggcaagagcttctacagcagcaacttcttcctgaaccacaagagggtgcacaccagggtgaagacctatgagtgcaaggaatgtgggaaggcctttgacaaccccaccagcttccagaagcatgagggcagccacaggaagggcaagagctatgagtgcaaggaatgtgggaaggtgttctccttcagccgctccttccgccgctatgaaagagcccacactggagagaagccctgtgagtag

SEQ ID NO: 18460 - DNA, 780 bp, Artificial Sequence
  Description of Artificial Sequence: Synthetic coding sequence
cgcagccacacccgggagaagcgctacaagtgcaagcagtgtgggaagcccttcatctacttcaatgccttccagaggcaccagaggagccacactggagagaacccctatgagtgcaagcagtgtgggaaggcctgcatcagcagcacagccttccagtgccgggagctgagccacactggagccaagcgctacaagtgcaagcagtgtgggaagggcttcaacctgcccagcagcatccgctaccacgagatgacccacactggagagaagccctatgagtgcaagcagtgtggccgggccttccgcagcgccagccacctgcggacccatgagaggacccacatcggggagaagccctatgagtgcaagcagtgtgggaaggtgtaccgctactggagcggcctgcgcatccacggcctgacccacatcggcaagaagccctatgagtgcaaggaatgtgggaaggcctttgacaaccccaccagcttccagaagcatgagggcagccacaggaagggcaagagctatgagtgcaaggaatgtgggaaggtgttctccttcagccgctccttcagaagacatggccgcatgcacactggagagaagccctatgagtgcaagaactgtgggaaggccttcaccagcgccaagagcctgcagaaccacggccgcacccacactggagagaagccctgtgagtgcaagcagtgtgggaaggccttcatctgcagcagcagctgccagagacatgaggagacccacagcgtgaacatgtag

SEQ ID NO: 18461 - DNA, 1278 bp, Artificial Sequence
  Description of Artificial Sequence: Synthetic coding sequence
atgtttcctccagcccggggcaaggagctgctgagctttgaagatgtggccatgtacttcacccgggaggagtggggccacctgaactggggccagaaggacctgtacagagatgtgatgctggagaactacagaaacatggtgctgctgggcttccagttccccaagccagagatgatctgccagctggagaactgggatgagcagtggatcctggacctgcccaggactggaaacaggaaggccagcggcagcgcctgccccggcagcgaggcccggcacaagatgaagaagctgacccccaagcagaagttcagcgaggacctggagagctacaagatctctgtggtgatgcaggagagcgctgagaagctgtctgagaagctgcacaagtgcaaggagtttgtggacagctgccgcctgaccttccccaccagcggagatgagtacagccggggcttcctgcagaacctgaacctgatccaggaccagaatgcccagacccgctggaagcagggccgctatgatgaagatggcaagcccttcaaccagaggagcctgctgctgggccacgagcgcatcctgacccgggccaagagctatgagtgcagtgaatgtgggaaggtgatccggaggaaggcctggtttgaccagcaccagaggatccacttcctggagaacccctttgagtgcaaggtgtgtggccaggccttccggcagaggtctgccctgactgtgcacaagcagtgccacctgcagaacaagccctaccgctgccacgactgtgggaagtgcttccggcagctggcctacctggtggagcacaagaggatccacaccaaggagaagccctacaagtgcagcaaatgtgagaagaccttcagccagaacagcaccctcatccgccaccaggtgatccacagcggggagaagaggcacaagtgcctggagtgtgggaaggccttcggccgccacagcaccctgctgtgccaccagcagatccacagcaagcccaacacccacaagtgcagtgaatgtggccagagctttggaagaaatgtggacctgatccagcaccagaggatccacaccaaggaggagttcttccagtgtggagaatgtgggaagaccttctccttcaagaggaacctcttccgccaccaggtgatccacacaggcagccagccctaccagtgtgtgatctgtgggaagagcttcaagtggcacaccagcttcatcaagcaccagggcacccacaagggccagatcagcacctag

SEQ ID NO: 18462 - DNA, 189 bp, Artificial Sequence
  Description of Artificial Sequence: Synthetic coding sequence
atgtttcctccagcccggggcaaggagctgctgagctttgaagatgtggccatgtacttcacccgggaggagtggggccacctgaactggggccagaaggacctgtacagagatgtgatgctggagaactacagaaacatggtgctgctggtgtacttccagtttgatgctgccatccccctgtgctag

SEQ ID NO: 18463 - DNA, 1911 bp, Artificial Sequence
  Description of Artificial Sequence: Synthetic coding sequence
atggcccacctgatgatgttcagagatgtggccgtggacttcagccaggaggagtgggagtgcctggacctggagcagagggacctgtacagagatgtgatgctggagaactacagcaacatggtgtccctgggcttctgcatctaccagcctgaggccttcagcctgctggagaagggcaaggagccctggaagatcctgagagatgagacccggggcccctgcccagacatgcagagccgctgccagaccaagaagctgctgcccaagaatggcatctttgagcgggagatcgcccagctggagatcatgaggatctgcaagaaccacagcctggactgcctgtgcttccggggggactgggagggcaacacccagttccagaccctgcaggacaaccaggaggagtgcttcaagcaggtgatccgcacctgtgagaagaggcccaccttcaaccagcacacagtgttcaacctgcaccagaggctgaacacaggagacaagctgaatgagttcaaggagctgggcaaggccttcatcagcggcagtgaccacacccagcaccagctgatccacaccagcgagaagttctgtggggacaaggaatgtggcaacaccttcctgcctgattctgaggtgatccagtaccagacagtgcacacagtgaagaagacctatgagtgcaaggaatgtgggaagagcttcagcctgcggagcagcctgaccggccacaagaggatccacactggagagaagcccttcaagtgcaaggactgtgggaaggccttccgcttccacagccagctgtctgtgcacaagaggatccacactggagagaagagctatgagtgcaaggaatgtgggaaggccttcagctgtggcagtgacctgaccaggcaccagaggatccacactggagagaagccctatgaatgtaatgaatgtaggaaggccttcagccagaggagccacctgatcaagcaccagaggatccacactggagagaagccctatgagtgcaaggaatgtgggaaggccttcacccggggcagccacctgacccagcaccagaggatccacactggagagaagagccatgagtgcaaggaatgtgggaaggccttcatccggggcagcaacctggcccagcaccagaatgtgcacgtgggcaggaagccctacaagtgtgagaagtgtgggaaggcctacatctggagcagccacctggcccggcaccagaggatccacactggaaggaagccctatgagtgcaagcagtgtgggaagaccttcacctgggccagctacctggcccagcacgagaagatccacaatgaaaggaagagctatgagtgcaaggaatgtgggaagaccttcctgcacggcagcgagttcaacagacaccagaagatccacactggagagaggaactatgagtgcaaggaatgtgggaagaccttcttccggggcagcgagctgaacagacaccagaagatccacacaggcaagaggccctatgaatgtgaggagtgtgggaaggccttcctgtggggcagccagctgaccaggcaccagaggatgcacactggagaggagccctacgtgtgcaaggaatgtgggaagagcttcatctggggcagccagctgaccaggcacaagaagatccacacagatgctgagccctacggctgcaagaagagcagccacatcttcagccaccacagctacttcacagagcagaagatccacaacagcgccaacctgtgtgagtggacagattatggcaacaccttcagccatgagagcaactttgcccagcaccagaacatctacacctttgagaagagctatgagttcaaggactttgagaaggccttcagcagcagcagccacttcatcagcctgctgtag

SEQ ID NO: 18464 - DNA, 408 bp, Artificial Sequence
  Description of Artificial Sequence: Synthetic coding sequence
atggcccacctgatgatgttcagagatgtggccgtggacttcagccaggaggagtgggagtgcctggacctggagcagagggacctgtacagagatgtgatgctggagaactacagcaacatggtgtccctgggcttctgcatctaccagcctgaggccttcagcctgctggagaagggcaaggagccctggaagatcctgagagatgagacccggggcccctgcccagacatgcagagccgctgccagaccaagaagctgctgcccaagaatggcatctttgagcgggagatcgcccagctggagatcatgaggatctgcaagaaccacagcctggactgcctgtgcttccggggggactgggagggcaacacccagttccagaccctgcaggacaaccaggagtag

SEQ ID NO: 18465 - DNA, 150 bp, Artificial Sequence
  Description of Artificial Sequence: Synthetic coding sequence
atggcccacctgatgatgttcagagatgtggccgtggacttcagccaggaggagtgggagtgcctggacctggagcagagggacctgtacagagatgtgatgctggagaactacagcaacatggtgtccctgggcttctgcatctactag

SEQ ID NO: 18466 - DNA, 540 bp, Artificial Sequence
  Description of Artificial Sequence: Synthetic coding sequence
atggcccacctgatgatgttcagagatgtggccgtggacttcagccaggaggagtgggagtgcctggacctggagcagagggacctgtacagagatgtgatgctggagaactacagcaacatggtgtccctgggcttctgcatctaccagcctgaggccttcagcctgctggagaagggcaaggagccctggaagatcctgagagatgagacccggggcccctgcccagacatgcagagccgctgccagaccaagaagctgctgcccaagaatggcatctttgagcgggagatcgcccagctggagatcatgaggatctgcaagaaccacagcctggactgcctgtgcttccggggggactgggagggcaacacccagttccagaccctgcaggacaaccaggaggagtgcttcaagcaggtgatccgcacctgtgagaagaggcccaccttcaaccagcacacagtgttcaacctgcaccagaggctgaacacaggagacaagctgaatgagttcaaggagctgggcaaggccttctag

SEQ ID NO: 18467 - DNA, 1731 bp, Artificial Sequence
  Description of Artificial Sequence: Synthetic coding sequence
atggattctgtggcctttgaagatgtgtctgtgtccttcagccaggaggagtgggccctgctggcccccagccagaagaagctgtacagagatgtgatgcaggagaccttcaagaacctggccagcattggagagaagtgggaggaccccaacgtggaggaccagcacaagaaccagggcaggaacctgcggagccacactggagagcggctgtgtgagggcaaggagggcagccagtgtgccgagaacttcagccccaacctgtctgtgaccaagaagacagctggggtgaagccctatgaatgtaccatctgtgggaaggccttcatgaggctgagcagcctgaccaggcacatgaggagccacacaggctatgagctgtttgagaagccctacaagtgcaaggaatgtgagaaggccttctcctacctgaagagcttccagagacatgagaggagccacactggagagaagccctacaagtgcaagcagtgtgggaagaccttcatctaccaccagcccttccagagacatgagaggacccacatcggggagaagccctatgagtgcaagcagtgtgggaaggccctgagctgcagcagcagcctgcgggtgcatgagcgcatccacactggagagaagccctatgagtgcaagcagtgtgggaaggccttcagctgcagcagcagcatccgggtgcatgagaggacccacactggagagaagccctatgcctgcaaggaatgtgggaaggccttcatcagccacacctctgtgctgacccacatgatcacccacaatggagaccggccctacaagtgcaaggaatgtgggaaggccttcatcttccccagcttcctgcgggtgcatgagcgcatccacactggagagaagccctacaagtgcaagcagtgtgggaaggccttccgctgcagcaccagcatccagatccacgagcgcatccacactggagagaagccctacaagtgcaaggaatgtgggaagagcttcagcgcccggcctgccttccgggtgcacgtgcgggtgcacactggagagaagccctacaagtgcaaggaatgtgggaaggccttcagccgcatctcctacttccgcatccacgagaggacccacactggagagaagccctatgagtgcaagaagtgtgggaagaccttcaactaccccctggacctgaagatccacaagaggaaccacactggagagaagccctatgagtgcaaggaatgtgccaagaccttcatcagcctggagaacttccgccgccacatgatcacccacactggagatggcccctacaagtgccgggactgtgggaaggtgttcatcttccccagcgccctgcggacccatgagaggacccacactggagagaagccctatgagtgcaagcagtgtgggaaggccttcagctgcagcagctacatccgcatccacaagaggacccacactggagagaagccctatgagtgcaaggaatgtgggaaggccttcatctaccccaccagcttccagggccacatgaggatgcacactggagagaagccctacaagtgcaaggaatgtgggaaggccttcagcctgcacagcagcttccagaggcacacccgcatccacaactatgagaagcccctggagtgcaagcagtgtgggaaggccttctctgtgtccaccagcctgaagaagcacatgaggatgcacaacagatag

SEQ ID NO: 18468 - DNA, 1434 bp, Artificial Sequence
  Description of Artificial Sequence: Synthetic coding sequence
atggattctgtggcctttgaagatgtgtctgtgtccttcagccaggaggagtgggccctgctggcccccagccagaagaagctgtacagagatgtgatgcaggagaccttcaagaacctggccagcattggagagaagtgggaggaccccaacgtggaggaccagcacaagaaccagggcaggaacctgcggagccacactggagagcggctgtgtgagggcaaggagggcagccagtgtgccgagaacttcagccccaacctgtctgtgaccaagaagacagctggggtgaagccctatgaatgtaccatctgtgggaaggccttcatgaggctgagcagcctgaccaggcacatgaggagccacacaggctatgagctgtttgagaagccctacaagtgcaaggagagcggggagaagccctacaagtgcaagcagtgtgggaagaccttcatctaccaccagcccttccagagacatgagaggacccacatcggggagaagccctatgagtgcaagcagtgtgggaaggccctgagctgcagcagcagcctgcgggtgcatgagcgcatccacactggagagaagccctatgagtgcaagcagtgtgggaaggccttcagctgcagcagcagcatccgggtgcatgagaggacccacactggagagaagccctatgcctgcaaggaatgtgggaaggccttcatcagccacacctctgtgctgacccacatgatcacccacaatggagaccggccctacaagtgcaaggaatgtgggaaggccttcatcttccccagcttcctgcgggtgcatgagcgcatccacactggagagaagccctacaagtgcaagcagtgtgggaaggccttccgctgcagcaccagcatccagatccacgagcgcatccacactggagagaagccctacaagtgcaaggaatgtgggaagagcttcagcgcccggcctgccttccgggtgcacgtgcgggtgcacactggagagaagccctacaagtgcaaggaatgtgggaaggccttcagccgcatctcctacttccgcatccacgagaggacccacactggagagaagccctatgagtgcaagaagtgtgggaagaccttcaactaccccctggacctgaagatccacaagaggaaccacactggagagaagccctatgagtgcaaggactgtgggaaggtgttcatcttccccagcgccctgcggacccatgagaggacccacactggagagaagccctatgagtgcaagcagtgtgggaaggccttcagctgcagcagctacatccgcatccacaagaggacccacactggagagaagccctatgagtgcaaggaatgtgggaaggccttcatctaccccaccagcttccagggccacatgaggatgcacactggagagaagccctag

SEQ ID NO: 18469 - DNA, 1635 bp, Artificial Sequence
  Description of Artificial Sequence: Synthetic coding sequence
atgcaggagaccttcaagaacctggccagcattggagagaagtgggaggaccccaacgtggaggaccagcacaagaaccagggcaggaacctgcggagccacactggagagcggctgtgtgagggcaaggagggcagccagtgtgccgagaacttcagccccaacctgtctgtgaccaagaagacagctggggtgaagccctatgaatgtaccatctgtgggaaggccttcatgaggctgagcagcctgaccaggcacatgaggagccacacaggctatgagctgtttgagaagccctacaagtgcaaggaatgtgagaaggccttctcctacctgaagagcttccagagacatgagaggagccacactggagagaagccctacaagtgcaagcagtgtgggaagaccttcatctaccaccagcccttccagagacatgagaggacccacatcggggagaagccctatgagtgcaagcagtgtgggaaggccctgagctgcagcagcagcctgcgggtgcatgagcgcatccacactggagagaagccctatgagtgcaagcagtgtgggaaggccttcagctgcagcagcagcatccgggtgcatgagaggacccacactggagagaagccctatgcctgcaaggaatgtgggaaggccttcatcagccacacctctgtgctgacccacatgatcacccacaatggagaccggccctacaagtgcaaggaatgtgggaaggccttcatcttccccagcttcctgcgggtgcatgagcgcatccacactggagagaagccctacaagtgcaagcagtgtgggaaggccttccgctgcagcaccagcatccagatccacgagcgcatccacactggagagaagccctacaagtgcaaggaatgtgggaagagcttcagcgcccggcctgccttccgggtgcacgtgcgggtgcacactggagagaagccctacaagtgcaaggaatgtgggaaggccttcagccgcatctcctacttccgcatccacgagaggacccacactggagagaagccctatgagtgcaagaagtgtgggaagaccttcaactaccccctggacctgaagatccacaagaggaaccacactggagagaagccctatgagtgcaaggaatgtgccaagaccttcatcagcctggagaacttccgccgccacatgatcacccacactggagatggcccctacaagtgccgggactgtgggaaggtgttcatcttccccagcgccctgcggacccatgagaggacccacactggagagaagccctatgagtgcaagcagtgtgggaaggccttcagctgcagcagctacatccgcatccacaagaggacccacactggagagaagccctatgagtgcaaggaatgtgggaaggccttcatctaccccaccagcttccagggccacatgaggatgcacactggagagaagccctacaagtgcaaggaatgtgggaaggccttcagcctgcacagcagcttccagaggcacacccgcatccacaactatgagaagcccctggagtgcaagcagtgtgggaaggccttctctgtgtccaccagcctgaagaagcacatgaggatgcacaacagatag

SEQ ID NO: 18470 - DNA, 1404 bp, Artificial Sequence
  Description of Artificial Sequence: Synthetic coding sequence
atgaggctgagcagcctgaccaggcacatgaggagccacacaggctatgagctgtttgagaagccctacaagtgcaaggaatgtgagaaggccttctcctacctgaagagcttccagagacatgagaggagccacactggagagaagccctacaagtgcaagcagtgtgggaagaccttcatctaccaccagcccttccagagacatgagaggacccacatcggggagaagccctatgagtgcaagcagtgtgggaaggccctgagctgcagcagcagcctgcgggtgcatgagcgcatccacactggagagaagccctatgagtgcaagcagtgtgggaaggccttcagctgcagcagcagcatccgggtgcatgagaggacccacactggagagaagccctatgcctgcaaggaatgtgggaaggccttcatcagccacacctctgtgctgacccacatgatcacccacaacggggaccggccctacaagtgcaaggaatgtgggaaggccttcatcttccccagcttcctgcgggtgcatgagcgcatccacactggagagaagccctacaagtgcaagcagtgtgggaaggccttccgctgcagcaccagcatccagatccacgagcgcatccacactggagagaagccctacaagtgcaaggaatgtgggaagagcttcagcgcccggcctgccttccgggtgcacgtgcgggtgcacactggagagaagccctacaagtgcaaggaatgtgggaaggccttcagccgcatctcctacttccgcatccacgagaggacccacactggagagaagccctatgagtgcaagaagtgtgggaagaccttcaactaccccctggacctgaagatccacaagaggaaccacactggagagaagccctatgagtgcaaggaatgtgccaagaccttcatcagcctggagaacttcagaagacacatgatcacccacactggagatggcccctacaagtgccgggactgtgggaaggtgttcatcttccccagcgccctgcggacccatgagaggacccacactggagagaagccctatgagtgcaagcagtgtgggaaggccttcagctgcagcagctacatccgcatccacaagaggacccacactggagagaagccctatgagtgcaaggaatgtgggaaggccttcatctaccccaccagcttccagggccacatgaggatgcacactggagagaagccctacaagtgcaaggaatgtgggaaggccttcagcctgcacagcagcttccagaggcacacccgcatccacaactatgagaagcccctggagtgcaagcagtgtgggaaggccttctctgtgtccaccagcctgaagaagcacatgaggatgcacaacagatag

SEQ ID NO: 18471 - DNA, 1035 bp, Artificial Sequence
  Description of Artificial Sequence: Synthetic coding sequence
ctggccgagcaccagaccacccacccccggcagaagccctttgtgtgtgaggagagcggagatgccttcaacaacaagagcaccctggtgcagcaccagaggatccacagccgggagcggccctatgaatgttccaaatgtggcatcttcttcacctacgccgctgacctgacccagcaccagaaggtgcacaacagaggcaagccctatgagtgctgtgaatgtgggaagttcttcagccagcacagcagcctggtgaagcacagaagagtgcacactggagagagcccccacgtgtgtggggactgtgggaagttcttcagccgcagcagcaacctgatccagcacaagagggtgcacactggagagaagccctatgaatgtagtgactgtgggaagttcttcagccagaggagcaacctgatccaccacaagagggtgcacacaggccgcagcgcccatgaatgttctgaatgtgggaagagcttcaactgcaacagcagcctcatcaagcactggagggtgcacactggagagcggccctacaagtgcaatgaatgtgggaagttcttcagccacatcgccagcctcatccagcaccagatcgtgcacactggagagcggccccacggctgtggggagtgtgggaaggccttcagccgcagcagtgacctgatgaagcaccagagggtgcacactggagagcggccctatgaatgtaatgaatgtgggaagctgttcagccagagcagcagcctgaacagccaccggcggctgcacactggagagcggccctaccagtgcagtgaatgtgggaagttcttcaaccagagcagcagcctgaacaaccaccggcggctgcacactggagagcggccctatgaatgttctgaatgtgggaagaccttccggcagaggagcaacctgcggcagcacctgaaggtgcacaagccagaccggccctatgaatgttctgaatgtgggaaggccttcaaccagaggcccaccctcatccgccaccagaagatccactag

SEQ ID NO: 18472 - DNA, 1899 bp, Artificial Sequence
  Description of Artificial Sequence: Synthetic coding sequence
atggctgctgctgccctgcgggaccctgcccagggctgtgtgacctttgaagatgtgaccatctacttcagccaggaggagtgggtgctgctggatgaggcccagaggctgctgtactgtgatgtgatgctggagaactttgccctgattgccagcctgggcctcatctccttccgcagccacatcgtgtcccagctggagatgggcaaggagccctgggtgcctgattctgtggacatgaccagcgccatggcccggggggcctacggccggcccggcagtgacttctgccacggcacagagggcaaggacctgcccagcgagcacaacgtgtctgtggagggcgtggcccaggacaggagccctgaggccaccctgtgcccccagaagacctgcccctgtgacatctgtggcctgcggctgaaggacatcctgcacctggccgagcaccagaccacccacccccggcagaagccctttgtgtgtgaggcctacgtgaagggcagcgagttcagcgccaacctgcccaggaagcaggtgcagcagaatgtgcacaaccccatcagaacagaggagggccaggccagccctgtgaagacctgccgggaccacaccagtgaccagctgagcacctgccgggagggcggcaaggactttgtggccacagctggcttcctgcagtgtgaggtgacccccagtgatggagagccccatgaggccacagaaggagtggtggacttccacatcgccctgcggcacaacaagtgctgtgagagcggagatgccttcaacaacaagagcaccctggtgcagcaccagaggatccacagccgggagcggccctatgaatgttccaaatgtggcatcttcttcacctacgccgctgacctgacccagcaccagaaggtgcacaacagaggcaagccctatgagtgctgtgaatgtgggaagttcttcagccagcacagcagcctggtgaagcacagaagagtgcacactggagagagcccccacgtgtgtggggactgtgggaagttcttcagccgcagcagcaacctgatccagcacaagagggtgcacactggagagaagccctatgaatgtagtgactgtgggaagttcttcagccagaggagcaacctgatccaccacaagagggtgcacacaggccgcagcgcccatgaatgttctgaatgtgggaagagcttcaactgcaacagcagcctcatcaagcactggagggtgcacactggagagcggccctacaagtgcaatgaatgtgggaagttcttcagccacatcgccagcctcatccagcaccagatcgtgcacactggagagcggccccacggctgtggggagtgtgggaaggccttcagccgcagcagtgacctgatgaagcaccagagggtgcacactggagagcggccctatgaatgtaatgaatgtgggaagctgttcagccagagcagcagcctgaacagccaccggcggctgcacactggagagcggccctaccagtgcagtgaatgtgggaagttcttcaaccagagcagcagcctgaacaaccaccggcggctgcacactggagagcggccctatgaatgttctgaatgtgggaagaccttccggcagaggagcaacctgcggcagcacctgaaggtgcacaagccagaccggccctatgaatgttctgaatgtgggaaggccttcaaccagaggcccaccctcatccgccaccagaagatccacatccgggagaggtccatggagaatgtgctgctgccctgcagccagcacaccccagagatcagcagtgaaaatcggccctaccagggcgctgtgaactacaagctgaagctggtgcaccccagcacccaccctggagaggtgccctag

SEQ ID NO: 18473 - DNA, 1836 bp, Artificial Sequence
  Description of Artificial Sequence: Synthetic coding sequence
atgcaggagaccatccggaacctggactgtgtgggcatgaagtggaaggaccagaacatcgaggaccagtaccgctaccccaggaagaacctgcgctgcaggatgctggagagatttgtggagagcaaggatggcacccagtgtggggagaccagcagccagatccaggacagcatcgtgaccaagaacaccctgcccggggtgggcccctatgagagcaggatgtctggagaggtgatcatgggccacagcagcctgaactgctacatccgggtgggcgccggccacaagccctatgagtaccatgaatgtggggagaagccagacacccacaagcagaggggcaaggccttctcctaccacaacagcctgcagacccatgagcggctgcacacaggcaagaagccctacaactgcaaggaatgtgggaagagcttcagcagcctgggcaacctgcagaggcacatggctgtgcagagaggagatggcccctacaagtgcaagctgtgtgggaaggccttcttctggcccagcctgctgcacatgcatgagaggacccacactggagagaagccctatgagtgcaagcagtgcagcaaggccttctccttctacagcagctacctgcggcatgagaggacccacactggagagaagctgtatgagtgcaagcagtgcagcaaggccttcccagactacagcagctgcctgcggcatgagaggacccacacaggcaagaagccctacacctgcaagcagtgtgggaaggccttcagcgccagcaccagcctgcggagacatgagaccacccacacagatgagaagccctatgcctgccagcagtgtgggaaggccttccaccacctgggcagcttccagaggcacatggtgatgcacaccagagatggcccccacaagtgcaagatctgtgggaagggctttgactgccccagcagcctgaagagccatgagaggacccacactggagagaagctgtatgagtgcaagcagtgtgggaaggccctgagccacagcagcagcttcagaagacacatgaccatgcacactggagatggcccccacaagtgcaagatctgtgggaaggcctttgtgtaccccagcgtcttccagagacatgagaagacccacacagctgagaagccctacaagtgcaagcagtgtgggaaggcctaccgcatcagcagcagcctgcggagacatgagaccacccacactggagagaagccctacaagtgcaagtgtgggaaggccttcatcgacttctacagcttccagaaccacaagaccacccatgctggggagaagccctatgagtgcaaggaatgtgggaaggccttcagctgcttccagtacctgagccagcacaggaggacccacactggagagaagccctatgagtgcaacacctgcaagaaggccttcagccacttcggcaacctgaaggtgcatgagcgcatccacagcggggagaagccctatgagtgcaaggaatgtgggaaggccttctcctggctgacctgcttcctgcggcatgagcgcatccacatgagggagaagccctatgagtgccagcagtgtgggaaggccttcacccacagccgcttcctgcagggccacgagaagacccacactggagagaacccctatgagtgcaaggaatgtgggaaggcctttgccagcctgagcagcctgcaccgccacaagaagacccactggaagaagacccacactggagagaacccctacggctgcaaggaatgtgggaaggcctttgccagcctgagcagcctgcaccgccacaagaagacccactag

SEQ ID NO: 18474 - DNA, 1932 bp, Artificial Sequence
  Description of Artificial Sequence: Synthetic coding sequence
atggcctctgtggccctggaggatgtggccgtgaacttcacccgggaggagtgggccctgctgggcccctgccagaagaacctgtacaaggatgtgatgcaggagaccatccggaacctggactgtgtgggcatgaagtggaaggaccagaacatcgaggaccagtaccgctaccccaggaagaacctgcgctgcaggatgctggagagatttgtggagagcaaggatggcacccagtgtggggagaccagcagccagatccaggacagcatcgtgaccaagaacaccctgcccggggtgggcccctatgagagcaggatgtctggagaggtgatcatgggccacagcagcctgaactgctacatccgggtgggcgccggccacaagccctatgagtaccatgaatgtggggagaagccagacacccacaagcagaggggcaaggccttctcctaccacaacagcctgcagacccatgagcggctgcacacaggcaagaagccctacaactgcaaggaatgtgggaagagcttcagcagcctgggcaacctgcagaggcacatggctgtgcagagaggagatggcccctacaagtgcaagctgtgtgggaaggccttcttctggcccagcctgctgcacatgcatgagaggacccacactggagagaagccctatgagtgcaagcagtgcagcaaggccttctccttctacagcagctacctgcggcatgagaggacccacactggagagaagctgtatgagtgcaagcagtgcagcaaggccttcccagactacagcagctgcctgcggcatgagaggacccacacaggcaagaagccctacacctgcaagcagtgtgggaaggccttcagcgccagcaccagcctgcggagacatgagaccacccacacagatgagaagccctatgcctgccagcagtgtgggaaggccttccaccacctgggcagcttccagaggcacatggtgatgcacaccagagatggcccccacaagtgcaagatctgtgggaagggctttgactgccccagcagcctgaagagccatgagaggacccacactggagagaagctgtatgagtgcaagcagtgtgggaaggccctgagccacagcagcagcttcagaagacacatgaccatgcacactggagatggcccccacaagtgcaagatctgtgggaaggcctttgtgtaccccagcgtcttccagagacatgagaagacccacacagctgagaagccctacaagtgcaagcagtgtgggaaggcctaccgcatcagcagcagcctgcggagacatgagaccacccacactggagagaagccctacaagtgcaagtgtgggaaggccttcatcgacttctacagcttccagaaccacaagaccacccatgctggggagaagccctatgagtgcaaggaatgtgggaaggccttcagctgcttccagtacctgagccagcacaggaggacccacactggagagaagccctatgagtgcaacacctgcaagaaggccttcagccacttcggcaacctgaaggtgcatgagcgcatccacagcggggagaagccctatgagtgcaaggaatgtgggaaggccttctcctggctgacctgcttcctgcggcatgagcgcatccacatgagggagaagccctatgagtgccagcagtgtgggaaggccttcacccacagccgcttcctgcagggccacgagaagacccacactggagagaacccctatgagtgcaaggaatgtgggaaggcctttgccagcctgagcagcctgcaccgccacaagaagacccactggaagaagacccacactggagagaacccctacggctgcaaggaatgtgggaaggcctttgccagcctgagcagcctgcaccgccacaagaagacccactag

SEQ ID NO: 18475 - DNA, 1995 bp, Artificial Sequence
  Description of Artificial Sequence: Synthetic coding sequence
atgcccctgcgggacaagtactgccagacagaccaccaccaccacggctgctgtgagcctgtgtacatcctggagcccggggacccccccctgctgcagcagcccctgcagaccagcaagagcggcatccagcagatcatcgagtgcttccgcagcggcaccaagcagctgaagcacatcctgctgaaggatgtggacaccatctttgagtgcaagctgtgccgcagcctcttccggggcctgcccaacctgatcacccacaagaagttctactgcccccccagcctgcagatggatgacaacctgcctgatgtgaatgacaagcagagccaggccatcaatgacctgctggaggccatctaccccagcgtggacaagcgggagtacatcatcaagctggagcccatcgagaccaaccagaatgctgtgttccagtacatcagcaggacagacaaccccatcgaggtgacagagagcagcagcaccccagagcagacagaggtgcagatccaggagaccagcacagagcagagcaagacagtgcctgtgacagacacagaggtggagaccgtggagcccccacctgtggagatcgtgacagatgaggtggcccccaccagtgatgagcagccccaggagagccaggccgacctggagaccagtgacaacagcgactttggccaccagctgatctgctgcctgtgcaggaaggagttcaacagccggcggggcgtgcggcggcacatcaggaaggtgcacaagaagaagatggaggagctgaagaagtacatcgagaccaggaagaaccccaaccagagcagcaagggccgcagcaagaatgtgctggtgcccctgagccgcagctgccctgtgtgctgcaagagctttgccaccaaggccaacgtgagaagacactttgatgaggtgcaccggggcctgcggcgggacagcatcaccccagacatcgccaccaagccaggccagcccctcttcctggacagcatcagccccaagaagagcttcaagaccaggaagcagaagagcagcagcaaggccgagtacaacctgacagcctgcaagtgcctgctgtgcaagaggaagtacagcagccagatcatgctgaagaggcacatgcagatcgtgcacaagatcaccctgagcggcaccaacagcaagcgggagaagggccccaacaacacagccaacagcagcgagatcaaggtgaaggtggagcctgctgacagcgtggagagcagcccccccagcatcacccacagcccccagaatgagctgaagggcaccaaccacagcaatgagaagaagaacaccccagctgcccagaagaacaaggtgaagcaggacagcgagagccccaagagcaccagccccagcgctgctgggggccagcagaagaccaggaagcccaagctgtctgctggctttgacttcaagcagctgtactgcaagctgtgcaagaggcagttcaccagcaagcagaacctgaccaagcacatcgagctgcacacagatggcaacaacatctacgtgaagttctacaagtgccccctgtgcacctatgagaccaggaggaagagagatgtgatccgccacatcaccgtggtgcacaagaagagcagccgctacctgggcaagatcacagccagcctggagatccgggccatcaagaagcccatcgactttgtgctgaacaaggtggccaagaggggccccagcagagatgaggccaagcacagcgacagcaagcatgatggcaccagcaacagccccagcaagaagtatgaggtggctgatgtgggcatcgaggtgaaggtgaccaagaacttcagcctgcaccgctgcaacaagtgtgggaaggcctttgccaagaagacctacctggagcaccacaagaagacccacaaggccaatgccagcaacagccctgagggcaacaagaccaagggccgcagcaccaggagcaaggccctggtgtag

SEQ ID NO: 18476 - DNA, 1995 bp, Artificial Sequence; identical to SEQ ID NO: 18475
  Description of Artificial Sequence: Synthetic coding sequence

SEQ ID NO: 18477 - DNA, 1995 bp, Artificial Sequence; identical to SEQ ID NO: 18475
  Description of Artificial Sequence: Synthetic coding sequence

SEQ ID NO: 18478 - DNA, 729 bp, Artificial Sequence
  Description of Artificial Sequence: Synthetic coding sequence
atgcccctgcgggacaagtactgccagacagaccaccaccaccacggctgctgtgagcctgtgtacatcctggagcccggggacccccccctgctgcagcagcccctgcagaccagcaagagcggcatccagcagatcatcgagtgcttccgcagcggcaccaagcagctgaagcacatcctgctgaaggatgtggacaccatctttgagtgcaagctgtgccgcagcctcttccggggcctgcccaacctgatcacccacaagaagttctactgcccccccagcctgcagatggatgacaacctgcctgatgtgaatgacaagcagagccaggccatcaatgacctgctggaggccatctaccccagcgtggacaagcgggagtacatcatcaagctggagcccatcgagaccaaccagaatgctgtgttccagtacatcagcaggacagacaaccccatcgaggtgacagagagcagcagcaccccagagcagacagaggtgcagatccaggagaccagcacagagcagagcaagacagtgcctgtgacagacacagaggtggagaccgtggagcccccacctgtggagatcgtgacagatgaggtggcccccaccagtgatgagcagccccaggagagccaggccgacctggagaccagtgacaacagcgactttggccaccagctgatctgctgcctgtgcaggaaggagttcaacagcaggtag

SEQ ID NO: 18479 - DNA, 393 bp, Artificial Sequence
  Description of Artificial Sequence: Synthetic coding sequence
atgcccctgcgggacaagtactgccagacagaccaccaccaccacggctgctgtgagcctgtgtacatcctggagcccggggacccccccctgctgcagcagcccctgcagaccagcaagagcggcatccagcagatcatcgagtgcttccgcagcggcaccaagcagctgaagcacatcctgctgaaggatgtggacaccatctttgagtgcaagctgtgccgcagcctcttccggggcctgcccaacctgatcacccacaagaagttctactgcccccccagcctgcagatggatgacaacctgcctgatgtgaatgacaagcagagccaggccatcaatgacctgctggaggccatctaccccagcgtggacaagcgggagtacatctag

SEQ ID NO: 18480 - DNA, 297 bp, Artificial Sequence
  Description of Artificial Sequence: Synthetic coding sequence
atgcccctgcgggacaagtactgccagacagaccaccaccaccacggctgctgtgagcctgtgtacatcctggagcccggggacccccccctgctgcagcagcccctgcagaccagcaagagcggcatccagcagatcatcgagtgcttccgcagcggcaccaagcagctgaagcacatcctgctgaaggatgtggacaccatctttgagtgcaagctgtgccgcagcctcttccggggcctgcccaacctgatcacccacaagaagttctactgcccccccagcctgcagatgtag

SEQ ID NO: 18481 - DNA, 1485 bp, Artificial Sequence
  Description of Artificial Sequence: Synthetic coding sequence
atgcagggcgagcggctgcggcccggcctggacagccagaaggagaagctgcccgggaagatgagccccaagcatgatggcctgggcacagctgacagcgtgtgcagccgcatcatccaggacagagtgtccctgggagatgatgtgcatgactgtgacagccacggcagcggcaagaaccctgtgatccaggaggaggagaacatcttcaagtgcaatgaatgtgagaaggtgttcaacaagaagaggctgctggcccggcatgagcgcatccacagcggcgtgaagccctatgaatgtacagaatgtgggaagaccttcagcaagagcacctacctgctgcagcaccacatggtgcacactggagagaagccctacaagtgcatggagtgtgggaaggccttcaacaggaagagccacctgacccagcaccagaggatccacagcggggagaagccctacaagtgcagtgaatgtgggaaggccttcacccacaggagcacctttgtgctgcacaacagaagccacactggagagaagccctttgtgtgcaaggaatgtgggaaggccttccgggacaggcctggcttcatccgccactacatcatccacagcggggagaacccctatgaatgttttgaatgtgggaaggtgttcaagcacaggagctacctgatgtggcaccagcagacccacactggagagaagccctatgaatgttctgaatgtgggaaggccttctgtgagagcgctgccctgatccaccactacgtgatccacactggagagaagccctttgaatgtctggagtgtgggaaggccttcaaccacaggagctacctgaagaggcaccagaggatccacactggagagaagccctacgtgtgcagtgaatgtgggaaggccttcacccactgcagcaccttcatcctgcacaagagggcccacactggagagaagccctttgagtgcaaggaatgtgggaaggccttcagcaacagagctgacctgatccgccacttcagcatccacactggagagaagccctatgagtgcatggagtgtgggaaggccttcaacagaagaagtggcctgaccaggcaccagaggatccacagcggggagaagccctatgaatgtattgaatgtgggaagaccttctgctggagcaccaacctgatccgccacagcatcatccacactggagagaagccctatgaatgttctgaatgtgggaaggccttcagccgcagcagcagcctgacccagcaccagaggatgcacactggaagaaaccccatctctgtgacagatgtgggccggcccttcaccagcggccagacctctgtgaacatccaggagctgctgctgggcaagaacttcctgaatgtgaccacagaggagaacctgctgcaggaggaggccagctacatggccagtgacaggacctaccagcgggagaccccccaggtgagcagcctgtag

SEQ ID NO: 18482 - DNA, 1884 bp, Artificial Sequence
  Description of Artificial Sequence: Synthetic coding sequence
atggccatggccctgacagatcctgcccaggtgtctgtgacctttgatgatgtggccgtgaccttcacccaggaggagtggggccagctggacctggcccagaggaccctgtaccaggaggtgatgctggagaactgtggcctgctggtgtccctgggctgccctgtgcccaggcctgagctgatctaccacctggagcacggccaggagccctggaccaggaaggaggacctgagccagggcacctgccctggggacaagggcaagcccaagagcacagagcccaccacctgtgagctggccctgtctgagggcatctccttctggggccagctgacccagggcgccagcggggacagccagctgggccagcccaaggaccaggacggcttcagcgagatgcagggcgagcggctgcggcccggcctggacagccagaaggagaagctgcccgggaagatgagccccaagcatgatggcctgggcacagctgacagcgtgtgcagccgcatcatccaggacagagtgtccctgggagatgatgtgcatgactgtgacagccacggcagcggcaagaaccctgtgatccaggaggaggagaacatcttcaagtgcaatgaatgtgagaaggtgttcaacaagaagaggctgctggcccggcatgagcgcatccacagcggcgtgaagccctatgagtgcacagaatgtgggaagaccttcagcaagagcacctacctgctgcagcaccacatggtgcacactggagagaagccctacaagtgcatggagtgtgggaaggccttcaacaggaagagccacctgacccagcaccagaggatccacagcggggagaagccctacaagtgcagtgaatgtgggaaggccttcacccacaggagcacctttgtgctgcacaacagaagccacactggagagaagccctttgtgtgcaaggaatgtgggaaggccttccgggaccggcccggcttcatccgccactacatcatccacagcggggagaacccctatgagtgctttgaatgtgggaaggtgttcaagcacaggagctacctgatgtggcaccagcagacccacactggagagaagccctatgagtgcagtgaatgtgggaaggccttctgtgagagcgctgccctgatccaccactacgtgatccacactggagagaagccctttgagtgcctggagtgtgggaaggccttcaaccacaggagctacctgaagaggcaccagaggatccacactggagagaagccctacgtgtgcagtgaatgtgggaaggccttcacccactgcagcaccttcatcctgcacaagagggcccacactggagagaagccctttgagtgcaaggaatgtgggaaggccttcagcaacagagctgacctgatccgccacttcagcatccacactggagagaagccctatgagtgcatggagtgtgggaaggccttcaacagaagaagtggcctgaccaggcaccagaggatccacagcggggagaagccctatgagtgcattgaatgtgggaagaccttctgctggagcaccaacctgatccgccacagcatcatccacactggagagaagccctatgagtgcagtgaatgtgggaaggccttcagccgcagcagcagcctgacccagcaccagaggatgcacacaggcaggaaccccatctctgtgacagatgtgggccggcccttcaccagcggccagacctctgtgaacatccaggagctgctgctgggcaagaacttcctgaatgtgaccacagaggagaacctgctgcaggaggaggccagctacatggccagtgacaggacctaccagcgggagaccccccaggtgagcagcctgtag

SEQ ID NO: 18483 - DNA, 1485 bp, Artificial Sequence; identical to SEQ ID NO: 18481
  Description of Artificial Sequence: Synthetic coding sequence

SEQ ID NO: 18484 - DNA, 153 bp, Artificial Sequence
  Description of Artificial Sequence: Synthetic coding sequence
gcccccctgctgagctgcatcaccggggccaccctggagaccctgtgtgtgcagagggtgaaggccttccgggacaggcctggcttcatccgccactacatcatccacagcggggagaacccctatgaatgttttgaatgtgggaaggtgtag

SEQ ID NO: 18485 - DNA, 2712 bp, Artificial Sequence
  Description of Artificial Sequence: Synthetic coding sequence
atgctgcgggaggaggccgcccagaagaggaagggcaaggagagcggcatggccctgccccagggccgcctgaccttcagagatgtggccatcgagttcagcctggccgagtggaagttcctgaacccagcccagagggccctgtaccgggaggtgatgctggagaactacagaaacctggaggccgtggacatcagcagcaagcacatgatgaaggaggtgctgagcacaggccagggcaaccgggaggtgatccacacaggcaccctgcagaggcaccagagctaccacatcggggacttctgcttccaggagattgagaaggagatccacaacatcgagttccagtgccaggaggatgaaagaaatggacatgaggcccccaccaccaagatcaagaagctgaccggcagcacagaccagcacgaccacagacatgctggcaacaagcccatcaaggaccagctgggcagcagcttctacagccacctgcctgagctgcacatcttccagatcaagggggagatcgccaaccagctggagaagagcaccagtgatgccagctctgtgtccaccagccagaggatcagctgccggccccagatccacatcagcaacaactacggcaacaaccccctgaacagcagcctgctgccccagaagcaggaggtgcacatgagggagaagagcttcccctgcaatgaaagtggcaaggccttcaactgcagcagcctgctgaggaagcaccagatcccccacctgggggacaagcagtacaagtgtgatgtgtgtgggaagctgttcaaccacaagcagtacctggcctgccaccggcgctgccacactggagagaagccctacaagtgcaaggaatgtgggaagagcttctcctacaagagcagcctgacctgccaccaccggctgcacactggagtgaagccctacaagtgcaatgaatgtgggaaggtgttccggcagaacagcgccctggtgatccacaaggccatccacactggagagaagccctacaagtgcaatgaatgtgggaaggccttcaaccagcagagccacctgagccgccaccagaggctgcacactggagtgaagccctacaagtgcaagatctgtgagaaggcctttgcctgccacagctacctggccaaccacacccgcatccacagcggggagaagacctacaagtgcaatgaatgtgggaaggccttcaaccaccagagcagcctggcccggcaccacatcctgcacactggagagaagccctacaagtgtgaagaatgtgacaaggtgttcagccagaagagcaccctggagcggcacaagaggatccacactggagagaagccctacaagtgcaaggtgtgtgacacagccttcacctgcaacagccagctggcccggcaccggcgcatccacactggagagaagacctacaagtgcaatgaatgtaggaagaccttcagccgccgcagcagcctgctgtgccaccggcggctgcacagcggggagaagccctacaagtgcaaccagtgtggcaacaccttccgccaccgggccagcctggtgtaccaccggcggctgcacaccctggagaagagctacaagtgcaccgtgtgcaacaaggtgttcatgaggaacagcgtgctggccgtgcacacccgcatccacacagccaagaagccctacaagtgcaatgaatgtgggaaggccttcaaccagcagagccacctgagccgccaccggcggctgcacactggagagaagccctacaagtgtgaggcctgtgacaaggtgtttggccagaagagcgccctggagagccacaagaggatccacactggagagaagccctaccgctgccaggtgtgtgacacagccttcacctggaacagccagctggcccggcacacccgcatccacactggagagaagacctacaagtgcaatgaatgtgggaagaccttctcctacaagagcagcctggtgtggcaccggcggctgcatggaggagagaagagctacaagtgcaaggtgtgtgacaaggcctttgtgtgccgctcctatgtggccaagcacacccgcatccacagcggcatgaagccctacaagtgcaatgaatgttccaagaccttcagcaacagaagcagcctggtgtgccaccggcgcatccacagcggggagaagccctacaagtgcagtgaatgttccaagaccttcagccagaaggccaccctgctgtgccaccggcggctgcacagcggggagaagccctacaagtgcaatgactgtggcaacaccttccgccactggagcagcctggtgtaccaccggcggctgcacactggagagaagagctacaagtgcaccgtgtgtgacaaggcctttgtgaggaacagctacctggcccggcacatccgcatccacacagctgagaagccctacaagtgcaatgaatgtgggaaggccttcaatgagcagagccacctgagccgccaccaccgcatccacactggagagaagccctacaagtgtgaggcctgtgacaaggtgttcagcaggaagagccacctgaagaggcaccgcatcatccacactggagagaagccctacaagtgcaatgaatgtgggaaggccttcagtgacaggagcaccctcatccaccaccaggccatccatggaattggcaagtttgattag

SEQ ID NO: 18486 - DNA, 1854 bp, Artificial Sequence
  Description of Artificial Sequence: Synthetic coding sequence
atggccctgccccagggcctgctgaccttcagagatgtggccatcgagttcagccaggaggagtggaagtgcctggaccctgcccagaggaccctgtacagagatgtgatgctggagaactacagaaacctggtgtccctggacatcagcagcaagtgcatgatgaaggagttcagcagcacagcccagggcaaccgggaggtgatccacacaggcaccctgcagagacatgagagccaccacactggagacttccgcttccaggagattgacaaggacatccacaacctggagttccagtggcaggaggatgagaggaacagccatgaggcccccatgacagagatcaagaagctgaccggcagcgctgacagatatgaccagagacatgctggcaacaagcccatcaaggaccagctgggcagcagcttccacagccacctgcctgagctgcacatgttccagacccagggcaagattggcaaccaggtggagaagagcatcaatgatgccagcagcatcagcaccagccagaggatcagctgccggcccaagacccacatcagcaacaactacggcaacaacttcaggaacagcagcctgctgacccagaagcaggaggtgcacatgagggagaagagcttccagtgcaatgaaagtggcaaggccttcaactacagcagcctgctgaggaagcaccagatcatccacctgggggagaagcagtacaagtgtgatgtgtgtgggaaggtgttcaacaggaagaggaacctggtgtgccaccggcgctgccacactggagagaagccctaccgctgcaatgaatgtgggaagaccttcagccagacctacagcctgacctgccaccggcggctgcacactggagagaagccctacaagtgtgaagaatgtgacaaggccttctccttcaagagcaacctgaagaggcaccggcgcatccacgccggggagaagccctacaagtgcaatgaatgtgggaagaccttcagccagaccagcagcctgacctgccaccggcggctgcacactggagagaagcccttcaagtgcaatgaatgtgggaagaccttcagcaggaagagcagcctgacctgccaccaccggctgcacactggagagaagccctacaagtgcaatgaatgtgggaagaccttcagccaggagctgaccctgaagtgccaccggcggctgcacactggagagaagccctacaagtgcaatgaatgtgggaaggtgttcaacaagaaggccaacctggcccggcaccaccggctgcacagcggggagaagccctacaagtgcacagaatgtgtgaagaccttcagcaggaacagcgccctggtgatccacaaggccatccacatcggggagaagcgctacaagtgcaatgaatgtgggaagaccttcagccgcatcagcgccctggtgatccacacagccatccacactggagagaagccctacaagtgcaatgaatgtgggaagggcttcaacaggaagacccacctggcctgccaccaccggctgcacactggagagaagccctacaagtgcaatgaatgtgggaaggtgttcaacaggaagacccacctggcccaccaccaccggctgcacactggagacaagccctacaagtgcaatgaatgtgggaaggtgttcaaccagaaggcccacctggcccggcaccaccggctgcacactggagagaagccctacaagtgcaatgaatgtgggaaggtgttcaaccagaaggccaacctggcccggcaccaccggctgcacactggagagaagccctacaagttcaatgaatgtgggaaggccttcaactag

SEQ ID NO: 18487 - DNA, 183 bp, Artificial Sequence
  Description of Artificial Sequence: Synthetic coding sequence
atggccctgccccagggcctgctgaccttcagagatgtggccatcgagttcagccaggaggagtggaagtgcctggaccctgcccagaggaccctgtacagagatgtgatgctggagaactacagaaacctggtgtccctggagctgagcggggagtgccccctggccgccccagccagctag

SEQ ID NO: 18488 - DNA, 1956 bp, Artificial Sequence
  Description of Artificial Sequence: Synthetic coding sequence
atgctgcgggaggaggccaccaagaagagcaaggagaaggagcccggcatggccctgccccagggccgcctgaccttcagagatgtggccatcgagttcagcctggaggagtggaagtgcctgaacccagcccagagggccctgtacagagctgtgatgctggagaactacagaaacctggagtttgtggacagcagcctgaagtccatgatggagttcagcagcaccaggcacagcatcactggagaggtgatccacacaggcaccctgcagaggcacaagagccaccacatcggggacttctgcttccctgagatgaagaaggacatccaccactttgagttccagtggcaggaggtggagagaaatggacatgaggcccccatgaccaagatcaagaagctgaccggcagcacagacagaagtgaccacagacatgctggcaacaagcccatcaaggaccagctgggcctgtccttccacagccacctgcctgagctgcacatgttccagaccaagggcaagatcagcaaccagctggacaagagcatcggggccagcagcgccagcgagagccagaggatcagctgccgcctgaagacccacatcagcaacaagtatggcaagaacttcctgcacagcagcttcacccagatccaggagatctgcatgagggagaagccctgccagagcaatgaatgtgggaaggccttcaactacagcagcctgctgcggcggcaccacatcacccacagccgggagcgggagtacaagtgtgatgtgtgtgggaagatcttcaaccagaagcagtacatcgtgtaccaccaccgctgccacactggagagaagacctacaagtgcaatgaatgtgggaagaccttcacccagatgagcagcctggtgtgccaccggcggctgcacactggagagaagccctacaagtgcaatgaatgtgggaagaccttcagcgagaagagcagcctgcgctgccaccggcggctgcacactggagagaagccctacaagtgcaatgaatgtgggaagaccttcggcaggaacagcgccctggtgatccacaaggccatccacactggagagaagccctacaagtgcaatgaatgtgggaagaccttcagccagaagagcagcctgcagtgccaccacatcctgcacactggagagaagccctacaagtgtgaagaatgtgacaacgtgtacatccgccgcagccacctggagcggcacaggaagatccacactggagagggcagctacaagtgcaaggtgtgtgacaaggtgttcagaagtgacagctacctggccgagcaccagagggtgcacactggagagaagccctacaagtgcaacaagtgtggccgctccttcagcaggaagagcagcctgcagtaccaccacaccctgcacactggagagaagccctacacctgcaatgaatgtgggaaggtgttcagccggcgggagaacctggcccggcaccaccggctgcacgccggggagaagccctacaagtgtgaagaatgtgacaaggtgttcagccgccgcagccacctggagcggcaccggcgcatccacactggagagaagccctacaagtgcaaggtgtgtgacaaggccttcagaagtgacagctgcctggccaaccacaccagggtgcacactggagagaagccctacaagtgcaacaagtgtgccaaggtgttcaaccagaagggcatcctggcccagcaccagagggtgcacactggagagaagccctacaagtgcaatgaatgtgggaaggtgttcaaccagaaggccagcctggccaagcaccagagggtgcacacagctgagaagccctacaagtgcaatgaatgtgggaaggccttcaccggccagagcaccctcatccaccaccaggccatccacggctgccgggagaccctgcagatgtag

SEQ ID NO: 18489 - DNA, 702 bp, Artificial Sequence
  Description of Artificial Sequence: Synthetic coding sequence
atgctgcgggaggaggccaccaagaagagcaaggagaaggagcccggcatggccctgccccagggccgcctgaccttcagagatgtggccatcgagttcagcctggaggagtggaagtgcctgaacccagcccagagggccctgtacagagctgtgatgctggagaactacagaaacctggagtttgtggacatcagcagcaagtgcatgatgaaggagttcagcagcacagcccagggcaacacagaggtgatccacacaggcaccctgcagagacatgagagccaccacatccgggacttctgcttccaggagattgagaaggacatccacaactttgagttccagtggcaggaggaggagagaaatggacatgaggcccccatgacagagatcaaggagctgaccggcagcacagacagacatgaccagagacatgctggcaacaagcccatcaaggaccagctgggcagcagcttccacagccacctgcctgagctgcacatcttccagcctgagtggaagattggcaaccaggtggagaagagcatcatcaatgccagcctcatcctgaccagccagaggatcagctgcagccccaagacccgcatcagcaacaactacggcaacaacagcctgcacagcagcctgcccatccagaagctgggcagcacccatgagaggaagatcttccccatgtag

SEQ ID NO: 18490 - DNA, 1956 bp, Artificial Sequence; identical to SEQ ID NO: 18488
  Description of Artificial Sequence: Synthetic coding sequence

SEQ ID NO: 18491 - DNA, 345 bp, Artificial Sequence
  Description of Artificial Sequence: Synthetic coding sequence
atgctgcgggaggaggccaccaagaagagcaaggagaaggagcccggcatggccctgccccagggccgcctgaccttcagagatgtggccatcgagttcagcctggaggagtggaagtgcctgaacccagcccagagggccctgtacagagctgtgatgctggagaactacagaaacctggagtttgtggacagcagcctgaagtccatgatggagttcagcagcaccaggcacagcatcactggagaggtgatccacacaggcaccctgcagaggcacaagagccaccacatcggggacttctgcttccctgagatgaagaaggacatccaccactttgaatag

SEQ ID NO: 18492 - DNA, 495 bp, Artificial Sequence
  Description of Artificial Sequence: Synthetic coding sequence
atgatgaaggagttcagcagcacagcccagggcaacacagaggtgatccacacaggcaccctgcagagacatgagagccaccacatccgggacttctgcttccaggagattgagaaggacatccacaactttgagttccagtggcaggaggaggagagaaatggccacgaggcccccatgacagagatcaaggagctgaccggcagcacagacagacatgaccagagacatgctggcaacaagcccatcaaggaccagctgggcagcagcttccacagccacctgcctgagctgcacatcttccagcctgagtggaagattggcaaccaggtggagaagagcatcatcaatgccagcctcatcctgaccagccagaggatcagctgcagccccaagacccgcatcagcaacaactacggcaacaacagcctgcacagcagcctgcccatccagaagctgggcagcacccatgagaggaagatcttccccatgtag

SEQ ID NO: 18493 - DNA, 1599 bp, Artificial Sequence
  Description of Artificial Sequence: Synthetic coding sequence
atggccctgcggtctgtgatgttcagtgatgtgtccattgacttcagccctgaggagtgggagtacctggacctggagcagaaggacctgtacagagatgtgatgctggagaactacagcaacctggtgtccctgggctgcttcatcagcaagccagatgtgatcagcagcctggagcagggcaaggagccctggaaggtggtgaggaagggccggcggcagtacccagacctggagaccaagtatgagaccaagaagctgagcctggagaatgacatctatgagatcaacctgagccagtggaagatcatggagagaattgagaaccacggcctgaagggcctcatcctgaagaatgactgggagagcacaggcaagattgagggccaggagcggccccaggagggctacttcagctctgtgaagatgcccagcgagaaggtgagcagctaccagaagaggacctctgtgaccccccaccagaggctgcactttgtggacaagccctatgagtgcaaggaatgtgggaaggccttccgggtgcggcagcagctgaccttccaccaccgcatccacactggagagaagccctatgagtgcaaggaatgtggcatggccttccggcagacagcccacctgaccaggcaccagaggctgcacagcggggagaagctgtatgagtgcaaggaatgtggggaggccttcatctgtggggctgacctgcgggtgcaccagaagatgcacatcggggagaagccctatgagtgcaaggaatgtgggaaggccttccgggtgcggggccagctgaccctgcaccagaggatccacactggagagaagccctacgtgtgcaaggaatgtgggaaggccttccggcagtatgcccacctgaccaggcaccagaagctgaacagcgctgaccggctgtatgagtgcaaggaatgtgggaaggccttcctgtgtggcagcggcctgcgggtgcaccacaagctgcacactggagagaagccctatgagtgcaaggaatgtgggaaggccttccgggtgcggcagcagctgaccctgcaccagaggatccacactggagagaagccctatgagtgcaaggaatgtgggaagaccttcagccggggctaccacctgatcctgcaccaccgcatccacactggagagaagccctatgagtgcaaggagtgctggaaggccttcagccgctacagccagctgatcagccaccagagcatccacatcggcgtgaagccctatgactgcaaggaatgtgggaaggccttccggctgctgagccagctgacccagcaccagagcatccacatcggggagaagccctacaagtgcaaggaatgtgggaaggccttccggctgcggcagaagctgaccctgcaccagagcatccacactggagagaagccctttgagtgcaaggagtgcaggaaggccttccggctgaacagcagcctcatccagcacctgcgcatccacagcggggagaagccctatgagtgcaaggagtgcaagaaggccttccggcagcacagccacctgacccaccacctgaagatccacaacgtgaagatctag

SEQ ID NO: 18494 - DNA, 1599 bp, Artificial Sequence
  Description of Artificial Sequence: Synthetic coding sequence
atggccctgcggtctgtgatgttcagtgatgtgtccattgacttcagccctgaggagtgggagtacctggacctggagcagaaggacctgtacagagatgtgatgctggagaactacagcaacctggtgtccctgggcctgctgctgctgtccttcatcagcaccctggagatgctgctgctgctggtgaaggaaaattccatgtgcctgctgagctgcttcatcctggacctggagaccaagtatgagaccaagaagctgagcctggagaatgacatctatgagatcaacctgagccagtggaagatcatggagagaattgagaaccacggcctgaagggcctcatcctgaagaatgactgggagagcacaggcaagattgagggccaggagcggccccaggagggctacttcagctctgtgaagatgcccagcgagaaggtgagcagctaccagaagaggacctctgtgaccccccaccagaggctgcactttgtggacaagccctatgagtgcaaggaatgtgggaaggccttccgggtgcggcagcagctgaccttccaccaccgcatccacactggagagaagccctatgagtgcaaggaatgtggcatggccttccggcagacagcccacctgaccaggcaccagaggctgcacagcggggagaagctgtatgagtgcaaggaatgtggggaggccttcatctgtggggctgacctgcgggtgcaccagaagatgcacatcggggagaagccctatgagtgcaaggaatgtgggaaggccttccgggtgcggggccagctgaccctgcaccagaggatccacactggagagaagccctacgtgtgcaaggaatgtgggaaggccttccggcagtatgcccacctgaccaggcaccagaagctgaacagcgctgaccggctgtatgagtgcaaggaatgtgggaaggccttcctgtgtggcagcggcctgcgggtgcaccacaagctgcacactggagagaagccctatgagtgcaaggaatgtgggaaggccttccgggtgcggcagcagctgaccctgcaccagaggatccacactggagagaagccctatgagtgcaaggaatgtgggaagaccttcagccggggctaccacctgatcctgcaccaccgcatccacactggagagaagccctatgagtgcaaggagtgctggaaggccttcagccgctacagccagctgatcagccaccagagcatccacatcggcgtgaagccctatgactgcaaggaatgtgggaaggccttccggctgctgagccagctgacccagcaccagagcatccacatcggggagaagccctacaagtgcaaggaatgtgggaaggccttccggctgcggcagaagctgaccctgcaccagagcatccacactggagagaagccctttgagtgcaaggagtgcaggaaggccttccggctgaacagcagcctcatccagcacctgcgcatccacagcggggagaagccctatgagtgcaaggagtgcaagaaggccttccggcagcacagccacctgacccaccacctgaagatccacaacgtgaagatctag

SEQ ID NO: 18495 - DNA, 1833 bp, Artificial Sequence
  Description of Artificial Sequence: Synthetic coding sequence
atggattctgtggcctttgaagatgtggccgtgaacttcacccaggaggagtgggccctgctgggccccagccagaagagcctgtacagaaatgtgatgcaggagaccatccggaacctggactgcatcgagatgaagtgggaggaccagaacatcggggaccagtgccagaatgccaagaggaacctgcggagccacacctgtgagatcaaggatgacagccagtgtggggagaccttcggccagatcccagacagcatcgtgaacaagaacaccccccgggtgaacccctgtgacagcggggagtgtggggaggtggtgctgggccacagcagcctgaactgcaacatccgggtggacaccggccacaagagctgtgagcaccaggagtatggagagaagccctacacccacaagcagaggggcaaggccatcagccaccagcacagcttccagacccatgagcggcccccaacaggcaagaagccctttgactgcaaggaatgtgccaagaccttcagcagcctgggcaacctgcggcggcacatggccgcccaccacggagatggcccctacaagtgcaagctgtgtgggaaggcctttgtgtggcccagcctcttccacctgcacgagaggacccacactggagagaagccctatgagtgcaagcagtgcagcaaggccttccccttctacagcagctacctgcggcatgagcgcatccacactggagagaaggcctatgagtgcaagcagtgcagcaaggccttcccagactacagcacctacctgcggcatgagaggacccacactggagagaagccctacaagtgcacccagtgtgggaaggccttcagctgctactactacacccggctgcacgagaggacccacactggagagcagccctatgcctgcaagcagtgtgggaagaccttctaccaccacaccagcttccgccgccacatgatccgccacactggagatggcccccacaagtgcaagatctgtgggaaaggatttgactgccccagctctgtgaggaaccacgagaccacccacactggagagaagccctatgagtgcaagcagtgtgggaaggtgctgagccacagcagcagcttccgcagccacatgatcacccacactggagatggcccccagaagtgcaagatctgtgggaaggccttcggctgccccagcctcttccagagacatgagaggacccacactggagagaagccctaccagtgcaagcagtgtgggaaggccttcagcctggccggcagcctgcggagacatgaggccacccacactggagtgaagccctacaagtgccagtgtgggaaggccttcagtgacctgagcagcttccagaaccacgagaccacccacactggagagaagccctatgagtgcaaggaatgtgggaaggccttcagctgcttcaagtacctgagccagcacaagaggacccacacagtggagaagccctatgagtgcaagacctgcaggaaggccttcagccacttcagcaacctgaaggtgcatgagcgcatccacagcggggagaagccctatgagtgcaaggaatgtgggaaggccttctcctggctgacctgcctgctgcggcatgagcgcatccacactggagagaagccctatgagtgcctgcagtgtgggaaggccttcaccaggagccgcttcctgcggggccacgagaagacccacactggagagaagctgtatgagtgcaaggaatgtgggaaggccctgagcagcctgcggagcctgcaccgccacaagaggacccactggaaggacaccctgtag

SEQ ID NO: 18496 - DNA, 1410 bp, Artificial Sequence
  Description of Artificial Sequence: Synthetic coding sequence
atgaagtgggaggaccagaacatcggggaccagtgccagaatgccaagaggaacctgcggagccacacctgtgagatcaaggatgacagccagtgtggggagaccttcggccagatcccagacagcatcgtgaacaagaacaccccccgggtgaacccctgtgacagcggggagtgtggggaggtggtgctgggccacagcagcctgaactgcaacatccgggtggacaccggccacaagagctgtgagcaccaggagtatggagagaagccctacacccacaagcagaggggcaaggccatcagccaccagcacagcttccagacccatgagcggcccccaacaggcaagaagccctttgactgcaaggaatgtgccaagaccttcagcagcctgggcaacctgcggcggcacatggccgcccaccacggagatggcccctacaagtgcaagctgtgtgggaaggcctttgtgtggcccagcctcttccacctgcacgagaggacccacactggagagaagccctatgagtgcaagcagtgcagcaaggccttccccttctacagcagctacctgcggcatgagcgcatccacactggagagaaggcctatgagtgcaagcagtgcagcaaggccttcccagactacagcacctacctgcggcatgagaggacccacactggagagaagccctacaagtgcacccagtgtgggaaggccttcagctgctactactacacccggctgcacgagaggacccacactggagagcagccctatgcctgcaagcagtgtgggaagaccttctaccaccacaccagcttccgccgccacatgatccgccacactggagatggcccccacaagtgcaagatctgtgggaaaggatttgactgccccagctctgtgaggaaccacgagaccacccacactggagagaagccctatgagtgcaagcagtgtgggaaggtgctgagccacagcagcagcttccgcagccacatgatcacccacactggagatggcccccagaagtgcaagatctgtgggaaggccttcggctgccccagcctcttccagagacatgagaggacccacactggagagaagccctaccagtgcaagcagtgtgggaaggccttcagcctggccggcagcctgcggagacatgaggccacccacactggagtgaagccctacaagtgccagtgtgggaaggccttcagtgacctgagcagcttccagaaccacgagaccacccacactggagagaagccctatgagtgcaaggaatgtgggaaggccttcagctgcttcaagtacctgagccagcacaagaggacccacacagtggagaagccctatgagtgcaagacctgcaggaaggccttcagccacttcagcaactag

SEQ ID NO: 18497 - DNA, 1287 bp, Artificial Sequence
  Description of Artificial Sequence: Synthetic coding sequence
atggccgcccaccacggagatggcccctacaagtgcaagctgtgtgggaaggcctttgtgtggcccagcctcttccacctgcacgagaggacccacactggagagaagccctatgagtgcaagcagtgcagcaaggccttccccttctacagcagctacctgcggcatgagcgcatccacactggagagaaggcctatgagtgcaagcagtgcagcaaggccttcccagactacagcacctacctgcggcatgagaggacccacactggagagaagccctacaagtgcacccagtgtgggaaggccttcagctgctactactacacccggctgcacgagaggacccacactggagagcagccctatgcctgcaagcagtgtgggaagaccttctaccaccacaccagcttccgccgccacatgatccgccacactggagatggcccccacaagtgcaagatctgtgggaaaggatttgactgccccagctctgtgaggaaccacgagaccacccacactggagagaagccctatgagtgcaagcagtgtgggaaggtgctgagccacagcagcagcttccgcagccacatgatcacccacactggagatggcccccagaagtgcaagatctgtgggaaggccttcggctgccccagcctcttccagagacatgagaggacccacactggagagaagccctaccagtgcaagcagtgtgggaaggccttcagcctggccggcagcctgcggagacatgaggccacccacactggagtgaagccctacaagtgccagtgtgggaaggccttcagtgacctgagcagcttccagaaccacgagaccacccacactggagagaagccctatgagtgcaaggaatgtgggaaggccttcagctgcttcaagtacctgagccagcacaagaggacccacacagtggagaagccctatgagtgcaagacctgcaggaaggccttcagccacttcagcaacctgaaggtgcatgagcgcatccacagcggggagaagccctatgagtgcaaggaatgtgggaaggccttctcctggctgacctgcctgctgcggcatgagcgcatccacactggagagaagccctatgagtgcctgcagtgtgggaaggccttcaccaggagccgcttcctgcggggccacgagaagacccacactggagagaagctgtatgagtgcaaggaatgtgggaaggccctgagcagcctgcggagcctgcaccgccacaagaggacccactggaaggacaccctgtag

SEQ ID NO: 18498 - DNA, 3243 bp, Artificial Sequence
  Description of Artificial Sequence: Synthetic coding sequence
cccagccggcagaagaagaagaagaagaagctgaccagtgatgtgtcccggcaggaggaggccgagggggagctgtctgagggggagcactggtacggcaacagcagcgagacccccagcgaggccagctatggagaggtgcaggagaactacaagctgagcctggaggaccgcatccaggagcagagcaccagcccagacaccagcctgggcagcaccacccccagcagccacaccctggagctggtggccctggacagcgaggtgctgcgggacagcctgcagtgccaggaccacctgagccctggggtgagcagcctgtgtgatgatgaccccggcagcaacaagcccctgagcagcaacctgcggcggctgctggaggccggcagcctgaagctggatgctgctgccacagccaacggccgggtggagagccctgtgaatgtgggcagcaacctgtccttcagcccccccagccaccacgcccagcagctgtctgtgctggccaggaagctggccgagaagcaggagcagaatgaccagtacacccccagcaaccgcttcatctggaaccagggcaagtggctgcccaacagcaccaccacctgcagcctgagcccagattctgccatcctgaagctgaaggctgctgccaatgctgtgctgcaggacaagagcctgaccaggacagaggagaccatgagatttgagagcttcagcagccccttcagcagccagagcgccagcagcaccctggccgccctgagcaagaaggtgtctgagaggagcctgaccccaggccaggagcaccccccaccagccagcagcttcctgagcctggcctccatgaccagcagcgctgccctgctgaaggaggtggccgcccgggccgccggcagcctgctggccgagaagagcagcctgctgcctgaggaccccctgcccccacctccttctgagaagaagccagagaaggtgaccccacctcctcctcctcctcctcctcctcctcctcctcctccaccccagagcctggagctgctgctgctgcctgtgcccaagggccgggtgtccaagcccagcaacagcgccagcgaggaggagagcggcaagcccttccagtgccccatctgtggcctggtgatcaagaggaagagctactggaagaggcacatggtgatccacacaggcctgaagagccaccagtgccccctgtgccccttccgctgtgccaggaaggacaacctgaagagccacatgaaggtgcaccagcaccaggacagaggagagaccttccagtgccagctgtgccccttcaccagcagccgccacttcagcctgaagctgcacatgcgctgccaccagcacttcctgaggacagaggccaaggtgaaggaggagatcccagaccctgatgtgaagggcagcccccacctgagtgacagcgcctgcctgggccagcagcgggagggcggcggcacagagctggtgggcaccatgatgaccagcaacaccccagagaggaccagccagggcggggccggcgtgagccccctgctggtgaaggaggagcccaaggaggacaatggcctgcccaccagcttcaccctgaatgctgctgacaggcctgccaaccacaccaagctgaaggaccccagtgaatatgtggccaacagcgccagcgccctcttcagccaggacatctctgtgaagatggccagtgacttcctgatgaagctgtctgctgccaaccagaaggagcccatgaacctgaacttcaaggtgaaggaggagcccaaggagggggagagcctgagcaccaccctgcccaggagcagctatgtgttcagccctgagagcgaggtgtctgcccctggggtgtctgaagatgccctgaagccccaggagggcaagggctctgtgctgcggagagatgtgtctgtgaaggccgccagcgagctgctgatgaagctgtctgctgagagctacaaggagacccagatggtgaagatcaaggaggagcccatggaggtggacatccaggacagccacgtgtccatcagccccagcagaaatgtgggctacagcaccctgattggccgggagaagacagagcccctgcagaagatgcctgagggccgggtgcccccagagaggaacctcttcagccaggacatctctgtgaagatggccagcgagctgctcttccagctgtctgagaaggtgtccaaggagcacaaccacaccaaggagaacaccatccgcaccaccaccagccccttcttcagcgaggacaccttccggcagagccccttcaccagcaacagcaaggagctgctgcccagcgacagcgtgctgcacggccgcatcagcgcccctgagacagagaagatcgtgctggaggccggaaatggcctgcccagctggaagttcaatgaccagctgttcccctgtgatgtgtgtgggaaggtgtttggccggcagcagaccctgagccgccacctgagcctgcacacagaggagaggaagtacaagtgccacctgtgcccctatgctgccaagtgccgggccaacctgaaccagcacctgactgtgcacagcgtgaagctggtgtccacagacacagaggacatcgtgtctgctgtgaccagcgagggcagtgatggcaagaagcacccctactactacagctgccacgtgtgtggctttgaaacagagctgaatgtgcagtttgtgagccacatgagcctgcacgtggacaaggagcagtggatgttcagcatctgctgcacagcctgtgactttgtgaccatggaggaggccgagatcaagacccacatcggcaccaagcacactggagaggacaggaagacccccagcgagagcaacagccccagcagcagcagcctgagcgccctgagtgacagcgccaacagcaaggatgacagtgatggcagccagaagaacaagggcggcaacaacctgctggtgatctctgtgatgcctggcagccagcccagcctgaacagcgaggagaagccagagaagggctttgaatgtgtgttctgcaactttgtgtgcaagaccaagaacatgtttgagcggcacctgcagatccacctgatcaccaggatgtttgaatgtgatgtgtgccacaagttcatgaagaccccagagcagctgctggagcacaagaagtgccacacagtgcccaccggcggcctgaacagcggccagtggtag

SEQ ID NO: 18499 - DNA, 2196 bp, Artificial Sequence
  Description of Artificial Sequence: Synthetic coding sequence
atgcccaggaggaagcaggagcagcccaagaggctgcccagccccagcgaggaggagagcggcaagcccttccagtgccccatctgtggcctggtgatcaagaggaagagctactggaagaggcacatggtgatccacacaggcctgaagagccaccagtgccccctgtgccccttccgctgtgccaggaaggacaacctgaagagccacatgaaggtgcaccagcaccaggacagaggagagaccttccagtgccagctgtgccccttcaccagcagccgccacttcagcctgaagctgcacatgcgctgccaccagcacttcctgaggacagaggccaaggtgaaggaggagatcccagaccctgatgtgaagggcagcccccacctgagtgacagcgcctgcctgggccagcagcgggagggcggcggcacagagctggtgggcaccatgatgaccagcaacaccccagagaggaccagccagggcggggccggcgtgagccccctgctggtgaaggaggagcccaaggaggacaatggcctgcccaccagcttcaccctgaatgctgctgacaggcctgccaaccacaccaagctgaaggaccccagtgaatatgtggccaacagcgccagcgccctcttcagccaggacatctctgtgaagatggccagtgacttcctgatgaagctgtctgctgccaaccagaaggagcccatgaacctgaacttcaaggtgaaggaggagcccaaggagggggagagcctgagcaccaccctgcccaggagcagctatgtgttcagccctgagagcgaggtgtctgcccctggggtgtctgaagatgccctgaagccccaggagggcaaaggatctgtgctgcggagagatgtgtctgtgaaggccgccagcgagctgctgatgaagctgtctgctgagagctacaaggagacccagatggtgaagatcaaggaggagcccatggaggtggacatccaggacagccacgtgtccatcagccccagcagaaatgtgggctacagcaccctcatcggccgggagaagacagagcccctgcagaagatgcctgagggccgggtgcccccagagaggaacctcttcagccaggacatctctgtgaagatggccagcgagctgctcttccagctgtctgagaaggtgtccaaggagcacaaccacaccaaggagaacaccatccgcaccaccaccagccccttcttcagcgaggacaccttccggcagagccccttcaccagcaacagcaaggagctgctgcccagcgacagcgtgctgcacggccgcatcagcgcccctgagacagagaagatcgtgctggaggccggaaatggcctgcccagctggaagttcaatgaccagctgttcccctgtgatgtgtgtgggaaggtgtttggccggcagcagaccctgagccgccacctgagcctgcacacagaggagaggaagtacaagtgccacctgtgcccctatgctgccaagtgccgggccaacctgaaccagcacctgactgtgcacagcgtgaagctggtgtccacagacacagaagatattgtgtctgctgtgaccagcgagggcagtgatggcaagaagcacccctactactacagctgccacgtgtgtggctttgaaacagagctgaatgtgcagtttgtgagccacatgagcctgcacgtggacaaggagcagtggatgttcagcatctgctgcacagcctgtgactttgtgaccatggaggaggccgagatcaagacccacatcggcaccaagcacactggagaggacaggaagaccccatctgagagcaacagccccagcagcagcagcctgagcgccctgagtgacagcgccaacagcaaggatgacagtgatggcagccagaagaacaagggcggcaacaacctgctggtgatctctgtgatgcctggcagccagcccagcctgaacagcgaggagaagccagagaagggctttgaatgtgtgttctgcaactttgtgtgcaagaccaagaacatgtttgagcggcacctgcagatccacctgatcaccaggatgtttgaatgtgatgtgtgccacaagttcatgaagaccccagagcagctgctggagcacaagaagtgccacacagtgcccactggaggcctgaagagaggagcctggtag

SEQ ID NO: 18500 - DNA, 3246 bp, Artificial Sequence
  Description of Artificial Sequence: Synthetic coding sequence
atgcccaggaggaagcaggagcagcccaagaggctgcccagccacgtgtcccggcaggaggaggccgagggggagctgtctgagggggagcactggtacggcaacagcagcgagaccccatctgaggccagctatggagaggtgcaggagaactacaagctgagcctggaggaccgcatccaggagcagagcaccagcccagacaccagcctgggcagcaccacccccagcagccacaccctggagctggtggccctggacagcgaggtgctgcgggacagcctgcagtgccaggaccacctgagccctggggtgagcagcctgtgtgatgatgatcctggcagcaacaagcccctgagcagcaacctgcggcggctgctggaggccggcagcctgaagctggatgctgctgccacagccaacggccgggtggagagccctgtgaatgtgggcagcaacctgtccttcagcccccccagccaccacgcccagcagctgtctgtgctggccaggaagctggccgagaagcaggagcagaatgaccagtacacccccagcaaccgcttcatctggaaccagggcaagtggctgcccaacagcaccaccacctgcagcctgagcccagacagcgccatcctgaagctgaaggccgccgccaatgctgtgctgcaggacaagagcctgaccaggacagaggagaccatgagatttgagagcttcagcagccccttcagcagccagagcgccagcagcaccctggccgccctgagcaagaaggtgtctgagaggagcctgaccccaggccaggagcaccccccaccagccagcagcttcctgagcctggcctccatgaccagcagcgctgccctgctgaaggaggtggccgcccgggctgctggcagcctgctggccgagaagagcagcctgctgcctgaggaccccctgcccccaccacccagcgagaagaagccagagaaggtgaccccacctcctcctcctcctcctcctcctcctcctcctcctccaccccagagcctggagctgctgctgctgcctgtgcccaagggccgggtgtccaagcccagcaacagcgccagcgaggaggagagcggcaagcccttccagtgccccatctgtggcctggtgatcaagaggaagagctactggaagaggcacatggtgatccacacaggcctgaagagccaccagtgccccctgtgccccttccgctgtgccaggaaggacaacctgaagagccacatgaaggtgcaccagcaccaggacagaggagagaccttccagtgccagctgtgccccttcaccagcagccgccacttcagcctgaagctgcacatgcgctgccaccagcacttcctgaggacagaggccaaggtgaaggaggagatcccagaccctgatgtgaagggcagcccccacctgagtgacagcgcctgcctgggccagcagcgggagggcggcggcacagagctggtgggcaccatgatgaccagcaacaccccagagaggaccagccagggcggggccggcgtgagccccctgctggtgaaggaggagcccaaggaggacaatggcctgcccaccagcttcaccctgaatgctgctgacaggcctgccaaccacaccaagctgaaggaccccagtgaatatgtggccaacagcgccagcgccctcttcagccaggacatctctgtgaagatggccagtgacttcctgatgaagctgtctgctgccaaccagaaggagcccatgaacctgaacttcaaggtgaaggaggagcccaaggagggggagagcctgagcaccaccctgcccaggagcagctatgtgttcagccctgagagcgaggtgtctgcccctggggtgtctgaagatgccctgaagccccaggagggcaaaggatctgtgctgcggagagatgtgtctgtgaaggccgccagcgagctgctgatgaagctgtctgctgagagctacaaggagacccagatggtgaagatcaaggaggagcccatggaggtggacatccaggacagccacgtgtccatcagccccagcagaaatgtgggctacagcaccctcatcggccgggagaagacagagcccctgcagaagatgcctgagggccgggtgcccccagagaggaacctcttcagccaggacatctctgtgaagatggccagcgagctgctcttccagctgtctgagaaggtgtccaaggagcacaaccacaccaaggagaacaccatccgcaccaccaccagccccttcttcagcgaggacaccttccggcagagccccttcaccagcaacagcaaggagctgctgcccagcgacagcgtgctgcacggccgcatcagcgcccctgagacagagaagatcgtgctggaggccggaaatggcctgcccagctggaagttcaatgaccagctgttcccctgtgatgtgtgtgggaaggtgtttggccggcagcagaccctgagccgccacctgagcctgcacacagaggagaggaagtacaagtgccacctgtgcccctatgctgccaagtgccgggccaacctgaaccagcacctgactgtgcacagcgtgaagctggtgtccacagacacagaagatattgtgtctgctgtgaccagcgagggcagtgatggcaagaagcacccctactactacagctgccacgtgtgtggctttgaaacagagctgaatgtgcagtttgtgagccacatgagcctgcacgtggacaaggagcagtggatgttcagcatctgctgcacagcctgtgactttgtgaccatggaggaggccgagatcaagacccacatcggcaccaagcacactggagaggacaggaagaccccatctgagagcaacagccccagcagcagcagcctgagcgccctgagtgacagcgccaacagcaaggatgacagtgatggcagccagaagaacaagggcggcaacaacctgctggtgatctctgtgatgcctggcagccagcccagcctgaacagcgaggagaagccagagaagggctttgaatgtgtgttctgcaactttgtgtgcaagaccaagaacatgtttgagcggcacctgcagatccacctgatcaccaggatgtttgaatgtgatgtgtgccacaagttcatgaagaccccagagcagctgctggagcacaagaagtgccacacagtgcccactggaggcctgaacagcggccagtggtag

SEQ ID NO: 18501 - DNA, 2196 bp, Artificial Sequence
  Description of Artificial Sequence: Synthetic coding sequence
atgcccaggaggaagcaggagcagcccaagaggctgcccagccccagcgaggaggagagcggcaagcccttccagtgccccatctgtggcctggtgatcaagaggaagagctactggaagaggcacatggtgatccacacaggcctgaagagccaccagtgccccctgtgccccttccgctgtgccaggaaggacaacctgaagagccacatgaaggtgcaccagcaccaggacagaggagagaccttccagtgccagctgtgccccttcaccagcagccgccacttcagcctgaagctgcacatgcgctgccaccagcacttcctgaggacagaggccaaggtgaaggaggagatcccagaccctgatgtgaagggcagcccccacctgagtgacagcgcctgcctgggccagcagcgggagggcggcggcacagagctggtgggcaccatgatgaccagcaacaccccagagaggaccagccagggcggggccggcgtgagccccctgctggtgaaggaggagcccaaggaggacaatggcctgcccaccagcttcaccctgaatgctgctgacaggcctgccaaccacaccaagctgaaggaccccagtgaatatgtggccaacagcgccagcgccctcttcagccaggacatctctgtgaagatggccagtgacttcctgatgaagctgtctgctgccaaccagaaggagcccatgaacctgaacttcaaggtgaaggaggagcccaaggagggggagagcctgagcaccaccctgcccaggagcagctatgtgttcagccctgagagcgaggtgtctgcccctggggtgtctgaagatgccctgaagccccaggagggcaaaggatctgtgctgcggagagatgtgtctgtgaaggccgccagcgagctgctgatgaagctgtctgctgagagctacaaggagacccagatggtgaagatcaaggaggagcccatggaggtggacatccaggacagccacgtgtccatcagccccagcagaaatgtgggctacagcaccctcatcggccgggagaagacagagcccctgcagaagatgcctgagggccgggtgcccccagagaggaacctcttcagccaggacatctctgtgaagatggccagcgagctgctcttccagctgtctgagaaggtgtccaaggagcacaaccacaccaaggagaacaccatccgcaccaccaccagccccttcttcagcgaggacaccttccggcagagccccttcaccagcaacagcaaggagctgctgcccagcgacagcgtgctgcacggccgcatcagcgcccctgagacagagaagatcgtgctggaggccggaaatggcctgcccagctggaagttcaatgaccagctgttcccctgtgatgtgtgtgggaaggtgtttggccggcagcagaccctgagccgccacctgagcctgcacacagaggagaggaagtacaagtgccacctgtgcccctatgctgccaagtgccgggccaacctgaaccagcacctgactgtgcacagcgtgaagctggtgtccacagacacagaagatattgtgtctgctgtgaccagcgagggcagtgatggcaagaagcacccctactactacagctgccacgtgtgtggctttgaaacagagctgaatgtgcagtttgtgagccacatgagcctgcacgtggacaaggagcagtggatgttcagcatctgctgcacagcctgtgactttgtgaccatggaggaggccgagatcaagacccacatcggcaccaagcacactggagaggacaggaagaccccatctgagagcaacagccccagcagcagcagcctgagcgccctgagtgacagcgccaacagcaaggatgacagtgatggcagccagaagaacaagggcggcaacaacctgctggtgatctctgtgatgcctggcagccagcccagcctgaacagcgaggagaagccagagaagggctttgaatgtgtgttctgcaactttgtgtgcaagaccaagaacatgtttgagcggcacctgcagatccacctgatcaccaggatgtttgaatgtgatgtgtgccacaagttcatgaagaccccagagcagctgctggagcacaagaagtgccacacagtgcccactggaggcctgaacagcggccagtggtag

SEQ ID NO: 18502 - DNA, 3234 bp, Artificial Sequence
  Description of Artificial Sequence: Synthetic coding sequence
atgcccaggaggaagcaggagcagcccaagaggctgcccagccacgtgtcccggcaggaggaggccgagggggagctgtctgagggggagcactggtacggcaacagcagcgagaccccatctgaggccagctatggagaggtgcaggagaactacaagctgagcctggaggaccgcatccaggagcagagcaccagcccagacaccagcctgggcagcaccacccccagcagccacaccctggagctggtggccctggacagcgaggtgctgcgggacagcctgcagtgccaggaccacctgagccctggggtgagcagcctgtgtgatgatgatcctggcagcaacaagcccctgagcagcaacctgcggcggctgctggaggccggcagcctgaagctggatgctgctgccacagccaacggccgggtggagagccctgtgaatgtgggcagcaacctgtccttcagcccccccagccaccacgcccagcagctgtctgtgctggccaggaagctggccgagaagcaggagcagaatgaccagtacacccccagcaaccgcttcatctggaaccagggcaagtggctgcccaacagcaccaccacctgcagcctgagcccagacagcgccatcctgaagctgaaggccgccgccaatgctgtgctgcaggacaagagcctgaccaggacagaggagaccatgagatttgagagcttcagcagccccttcagcagccagagcgccagcagcaccctggccgccctgagcaagaaggtgtctgagaggagcctgaccccaggccaggagcaccccccaccagccagcagcttcctgagcctggcctccatgaccagcagcgctgccctgctgaaggaggtggccgcccgggctgctggcagcctgctggccgagaagagcagcctgctgcctgaggaccccctgcccccaccacccagcgagaagaagccagagaaggtgaccccacctcctcctcctcctcctcctcctcctcctcctcctccaccccagagcctggagctgctgctgctgcctgtgcccaagggccgggtgtccaagcccagcaacagcgccagcgaggaggagagcggcaagcccttccagtgccccatctgtggcctggtgatcaagaggaagagctactggaagaggcacatggtgatccacacaggcctgaagagccaccagtgccccctgtgccccttccgctgtgccaggaaggacaacctgaagagccacatgaaggtgcaccagcaccaggacagaggagagaccttccagtgccagctgtgccccttcaccagcagccgccacttcagcctgaagctgcacatgcgctgccaccagcacttcctgaggacagaggccaaggtgaaggaggagatcccagaccctgatgtgaagggcagcccccacctgagtgacagcgcctgcctgggccagcagcgggagggcggcggcacagagctggtgggcaccatgatgaccagcaacaccccagagaggaccagccagggcggggccggcgtgagccccctgctggtgaaggaggagcccaaggaggacaatggcctgcccaccagcttcaccctgaatgctgctgacaggcctgccaaccacaccaagctgaaggaccccagtgaatatgtggccaacagcgccagcgccctcttcagccaggacatctctgtgaagatggccagtgacttcctgatgaagctgtctgctgccaaccagaaggagcccatgaacctgaacttcaaggtgaaggaggagcccaaggagggggagagcctgagcaccaccctgcccaggagcagctatgtgttcagccctgagagcgaggtgtctgcccctggggtgtctgaagatgccctgaagccccaggagggcaaaggatctgtgctgcggagagatgtgtctgtgaaggccgccagcgagctgctgatgaagctgtctgctgagagctacaaggagacccagatggtgaagatcaaggaggagcccatggaggtggacatccaggacagccacgtgtccatcagccccagcagaaatgtgggctacagcaccctcatcggccgggagaagacagagcccctgcagaagatgcctgagggccgggtgcccccagagaggaacctcttcagccaggacatctctgtgaagatggccagcgagctgctcttccagctgtctgagaaggtgtccaaggagcacaaccacaccaaggagaacaccatccgcaccaccaccagccccttcttcagcgaggacaccttccggcagagccccttcaccagcaacagcaaggagctgctgcccagcgacagcgtgctgcacggccgcatcagcgcccctgagacagagaagatcgtgctggaggccggaaatggcctgcccagctggaagttcaatgaccagctgttcccctgtgatgtgtgtgggaaggtgtttggccggcagcagaccctgagccgccacctgagcctgcacacagaggagaggaagtacaagtgccacctgtgcccctatgctgccaagtgccgggccaacctgaaccagcacctgactgtgcacagcgtgaagctggtgtccacagacacagaagatattgtgtctgctgtgaccagcgagggcagtgatggcaagaagcacccctactactacagctgccacgtgtgtggctttgaaacagagctgaatgtgcagtttgtgagccacatgagcctgcacgtggacaaggagcagtggatgttcagcatctgctgcacagcctgtgactttgtgaccatggaggaggccgagatcaagacccacatcggcaccaagcacactggagaggacaggaagaccccatctgagagcaacagccccagcagcagcagcctgagcgccctgagtgacagcgccaacagcaaggatgacagtgatggcagccagaagaacaagggcggcaacaacctgctggtgatctctgtgatgcctggcagccagcccagcctgaacagcgaggagaagccagagaagggctttgaatgtgtgttctgcaactttgtgtgcaagaccaagaacatgtttgagcggcacctgcagatccacctgatcaccaggatgtttgaatgtgatgtgtgccacaagttcatgaagaccccagagcagctgctggagcacaagaagtgccacacagtgcccactggaggcctgaagtag

SEQ ID NO: 18503 - DNA, 1299 bp, Artificial Sequence
  Description of Artificial Sequence: Synthetic coding sequence
atgccccacagccccctcatcagcatcccccacgtgtggtgccaccctgaggaggaggagaggatgcatgatgagctgctgcaggccgtgtccaagggccctgtgatgttcagagatgtgtccattgacttcagccaggaggagtgggagtgcctggatgctgaccagatgaacctgtacaaggaggtgatgctggagaacttcagcaacctggtgtctgtgggcctgagcaacagcaagccagctgtgatcagcctgctggagcagggcaaggagccctggatggtggaccgggagctgacccggggcctgtgcagcgacctggagagcatgtgtgagaccaagatcctgagcctgaagaagaggcacttcagccaggtgatcatcacccgggaggacatgagcaccttcatccagcccaccttcctgatccccccccagaagaccatgtctgaggagaagccctgggagtgcaagatctgtgggaagaccttcaaccagaacagccagttcatccagcaccagaggatccactttggagagaagcactatgagagcaaggagtatggcaagagcttcagccggggcagcctggtgaccaggcaccagaggatccacacaggcaagaagccctatgagtgcaaggaatgtgggaaggccttcagctgcagcagctacttcagccagcaccagaggatccacactggagagaagccctatgagtgcaaggaatgtgggaaggccttcaagtactgcagcaacctgaatgaccaccagaggatccacactggagagaagccctatgagtgcaaggtgtgtgggaaggccttcaccaagagcagccagctgttcctgcacctgcgcatccacactggagagaagccctatgagtgcaaggaatgtgggaaggccttcacccagcacagccgcctcatccagcaccagaggatgcacactggagagaagccctatgagtgcaagcagtgtgggaaggccttcaacagcgccagcaccctgaccaaccaccaccgcatccatgctggggagaagctgtatgaatgtgaggagtgcaggaaggccttcatccagagcagcgagctgatccagcaccagaggatccacacagatgagaagccctatgaatgtaatgaatgtgggaaggccttcaacaagggcagcaacctgaccaggcaccagaggatccacactggagagaagccctatgactgcaaggaatgtgggaaggccttcggcagcagaagtgacctgatcagacatgagggcatccacactggatag

SEQ ID NO: 18504 - DNA, 1299 bp, Artificial Sequence; identical to SEQ ID NO: 18503
  Description of Artificial Sequence: Synthetic coding sequence

SEQ ID NO: 18505 - DNA, 2811 bp, Artificial Sequence
  Description of Artificial Sequence: Synthetic coding sequence
atggccctgacccagggccccctgaccttcagagatgtggccatcgagttcagccaggaggagtggaagagcctggaccctgtgcagaaggccctgtactgggatgtgatgctggagaactacagaaacctggtgttcctgggcatcctgcccaagtgcatgaccaaggagctgccccccatcggcaacagcaacacaggagagaagtgccagacagtgaccctggagagacatgaatgttatgatgtggagaacttctacctgcgggagatccagaagaacctgcaggacctggagttccagtggaaggatggagagatcaactacaaggaggtgcccatgacctacaagaacaacctgaatggcaagaggggccagcacagccaggaggatgtggagaacaagtgcatcgagaaccagctgaccctgtccttccagagccggctgacagagctgcagaagttccagacagagggcaagatctatgagtgcaaccagagcgagaagacagtgaacaacagcagcctggtgagccccctgcagaggatcctgcccagcgtgcagaccaacatcagcaagaagtatgaaaatgagttcctgcagctgagcctgcccacccagctggagaagacccacatccgggagaagccctacatgtgcaagggctgcggcaaggccttccgggtgagcagcagcctcatcaaccaccagatggtgcacaccacagagaagccctacaagtgcaatgaatgtgggaaggccttccaccggggcagcctgctgaccatccaccagatcgtgcacacccggggcaagccctaccagtgtggggtgtgtgggaagatcttccggcagaacagcgacctggtgaaccacagaagaagccacactggagagaagccctacaagtgcaatgaatgtgggaagagcttcagccagagctacaacctggccatccaccagaggatccacactggagagaagccctacaagtgcaatgaatgtgggaagaccttcaagcagggcagctgcctgaccacccaccagatcatccacactggagagaagccctaccagtgtgacatctgtgggaaggtgttccggcagaacagcaacctggtgaaccaccagaggatccacactggagagaagccctacaagtgcaacatctgtgggaagagcttcagccagagcagcaacctggccacccaccagacagtgcacagcggcaacaagccctacaagtgtgatgaatgtgggaagaccttcaagaggagcagcagcctgaccacccaccagatcatccacactggagagaagccctacacctgtgatgtgtgtgacaaggtgttcagccagaggagccagctggcccggcaccagaggagccacactggagagaagccctacaagtgcaatgaatgtgggaaggtgttcagccagaccagccacctggtgggccaccggcgcatccacactggagagaagccctacaagtgtgacaagtgtgggaaggccttcaagcagggcagcctgctgaccaggcacaagatcatccacacccgggagaagcgctaccagtgtggggagtgtgggaaggtgttttctgagaacagctgcctggtgcgccacctgcgcatccacactggagagcagccctacaagtgcaatgtgtgtgggaaggtgttcaactacagcggcaacctgagcatccacaagaggatccacactggagagaagcccttccagtgcaatgaatgtggcaccgtcttcaggaactacagctgcctggcccggcacctgcgcatccacacaggccagaagccctacaagtgcaatgtgtgtgggaaggtgttcaatgacagcggcaacctgagcaaccacaagaggatccacactggagagaagcccttccagtgcaatgaatgtgggaaggtgttctcctactacagctgcctggcccggcacaggaagatccacactggagagaagccctacaagtgcaatgactgtgggaaggcctacacccagaggagcagcctgaccaagcacctgatcatccacactggagagaagccctacaactgcaatgaatttggaggagccttcatccagagcagcaagctggcccgctaccacaggaaccccactggagagaagccccacaagtgcagccactgcggccgcaccttcagccacatcaccggcctgacctaccaccagaggaggcacactggagagatgccctacaagtgcattgaatgtggccaggtgttcaacagcaccagcaacctggcccggcaccggcgcatccacactggagagaagccctacaagtgcaatgaatgtgggaaggtgttccgccaccagagcaccctggcccggcacaggagcatccacactggagagaagccctacgtgtgcaatgaatgtgggaaggccttccgggtgcgcagcatcctggtgaaccaccagaagatgcacactggagacaagccctacaagtgcaatgaatgtgggaaggccttcatcgagaggagcaagctggtgtaccaccagaggaaccacactggagagaagccctacaagtgcattgaatgtgggaaggccttcggccgcttcagctgcctgaacaagcaccagatgatccacagcggggagaagccctacaagtgcaatgaatgtgggaagagcttcatcagccgcagcggcctgaccaagcaccagaccaagcacacagctgagagcctgaagaccaagttcaacgtggagaagcccctggatgtgctgctgaccagcggcttcaagtag

SEQ ID NO: 18506 - DNA, 534 bp, Artificial Sequence
  Description of Artificial Sequence: Synthetic coding sequence
agcctgcccacccagctggagaagacccacatccgggagaagccctacatgtgcaagggctgcggcaaggccttccgggtgagcagcagcctcatcaaccaccagatggtgcacaccacagagaagccctacaagtgcaatgaatgtgggaaggccttccaccggggcagcctgctgaccatccaccagatcgtgcacacccggggcaagccctaccagtgtggggtgtgtgggaagatcttccggcagaacagcgacctggtgaaccacagaagaagccacactggagagaagccctacaagtgcaatgaatgtgggaagagcttcagccagagctacaacctggccatccaccagaggatccacactggagagcagccctacaagtgcaatgtgtgtgggaaggtgttcaactacagcggcaacctgagcatccacaagaggatccacactggagagaagcccttccagtgcaatgaatgtggcaccgtcttcaggaactacagctgcctggcccggcacctgcgcatctag

SEQ ID NO: 18507 - DNA, 1596 bp, Artificial Sequence
  Description of Artificial Sequence: Synthetic coding sequence
atggaggccccagcccagaaggccggccagggcggcctgcccaaggcagatgcccagggcgccagcggggcccgggagaagaggcctgaggagccccggcccctggaggaggaccgggccggcagccggcccacccagaagggggacctgcggggagctgctgggggccgcaccaccccacctgggggcggcagccggggctgcagcctgggcgtgtccccaggccctggcaccaggcacagcgctggcacccggcccctggtgcgggagccctgtggccccaccagcagccagaaccctgagctggtgattcctgagggcctgcaggcccgggagggcccctgccgcagccctgcccggggcggggactgcagcaggaacagctgcctggcctggcacagaggagccccagctggggagaccccacctgtgtgtgacccctgcccagagcgcatccagaaccaccccaggacccagctgtgtgaggtgcacacagactgctggccctgccagcccggcaccggggcccccacctgccccaggacccccaagcccaccagccggggcaggaaccccctggtggagcagccccgggcctgtgcctgtggggaggcctttgcctggagggccctgcgcatcccccaggagcggctgcaggccacagaggagccccggccctgtgcccgctgtgggaagcgcttccggcccaaccagcagcagcaggccggcaagagcccccctgtgtgcccagaatgtggccagaccagccggccccggcccatcgtgcctgaccccccagcccagaggctgtatgcctgtgatgaatgtgggaaggccttcaccaggaccagcagcctgctgcagcaccagaggatccacactggagagcggccctatgaatgtgctgaatgtgggaaggcctttgtgcgctgcagcggcctgtaccgccaccagaagacccacagcgctgagcggcacagaagaggccctgtgctggcccggcgggccttccggctgggctgccccccctgtggggactacagcgagaggagcccccggcggggcagcggggccggggagaagccctatgaatgtgccgactgtgccaaggccttcggcctcttcagccacctggtggagcaccggcgggtgcacactggagagaagccctatgcctgcccagaatgtgggaaggccttcaaccagaggagcaacctgagccgccaccagaggacccacagcagcgccaagccctatgcctgccccctgtgtgagaaggccttcaagggccgcagcggcctggtgcagcaccagagggcccacactggagagcggccctacggctgcagtgaatgtgggaagaccttccggggctgcagcgagctgcggcagcacgagcggctgcacagcggggagaagccctacatctgccgggactgtgggaaggcctttgtgaggaactgcagcctggtgcgccacctgcggacccacactggagagcggccctatgcctgtggggactgtggccgggccttcagccagaggagcaacctgaatgagcacaggaagagacatggaggccgggccgccccctag

SEQ ID NO: 18508 - DNA, 1596 bp, Artificial Sequence; identical to SEQ ID NO: 18507
  Description of Artificial Sequence: Synthetic coding sequence

SEQ ID NO: 18509 - DNA, 2217 bp, Artificial Sequence
  Description of Artificial Sequence: Synthetic coding sequence
atgaccatgctgcaggagagcttctcctttgatgacctgtctgtggacttcacccagaaggagtggcagctgctggaccccagccagaagaacctgtacaaggatgtgatgctggagaactacagcagcctggtgtccctgggctatgaggtgatgaagccagatgtgatcttcaagctggagcagggcgaggagccctgggtgggagatggagagatccccagcagtgacagccctgaggtgtggaaggtggatggcaacatgatgtggcaccaggacaaccaggacaagctgaagatcatcaagaggggccatgaatgtgatgccttcggcaagaacttcaacctgaacatgaactttgtgcccctgaggaagagcaacagcgagggggacctggatggcctcatcctgaagcaccacctggacctgctgatccccaagggggactatggcaaggccgagagtgatgacttcaacgtgtttgacaacttcttcctgcacagcaagccagaggacacagacacctggctgaagtactatgactgtgacaagtacaaggagagctacaagaagagccagatcatcatctaccacaggaaccggctgggggagaagctgtatgagtgcagtgaatgtaggaagcgcttcagcaagaagcccagcctcatcaagcaccagagccgccacatccgggacatcgccttcggctgcggcaactgtgggaagaccttcccccagaagagccagttcatcacccaccacaggacccacactggagagaagccctacaactgcagccagtgtgggaaggccttcagccagaagagccagctgaccagccaccagaggacccacactggagagaagccctatgaatgtggagaatgtgggaaggccttcagcaggaagagccacctgatcagccactggaggacccacactggagagaagccctacggctgcaatgaatgtggccgggccttcagcgagaagagcaacctgatcaaccaccagaggatccacactggagagaagccctttgagtgcagagaatgtgggaaggccttcagcaggaagagccagctggtgacccaccacaggacccacacaggcaccaagcccttcggctgcagcgactgcaggaaggccttctttgagaagtctgagctgatccgccaccagaccatccacactggagagaagccctatgagtgcagtgaatgtaggaaggccttccgggagaggagcagcctcatcaaccaccagaggacccacactggagagaagccccacggctgcatccagtgtgggaaggccttcagccagaagagccacctgatcagccaccagatgacccacactggagagaagcccttcatctgcagcaaatgtgggaaggccttcagcaggaagagccagctggtgcgccaccagaggacccacactggagagaagccctatgagtgcagtgaatgtgggaaggccttcagcgagaagctgagcctgaccaaccaccagaggatccacactggagagaagccctacgtgtgcagtgaatgtgggaaggccttctgccagaagagccacctgatcagccaccagaggacccacactggagagaagccctatgagtgcagtgaatgtgggaaggccttcggggagaagagcagcctggccacccaccagaggacccacactggagagaagccctatgagtgccgggactgtgagaaggccttcagccagaagagccagctgaacacccaccagaggatccacactggagagaagccctatgagtgcagcctgtgcaggaaggccttctttgagaagtctgagctgatccgccacctgcggacccacactggagagaagccctatgagtgcaatgaatgtaggaaggccttccgggagaagagcagcctcatcaaccaccagaggatccacactggagagaagccctttgagtgcagtgaatgtgggaaggccttcagcaggaagagccacctgatcccccaccagaggacccacactggagagaagccctacggctgcagtgaatgtaggaaggccttcagccagaagagccagctggtgaaccaccagaggatccacactggagagaagccctaccgctgcattgaatgtgggaaggccttcagccagaagagccagctgatcaaccaccagaggacccacacagtgaagaagagctag

SEQ ID NO: 18510 - DNA, 2217 bp, Artificial Sequence; identical to SEQ ID NO: 18509
  Description of Artificial Sequence: Synthetic coding sequence

SEQ ID NO: 18511 - DNA, 210 bp, Artificial Sequence
  Description of Artificial Sequence: Synthetic coding sequence
atgaccatgctgcaggagagcttctcctttgatgacctgtctgtggacttcacccagaaggagtggcagctgctggaccccagccagaagaacctgtacaaggatgtgatgctggagaactacagcagcctggtgtccctgggctatgaggtgatgaagccagatgtgatcttcaagctggagcagggcgaggagccctgggtgggctag

SEQ ID NO: 18512 - DNA, 2217 bp, Artificial Sequence; identical to SEQ ID NO: 18509
  Description of Artificial Sequence: Synthetic coding sequence

SEQ ID NO: 18513 - DNA, 168 bp, Artificial Sequence
  Description of Artificial Sequence: Synthetic coding sequence
atgaccatgctgcaggagagcttctcctttgatgacctgtctgtggacttcacccagaaggagtggcagctgctggaccccagccagaagaacctgtacaaggatgtgatgctggagaactacagcagcctggtgtccctgggctatgaggtgatgaagccagactag

SEQ ID NO: 18514 - DNA, 2217 bp, Artificial Sequence; identical to SEQ ID NO: 18509
  Description of Artificial Sequence: Synthetic coding sequence

SEQ ID NO: 18515 - DNA, 711 bp, Artificial Sequence
  Description of Artificial Sequence: Synthetic coding sequence
atgaccatgctgcaggagagcttctcctttgatgacctgtctgtggacttcacccagaaggagtggcagctgctggaccccagccagaagaacctgtacaaggatgtgatgctggagaactacagcagcctggtgtccctgggctatgaggtgatgaagccagatgtgatcttcaagctggagcagggcgaggagccctgggtgggagatggagagatccccagcagtgacagccctgaggtgtggaaggtggatggcaacatgatgtggcaccaggacaaccaggacaagctgaagatcatcaagaggggccatgaatgtgatgccttcggcaagaacttcaacctgaacatgaactttgtgcccctgaggaagagcaacagcgagggggacctggatggcctcatcctgaagcaccacctggacctgctgatccccaagggggactatggcaaggccgagagtgatgacttcaacgtgtttgacaacttcttcctgcacagcaagccagaggacacagacacctggctgaagtactatgactgtgacaagtacaaggagagctacaagaagagccagatcatcatctaccacaggaaccggctgggggagaagctgtatgagtgcagtgaatgtaggaagcgcttcagcaagaagcccagcctcatcaagcaccagagccgccacatccgggacatcgcctttggatag

SEQ ID NO: 18516 - DNA, 204 bp, Artificial Sequence
  Description of Artificial Sequence: Synthetic coding sequence
atgaccatgctgcaggagagcttctcctttgatgacctgtctgtggacttcacccagaaggagtggcagctgctggaccccagccagaagaacctgtacaaggatgtgatgctggagaactacagcagcctggtgtccctgggctatgaggtgatgaagccagatgtgatcttcaagctggagcagggcgaggagccctggtag

SEQ ID NO: 18517 - DNA, 237 bp, Artificial Sequence
  Description of Artificial Sequence: Synthetic coding sequence
atgaccatgctgcaggagagcttctcctttgatgacctgtctgtggacttcacccagaaggagtggcagctgctggaccccagccagaagaacctgtacaaggatgtgatgctggagaactacagcagcctggtgtccctgggctatgaggtgatgaagccagatgtgatcttcaagctggagcagggcgaggagccctgggtgggagatggagagatccccagcagtgacagctag

SEQ ID NO: 18518 - DNA, 2214 bp, Artificial Sequence
  Description of Artificial Sequence: Synthetic coding sequence
atgaccatgctgcaggagagcttctcctttgatgacctgtctgtggacttcacccagaaggagtggcagctgctggaccccagccagaagaacctgtacaaggatgtgatgctggagaactacagcagcctggtgtccctgggctatgaggtgatgaagccagatgtgatcttcaagctggagcagggcgaggagccctgggtgggagatggagagatccccagcagtgacagccctgtgtggaaggtggatggcaacatgatgtggcaccaggacaaccaggacaagctgaagatcatcaagaggggccatgaatgtgatgccttcggcaagaacttcaacctgaacatgaactttgtgcccctgaggaagagcaacagcgagggggacctggatggcctcatcctgaagcaccacctggacctgctgatccccaagggggactatggcaaggccgagagtgatgacttcaacgtgtttgacaacttcttcctgcacagcaagccagaggacacagacacctggctgaagtactatgactgtgacaagtacaaggagagctacaagaagagccagatcatcatctaccacaggaaccggctgggggagaagctgtatgaatgttctgagtgcaggaagcgcttcagcaagaagcccagcctcatcaagcaccagagccgccacatccgggacatcgccttcggctgcggcaactgtgggaagaccttcccccagaagagccagttcatcacccaccacaggacccacactggagagaagccctacaactgcagccagtgtgggaaggccttcagccagaagagccagctgaccagccaccagaggacccacactggagagaagccctatgaatgtggggagtgtgggaaggccttcagcaggaagagccacctgatcagccactggaggacccacactggagagaagccctacggctgcaatgaatgtggccgggccttcagcgagaagagcaacctgatcaaccaccagaggatccacactggagagaagccctttgaatgtcgggagtgtgggaaggccttcagcaggaagagccagctggtgacccaccacaggacccacacaggcaccaagcccttcggctgcagcgactgcaggaaggccttctttgagaagtctgagctgatccgccaccagaccatccacactggagagaagccctatgaatgttctgagtgcaggaaggccttccgggagaggagcagcctcatcaaccaccagaggacccacactggagagaagccccacggctgcatccagtgtgggaaggccttcagccagaagagccacctgatcagccaccagatgacccacactggagagaagcccttcatctgcagcaaatgtgggaaggccttcagcaggaagagccagctggtgcgccaccagaggacccacactggagagaagccctatgaatgttctgaatgtgggaaggccttcagcgagaagctgagcctgaccaaccaccagaggatccacactggagagaagccctacgtgtgcagtgaatgtgggaaggccttctgccagaagagccacctgatcagccaccagaggacccacactggagagaagccctatgaatgttctgaatgtgggaaggcctttggagagaagagcagcctggccacccaccagaggacccacactggagagaagccctatgaatgtcgggactgtgagaaggccttcagccagaagagccagctgaacacccaccagaggatccacactggagagaagccctatgaatgttccctgtgcaggaaggccttctttgagaagtctgagctgatccgccacctgcggacccacactggagagaagccctatgaatgtaatgaatgtaggaaggccttccgggagaagagcagcctcatcaaccaccagaggatccacactggagagaagccctttgaatgttctgaatgtgggaaggccttcagcaggaagagccacctgatcccccaccagaggacccacactggagagaagccctacggctgcagcgagtgcaggaaggccttcagccagaagagccagctggtgaaccaccagaggatccacactggagagaagccctaccgctgcattgaatgtgggaaggccttcagccagaagagccagctgatcaaccaccagaggacccacacagtgaagaagagctag

SEQ ID NO: 18519 - DNA, 21 bp, Artificial Sequence
  Description of Artificial Sequence: Synthetic coding sequence
atgaccatgctgcaggtgtag

SEQ ID NO: 18520 - DNA, 1503 bp, Artificial Sequence
  Description of Artificial Sequence: Synthetic coding sequence
atgctggagggccacgagagctatgacacagagaacttctacttccgggagatcaggaagaacctgcaggaggtggacttccagtggaaggatggagagatcaactacaaggagggccccatgacccacaagaacaacctgaccggccagagggtgcgccacagccagggagatgtggagaacaagcacatggagaaccagctgatcctgcgcttccagagcggcctgggggagctgcagaagttccagacagctgagaagatctacggctgcaaccagatcgagaggacagtgaacaactgcttcctggccagccccctgcagaggatcttccctggggtgcagaccaacatcagcaggaaatatggaaatgacttcctgcagctgagcctgcccacccaggatgagaagacccacatccgggagaagccctacatcggaaatgaatgtgggaaggccttccgggtgagcagcagcctcatcaaccaccagatgatccacaccacagagaagccctaccgctgcaatgaaagtggcaaggccttccaccggggcagcctgctgactgtgcaccagatcgtgcacacccggggcaagccctaccagtgtgatgtgtgtggccgcatcttccggcagaacagcgacctggtgaaccaccggcgcagccacactggagacaagccctacatctgcaatgaatgtgggaagagcttcagcaagagcagccacctggccgtgcaccagaggatccacactggagagaagccctacaagtgcaacagatgtgggaagtgcttcagccagagcagcagcctggccacccaccagacagtgcacactggagacaagccctacaagtgcaatgaatgtgggaagaccttcaagaggaacagcagcctgacagcccaccacatcatccacgccggcaagaagccctacacctgtgatgtgtgtgggaaggtgttctaccagaacagccagctggtgcgccaccagatcatccacactggagagaccccctacaagtgcaatgaatgtgggaaggtgttccgctaccgcagcggcctggcccggcactggagcatccacactggagagaagccctacaagtgcaatgaatgtgggaaggccttccgggtgcgcagcatcctgctgaaccaccagatgatgcacactggagagaagccctacaagtgcaatgaatgtgggaaggccttcatcgagaggagcaacctggtgtaccaccagaggaaccacactggagagaagccctacaagtgcatggagtgtgggaaggccttcggccgccgcagctgcctgaccaagcaccagaggatccacagcagcgagaagccctacaagtgcaatgaatgtgggaagagctacatcagccgcagcggcctgaccaagcaccagatcaagcacgccggggagaacctgaccaccaagctgaatgtggagcggcccctggatgtggtgctgaccagcggcatccccaagtag

SEQ ID NO: 18521 - DNA, 2775 bp, Artificial Sequence
  Description of Artificial Sequence: Synthetic coding sequence
atggccctgccccagggcagcctgaccttcagagatgtggccgtggagttcagccaggaggagtggaagtgcctggaccctgtgcagaaggccctgtacagagatgtgatgctggagaactacagaaacctgggcttcctgggcctgtgcctgcctgacctgaacatcatctccatgctggagcagggcaaggagccctggacagtggtgtcccaggtgaagatcgccaggaaccccaactgtggggagtgcatgaagggcgtcatcaccggcatcagccccaagtgtgtgatcaaggagctgccccccatccagaacagcaacacaggagagaagttccaggccgtgatgctggagggccacgagagctatgacacagagaacttctacttccgggagatcaggaagaacctgcaggaggtggacttccagtggaaggatggagagatcaactacaaggagggccccatgacccacaagaacaacctgaccggccagagggtgcgccacagccagggagatgtggagaacaagcacatggagaaccagctgatcctgcgcttccagagcggcctgggggagctgcagaagttccagacagctgagaagatctacggctgcaaccagatcgagaggacagtgaacaactgcttcctggccagccccctgcagaggatcttccctggggtgcagaccaacatcagcaggaaatatggaaatgacttcctgcagctgagcctgcccacccaggatgagaagacccacatccgggagaagccctacatcggaaatgaatgtgggaaggccttccgggtgagcagcagcctcatcaaccaccagatgatccacaccacagagaagccctaccgctgcaatgaaagtggcaaggccttccaccggggcagcctgctgactgtgcaccagatcgtgcacacccggggcaagccctaccagtgtgatgtgtgtggccgcatcttccggcagaacagcgacctggtgaaccaccggcgcagccacactggagacaagccctacatctgcaatgaatgtgggaagagcttcagcaagagcagccacctggccgtgcaccagaggatccacactggagagaagccctacaagtgcaacagatgtgggaagtgcttcagccagagcagcagcctggccacccaccagacagtgcacactggagacaagccctacaagtgcaatgaatgtgggaagaccttcaagaggaacagcagcctgacagcccaccacatcatccacgccggcaagaagccctacacctgtgatgtgtgtgggaaggtgttctaccagaacagccagctggtgcgccaccagatcatccacactggagagaccccctacaagtgcaatgaatgtgggaaggtgttcttccagaggagccggctggccggccaccggcgcatccacactggagagaagccctacaagtgcaatgaatgtgggaaggtgttcagccagcacagccacctggccgtgcaccagagggtgcacactggagagaagccctacaagtgcaatgaatgtgggaaggccttcaactggggcagcctgctgactgtgcaccagaggatccacactggagagaagccctacaagtgcaatgtgtgtgggaaggtgttcaactacggcggctacctgtctgtgcacatgcgctgccacactggagagaagcccctgcactgcaacaagtgtggcatggtgttcacctactacagctgcctggcccggcaccagaggatgcacactggagagaagccctacaagtgcaatgtgtgtgggaaggtgttcattgattctggcaacctgagcatccaccggcgcagccacactggagagaagcccttccagtgcaatgaatgtgggaaggtgttctcctactacagctgcctggcccggcacaggaagatccacactggagagaagccctacaagtgcaatgactgtgggaaggcctacacccagaggagcagcctgaccaagcacctggtgatccacactggagagaacccctaccactgcaatgaatttggagaggccttcatccagagcagcaagctggcccgctaccacaggaaccccaccggggagaagccccacaagtgcagtgaatgtggccgcaccttcagccacaagaccagcctggtgtaccaccagaggaggcacactggagagatgccctacaagtgcattgaatgtgggaaggtgttcaacagcaccaccaccctggcccggcaccggcgcatccacactggagagaagccctacaagtgcaatgaatgtgggaaggtgttccgctaccgcagcggcctggcccggcactggagcatccacactggagagaagccctacaagtgcaatgaatgtgggaaggccttccgggtgcgcagcatcctgctgaaccaccagatgatgcacactggagagaagccctacaagtgcaatgaatgtgggaaggccttcatcgagaggagcaacctggtgtaccaccagaggaaccacactggagagaagccctacaagtgcatggagtgtgggaaggccttcggccgccgcagctgcctgaccaagcaccagaggatccacagcagcgagaagccctacaagtgcaatgaatgtgggaagagctacatcagccgcagcggcctgaccaagcaccagatcaagcacgccggggagaacctgaccaccaagctgaatgtggagcggcccctggatgtggtgctgaccagcggcatccccaagtag

SEQ ID NO: 18522 - DNA, 2427 bp, Artificial Sequence
  Description of Artificial Sequence: Synthetic coding sequence
atgctggagggccacgagagctatgacacagagaacttctacttccgggagatcaggaagaacctgcaggaggtggacttccagtggaaggatggagagatcaactacaaggagggccccatgacccacaagaacaacctgaccggccagagggtgcgccacagccagggagatgtggagaacaagcacatggagaaccagctgatcctgcgcttccagagcggcctgggggagctgcagaagttccagacagctgagaagatctacggctgcaaccagatcgagaggacagtgaacaactgcttcctggccagccccctgcagaggatcttccctggggtgcagaccaacatcagcaggaaatatggaaatgacttcctgcagctgagcctgcccacccaggatgagaagacccacatccgggagaagccctacatcggaaatgaatgtgggaaggccttccgggtgagcagcagcctcatcaaccaccagatgatccacaccacagagaagccctaccgctgcaatgaaagtggcaaggccttccaccggggcagcctgctgactgtgcaccagatcgtgcacacccggggcaagccctaccagtgtgatgtgtgtggccgcatcttccggcagaacagcgacctggtgaaccaccggcgcagccacactggagacaagccctacatctgcaatgaatgtgggaagagcttcagcaagagcagccacctggccgtgcaccagaggatccacactggagagaagccctacaagtgcaacagatgtgggaagtgcttcagccagagcagcagcctggccacccaccagacagtgcacactggagacaagccctacaagtgcaatgaatgtgggaagaccttcaagaggaacagcagcctgacagcccaccacatcatccacgccggcaagaagccctacacctgtgatgtgtgtgggaaggtgttctaccagaacagccagctggtgcgccaccagatcatccacactggagagaccccctacaagtgcaatgaatgtgggaaggtgttcttccagaggagccggctggccggccaccggcgcatccacactggagagaagccctacaagtgcaatgaatgtgggaaggtgttcagccagcacagccacctggccgtgcaccagagggtgcacactggagagaagccctacaagtgcaatgaatgtgggaaggccttcaactggggcagcctgctgactgtgcaccagaggatccacactggagagaagccctacaagtgcaatgtgtgtgggaaggtgttcaactacggcggctacctgtctgtgcacatgcgctgccacactggagagaagcccctgcactgcaacaagtgtggcatggtgttcacctactacagctgcctggcccggcaccagaggatgcacactggagagaagccctacaagtgcaatgtgtgtgggaaggtgttcattgattctggcaacctgagcatccaccggcgcagccacactggagagaagcccttccagtgcaatgaatgtgggaaggtgttctcctactacagctgcctggcccggcacaggaagatccacactggagagaagccctacaagtgcaatgactgtgggaaggcctacacccagaggagcagcctgaccaagcacctggtgatccacactggagagaacccctaccactgcaatgaatttggagaggccttcatccagagcagcaagctggcccgctaccacaggaaccccaccggggagaagccccacaagtgcagtgaatgtggccgcaccttcagccacaagaccagcctggtgtaccaccagaggaggcacactggagagatgccctacaagtgcattgaatgtgggaaggtgttcaacagcaccaccaccctggcccggcaccggcgcatccacactggagagaagccctacaagtgcaatgaatgtgggaaggtgttccgctaccgcagcggcctggcccggcactggagcatccacactggagagaagccctacaagtgcaatgaatgtgggaaggccttccgggtgcgcagcatcctgctgaaccaccagatgatgcacactggagagaagccctacaagtgcaatgaatgtgggaaggccttcatcgagaggagcaacctggtgtaccaccagaggaaccacactggagagaagccctacaagtgcatggagtgtgggaaggccttcggccgccgcagctgcctgaccaagcaccagaggatccacagcagcgagaagccctacaagtgcaatgaatgtgggaagagctacatcagccgcagcggcctgaccaagcaccagatcaagcacgccggggagaacctgaccaccaagctgaatgtggagcggcccctggatgtggtgctgaccagcggcatccccaagtag

SEQ ID NO: 18523 - DNA, 2001 bp, Artificial Sequence
  Description of Artificial Sequence: Synthetic coding sequence
atggacctggtggcctttgaagatgtggccgtgaacttcacccaggaggagtggagcctgctggaccccagccagaagaacctgtaccgggaggtgatgcaggagaccctgaggaacctggccagcattggagagaagtggaaggaccagaacatcgaggaccagtacaagaaccccaggaacaacctgcggagcctgctgggggagcgggtggatgaaaatacagaggagaaccactgtggggagaccagcagccagatcccagatgacaccctgaacaagaagaccagccctggggtgaagagctgtgagagctctgtgtgtggggaggtgtttgtgggccacagcagcctgaacagacacatccgggctgacacagcccacaagcccagcgagtaccaggagtatggccaggagccctacaagtgccagcagaggaagaaggccttccgctgccaccccagcttccagatgcaggagaaggcccacactggagagaagctgtatgactgcaaggaatgtgggaagaccttcatcagccacagcagcatccagaggcacatgatcatgcacaatggagatggcacctacaagtgcaagttctgtgggaaggcctgcccctgcctgagcatctacctgattcatgagcgggtgcacactggagagaagccctacaagtgcaagcagtgtgggaaggccttctcctacagcaccagcctgcagatccacgagaggacccacactggagagaagccctatgagtgcaaggaatgtgggaaggccttcggcagccccaacagcctgtatgagcacaggaggacccacactggagagaagccctatgagtgcaagcagtgtgggaaggccttccgctggttccacagcttccagatccacgagaggacccacagcgaggagaaggcctatgagtgcaccaagtgtgggaaggccttcaagtgccccagctacctgtgcagacatgaggtgacccacagcggcaagaagccctgtgagtgcaagcagtgtgggaaggccctgagctacctgaacttccagaggcacatgaagatgcacaccaggatgaggccctacaagtgcaagacagtggagaagcccctcatcctgcctgtgcgctttgaggacatgaaggagctgaccctggagaggaacctgatgaatgccagcacagtggtgaagcccagcatcgtgcctgtgcccttcaccatcatgaagggcctgaccctggagaggaaccccatgaatgtgtcctctgtggtgaagcccagcttcctgcccctgccctttgacatcatgaagggcctgaccctggagaggaacaggatgtctgtgtccaatgtgggcaagcccagcgacctgccccacaccttcaagtgcatggagggcctgaccctgaagaggaaccccatgaatgtgtcctctgtggtgaagcccagcttcttccccctgccctttgacatcatgaagggcctgaccctggagaggaaccccatgtctgtgtccaatgtgggcaagcccagccacctgccccacaccttcaagtgcatgaagggcctgaccctggagagcaactgcatgaacctgaacaacgtgaagaagcccctggacctgtctgagaccttcaagttcatgaagaggcacaccctggagaggaaccccatccggaacatggagaagcacagcaccatcagcctgcccttcaagtacatgcagcagtgcacagaggacaggatgcccatgaatgtgaagtctgtgaccaagcacagctacctgcccaggagctttgagtacatgcaggagcacaccctggagaggaaccccatgaatgtgagaaatgctgagaagaggagcatcatcttcctgctgtgtgtgtacaccaagggctgcaccctggagaggaaccacatcaacgtgcgcatcgtgggcaagcacagcgtgtgcctggtgccctttgtggacatcaagggcctgaccctggagtag

SEQ ID NO: 18524 - DNA, 1035 bp, Artificial Sequence
  Description of Artificial Sequence: Synthetic coding sequence
atggacctggtggcctttgaagatgtggccgtgaacttcacccaggaggagtggagcctgctggaccccagccagaagaacctgtaccgggaggtgatgcaggagaccctgaggaacctggccagcattggagagaagtggaaggaccagaacatcgaggaccagtacaagaaccccaggaacaacctgcggagcctgctgggggagcgggtggatgaaaatacagaggagaaccactgtggggagaccagcagccagatcccagatgacaccctgaacaagaagaccagccctggggtgaagagctgtgagagctctgtgtgtggggaggtgtttgtgggccacagcagcctgaacagacacatccgggctgacacctgccaccccagcttccagatgcaggagaaggcccacactggagagaagctgtatgactgcaaggaatgtgggaagaccttcatcagccacagcagcatccagaggcacatgatcatgcacaatggagatggcacctacaagtgcaagttctgtgggaaggcctgcccctgcctgagcatctacctgatccacgagcgggtgcacactggagagaagccctacaagtgcaagcagtgtgggaaggccttctcctacagcaccagcctgcagatccacgagaggacccacactggagagaagccctatgagtgcaaggaatgtgggaaggccttcggcagccccaacagcctgtatgagcacaggaggacccacactggagagaagccctatgagtgcaagcagtgtgggaaggccttccgctggttccacagcttccagatccacgagaggacccacagcgaggagaaggcctatgaatgtaccaagtgtgggaaggccttcaagtgccccagctacctgtgcagacatgaggtgacccacagcggcaagaagccctgtgagtgcaagcagtgtgggaaggccctgagctacctgaacttccagagacatgagaggacccacactggagagaagccctatgagtgcaagcactgctag

SEQ ID NO: 18525 - DNA, 1578 bp, Artificial Sequence
  Description of Artificial Sequence: Synthetic coding sequence
atggacctggtggcctttgaagatgtggccgtgaacttcacccaggaggagtggagcctgctggaccccagccagaagaacctgtaccgggaggtgatgcaggagaccctgaggaacctggccagcattggagagaagtggaaggaccagaacatcgaggaccagtacaagaaccccaggaacaacctgcggagcctgctgggggagcgggtggatgaaaatacagaggagaaccactgtggggagaccagcagccagatcccagatgacaccctgaacaagaagaccagccctggggtgaagagctgtgagagctctgtgtgtggggaggtgtttgtgggccacagcagcctgaacagacacatccgggctgacacagcccacaagcccagcgagtaccaggagtatggccaggagccctacaagtgccagcagaggaagaaggccttccgctgccaccccagcttccagatgcaggagaaggcccacactggagagaagctgtatgactgcaaggaatgtgggaagaccttcatcagccacagcagcatccagaggcacatgatcatgcacaatggagatggcacctacaagtgcaagttctgtgggaaggcctgcccctgcctgagcatctacctgattcatgagcgggtgcacactggagagaagccctacaagtgcaagcagtgtgggaaggccttctcctacagcaccagcctgcagatccacgagaggacccacactggagagaagccctatgagtgcaaggaatgtgggaaggccttcggcagccccaacagcctgtatgagcacaggaggacccacactggagagaagccctatgagtgcaagcagtgtgggaaggccttccgctggttccacagcttccagatccacgagaggacccacagcgaggagaaggcctatgagtgcaccaagtgtgggaaggccttcaagtgccccagctacctgtgcagacatgaggtgacccacagcggcaagaagccctgtgagtgcaagcagtgtgggaaggccctgagctacctgaacttccagaggcacatgaagatgcacaccaggatgaggccctacaagtgcaagacagtggagaagcccctcatcctgcctgtgcgctttgaggacatgaaggagctgaccctggagaggaacctgatgaatgccagcacagtggtgaagcccagcatcgtgcctgtgcccttcaccatcatgaagggcctgaccctggagaggaaccccatgaatgtgtcctctgtggtgaagcccagcttcctgcccctgccctttgacatcatgaagggcctgaccctggagaggaacaggatgtctgtgtccaatgtgggcaagcccagcgacctgccccacaccttcaagtgcatggagggcctgaccctgaagaggaaccccatgaatgtgtcctctgtggtgaagcccagcttcttccccctgccctttgacatcatgaagggcctgaccctggagaggaaccccatgtctgtgtccaatgtgggcaagcccagccacctgccccacaccttcaagtgcatgaagggccagtag

SEQ ID NO: 18526 - DNA, 183 bp, Artificial Sequence
  Description of Artificial Sequence: Synthetic coding sequence
ctgagcctgccccagggcctgctgaccttcagagatgtggccatcgagttcagccaggaggagtggaagtgcctggaccctgcccagaggaccctgtacagagatgtgatgctggagaactacagaaacctggtgtccctgggcagcagcgctgtgtgtgacctgggcagcccccagccctag

SEQ ID NO: 18527 - DNA, 2661 bp, Artificial Sequence
  Description of Artificial Sequence: Synthetic coding sequence
atggccctgagccagggcctgctgaccttcagagatgtggccatcgagttcagccaggaggagtggaagtgcctggaccctgcccagaggaccctgtacagagatgtgatgctggagaactacagaaacctggtgtccctggacatcagcagcaagtgcatgatgaaggagttcagcagcacagcccagggcaacacagaggtgatccacacaggcaccctgcagagacatgagcggcaccacatcggggacttctgcttccaggagatggagaaggacatccatgactttgagttccagtggaaggaggatgagaggaacagccatgaggcccccatgacagagatcaagcagctgaccggcagcaccaacagacatgaccagagacatgctggcaacaagcccatcaaggaccagctgggcagcagcttccacagccacctgcctgagctgcacatgttccagacagagggcaagattggcaaccaggtggagaagagcatcaacagcgccagcctggtgtccaccagccagaggatcagctgccggcccaagacccacatcagcaagaactacggcaacaacttcctgaacagcagcctgctgacccagaagcaggaggtgcacatgagggagaagagcttccagtgcaatgaaagtggcaaggccttcaactacagctctgtgctgaggaagcaccagatcatccacctgggcgccaagcagtacaagtgtgatgtgtgtgggaaggtgttcaaccagaagcgctacctggcctgccaccggcgctgccacacaggcaagaagccctacaagtgcaatgactgtgggaagaccttcagccaggagctgaccctgacctgccaccaccggctgcacactggagagaagcactacaagtgcagtgaatgtgggaagaccttcagcaggaacagcgccctggtgatccacaaggccatccacactggagagaagagctacaagtgcaatgaatgtgggaagaccttcagccagaccagctacctggtgtaccaccggcggctgcacactggagagaagccctacaagtgtgaagaatgtgacaaggccttctccttcaagagcaacctggagcggcacaggaagatccacactggagagaagccctacaagtgcaatgaatgttccaggaccttcagcaggaagagcagcctgaccaggcaccggcggctgcacactggagagaagccctacaagtgcaatgactgtgggaagaccttcagccagatgagcagcctggtgtaccaccggcggctgcacactggagagaagccctacaagtgtgaagaatgtgatgaggccttctccttcaagagcaacctggagcggcaccggcgcatccacactggagagaagccctacaagtgcaatgactgtgggaagaccttcagccagaccagcagcctggtgtaccaccggcggctgcacactggagagaagccctacaagtgtgaagaatgtgatgaggccttctccttcaagagcaacctggagcggcaccgcatcatccacactggagagaagctgtacaagtgcaatgaatgtgggaagaccttcagcaggaagagcagcctgaccaggcactgccgcctgcacactggagagaagccctaccagtgcaatgaatgtgggaaggccttccggggccagagcgccctgatctaccaccaggccatccatggaattggcaagctgtacaagtgcaatgactgccaccaggtgttcagcaatgccaccaccatcgccaaccactggaggatccacaatgaggagaggagctacaagtgcaacagatgtgggaagttcttccgccacaggagctacctggccgtgcactggaggacccacagcggggagaagccctacaagtgtgaagaatgtgatgaggccttctccttcaagagcaacctgcagaggcaccggcgcatccacactggagagaagccctacaagtgtgaagaatgtgacaaggtgttcagcaggaagagcagcctggagaagcaccggcgcatccacactggagagaagccctacaagtgcaaggtgtgtgacaaggccttcggccgggacagccacctggcccagcacacccgcatccacactggagagaagccctacaagtgcaatgaatgtgggaagaacttccgccacaacagcgccctggtgatccacaaggccatccacagcggggagaagccctacaagtgcaatgaatgtgggaagaccttccgccacaacagcgccctggagatccacaaggccatccacactggagagaagccctacaagtgcagtgaatgtgggaaggtgttcaacaggaaggccaacctgagccgccaccaccggctgcacactggagagaagccctacaagtgcaacaagtgtgggaaggtgttcaaccagcaggcccacctggcctgccaccaccgcatccacactggagagaagccctacaagtgcaatgaatgtgggaagaccttccgccacaacagcgtgctggtgatccacaagaccatccacactggagagaagccctacaagtgcaatgaatgtgggaaggtgttcaacaggaaggccaagctggcccggcaccaccgcatccacacaggcaagaagcactag

SEQ ID NO: 18528 - DNA, 2913 bp, Artificial Sequence
  Description of Artificial Sequence: Synthetic coding sequence
atggccctgagccagggcctgctgaccttcagagatgtggccatcgagttcagccaggaggagtggaagtgcctggaccctgcccagaggaccctgtacagagatgtgatgctggagaactacagaaacctggtgtccctggacatcagcagcaagtgcatgatgaaggagttcagcagcacagcccagggcaacacagaggtgatccacacaggcaccctgcagagacatgagcggcaccacatcggggacttctgcttccaggagatggagaaggacatccatgactttgagttccagtggaaggaggatgagaggaacagccatgaggcccccatgacagagatcaagcagctgaccggcagcaccaacagacatgaccagagacatgctggcaacaagcccatcaaggaccagctgggcagcagcttccacagccacctgcctgagctgcacatgttccagacagagggcaagattggcaaccaggtggagaagagcatcaacagcgccagcctggtgtccaccagccagaggatcagctgccggcccaagacccacatcagcaagaactacggcaacaacttcctgaacagcagcctgctgacccagaagcaggaggtgcacatgagggagaagagcttccagtgcaatgaaagtggcaaggccttcaactacagctctgtgctgaggaagcaccagatcatccacctgggcgccaagcagtacaagtgtgatgtgtgtgggaaggtgttcaaccagaagcgctacctggcctgccaccggcgctgccacacaggcaagaagccctacaagtgcaatgactgtgggaagaccttcagccaggagctgaccctgacctgccaccaccggctgcacactggagagaagcactacaagtgcagtgaatgtgggaagaccttcagcaggaacagcgccctggtgatccacaaggccatccacactggagagaagagctacaagtgcaatgaatgtgggaagaccttcagccagaccagctacctggtgtaccaccggcggctgcacactggagagaagccctacaagtgtgaagaatgtgacaaggccttctccttcaagagcaacctggagcggcacaggaagatccacactggagagaagccctacaagtgcaatgaatgttccaggaccttcagcaggaagagcagcctgaccaggcaccggcggctgcacactggagagaagccctacaagtgcaatgactgtgggaagaccttcagccagatgagcagcctggtgtaccaccggcggctgcacactggagagaagccctacaagtgtgaagaatgtgatgaggccttctccttcaagagcaacctggagcggcaccggcgcatccacactggagagaagccctacaagtgcaatgactgtgggaagaccttcagccagaccagcagcctggtgtaccaccggcggctgcacactggagagaagccctacaagtgtgaagaatgtgatgaggccttctccttcaagagcaacctggagcggcaccgcatcatccacactggagagaagctgtacaagtgcaatgaatgtgggaagaccttcagcaggaagagcagcctgaccaggcactgccgcctgcacactggagagaagccctaccagtgcaatgaatgtgggaaggccttccggggccagagcgccctgatctaccaccaggccatccatggaattggcaagctgtacaagtgcaatgactgccaccaggtgttcagcaatgccaccaccatcgccaaccactggaggatccacaatgaggagaggagctacaagtgcaacagatgtgggaagttcttccgccacaggagctacctggccgtgcactggaggacccacagcggggagaagccctacaagtgtgaagaatgtgatgaggccttctccttcaagagcaacctgcagaggcaccggcgcatccacactggagagaagccctaccgctgcaatgaatgtgggaagaccttcagcaggaagagctacctgacctgccaccggcggctgcacactggagagaagccctacaagtgcaatgaatgtgggaagaccttcggcaggaacagcgccctgatcatccacaaggccatccacactggagagaagccctacaagtgcaatgaatgtgggaaggccttcagccagaagagcagcctgacctgccacctgcggctgcacactggagagaagccctacaagtgtgaagaatgtgacaaggtgttcagcaggaagagcagcctggagaagcaccggcgcatccacactggagagaagccctacaagtgcaaggtgtgtgacaaggccttcggccgggacagccacctggcccagcacacccgcatccacactggagagaagccctacaagtgcaatgaatgtgggaagaacttccgccacaacagcgccctggtgatccacaaggccatccacagcggggagaagccctacaagtgcaatgaatgtgggaagaccttccgccacaacagcgccctggagatccacaaggccatccacactggagagaagccctacaagtgcagtgaatgtgggaaggtgttcaacaggaaggccaacctgagccgccaccaccggctgcacactggagagaagccctacaagtgcaacaagtgtgggaaggtgttcaaccagcaggcccacctggcctgccaccaccgcatccacactggagagaagccctacaagtgcaatgaatgtgggaagaccttccgccacaacagcgtgctggtgatccacaagaccatccacactggagagaagccctacaagtgcaatgaatgtgggaaggtgttcaacaggaaggccaagctggcccggcaccaccgcatccacacaggcaagaagcactag

SEQ ID NO: 18529 - DNA, 1602 bp, Artificial Sequence
  Description of Artificial Sequence: Synthetic coding sequence
atggacagcagccagcacctggtgacctttgaagatgtggccgtggacttcacccaggaggagtggaccctgctggaccaggcccagagggacctgtacagagatgtgatgctggagaactacaagaacctgatcatcctggccggcagcgagctgttcaagaggagcctgatgagcggcctggagcagatggaggagctgaggactggagtgactggagtgctgcaggagctggacctgcagctgaagaccaagggcagccccctgctgcaggacatctctgctgagaggagccccaacggggtgcagctggagaggagcaacacagctgagaagctgtatgacagcaaccacagcggcaaggtgttcaatgagcaccccttcctgatgacccacatgatcacccacatcggggagaagaccagcgaggacaaccagagcggcaaggccctgaggaagaacttcccccacagcttctacaagaagagccatgctgagggcaagatgcccaagtgtgtgaagcatgagaaggccttcaaccagttccccaacctgacccggcagaacaagacccacacccaggagaagctgtgtgagtgcaaggactgctggaggaccttcctgaaccagagcagcctgaagctgcacatccgcagccacaatggagacaagcactacgtgtgcaaggaatgtgggaaggccttcagcaacagcagccacctgattggccacggccgcatccacagcggggagaagccctacgtgtgcaaggaatgtgggaaggccttcacccagagcacaggcctgaagctgcacatccgcacccacagcggggagaagccctacaagtgcaaggaatgtgggaaggccttcacccacagcagctacctgacagaccacacccgcatccacagcggcaagaagccctacgtgtgcatggagtgtgggaaggccttcaccaggagcacaggcctcatcctgcacatgaggatccacactggagagaagccctatgagtgcaaggaatgtgggaaggccttcatccacagcagctacctgaccaagcacgtgcgcatccacagcggggagaagctgtacctgtgcaaggcctgtgggaaggccttcaccaggagcagcggcctggtgctgcacatgaggacccacactggagagaagccctatgagtgcaaggaatgtgggaaggccttcaacaacagctccatgctgagccagcacgtgcgcatccacactggagagaagccctatgagtgcaaggaatgtgggaaggccttcacccagagcagcggcctgagcacccacctgcggacccacactggagagaaggcctgtgagtgcaaggaatgtgggaaggcctttgcccggagcaccaacctgaacatgcacatgaggacccacactggagagaagccctatgcctgcaaggaatgtgggaaggccttccgctacagcacctacctgaatgtgcacaccaggacccacactggagccaagccctatgagtgcaagaagtgtgggaagaacttcacccagagcagcgccctggccaagcacctgcggaccaaggcctgtgagaagacctag

SEQ ID NO: 18530 - DNA, 1899 bp, Artificial Sequence
  Description of Artificial Sequence: Synthetic coding sequence
atgctgcgggaggaggccgcccagaagaggaaggagaaggagcccggcatggccctgccccagggccacctgaccttcagagatgtggccatcgagttcagcctggaggagtggaagtgcctggaccccacccagagggccctgtaccgggccatgatgctggagaactacagaaacctgcacagcgtggacatcagcagcaagtgcatgatgaagaagttcagcagcacagcccagggcaacacagaggtggacaccggcaccctggagagacatgagagccaccacatcggggacttctgcttccagaagattggcaaggacatccatgactttgagttccagtggcaggaggacaagaggaacagccatgaggccaccatgacccagatcaagaagctgaccggcagcacagacagatatgacagaagacaccctggcaacaagcccatcaaggaccagctgggcctgtccttccacagccacctgcctgagctgcacatcttccagaccaagggcaaggtgggcaaccaggtggagaagagcatcaatgatgccagctctgtgctgaccagccagaggatcagcagccggcccaagatccacatcagcaacaactatgagaacaacttcttccacagcagcctgctgaccctgaagcaggaggtgcacatccgggagaagagcttccagtgcaatgaaagtggcaaggccttcaactgcagcagcctgctgaggaagcaccagatcatctacctgggcggcaagcagtacaagtgtgatgtgtgtgggaaggtgttcaaccagaagcgctacctggcctgccaccaccgctgccacactggagagaagccctacaagtgcaatgaatgtgggaaggtgttcaaccagcagagcaacctggccagccaccaccggctgcacactggagagaagccctacaagtgtgaggagtgtgacaaggtgttcagcaggaagagcaacctggagcggcaccggcgcatccacactggagagaagccctacaagtgcaaggtgtgtgagaaggccttccggcgggacagccacctgacccagcacacccgcatccacactggagagaagccctacaagtgcaatgaatgtgggaaggccttcagcggccagagcaccctcatccaccaccaggccatccacggcatcggcaagctgtacaagtgcaatgactgccacaaggtgttcagcaatgccaccaccatcgccaaccactggaggatccacaatgaggagaggagctacaagtgcaacaagtgtgggaagttcttcagaagaagaagctacctggtggtgcactggaggacccacactggagagaagccctacaagtgcaatgaatgtgggaagaccttccaccacaacagcgccctggtgatccacaaggccatccacactggagagaagccctacaagtgcaatgaatgtgggaagaccttccgccacaacagcgccctggtgatccacaaggccatccacactggagagaagccctacaagtgcaatgaatgtgggaaggtgttcaaccagcaggccaccctggcccggcaccaccggctgcacactggagagaagccctacaagtgtgaggagtgtgacacagtgttcagcaggaagagccaccacgagacccacaagaggatccacactggagagaagccctacaagtgtgatgactttgatgaggccttcagccaggccagcagctatgccaagcagaggcgcatccacatgggagagaagcaccacaagtgtgatgactgtgggaaggccttcaccagccacagccaccgcatccgccaccagaggatccacacaggccagaagagctacaagtgccacaagaggggcaaggtgttctcctag

SEQ ID NO: 18531 - DNA, 1122 bp, Artificial Sequence
  Description of Artificial Sequence: Synthetic coding sequence
atgagcctgcggcggcacatcggcaaccctgagtacctgatgaagaggatcccccagaacccccgctaccagcacatcaagagccggctggacaccggcaacagcatgaccaagtacacagagaagctggaggagatcaagaagaactaccgctacaagaaggatgagctgttcaagaggctgaaggtgaccacctttgcccagctgatcatccaggtggccagcctgagtgaccagaccctggaggtgacagctgaggagatccagaggctggaggacaatgacagcgctgccagtgaccctgatgctgagaccacagcccggaccaacgggaagggcaaccctggagagcagagccccagccctgagcagttcatcaacaatgctggggccggggacagcagccgcagcaccctgcagagcgtcatcagcggcgtgggggagctggacctggacaagggccctgtgaagaaggccgagccccacaccaaggacaagccctacccagactgccccttcctgctgctggatgtgcgggaccgggacagctaccagcagtgccacatcgtgggcgcctacagctaccccatcgccaccctgagcaggaccatgaacccctacagcaatgacatcctggagtacaagaatgcccacggcaagatcatcatcctgtatgatgatgatgagcggctggccagccaggccgccaccaccatgtgtgagcggggctttgaaaatctcttcatgctgagcggcggcctgaaggtgctggcccagaagtttcctgagggcctcatcaccggcagcctgcctgccagctgccagcaggccctgcccccaggcagcgccaggaagaggagcagccccaagggcccccccctgcctgctgagaacaagtggaggttcaccccagaggacctgaagaagattgagtactacctggaggaggagcagggccctgctgaccaccccagccggctgaaccaggccaacagcagcggccgggagagcaaggtgcctggggcccggagcgcccagaacctgcccggcggcggccctgccagccacagcaaccccaggagcctgagcagcggccacctgcagggcaagccctggaagtag

SEQ ID NO: 18532 - DNA, 1692 bp, Artificial Sequence
  Description of Artificial Sequence: Synthetic coding sequence
atggcccggcggctgctgcctgcccacgtgcaggagagcgtgaccttcagagatgtggccgtgttcttcagccaggatgagtggctgcacctggacagcgcccagagggccctgtaccgggaggtgatgctggagaactacagcatcctggtgtccctgggcatcctcttcagcaagcccaaggtgatcagccagctggagcagggcgaggacccctggatggtggagagcggcgtgccccagggcgcccacctgggctgggagagcctgtttggcaccatcgtgtccaaggaggagaaccaggaggtgatgaagaagctgatcattgatggcacctttgacttcaagctggagaagacctacatcaatgaagacaagctggagaagcagcagggcaagaagaacagactcttcagcaaggtgctggtgaccatcaagaaggtgtacatgaaggagaggagcttcaagggcgtggagtttgggaagaacctgggcctgaagagcagcctcatcaggaagccccgcatcgtgtcccggggcagaagacccaggagccagcagtacagcgtgctcttcaagcagctgggcgtgaacacagtgaggaagtgctacaagtgcaacatctgtgggaagatcttcctgcacagcagcagcctgagcaagcaccagaggatccacactggagagaagctgtacaagtgcaaggagtgcaggaaggccttcagccagagcagcagcctgacccagcacctgcgggtgcacactggagagaagccctacatctgcagtgaatgtgggaaggccttctccttcaccaccagcctcatcggccaccagaggatgcacactggagagcggccctacaagtgcaaggaatgtgggaagaccttcaagggcagcagcagcctgaacaaccaccagaggatccacactggagagaagccctacaagtgcaatgaatgtggccgggccttcagccagtgcagcagcctcatccagcaccaccgcatccacactggagagaagccctatgaatgtacccagtgtgggaaggccttcaccagcatcagccggctgagccgccaccaccgcatccacactggagagaagcccttccactgcaatgaatgtgggaaggtgttctcctaccacagcgccctgatcatccaccagaggatccacactggagagaagccctatgcctgcaaggaatgtgggaaggccttcagccagagcagcgccctgatccagcaccagaggatccacactggagagaagccctacaagtgcaatgaatgtgggaaggccttctcctggatcagccggctgaacatccaccaccgcatccacactggagagaagccctacaactgcaaggaatgtgggaaggccttcagcagccacagcggcgtgaacacccacaggaagatccacactggagagaagccctacaagtgcaatgactgtgagaaggccttcaaccagagcagcgccctgatccagcaccagaggatccacactggagagaagccctacaactgcaaggtgtgtgggaaggccttccggcagagcagcagcctgatgacccacatgaggatccacactggagagaagccctacaagtgcaaggaatgtgggaaggccttcagccagagcagcagcctgaccaaccaccagaggacccacaactag

SEQ ID NO: 18533 - DNA, 126 bp, Artificial Sequence
  Description of Artificial Sequence: Synthetic coding sequence
atggcccggcggctgctgcctgcccacgtgcaggagagcgtgaccttcagagatgtggccgtgttcttcagccaggatgagtggctgcacctggacagcgcccagagggccctgtaccgggagtag

SEQ ID NO: 18534 - DNA, 405 bp, Artificial Sequence
  Description of Artificial Sequence: Synthetic coding sequence
atggcccggcggctgctgcctgcccacgtgcaggagagcgtgaccttcagagatgtggccgtgttcttcagccaggatgagtggctgcacctggacagcgcccagagggccctgtaccgggaggtgatgctggagaactacagcatcctggtgtccctgggcatcctcttcagcaagcccaaggtgatcagccagctggagcagggcgaggacccctggatggtggagagcggcgtgccccagggcgcccacctgggctgggagagcctgtttggcaccatcgtgtccaaggaggagaaccaggaggtgatgaagaagctgatcattgatggcacctttgacttcaagctggagaagacctacatcaatgaagacaagctggagaagcagcagggcaagaagtag

SEQ ID NO: 18535 - DNA, 1713 bp, Artificial Sequence
  Description of Artificial Sequence: Synthetic coding sequence
atgcctggagaaacagaggagccccggcccccagagcagcaggaccaggagggcggggaggccgccaaggccgcccctgaggagccccagcagaggcctcctgaggccgtggccgccgccccagctggcaccaccagcagccgggtgctgcggggcggccgggaccggggccgggctgctgctgctgctgctgctgctgctgtgtccagaagaaggaaggccgagtaccccaggagaagaagaagcagccccagcgcccggcccccagatgtgcccggccagcagccccaggccgccaagagccccagccctgtgcagggcaagaagagcccccggctgctgtgcatcgagaaggtgaccacagacaaggaccccaaggaggagaaggaggaggaggatgattctgccctgccccaggaggtgtccattgctgccagccggcccagccggggctggaggagcagcaggacctctgtgagccgccaccgggacacagagaacaccaggagcagccgcagcaagacaggcagcctgcagctgatctgcaagtctgagcccaacacagaccagctggactatgatgtgggggaggagcaccagagccctgggggcatcagcagcgaggaggaggaggaggaggaggaggagatgctgatcagcgaggaggagatccccttcaaggatgaccccagagatgagacctacaagccccacctggagcgggagacccccaagcccaggaggaagagcggcaaggtgaaggaggagaaggagaagaaggagatcaaggtggaggtggaggtggaggtgaaggaggaggagaatgagatcagagaagatgaggagccccccaggaagagaggaagaagaaggaaggatgacaagagcccccggctgcccaagaggaggaagaagccacccatccagtatgtgcgctgtgagatggagggctgcggcaccgtgctggcccacccccgctacctgcagcaccacatcaagtaccagcacctgctgaagaagaagtatgtgtgcccccaccccagctgtggccgcctcttccggctgcagaagcagctgctgcggcatgccaagcaccacacagaccagagggactacatctgtgagtactgtgcccgggccttcaagagcagccacaacctggccgtgcacaggatgatccacactggagagaagcccctgcagtgtgagatctgtggcttcacctgccggcagaaggccagcctgaactggcacatgaagaagcatgatgctgacagcttctaccagttcagctgcaacatctgtgggaagaagtttgagaagaaggacagcgtggtggcccacaaggccaagagccaccctgaggtgctgattgctgaggccctggccgccaatgctggggccctgatcaccagcacagacatcctgggcaccaaccctgagagcctgacccagcccagtgatggccagggcctgcccctgctgcctgagcccctgggcaacagcaccagcggggagtgcctgctgctggaggccgagggcatgagcaagagctactgcagcggcacagagcgggtgtccctgatggctgatggcaagatctttgtgggcagcggcagcagcggcggcacagagggcctggtgatgaacagcgacatcctgggcgccaccacagaggtgctgattgaagattctgattctgctggcccctag

SEQ ID NO: 18536 - DNA, 1590 bp, Artificial Sequence
  Description of Artificial Sequence: Synthetic coding sequence
atgcctggagaaacagaggagccccggcccccagagcagcaggaccaggagggcggggaggccgccaaggccgcccctgaggagccccagcagaggcctcctgaggccgtggccgccgccccagctggcaccaccagcagccgggtgctgcggggcggccgggaccggggccgggctgctgctgctgctgctgctgctgctgtgtccagaagaaggaaggccgagtaccccaggagaagaagaagcagccccagcgcccggcccccagatgtgcccggccagcagccccaggccgccaagagccccagccctgtgcagggcaagaagagcccccggctgctgtgcatcgagaaggtgaccacagacaaggaccccaaggaggagaaggaggaggaggatgattctgccctgccccaggaggtgtccattgctgccagccggcccagccggggctggaggagcagcaggacctctgtgagccgccaccgggacacagagaacaccaggagcagccgcagcaagacaggcagcctgcagctgatctgcaagtctgagcccaacacagaccagctggactatgatgtgggggaggagcaccagagccctgggggcatcagcagcgaggaggaggaggaggaggaggaggagatgctgatcagcgaggaggagatccccttcaaggatgaccccagagatgagacctacaagccccacctggagcgggagacccccaagcccaggaggaagagcggcaaggtgaaggaggagaaggagaagaaggagatcaaggtggaggtggaggtggaggtgaaggaggaggagaatgagatcagagaagatgaggagccccccaggaagagaggaagaagaaggaaggatgacaagagcccccggctgcccaagaggaggaagaagccacccatccagtatgtgcgctgtgagatggagggctgcggcaccgtgctggcccacccccgctacctgcagcaccacatcaagtaccagcacctgctgaagaagaagtatgtgtgcccccaccccagctgtggccgcctcttccggctgcagaagcagctgctgcggcatgccaagcaccacacagaccagagggactacatctgtgagtactgtgcccgggccttcaagagcagccacaacctggccgtgcacaggatgatccacactggagagaagcccctgcagtgtgagatctgtggcttcacctgccggcagaaggccagcctgaactggcacatgaagaagcatgatgctgacagcttctaccagttcagctgcaacatctgtgggaagaagtttgagaagaaggacagcgtggtggcccacaaggccaagagccaccctgaggtgctgattgctgaggccctggccgccaatgctggggccctgatcaccagcacagacatcctgggcaccaaccctgagagcctgacccagcccagtgatggccagggcctgcccctgctgcctgagcccctgggcaacagcaccagcggggagtgcctgctgctggaggccgagggcatgagcaagagctactgcagcggcacagagcgggcccggcacaggtag

SEQ ID NO: 18537 - DNA, 1464 bp, Artificial Sequence
  Description of Artificial Sequence: Synthetic coding sequence
atggctgctgctgccctgcgggcccccacccaggtgacagtgtccccagagacccacatggacctgaccaagggctgtgtgacctttgaggacatcgccatctacttcagccaggatgagtggggcctgctggatgaggcccagaggctgctgtacctggaggtgatgctggagaactttgccctggtggccagcctgggctgcggccacggcacagaagatgaggagacccccagcgaccagaatgtgtctgtgggcgtgtcccagagcaaggccggcagcagcacccagaagacccagagctgtgagatgtgtgtgcctgtgctgaaggacatcctgcacctggccgacctgcccggccagaagccctacctggtgggggagtgcaccaaccaccaccagcaccagaagcaccacagcgccaagaagagcctgaagagggacatggaccgggccagctatgtgaagtgctgcctcttctgcatgagcctgaagcccttcaggaagtgggaggtgggcaaggacctgcctgccatgctgcggctgctgcggagcctggtgtttcctgggggcaagaagccaggcaccatcacagaatgtggggaggacatccgcagccagaagagccactacaagtctggagaatgtgggaaggccagccgccacaagcacacccctgtgtaccacccccgggtgtacaccgggaagaagctgtatgagtgcagcaaatgtgggaaggccttccggggcaagtacagcctggtgcagcaccagagggtgcacactggagagcggccctgggagtgcaatgaatgtgggaagttcttcagccagaccagccacctgaatgaccaccggcgcatccacactggagagcggccctatgagtgcagtgaatgtgggaagctgttccggcagaacagcagcctggtggaccaccagaagatccacactggagcccggccctatgagtgcagccagtgtgggaagagcttcagccagaaggccaccctggtgaagcaccagagggtgcacactggagagcggccctacaagtgtggagaatgtggcaacagcttcagccagagcgccatcctgaaccagcaccggcgcatccacactggagccaagccctatgaatgtggccagtgtgggaagagcttcagccagaaggccaccctcatcaagcaccagagggtgcacactggagagcggccctacaagtgtggggactgtgggaagagcttcagccagagcagcatcctgatccagcaccggcgcatccacactggagcccggccctatgaatgtggccagtgtgggaagagcttcagccagaagagcggcctcatccagcaccaggtggtgcacactggagagcggccctatgagtgcaacaagtgtggcaacagcttcagccagtgcagcagcctcatccaccaccagaagtgccacaacacctag

SEQ ID NO: 18538 - DNA, 1317 bp, Artificial Sequence
  Description of Artificial Sequence: Synthetic coding sequence
atggacctgaccaagggctgtgtgacctttgaagatattgccatctacttcagccaggatgagtggggcctgctggatgaggcccagaggctgctgtacctggaggtgatgctggagaactttgccctggtggccagcctgggctgcggccatggaacagaagatgaggagacccccagcgaccagaatgtgtctgtgggcgtgtcccagagcaaggccggcagcagcacccagaagacccagagctgtgagatgtgtgtgcctgtgctgaaggacatcctgcacctggccgacctgcccggccagaagccctacctggtgggagaatgtaccaaccaccaccagcaccagaagcaccacagcgccaagaagagcctgaagagggacatggaccgggccagctatgtgaagtgctgcctcttctgcatgagcctgaagcccttcaggaagtgggaggtgggcaaggacctgcctgccatgctgcggctgctgcggagcctggtgtttcctgggggcaagaagccaggcaccatcacagaatgtggggaggacatccgcagccagaagagccactacaagagcggggagtgtgggaaggccagccgccacaagcacacccctgtgtaccacccccgggtgtacacaggcaagaagctgtatgaatgttccaaatgtgggaaggccttccggggcaagtacagcctggtgcagcaccagagggtgcacactggagagcggccctgggagtgcaatgaatgtgggaagttcttcagccagaccagccacctgaatgaccaccggcgcatccacactggagagcggccctatgaatgttcccagtgtgggaagagcttcagccagaaggccaccctggtgaagcaccagagggtgcacactggagagcggccctacaagtgtggggagtgtggcaacagcttcagccagagcgccatcctgaaccagcaccggcgcatccacactggagccaagccctatgaatgtggccagtgtgggaagagcttcagccagaaggccaccctcatcaagcaccagagggtgcacactggagagcggccctacaagtgtggggactgtgggaagagcttcagccagagcagcatcctgatccagcaccggcgcatccacactggagcccggccctatgaatgtggccagtgtgggaagagcttcagccagaagagcggcctcatccagcaccaggtggtgcacactggagagcggccctatgagtgcaacaagtgtggcaacagcttcagccagtgcagcagcctcatccaccaccagaagtgccactag

SEQ ID NO: 18539 - DNA, 1425 bp, Artificial Sequence
  Description of Artificial Sequence: Synthetic coding sequence
atggctgctgctgccctgcgggcccccacccagggctgtgtgacctttgaagatattgccatctacttcagccaggatgagtggggcctgctggatgaggcccagaggctgctgtacctggaggtgatgctggagaactttgccctggtggccagcctgggctgcggccatggaacagaagatgaggagacccccagcgaccagaatgtgtctgtgggcgtgtcccagagcaaggccggcagcagcacccagaagacccagagctgtgagatgtgtgtgcctgtgctgaaggacatcctgcacctggccgacctgcccggccagaagccctacctggtgggagaatgtaccaaccaccaccagcaccagaagcaccacagcgccaagaagagcctgaagagggacatggaccgggccagctatgtgaagtgctgcctcttctgcatgagcctgaagcccttcaggaagtgggaggtgggcaaggacctgcctgccatgctgcggctgctgcggagcctggtgtttcctgggggcaagaagccaggcaccatcacagaatgtggggaggacatccgcagccagaagagccactacaagagcggggagtgtgggaaggccagccgccacaagcacacccctgtgtaccacccccgggtgtacacaggcaagaagctgtatgaatgttccaaatgtgggaaggccttccggggcaagtacagcctggtgcagcaccagagggtgcacactggagagcggccctgggagtgcaatgaatgtgggaagttcttcagccagaccagccacctgaatgaccaccggcgcatccacactggagagcggccctatgaatgttctgaatgtgggaagctgttccggcagaacagcagcctggtggaccaccagaagatccacactggagcccggccctatgaatgttcccagtgtgggaagagcttcagccagaaggccaccctggtgaagcaccagagggtgcacactggagagcggccctacaagtgtggggagtgtggcaacagcttcagccagagcgccatcctgaaccagcaccggcgcatccacactggagccaagccctatgaatgtggccagtgtgggaagagcttcagccagaaggccaccctcatcaagcaccagagggtgcacactggagagcggccctacaagtgtggggactgtgggaagagcttcagccagagcagcatcctgatccagcaccggcgcatccacactggagcccggccctatgaatgtggccagtgtgggaagagcttcagccagaagagcggcctcatccagcaccaggtggtgcacactggagagcggccctatgagtgcaacaagtgtggcaacagcttcagccagtgcagcagcctcatccaccaccagaagtgccacaacacctag

SEQ ID NO: 18540 - DNA, 1464 bp, Artificial Sequence; identical to SEQ ID NO: 18537
  Description of Artificial Sequence: Synthetic coding sequence

SEQ ID NO: 18541 - DNA, 1692 bp, Artificial Sequence
  Description of Artificial Sequence: Synthetic coding sequence
atgatgacagctgagagccgggaggccaccggcctgagcccccaggccgcccaggagaaggatggcatcgtgattgtgaaggtggaggaggaggatgaggaggaccacatgtggggccaggacagcaccctgcaggacaccccacctccagaccctgagatcttccggcagcgcttccgccgcttctgctaccagaacaccttcggcccccgggaggccctgagccggctgaaggagctgtgccaccagtggctgcggcctgagatcaacaccaaggagcagatcctggagctgctggtgctggagcagttcctgagcatcctgcccaaggagctgcaggtgtggctgcaggagtacagaccagattctggagaggaggccgtgaccctgctggaggacctggagctggacctgagcggccagcaggtgcccggccaggtgcacggccctgagatgctggcccggggcatggtgcccctggaccctgtgcaggagagcagcagctttgacctgcaccacgaggccacccagagccacttcaagcacagcagcaggaagccccggctgctgcagagccgggccctgcctgctgcccacatcccagcccctcctcatgagggcagcccccgggaccaggccatggccagcgccctcttcaccgctgacagccaggccatggtgaagattgaggacatggctgtgtccctcatcctggaggagtggggctgccagaacctggcccggaggaacctgagccgggacaaccggcaggagaactacggcagcgccttcccccagggcggagaaaatagaaatgaaaatgaggagagcaccagcaaggccgagaccagtgaagattctgccagcagaggagagaccaccggccgcagccagaaggagtttggagagaagagggaccaggagggcaagacaggagagcggcagcagaagaaccctgaggagaagaccaggaaggagaagagggacagcggccctgccatcggcaaggacaagaagaccatcaccggggagcggggcccccgggagaagggcaagggcctgggccgctccttcagcctgagcagcaacttcaccaccccagaggaggtgcccaccggcaccaagagccaccgctgtgatgaatgtgggaagtgcttcaccaggagcagcagcctcatccgccacaagatcatccacactggagagaagccctatgagtgcagtgaatgtgggaaggccttcagcctgaacagcaacctggtgctgcaccagaggatccacactggagagaagccccatgagtgcaatgaatgtgggaaggccttcagccacagcagcaacctgatcctgcaccagaggatccacagcggggagaagccctatgagtgcaatgaatgtgggaaggccttcagccagagcagtgacctgaccaagcaccagaggatccacactggagagaagccctatgagtgcagtgaatgtgggaaggccttcaacagaaacagctacctgatcctgcaccggcgcatccacacccgggagaagccctacaagtgcaccaagtgtgggaaggccttcaccaggagcagcaccctgaccctgcaccaccgcatccacgcccgggagcgggccagcgagtacagccctgccagcctggatgcctttggagccttcctgaagagctgtgtgtag

SEQ ID NO: 18542 - DNA, 1584 bp, Artificial Sequence
  Description of Artificial Sequence: Synthetic coding sequence
atgtggggccaggacagcaccctgcaggacaccccacctccagaccctgagatcttccggcagcgcttccgccgcttctgctaccagaacaccttcggcccccgggaggccctgagccggctgaaggagctgtgccaccagtggctgcggcctgagatcaacaccaaggagcagatcctggagctgctggtgctggagcagttcctgagcatcctgcccaaggagctgcaggtgtggctgcaggagtacagaccagattctggagaggaggccgtgaccctgctggaggacctggagctggacctgagcggccagcaggtgcccggccaggtgcacggccctgagatgctggcccggggcatggtgcccctggaccctgtgcaggagagcagcagctttgacctgcaccacgaggccacccagagccacttcaagcacagcagcaggaagccccggctgctgcagagccgggccctgcctgctgcccacatcccagcccctcctcatgagggcagcccccgggaccaggccatggccagcgccctcttcaccgctgacagccaggccatggtgaagattgaggacatggctgtgtccctcatcctggaggagtggggctgccagaacctggcccggaggaacctgagccgggacaaccggcaggagaactacggcagcgccttcccccagggcggagaaaatagaaatgaaaatgaggagagcaccagcaaggccgagaccagtgaagattctgccagcagaggagagaccaccggccgcagccagaaggagtttggagagaagagggaccaggagggcaagacaggagagcggcagcagaagaaccctgaggagaagaccaggaaggagaagagggacagcggccctgccatcggcaaggacaagaagaccatcaccggggagcggggcccccgggagaagggcaagggcctgggccgctccttcagcctgagcagcaacttcaccaccccagaggaggtgcccaccggcaccaagagccaccgctgtgatgaatgtgggaagtgcttcaccaggagcagcagcctcatccgccacaagatcatccacactggagagaagccctatgagtgcagtgaatgtgggaaggccttcagcctgaacagcaacctggtgctgcaccagaggatccacactggagagaagccccatgagtgcaatgaatgtgggaaggccttcagccacagcagcaacctgatcctgcaccagaggatccacagcggggagaagccctatgagtgcaatgaatgtgggaaggccttcagccagagcagtgacctgaccaagcaccagaggatccacactggagagaagccctatgagtgcagtgaatgtgggaaggccttcaacagaaacagctacctgatcctgcaccggcgcatccacacccgggagaagccctacaagtgcaccaagtgtgggaaggccttcaccaggagcagcaccctgaccctgcaccaccgcatccacgcccgggagcgggccagcgagtacagccctgccagcctggatgcctttggagccttcctgaagagctgtgtgtag

SEQ ID NO: 18543 - DNA, 378 bp, Artificial Sequence
  Description of Artificial Sequence: Synthetic coding sequence
atgatgacagctgagagccgggaggccaccggcctgagcccccaggccgcccaggagaaggatggcatcgtgattgtgaaggtggaggaggaggatgaggaggaccacatgtggggccaggacagcaccctgcaggacaccccacctccagaccctgagatcttccggcagcgcttccgccgcttctgctaccagaacaccttcggcccccgggaggccctgagccggctgaaggagctgtgccaccagtggctgcggcctgagatcaacaccaaggagcagatcctggagctgctggtgctggagcagttcctgagcatcctgcccaaggagctgcaggtgtggctgcaggagtacagaccagattctggagagtag

SEQ ID NO: 18544 - DNA, 1053 bp, Artificial Sequence
  Description of Artificial Sequence: Synthetic coding sequence
atggccagcgccctcttcaccgctgacagccaggccatggtgaagattgaggacatggctgtgtccctcatcctggaggagtggggctgccagaacctggcccggaggaacctgagccgggacaaccggcaggagaactacggcagcgccttcccccagggcggggagaacagaaatgaaaatgaggagagcaccagcaaggccgagaccagcgaggacagcgccagcagaggagagaccaccggccgcagccagaaggagtttggagagaagagggaccaggagggcaagacaggagagcggcagcagaagaaccctgaggagaagaccaggaaggagaagagggacagcggccctgccatcggcaaggacaagaagaccatcactggagagcggggcccccgggagaagggcaagggcctgggccgctccttcagcctgagcagcaacttcaccaccccagaggaggtgcccaccggcaccaagagccaccgctgtgatgaatgtgggaagtgcttcaccaggagcagcagcctcatccgccacaagatcatccacactggagagaagccctatgaatgttctgaatgtgggaaggccttcagcctgaacagcaacctggtgctgcaccagaggatccacactggagagaagccccatgaatgtaatgaatgtgggaaggccttcagccacagcagcaacctgatcctgcaccagaggatccacagcggggagaagccctatgaatgtaatgaatgtgggaaggccttcagccagagcagtgacctgaccaagcaccagaggatccacactggagagaagccctatgaatgttctgaatgtgggaaggccttcaacagaaattcctacctgatcctgcaccggcgcatccacacccgggagaagccctacaagtgcaccaagtgtgggaaggccttcaccaggagcagcaccctgaccctgcaccaccgcatccacgcccgggagcgggccagcgagtacagccctgccagcctggatgccttcggggccttcctgaagagctgtgtgtag

SEQ ID NO: 18545 - DNA, 2904 bp, Artificial Sequence
  Description of Artificial Sequence: Synthetic coding sequence
atggctgtggccctggacagccagattgatgcccccctggaggtggagggctgcctgatcatgaaggtggagaaggaccctgagtgggccagcgagcccatcctggagggcagtgacagcagcgagaccttcaggaagtgcttccggcagttctgctatgaagatgtgacaggcccccatgaggccttcagcaagctgtgggagctgtgctgccgctggctgaagccagagatgaggagcaaggagcagatcctggagctgctggtgattgagcagttcctgaccatcctgcctgagaagatccaggcctgggcccagaagcagtgcccccagagcggggaggaggccgtggccctggtggtgcacctggagaaggagaccggccgcctgcggcagcaggtgagcagccctgtgcaccgggagaagcacagccccctgggcgccgcctgggaggtggccgacttccagcctgagcaggtggagacccagcccagggctgtgtcccgggaggagcccggcagcctgcacagcggccaccaggagcagctgaacaggaagcgggagcggcggcccctgcccaagaatgcccggcccagcccctgggtgcctgccctggctgatgagtggaacaccctggaccaggaggtgaccaccacccggctgcctgctggcagccaggagcctgtgaaggatgtgcacgtggcccggggcttctcctacaggaagtctgtgcaccagatcccagcccagagggacctgtacagagacttcagaaaagaaaatgtgggcaatgtggtgtccctgggcagcgctgtgtccaccagcaacaagatcacccggctggagcagaggaaggagccctggaccctgggcctgcacagcagcaacaagaggagcatcctgcggagcaactacgtgaaggagaagtctgtgcacgccatccaggtgcctgcccggtctgctgggaagacctggagggagcagcagcagtggggcctggaggatgagaagattgctggggtgcactggagctatgaggagaccaagaccttcctggccatcctgaaggagagccgcttctatgagaccctgcaggcctgccccaggaacagccaggtgtatggagctgtggccgagtggctgagagaatgtggcttcctgcggaccccagagcagtgcaggaccaagttcaagagcctgcagaagagctacaggaaggtgagaaatggccacatgctggagccctgtgccttctttgaggacatggatgccctgctgaacccagctgcccgggcccccagcacagacaagcccaaggagatgatccctgtgccccggctgaagagaattgccatcagcgccaaggagcacatcagcctggtggaggaggaggaggccgctgaggacagtgatgatgatgaaattggaattgagttcatcaggaagtctgagatccacggggcccctgtgctcttccagaacctgagcggcgtgcactggggctatgaggagaccaagaccttcctggacatcctgcgggagacccgcttctatgaggccctgcaggcctgccacaggaagagcaagctgtatggagctgtggccgagcagctgcgggagtgtggcttcctgcggaccccagagcagtgcaggaccaagttcaagagcctgcagaagagctacaggaaggtgaagaatggccacgtgctggagagctgtgccttctacaaggagatggatgccctgatcaacagccgggccagcgcccccagccccagcaccccagaggaggtgcccagccccagccggcaggagcggggcggcatcgaggtggagccccaggagcccaccggctgggagcctgaggagaccagccaggaggccgtgattgaggacagctgcagcgagaggatgtctgaggaggagatcgtgcaggagcctgagttccagggccccccaggcctgctgcagagccccaatgactttgagatcggcagcagcatcaaggaggaccccacccagatcgtgtacaaggacatggagcagcaccgggccctgattgagaagagcaagagggtggtgtcccagagcacagaccccagcaagtacaggaagcgggagtgcatcagcggccggcagtgggagaacctgcagggcatccggcagggcaagcccatgagccagccccgggacctgggcaaggctgtggtgcaccagaggccctttgtgggcaagaggccctaccgcctgctgaagtatggagagagctttggccgcagcacccggctgatgtgcaggatgacccaccacaaggagaacccctacaagtgtggggtgtgtgggaagtgcttcggccgcagccgcagcctcatccgccaccagaggatccacactggagagaagcccttcaagtgcctggactgtgggaagagcttcaatgacagcagcaactttggagcccaccagaggatccacactggagagaagccctaccgctgtggagaatgtgggaagtgcttcagccagagcagcagcctcatcatccaccagaggacccacactggagagaagccctaccagtgtggagaatgtgggaagagcttcaccaacagcagccacttcagcgcccaccggcgggtgcacactggagagaacccctacaagtgtgtggactgtgagaagagcttcaacaactgcacccgcttccgggagcaccggcgcatccacactggagagaagccctacggctgtgcccagtgtgggaagcgcttcagcaagagctctgtgctgaccaagcaccgggaggtgcacgtgcgggagaagcccctgccccacccccccagcctgtactgcccagagaacccccacaagggcaagacagatgagttcaggaagaccttctag

SEQ ID NO: 18546 - DNA, 2511 bp, Artificial Sequence
  Description of Artificial Sequence: Synthetic coding sequence
atggctgtggccctggacagccagattgatgcccccctggaggtggagggctgcctgatcatgaaggtggagaaggaccctgagtgggccagcgagcccatcctggagggcagtgacagcagcgagaccttcaggaagtgcttccggcagttctgctatgaagatgtgacaggcccccatgaggccttcagcaagctgtgggagctgtgctgccgctggctgaagccagagatgaggagcaaggagcagatcctggagctgctggtgattgagcagttcctgaccatcctgcctgagaagatccaggcctgggcccagaagcagtgcccccagagcggggaggaggccgtggccctggtggtgcacctggagaaggagaccggccgcctgcggcagcaggtgagcagccctgtgcaccgggagaagcacagccccctgggcgccgcctgggaggtggccgacttccagcctgagcaggtggagacccagcccagggctgtgtcccgggaggagcccggcagcctgcacagcggccaccaggagcagctgaacaggaagcgggagcggcggcccctgcccaagaatgcccggcccagcccctgggtgcctgccctggctgatgagtggaacaccctggaccaggaggtgaccaccacccggctgcctgctggcagccaggagcctgtgaaggatgtgcacgtggcccggggcttctcctacaggaagtctgtgcaccagatcccagcccagagggacctgtacagagacttcagaaaagaaaatgtgggcaatgtggtgtccctgggcagcgctgtgtccaccagcaacaagatcacccggctggagcagaggaaggagccctggaccctgggcctgcacagcagcaacaagaggagcatcctgcggagcaactacgtgaaggagaagtctgtgcacgccatccaggtgcctgcccggtctgctgggaagacctggagggagcagcagcagtggggcctggaggatgagaagattgctggggtgcactggagctatgaggagaccaagaccttcctggccatcctgaaggagagccgcttctatgagaccctgcaggcctgccccaggaacagccaggtgtatggagctgtggccgagtggctgagagaatgtggcttcctgcggaccccagagcagtgcaggaccaagttcaagagcctgcagaagagctacaggaaggtgagaaatggccacatgctggagccctgtgccttctttgaggacatggatgccctgctgaacccagctgcccgggcccccagcacagacaagcccaaggagatgatccctgtgccccggctgaagagaattgccatcagcgccaaggagcacatcagcctggtggaggaggaggaggccgctgaggacagtgatgatgatgaaattggaattgagttcatcaggaagtctgagatccacggggcccctgtgctcttccagaacctgagcggcgtgcactggggctatgaggagaccaagaccttcctggacatcctgcgggagacccgcttctatgaggccctgcaggcctgccacaggaagagcaagctgtatggagctgtggccgagcagctgcgggagtgtggcttcctgcggaccccagagcagtgcaggaccaagttcaagagcctgcagaagagctacaggaaggtgaagaatggccacgtgctggagagctgtgccttctacaaggagatggatgccctgatcaacagccgggccagcgcccccagccccagcaccccagaggaggtgcccagccccagccggcaggagcggggcggcatcgaggtggagccccaggagcccaccggctgggagcctgaggagaccagccaggaggccgtgattgaggacagctgcagcgagaggatgtctgaggaggagatcgtgcaggagcctgagttccagggccccccaggcctgctgcagagccccaatgactttgagatcggcagcagcatcaaggaggaccccacccagatcgtgtacaaggacatggagcagcaccgggccctgattgagaagagcaagagggtggtgtcccagagcacagaccccagcaagtacaggaagcgggagtgcatcagcggccggcagtgggagaacctgcagggcatccggcagggcaagcccatgagccagccccgggacctgggcaaggctgtggtgcaccagaggccctttgtgggcaagaggccctaccgcctgctgaagtatggagagagctttggccgcagcacccggctgatgtgcaggatgacccaccacaaggagaacccctacaagtgtggggtgtgtgggaagtgcttcggccgcagccgcagcctcatccgccaccagaggatccacactggagagaagcccttcaagtgcctggactgtgggaagagcttcaatgacagcagcaactttggagcccaccagaggatccacactggagagaagcccagcatctctgtgctgccctag

SEQ ID NO: 18547 - DNA, 2520 bp, Artificial Sequence
  Description of Artificial Sequence: Synthetic coding sequence
atgatcatgacagagagccgggaggtgattgacctggaccccccagctgagaccagccaggagcaggaggacctcttcatcgtgaaggtggaggaggaggactgcacctggatgcaggagtacaacccccccacctttgagaccttctaccagcgcttccgccacttccagtaccacgaggccagcggcccccgggaggccctgagccagctgcgggtgctgtgctgtgagtggctgcggcctgagctgcacaccaaggagcagatcctggagctgctggtgctggagcagttcctgaccatcctgcctgaggagttccagccctgggtgcgggagcaccaccctgagagcggggaggaggccgtggccgtgattgagaacatccagcgggagctggaggagcggcggcagcagatcgtggcctgcccagatgtgctgcccaggaagatggccaccccaggagctgtgcaggagagctgcagcccccaccccctgactgtggacacccagcctgagcaggccccccagaagccccggctgctggaggagaatgccctgcctgtgctgcaggtgcccagcctgcccctgaaggacagccaggagctgacagccagcctgctgagcacaggcagccagaagctggtgaagattgaggaggtggctgatgtggccgtgtccttcatcctggaggagtggggccacctggaccagagccagaagagcctgtacagagatgacagaaaagaaaattatggcagcatcacctccatgggctatgagagccgggacaacatggagctgattgtgaagcagatcagtgatgacagcgagagccactgggtggcccctgagcacacagagaggtctgtgccccaggaccctgactttgctgaggtgtctgacctgaagggcatggtgcagcgctggcaggtgaaccccaccgtgggcaagagccggcagaaccccagccagaagagggacctggatgccatcacagacatcagccccaagcagagcacccatggagagcggggccaccgctgcagcgactgtgggaagttcttcctgcaggccagcaacttcatccagcaccggcgcatccacactggagagaagcccttcaagtgtggggagtgtgggaagagctacaaccagagggtgcacctgacccagcaccagagggtgcacactggagagaagccctacaagtgccaggtgtgtgggaaggccttccgggtgagcagccacctggtgcagcaccacagcgtgcacagcggggagcggccctacggctgcaatgaatgtgggaagaactttggccgccacagccacctgattgagcacctgaagaggcacttccgggagaagagccagcgctgcagcgacaagaggagcaagaacaccaagctgtctgtgaagaagaagatcagcgagtacagcgaggccgacatggagctgagcggcaagacccagagaaatgtgtcccaggtgcaggactttggagagggctgtgagttccagggcaagctggacaggaagcagggcatccccatgaaggagatcctgggccagcccagcagcaagaggatgaactacagcgaggtgccctacgtgcacaagaagagcagcactggagagcggccccacaagtgcaatgaatgtgggaagagcttcatccagagcgcccacctgatccagcaccagaggatccacactggagagaagcccttccgctgtgaagaatgtgggaagagctacaaccagagggtgcacctgacccagcaccagagggtgcacactggagagaagccctacacctgccccctgtgtgggaaggccttccgggtgcgcagccacctggtgcagcaccagagcgtgcacagcggggagcggcccttcaagtgcaatgaatgtgggaagggcttcggccgccgcagccacctggccggccacctgcggctgcacagccgggagaagagccaccagtgcagagaatgtggggagatcttcttccagtatgtgtccctgattgagcaccaggtgctgcacatgggccagaagaatgagaagaatggcatctgtgaggaggcctacagctggaacctgactgtgattgaggacaagaagattgagctgcaggagcagccctaccagtgtgacatctgtgggaaggccttcggctacagcagtgacctgatccagcactaccgcacccacacagctgagaagccctaccagtgtgacatctgccgggagaatgtgggccagtgcagccacaccaagcagcaccagaagatctacagcagcaccaagagccaccagtgccatgaatgtggccggggcttcaccctgaagagccacctgaaccagcaccagaggatccacactggagagaagcccttccagtgcaaggaatgtggcatgaacttctcctggagctgcagcctcttcaagcacctgcggagccatgagaggacagaccccatcaacaccctgtctgtggagggcagcctgctgtag

SEQ ID NO: 18548 - DNA, 2520 bp, Artificial Sequence; identical to SEQ ID NO: 18547
  Description of Artificial Sequence: Synthetic coding sequence

SEQ ID NO: 18549 - DNA, 291 bp, Artificial Sequence
  Description of Artificial Sequence: Synthetic coding sequence
ttccgccacttccagtaccacgaggccagcggcccccgggaggccctgagccagctgcgggtgctgtgctgtgagtggctgcggcctgagctgcacaccaaggagcagatcctggagctgctggtgctggagcagttcctgaccatcctgcctgaggagttccagccctgggtgcgggagcaccaccctgagagcggggaggaggccgtggccgtgattgagaacatccagcgggagctggaggagcggcggcagcaggtgtcccgggcccagtggctgaccctggtgtag

SEQ ID NO: 18550 - DNA, 2520 bp, Artificial Sequence; identical to SEQ ID NO: 18547
  Description of Artificial Sequence: Synthetic coding sequence

SEQ ID NO: 18551 - DNA, 2301 bp, Artificial Sequence
  Description of Artificial Sequence: Synthetic coding sequence
atgatcatgacagagagccgggaggtgattgacctggaccccccagctgagaccagccaggagcaggaggacctcttcatcgtgaaggtggaggaggaggactgcacctggatgcaggagtacaacccccccacctttgagaccttctaccagcgcttccgccacttccagtaccacgaggccagcggcccccgggaggccctgagccagctgcgggtgctgtgctgtgagtggctgcggcctgagctgcacaccaaggagcagatcctggagctgctggtgctggagcagttcctgaccatcctgcctgaggagttccagccctgggtgcgggagcaccaccctgagagcggggaggaggccgtggccgtgattgagaacatccagcgggagctggaggagcggcggcagcagatcgtggcctgcccagatgtgctgcccaggaagatggccaccccaggagctgtgcaggagagctgcagcccccaccccctgactgtggacacccagcctgagcaggccccccagaagccccggctgctggaggagaatgccctgcctgtgctgcaggtgcccagcctgcccctgaaggacagccaggagctgacagccagcctgctgagcacaggcagccagaagctggtgaagattgaggaggtggctgatgtggccgtgtccttcatcctggaggagtggggccacctggaccagagccagaagagcctgtacagagatgacagaaaagaaaattatggcagcatcacctccatgggctatgagagccgggacaacatggagctgattgtgaagcagatcagtgatgacagcgagagccactgggtggcccctgagcacacagagaggtctgtgccccaggaccctgactttgctgaggtgtctgacctgaagggcatggtgcagcgctggcaggtgaaccccaccgtgggcaagagccggcagaaccccagccagaagagggacctggatgccatcacagacatcagccccaagcagagcacccatggagagcggggccaccgctgcagcgactgtgggaagttcttcctgcaggccagcaacttcatccagcaccggcgcatccacactggagagaagcccttcaagtgtggggagtgtgggaagagctacaaccagagggtgcacctgacccagcaccagagggtgcacactggagagaagccctacaagtgccaggtgtgtgggaaggccttccgggtgagcagccacctggtgcagcaccacagcgtgcacagcggggagcggccctacggctgcaatgaatgtgggaagaactttggccgccacagccacctgattgagcacctgaagaggcacttccgggagaagagccagcgctgcagcgacaagaggagcaagaacaccaagctgtctgtgaagaagaagatcagcgagtacagcgaggccgacatggagctgagcggcaagacccagagaaatgtgtcccaggtgcaggactttggagagggctgtgagttccagggcaagctggacaggaagcagggcatccccatgaaggagatcctgggccagcccagcagcaagaggatgaactacagcgaggtgccctacgtgcacaagaagagcagcactggagagcggccccacaagtgcaatgaatgtgggaagagcttcatccagagcgcccacctgatccagcaccagaggatccacactggagagaagcccttccgctgtgaagaatgtgggaagagctacaaccagagggtgcacctgacccagcaccagagggtgcacactggagagaagccctacacctgccccctgtgtgggaaggccttccgggtgcgcagccacctggtgcagcaccagagcgtgcacagcggggagcggcccttcaagtgcaatgaatgtgggaagggcttcggccgccgcagccacctggccggccacctgcggctgcacagccgggagaagagccaccagtgcagagaatgtggggagatcttcttccagtatgtgtccctgattgagcaccaggtgctgcacatgggccagaagaatgagaagaatggcatctgtgaggaggcctacagctggaacctgactgtgattgaggacaagaagattgagctgcaggagcagccctaccagtgtgacatctgtgggaaggccttcggctacagcagtgacctgatccagcactaccgcacccacacagctgagaagccctaccagtgtgacatctgccgggtggtgatctacaggatgtccttcagcctgcactgctcctgggactag

SEQ ID NO: 18552 - DNA, 1446 bp, Artificial Sequence
  Description of Artificial Sequence: Synthetic coding sequence
atgaggggcctgcccaggaagcgggaggcctggacccagccccaccccctggaggccctgtatgagagcctgcgggtgctggagaaggacaccagcgccaccagccagagcgtgaatggcagcccccaggccgagcagcccagcctggagagcaccagcaaggaggccttcttcagccgggtggagaccttcagcagcctgaagtgggccggcaagccctttgagctgagccccctggtgtgtgccaagtatggctgggtgacagtggagtgtgacatgctgaagtgcagcagctgccaggccttcctgtgtgccagcctgcagcctgcctttgattttgaccgctacaagcagagatgtgccgagctgaagaaggccctgtgcacagcccacgagaagttctgcttctggccagacagccccagcccagaccgcttcggcatgctgcccctggatgagcccgccatcctggtgtctgagttcctggaccgcttccagagcctgtgccacctggacctgcagctgcccagcctgcggcctgaggacctgaagaccatgtgcctgacagaggacaagatcagcctgctgctgcacctgctggaggatgagctggaccacaggacagatgagaggaagaccaccatcaagctgggcagtgacatccaggtgcacgtgacagcctgcatcctgtctgtgtgtggctgggcctgcagcagcagcctggagagcatgcagctgagcctcatcacctgcagccagtgcatgaggaaggtgggcctgtggggcttccagcagatcgagagctccatgacagacctggatgccagctttggcctgaccagcagccccatccctggcctggagggccggcctgagcggctgcccctggtgcctgagagccccaggaggatgatgaccaggagccaggatgccaccttcagccctggcagcgagcaggccgagaagagccctggccccatcgtgtccaggaccaggtcctgggacagcagcagccctgtggacaggcctgagcctgaggccgccagccccaccaccaggaccaggcctgtgaccaggtccatgggcactggagacaccccaggcctggaggtgcccagcagccccctgaggaaggccaagagggcccggctgtgcagcagcagcagcagtgacaccagcagccgctccttctttgaccccaccagccagcaccgggactggtgcccctgggtgaacatcaccctgggcaaggagagcagagaaaatggaggaacagagccagatgccagcgccccagctgagcccggctggaaggctgtgctgaccatcctgctggcccacaagcagagcagccagcctgctgagacagacagcatgagcctgtctgagaagagcaggaaggtgttccgcatcttccggcagtgggagagcctgtgcagctgctag

SEQ ID NO: 18553 - DNA, 1509 bp, Artificial Sequence
  Description of Artificial Sequence: Synthetic coding sequence
atggccgccccctgtgagggccaggcctttgctgtgggcgtggagaagaactggggcgctgtggtgcgcagccctgagggcaccccccagaagatccggcagctgattgatgagggcatcgcccctgaggagggcggcgtggatgccaaggacaccagcgccaccagccagagcgtgaatggcagcccccaggccgagcagcccagcctggagagcaccagcaaggaggccttcttcagccgggtggagaccttcagcagcctgaagtgggccggcaagccctttgagctgagccccctggtgtgtgccaagtatggctgggtgacagtggagtgtgacatgctgaagtgcagcagctgccaggccttcctgtgtgccagcctgcagcctgcctttgattttgaccgctacaagcagagatgtgccgagctgaagaaggccctgtgcacagcccacgagaagttctgcttctggccagacagccccagcccagacagatttggcatgctgcccctggatgagcccgccatcctggtgtctgagttcctggaccgcttccagagcctgtgccacctggacctgcagctgcccagcctgcggcctgaggacctgaagaccatgtgcctgacagaggacaagatcagcctgctgctgcacctgctggaggatgagctggaccacaggacagatgagaggaagaccaccatcaagctgggcagtgacatccaggtgcacgtgacagcctgcatcctgtctgtgtgtggctgggcctgcagcagcagcctggagagcatgcagctgagcctcatcacctgcagccagtgcatgaggaaggtgggcctgtggggcttccagcagatcgagagctccatgacagacctggatgccagctttggcctgaccagcagccccatccctggcctggagggccggcctgagcggctgcccctggtgcctgagagccccaggaggatgatgaccaggagccaggatgccaccttcagccctggcagcgagcaggccgagaagagccctggccccatcgtgtccaggaccaggtcctgggacagcagcagccctgtggacaggcctgagcctgaggccgccagccccaccaccaggaccaggcctgtgaccaggtccatgggcaccggggacaccccaggcctggaggtgcccagcagccccctgaggaaggccaagagggcccggctgtgcagcagcagcagcagtgacaccagcagccgctccttctttgaccccaccagccagcaccgggactggtgcccctgggtgaacatcaccctgggcaaggagagccgggagaatggaggaacagagccagatgccagcgccccagctgagcccggctggaaggctgtgctgaccatcctgctggcccacaagcagagcagccagcctgctgagacagacagcatgagcctgtctgagaagagcaggaaggtgttccgcatcttccggcagtgggagagcctgtgcagctgctag

SEQ ID NO: 18554 - DNA, 1296 bp, Artificial Sequence
  Description of Artificial Sequence: Synthetic coding sequence
atggccgccccctgtgagggccaggcctttgctgtgggcgtggagaagaactggggcgctgtggtgcgcagccctgagggcaccccccagaagatccggcagctgattgatgagggcatcgcccctgaggagggcggcgtggatgccaaggacaccagcgccaccagccagagcgtgaatggcagcccccaggccgagcagcccagcctggagagcaccagcaaggaggccttcttcagccgggtggagaccttcagcagcctgaagtgggccggcaagccctttgagctgagccccctggtgtgtgccaagtatggctgggtgacagtggagtgtgacatgctgaagtgcagcagctgccaggccttcctgtgtgccagcctgcagcctgcctttgattttgaccgctacaagcagagatgtgccgagctgaagaaggccctgtgcacagcccacgagaagttctgcttctggccagacagccccagcccagacagatttggcatgctgcccctggatgagcccgccatcctggtgtctgagttcctggaccgcttccagagcctgtgccacctggacctgcagctgcccagcctgcggcctgaggacctgaagaccatgtgcctgacagaggacaagatcagcctgctgctgcacctgctggaggatgagctggaccacaggacagatgagaggaagaccaccatcaagctgggcagtgacatccaggtgcacgtgacagcctgcatcctgtctgtgtgtggctgggcctgcagcagcagcctggagagcatgcagctgagcctcatcacctgcagccagtgcatgaggaaggtgggcctgtggggcttccagcagatcgagagctccatgacagacctggatgccagctttggcctgaccagcagccccatccctggcctggagggccggcctgagcggctgcccctggtgcctgagagccccaggaggatgatgaccaggagccaggatgccaccttcagccctggcagcgagcaggacaccagcagccgctccttctttgaccccaccagccagcaccgggactggtgcccctgggtgaacatcaccctgggcaaggagagcagagaaaatggaggaacagagccagatgccagcgccccagctgagcccggctggaaggctgtgctgaccatcctgctggcccacaagcagagcagccagcctgctgagacagacagcatgagcctgtctgagaagagcaggaaggtgttccgcatcttccggcagtgggagagcctgtgcagctgctag

SEQ ID NO: 18555 - DNA, 1596 bp, Artificial Sequence
  Description of Artificial Sequence: Synthetic coding sequence
atggatgaggagagcctggagagcgccctgcagacctaccgggcccagctgcagcaggtggagctggccctgggcgccggcctggacagcagcgagcaggccgacctgcggcagctgcagggcgacctgaaggagctgattgagctgacagaggccagcctggtgtctgtgaggaagagcagcctgctggccgccctggatgaggagaggcctggccggcaggaggatgctgagtaccaggccttccgggaggccatcacagaagctgtggaggccccagctgctgcccggggcagcggcagcgagaccgtgcccaaggccgaggccggccctgagagcgctgctgggggccaggaggaggaggagggggaggatgaggaggagctgagcggcaccaaggtgtctgccccctactacagctcctggggcaccctggagtaccacaatgccatggtggtgggcacagaggaggctgaagatggcagcgctggggtgcgggtgctgtacctgtaccccacccacaagagcctgaagccctgccccttcttcctggagggcaaatgtcgcttcaaggagaactgccgcttcagccacggccaggtggtgtccctggatgagctgcggcccttccaggaccctgacctgagcagcctgcaggccggcagcgcctgcctggccaagcaccaggacggcctgtggcatgctgcccgcatcacagatgtggacaatggctactacacagtgaagtttgacagcctgctgctgcgggaggccgtggtggagggagatggcatcctgccccccctgaggacagaggccacagaaagtgacagcgacagtgatggcactggagacagcagctatgcccgggtggtgggcagtgatgctgtggacagcgcccagagcagcgccctgtgccccagcctggccgtggtgggcagtgatgctgtggacagcggcacctgcagcagcgcctttgctggctgggaggtgcacacccggggcatcggcagccggctgctgaccaagatgggctatgaatttgggaagggcctgggcagacatgctgagggccgggtggagcccatccatgctgtggtgctgccccggggcaagagcctggaccagtgtgtggagaccctgcagaagcagaccagggtgggcaaggccggcaccaacaagcccccacgctgccggggccgcggggcccggcctgggggccgcccagcccccagaaatgtgtttgacttcctgaatgagaagctgcagggccaggcccctggggccctggaggccggggccgccccagctggaagaagaagcaaggacatgtaccacgccagcaagagcgccaagagggccctgagcctgcggctcttccagacagaggagaagattgaaagaacccagagggacatccgcagcatccaggaggccctggccagaaatgccggccgccacagcgtggccagcgcccagctgcaggagaagctggccggggcccagaggcagctgggccagctgcgggcccaggaggccggcctgcagcaggagcagaggaaggctgacacccacaagaagatgacagagttctag

SEQ ID NO: 18556 - DNA, 1536 bp, Artificial Sequence
  Description of Artificial Sequence: Synthetic coding sequence
atggatgaggagagcctggagagcgccctgcagacctaccgggcccagctgcagcaggtggagctggccctgggcgccggcctggacagcagcgagcaggccgacctgcggcagctgcagggcgacctgaaggagctgattgagctgacagaggccagcctggtgtctgtgaggaagagcagcctgctggccgccctggatgaggagaggcctggccggcaggaggatgctgagtaccaggccttccgggaggccatcacagaagctgtggaggccccagctgctgcccggggcagcggcagcgagaccgtgcccaaggccgaggccggccctgagagcgctgctgggggccaggaggaggaggagggggaggatgaggaggagctgagcggcaccaaggtgtctgccccctactacagctcctggggcaccctggagtaccacaatgccatggtggtgggcacagaggaggctgaagatggcagcgctggggtgcgggtgctgtacctgtaccccacccacaagagcctgaagccctgccccttcttcctggagggcaaatgtcgcttcaaggagaactgccgcttcagccacggccaggtggtgtccctggatgagctgcggcccttccaggaccctgacctgagcagcctgcaggccggcagcgcctgcctggccaagcaccaggacggcctgtggcatgctgcccgcatcacagatgtggacaatggctactacacagtgaagtttgacagcctgctgctgcgggaggccgtggtggagggagatggcatcctgccccccctgaggacagaggccacagaaagtgacagcgacagtgatggcactggagacagcagctatgcccgggtggtgggcagtgatgctgtggacagcggcacctgcagcagcgcctttgctggctgggaggtgcacacccggggcatcggcagccggctgctgaccaagatgggctatgaatttgggaagggcctgggcagacatgctgagggccgggtggagcccatccatgctgtggtgctgccccggggcaagagcctggaccagtgtgtggagaccctgcagaagcagaccagggtgggcaaggccggcaccaacaagcccccacgctgccggggccgcggggcccggcctgggggccgcccagcccccagaaatgtgtttgacttcctgaatgagaagctgcagggccaggcccctggggccctggaggccggggccgccccagctggaagaagaagcaaggacatgtaccacgccagcaagagcgccaagagggccctgagcctgcggctcttccagacagaggagaagattgaaagaacccagagggacatccgcagcatccaggaggccctggccagaaatgccggccgccacagcgtggccagcgcccagctgcaggagaagctggccggggcccagaggcagctgggccagctgcgggcccaggaggccggcctgcagcaggagcagaggaaggctgacacccacaagaagatgacagagttctag

SEQ ID NO: 18557 - DNA, 1509 bp, Artificial Sequence
  Description of Artificial Sequence: Synthetic coding sequence
atggatgaggagagcctggagagcgccctgcagacctaccgggcccagctgcagcaggtggagctggccctgggcgccggcctggacagcagcgagcaggccgacctgcggcagctgcagggcgacctgaaggagctgattgagctgacagaggccagcctggtgtctgtgaggaagagcagcctgctggccgccctggatgaggagaggcctggccggcaggaggatgctgagtaccaggccttccgggaggccatcacagaagctgtggaggccccagctgctgcccggggcagcggcagcgagaccgtgcccaaggccgaggccggccctgagagcgctgctgggggccaggaggaggaggagggggaggatgaggaggagctgagcggcaccaaggtgtctgccccctactacagctcctggggcaccctggagtaccacaatgccatggtggtgggcacagaggaggctgaagatggcagcgctggggtgcgggtgctgtacctgtaccccacccacaagagcctgaagccctgccccttcttcctggagggcaaatgtcgcttcaaggagaactgccgcttcagccacggccaggtggtgtccctggatgagctgcggcccttccaggaccctgacctgagcagcctgcaggccggcagcgcctgcctggccaagcaccaggacggcctgtggcatgctgcccgcatcacagatgtggacaatggctactacacagtgaagtttgacagcctgctgctgcgggaggccgtggtggagggagatggcatcctgccccccctgaggacagaggccacagaaagtgacagcgacagtgatgtggtgggcagtgatgctgtggacagcggcacctgcagcagcgcctttgctggctgggaggtgcacacccggggcatcggcagccggctgctgaccaagatgggctatgaatttgggaagggcctgggcagacatgctgagggccgggtggagcccatccatgctgtggtgctgccccggggcaagagcctggaccagtgtgtggagaccctgcagaagcagaccagggtgggcaaggccggcaccaacaagccaccccgctgccggggccgcggggcccggcctgggggccggcctgcccccagaaatgtgtttgacttcctgaatgagaagctgcagggccaggcccctggggccctggaggccggggccgccccagctggccgccgcagcaaggacatgtaccacgccagcaagagcgccaagagggccctgagcctgcggctcttccagacagaggagaagattgaaagaacccagagggacatccgcagcatccaggaggccctggccagaaatgccggccgccacagcgtggccagcgcccagctgcaggagaagctggccggggcccagaggcagctgggccagctgcgggcccaggaggccggcctgcagcaggagcagaggaaggctgacacccacaagaagatgacagagttctag

SEQ ID NO: 18558 - DNA, 1536 bp, Artificial Sequence; identical to SEQ ID NO: 18556
  Description of Artificial Sequence: Synthetic coding sequence

SEQ ID NO: 18559 - DNA, 294 bp, Artificial Sequence
  Description of Artificial Sequence: Synthetic coding sequence
atggatgaggagagcctggagagcgccctgcagacctaccgggcccagctgcagcaggtggagctggccctgggcgccggcctggacagcagcgagcaggccgacctgcggcagctgcagggcgacctgaaggagctgattgagctgacagaggccagcctggtgtctgtgaggaagagcagcctgctggccgccctggatgaggagaggcctggccggcaggaggatgctgagtaccaggccttccgggaggccatcacagaagctgtggaggccccagctgctgccaggtag

SEQ ID NO: 18560 - DNA, 1536 bp, Artificial Sequence; identical to SEQ ID NO: 18556
  Description of Artificial Sequence: Synthetic coding sequence

SEQ ID NO: 18561 - DNA, 1419 bp, Artificial Sequence
  Description of Artificial Sequence: Synthetic coding sequence
atgaacaacagccagggccgggtgacctttgaagatgtgacagtgaacttcacccagggcgagtggcagaggctgaaccctgagcagaggaacctgtacagagatgtgatgctggagaactacagcaacctggtgtctgtgggccagggcgagaccaccaagccagatgtgatcctgcggctggagcagggcaaggagccctggctggaggaggaggaggtgctgggcagcggccgggcagagaagaatggagacatcggcggccagatctggaagcccaaggatgtgaaggagagcctggcccgggaggtgcccagcatcaacaaggagaccctgaccacccagaagggcgtggagtgtgatggcagcaagaagatcctgcccctgggcattgatgatgtgagcagcctgcagcactacgtgcagaacaacagccatgatgacaatggctacaggaagctggtgggcaacaaccccagcaagtttgtgggccagcagctgaagtgcaatgcctgcaggaagctgttcagcagcaagagccggctgcagagccacctgcggagacatgcctgccagaagccctttgagtgccacagctgtggccgggccttcggggagaagtggaagctggacaagcaccagaagacccacgccgaggagcggccctacaagtgtgagaactgtggaaatgcctacaagcagaagagcaacctcttccagcaccagaagatgcacaccaaggagaagccctaccagtgcaagacctgtgggaaggccttctcctggaagagcagctgcatcaaccacgagaagatccacaatgccaagaagagctaccagtgcaatgaatgtgagaagagcttccggcagaacagcaccctcatccagcacaagaaggtgcacacaggccagaagcccttccagtgcacagactgtgggaaggccttcatctacaagagtgacctggtgaagcaccagaggatccacactggagagaagccctacaagtgcagcatctgtgagaaggccttcagccagaagagcaatgtgattgaccacgagaagatccacacaggcaagagggcctatgaatgtgacctgtgtggcaacaccttcatccagaagaagaacctgatccagcacaagaagatccacactggagagaagccctatgagtgcaacagatgtgggaaggccttcttccagaagagcaacctgcacagccaccagaagacccacagcggggagaggacctaccgctgcagtgaatgtgggaagaccttcatcaggaagctgaacctgagcctgcacaagaagacccacacaggccagaagccctacggctgcagtgaatgtgggaaggcctttgctgacaggagctacctggtgcgccaccagaagaggatccacagcaggtag

SEQ ID NO: 18562 - DNA, 1917 bp, Artificial Sequence
  Description of Artificial Sequence: Synthetic coding sequence
atggagagctgcagcgtgacccggctggagtgcagcggggccatcagcgcccactgcagcctgcacctgcccggcagcagtgacagccctgccagcgccagccagattgctggcaccacagatgccatctggaatgagcaggagaaggccgagctgttcacagacaagttctgccaggtgtgtggggtgatgctgcagtttgagagccagaggatcagccactatgaaggagagaagcacgcccagaatgtgtccttctacttccagatgcatggagagcagaatgaggtgcctgggaagaagatgaagatgcacgtggagaacttccaggtgcacagatatgagggcgtggacaagaacaagttctgtgacctgtgcaacatgatgttcagcagccccctgattgcccagagccactacgtgggcaaggtgcacgccaagaagctgaagcagctgatggaggagcatgaccaggccagccccagcggcttccagcctgagatggccttctccatgaggacctacgtgtgccacatctgcagcatcgccttcaccagcctggacatgttccgcagccacatgcagggcagcgagcaccagatcaaggagagcatcgtcatcaacctggtgaagaacagcaggaagacccaggacagctaccagaatgaatgtgccgactacatcaacgtgcagaaggcccggggcctggaggccaagacctgcttcaggaagatggaggagagcagcctggagacccggcgctaccgggaggtggtggacagccggcccaggcacaggatgtttgagcagaggctgccctttgagaccttccgcacctatgctgccccctacaacatcagccaggccatggagaagcagctgccccacagcaagaagacctatgacagcttccaggatgagctggaggactacatcaaggtgcagaaggcccggggcctggaccccaagacctgcttcaggaagatgagagaaaattctgtggacacccacggctaccgggagatggtggacagcggccccaggagcaggatgtgtgagcagcgcttcagccatgaggccagccagacctaccagaggccctaccacatcagccctgtggagagccagctgccccagtggctgcccacccacagcaagaggacctatgacagcttccaggatgagctggaggactacatcaaggtgcagaaggcccggggcctggagcccaagacctgcttcaggaagattggagacagctctgtggagacccacaggaaccgggagatggtggatgtgcggcccaggcacaggatgctggagcagaagctgccctgtgagaccttccagacctacagcggcccctacagcatcagccaggtggtggagaaccagctgccccactgcctgcctgcccatgacagcaagcagaggctggacagcatctcctactgccagctgacccgggactgcttccctgagaagcctgtgcccctgagcctgaaccagcaggagaacaacagcggcagctacagcgtggagagcgaggtgtacaagcacctgagcagcgagaacaacacagctgaccaccaggccggccacaagcagaagcaccagaagaggaagaggcacctggaggagggcaaggagaggcctgagaaggagcagagcaagcacaagaggaagaagagctatgaggacacagacctggacaaggacaagagcatccggcagaggaagcgggaggaggacagagtgaaggtgagcagcggcaagctgaagcacaggaagaagaagaagagccatgatgtgcccagcgagaaggaggagaggaagcacaggaaggagaagaagaagtctgtggaggagaggacagaggaggagatgctgtgggatgagagcatcctgggcttctag

SEQ ID NO: 18563 - DNA, 1404 bp, Artificial Sequence
  Description of Artificial Sequence: Synthetic coding sequence
atgaggacctacgtgtgccacatctgcagcatcgccttcaccagcctggacatgttccgcagccacatgcagggcagcgagcaccagatcaaggagagcatcgtcatcaacctggtgaagaacagcaggaagacccaggacagctaccagaatgaatgtgccgactacatcaacgtgcagaaggcccggggcctggaggccaagacctgcttcaggaagatggaggagagcagcctggagacccggcgctaccgggaggtggtggacagccggcccaggcacaggatgtttgagcagaggctgccctttgagaccttccgcacctacgccgccccctacaacatcagccaggccatggagaagcagctgccccacagcaagaagacctatgacagcttccaggatgagctggaggactacatcaaggtgcagaaggcccggggcctggaccccaagacctgcttcaggaagatgagggagaacagcgtggacacccacggctaccgggagatggtggacagcggccccaggagcaggatgtgtgagcagcgcttcagccatgaggccagccagacctaccagaggccctaccacatcagccctgtggagagccagctgccccagtggctgcccacccacagcaagaggacctatgacagcttccaggatgagctggaggactacatcaaggtgcagaaggcccggggcctggagcccaagacctgcttcaggaagatcggggacagctctgtggagacccacaggaaccgggagatggtggatgtgcggcccaggcacaggatgctggagcagaagctgccctgtgagaccttccagacctacagcggcccctacagcatcagccaggtggtggagaaccagctgccccactgcctgcctgcccatgacagcaagcagaggctggacagcatctcctactgccagctgacccgggactgcttccctgagaagcctgtgcccctgagcctgaaccagcaggagaacaacagcggcagctacagcgtggagagcgaggtgtacaagcacctgagcagcgagaacaacacagctgaccaccaggccggccacaagcagaagcaccagaagaggaagaggcacctggaggagggcaaggagaggcctgagaaggagcagagcaagcacaagaggaagaagagctatgaggacacagacctggacaaggacaagagcatccggcagaggaagcgggaggaggacagagtgaaggtgtcctctgggaagctgaagcacaggaagaagaagaagagccatgatgtgcccagcgagaaggaggagaggaagcacaggaaggagaagaagaagtctgtggaggagaggacagaggaggagatgctgtgggatgagagcatcctgggcttctag

SEQ ID NO: 18564 - DNA, 1917 bp, Artificial Sequence; identical to SEQ ID NO: 18562
  Description of Artificial Sequence: Synthetic coding sequence

SEQ ID NO: 18565 - DNA, 600 bp, Artificial Sequence
  Description of Artificial Sequence: Synthetic coding sequence
atggccagcggcagcggcaccaagaacctggacttccggaggaagtgggacaaggatgaatatgagaagctggccgagaagaggctgacagaggagcgggagaagaaggatggcaagcctgtgcagcctgtgaagcgggagctgctgcggcaccgggactacaaggtggacctggagagcaagctgggcaagaccatcgtcatcaccaagaccaccccccagagcgagatgggcggctactactgcaatgtgtgtgactgtgtggtgaaggacagcatcaacttcctggaccacatcaacgggaagaagcaccagaggaacctgggcatgtccatgagggtggagaggagcaccctggaccaggtgaagaagagatttgaggtgaacaagaagaagatggaggagaagcagaaggactatgactttgaggagaggatgaaggagctgcgggaggaggaggagaaggccaaggcctacaagaaggagaagcagaaggagaagaagagaagagctgaggaggacctgacctttgaagaagatgatgagatggctgctgtgatgggcttcagcggcttcggcagcaccaagaagagctactag

SEQ ID NO: 18566 - DNA, 870 bp, Artificial Sequence
  Description of Artificial Sequence: Synthetic coding sequence
atgatcctgctgcagcacgctgtgctgcccccacccaagcagcccagccccagcccccccatgtctgtggccaccaggagcacaggcaccctgcagctgcccccccagaagcccttcggccaggaggccagcctgcccctggccggggaggaggagctgagcaaaggaggagagcaggactgtgccctggaggagctgtgcaagcccctgtactgcaagctgtgcaatgtgaccctgaacagcgcccagcaggcccaggcccactaccagggcaagaaccacggcaagaagctgaggaactactatgctgccaacagctgccccccaccagccaggatgagcaatgtggtggagcctgctgccacccctgtggtgcctgtgcccccccagatgggcagcttcaagccaggcggccgggtcatcctggccacagaaaatgactactgcaagctgtgtgatgccagcttcagcagccctgctgtggcccaggcccactaccagggcaagaaccacgccaagaggctgcggctggccgaggcccagagcaacagcttcagcgagagcagcgagctgggccagaggcgggccaggaaggagggcaatgagttcaagatgatgcccaacagaagaaacatgtacacagtgcagaacaacagcgctggcccctacttcaaccccaggagccggcagaggatcccccgggacctggccatgtgtgtgaccccatctggccagttctactgcagcatgtgcaatgtgggcgctggggaggagatggagttccggcagcacctggagagcaagcagcacaagagcaaggtgtctgagcagcgctacagaaatgagatggagaacctgggctacgtgtag

SEQ ID NO: 18567 - DNA, 447 bp, Artificial Sequence
  Description of Artificial Sequence: Synthetic coding sequence
atgatcctgctgcagcacgctgtgctgcccccacccaagcagcccagccccagcccccccatgtctgtggccaccaggagcacaggcaccctgcagctgcccccccagaagcccttcggccaggaggccagcctgcccctggccggggaggaggagctgagcaaaggaggagagcaggactgtgccctggaggagctgtgcaagcccctgtactgcaagctgtgcaatgtgaccctgaacagcgcccagcaggcccaggcccactaccagggcaagaaccacggcaagaagctgaggaactactatgctgccaacagctgccccccaccagccaggatgagcaatgtggtggagcctgctgccacccctgtggtgcctgtgcccccccagatgggcagcttcaagccaggcggccgggtcatcctggccacagaaaatgactactag

SEQ ID NO: 18568 - DNA, 867 bp, Artificial Sequence
  Description of Artificial Sequence: Synthetic coding sequence
atgatcctgctgcagcacgctgtgctgcccccacccaagcagcccagccccagcccccccatgtctgtggccaccaggagcacaggcaccctgcagctgcccccccagaagcccttcggccaggaggccagcctgcccctggccggggaggaggagctgagcaaaggaggagagcaggactgtgccctggaggagctgtgcaagcccctgtactgcaagctgtgcaatgtgaccctgaacagcgcccagcaggcccaggcccactaccagggcaagaaccacggcaagaagctgaggaactactatgctgccaacagctgccccccaccagccaggatgagcaatgtggtggagcctgctgccacccctgtggtgcctgtgcccccccagatgggcagcttcaagccaggcggccgggtcatcctggccacagaaaatgactactgcaagctgtgtgatgccagcttcagcagccctgctgtggcccaggcccactaccagggcaagaaccacgccaagaggctgcggctggccgaggcccagagcaacagcttcagcgagagcagcgagctgggccagaggcgggccaggaaggagggcaatgagttcaagatgatgcccaacagaagaaacatgtacacagtgcagaacaacagcggcccctacttcaaccccaggagccggcagaggatcccccgggacctggccatgtgtgtgacccccagcggccagttctactgcagcatgtgcaatgtgggcgctggggaggagatggagttccggcagcacctggagagcaagcagcacaagagcaaggtgtctgagcagcgctacagaaatgagatggagaacctgggctacgtgtag

SEQ ID NO: 18569 - DNA, 690 bp, Artificial Sequence
  Description of Artificial Sequence: Synthetic coding sequence
atgaagagcagtgacatcgaccaggacctcttcacagacagctactgcaaggtgtgcagcgcccagctgatcagcgagagccagagggtggcccactatgagagcaggaagcacgccagcaaggtgcggctgtactacatgctgcaccccagagatggcggctgcccagccaagaggctgcggagtgaaaatggaagtgatgctgacatggtggacaagaacaagtgctgcaccctgtgcaacatgtccttcaccagcgctgtggtggccgacagccactaccagggcaagatccacgccaagaggctgaagctgctgctgggggagaagacccccctgaagaccacagccacccccctgagccccctgaagccacccaggatggacacagcccctgtggtggccagcccctaccagaggcgggacagcgaccgctactgcggcctgtgtgccgcctggttcaacaaccccctgatggcccagcagcactatgatggcaagaagcacaagaagaatgctgcccgggtggccctgctggagcagctgggcaccaccctggacatgggagagctgcggggcctgcggaggaactaccgctgcaccatctgcagcgtgtccctgaacagcattgagcagtaccacgcccacctgaagggcagcaagcaccagaccaacctgaagaacaagtag

SEQ ID NO: 18570 - DNA, 462 bp, Artificial Sequence
  Description of Artificial Sequence: Synthetic coding sequence
atgaagagcagtgacatcgaccaggacctcttcacagacagctactgcaaggtgtgcagcgcccagctgatcagcgagagccagagggtggcccactatgagagcaggaagcacgccagcaaggtgcggctgtactacatgctgcaccccagagatggcggctgcccagccaagaggctgcggagtgaaaatggaagtgatgctgacatggtggacaagaacaagtgctgcaccctgtgcaacatgtccttcaccagcgctgtggtggccgacagccactaccagggcaagatccacgccaagaggctgaagctgctgctgggggagaagacccccctgaagaccaccggcctgcggaggaactaccgctgcaccatctgcagcgtgtccctgaacagcattgagcagtaccacgcccacctgaagggcagcaagcaccagaccaacctgaagaacaagtag

SEQ ID NO: 18571 - DNA, 636 bp, Artificial Sequence
  Description of Artificial Sequence: Synthetic coding sequence
atgaagagcagtgacatcgaccaggacctcttcacagacagctactgcaaggtgtgcagcgcccagctgatcagcgagagccagagggtggcccactatgagagcaggaagcacgccagcaaggtgcggctgtactacatgctgcaccccagagatggcggctgcccagccaagaggctgcggagtgaaaatggaagtgatgctgacatggtggacaagaacaagtgctgcaccctgtgcaacatgtccttcaccagcgctgtggtggccgacagccactaccagggcaagatccacgccaagaggctgaagctgctgctgggggagaagacccccctgaagaccacagccacccccctgagccccctgaagccacccaggatggacacagcccctgtggtggccagcccctaccagaggcgggacagcgaccgctactgcggcctgtgtgccgcctggttcaacaaccccctgatggcccagcagcactatgatggcaagaagcacaagaagaatgctgcccgggtggccctgctggagcagctgggcaccaccctggacatgggagagctgcggggcctgcggaggaactaccgctgcaccatctgcagcgtgtccctgaacagcattgaatag

SEQ ID NO: 18572 - DNA, 2685 bp, Artificial Sequence
  Description of Artificial Sequence: Synthetic coding sequence
atgaacagcatgaaccccatgaagccagccctgcccccagcccctcatggagatggcagctttgcctatgaatctgtgccctggcagcagagcgccacccagcctgctggcagcctgtctgtggtgaccaccgtgtggggcgtgggcaatgccacccagagccaggtgctgggcaaccccatgggccctgctggcagccccagcggcagctccatgatgcctggggtggccggcggcagcagcgccctgaccagcccccagtgcctgggccagcaggcctttgctgagggcggggccaacaagggctacgtgcagcagggcgtgtacagccggggcggctacccaggggcccctggcttcaccaccggctacgccggcggccctgggggcctgggcctgcccagccatgctgcccggcccagcacagacttcacccaggccgctgctgctgctgctgtggccgctgctgctgccacagccacagccacagccacagccaccgtggccgccctgcaggagaagcagagccaggagctgagccagtacggggccatgggcgccggccagagcttcaacagccagttcctgcagcacggcggcccccggggccccagcgtgcctgctggcatgaaccccactggaattggaggagtgatgggccccagcggcctgagccccctggccatgaaccccaccagggctgctggcatgacccccctgtatgccggccagaggctgccccagcacggctacccaggccccccccaggcccagcccctgccccggcagggcgtgaagaggacctacagcgaggtgtacccaggccagcagtacctgcagggcggccagtatgcccccagcacagcccagtttgcccccagccctggccagcccccagcccccagccccagctacccaggccaccggctgcccctgcagcagggcatgacccagagcctgtctgtgcccggccccaccggcctgcactacaagcccaccaggagcatccctggctaccccagcagccccctgcccggcaaccccaccccacccatgacccccagcagctctgtgccctacatgagccccaaccaggaggtgaagagccccttcctgcctgacctgaagcccaacctgaacagcctgcacagcagccccagcggcagcggcccctgtgatgagctgcggctgaccttccctgtgagagatggagtggtgctggagcccttccggctgcagcacaacctggccgtgagcaaccacgtgttccagctgcgggacagcgtgtacaagaccctcatcatgaggccagacctggagctgcagttcaagtgctaccaccatgaagatcggcagatgaacaccaactggccagcctctgtgcaggtgtctgtgaatgccacccccctgaccatcgagcggggggacaacaagaccagccacaagcccctgtacctgaagcacgtgtgccagcccggcaggaacaccatccagatcaccgtgacagcctgctgctgcagccacctgtttgtgctgcagctggtgcaccggcccagcgtgcgctctgtgctgcagggcctgctgaagaagaggctgctgcctgctgagcactgcatcaccaagatcaagaggaacttcagcagcggcaccatccctggcaccccaggccccaacggggaggatggagtggagcagacagccatcaaggtgtccctgaagtgccccatcaccttccgccgcatccagctgcctgcccggggccatgactgccgccacatccagtgctttgacctggagagctacctgcagctgaactgtgagcggggcacctggcgctgccctgtgtgcaacaagacagccctgctggagggcctggaggtggaccagtacatgctgggcatcctgatctacatccagaacagcgactatgaggagatcaccatcgaccccacctgctcctggaagcctgtgcctgtgaagccagacatgcacatcaaggaggagccagatggccctgccctgaagcgctgcaggacagtgtccccagcccacgtgctgatgcccagcgtgatggagatgattgctgccctgggccctggagctgccccctttgcccccctgcagcccccatctgtgcctgcccccagcgactacccaggccagggcagcagcttcctgggccctggcaccttccctgagagcttcccccccaccacccccagcacccccaccctggccgagttcaccccaggccccccacccatctcctaccagagcgacatccccagcagcctgctgaccagcgagaagagcacagcctgcctgcccagccagatggccccagctggccacctggaccccacccacaaccctggcaccccaggcctgcacaccagcaacctgggcgcccctcctggcccccagctgcaccacagcaaccccccaccagccagccggcagagcctgggccaggccagcctgggccccaccggggagctggccttctccccagccactggagtgatgggcccccccagcatgtctggggccggggaggcccctgagcccgccctggacctgctgcctgagctgaccaacccagatgagctgctgagctacctgggccccccagacctgcccaccaacaacaatgatgacctgctgagcctgtttgagaacaactag

SEQ ID NO: 18573 - DNA, 2763 bp, Artificial Sequence
  Description of Artificial Sequence: Synthetic coding sequence
atgaacagcatgaaccccatgaagccagccctgcccccagcccctcatggagatggcagctttgcctatgaatctgtgccctggcagcagagcgccacccagcctgctggcagcctgtctgtggtgaccaccgtgtggggcgtgggcaatgccacccagagccaggtgctgggcaaccccatgggccctgctggcagccccagcggcagctccatgatgcctggggtggccggcggcagcagcgccctgaccagcccccagtgcctgggccagcaggcctttgctgagggcggggccaacaagggctacgtgcagcagggcgtgtacagccggggcggctacccaggggcccctggcttcaccaccggctacgccggcggccctgggggcctgggcctgcccagccatgctgcccggcccagcacagacttcacccaggccgctgctgctgctgctgtggccgctgctgctgccacagccacagccacagccacagccaccgtggccgccctgcaggagaagcagagccaggagctgagccagtacggggccatgggcgccggccagagcttcaacagccagttcctgcagcacggcggcccccggggccccagcgtgcctgctggcatgaaccccactggaattggaggagtgatgggccccagcggcctgagccccctggccatgaaccccaccagggctgctggcatgacccccctgtatgccggccagaggctgccccagcacggctacccaggccccccccaggcccagcccctgccccggcagggcgtgaagaggacctacagcgaggtgtacccaggccagcagtacctgcagggcggccagtatgcccccagcacagcccagtttgcccccagccctggccagcccccagcccccagccccagctacccaggccaccggctgcccctgcagcagggcatgacccagagcctgtctgtgcccggccccaccggcctgcactacaagcccacagagcagttcaacggccagggcgccagcttcaacggcggctctgtgtcctacagccagcccggcctgagcggccccaccaggagcatccctggctaccccagcagccccctgcccggcaaccccaccccacccatgacccccagcagctctgtgccctacatgagccccaaccaggaggtgaagagccccttcctgcctgacctgaagcccaacctgaacagcctgcacagcagccccagcggcagcggcccctgtgatgagctgcggctgaccttccctgtgagagatggagtggtgctggagcccttccggctgcagcacaacctggccgtgagcaaccacgtgttccagctgcgggacagcgtgtacaagaccctcatcatgaggccagacctggagctgcagttcaagtgctaccaccatgaagatcggcagatgaacaccaactggccagcctctgtgcaggtgtctgtgaatgccacccccctgaccatcgagcggggggacaacaagaccagccacaagcccctgtacctgaagcacgtgtgccagcccggcaggaacaccatccagatcaccgtgacagcctgctgctgcagccacctgtttgtgctgcagctggtgcaccggcccagcgtgcgctctgtgctgcagggcctgctgaagaagaggctgctgcctgctgagcactgcatcaccaagatcaagaggaacttcagcagcggcaccatccctggcaccccaggccccaacggggaggatggagtggagcagacagccatcaaggtgtccctgaagtgccccatcaccttccgccgcatccagctgcctgcccggggccatgactgccgccacatccagtgctttgacctggagagctacctgcagctgaactgtgagcggggcacctggcgctgccctgtgtgcaacaagacagccctgctggagggcctggaggtggaccagtacatgctgggcatcctgatctacatccagaacagcgactatgaggagatcaccatcgaccccacctgctcctggaagcctgtgcctgtgaagccagacatgcacatcaaggaggagccagatggccctgccctgaagcgctgcaggacagtgtccccagcccacgtgctgatgcccagcgtgatggagatgattgctgccctgggccctggagctgccccctttgcccccctgcagcccccatctgtgcctgcccccagcgactacccaggccagggcagcagcttcctgggccctggcaccttccctgagagcttcccccccaccacccccagcacccccaccctggccgagttcaccccaggccccccacccatctcctaccagagcgacatccccagcagcctgctgaccagcgagaagagcacagcctgcctgcccagccagatggccccagctggccacctggaccccacccacaaccctggcaccccaggcctgcacaccagcaacctgggcgcccctcctggcccccagctgcaccacagcaaccccccaccagccagccggcagagcctgggccaggccagcctgggccccaccggggagctggccttctccccagccactggagtgatgggcccccccagcatgtctggggccggggaggcccctgagcccgccctggacctgctgcctgagctgaccaacccagatgagctgctgagctacctgggccccccagacctgcccaccaacaacaatgatgacctgctgagcctgtttgagaacaactag

SEQ ID NO: 18574 - DNA, 2772 bp, Artificial Sequence
  Description of Artificial Sequence: Synthetic coding sequence
atgaacagcatgaaccccatgaagccagccctgcccccagcccctcatggagatggcagctttgcctatgaatctgtgccctggcagcagagcgccacccagcctgctggcagcctgtctgtggtgaccaccgtgtggggcgtgggcaatgccacccagagccaggtgctgggcaaccccatgggccctgctggcagccccagcggcagctccatgatgcctggggtggccggcggcagcagcgccctgaccagcccccagtgcctgggccagcaggcctttgctgagggcggggccaacaagggctacgtgcagcagggcgtgtacagccggggcggctacccaggggcccctggcttcaccaccggctacgccggcggccctgggggcctgggcctgcccagccatgctgcccggcccagcacagacttcacccaggccgctgctgctgctgctgtggccgctgctgctgccacagccacagccacagccacagccaccgtggccgccctgcaggagaagcagagccaggagctgagccagtacggggccatgggcgccggccagagcttcaacagccagttcctgcagcacggcggcccccggggccccagcgtgcctgctggcatgaaccccactggaattggaggagtgatgggccccagcggcctgagccccctggccatgaaccccaccagggctgctggcatgacccccctgtatgccggccagaggctgccccagcacggctacccaggccccccccaggcccagcccctgccccggcagggcgtgaagaggacctacagcgaggtgtacccaggccagcagtacctgcagggcggccagtatgcccccagcacagcccagtttgcccccagccctggccagcccccagcccccagccccagctacccaggccaccggctgcccctgcagcagggcatgacccagagcctgtctgtgcccggccccaccggcctgcactacaagcccacagagcagttcaacggccagggcgccagcttcaacggcggctctgtgtcctacagccagcccggcctgagcggccccaccaggagcatccctggctaccccagcagccccctgcccggcaaccccaccccacccatgacccccagcagctctgtgccctacatgagccccaaccaggaggtgaagagccccttcctgcctgacctgaagcccaacctgaacagcctgcacagcagccccagcggcagcggcccctgtgatgagctgcggctgaccttccctgtgagagatggagtggtgctggagcccttccggctgcagcacaacctggccgtgagcaaccacgtgttccagctgcgggacagcgtgtacaagaccctcatcatgaggccagacctggagctgcagttcaagtgctaccaccatgaagatcggcagatgaacaccaactggccagcctctgtgcaggtgtctgtgaatgccacccccctgaccatcgagcggggggacaacaagaccagccacaagcccctgtacctgaagcacgtgtgtgcccggccccagcaccaccccagccccagccccccagctgctgcctgtgtgtcctgcagccacctgtttgtgctgcagctggtgcaccggcccagcgtgcgctctgtgctgcagggcctgctgaagaagaggctgctgcctgctgagcactgcatcaccaagatcaagaggaacttcagcagcggcaccatccctggcaccccaggccccaatggagaagatggagtggagcagacagccatcaaggtgtccctgaagtgccccatcaccttccgccgcatccagctgcctgcccggggccatgactgccgccacatccagtgctttgacctggagagctacctgcagctgaactgtgagcggggcacctggcgctgccctgtgtgcaacaagacagccctgctggagggcctggaggtggaccagtacatgctgggcatcctgatctacatccagaacagcgactatgaggagatcaccatcgaccccacctgctcctggaagcctgtgcctgtgaagccagacatgcacatcaaggaggagccagatggccctgccctgaagcgctgcaggacagtgtccccagcccacgtgctgatgcccagcgtgatggagatgattgctgccctgggccctggggccgccccctttgcccccctgcagccccccagcgtgcctgcccccagcgactacccaggccagggcagcagcttcctgggccctggcaccttccctgagagcttcccccccaccacccccagcacccccaccctggccgagttcaccccaggccccccacccatctcctaccagagcgacatccccagcagcctgctgaccagcgagaagagcacagcctgcctgcccagccagatggccccagctggccacctggaccccacccacaaccctggcaccccaggcctgcacaccagcaacctgggcgcccctcctggcccccagctgcaccacagcaaccccccaccagccagccggcagagcctgggccaggccagcctgggccccactggagagctggccttcagccctgccaccggggtgatgggccccccatccatgtctggagctggggaggcccctgagcccgccctggacctgctgcctgagctgaccaacccagatgagctgctgagctacctgggccccccagacctgcccaccaacaacaatgatgacctgctgagcctgtttgagaacaactag

SEQ ID NO: 18575 - DNA, 2763 bp, Artificial Sequence; identical to SEQ ID NO: 18573
  Description of Artificial Sequence: Synthetic coding sequence

SEQ ID NO: 18576 - DNA, 273 bp, Artificial Sequence
  Description of Artificial Sequence: Synthetic coding sequence
atgaacagcatgaaccccatgaagccagccctgcccccagcccctcatggagatggcagctttgcctatgaatctgtgccctggcagcagagcgccacccagcctgctggcagcctgtctgtggtgaccaccgtgtggggcgtgggcaatgccacccagagccaggtgctgggcaaccccatgggccctgctggcagccccagcggcagctccatgatgcctggggtggccggcggcagcagcgccctgaccagcccccagtgcctgggctag

SEQ ID NO: 18577 - DNA, 3429 bp, Artificial Sequence
  Description of Artificial Sequence: Synthetic coding sequence
atgaaggagcccctgctgggcggagaatgtgacaaggctgtggccagccagctgggcctgctggatgagatcaagacagagccagacaatgcccaggagtactgccaccggcagcagagcaggacccaggagaatgagctgaagatcaatgctgtgttcagcgagagcgccagccagctgacagctggcatccagctgagcctggccagcagtggagtgaacaagatgctgcccagcgtgtccaccacagccatccaggtgtcctgtgccggctgcaagaagatcctgcagaagggccagacagcctaccagaggaagggcagcgcccagctgttctgcagcatcccctgcatcacagagtacatcagcagcgccagcagccctgtgcccagcaagaggacctgcagcaactgcagcaaggacatcctgaaccccaaggatgtgatctctgtgcagctggaggacaccaccagctgcaagaccttctgcagcctgagctgcctgagcagctatgaggagaagaggaagccctttgtgaccatctgcaccaacagcatcctgaccaagtgcagcatgtgccagaagacagccatcatccagtatgaggtgaagtaccagaatgtgaagcacaacctgtgcagcaatgcctgcctgagcaagttccacagcgccaacaacttcatcatgaactgctgtgagaactgtggcacctactgctacaccagcagcagcctgagccacatcctgcagatggagggccagagccactacttcaacagcagcaagagcatcacagcctacaagcagaagccagccaagcccctcatctctgtgccctgcaagcccctgaagcccagtgatgagatgattgagaccaccagtgacctgggcaagacagagctgttctgcagcatcaactgcttcagcgcctacagcaaggccaagatggagagcagctctgtgtctgtggtgtctgtggtgcatgacaccagcacagagctgctgagccccaagaaggacaccacccctgtgatcagcaacatcgtgtccctggccgacacagatgtggccctgcccatcatgaacacagatgtgctgcaggacacagtgtcctctgtgacagccacagcagatgtgattgtggacctgagcaagagcagccccagcgagcccagcaatgctgtggccagcagcagcacagagcagcccagcgtgagccccagcagcagcgtcttcagccagcacgccatcggcagcagcacagaggtgcagaaggacaacatgaagtccatgaagatcagtgatgagctgtgccaccccaagtgcaccagcaaggtgcagaaggtgaagggcaagagccgcagcatcaagaagagctgctgtgccgactttgaatgtctggagaacagcaagaaggatgtggccttctgctacagctgccagctgttctgccagaagtacttcagctgtggccgggagagctttgccacccacggcaccagcaactggaagaagaccctggagaagttcaggaagcatgagaagtctgagatgcacctgaagagcctggagttctggagggagtaccagttctgtgatggagctgtgtctgatgacctgagcatccacagcaagcagatcgagggcaacaagaagtacctgaagctgatcatcgagaacatcctcttcctgggcaagcagtgcctgcccctgcggggaaatgaccagagcgtgtcctctgtgaacaagggcaacttcctggagctgctggagatgagggccaaggacaagggggaggagaccttccggctgatgaacagccaggtggacttctacaacagcacccagatccagagcgacatcatcgagatcatcaagacagagatgctgcaggacatcgtgaatgagatcaatgacagcagcgccttcagcatcatctgtgatgagaccatcaacagcgccatgaaggagcagctgagcatctgtgtgcgctacccccagaagagcagcaaggccatcctgatcaaggagcgcttcctgggctttgtggacacagaggagatgacaggcacccacctgcacaggaccatcaagacctacctgcagcagatcggcgtggacatggacaagatccacggccaggcctatgacagcaccaccaacctgaagatcaagttcaacaagattgctgctgagttcaagaaggaggagccccgggccctgtacatccactgctacgcccacttcctggacctgagcatcatccgcttctgcaaggaggtgaaggagctgcggagcgccctgaagaccctgagcagcctcttcaacaccatctgcatgtctggagagatgctggccaacttcaggaacatctaccgcctgagccagaacaagacctgcaagaagcacatcagccagagctgctggacagtgcatgacaggaccctgctgagcgtcatcgacagcctgcctgagatcatcgagaccctggaggtgattgccagccacagcagcaacaccagctttgctgatgagctgagccacctgctgaccctggtgtccaagtttgaatttgtgttctgcctgaagttcctgtacagagtgctgtctgtgacaggcatcctgagcaaggagctgcagaacaagaccatcgacatcttcagcctgagcagcaagattgaggccatcctggagtgcctgagcagcgagagaaatgatgtgtacttcaagaccatctgggatggaacagaggagatctgccagaagatcacctgcaagggcttcaaggtggagaagcccagcctgcagaagaggaggaagatccagaagtctgtggacctgggcaacagcgacaacatgttcttccccaccagcacagaggagcagtacaagatcaacatctactaccagggcctggacaccatcctgcagaacctgaagctgtgcttcagcgagtttgactactgcaagatcaagcagatcagcgagctgctcttcaagtggaatgagcccctgaatgagaccacagccaagcacgtgcaggagttctacaagctggatgaggacatcatccctgagctgcgcttctaccgccactacgccaagctgaactttgtgattgatgacagctgcatcaactttgtgtccctgggctgcctcttcatccagcacggcctgcacagcaacatcccctgcctgagcaagctgctgtacatcgccctgtcctggcccatcaccagcgccagcacagagaacagcttcagcaccctgccccggctgaagacctacctgtgcaacaccatgggccaggagaagctgactggacctgccctgatggctgtggagcaggagctggtgaacaagctgatggagcctgagcggctgaatgaaattgtggagaagttcatcagccagatgaaggagatctag

SEQ ID NO: 18578 - DNA, 3204 bp, Artificial Sequence
  Description of Artificial Sequence: Synthetic coding sequence
atgctgcccagcgtgtccaccacagccatccaggtgtcctgtgccggctgcaagaagatcctgcagaagggccagacagcctaccagaggaaaggaagtgcccagctgttctgcagcatcccctgcatcacagagtacatcagcagcgccagcagccctgtgcccagcaagaggacctgcagcaactgcagcaaggacatcctgaaccccaaggatgtgatctctgtgcagctggaggacaccaccagctgcaagaccttctgcagcctgagctgcctgagcagctatgaggagaagaggaagccctttgtgaccatctgcaccaacagcatcctgaccaagtgcagcatgtgccagaagacagccatcatccagtatgaggtgaagtaccagaatgtgaagcacaacctgtgcagcaatgcctgcctgagcaagttccacagcgccaacaacttcatcatgaactgctgtgagaactgtggcacctactgctacaccagcagcagcctgagccacatcctgcagatggagggccagagccactacttcaacagcagcaagagcatcacagcctacaagcagaagccagccaagcccctcatctctgtgccctgcaagcccctgaagcccagtgatgagatgattgagaccaccagtgacctgggcaagacagagctgttctgcagcatcaactgcttcagcgcctacagcaaggccaagatggagagcagctctgtgtctgtggtgtctgtggtgcatgacaccagcacagagctgctgagccccaagaaggacaccacccctgtgatcagcaacatcgtgtccctggccgacacagatgtggccctgcccatcatgaacacagatgtgctgcaggacacagtgtcctctgtgacagccacagcagatgtgattgtggacctgagcaagagcagccccagcgagcccagcaatgctgtggccagcagcagcacagagcagcccagcgtgagccccagcagctctgtgttcagccagcacgccatcggcagcagcacagaggtgcagaaggacaacatgaagtccatgaagatcagtgatgagctgtgccaccccaagtgcaccagcaaggtgcagaaggtgaagggcaagagccgcagcatcaagaagagctgctgtgccgactttgagtgcctggagaacagcaagaaggatgtggccttctgctacagctgccagctgttctgccagaagtacttcagctgtggccgggagagctttgccacccacggcaccagcaactggaagaagaccctggagaagttcaggaagcatgagaagtctgagatgcacctgaagagcctggagttctggagggagtaccagttctgtgatggagctgtgtctgatgacctgagcatccacagcaagcagatcgagggcaacaagaagtacctgaagctgatcatcgagaacatcctcttcctgggcaagcagtgcctgcccctgcggggaaatgaccagagcgtgtcctctgtgaacaagggcaacttcctggagctgctggagatgagggccaaggacaagggggaggagaccttccggctgatgaacagccaggtggacttctacaacagcacccagatccagagcgacatcatcgagatcatcaagacagagatgctgcaggacatcgtgaatgagatcaatgacagcagcgccttcagcatcatctgtgatgagaccatcaacagcgccatgaaggagcagctgagcatctgtgtgcgctacccccagaagagcagcaaggccatcctgatcaaggagcgcttcctgggctttgtggacacagaggagatgacaggcacccacctgcacaggaccatcaagacctacctgcagcagattggagtggacatggacaagatccacggccaggcctatgacagcaccaccaacctgaagatcaagttcaacaagattgctgctgagttcaagaaggaggagccccgggccctgtacatccactgctacgcccacttcctggacctgagcatcatccgcttctgcaaggaggtgaaggagctgcggagcgccctgaagaccctgagcagcctcttcaacaccatctgcatgtctggagagatgctggccaacttcaggaacatctaccgcctgagccagaacaagacctgcaagaagcacatcagccagagctgctggacagtgcatgacaggaccctgctgtctgtgattgacagcctgcctgagatcatcgagaccctggaggtgattgccagccacagcagcaacaccagctttgctgatgagctgagccacctgctgaccctggtgtccaagtttgaatttgtgttctgcctgaagttcctgtacagagtgctgtctgtgacaggcatcctgagcaaggagctgcagaacaagaccatcgacatcttcagcctgagcagcaagattgaggccatcctggagtgcctgagcagcgagagaaatgatgtgtacttcaagaccatctgggatggaacagaggagatctgccagaagatcacctgcaagggcttcaaggtggagaagcccagcctgcagaagaggaggaagatccagaagtctgtggacctgggcaacagcgacaacatgttcttccccaccagcacagaggagcagtacaagatcaacatctactaccagggcctggacaccatcctgcagaacctgaagctgtgcttcagcgagtttgactactgcaagatcaagcagatcagcgagctgctcttcaagtggaatgagcccctgaatgagaccacagccaagcacgtgcaggagttctacaagctggatgaggacatcatccctgagctgcgcttctaccgccactacgccaagctgaactttgtgattgatgacagctgcatcaactttgtgtccctgggctgcctcttcatccagcacggcctgcacagcaacatcccctgcctgagcaagctgctgtacatcgccctgtcctggcccatcaccagcgccagcacagaaaattccttcagcaccctgccccggctgaagacctacctgtgcaacaccatgggccaggagaagctgaccggccctgccctgatggctgtggagcaggagctggtgaacaagctgatggagcctgagcggctgaatgagatcgtggagaagttcatcagccagatgaaggagatctag

SEQ ID NO: 18579 - DNA, 3429 bp, Artificial Sequence; identical to SEQ ID NO: 18577
  Description of Artificial Sequence: Synthetic coding sequence

SEQ ID NO: 18580 - DNA, 1389 bp, Artificial Sequence
  Description of Artificial Sequence: Synthetic coding sequence
atgaaggagcccctgctgggcggagaatgtgacaaggctgtggccagccagctgggcctgctggatgagatcaagacagagccagacaatgcccaggagtactgccaccggcagcagagcaggacccaggagaatgagctgaagatcaatgctgtgttcagcgagagcgccagccagctgacagctggcatccagctgagcctggccagcagtggagtgaacaagatgctgcccagcgtgtccaccacagccatccaggtgtcctgtgccggctgcaagaagatcctgcagaagggccagacagcctaccagaggaagggcagcgcccagctgttctgcagcatcccctgcatcacagagtacatcagcagcgccagcagccctgtgcccagcaagaggacctgcagcaactgcagcaaggacatcctgaaccccaaggatgtgatctctgtgcagctggaggacaccaccagctgcaagaccttctgcagcctgagctgcctgagcagctatgaggagaagaggaagccctttgtgaccatctgcaccaacagcatcctgaccaagtgcagcatgtgccagaagacagccatcatccagtatgaggtgaagtaccagaatgtgaagcacaacctgtgcagcaatgcctgcctgagcaagttccacagcgccaacaacttcatcatgaactgctgtgagaactgtggcacctactgctacaccagcagcagcctgagccacatcctgcagatggagggccagagccactacttcaacagcagcaagagcatcacagcctacaagcagaagccagccaagcccctcatctctgtgccctgcaagcccctgaagcccagtgatgagatgattgagaccaccagtgacctgggcaagacagagctgttctgcagcatcaactgcttcagcgcctacagcaaggccaagatggagagcagctctgtgtctgtggtgtctgtggtgcatgacaccagcacagagctgctgagccccaagaaggacaccacccctgtgatcagcaacatcgtgtccctggccgacacagatgtggccctgcccatcatgaacacagatgtgctgcaggacacagtgtcctctgtgacagccacagcagatgtgattgtggacctgagcaagagcagccccagcgagcccagcaatgctgtggccagcagcagcacagagcagcccagcgtgagccccagcagcagcgtcttcagccagcacgccatcggcagcagcacagaggtgcagaaggacaacatgaagtccatgaagatcagtgatgagctgtgccaccccaagtgcaccagcaaggtgcagaaggtgaagggcaagagccgcagcatcaagaagagctgctgtgcctag

SEQ ID NO: 18581 - DNA, 2010 bp, Artificial Sequence
  Description of Artificial Sequence: Synthetic coding sequence
atggagaagtgcagcgtgggcggcctggagctgacagagcagaccccagccctgctgggcaacatggccatggccaccagcctgatggacattggagacagctttggccacccagcctgccccctggtgagccgcagcaggaacagccctgtggaggatgatgatgatgatgatgatgtggtgttcatcgagagcatccagccccccagcatcagcgccccagccatcgctgaccagaggaacttcatctttgccagcagcaagaatgagaagccccagggcaactacagcgtcatcccccccagcagccgggacctggccagccagaagggcaacatcagcgagaccatcgtgattgatgatgaagaagatattgagaccaacggcggcgctgagaagaagagcagctgcttcatcgagtggggcctgcccggcaccaagaacaagaccaatgacctggacttcagcaccagcagcctgagccgcagcaagaccaagacaggagtgcggcccttcaaccctggccgcatgaatgtggccggggacctcttccagaatggagaatttgccacccaccacagcccagacagctggatcagccagagcgccagcttccccagcaaccagaagcagcccggggtggacagcctgagccctgtggccctgctgaggaagcagaacttccagcccacagcccagcagcagctgaccaagccagccaagatcacctgtgccaactgcaagaagcccctgcagaagggccagacagcctaccagaggaaaggaagtgcccacctgttctgcagcaccacctgcctgagcagcttcagccacaagaggacccagaacaccaggagcatcatctgcaagaaggatgccagcaccaagaaggccaacgtcatcctgcctgtggagagcagcaagagcttccaggagttctacagcaccagctgcctgagcccctgtgagaacaactggaacctgaagaagggcgtcttcaacaagagccgctgcaccatctgcagcaagctggccgagatcagacatgaggtgtctgtgaacaacgtgacccacaagctgtgcagcaaccactgcttcaacaagtaccgcctggccaacggcctcatcatgaactgctgtgagcactgtggggagtacatgcccagcaagagcacaggcaacaacatcctggtgattggaggccagcagaagcgcttctgctgccagagctgcatcaatgagtacaagcagatgatggagaccaagagcaagaagctgacagccagcgagaacaggaagagaaatgccttccgggaggagaatgagaagcagctgtatggcagcagcaacaccctgctgaagaagattgagggcatccctgagaagaaggagaagaccagccagctgcagctgtctgtggagtgtggcacagacaccctgctgatccaggagaatgtgaacctgccccccagcagcaccagcaccatcgctgacaccttccaggagcagctggaggagaagaactttgaggacagcatcgtgcctgtggtgctgtctgctgaccccggcacctggccccgcatcctgaacatcaagcagagggacaccctggtggagaatgtgcccccccaggtgaggaacttcaacttccccaaggacaacacaggcaggaagttcagcgagacctactacacccgcatcctgcccaacggggagaagaccaccaggtcctggctgctgtacagcaccagcaaggacagcgtcttctgcctgtactgcaagctgtttggagagggcaagaaccagctgaagaatgaaaatggctgcaaggactggcagcacctgagccacatcctgagcaagcatgaggagagcgagatgcacgtgaacaacagcgtgaagtacagcaagctgaagagtgacctgaagaagaacaaggccattgatgctgctgagcaccggctgtatgaaaatgagaagaatgatggagtgctgctgctgtacacctag

SEQ ID NO: 18582 - DNA, 1149 bp, Artificial Sequence
  Description of Artificial Sequence: Synthetic coding sequence
atggagaagtgcagcgtgggcggcctggagctgacagagcagaccccagccctgctgggcaacatggccatggccaccagcctgatggacattggagacagctttggccacccagcctgccccctggtgagccgcagcaggaacagccctgtggaggatgatgatgatgatgatgatgtggtgttcatcgagagcatccagccccccagcatcagcgccccagccatcgctgaccagaggaacttcatctttgccagcagcaagaatgagaagccccagggcaactacagcgtcatcccccccagcagccgggacctggccagccagaagggcaacatcagcgagaccatcgtgattgatgatgaagaagatattgagaccaacggcggcgctgagaagaagagcagctgcttcatcgagtggggcctgcccggcaccaagaacaagaccaatgacctggacttcagcaccagcagcctgagccgcagcaagaccaagacaggagtgcggcccttcaaccctggccgcatgaatgtggccggggacctcttccagaatggagaatttgccacccaccacagcccagacagctggatcagccagagcgccagcttccccagcaaccagaagcagcccggggtggacagcctgagccctgtggccctgctgaggaagcagaacttccagcccacagcccagcagcagctgaccaagccagccaagatcacctgtgccaactgcaagaagcccctgcagaagggccagacagcctaccagaggaaaggaagtgcccacctgttctgcagcaccacctgcctgagcagcttcagccacaagaggacccagaacaccaggagcatcatctgcaagaaggatgccagcaccaagaaggccaacgtcatcctgcctgtggagagcagcaagagcttccaggagttctacagcaccagctgcctgagcccctgtgagaacaactggaacctgaagaagggcgtcttcaacaagagccgctgcaccatctgcagcaagctggccgaggtgtggatcttcatccccaagctgctcttccggctgaccgtcatcatcctgaccttcaagtgctactacgtgctcttccacctgcacaatgcccgggtgctggatgtgtag

SEQ ID NO: 18583 - DNA, 627 bp, Artificial Sequence
  Description of Artificial Sequence: Synthetic coding sequence
atggagaagtgcagcgtgggcggcctggagctgacagagcagaccccagccctgctgggcaacatggccatggccaccagcctgatggacattggagacagctttggccacccagcctgccccctggtgagccgcagcaggaacagccctgtggaggatgatgatgatgatgatgatgtggtgttcatcgagagcatccagccccccagcatcagcgccccagccatcgctgaccagaggaacttcatctttgccagcagcaagaatgagaagccccagggcaactacagcgtcatcccccccagcagccgggacctggccagccagaagggcaacatcagcgagaccatcgtgattgatgatgaagaagatattgagaccaacggcggcgctgagaagaagagcagctgcttcatcgagtggggcctgcccggcaccaagaacaagaccaatgacctggacttcagcaccagcagcctgagccgcagcaagaccaagacaggagtgcggcccttcaaccctggccgcatgaatgtggccggggacctcttccagaatggagaatttgccacccaccacagccctgagatgcacctgcagaggcggctgatgtccttcttccagtag

SEQ ID NO: 18584 - DNA, 513 bp, Artificial Sequence
  Description of Artificial Sequence: Synthetic coding sequence
atgaaggagcccctggatggagaatgtgggaaggctgtggtgccccagcaggagctgctggacaagatcaaggaggagccagacaatgcccaggagtatggctgtgtgcagcagcccaagacccaggagagcaagctgaagattggaggagtgtcctctgtgaatgaaagacccatcgcccagcagctgaaccctggcttccagctgagctttgccagcagcggccccagcgtgctgctgcccagcgtgcctgctgtggccatcaaggtgttctgcagcggctgcaagaagatgctgtacaagggccagacagcctaccacaagacaggcagcacccagctgttctgcagcacccgctgcatcaccaggcacagcagccctgcctgcctgcccccaccacccaagaagacctgcaccaactgcagcaagtacaagatcctgaacatccccttctacttcaccttcttcctggtgtgcatcctcttcagcagcaacatcctgctgatcctgtag

SEQ ID NO: 18585 - DNA, 3978 bp, Artificial Sequence
  Description of Artificial Sequence: Synthetic coding sequence
atgaaggagcccctggatggagaatgtgggaaggctgtggtgccccagcaggagctgctggacaagatcaaggaggagccagacaatgcccaggagtatggctgtgtgcagcagcccaagacccaggagagcaagctgaagattggaggagtgtcctctgtgaatgaaagacccatcgcccagcagctgaaccctggcttccagctgagctttgccagcagcggccccagcgtgctgctgcccagcgtgcctgctgtggccatcaaggtgttctgcagcggctgcaagaagatgctgtacaagggccagacagcctaccacaagacaggcagcacccagctgttctgcagcacccgctgcatcaccaggcacagcagccctgcctgcctgcccccaccacccaagaagacctgcaccaactgcagcaaggacatcctgaaccccaaggatgtgatcaccaccaggtttgaaaattcctaccccagcaaggacttctgcagccagagctgcctgagcagctatgagctgaagaagaagcctgtggtgaccatctacaccaagagcatcagcaccaagtgcagcatgtgccagaagaatgctgacaccaggtttgaggtgaagtaccagaatgtggtgcacggcctgtgcagtgatgcctgcttcagcaagttccacagcaccaacaacctgaccatgaactgctgtgagaactgtggcagctactgctacagcagcagcggcccctgccagagccagaaggtgttcagcagcacctctgtgacagcctacaagcagaacagcgcccagatccccccctatgccctgggcaagagcctgcggcccagcgctgagatgattgagaccaccaatgacagcggcaagacagagctgttctgcagcatcaactgcctgagcgcctacagagtgaagacagtgaccagcagtggagtgcaggtgtcctgccacagctgcaagaccagcgccatcccccagtaccacctggccatgagcaatggcaccatctacagcttctgcagcagcagctgtgtggtggccttccagaatgtgttcagcaagcccaagggcaccaacagcagcgctgtgcccctgagccagggccaggtggtggtgtccccacccagcagccgctctgctgtgtccatcggcggcggcaacaccagcgctgtgagccccagcagcatccggggcagcgctgctgccagcctgcagcccctggccgagcagagccagcaggtggccctgacccacacagtggtgaagctgaagtgccagcactgcaaccacctgtttgccaccaagccagagctgctcttctacaagggcaagatgttcctgttctgtgggaagaactgcagtgatgagtacaagaagaagaacaaggtggtggccatgtgtgactactgcaagctgcagaagatcatcaaggagaccgtgcgcttcagcggcgtggacaagcccttctgcagcgaggtgtgcaagttcctgagcgcccgggactttggagagcgctggggcaactactgcaagatgtgcagctactgcagccagaccagccccaacctggtggagaaccggctggagggcaagctggaggagttctgctgtgaggactgcatgagcaagttcaccgtgctcttctaccagatggccaagtgtgatggctgcaagaggcagggcaagctgtctgagagcatcaagtggaggggcaacatcaagcacttctgcaacctcttctgtgtgctggagttctgccaccagcagatcatgaatgactgcctgccccagaacaaggtgaacatcagcaaggccaagacagctgtgacagagctgcccagcgccaggacagacaccacccctgtgatcacctctgtgatgagcctggccaagatcccagccaccctgagcactggaaacaccaacagcgtgctgaagggagctgtgaccaaggaggccgccaagatcatccaggatgagagcacccaggaggatgccatgaagttccccagcagccagagcagccagcccagccggctgctgaagaacaagggcatcagctgcaagcctgtgacccagaccaaggccaccagctgcaagccccacacccagcacaaggagtgccagacagacctgcccatgcccaatgagaagaatgatgctgagctggacagcccccccagcaagaagaagaggctgggcttcttccagacctatgacacagagtacctgaaggtgggcttcatcatctgccccggcagcaaggagagcagcccccggccccagtgtgtgatctgtggggagatcctgagcagcgagaacatgaagccagccaacctgagccaccacctgaagaccaagcacagcgagctggagaacaagcctgtggacttctttgagcagaagagcctggagatggagtgccagaacagcagcctgaagaagtgcctgctggtggagaagagcctggtgaaggccagctacctgattgccttccagacagctgccagcaagaagcccttcagcattgctgaggagctgatcaagccctacctggtggagatgtgcagcgaggtgctgggcagcagcgctggggacaagatgaagaccatccccctgagcaatgtgaccatccagcacagaattgatgagctgtctgctgacatcgaggaccagctgatccagaaggtgcgggagagcaagtggtttgccctgcagattgatgagagcagcgagatcagcaacatcaccctgctgctgtgctacatccgcttcattgattatgactgcagagatgtgaaggaggagctgctcttctgcatcgagatgcccacccagatcactggatttgagatctttgagctgatcaacaagtacatcgacagcaagagcctgaactggaagcactgtgtgggcctgtgcacagatggagctgcctccatgacaggccgctacagcggcctgaaggccaagatccaggaggtggccatgaacacagctgccttcacccactgcttcatccaccgggagcggctggtggccgagaagctgagcccctgcctgcacaagatcctgctgcagagcgcccagatcctgtccttcatcaagagcaatgccctgaacagcaggatgctgaccatcctgtgtgaggagatgggcagcgagcacgtgtccctgcccctgcacgccgaggtgcgctggatcagccggggccgcatgctgaagaggctgtttgagctgcggcatgaaattgagatcttcctgagccagaagcacagcgacctggccaagtacttccatgatgaggagtgggtgggcaagctggcctacctgagtgacatcttcagcctcatcaatgagctgaacctgagcctgcagggcaccctgaccaccttcttcaacctgtgcaacaagattgatgtgttcaagaggaagctgaagatgtggctgaagaggacccaggagaatgactatgacatgttccccagcttcagcgagttcagcaacagcagcggcctgaacatgacagacatcacccgcatcatctttgagcacctggagggcctgagccaggtgttcagtgactgcttccccccagagcaggacctgcggagcggcaacctgtggatcatccaccccttcatgaaccaccagaacaacaacctgacagactttgaggaggagaagctgacagagctgagcagtgacctgggcctgcaggccctcttcaagtctgtgtctgtgacccagttctggatcaatgccaagaccagctacccagagctgcacgagcgggccatgaagttcctgctgcccttcagcacagtgtacctgtgtgatgctgccttcagcgccctgacagagagcaagcagaagaacctgctgggcagcggccctgccctgcggctggccgtgaccagcctcatccccagaattgagaagctggtgaaggagaaggagtag

SEQ ID NO: 18586 - DNA, 513 bp, Artificial Sequence; identical to SEQ ID NO: 18584
  Description of Artificial Sequence: Synthetic coding sequence

SEQ ID NO: 18587 - DNA, 2172 bp, Artificial Sequence
  Description of Artificial Sequence: Synthetic coding sequence
atgaaggagcccctggatggagaatgtgggaaggctgtggtgccccagcaggagctgctggacaagatcaaggaggagccagacaatgcccaggagtatggctgtgtgcagcagcccaagacccaggagagcaagctgaagattggaggagtgtcctctgtgaatgaaagacccatcgcccagcagctgaaccctggcttccagctgagctttgccagcagcggccccagcgtgctgctgcccagcgtgcctgctgtggccatcaaggtgttctgcagcggctgcaagaagatgctgtacaagggccagacagcctaccacaagacaggcagcacccagctgttctgcagcacccgctgcatcaccaggcacagcagccctgcctgcctgcccccaccacccaagaagacctgcaccaactgcagcaaggacatcctgaaccccaaggatgtgatcaccaccaggtttgaaaattcctaccccagcaaggacttctgcagccagagctgcctgagcagctatgagctgaagaagaagcctgtggtgaccatctacaccaagagcatcagcaccaagtgcagcatgtgccagaagaatgctgacaccaggtttgaggtgaagtaccagaatgtggtgcacggcctgtgcagtgatgcctgcttcagcaagttccacagcaccaacaacctgaccatgaactgctgtgagaactgtggcagctactgctacagcagcagcggcccctgccagagccagaaggtgttcagcagcacctctgtgacagcctacaagcagaacagcgcccagatccccccctatgccctgggcaagagcctgcggcccagcgctgagatgattgagaccaccaatgacagcggcaagacagagctgttctgcagcatcaactgcctgagcgcctacagagtgaagacagtgaccagcagtggagtgcaggtgtcctgccacagctgcaagaccagcgccatcccccagtaccacctggccatgagcaatggcaccatctacagcttctgcagcagcagctgtgtggtggccttccagaatgtgttcagcaagcccaagggcaccaacagcagcgctgtgcccctgagccagggccaggtggtggtgtccccacccagcagccgctctgctgtgtccatcggcggcggcaacaccagcgctgtgagccccagcagcatccggggcagcgctgctgccagcctgcagcccctggccgagcagagccagcaggtggccctgacccacacagtggtgaagctgaagtgccagcactgcaaccacctgtttgccaccaagccagagctgctcttctacaagggcaagatgttcctgttctgtgggaagaactgcagtgatgagtacaagaagaagaacaaggtggtggccatgtgtgactactgcaagctgcagaagatcatcaaggagaccgtgcgcttcagcggcgtggacaagcccttctgcagcgaggtgtgcaagttcctgagcgcccgggactttggagagcgctggggcaactactgcaagatgtgcagctactgcagccagaccagccccaacctggtggagaaccggctggagggcaagctggaggagttctgctgtgaggactgcatgagcaagttcaccgtgctcttctaccagatggccaagtgtgatggctgcaagaggcagggcaagctgtctgagagcatcaagtggaggggcaacatcaagcacttctgcaacctcttctgtgtgctggagttctgccaccagcagatcatgaatgactgcctgccccagaacaaggtgaacatcagcaaggccaagacagctgtgacagagctgcccagcgccaggacagacaccacccctgtgatcacctctgtgatgagcctggccaagatcccagccaccctgagcactggaaacaccaacagcgtgctgaagggagctgtgaccaaggaggccgccaagatcatccaggatgagagcacccaggaggatgccatgaagttccccagcagccagagcagccagcccagccggctgctgaagaacaagggcatcagctgcaagcctgtgacccagaccaaggccaccagctgcaagccccacacccagcacaaggagtgccagacagagtgccctgtgcgggctgtgtgctag

SEQ ID NO: 18588 - DNA, 627 bp, Artificial Sequence
  Description of Artificial Sequence: Synthetic coding sequence
atgaaggagcccctggatggagaatgtgggaaggctgtggtgccccagcaggagctgctggacaagatcaaggaggagccagacaatgcccaggagtatggctgtgtgcagcagcccaagacccaggagagcaagctgaagattggaggagtgtcctctgtgaatgaaagacccatcgcccagcagctgaaccctggcttccagctgagctttgccagcagcggccccagcgtgctgctgcccagcgtgcctgctgtggccatcaaggtgttctgcagcggctgcaagaagatgctgtacaagggccagacagcctaccacaagacaggcagcacccagctgttctgcagcacccgctgcatcaccaggcacagcagccctgcctgcctgcccccaccacccaagaagacctgcaccaactgcagcaaggacatcctgaaccccaaggatgtgatcaccaccaggtttgaaaattcctaccccagcaaggacttctgcagccagagctgcctgagcagctatgagctgaagaagaagcctgtggtgaccatctacaccaagagcatcagcaccaagtgcagcatgtgccagaagaatgctgacaccaggtttgaggtgaagtactag

SEQ ID NO: 18589 - DNA, 1689 bp, Artificial Sequence
  Description of Artificial Sequence: Synthetic coding sequence
atgagccgggtgcacggcatgcaccccaaggagaccacccggcagctgagcctggccgtgaaggatggcctgattgtggagaccctgactgtgggctgcaagggcagcaaggccggcatcgagcaggagggctactggctgcctggagatgaaattgactgggagacagaaaatcatgactggtactgctttgagtgccacctgcctggagaggtgctgatctgtgacctgtgcttccgggtgtaccacagcaagtgcctgagtgatgagttccggctgcgggacagcagcagcccctggcagtgccctgtgtgccgcagcatcaagaagaagaacaccaacaagcaggagatgggcacctacctgcgcttcatcgtgtccaggatgaaggagcgggccatcgacctgaacaagaagggcaaggacaacaagcaccccatgtacagaaggctggtgcacagcgctgtggatgtgcccaccatccaggagaaggtgaatgaaggcaagtaccgctcctatgaggagttcaaggcagatgcccagctgctgctgcacaacacagtcatcttctatggagctgacagcgagcaggccgacatcgccaggatgctgtacaaggacacctgccacgagctggatgagctgcagctgtgcaagaactgcttctacctgagcaatgcccggccagacaactggttctgctacccctgcatccccaaccacgagctggtgtgggccaagatgaagggcttcggcttctggccagccaaggtgatgcagaaggaggacaaccaggtggatgtgcgcttcttcggccaccaccaccagagggcctggatccccagcgagaacatccaggacatcaccgtgaacatccaccggctgcacgtgaagaggtccatgggctggaagaaggcctgtgatgagctggagctgcaccagcgcttcctgcgggagggccgcttctggaagagcaagaatgaagatagaggagaggaggaggccgagagcagcatcagcagcaccagcaatgagcagctgaaggtgacccaggagccccgggccaagaagggcagaagaaaccagagcgtggagcccaagaaggaggagcctgagcctgagacagaagctgtgagcagcagccaggagatccccaccatgccccagcccatcgagaaggtgtctgtgtccacccagaccaagaagctgagcgccagcagccccaggatgctgcacaggagcacccagaccaccaatgatggagtgtgccagagcatgtgccacgacaagtacaccaagatcttcaatgacttcaaggacaggatgaagagtgaccacaagcgggagacagagcgggtggtgcgggaggccctggagaagctgcggtctgagatggaggaggagaagaggcaggccgtgaacaaggctgtggccaacatgcagggcgagatggacaggaagtgcaagcaggtgaaggagaagtgcaaggaggagtttgtggaggagatcaagaagctggccacccagcacaagcagctgatcagccagaccaagaagaagcagtggtgctacaactgtgaggaggaggccatgtaccactgctgctggaacaccagctactgcagcatcaagtgccagcaggagcactggcacgccgagcacaagaggacctgcaggaggaagaggtag

SEQ ID NO: 18590 - DNA, 1758 bp, Artificial Sequence
  Description of Artificial Sequence: Synthetic coding sequence
atggtgatcttcaccagcctgcaccgctacgtgatcttcatcagctgcatcatcgtcatcaactggtacatgagccgggtgcacggcatgcaccccaaggagaccacccggcagctgagcctggccgtgaaggatggcctcatcgtggagaccctgactgtgggctgcaagggcagcaaggccggcatcgagcaggagggctactggctgcctggagatgaaattgactgggagacagagaaccacgactggtactgctttgagtgccacctgcccggggaggtgctgatctgtgacctgtgcttccgggtgtaccacagcaagtgcctgagtgatgagttccggctgcgggacagcagcagcccctggcagtgccctgtgtgccgcagcatcaagaagaagaacaccaacaagcaggagatgggcacctacctgcgcttcatcgtgtccaggatgaaggagcgggccatcgacctgaacaagaagggcaaggacaacaagcaccccatgtaccgccgcctggtgcacagcgctgtggatgtgcccaccatccaggagaaggtgaatgaaggcaagtaccgctcctatgaggagttcaaggcagatgcccagctgctgctgcacaacacagtcatcttctacggggctgacagcgagcaggccgacatcgccaggatgctgtacaaggacacctgccacgagctggatgagctgcagctgtgcaagaactgcttctacctgagcaatgcccggccagacaactggttctgctacccctgcatccccaaccacgagctggtgtgggccaagatgaagggcttcggcttctggccagccaaggtgatgcagaaggaggacaaccaggtggatgtgcgcttcttcggccaccaccaccagagggcctggatccccagcgagaacatccaggacatcaccgtgaacatccaccggctgcacgtgaagaggtccatgggctggaagaaggcctgtgatgagctggagctgcaccagcgcttcctgcgggagggccgcttctggaagagcaagaatgaagatagaggagaggaggaggccgagagcagcatcagcagcaccagcaatgagcagctgaaggtgacccaggagccccgggccaagaagggcagaagaaaccagagcgtggagcccaagaaggaggagcctgagcctgagacagaggccgtgagcagcagccaggagatccccaccatgccccagcccatcgagaaggtgtctgtgtccacccagaccaagaagctgagcgccagcagccccaggatgctgcacaggagcacccagaccaccaatgatggagtgtgccagagcatgtgccacgacaagtacaccaagatcttcaatgacttcaaggacaggatgaagagtgaccacaagcgggagacagagcgggtggtgcgggaggccctggagaagctgcggtctgagatggaggaggagaagaggcaggccgtgaacaaggctgtggccaacatgcagggcgagatggacaggaagtgcaagcaggtgaaggagaagtgcaaggaggagtttgtggaggagatcaagaagctggccacccagcacaagcagctgatcagccagaccaagaagaagcagtggtgctacaactgtgaggaggaggccatgtaccactgctgctggaacaccagctactgcagcatcaagtgccagcaggagcactggcatgctgagcacaagaggacctgcaggaggaagaggtag

SEQ ID NO: 18591 - DNA, 1809 bp, Artificial Sequence
  Description of Artificial Sequence: Synthetic coding sequence
atggcccggctgaccaagaggcggcaggccgacaccaaggccatccagcacctgtgggccgccatcgagatcatccggaaccagaagcagatcgccaacatcgaccgcatcaccaagtacatgagccgggtgcacggcatgcaccccaaggagaccacccggcagctgagcctggccgtgaaggatggcctgattgtggagaccctgactgtgggctgcaagggcagcaaggccggcatcgagcaggagggctactggctgcctggagatgaaattgactgggagacagaaaatcatgactggtactgctttgagtgccacctgcctggagaggtgctgatctgtgacctgtgcttccgggtgtaccacagcaagtgcctgagtgatgagttccggctgcgggacagcagcagcccctggcagtgccctgtgtgccgcagcatcaagaagaagaacaccaacaagcaggagatgggcacctacctgcgcttcatcgtgtccaggatgaaggagcgggccatcgacctgaacaagaagggcaaggacaacaagcaccccatgtacagaaggctggtgcacagcgctgtggatgtgcccaccatccaggagaaggtgaatgaaggcaagtaccgctcctatgaggagttcaaggcagatgcccagctgctgctgcacaacacagtcatcttctatggagctgacagcgagcaggccgacatcgccaggatgctgtacaaggacacctgccacgagctggatgagctgcagctgtgcaagaactgcttctacctgagcaatgcccggccagacaactggttctgctacccctgcatccccaaccacgagctggtgtgggccaagatgaagggcttcggcttctggccagccaaggtgatgcagaaggaggacaaccaggtggatgtgcgcttcttcggccaccaccaccagagggcctggatccccagcgagaacatccaggacatcaccgtgaacatccaccggctgcacgtgaagaggtccatgggctggaagaaggcctgtgatgagctggagctgcaccagcgcttcctgcgggagggccgcttctggaagagcaagaatgaagatagaggagaggaggaggccgagagcagcatcagcagcaccagcaatgagcagctgaaggtgacccaggagccccgggccaagaagggcagaagaaaccagagcgtggagcccaagaaggaggagcctgagcctgagacagaagctgtgagcagcagccaggagatccccaccatgccccagcccatcgagaaggtgtctgtgtccacccagaccaagaagctgagcgccagcagccccaggatgctgcacaggagcacccagaccaccaatgatggagtgtgccagagcatgtgccacgacaagtacaccaagatcttcaatgacttcaaggacaggatgaagagtgaccacaagcgggagacagagcgggtggtgcgggaggccctggagaagctgcggtctgagatggaggaggagaagaggcaggccgtgaacaaggctgtggccaacatgcagggcgagatggacaggaagtgcaagcaggtgaaggagaagtgcaaggaggagtttgtggaggagatcaagaagctggccacccagcacaagcagctgatcagccagaccaagaagaagcagtggtgctacaactgtgaggaggaggccatgtaccactgctgctggaacaccagctactgcagcatcaagtgccagcaggagcactggcacgccgagcacaagaggacctgcaggaggaagaggtag

SEQ ID NO: 18592 - DNA, 1587 bp, Artificial Sequence
  Description of Artificial Sequence: Synthetic coding sequence
atgagccgggtgcacggcatgcaccccaaggagaccacccggcagctgagcctggccgtgaaggatggcctgattgtggagaccctgactgtgggctgcaagggcagcaaggccggcatcgagcaggagggctactggctgcctggagatgaaattgactgggagacagaaaatcatgactggtactgctttgagtgccacctgcctggagaggtgctgatctgtgacctgtgcttccgggtgtaccacagcaagtgcctgagtgatgagttccggctgcgggacagcagcagcccctggcagtgccctgtgtgccgcagcatcaagaagaagaacaccaacaagcaggagatgggcacctacctgcgcttcatcgtgtccaggatgaaggagcgggccatcgacctgaacaagaagggcaaggacaacaagcaccccatgtacagaaggctggtgcacagcgctgtggatgtgcccaccatccaggagaaggtgaatgaaggcaagtaccgctcctatgaggagttcaaggcagatgcccagctgctgctgcacaacacagtcatcttctatggagctgacagcgagcaggccgacatcgccaggatgctgtacaaggacacctgccacgagctggatgagctgcagctgtgcaagaactgcttctacctgagcaatgcccggccagacaactggttctgctacccctgcatccccaaccacgagctggtgtgggccaagatgaagggcttcggcttctggccagccaaggtgatgcagaaggaggacaaccaggtggatgtgcgcttcttcggccaccaccaccagagggcctggatccccagcgagaacatccaggacatcaccgtgaacatccaccggctgcacgtgaagaggtccatgggctggaagaaggcctgtgatgagctggagctgcaccagcgcttcctgcgggagggccgcttctggaagagcaagaatgaagatagaggagaggaggaggccgagagcagcatcagcagcaccagcaatgagcagctgaaggtgacccaggagccccgggccaagaagggcagaagaaaccagagcgtggagcccaagaaggaggagcctgagcctgagacagaagctgtgagcagcagccaggagatccccaccatgccccagcccatcgagaaggtgtctgtgtccacccagaccaagaagctgagcgccagcagccccaggatgctgcacaggagcacccagaccaccaatgatggagtgtgccagagcatgtgccacgacaagtacaccaagatcttcaatgacttcaaggacaggatgaagagtgaccacaagcgggagacagagcgggtggtgcgggaggccctggagaagctgcggtctgagatggaggaggagaagaggcaggccgtgaacaaggctgtggccaacatgcagggcgagatggacaggaagtgcaagcaggtgaaggagaagtgcaaggaggagtttgtggaggagatcaagaagctggccacccagcacaagcagctgatcagccagaccaagaagaagcagtgggtgaacaccagcctcttctag

SEQ ID NO: 18593 - DNA, 1689 bp, Artificial Sequence; identical to SEQ ID NO: 18589
  Description of Artificial Sequence: Synthetic coding sequence

SEQ ID NO: 18594 - DNA, 1527 bp, Artificial Sequence
  Description of Artificial Sequence: Synthetic coding sequence
atgagccgggtgcacggcatgcaccccaaggagaccacccggcagctgagcctggccgtgaaggatggcctgattgtggagaccctgactgtgggctgcaagggcagcaaggccggcatcgagcaggagggctactggctgcctggagatgagatcagcatcaagaagaagaacaccaacaagcaggagatgggcacctacctgcgcttcatcgtgtccaggatgaaggagcgggccatcgacctgaacaagaagggcaaggacaacaagcaccccatgtacagaaggctggtgcacagcgctgtggatgtgcccaccatccaggagaaggtgaatgaaggcaagtaccgctcctatgaggagttcaaggcagatgcccagctgctgctgcacaacacagtcatcttctatggagctgacagcgagcaggccgacatcgccaggatgctgtacaaggacacctgccacgagctggatgagctgcagctgtgcaagaactgcttctacctgagcaatgcccggccagacaactggttctgctacccctgcatccccaaccacgagctggtgtgggccaagatgaagggcttcggcttctggccagccaaggtgatgcagaaggaggacaaccaggtggatgtgcgcttcttcggccaccaccaccagagggcctggatccccagcgagaacatccaggacatcaccgtgaacatccaccggctgcacgtgaagaggtccatgggctggaagaaggcctgtgatgagctggagctgcaccagcgcttcctgcgggagggccgcttctggaagagcaagaatgaagatagaggagaggaggaggccgagagcagcatcagcagcaccagcaatgagcagctgaaggtgacccaggagccccgggccaagaagggcagaagaaaccagagcgtggagcccaagaaggaggagcctgagcctgagacagaagctgtgagcagcagccaggagatccccaccatgccccagcccatcgagaaggtgtctgtgtccacccagaccaagaagctgagcgccagcagccccaggatgctgcacaggagcacccagaccaccaatgatggagtgtgccagagcatgtgccacgacaagtacaccaagatcttcaatgacttcaaggacaggatgaagagtgaccacaagcgggagacagagcgggtggtgcgggaggccctggagaagctgcggtctgagatggaggaggagaagaggcaggccgtgaacaaggctgtggccaacatgcagggcgagatggacaggaagtgcaagcaggtgaaggagaagtgcaaggaggagtttgtggaggagatcaagaagctggccacccagcacaagcagctgatcagccagaccaagaagaagcagtggtgctacaactgtgaggaggaggccatgtaccactgctgctggaacaccagctactgcagcatcaagtgccagcaggagcactggcacgccgagcacaagaggacctgcaggaggaagaggtag

SEQ ID NO: 18595 - DNA, 1554 bp, Artificial Sequence
  Description of Artificial Sequence: Synthetic coding sequence
atggcccggctgaccaagaggcggcaggccgacaccaaggccatccagcacctgtgggccgccatcgagatcatccggaaccagaagcagatcgccaacatcgaccgcatcaccaagtacatgagccgggtgcacggcatgcaccccaaggagaccacccggcagctgagcctggccgtgaaggatggcctgattgtggagaccctgactgtgggctgcaagggcagcaaggccggcatcgagcaggagggctactggctgcctggagatgagatcagcatcaagaagaagaacaccaacaagcaggagatgggcacctacctgcgcttcatcgtgtccaggatgaaggagaggaaggtgaatgaaggcaagtaccgctcctatgaggagttcaaggcagatgcccagctgctgctgcacaacacagtcatcttctacggggctgacagcgagcaggccgacatcgccaggatgctgtacaaggacacctgccacgagctggatgagctgcagctgtgcaagaactgcttctacctgagcaatgcccggccagacaactggttctgctacccctgcatccccaaccacgagctggtgtgggccaagatgaagggcttcggcttctggccagccaaggtgatgcagaaggaggacaaccaggtggatgtgcgcttcttcggccaccaccaccagagggcctggatccccagcgagaacatccaggacatcaccgtgaacatccaccggctgcacgtgaagaggtccatgggctggaagaaggcctgtgatgagctggagctgcaccagcgcttcctgcgggagggccgcttctggaagagcaagaatgaagatagaggagaggaggaggccgagagcagcatcagcagcaccagcaatgagcagctgaaggtgacccaggagccccgggccaagaagggcagaagaaaccagagcgtggagcccaagaaggaggagcctgagcctgagacagaggccgtgagcagcagccaggagatccccaccatgccccagcccatcgagaaggtgtctgtgtccacccagaccaagaagctgagcgccagcagccccaggatgctgcacaggagcacccagaccaccaatgatggagtgtgccagagcatgtgccacgacaagtacaccaagatcttcaatgacttcaaggacaggatgaagagtgaccacaagcgggagacagagcgggtggtgcgggaggccctggagaagctgcggtctgagatggaggaggagaagaggcaggccgtgaacaaggctgtggccaacatgcagggcgagatggacaggaagtgcaagcaggtgaaggagaagtgcaaggaggagtttgtggaggagatcaagaagctggccacccagcacaagcagctgatcagccagaccaagaagaagcagtggtgctacaactgtgaggaggaggccatgtaccactgctgctggaacaccagctactgcagcatcaagtgccagcaggagcactggcatgctgagcacaagaggacctgcaggaggaagaggtag

SEQ ID NO: 18596 - DNA, 1809 bp, Artificial Sequence; identical to SEQ ID NO: 18591
  Description of Artificial Sequence: Synthetic coding sequence

SEQ ID NO: 18597 - DNA, 1569 bp, Artificial Sequence
  Description of Artificial Sequence: Synthetic coding sequence
atggcccggctgaccaagaggcggcaggccgacaccaaggccatccagcacctgtgggccgccatcgagatcatccggaaccagaagcagatcgccaacatcgaccgcatcaccaagtacatgagccgggtgcacggcatgcaccccaaggagaccacccggcagctgagcctggccgtgaaggatggcctgattgtggagaccctgactgtgggctgcaagggcagcaaggccggcatcgagcaggagggctactggctgcctggagatgagatcagcatcaagaagaagaacaccaacaagcaggagatgggcacctacctgcgcttcatcgtgtccaggatgaaggagcgggccatcgacctgaacaagaagggcaaggacaacaagcaccccatgtacagaaggctggtgcacagcgctgtggatgtgcccaccatccaggagaaggtgaatgaaggcaagtaccgctcctatgaggagttcaaggcagatgcccagctgctgctgcacaacacagtcatcttctatggagctgacagcgagcaggccgacatcgccaggatgctgtacaaggacacctgccacgagatccccaaccacgagctggtgtgggccaagatgaagggcttcggcttctggccagccaaggtgatgcagaaggaggacaaccaggtggatgtgcgcttcttcggccaccaccaccagagggcctggatccccagcgagaacatccaggacatcaccgtgaacatccaccggctgcacgtgaagaggtccatgggctggaagaaggcctgtgatgagctggagctgcaccagcgcttcctgcgggagggccgcttctggaagagcaagaatgaagatagaggagaggaggaggccgagagcagcatcagcagcaccagcaatgagcagctgaaggtgacccaggagccccgggccaagaagggcagaagaaaccagagcgtggagcccaagaaggaggagcctgagcctgagacagaagctgtgagcagcagccaggagatccccaccatgccccagcccatcgagaaggtgtctgtgtccacccagaccaagaagctgagcgccagcagccccaggatgctgcacaggagcacccagaccaccaatgatggagtgtgccagagcatgtgccacgacaagtacaccaagatcttcaatgacttcaaggacaggatgaagagtgaccacaagcgggagacagagcgggtggtgcgggaggccctggagaagctgcggtctgagatggaggaggagaagaggcaggccgtgaacaaggctgtggccaacatgcagggcgagatggacaggaagtgcaagcaggtgaaggagaagtgcaaggaggagtttgtggaggagatcaagaagctggccacccagcacaagcagctgatcagccagaccaagaagaagcagtggtgctacaactgtgaggaggaggccatgtaccactgctgctggaacaccagctactgcagcatcaagtgccagcaggagcactggcacgccgagcacaagaggacctgcaggaggaagaggtag

SEQ ID NO: 18598 - DNA, 1704 bp, Artificial Sequence
  Description of Artificial Sequence: Synthetic coding sequence
atggcccggctgaccaagaggcggcaggccgacaccaaggccatccagcacctgtgggccgccatcgagatcatccggaaccagaagcagatcgccaacatcgaccgcatcaccaagtacatgagccgggtgcacggcatgcaccccaaggagaccacccggcagctgagcctggccgtgaaggatggcctgattgtggagaccctgactgtgggctgcaagggcagcaaggccggcatcgagcaggagggctactggctgcctggagatgaaattgactgggagacagaaaatcatgactggtactgctttgagtgccacctgcctggagaggtgctgatctgtgacctgtgcttccgggtgtaccacagcaagtgcctgagtgatgagttccggctgcgggacagcagcagcccctggcagtgccctgtgtgccgcagcatcaagaagaagaacaccaacaagcaggagatgggcacctacctgcgcttcatcgtgtccaggatgaaggagcgggccatcgacctgaacaagaagggcaaggacaacaagcaccccatgtacagaaggctggtgcacagcgctgtggatgtgcccaccatccaggagaaggtgaatgaaggcaagtaccgctcctatgaggagttcaaggcagatgcccagctgctgctgcacaacacagtcatcttctatggagacagcgagcaggccgacatcgccaggatgctgtacaaggacacctgccacgagctggatgagctgcagctgtgcaagaactgcttctacctgagcaatgcccggccagacaactggttctgctacccctgcatccccaaccacgagctggtgtgggccaagatgaagggcttcggcttctggccagccaaggtgatgcagaaggaggacaaccaggtggatgtgcgcttcttcggccaccaccaccagagggcctggatccccagcgagaacatccaggacatcaccgtgaacatccaccggctgcacgtgaagaggtccatgggctggaagaaggcctgtgatgagctggagctgcaccagcgcttcctgcgggagggccgcttctggaagagcaagaatgaagatagaggagaggaggaggccgagagcagcatcagcagcaccagcaatgagcagctgaaggtgacccaggagccccgggccaagaagggcagaagaaaccagagcgtggagcccaagaaggaggagcctgagcctgagacagaggccgtgagcagcagccaggagatccccaccatgccccagcccatcgagaaggtgtctgtgtccacccagaccaagaagctgagcgccagcagccccaggatgctgcacaggagcacccagaccaccaatgatggagtgtgccagagcatgtgccacgacaagtacaccaagatcttcaatgacttcaaggacaggatgaagagtgaccacaagcgggagacagagcgggtggtgcgggaggccctggagaagctgcggtctgagatggaggaggagaagaggcaggccgtgaacaaggctgtggccaacatgcagggcgagatggacaggaagtgcaagcaggtgaaggagaagtgcaaggaggagtttgtggaggagatcaagaagctggccacccagcacaagcagctgatcagccagaccaagaagaagcagtgggtgaacaccagcctcttctag

SEQ ID NO: 18599 - DNA, 1194 bp, Artificial Sequence
  Description of Artificial Sequence: Synthetic coding sequence
atgggcacctacctgcgcttcatcgtgtccaggatgaaggagcgggccatcgacctgaacaagaagggcaaggacaacaagcaccccatgtaccgccgcctggtgcacagcgctgtggatgtgcccaccatccaggagctggatgagctgcagctgtgcaagaactgcttctacctgagcaatgcccggccagacaactggttctgctacccctgcatccccaaccacgagctggtgtgggccaagatgaagggcttcggcttctggccagccaaggtgatgcagaaggaggacaaccaggtggatgtgcgcttcttcggccaccaccaccagagggcctggatccccagcgagaacatccaggacatcaccgtgaacatccaccggctgcacgtgaagaggtccatgggctggaagaaggcctgtgatgagctggagctgcaccagcgcttcctgcgggagggccgcttctggaagagcaagaatgaagatagaggagaggaggaggccgagagcagcatcagcagcaccagcaatgagcagctgaaggtgacccaggagccccgggccaagaagggcagaagaaaccagagcgtggagcccaagaaggaggagcctgagcctgagacagaggccgtgagcagcagccaggagatccccaccatgccccagcccatcgagaaggtgtctgtgtccacccagaccaagaagctgagcgccagcagccccaggatgctgcacaggagcacccagaccaccaatgatggagtgtgccagagcatgtgccacgacaagtacaccaagatcttcaatgacttcaaggacaggatgaagagtgaccacaagcgggagacagagcgggtggtgcgggaggccctggagaagctgcggtctgagatggaggaggagaagaggcaggccgtgaacaaggctgtggccaacatgcagggcgagatggacaggaagtgcaagcaggtgaaggagaagtgcaaggaggagtttgtggaggagatcaagaagctggccacccagcacaagcagctgatcagccagaccaagaagaagcagtggtgctacaactgtgaggaggaggccatgtaccactgctgctggaacaccagctactgcagcatcaagtgccagcaggagcactggcatgctgagcacaagaggacctgcaggaggaagaggtag

SEQ ID NO: 18600 - DNA, 1449 bp, Artificial Sequence
  Description of Artificial Sequence: Synthetic coding sequence
atgagccgggtgcacggcatgcaccccaaggagaccacccggcagctgagcctggccgtgaaggatggcctgattgtggagaccctgactgtgggctgcaagggcagcaaggccggcatcgagcaggagggctactggctgcctggagatgagatcagcatcaagaagaagaacaccaacaagcaggagatgggcacctacctgcgcttcatcgtgtccaggatgaaggagcgggccatcgacctgaacaagaagggcaaggacaacaagcaccccatgtacagaaggctggtgcacagcgctgtggatgtgcccaccatccaggagaaggtgaatgaaggcaagtaccgctcctatgaggagttcaaggcagatgcccagctgctgctgcacaacacagtcatcttctatggagctgacagcgagcaggccgacatcgccaggatgctgtacaaggacacctgccacgagatccccaaccacgagctggtgtgggccaagatgaagggcttcggcttctggccagccaaggtgatgcagaaggaggacaaccaggtggatgtgcgcttcttcggccaccaccaccagagggcctggatccccagcgagaacatccaggacatcaccgtgaacatccaccggctgcacgtgaagaggtccatgggctggaagaaggcctgtgatgagctggagctgcaccagcgcttcctgcgggagggccgcttctggaagagcaagaatgaagatagaggagaggaggaggccgagagcagcatcagcagcaccagcaatgagcagctgaaggtgacccaggagccccgggccaagaagggcagaagaaaccagagcgtggagcccaagaaggaggagcctgagcctgagacagaagctgtgagcagcagccaggagatccccaccatgccccagcccatcgagaaggtgtctgtgtccacccagaccaagaagctgagcgccagcagccccaggatgctgcacaggagcacccagaccaccaatgatggagtgtgccagagcatgtgccacgacaagtacaccaagatcttcaatgacttcaaggacaggatgaagagtgaccacaagcgggagacagagcgggtggtgcgggaggccctggagaagctgcggtctgagatggaggaggagaagaggcaggccgtgaacaaggctgtggccaacatgcagggcgagatggacaggaagtgcaagcaggtgaaggagaagtgcaaggaggagtttgtggaggagatcaagaagctggccacccagcacaagcagctgatcagccagaccaagaagaagcagtggtgctacaactgtgaggaggaggccatgtaccactgctgctggaacaccagctactgcagcatcaagtgccagcaggagcactggcacgccgagcacaagaggacctgcaggaggaagaggtag

SEQ ID NO: 18601 - DNA, 3510 bp, Artificial Sequence
  Description of Artificial Sequence: Synthetic coding sequence
atggacatcagcaccaggagcaaggaccccggcagcgctgagaggacagcccagaagaggaagttccccagccccccccacagcagcaatggccacagcccccaggacaccagcaccagccccatcaagaagaagaagaagccaggcctgctgaacagcaacaacaaggagcagagcgagctgcggcacggccccttctactacatgaagcagcccctgaccacagatcctgtggatgtggtgccccaggacggcagaaatgacttctactgctgggtgtgccaccgggagggccaggtgctgtgctgtgagctgtgcccccgggtgtaccacgccaagtgcctgcggctgaccagcgagcctgagggggactggttctgcccagaatgtgagaagatcaccgtggctgaatgtattgagacccagagcaaggccatgaccatgctgaccatcgagcagctgagctacctgctgaagtttgccatccagaagatgaagcagcccggcacagatgccttccagaagcctgtgcccctggagcagcacccagactatgcagagtacatcttccaccccatggacctgtgcaccctggagaagaatgccaagaagaagatgtatggctgcacagaggccttcctggctgatgccaagtggatcctgcacaactgcatcatctacaacggcggcaaccacaagctgacccagatcgccaaggtggtgatcaagatctgtgaacatgagatgaatgaaattgaggtgtgcccagagtgctacctggccgcctgccagaagagggacaactggttctgtgagccctgcagcaacccccaccccctggtgtgggccaagctgaagggcttccccttctggccagccaaggccctgcgggacaaggatggccaggtggatgcccgcttcttcggccagcacgaccgggcctgggtgcccatcaacaactgctacctgatgagcaaggagatccccttctctgtgaagaagaccaagagcatcttcaacagcgccatgcaggagatggaggtgtatgtggagaacatccggaggaagtttggagtcttcaactacagccccttccgcaccccctacacccccaacagccagtaccagatgctgctggaccccaccaaccccagcgctggaacagccaagattgacaagcaggagaaggtgaagctgaactttgacatgacagccagccccaagatcctgatgagcaagcctgtgctgagcggcggcaccggccgccgcatcagcctgagtgacatgcccaggagccccatgagcaccaacagctctgtgcacacaggcagtgatgtggagcaggatgctgagaagaaggccaccagcagccacttcagcgccagcgaggagagcatggacttcctggacaagagcacagccagccctgccagcaccaagacaggccaggccggcagcctgagcggcagccccaagcccttcagcccccagctgagcgcccccatcaccaccaagacagacaagaccagcaccaccggcagcatcctgaacctgaacctgggccacaggagcaaggccgagatggacctgaaggagctgtctgagagcgtgcagcagcagagcacccctgtgcccctcatcagccccaagaggcagatccgcagccgcttccagctgaacctggacaagaccatcgagagctgcaaggcccagctgggcatcaatgagatcagtgaagatgtgtacacagctgtggagcacagcgacagtgaagattctgagaagagtgacagcagtgacagcgagtacatcagtgatgatgagcagaagagcaagaatgaacctgaggacacagaggacaaggagggctgccagatggacaaggagcccagcgctgtgaagaagaagcccaagcccaccaaccctgtggagatcaaggaggagctgaagagcaccagccctgccagcgagaaggctgaccctggagctgtgaaggacaaggccagccctgagcctgagaaggacttcagcgagaaggccaagcccagcccccaccccatcaaggacaagctgaagggcaaggatgaaacagacagccccaccgtgcacctgggcctggacagcgacagcgagagcgagctggtgattgacctgggggaggaccacagcggccgggagggcaggaagaacaagaaggagcccaaggagcccagccccaagcaggatgtggtgggcaagaccccacccagcaccaccgtgggcagccacagccccccagagacccctgtgctgaccaggagcagcgcccagaccagcgctgctggggccacagccaccaccagcaccagcagcacagtgacagtgacagccccagccccagctgccaccggcagccctgtgaagaagcagaggcccctgctgcccaaggagacagccccagctgtgcagagggtggtgtggaacagcagcacagtgcagcagaaggagatcacccagagccccagcaccagcaccatcaccctggtgaccagcacccagagcagccccctggtgaccagcagcggctccatgagcaccctggtgtcctctgtgaatgctgacctgcccatcgccacagccagcgcagatgtggccgctgacatcgccaagtacaccagcaagatgatggatgccatcaagggcaccatgacagagatctacaatgacctgagcaagaacaccaccggcagcaccatcgccgagatccggcggctgcgcatcgagattgagaagctgcagtggctgcaccagcaggagctgtctgagatgaagcacaacctggagctgaccatggccgagatgaggcagagcctggagcaggagcgggaccggctgattgctgaggtgaagaagcagctggagctggagaagcagcaggccgtggatgagaccaagaagaagcagtggtgtgccaactgcaagaaggaggccatcttctactgctgctggaacaccagctactgtgactacccctgccagcaggcccactggccagagcacatgaagagctgcacccagagcgccacagccccccagcaggaggctgatgctgaggtgaacacagagaccctgaacaagagcagccagggcagcagcagcagcacccagagcgcccccagcgagacagccagcgccagcaaggagaaggagaccagcgctgagaagagcaaggagagcggcagcaccctggacctgagcggcagccgggagacccccagcagcatcctgctgggcagcaaccagggctctgtgtccaagagatgtgacaagcagcctgcctatgcccccaccaccacagaccaccagccccaccccaactacccagcccagaagtaccacagccgcagcaacaagagctcctggagcagcagtgatgagaagaggggcagcaccaggagtgaccacaacaccagcaccagcaccaagagcctgctgcccaaggagagccggctggacaccttctgggactag

SEQ ID NO: 18602 - DNA, 3561 bp, Artificial Sequence
  Description of Artificial Sequence: Synthetic coding sequence
atggacatcagcaccaggagcaaggaccccggcagcgctgagaggacagcccagaagaggaagttccccagccccccccacagcagcaatggccacagcccccaggacaccagcaccagccccatcaagaagaagaagaagccaggcctgctgaacagcaacaacaaggagcagagcgagctgcggcacggccccttctactacatgaagcagcccctgaccacagatcctgtggatgtggtgccccaggacggcagaaatgacttctactgctgggtgtgccaccgggagggccaggtgctgtgctgtgagctgtgcccccgggtgtaccacgccaagtgcctgcggctgaccagcgagcctgagggggactggttctgcccagaatgtgagaagatcaccgtggctgaatgtattgagacccagagcaaggccatgaccatgctgaccatcgagcagctgagctacctgctgaagtttgccatccagaagatgaagcagcccggcacagatgccttccagaagcctgtgcccctggagcagcacccagactatgcagagtacatcttccaccccatggacctgtgcaccctggagaagaatgccaagaagaagatgtatggctgcacagaggccttcctggctgatgccaagtggatcctgcacaactgcatcatctacaacggcggcaaccacaagctgacccagatcgccaaggtggtgatcaagatctgtgaacatgagatgaatgaaattgaggtgtgcccagagtgctacctggccgcctgccagaagagggacaactggttctgtgagccctgcagcaacccccaccccctggtgtgggccaagctgaagggcttccccttctggccagccaaggccctgcgggacaaggatggccaggtggatgcccgcttcttcggccagcacgaccgggcctgggtgcccatcaacaactgctacctgatgagcaaggagatccccttctctgtgaagaagaccaagagcatcttcaacagcgccatgcaggagatggaggtgtatgtggagaacatccggaggaagtttggagtcttcaactacagccccttccgcaccccctacacccccaacagccagtaccagatgctgctggaccccaccaaccccagcgctggaacagccaagattgacaagcaggagaaggtgaagctgaactttgacatgacagccagccccaagatcctgatgagcaagcctgtgctgagcggcggcaccggccgccgcatcagcctgagtgacatgcccaggagccccatgagcaccaacagctctgtgcacacaggcagtgatgtggagcaggatgctgagaagaaggccaccagcagccacttcagcgccagcgaggagagcatggacttcctggacaagagcacagccagccctgccagcaccaagacaggccaggccggcagcctgagcggcagccccaagcccttcagcccccagctgagcgcccccatcaccaccaagacagacaagaccagcaccaccggcagcatcctgaacctgaacctggacaggagcaaggccgagatggacctgaaggagctgtctgagagcgtgcagcagcagagcacccctgtgcccctcatcagccccaagaggcagatccgcagccgcttccagctgaacctggacaagaccatcgagagctgcaaggcccagctgggcatcaatgagatcagtgaagatgtgtacacagctgtggagcacagcgacagcgaggacagcgagaagagtgacagcagtgacagcgagtacatcagtgatgatgagcagaagagcaagaatgaacctgaggacacagaggacaaggagggctgccagatggacaaggagcccagcgctgtgaagaagaagcccaagcccaccaaccctgtggagatcaaggaggagctgaagagcaccagccctgccagcgagaaggctgaccccggggctgtgaaggacaaggccagccctgagcctgagaaggacttcagcgagaaggccaagcccagcccccaccccatcaaggacaagctgaagggcaaggatgaaacagacagccccaccgtgcacctgggcctggacagcgacagcgagagcgagctggtgattgacctgggggaggaccacagcggccgggagggcaggaagaacaagaaggagcccaaggagcccagccccaagcaggatgtggtgggcaagaccccacccagcaccaccgtgggcagccacagccccccagagacccctgtgctgaccaggagcagcgcccagaccagcgctgctggggccacagccaccaccagcaccagcagcacagtgacagtgacagccccagccccagctgccaccggcagccctgtgaagaagcagaggcccctgctgcccaaggagacagccccagctgtgcagagggtggtgtggaacagcagcagcaagttccagaccagcagccagaagtggcacatgcagaagatgcagaggcagcagcagcagcagcagcagcagaaccagcagcagcagccccagagcagccagggcacccgctaccagacccggcaggccgtgaaggctgtgcagcagaaggagatcacccagagccccagcaccagcaccatcaccctggtgaccagcacccagagcagccccctggtgaccagcagcggctccatgagcaccctggtgtcctctgtgaatgctgacctgcccatcgccacagccagcgcagatgtggccgctgacatcgccaagtacaccagcaagatgatggatgccatcaagggcaccatgacagagatctacaatgacctgagcaagaacaccaccggcagcaccatcgccgagatccggcggctgagaattgaaattgagaagctgcagtggctgcaccagcaggagctgtctgagatgaagcacaacctggagctgaccatggccgagatgaggcagagcctggagcaggagcgggaccggctgattgctgaggtgaagaagcagctggagctggagaagcagcaggccgtggatgagaccaagaagaagcagtggtgtgccaactgcaagaaggaggccatcttctactgctgctggaacaccagctactgtgactacccctgccagcaggcccactggccagagcacatgaagagctgcacccagagcgccacagccccccagcaggaggctgatgctgaggtgaacacagagaccctgaacaagagcagccagggcagcagcagcagcacccagagcgcccccagcgagacagccagcgccagcaaggagaaggagaccagcgctgagaagagcaaggagagcggcagcaccctggacctgagcggcagccgggagacccccagcagcatcctgctgggcagcaaccagggcagtgaccacagccgcagcaacaagagctcctggagcagcagtgatgagaagaggggcagcaccaggagtgaccacaacaccagcaccagcaccaagagcctgctgcccaaggagagccggctggacaccttctgggactag

SEQ ID NO: 18603 - DNA, 3483 bp, Artificial Sequence
  Description of Artificial Sequence: Synthetic coding sequence
atgcacccccagagcctggccgaggaggagatcaagacagagcaggaggtggtggagggcatggacatcagcaccaggagcaaggaccccggcagcgctgagaggacagcccagaagaggaagttccccagccccccccacagcagcaatggccacagcccccaggacaccagcaccagccccatcaagaagaagaagaagccaggcctgctgaacagcaacaacaaggagcagagcgagctgcggcacggccccttctactacatgaagcagcccctgaccacagatcctgtggatgtggtgccccaggacggcagaaatgacttctactgctgggtgtgccaccgggagggccaggtgctgtgctgtgagctgtgcccccgggtgtaccacgccaagtgcctgcggctgaccagcgagcctgagggggactggttctgcccagaatgtgagaagatcaccgtggctgaatgtattgagacccagagcaaggccatgaccatgctgaccatcgagcagctgagctacctgctgaagtttgccatccagaagatgaagcagcccggcacagatgccttccagaagcctgtgcccctggagcagcacccagactatgcagagtacatcttccaccccatggacctgtgcaccctggagaagaatgccaagaagaagatgtatggctgcacagaggccttcctggctgatgccaagtggatcctgcacaactgcatcatctacaacggcggcaaccacaagctgacccagatcgccaaggtggtgatcaagatctgtgaacatgagatgaatgaaattgaggtgtgcccagagtgctacctggccgcctgccagaagagggacaactggttctgtgagccctgcagcaacccccaccccctggtgtgggccaagctgaagggcttccccttctggccagccaaggccctgcgggacaaggatggccaggtggatgcccgcttcttcggccagcacgaccgggcctgggtgcccatcaacaactgctacctgatgagcaaggagatccccttctctgtgaagaagaccaagagcatcttcaacagcgccatgcaggagatggaggtgtatgtggagaacatccggaggaagtttggagtcttcaactacagccccttccgcaccccctacacccccaacagccagtaccagatgctgctggaccccaccaaccccagcgctggaacagccaagattgacaagcaggagaaggtgaagctgaactttgacatgacagccagccccaagatcctgatgagcaagcctgtgctgagcggcggcaccggccgccgcatcagcctgagtgacatgcccaggagccccatgagcaccaacagctctgtgcacacaggcagtgatgtggagcaggatgctgagaagaaggccaccagcagccacttcagcgccagcgaggagagcatggacttcctggacaagagcacagccagccctgccagcaccaagacaggccaggccggcagcctgagcggcagccccaagcccttcagcccccagctgagcgcccccatcaccaccaagacagacaagaccagcaccaccggcagcatcctgaacctgaacctggacaggagcaaggccgagatggacctgaaggagctgtctgagagcgtgcagcagcagagcacccctgtgcccctcatcagccccaagaggcagatccgcagccgcttccagctgaacctggacaagaccatcgagagctgcaaggcccagctgggcatcaatgagatcagtgaagatgtgtacacagctgtggagcacagcgacagcgaggacagcgagaagagtgacagcagtgacagcgagtacatcagtgatgatgagcagaagagcaagaatgaacctgaggacacagaggacaaggagggctgccagatggacaaggagcccagcgctgtgaagaagaagcccaagcccaccaaccctgtggagatcaaggaggagctgaagagcaccagccctgccagcgagaaggctgaccccggggctgtgaaggacaaggccagccctgagcctgagaaggacttcagcgagaaggccaagcccagcccccaccccatcaaggacaagctgaagggcaaggatgaaacagacagccccaccgtgcacctgggcctggacagcgacagcgagagcgagctggtgattgacctgggggaggaccacagcggccgggagggcaggaagaacaagaaggagcccaaggagcccagccccaagcaggatgtggtgggcaagaccccacccagcaccaccgtgggcagccacagccccccagagacccctgtgctgaccaggagcagcgcccagaccagcgctgctggggccacagccaccaccagcaccagcagcacagtgacagtgacagccccagccccagctgccaccggcagccctgtgaagaagcagaggcccctgctgcccaaggagacagccccagctgtgcagagggtggtgtggaacagcagcacagtgcagcagaaggagatcacccagagccccagcaccagcaccatcaccctggtgaccagcacccagagcagccccctggtgaccagcagcggctccatgagcaccctggtgtcctctgtgaatgctgacctgcccatcgccacagccagcgcagatgtggccgctgacatcgccaagtacaccagcaagatgatggatgccatcaagggcaccatgacagagatctacaatgacctgagcaagaacaccaccggcagcaccatcgccgagatccggcggctgagaattgaaattgagaagctgcagtggctgcaccagcaggagctgtctgagatgaagcacaacctggagctgaccatggccgagatgaggcagagcctggagcaggagcgggaccggctgattgctgaggtgaagaagcagctggagctggagaagcagcaggccgtggatgagaccaagaagaagcagtggtgtgccaactgcaagaaggaggccatcttctactgctgctggaacaccagctactgtgactacccctgccagcaggcccactggccagagcacatgaagagctgcacccagagcgccacagccccccagcaggaggctgatgctgaggtgaacacagagaccctgaacaagagcagccagggcagcagcagcagcacccagagcgcccccagcgagacagccagcgccagcaaggagaaggagaccagcgctgagaagagcaaggagagcggcagcaccctggacctgagcggcagccgggagacccccagcagcatcctgctgggcagcaaccagggcagtgaccacagccgcagcaacaagagctcctggagcagcagtgatgagaagaggggcagcaccaggagtgaccacaacaccagcaccagcaccaagagcctgctgcccaaggagagccggctggacaccttctgggactag

SEQ ID NO: 18604 - DNA, 3645 bp, Artificial Sequence
  Description of Artificial Sequence: Synthetic coding sequence
atggacatcagcaccaggagcaaggaccccggcagcgctgagaggacagcccagaagaggaagttccccagccccccccacagcagcaatggccacagcccccaggacaccagcaccagccccatcaagaagaagaagaagccaggcctgctgaacagcaacaacaaggagcagagcgagctgcggcacggccccttctactacatgaagcagcccctgaccacagatcctgtggatgtggtgccccaggacggcagaaatgacttctactgctgggtgtgccaccgggagggccaggtgctgtgctgtgagctgtgcccccgggtgtaccacgccaagtgcctgcggctgaccagcgagcctgagggggactggttctgcccagaatgtgagaagatcaccgtggctgaatgtattgagacccagagcaaggccatgaccatgctgaccatcgagcagctgagctacctgctgaagtttgccatccagaagatgaagcagcccggcacagatgccttccagaagcctgtgcccctggagcagcacccagactatgcagagtacatcttccaccccatggacctgtgcaccctggagaagaatgccaagaagaagatgtatggctgcacagaggccttcctggctgatgccaagtggatcctgcacaactgcatcatctacaacggcggcaaccacaagctgacccagatcgccaaggtggtgatcaagatctgtgaacatgagatgaatgaaattgaggtgtgcccagagtgctacctggccgcctgccagaagagggacaactggttctgtgagccctgcagcaacccccaccccctggtgtgggccaagctgaagggcttccccttctggccagccaaggccctgcgggacaaggatggccaggtggatgcccgcttcttcggccagcacgaccgggcctgggtgcccatcaacaactgctacctgatgagcaaggagatccccttctctgtgaagaagaccaagagcatcttcaacagcgccatgcaggagatggaggtgtatgtggagaacatccggaggaagtttggagtcttcaactacagccccttccgcaccccctacacccccaacagccagtaccagatgctgctggaccccaccaaccccagcgctggaacagccaagattgacaagcaggagaaggtgaagctgaactttgacatgacagccagccccaagatcctgatgagcaagcctgtgctgagcggcggcaccggccgccgcatcagcctgagtgacatgcccaggagccccatgagcaccaacagctctgtgcacacaggcagtgatgtggagcaggatgctgagaagaaggccaccagcagccacttcagcgccagcgaggagagcatggacttcctggacaagagcacagccagccctgccagcaccaagacaggccaggccggcagcctgagcggcagccccaagcccttcagcccccagctgagcgcccccatcaccaccaagacagacaagaccagcaccaccggcagcatcctgaacctgaacctggacaggagcaaggccgagatggacctgaaggagctgtctgagagcgtgcagcagcagagcacccctgtgcccctcatcagccccaagaggcagatccgcagccgcttccagctgaacctggacaagaccatcgagagctgcaaggcccagctgggcatcaatgagatcagtgaagatgtgtacacagctgtggagcacagcgacagcgaggacagcgagaagagtgacagcagtgacagcgagtacatcagtgatgatgagcagaagagcaagaatgaacctgaggacacagaggacaaggagggctgccagatggacaaggagcccagcgctgtgaagaagaagcccaagcccaccaaccctgtggagatcaaggaggagctgaagagcaccagccctgccagcgagaaggctgaccccggggctgtgaaggacaaggccagccctgagcctgagaaggacttcagcgagaaggccaagcccagcccccaccccatcaaggacaagctgaagggcaaggatgaaacagacagccccaccgtgcacctgggcctggacagcgacagcgagagcgagctggtgattgacctgggggaggaccacagcggccgggagggcaggaagaacaagaaggagcccaaggagcccagccccaagcaggatgtggtgggcaagaccccacccagcaccaccgtgggcagccacagccccccagagacccctgtgctgaccaggagcagcgcccagaccagcgctgctggggccacagccaccaccagcaccagcagcacagtgacagtgacagccccagccccagctgccaccggcagccctgtgaagaagcagaggcccctgctgcccaaggagacagccccagctgtgcagagggtggtgtggaacagcagcagcaagttccagaccagcagccagaagtggcacatgcagaagatgcagaggcagcagcagcagcagcagcagcagaaccagcagcagcagccccagagcagccagggcacccgctaccagacccggcaggccgtgaaggctgtgcagcagaaggagatcacccagagccccagcaccagcaccatcaccctggtgaccagcacccagagcagccccctggtgaccagcagcggctccatgagcaccctggtgtcctctgtgaatgctgacctgcccatcgccacagccagcgcagatgtggccgctgacatcgccaagtacaccagcaagatgatggatgccatcaagggcaccatgacagagatctacaatgacctgagcaagaacaccaccggcagcaccatcgccgagatccggcggctgagaattgaaattgagaagctgcagtggctgcaccagcaggagctgtctgagatgaagcacaacctggagctgaccatggccgagatgaggcagagcctggagcaggagcgggaccggctgattgctgaggtgaagaagcagctggagctggagaagcagcaggccgtggatgagaccaagaagaagcagtggtgtgccaactgcaagaaggaggccatcttctactgctgctggaacaccagctactgtgactacccctgccagcaggcccactggccagagcacatgaagagctgcacccagagcgccacagccccccagcaggaggctgatgctgaggtgaacacagagaccctgaacaagagcagccagggcagcagcagcagcacccagagcgcccccagcgagacagccagcgccagcaaggagaaggagaccagcgctgagaagagcaaggagagcggcagcaccctggacctgagcggcagccgggagacccccagcagcatcctgctgggcagcaaccagggctctgtgtccaagagatgtgacaagcagcctgcctatgcccccaccaccacagaccaccagccccaccccaactacccagcccagaagtaccacagccgcagcaacaagagctcctggagcagcagtgatgagaagaggggcagcaccaggagtgaccacaacaccagcaccagcaccaagagcctgctgcccaaggagagccggctggacaccttctgggactag

SEQ ID NO: 18605 - DNA, 3408 bp, Artificial Sequence
  Description of Artificial Sequence: Synthetic coding sequence
atgcacccccagagcctggccgaggaggagatcaagacagagcaggaggtggtggagggcatggacatcagcaccaggagcaaggaccccggcagcgctgagaggacagcccagaagaggaagttccccagccccccccacagcagcaatggccacagcccccaggacaccagcaccagccccatcaagaagaagaagaagccaggcctgctgaacagcaacaacaaggagcaggatggaagaaatgacttctactgctgggtgtgccaccgggagggccaggtgctgtgctgtgagctgtgcccccgggtgtaccacgccaagtgcctgcggctgaccagcgagcctgagggggactggttctgcccagaatgtgagaagatcaccgtggccgagtgcatcgagacccagagcaaggccatgaccatgctgaccatcgagcagctgagctacctgctgaagtttgccatccagaagatgaagcagcctggaacagatgccttccagaagcctgtgcccctggagcagcacccagactatgcagagtacatcttccaccccatggacctgtgcaccctggagaagaatgccaagaagaagatgtatggctgcacagaggccttcctggctgatgccaagtggatcctgcacaactgcatcatctacaatggaggcaaccacaagctgacccagatcgccaaggtggtgatcaagatctgtgagcacgagatgaatgaaattgaggtgtgcccagagtgctacctggccgcctgccagaagagggacaactggttctgtgagccctgcagcaacccccaccccctggtgtgggccaagctgaagggcttccccttctggccagccaaggccctgcgggacaaggatggccaggtggatgcccgcttcttcggccagcacgaccgggcctgggtgcccatcaacaactgctacctgatgagcaaggagatccccttctctgtgaagaagaccaagagcatcttcaacagcgccatgcaggagatggaggtgtatgtggagaacatccggaggaagtttggagtcttcaactacagccccttccgcaccccctacacccccaacagccagtaccagatgctgctggaccccaccaaccccagcgctggaacagccaagattgacaagcaggagaaggtgaagctgaactttgacatgacagccagccccaagatcctgatgagcaagcctgtgctgagcggcggcactggaagacgcatcagcctgagtgacatgcccaggagccccatgagcaccaacagctctgtgcacactggaagtgatgtggagcaggatgctgagaagaaggccaccagcagccacttcagcgccagcgaggagagcatggacttcctggacaagagcacagccagccctgccagcaccaagacaggccaggccggcagcctgagcggcagccccaagcccttcagcccccagctgagcgcccccatcaccaccaagacagacaagaccagcaccaccggcagcatcctgaacctgaacctggacaggagcaaggccgagatggacctgaaggagctgtctgagagcgtgcagcagcagagcacccctgtgcccctcatcagccccaagaggcagatccgcagccgcttccagctgaacctggacaagaccatcgagagctgcaaggcccagctgggcatcaatgagatcagtgaagatgtgtacacagctgtggagcacagcgacagtgaagattctgagaagagtgacagcagtgacagcgagtacatcagtgatgatgagcagaagagcaagaatgaacctgaggacacagaggacaaggagggctgccagatggacaaggagcccagcgctgtgaagaagaagcccaagcccaccaaccctgtggagatcaaggaggagctgaagagcaccagccctgccagcgagaaggctgaccctggagctgtgaaggacaaggccagccctgagcctgagaaggacttcagcgagaaggccaagcccagcccccaccccatcaaggacaagctgaagggcaaggatgaaacagacagccccaccgtgcacctgggcctggacagcgacagcgagagcgagctggtgattgacctgggggaggaccacagcggccgggagggcaggaagaacaagaaggagcccaaggagcccagccccaagcaggatgtggtgggcaagaccccacccagcaccaccgtgggcagccacagccccccagagacccctgtgctgaccaggagcagcgcccagaccagcgctgctggggccacagccaccaccagcaccagcagcacagtgacagtgacagccccagccccagctgccaccggcagccctgtgaagaagcagaggcccctgctgcccaaggagacagccccagctgtgcagagggtggtgtggaacagcagcacagtgcagcagaaggagatcacccagagccccagcaccagcaccatcaccctggtgaccagcacccagagcagccccctggtgaccagcagcggctccatgagcaccctggtgtcctctgtgaatgctgacctgcccatcgccacagccagcgcagatgtggccgctgacatcgccaagtacaccagcaagatgatggatgccatcaagggcaccatgacagagatctacaatgacctgagcaagaacaccaccggcagcaccatcgccgagatccggcggctgcgcatcgagattgagaagctgcagtggctgcaccagcaggagctgtctgagatgaagcacaacctggagctgaccatggccgagatgaggcagagcctggagcaggagcgggaccggctgattgctgaggtgaagaagcagctggagctggagaagcagcaggccgtggatgagaccaagaagaagcagtggtgtgccaactgcaagaaggaggccatcttctactgctgctggaacaccagctactgtgactacccctgccagcaggcccactggccagagcacatgaagagctgcacccagagcgccacagccccccagcaggaggctgatgctgaggtgaacacagagaccctgaacaagagcagccagggcagcagcagcagcacccagagcgcccccagcgagacagccagcgccagcaaggagaaggagaccagcgctgagaagagcaaggagagcggcagcaccctggacctgagcggcagccgggagacccccagcagcatcctgctgggcagcaaccagggcagtgaccacagccgcagcaacaagagctcctggagcagcagtgatgagaagaggggcagcaccaggagtgaccacaacaccagcaccagcaccaagagcctgctgcccaaggagagccggctggacaccttctgggactag

SEQ ID NO: 18606 - DNA, 3411 bp, Artificial Sequence
  Description of Artificial Sequence: Synthetic coding sequence
atgcacccccagagcctggccgaggaggagatcaagacagagcaggaggtggtggagggcatggacatcagcaccaggagcaaggaccccggcagcgctgagaggacagcccagaagaggaagttccccagccccccccacagcagcaatggccacagcccccaggacaccagcaccagccccatcaagaagaagaagaagccaggcctgctgaacagcaacaacaaggagcaggatggaagaaatgacttctactgctgggtgtgccaccgggagggccaggtgctgtgctgtgagctgtgcccccgggtgtaccacgccaagtgcctgcggctgaccagcgagcctgagggggactggttctgcccagaatgtgagaagatcaccgtggccgagtgcatcgagacccagagcaaggccatgaccatgctgaccatcgagcagctgagctacctgctgaagtttgccatccagaagatgaagcagcctggaacagatgccttccagaagcctgtgcccctggagcagcacccagactatgcagagtacatcttccaccccatggacctgtgcaccctggagaagaatgccaagaagaagatgtatggctgcacagaggccttcctggctgatgccaagtggatcctgcacaactgcatcatctacaatggaggcaaccacaagctgacccagatcgccaaggtggtgatcaagatctgtgagcacgagatgaatgaaattgaggtgtgcccagagtgctacctggccgcctgccagaagagggacaactggttctgtgagccctgcagcaacccccaccccctggtgtgggccaagctgaagggcttccccttctggccagccaaggccctgcgggacaaggatggccaggtggatgcccgcttcttcggccagcacgaccgggcctgggtgcccatcaacaactgctacctgatgagcaaggagatccccttctctgtgaagaagaccaagagcatcttcaacagcgccatgcaggagatggaggtgtatgtggagaacatccggaggaagtttggagtcttcaactacagccccttccgcaccccctacacccccaacagccagtaccagatgctgctggaccccaccaaccccagcgctggaacagccaagattgacaagcaggagaaggtgaagctgaactttgacatgacagccagccccaagatcctgatgagcaagcctgtgctgagcggcggcactggaagacgcatcagcctgagtgacatgcccaggagccccatgagcaccaacagctctgtgcacactggaagtgatgtggagcaggatgctgagaagaaggccaccagcagccacttcagcgccagcgaggagagcatggacttcctggacaagagcacagccagccctgccagcaccaagacaggccaggccggcagcctgagcggcagccccaagcccttcagcccccagctgagcgcccccatcaccaccaagacagacaagaccagcaccaccggcagcatcctgaacctgaacctggacaggagcaaggccgagatggacctgaaggagctgtctgagagcgtgcagcagcagagcacccctgtgcccctcatcagccccaagaggcagatccgcagccgcttccagctgaacctggacaagaccatcgagagctgcaaggcccagctgggcatcaatgagatcagtgaagatgtgtacacagctgtggagcacagcgacagtgaagattctgagaagagtgacagcagtgacagcgagtacatcagtgatgatgagcagaagagcaagaatgaacctgaggacacagaggacaaggagggctgccagatggacaaggagcccagcgctgtgaagaagaagcccaagcccaccaaccctgtggagatcaaggaggagctgaagagcaccagccctgccagcgagaaggctgaccctggagctgtgaaggacaaggccagccctgagcctgagaaggacttcagcgagaaggccaagcccagcccccaccccatcaaggacaagctgaagggcaaggatgaaacagacagccccaccgtgcacctgggcctggacagcgacagcgagagcgagctggtgattgacctgggggaggaccacagcggccgggagggcaggaagaacaagaaggagcccaaggagcccagccccaagcaggatgtggtgggcaagaccccacccagcaccaccgtgggcagccacagccccccagagacccctgtgctgaccaggagcagcgcccagaccagcgctgctggggccacagccaccaccagcaccagcagcacagtgacagtgacagccccagccccagctgccaccggcagccctgtgaagaagcagaggcccctgctgcccaaggagacagccccagctgtgcagagggtggtgtggaacagcagcacagtgcagcagaaggagatcacccagagccccagcaccagcaccatcaccctggtgaccagcacccagagcagccccctggtgaccagcagcggctccatgagcaccctggtgtcctctgtgaatgctgacctgcccatcgccacagccagcgcagatgtggccgctgacatcgccaagtacaccagcaagatccggcggctgagaattgaaattgagaagctgcagtggctgcaccagcaggagctgtctgagatgaagcacaacctggagctgaccatggccgagatgaggcagagcctggagcaggagcgggaccggctgattgctgaggtgaagaagcagctggagctggagaagcagcaggccgtggatgagaccaagaagaagcagtggtgtgccaactgcaagaaggaggccatcttctactgctgctggaacaccagctactgtgactacccctgccagcaggcccactggccagagcacatgaagagctgcacccagagcgccacagccccccagcaggaggctgatgctgaggtgaacacagagaccctgaacaagagcagccagggcagcagcagcagcacccagagcgcccccagcgagacagccagcgccagcaaggagaaggagaccagcgctgagaagagcaaggagagcggcagcaccctggacctgagcggcagccgggagacccccagcagcatcctgctgggcagcaaccagggctctgtgtccaagagatgtgacaagcagcctgcctatgcccccaccaccacagaccaccagccccaccccaactacccagcccagaagtaccacagccgcagcaacaagagctcctggagcagcagtgatgagaagaggggcagcaccaggagtgaccacaacaccagcaccagcaccaagagcctgctgcccaaggagagccggctggacaccttctgggactag

SEQ ID NO: 18607 - DNA, 3561 bp, Artificial Sequence
  Description of Artificial Sequence: Synthetic coding sequence
atgttcagcagcctgcagaagagcttcaacctggccgaggaggagatcaagacagagcaggaggtggtggagggcatggacatcagcaccaggagcaaggaccccggcagcgctgagaggacagcccagaagaggaagttccccagccccccccacagcagcaatggccacagcccccaggacaccagcaccagccccatcaagaagaagaagaagccaggcctgctgaacagcaacaacaaggagcaggacggcagaaatgacttctactgctgggtgtgccaccgggagggccaggtgctgtgctgtgagctgtgcccccgggtgtaccacgccaagtgcctgcggctgaccagcgagcctgagggggactggttctgcccagaatgtgagaagatcaccgtggctgaatgtattgagacccagagcaaggccatgaccatgctgaccatcgagcagctgagctacctgctgaagtttgccatccagaagatgaagcagcccggcacagatgccttccagaagcctgtgcccctggagcagcacccagactatgcagagtacatcttccaccccatggacctgtgcaccctggagaagaatgccaagaagaagatgtatggctgcacagaggccttcctggctgatgccaagtggatcctgcacaactgcatcatctacaacggcggcaaccacaagctgacccagatcgccaaggtggtgatcaagatctgtgaacatgagatgaatgaaattgaggtgtgcccagagtgctacctggccgcctgccagaagagggacaactggttctgtgagccctgcagcaacccccaccccctggtgtgggccaagctgaagggcttccccttctggccagccaaggccctgcgggacaaggatggccaggtggatgcccgcttcttcggccagcacgaccgggcctgggtgcccatcaacaactgctacctgatgagcaaggagatccccttctctgtgaagaagaccaagagcatcttcaacagcgccatgcaggagatggaggtgtatgtggagaacatccggaggaagtttggagtcttcaactacagccccttccgcaccccctacacccccaacagccagtaccagatgctgctggaccccaccaaccccagcgctggaacagccaagattgacaagcaggagaaggtgaagctgaactttgacatgacagccagccccaagatcctgatgagcaagcctgtgctgagcggcggcaccggccgccgcatcagcctgagtgacatgcccaggagccccatgagcaccaacagctctgtgcacacaggcagtgatgtggagcaggatgctgagaagaaggccaccagcagccacttcagcgccagcgaggagagcatggacttcctggacaagagcacagccagccctgccagcaccaagacaggccaggccggcagcctgagcggcagccccaagcccttcagcccccagctgagcgcccccatcaccaccaagacagacaagaccagcaccaccggcagcatcctgaacctgaacctggacaggagcaaggccgagatggacctgaaggagctgtctgagagcgtgcagcagcagagcacccctgtgcccctcatcagccccaagaggcagatccgcagccgcttccagctgaacctggacaagaccatcgagagctgcaaggcccagctgggcatcaatgagatcagtgaagatgtgtacacagctgtggagcacagcgacagcgaggacagcgagaagagtgacagcagtgacagcgagtacatcagtgatgatgagcagaagagcaagaatgaacctgaggacacagaggacaaggagggctgccagatggacaaggagcccagcgctgtgaagaagaagcccaagcccaccaaccctgtggagatcaaggaggagctgaagagcaccagccctgccagcgagaaggctgaccccggggctgtgaaggacaaggccagccctgagcctgagaaggacttcagcgagaaggccaagcccagcccccaccccatcaaggacaagctgaagggcaaggatgaaacagacagccccaccgtgcacctgggcctggacagcgacagcgagagcgagctggtgattgacctgggggaggaccacagcggccgggagggcaggaagaacaagaaggagcccaaggagcccagccccaagcaggatgtggtgggcaagaccccacccagcaccaccgtgggcagccacagccccccagagacccctgtgctgaccaggagcagcgcccagaccagcgctgctggggccacagccaccaccagcaccagcagcacagtgacagtgacagccccagccccagctgccaccggcagccctgtgaagaagcagaggcccctgctgcccaaggagacagccccagctgtgcagagggtggtgtggaacagcagcagcaagttccagaccagcagccagaagtggcacatgcagaagatgcagaggcagcagcagcagcagcagcagcagaaccagcagcagcagccccagagcagccagggcacccgctaccagacccggcaggccgtgaaggctgtgcagcagaaggagatcacccagagccccagcaccagcaccatcaccctggtgaccagcacccagagcagccccctggtgaccagcagcggctccatgagcaccctggtgtcctctgtgaatgctgacctgcccatcgccacagccagcgcagatgtggccgctgacatcgccaagtacaccagcaagatgatggatgccatcaagggcaccatgacagagatctacaatgacctgagcaagaacaccaccggcagcaccatcgccgagatccggcggctgagaattgaaattgagaagctgcagtggctgcaccagcaggagctgtctgagatgaagcacaacctggagctgaccatggccgagatgaggcagagcctggagcaggagcgggaccggctgattgctgaggtgaagaagcagctggagctggagaagcagcaggccgtggatgagaccaagaagaagcagtggtgtgccaactgcaagaaggaggccatcttctactgctgctggaacaccagctactgtgactacccctgccagcaggcccactggccagagcacatgaagagctgcacccagagcgccacagccccccagcaggaggctgatgctgaggtgaacacagagaccctgaacaagagcagccagggcagcagcagcagcacccagagcgcccccagcgagacagccagcgccagcaaggagaaggagaccagcgctgagaagagcaaggagagcggcagcaccctggacctgagcggcagccgggagacccccagcagcatcctgctgggcagcaaccagggcagtgaccacagccgcagcaacaagagctcctggagcagcagtgatgagaagaggggcagcaccaggagtgaccacaacaccagcaccagcaccaagagcctgctgcccaaggagagccggctggacaccttctgggactag

SEQ ID NO: 18608 - DNA, 75 bp, Artificial Sequence
  Description of Artificial Sequence: Synthetic coding sequence
atggacatcagcaccaggagcaaggaccccggcagcgctgagaggacagcccagaagaggaagttccccagctag

SEQ ID NO: 18609 - DNA, 129 bp, Artificial Sequence
  Description of Artificial Sequence: Synthetic coding sequence
atggacatcagcaccaggagcaaggaccccggcagcgctgagaggacagcccagaagaggaagttccccagccccccccacagcagcaatggccacagcccccaggacaccagcaccagccccatctag

SEQ ID NO: 18610 - DNA, 3318 bp, Artificial Sequence
  Description of Artificial Sequence: Synthetic coding sequence
atggacatcagcaccaggagcaaggaccccggcagcgctgagaggacagcccagaagaggaagttccccagccccccccacagcagcaatggccacagcccccaggacaccagcaccagccccatcaagaagaagaagaagccaggcctgctgaacagcaacaacaaggagcaggatggaagaaatgacttctactgctgggtgtgccaccgggagggccaggtgctgtgctgtgagctgtgcccccgggtgtaccacgccaagtgcctgcggctgaccagcgagcctgagggggactggttctgcccagaatgtgaaacagatgccttccagaagcctgtgcccctggagcagcacccagactatgcagagtacatcttccaccccatggacctgtgcaccctggagaagaatgccaagaagaagatgtatggctgcacagaggccttcctggctgatgccaagtggatcctgcacaactgcatcatctacaatggaggcaaccacaagctgacccagatcgccaaggtggtgatcaagatctgtgagcacgagatgaatgaaattgaggtgtgcccagagtgctacctggccgcctgccagaagagggacaactggttctgtgagccctgcagcaacccccaccccctggtgtgggccaagctgaagggcttccccttctggccagccaaggccctgcgggacaaggatggccaggtggatgcccgcttcttcggccagcacgaccgggcctgggtgcccatcaacaactgctacctgatgagcaaggagatccccttctctgtgaagaagaccaagagcatcttcaacagcgccatgcaggagatggaggtgtatgtggagaacatccggaggaagtttggagtcttcaactacagccccttccgcaccccctacacccccaacagccagtaccagatgctgctggaccccaccaaccccagcgctggaacagccaagattgacaagcaggagaaggtgaagctgaactttgacatgacagccagccccaagatcctgatgagcaagcctgtgctgagcggcggcactggaagacgcatcagcctgagtgacatgcccaggagccccatgagcaccaacagctctgtgcacactggaagtgatgtggagcaggatgctgagaagaaggccaccagcagccacttcagcgccagcgaggagagcatggacttcctggacaagagcacagccagccctgccagcaccaagacaggccaggccggcagcctgagcggcagccccaagcccttcagcccccagctgagcgcccccatcaccaccaagacagacaagaccagcaccaccggcagcatcctgaacctgaacctggacaggagcaaggccgagatggacctgaaggagctgtctgagagcgtgcagcagcagagcacccctgtgcccctcatcagccccaagaggcagatccgcagccgcttccagctgaacctggacaagaccatcgagagctgcaaggcccagctgggcatcaatgagatcagtgaagatgtgtacacagctgtggagcacagcgacagtgaagattctgagaagagtgacagcagtgacagcgagtacatcagtgatgatgagcagaagagcaagaatgaacctgaggacacagaggacaaggagggctgccagatggacaaggagcccagcgctgtgaagaagaagcccaagcccaccaaccctgtggagatcaaggaggagctgaagagcaccagccctgccagcgagaaggctgaccctggagctgtgaaggacaaggccagccctgagcctgagaaggacttcagcgagaaggccaagcccagcccccaccccatcaaggacaagctgaagggcaaggatgaaacagacagccccaccgtgcacctgggcctggacagcgacagcgagagcgagctggtgattgacctgggggaggaccacagcggccgggagggcaggaagaacaagaaggagcccaaggagcccagccccaagcaggatgtggtgggcaagaccccacccagcaccaccgtgggcagccacagccccccagagacccctgtgctgaccaggagcagcgcccagaccagcgctgctggggccacagccaccaccagcaccagcagcacagtgacagtgacagccccagccccagctgccaccggcagccctgtgaagaagcagaggcccctgctgcccaaggagacagccccagctgtgcagagggtggtgtggaacagcagcacagtgcagcagaaggagatcacccagagccccagcaccagcaccatcaccctggtgaccagcacccagagcagccccctggtgaccagcagcggctccatgagcaccctggtgtcctctgtgaatgctgacctgcccatcgccacagccagcgcagatgtggccgctgacatcgccaagtacaccagcaagatgatggatgccatcaagggcaccatgacagagatctacaatgacctgagcaagaacaccaccggcagcaccatcgccgagatccggcggctgcgcatcgagattgagaagctgcagtggctgcaccagcaggagctgtctgagatgaagcacaacctggagctgaccatggccgagatgaggcagagcctggagcaggagcgggaccggctgattgctgaggtgaagaagcagctggagctggagaagcagcaggccgtggatgagaccaagaagaagcagtggtgtgccaactgcaagaaggaggccatcttctactgctgctggaacaccagctactgtgactacccctgccagcaggcccactggccagagcacatgaagagctgcacccagagcgccacagccccccagcaggaggctgatgctgaggtgaacacagagaccctgaacaagagcagccagggcagcagcagcagcacccagagcgcccccagcgagacagccagcgccagcaaggagaaggagaccagcgctgagaagagcaaggagagcggcagcaccctggacctgagcggcagccgggagacccccagcagcatcctgctgggcagcaaccagggctctgtgtccaagagatgtgacaagcagcctgcctatgcccccaccaccacagaccaccagccccaccccaactacccagcccagaagtaccacagccgcagcaacaagagctcctggagcagcagtgatgagaagaggggcagcaccaggagtgaccacaacaccagcaccagcaccaagagcctgctgcccaaggagagccggctggacaccttctgggactag

SEQ ID NO: 18611 - DNA, 3567 bp, Artificial Sequence
  Description of Artificial Sequence: Synthetic coding sequence
atgcacccccagagcctggccgaggaggagatcaagacagagcaggaggtggtggagggcatggacatcagcaccaggagcaaggaccccggcagcgctgagaggacagcccagaagaggaagttccccagccccccccacagcagcaatggccacagcccccaggacaccagcaccagccccatcaagaagaagaagaagccaggcctgctgaacagcaacaacaaggagcagagcgagctgcggcacggccccttctactacatgaagcagcccctgaccacagatcctgtggatgtggtgccccaggacggcagaaatgacttctactgctgggtgtgccaccgggagggccaggtgctgtgctgtgagctgtgcccccgggtgtaccacgccaagtgcctgcggctgaccagcgagcctgagggggactggttctgcccagaatgtgagaagatcaccgtggctgaatgtattgagacccagagcaaggccatgaccatgctgaccatcgagcagctgagctacctgctgaagtttgccatccagaagatgaagcagcccggcacagatgccttccagaagcctgtgcccctggagcagcacccagactatgcagagtacatcttccaccccatggacctgtgcaccctggagaagaatgccaagaagaagatgtatggctgcacagaggccttcctggctgatgccaagtggatcctgcacaactgcatcatctacaacggcggcaaccacaagctgacccagatcgccaaggtggtgatcaagatctgtgaacatgagatgaatgaaattgaggtgtgcccagagtgctacctggccgcctgccagaagagggacaactggttctgtgagccctgcagcaacccccaccccctggtgtgggccaagctgaagggcttccccttctggccagccaaggccctgcgggacaaggatggccaggtggatgcccgcttcttcggccagcacgaccgggcctgggtgcccatcaacaactgctacctgatgagcaaggagatccccttctctgtgaagaagaccaagagcatcttcaacagcgccatgcaggagatggaggtgtatgtggagaacatccggaggaagtttggagtcttcaactacagccccttccgcaccccctacacccccaacagccagtaccagatgctgctggaccccaccaaccccagcgctggaacagccaagattgacaagcaggagaaggtgaagctgaactttgacatgacagccagccccaagatcctgatgagcaagcctgtgctgagcggcggcaccggccgccgcatcagcctgagtgacatgcccaggagccccatgagcaccaacagctctgtgcacacaggcagtgatgtggagcaggatgctgagaagaaggccaccagcagccacttcagcgccagcgaggagagcatggacttcctggacaagagcacagccagccctgccagcaccaagacaggccaggccggcagcctgagcggcagccccaagcccttcagcccccagctgagcgcccccatcaccaccaagacagacaagaccagcaccaccggcagcatcctgaacctgaacctggacaggagcaaggccgagatggacctgaaggagctgtctgagagcgtgcagcagcagagcacccctgtgcccctcatcagccccaagaggcagatccgcagccgcttccagctgaacctggacaagaccatcgagagctgcaaggcccagctgggcatcaatgagatcagtgaagatgtgtacacagctgtggagcacagcgacagcgaggacagcgagaagagtgacagcagtgacagcgagtacatcagtgatgatgagcagaagagcaagaatgaacctgaggacacagaggacaaggagggctgccagatggacaaggagcccagcgctgtgaagaagaagcccaagcccaccaaccctgtggagatcaaggaggagctgaagagcaccagccctgccagcgagaaggctgaccccggggctgtgaaggacaaggccagccctgagcctgagaaggacttcagcgagaaggccaagcccagcccccaccccatcaaggacaagctgaagggcaaggatgaaacagacagccccaccgtgcacctgggcctggacagcgacagcgagagcgagctggtgattgacctgggggaggaccacagcggccgggagggcaggaagaacaagaaggagcccaaggagcccagccccaagcaggatgtggtgggcaagaccccacccagcaccaccgtgggcagccacagccccccagagacccctgtgctgaccaggagcagcgcccagaccagcgctgctggggccacagccaccaccagcaccagcagcacagtgacagtgacagccccagccccagctgccaccggcagccctgtgaagaagcagaggcccctgctgcccaaggagacagccccagctgtgcagagggtggtgtggaacagcagcacagtgcagcagaaggagatcacccagagccccagcaccagcaccatcaccctggtgaccagcacccagagcagccccctggtgaccagcagcggctccatgagcaccctggtgtcctctgtgaatgctgacctgcccatcgccacagccagcgcagatgtggccgctgacatcgccaagtacaccagcaagatgatggatgccatcaagggcaccatgacagagatctacaatgacctgagcaagaacaccaccggcagcaccatcgccgagatccggcggctgagaattgaaattgagaagctgcagtggctgcaccagcaggagctgtctgagatgaagcacaacctggagctgaccatggccgagatgaggcagagcctggagcaggagcgggaccggctgattgctgaggtgaagaagcagctggagctggagaagcagcaggccgtggatgagaccaagaagaagcagtggtgtgccaactgcaagaaggaggccatcttctactgctgctggaacaccagctactgtgactacccctgccagcaggcccactggccagagcacatgaagagctgcacccagagcgccacagccccccagcaggaggctgatgctgaggtgaacacagagaccctgaacaagagcagccagggcagcagcagcagcacccagagcgcccccagcgagacagccagcgccagcaaggagaaggagaccagcgctgagaagagcaaggagagcggcagcaccctggacctgagcggcagccgggagacccccagcagcatcctgctgggcagcaaccagggctctgtgtccaagagatgtgacaagcagcctgcctatgcccccaccaccacagaccaccagccccaccccaactacccagcccagaagtaccacagccgcagcaacaagagctcctggagcagcagtgatgagaagaggggcagcaccaggagtgaccacaacaccagcaccagcaccaagagcctgctgcccaaggagagccggctggacaccttctgggactag

SEQ ID NO: 18612 - DNA, 3291 bp, Artificial Sequence
  Description of Artificial Sequence: Synthetic coding sequence
tgaacagatcctgtggatgtggtgccccaggatggaagaaatgacttctactgctgggtgtgccaccgggagggccaggtgctgtgctgtgagctgtgcccccgggtgtaccacgccaagtgcctgcggctgaccagcgagcctgagggggactggttctgcccagaatgtgagaagatcaccgtggccgagtgcatcgagacccagagcaaggccatgaccatgctgaccatcgagcagctgagctacctgctgaagtttgccatccagaagatgaagcagcctggaacagatgccttccagaagcctgtgcccctggagcagcacccagactatgcagagtacatcttccaccccatggacctgtgcaccctggagaagaatgccaagaagaagatgtatggctgcacagaggccttcctggctgatgccaagtggatcctgcacaactgcatcatctacaatggaggcaaccacaagctgacccagatcgccaaggtggtgatcaagatctgtgagcacgagatgaatgaaattgaggtgtgcccagagtgctacctggccgcctgccagaagagggacaactggttctgtgagccctgcagcaacccccaccccctggtgtgggccaagctgaagggcttccccttctggccagccaaggccctgcgggacaaggatggccaggtggatgcccgcttcttcggccagcacgaccgggcctgggtgcccatcaacaactgctacctgatgagcaaggagatccccttctctgtgaagaagaccaagagcatcttcaacagcgccatgcaggagatggaggtgtatgtggagaacatccggaggaagtttggagtcttcaactacagccccttccgcaccccctacacccccaacagccagtaccagatgctgctggaccccaccaaccccagcgctggaacagccaagattgacaagcaggagaaggtgaagctgaactttgacatgacagccagccccaagatcctgatgagcaagcctgtgctgagcggcggcactggaagacgcatcagcctgagtgacatgcccaggagccccatgagcaccaacagctctgtgcacactggaagtgatgtggagcaggatgctgagaagaaggccaccagcagccacttcagcgccagcgaggagagcatggacttcctggacaagagcacagccagccctgccagcaccaagacaggccaggccggcagcctgagcggcagccccaagcccttcagcccccagctgagcgcccccatcaccaccaagacagacaagaccagcaccaccggcagcatcctgaacctgaacctgggccacaggagcaaggccgagatggacctgaaggagctgtctgagagcgtgcagcagcagagcacccctgtgcccctcatcagccccaagaggcagatccgcagccgcttccagctgaacctggacaagaccatcgagagctgcaaggcccagctgggcatcaatgagatcagtgaagatgtgtacacagctgtggagcacagcgacagcgaggacagcgagaagagtgacagcagtgacagcgagtacatcagtgatgatgagcagaagagcaagaatgaacctgaggacacagaggacaaggagggctgccagatggacaaggagcccagcgctgtgaagaagaagcccaagcccaccaaccctgtggagatcaaggaggagctgaagagcaccagccctgccagcgagaaggctgaccccggggctgtgaaggacaaggccagccctgagcctgagaaggacttcagcgagaaggccaagcccagcccccaccccatcaaggacaagctgaagggcaaggatgaaacagacagccccaccgtgcacctgggcctggacagcgacagcgagagcgagctggtgattgacctgggggaggaccacagcggccgggagggcaggaagaacaagaaggagcccaaggagcccagccccaagcaggatgtggtgggcaagaccccacccagcaccaccgtgggcagccacagccccccagagacccctgtgctgaccaggagcagcgcccagaccagcgctgctggggccacagccaccaccagcaccagcagcacagtgacagtgacagccccagccccagctgccaccggcagccctgtgaagaagcagaggcccctgctgcccaaggagacagccccagctgtgcagagggtggtgtggaacagcagcacagtgcagcagaaggagatcacccagagccccagcaccagcaccatcaccctggtgaccagcacccagagcagccccctggtgaccagcagcggctccatgagcaccctggtgtcctctgtgaatgctgacctgcccatcgccacagccagcgcagatgtggccgctgacatcgccaagtacaccagcaagatgatggatgccatcaagggcaccatgacagagatctacaatgacctgagcaagaacaccaccggcagcaccatcgccgagatccggcggctgagaattgaaattgagaagctgcagtggctgcaccagcaggagctgtctgagatgaagcacaacctggagctgaccatggccgagatgaggcagagcctggagcaggagcgggaccggctgattgctgaggtgaagaagcagctggagctggagaagcagcaggccgtggatgagaccaagaagaagcagtggtgtgccaactgcaagaaggaggccatcttctactgctgctggaacaccagctactgtgactacccctgccagcaggcccactggccagagcacatgaagagctgcacccagagcgccacagccccccagcaggaggctgatgctgaggtgaacacagagaccctgaacaagagcagccagggcagcagcagcagcacccagagcgcccccagcgagacagccagcgccagcaaggagaaggagaccagcgctgagaagagcaaggagagcggcagcaccctggacctgagcggcagccgggagacccccagcagcatcctgctgggcagcaaccagggctctgtgtccaagagatgtgacaagcagcctgcctatgcccccaccaccacagaccaccagccccaccccaactacccagcccagaagtaccacagccgcagcaacaagagctcctggagcagcagtgatgagaagaggggcagcaccaggagtgaccacaacaccagcaccagcaccaagagcctgctgcccaaggagagccggctggacaccttctgggactag

SEQ ID NO: 18613 - DNA, 3726 bp, Artificial Sequence
  Description of Artificial Sequence: Synthetic coding sequence
atggtgttcctggaggagtttgaggcccggagctgcctggccgaggaggagatcaagacagagcaggaggtggtggagggcatggacatcagcaccaggagcaaggaccccggcagcgctgagaggacagcccagaagaggaagttccccagccccccccacagcagcaatggccacagcccccaggacaccagcaccagccccatcaagaagaagaagaagccaggcctgctgaacagcaacaacaaggagcagagcgagctgcggcacggccccttctactacatgaagcagcccctgaccacagatcctgtggatgtggtgccccaggatggaagaaatgacttctactgctgggtgtgccaccgggagggccaggtgctgtgctgtgagctgtgcccccgggtgtaccacgccaagtgcctgcggctgaccagcgagcctgagggggactggttctgcccagaatgtgagaagatcaccgtggccgagtgcatcgagacccagagcaaggccatgaccatgctgaccatcgagcagctgagctacctgctgaagtttgccatccagaagatgaagcagcctggaacagatgccttccagaagcctgtgcccctggagcagcacccagactatgcagagtacatcttccaccccatggacctgtgcaccctggagaagaatgccaagaagaagatgtatggctgcacagaggccttcctggctgatgccaagtggatcctgcacaactgcatcatctacaatggaggcaaccacaagctgacccagatcgccaaggtggtgatcaagatctgtgagcacgagatgaatgaaattgaggtgtgcccagagtgctacctggccgcctgccagaagagggacaactggttctgtgagccctgcagcaacccccaccccctggtgtgggccaagctgaagggcttccccttctggccagccaaggccctgcgggacaaggatggccaggtggatgcccgcttcttcggccagcacgaccgggcctgggtgcccatcaacaactgctacctgatgagcaaggagatccccttctctgtgaagaagaccaagagcatcttcaacagcgccatgcaggagatggaggtgtatgtggagaacatccggaggaagtttggagtcttcaactacagccccttccgcaccccctacacccccaacagccagtaccagatgctgctggaccccaccaaccccagcgctggaacagccaagattgacaagcaggagaaggtgaagctgaactttgacatgacagccagccccaagatcctgatgagcaagcctgtgctgagcggcggcactggaagacgcatcagcctgagtgacatgcccaggagccccatgagcaccaacagctctgtgcacactggaagtgatgtggagcaggatgctgagaagaaggccaccagcagccacttcagcgccagcgaggagagcatggacttcctggacaagagcacagccagccctgccagcaccaagacaggccaggccggcagcctgagcggcagccccaagcccttcagcccccagctgagcgcccccatcaccaccaagacagacaagaccagcaccaccggcagcatcctgaacctgaacctggacaggagcaaggccgagatggacctgaaggagctgtctgagagcgtgcagcagcagagcacccctgtgcccctcatcagccccaagaggcagatccgcagccgcttccagctgaacctggacaagaccatcgagagctgcaaggcccagctgggcatcaatgagatcagtgaagatgtgtacacagctgtggagcacagcgacagtgaagattctgagaagagtgacagcagtgacagcgagtacatcagtgatgatgagcagaagagcaagaatgaacctgaggacacagaggacaaggagggctgccagatggacaaggagcccagcgctgtgaagaagaagcccaagcccaccaaccctgtggagatcaaggaggagctgaagagcaccagccctgccagcgagaaggctgaccctggagctgtgaaggacaaggccagccctgagcctgagaaggacttcagcgagaaggccaagcccagcccccaccccatcaaggacaagctgaagggcaaggatgaaacagacagccccaccgtgcacctgggcctggacagcgacagcgagagcgagctggtgattgacctgggggaggaccacagcggccgggagggcaggaagaacaagaaggagcccaaggagcccagccccaagcaggatgtggtgggcaagaccccacccagcaccaccgtgggcagccacagccccccagagacccctgtgctgaccaggagcagcgcccagaccagcgctgctggggccacagccaccaccagcaccagcagcacagtgacagtgacagccccagccccagctgccaccggcagccctgtgaagaagcagaggcccctgctgcccaaggagacagccccagctgtgcagagggtggtgtggaacagcagcagcaagttccagaccagcagccagaagtggcacatgcagaagatgcagaggcagcagcagcagcagcagcagcagaaccagcagcagcagccccagagcagccagggcacccgctaccagacccggcaggccgtgaaggctgtgcagcagaaggagatcacccagagccccagcaccagcaccatcaccctggtgaccagcacccagagcagccccctggtgaccagcagcggctccatgagcaccctggtgtcctctgtgaatgctgacctgcccatcgccacagccagcgcagatgtggccgctgacatcgccaagtacaccagcaagatgatggatgccatcaagggcaccatgacagagatctacaatgacctgagcaagaacaccaccggcagcaccatcgccgagatccggcggctgcgcatcgagattgagaagctgcagtggctgcaccagcaggagctgtctgagatgaagcacaacctggagctgaccatggccgagatgaggcagagcctggagcaggagcgggaccggctgattgctgaggtgaagaagcagctggagctggagaagcagcaggccgtggatgagaccaagaagaagcagtggtgtgccaactgcaagaaggaggccatcttctactgctgctggaacaccagctactgtgactacccctgccagcaggcccactggccagagcacatgaagagctgcacccagagcgccacagccccccagcaggaggctgatgctgaggtgaacacagagaccctgaacaagagcagccagggcagcagcagcagcacccagagcgcccccagcgagacagccagcgccagcaaggagaaggagaccagcgctgagaagagcaaggagagcggcagcaccctggacctgagcggcagccgggagacccccagcagcatcctgctgggcagcaaccagggctctgtgtccaagagatgtgacaagcagcctgcctatgcccccaccaccacagaccaccagccccaccccaactacccagcccagaagtaccacagccgcagcaacaagagctcctggagcagcagtgatgagaagaggggcagcaccaggagtgaccacaacaccagcaccagcaccaagagcctgctgcccaaggagagccggctggacaccttctgggactag

SEQ ID NO: 18614 - DNA, 3405 bp, Artificial Sequence
  Description of Artificial Sequence: Synthetic coding sequence
atgcacccccagagcctggccgaggaggagatcaagacagagcaggaggtggtggagggcatggacatcagcaccaggagcaaggaccccggcagcgctgagaggacagcccagaagaggaagttccccagccccccccacagcagcaatggccacagcccccaggacaccagcaccagccccatcaagaagaagaagaagccaggcctgctgaacagcaacaacaaggagcaggatggaagaaatgacttctactgctgggtgtgccaccgggagggccaggtgctgtgctgtgagctgtgcccccgggtgtaccacgccaagtgcctgcggctgaccagcgagcctgagggggactggttctgcccagaatgtgagaagatcaccgtggccgagtgcatcgagacccagagcaaggccatgaccatgctgaccatcgagcagctgagctacctgctgaagtttgccatccagaagatgaagcagcctggaacagatgccttccagaagcctgtgcccctggagcagcacccagactatgcagagtacatcttccaccccatggacctgtgcaccctggagaagaatgccaagaagaagatgtatggctgcacagaggccttcctggctgatgccaagtggatcctgcacaactgcatcatctacaatggaggcaaccacaagctgacccagatcgccaaggtggtgatcaagatctgtgagcacgagatgaatgaaattgaggtgtgcccagagtgctacctggccgcctgccagaagagggacaactggttctgtgagccctgcagcaacccccaccccctggtgtgggccaagctgaagggcttccccttctggccagccaaggccctgcgggacaaggatggccaggtggatgcccgcttcttcggccagcacgaccgggcctgggtgcccatcaacaactgctacctgatgagcaaggagatccccttctctgtgaagaagaccaagagcatcttcaacagcgccatgcaggagatggaggtgtatgtggagaacatccggaggaagtttggagtcttcaactacagccccttccgcaccccctacacccccaacagccagtaccagatgctgctggaccccaccaaccccagcgctggaacagccaagattgacaagcaggagaaggtgaagctgaactttgacatgacagccagccccaagatcctgatgagcaagcctgtgctgagcggcggcactggaagacgcatcagcctgagtgacatgcccaggagccccatgagcaccaacagctctgtgcacactggaagtgatgtggagcaggatgctgagaagaaggccaccagcagccacttcagcgccagcgaggagagcatggacttcctggacaagagcacagacaggagcaaggccgagatggacctgaaggagctgtctgagagcgtgcagcagcagagcacccctgtgcccctcatcagccccaagaggcagatccgcagccgcttccagctgaacctggacaagaccatcgagagctgcaaggcccagctgggcatcaatgagatcagtgaagatgtgtacacagctgtggagcacagcgacagcgaggacagcgagaagagtgacagcagtgacagcgagtacatcagtgatgatgagcagaagagcaagaatgaacctgaggacacagaggacaaggagggctgccagatggacaaggagcccagcgctgtgaagaagaagcccaagcccaccaaccctgtggagatcaaggaggagctgaagagcaccagccctgccagcgagaaggctgaccccggggctgtgaaggacaaggccagccctgagcctgagaaggacttcagcgagaaggccaagcccagcccccaccccatcaaggacaagctgaagggcaaggatgaaacagacagccccaccgtgcacctgggcctggacagcgacagcgagagcgagctggtgattgacctgggggaggaccacagcggccgggagggcaggaagaacaagaaggagcccaaggagcccagccccaagcaggatgtggtgggcaagaccccacccagcaccaccgtgggcagccacagccccccagagacccctgtgctgaccaggagcagcgcccagaccagcgctgctggggccacagccaccaccagcaccagcagcacagtgacagtgacagccccagccccagctgccaccggcagccctgtgaagaagcagaggcccctgctgcccaaggagacagccccagctgtgcagagggtggtgtggaacagcagcagcaagttccagaccagcagccagaagtggcacatgcagaagatgcagaggcagcagcagcagcagcagcagcagaaccagcagcagcagccccagagcagccagggcacccgctaccagacccggcaggccgtgaaggctgtgcagcagaaggagatcacccagagccccagcaccagcaccatcaccctggtgaccagcacccagagcagccccctggtgaccagcagcggctccatgagcaccctggtgtcctctgtgaatgctgacctgcccatcgccacagccagcgcagatgtggccgctgacatcgccaagtacaccagcaagatgatggatgccatcaagggcaccatgacagagatctacaatgacctgagcaagaacaccaccggcagcaccatcgccgagatccggcggctgagaattgaaattgagaagctgcagtggctgcaccagcaggagctgtctgagatgaagcacaacctggagctgaccatggccgagatgaggcagagcctggagcaggagcgggaccggctgattgctgaggtgaagaagcagctggagctggagaagcagcaggccgtggatgagaccaagaagaagcagtggtgtgccaactgcaagaaggaggccatcttctactgctgctggaacaccagctactgtgactacccctgccagcaggcccactggccagagcacatgaagagctgcacccagagcgccacagccccccagcaggaggctgatgctgaggtgaacacagagaccctgaacaagagcagccagggcagcagcagcagcacccagagcgcccccagcgagacagccagcgccagcaaggagaaggagaccagcgctgagaagagcaaggagagcggcagcaccctggacctgagcggcagccgggagacccccagcagcatcctgctgggcagcaaccagggcagtgaccacagccgcagcaacaagagctcctggagcagcagtgatgagaagaggggcagcaccaggagtgaccacaacaccagcaccagcaccaagagcctgctgcccaaggagagccggctggacaccttctgggactag

SEQ ID NO: 18615 - DNA, 2805 bp, Artificial Sequence
  Description of Artificial Sequence: Synthetic coding sequence
atggaggagcggcggccccacctggatgcccggcccaggaacagccacaccaaccaccggggccctgtggatggagagctgcccccccgggccaggaaccaggccaacaaccccccagccaatgccctgcggggcggggccagccaccctggccgccacccccgggccaacaaccaccctgctgcctactggcagcgggaggagcgcttccgggccatgggcaggaacccccaccagggcagaagaaaccaggagggccacgccagtgatgaggcccgggaccagagacatgaccaggagaatgacacccgctggagaaatggaaaccaggactgcaggaacagaagaccaccctggagcaatgacaacttccagcagtggaggaccccccaccagaagcccacagagcagccccagcaggccaagaagctgggctacaagttcctggagagcctgctgcagaaggaccccagcgaggtggtgatcaccctggccaccagcctgggcctgaaggagctgctgagccacagctccatgaagagcaacttcctggagctgatctgccaggtgctgaggaaggcctgcagcagcaagatggaccggcagagcgtgctgcacgtgctgggcatcctgaagaacagcaagttcctgaaggtgtgcctgcctgcctacgtggtgggcatgatcacagagcccatcccagacatccggaaccagtacccagagcacatcagcaacatcatcagcctgctgcaggacctggtgtctgtgtttcctgccagctctgtgcaggagacctccatgctggtgtccctgctgcccaccagcctgaatgccctgcgggccagcggcgtggacatcgaggaggagacagagaagaacctggagaaggtgcagaccatcatcgagcacctgcaggagaagagaagagagggcaccctgcgggtggacacctacaccctggtgcagcctgaggctgaagatcatgtggagagctaccgcaccatgcccatctaccccacctacaatgaggtgcacctggatgagcggcccttcctgcggcccaacatcatcagcggcaagtatgacagcacagccatctacctggacacccacttccggctgctgcgggaggactttgtgcggcccctgcgggagggcatcctggagctgctgcagagctttgaggaccagggcctgaggaagaggaagtttgatgacatccgcatctactttgacacccgcatcatcacccccatgtgcagcagcagcggcatcgtgtacaaggtgcagtttgacaccaagcccctgaagtttgtgcgctggcagaacagcaagaggctgctgtatggcagcctggtgtgcatgagcaaggacaactttgagaccttcctgtttgccaccgtgagcaaccgggagcaggaggacctgtgccggggcatcgtgcagctgtgcttcaatgagcagagccagcagctgctggccgaggtgcagcccagcgacagcttcctgatggtggagaccacagcctactttgaggcctacagacatgtgctggagggcctgcaggaggtgcaggaggaggatgtgcccttccagaggaacatcgtggagtgcaacagccacgtgaaggagccccgctacctgctgatgggcggccgctatgacttcacccccctgattgagaaccccagcgccactggagagttcctgagaaatgtggagggcctgcggcacccccgcatcaacgtgctggaccccggccagtggcccagcaaggaggccctgaagctggatgacagccagatggaggccctgcagtttgccctgacccgggagctggccatcatccagggccccccaggcaccgggaagacctacgtgggcctgaagatcgtgcaggccctgctgaccaatgaatctgtgtggcagatcagcctgcagaagttccccatcctggtggtgtgctacaccaaccacgccctggaccagttcctggagggcatctacaactgccagaagaccagcatcgtgcgggtgggcggccgcagcaacagcgagatcctgaagcagttcaccctgcgggagctgaggaacaagcgggagttcagaagaaacctgcccatgcacctgcggcgggcctacatgagcatcatgacccagatgaaggagagcgagcaggagctgcacgagggcgccaagaccctggagtgcaccatgaggggcgtgctgcgggagcagtacctgcagaagtacatcagcccccagcactgggagagcctgatgaatggacctgtgcaggacagcgagtggatctgcttccagcactggaagcacagcatgatgctggagtggctgggcctgggcgtgggcagcttcacccagagcgtgtccccagctggcccagaaaatacagcccaggccgagggagatgaggaggaggagggggaggaggagagcagcctgattgaaattgctgaggaggccgacctgatccaggccgacagagtcatcgaggaggaggaggtggtgcggccccagaggaggaagaaggaggagagcggggctgaccaggagctggccaagatgctgctggccatgaggctggaccactgcggcaccggcacagctgctggccaggagcaggccaccggggagtggcagacccagaggaaccagaagaagaagatgaagaagagggtgaaggatgagctgaggaagctgaacaccatgacagctgctgaggccaatgaaattgaagatgtgtggcagctggacctgagcagccgctggcagctgtactag

SEQ ID NO: 18616 - DNA, 5757 bp, Artificial Sequence
  Description of Artificial Sequence: Synthetic coding sequence
atggaggagcggcggccccacctggatgcccggcccaggaacagccacaccaaccaccggggccctgtggatggagagctgcccccccgggccaggaaccaggccaacaaccccccagccaatgccctgcggggcggggccagccaccctggccgccacccccgggccaacaaccaccctgctgcctactggcagcgggaggagcgcttccgggccatgggcaggaacccccaccagggcagaagaaaccaggagggccacgccagtgatgaggcccgggaccagagacatgaccaggagaatgacacccgctggagaaatggaaaccaggactgcaggaacagaagaccaccctggagcaatgacaacttccagcagtggaggaccccccaccagaagcccacagagcagccccagcaggccaagaagctgggctacaagttcctggagagcctgctgcagaaggaccccagcgaggtggtgatcaccctggccaccagcctgggcctgaaggagctgctgagccacagctccatgaagagcaacttcctggagctgatctgccaggtgctgaggaaggcctgcagcagcaagatggaccggcagagcgtgctgcacgtgctgggcatcctgaagaacagcaagttcctgaaggtgtgcctgcctgcctacgtggtgggcatgatcacagagcccatcccagacatccggaaccagtacccagagcacatcagcaacatcatcagcctgctgcaggacctggtgtctgtgtttcctgccagctctgtgcaggagacctccatgctggtgtccctgctgcccaccagcctgaatgccctgcgggccagcggcgtggacatcgaggaggagacagagaagaacctggagaaggtgcagaccatcatcgagcacctgcaggagaagagaagagagggcaccctgcgggtggacacctacaccctggtgcagcctgaggctgaagatcatgtggagagctaccgcaccatgcccatctaccccacctacaatgaggtgcacctggatgagcggcccttcctgcggcccaacatcatcagcggcaagtatgacagcacagccatctacctggacacccacttccggctgctgcgggaggactttgtgcggcccctgcgggagggcatcctggagctgctgcagagctttgaggaccagggcctgaggaagaggaagtttgatgacatccgcatctactttgacacccgcatcatcacccccatgtgcagcagcagcggcatcgtgtacaaggtgcagtttgacaccaagcccctgaagtttgtgcgctggcagaacagcaagaggctgctgtatggcagcctggtgtgcatgagcaaggacaactttgagaccttcctgtttgccaccgtgagcaaccgggagcaggaggacctgtgccggggcatcgtgcagctgtgcttcaatgagcagagccagcagctgctggccgaggtgcagcccagcgacagcttcctgatggtggagaccacagcctactttgaggcctacagacatgtgctggagggcctgcaggaggtgcaggaggaggatgtgcccttccagaggaacatcgtggagtgcaacagccacgtgaaggagccccgctacctgctgatgggcggccgctatgacttcacccccctgattgagaaccccagcgccactggagagttcctgagaaatgtggagggcctgcggcacccccgcatcaacgtgctggaccccggccagtggcccagcaaggaggccctgaagctggatgacagccagatggaggccctgcagtttgccctgacccgggagctggccatcatccagggccccccaggcaccgggaagacctacgtgggcctgaagatcgtgcaggccctgctgaccaatgaatctgtgtggcagatcagcctgcagaagttccccatcctggtggtgtgctacaccaaccacgccctggaccagttcctggagggcatctacaactgccagaagaccagcatcgtgcgggtgggcggccgcagcaacagcgagatcctgaagcagttcaccctgcgggagctgaggaacaagcgggagttcagaagaaacctgcccatgcacctgcggcgggcctacatgagcatcatgacccagatgaaggagagcgagcaggagctgcacgagggcgccaagaccctggagtgcaccatgaggggcgtgctgcgggagcagtacctgcagaagtacatcagcccccagcactgggagagcctgatgaatggacctgtgcaggacagcgagtggatctgcttccagcactggaagcacagcatgatgctggagtggctgggcctgggcgtgggcagcttcacccagagcgtgtccccagctggcccagaaaatacagcccaggccgagggagatgaggaggaggagggggaggaggagagcagcctgattgaaattgctgaggaggccgacctgatccaggccgacagagtcatcgaggaggaggaggtggtgcggccccagaggaggaagaaggaggagagcggggctgaccaggagctggccaagatgctgctggccatgaggctggaccactgcggcaccggcacagctgctggccaggagcaggccaccggggagtggcagacccagaggaaccagaagaagaagatgaagaagagggtgaaggatgagctgaggaagctgaacaccatgacagctgctgaggccaatgaaattgaagatgtgtggcagctggacctgagcagccgctggcagctgtaccgcctgtggctgcagctgtaccaggccgacaccaggaggaagatcctgtcctatgaaaggcagtaccgcaccagcgctgagaggatggccgagctgcggctgcaggaggacctgcacatcctgaaggatgcccaggtggtgggcatgaccaccaccggggccgccaagtaccggcagatcctgcagaaggtggagccccgcatcgtcatcgtggaggaggccgctgaggtgctggaggcccacaccatcgccaccctgagcaaggcctgccagcacctgatcctgattggagaccaccagcagctgcggcccagcgccaacgtgtatgacctggccaagaacttcaacctggaggtgtccctgtttgagcggctggtgaaggtgaacatcccctttgtgcggctgaactaccagcacaggatgtgcccagaaattgcccggctgctgaccccccacatctaccaggacctggagaaccaccccagcgtgctgaagtatgagaagatcaagggcgtgagcagcaacctcttctttgtggagcacaacttccctgagcaggagatccaggagggcaagagccaccagaaccagcacgaggcccactttgtggtggagctgtgcaagtacttcctgtgccaggagtacctgcccagccagatcaccatcctgaccacctacacaggccagctgttctgcctgaggaagctgatgcctgccaagacctttgctggggtgcgggtgcacgtggtggacaagtaccagggcgaggagaatgacatcatcctgctgagcctggtgcgcagcaaccaggagggcaaggtgggcttcctgcagatcagcaaccgcatctgtgtggccctgagccgggccaagaagggcatgtactgcatcggcaacatgcagatgctggccaaggtgcccctgtggagcaagatcatccacaccctgcgggagaacaaccagatcggccccatgctgcggctgtgctgccagaaccaccctgagacccacaccctggtgtccaaggccagtgacttccagaaggtgcctgagggcggctgcagcctgccctgtgagttccggctgggctgcggccacgtgtgcacccgggcctgccacccctatgacagcagccacaaggagttccagtgcatgaagccctgccagaaggtgatctgccaggagggccaccgctgccccctggtgtgcttccaggagtgccagccctgccaggtgaaggtgcccaagaccatcccccgctgtggccacgagcagatggtgccctgcagcgtgcctgagagtgacttctgctgccaggagccctgcagcaagagcctgcgctgtggccaccgctgcagccacccctgtggggaggactgtgtgcagctgtgcagcgagatggtgaccatcaagctgaagtgtggccacagccagcctgtgaagtgtggccacgtggagggcctgctgtatggaggcctgctggtgaagtgcaccaccaagtgtggcaccatcctggactgtggccacccctgccccggcagctgccacagctgctttgagggccgcttccacgagcgctgccagcagccctgcaagaggctgctgatctgcagccacaagtgccaggagccctgcatcggggagtgccccccctgccagaggacctgccagaacagatgtgtgcacagccagtgcaagaagaagtgtggggagctgtgcagcccctgtgtggagccctgtgtgtggcgctgccagcactaccagtgcaccaagctgtgcagcgagccctgcaaccggcccccctgctacgtgccctgcaccaagctgctggtgtgtggccacccctgcatcggcctgtgtggggagccctgccccaagaagtgccgcatctgccacatggatgaggtgacccagatcttctttggatttgaagatgagccagatgccaggtttgtgcagctggaggactgcagccacatctttgaggtgcaggccctggaccgctacatgaatgagcagaaggatgatgaggtggccatccggctgaaggtgtgccccatctgccaggtgcccatcaggaagaacctgcgctatggcaccagcatcaagcagaggctggaggagattgagatcatcaaggagaagatccagggcagcgctggggagatcgccaccagccaggagcggctgaaggccctgctggagaggaagagcctgctgcaccagctgctgcctgaggacttcctgatgctgaaggagaagctggcccagaagaacctgtctgtgaaggacctgggcctggtggagaactacatctccttctatgaccacctggccagcctgtgggacagcctgaagaagatgcacgtgctggaggagaagagggtgaggacccggctggagcaggtgcatgagtggctggccaagaagaggctgtccttcaccagccaggagctgagtgacctgcggtctgagatccagaggctgacctacctggtgaacctgctgacccgctacaagattgctgagaagaaggtgaaggacagcattgctgtggaggtgtacagcgtgcagaacatcctggagaagacctgcaagttcacccaggaggatgagcagctggtgcaggagaagatggaggccctgaaggccaccctgccctgcagcggcctgggcatcagcgaggaggagcgggtgcagatcgtgtctgccatcggctacccccggggccactggttcaagtgcagaaatggccacatctacgtgattggagactgtggcggggccatggagcggggcacctgcccagactgcaaggaggtgattggaggcaccaaccacaccctggagaggagcaaccagctggccagcgagatggatggagcccagcacgccgcctggagcgacacagccaacaacctgatgaactttgaggagatccagggcatgatgtag

SEQ ID NO: 18617 - DNA, 3813 bp, Artificial Sequence
  Description of Artificial Sequence: Synthetic coding sequence
atggaggagcggcggccccacctggatgcccggcccaggaacagccacaccaaccaccggggccctgtggatggagagctgcccccccgggccaggaaccaggccaacaaccccccagccaatgccctgcggggcggggccagccaccctggccgccacccccgggccaacaaccaccctgctgcctactggcagcgggaggagcgcttccgggccatgggcaggaacccccaccagggcagaagaaaccaggagggccacgccagtgatgaggcccgggaccagagacatgaccaggagaatgacacccgctggagaaatggaaaccaggactgcaggaacagaagaccaccctggagcaatgacaacttccagcagtggaggaccccccaccagaagcccacagagcagccccagcaggccaagaagctgggctacaagttcctggagagcctgctgcagaaggaccccagcgaggtggtgatcaccctggccaccagcctgggcctgaaggagctgctgagccacagctccatgaagagcaacttcctggagctgatctgccaggtgctgaggaaggcctgcagcagcaagatggaccggcagagcgtgctgcacgtgctgggcatcctgaagaacagcaagttcctgaaggtgtgcctgcctgcctacgtggtgggcatgatcacagagcccatcccagacatccggaaccagtacccagagcacatcagcaacatcatcagcctgctgcaggacctggtgtctgtgtttcctgccagctctgtgcaggagacctccatgctggtgtccctgctgcccaccagcctgaatgccctgcgggccagcggcgtggacatcgaggaggagacagagaagaacctggagaaggtgcagaccatcatcgagcacctgcaggagaagagaagagagggcaccctgcgggtggacacctacaccctggtgcagcctgaggctgaagatcatgtggagagctaccgcaccatgcccatctaccccacctacaatgaggtgcacctggatgagcggcccttcctgcggcccaacatcatcagcggcaagtatgacagcacagccatctacctggacacccacttccggctgctgcgggaggactttgtgcggcccctgcgggagggcatcctggagctgctgcagagctttgaggaccagggcctgaggaagaggaagtttgatgacatccgcatctactttgacacccgcatcatcacccccatgtgcagcagcagcggcatcgtgtacaaggtgcagtttgacaccaagcccctgaagtttgtgcgctggcagaacagcaagaggctgctgtatggcagcctggtgtgcatgagcaaggacaactttgagaccttcctgtttgccaccgtgagcaaccgggagcaggaggacctgtgccggggcatcgtgcagctgtgcttcaatgagcagagccagcagctgctggccgaggtgcagcccagcgacagcttcctgatggtggagaccacagcctactttgaggcctacagacatgtgctggagggcctgcaggaggtgcaggaggaggatgtgcccttccagaggaacatcgtggagtgcaacagccacgtgaaggagccccgctacctgctgatgggcggccgctatgacttcacccccctgattgagaaccccagcgccactggagagttcctgagaaatgtggagggcctgcggcacccccgcatcaacgtgctggaccccggccagtggcccagcaaggaggccctgaagctggatgacagccagatggaggccctgcagtttgccctgacccgggagctggccatcatccagggccccccaggcaccgggaagacctacgtgggcctgaagatcgtgcaggccctgctgaccaatgaatctgtgtggcagatcagcctgcagaagttccccatcctggtggtgtgctacaccaaccacgccctggaccagttcctggagggcatctacaactgccagaagaccagcatcgtgcgggtgggcggccgcagcaacagcgagatcctgaagcagttcaccctgcgggagctgaggaacaagcgggagttcagaagaaacctgcccatgcacctgcggcgggcctacatgagcatcatgacccagatgaaggagagcgagcaggagctgcacgagggcgccaagaccctggagtgcaccatgaggggcgtgctgcgggagcagtacctgcagaagtacatcagcccccagcactgggagagcctgatgaatggacctgtgcaggacagcgagtggatctgcttccagcactggaagcacagcatgatgctggagtggctgggcctgggcgtgggcagcttcacccagagcgtgtccccagctggcccagaaaatacagcccaggccgagggagatgaggaggaggagggggaggaggagagcagcctgattgaaattgctgaggaggccgacctgatccaggccgacagagtcatcgaggaggaggaggtggtgcggccccagaggaggaagaaggaggagagcggggctgaccaggagctggccaagatgctgctggccatgaggctggaccactgcggcaccggcacagctgctggccaggagcaggccaccggggagtggcagacccagaggaaccagaagaagaagatgaagaagagggtgaaggatgagctgaggaagctgaacaccatgacagctgctgaggccaatgaaattgaagatgtgtggcagctggacctgagcagccgctggcagctgtaccgcctgtggctgcagctgtaccaggccgacaccaggaggaagatcctgtcctatgaaaggcagtaccgcaccagcgctgagaggatggccgagctgcggctgcaggaggacctgcacatcctgaaggatgcccaggtggtgggcatgaccaccaccggggccgccaagtaccggcagatcctgcagaaggtggagccccgcatcgtcatcgtggaggaggccgctgaggtgctggaggcccacaccatcgccaccctgagcaaggcctgccagcacctgatcctgattggagaccaccagcagctgcggcccagcgccaacgtgtatgacctggccaagaacttcaacctggaggtgtccctgtttgagcggctggtgaaggtgaacatcccctttgtgcggctgaactaccagcacaggatgtgcccagaaattgcccggctgctgaccccccacatctaccaggacctggagaaccaccccagcgtgctgaagtatgagaagatcaaggccaagagcaacagctgccgggccctggccaccggcatgaggaggaagcacaagatcagcggcatgatcctgtccttcttcaagctgaccatccgcagcgcccgcttccagctgctgctgagcggctcctggaccacagccagcttccccttcagccgcagcagatttgctgtgctgatctgccgggacaacaagaggatgcctgctgtgaagcctgtgtccaccaacacaggcagccacggcctgcagatgcctggggccctgatgggagagaccttccagaagggcagcaccagcagagatgctgctgcctgcctgctgagcagcctggtgaacaagatccccccaagaagcctgacctgggccagtgactgctgcatctccttcagcagcgccagcagctgcaggacagcctacaccagcttcagcatcttcagcatcctgagcaggaacctgaggatgaccagccagtgggagaagatcaagaggatctacaagtag

SEQ ID NO: 18618 - DNA, 5757 bp, Artificial Sequence; identical to SEQ ID NO: 18616
  Description of Artificial Sequence: Synthetic coding sequence

SEQ ID NO: 18619 - DNA, 2748 bp, Artificial Sequence
  Description of Artificial Sequence: Synthetic coding sequence
atggaggagcggcggccccacctggatgcccggcccaggaacagccacaccaaccaccggggccctgtggatggagagctgcccccccgggccaggaaccaggccaacaaccccccagccaatgccctgcggggcggggccagccaccctggccgccacccccgggccaacaaccaccctgctgcctactggcagcgggaggagcgcttccgggccatgggcaggaacccccaccagggcagaagaaaccaggagggccacgccagtgatgaggcccgggaccagagacatgaccaggagaatgacacccgctggagaaatggaaaccaggactgcaggaacagaagaccaccctggagcaatgacaacttccagcagtggaggaccccccaccagaagcccacagagcagccccagcaggccaagaagctgggctacaagttcctggagagcctgctgcagaaggaccccagcgaggtggtgatcaccctggccaccagcctgggcctgaaggagctgctgagccacagctccatgaagagcaacttcctggagctgatctgccaggtgctgaggaaggcctgcagcagcaagatggaccggcagagcgtgctgcacgtgctgggcatcctgaagaacagcaagttcctgaaggtgtgcctgcctgcctacgtggtgggcatgatcacagagcccatcccagacatccggaaccagtacccagagcacatcagcaacatcatcagcctgctgcaggacctggtgtctgtgtttcctgccagctctgtgcaggagacctccatgctggtgtccctgctgcccaccagcctgaatgccctgcgggccagcggcgtggacatcgaggaggagacagagaagaacctggagaaggtgcagaccatcatcgagcacctgcaggagaagagaagagagggcaccctgcgggtggacacctacaccctggtgcagcctgaggctgaagatcatgtggagagctaccgcaccatgcccatctaccccacctacaatgaggtgcacctggatgagcggcccttcctgcggcccaacatcatcagcggcaagtatgacagcacagccatctacctggacacccacttccggctgctgcgggaggactttgtgcggcccctgcgggagggcatcctggagctgctgcagagctttgaggaccagggcctgaggaagaggaagtttgatgacatccgcatctactttgacacccgcatcatcacccccatgtgcagcagcagcggcatcgtgtacaaggtgcagtttgacaccaagcccctgaagtttgtgcgctggcagaacagcaagaggctgctgtatggcagcctggtgtgcatgagcaaggacaactttgagaccttcctgtttgccaccgtgagcaaccgggagcaggaggacctgtgccggggcatcgtgcagctgtgcttcaatgagcagagccagcagctgctggccgaggtgcagcccagcgacagcttcctgatggtggagaccacagcctactttgaggcctacagacatgtgctggagggcctgcaggaggtgcaggaggaggatgtgcccttccagaggaacatcgtggagtgcaacagccacgtgaaggagccccgctacctgctgatgggcggccgctatgacttcacccccctgattgagaaccccagcgccactggagagttcctgagaaatgtggagggcctgcggcacccccgcatcaacgtgctggaccccggccagtggcccagcaaggaggccctgaagctggatgacagccagatggaggccctgcagtttgccctgacccgggagctggccatcatccagggccccccaggcaccgggaagacctacgtgggcctgaagatcgtgcaggccctgctgaccaatgaatctgtgtggcagatcagcctgcagaagttccccatcctggtggtgtgctacaccaaccacgccctggaccagttcctggagggcatctacaactgccagaagaccagcatcgtgcgggtgggcggccgcagcaacagcgagatcctgaagcagttcaccctgcgggagctgaggaacaagcgggagttcagaagaaacctgcccatgcacctgcggcgggcctacatgagcatcatgacccagatgaaggagagcgagcaggagctgcacgagggcgccaagaccctggagtgcaccatgaggggcgtgctgcgggagcagtacctgcagaagtacatcagcccccagcactgggagagcctgatgaatggacctgtgcaggacagcgagtggatctgcttccagcactggaagcacagcatgatgctggagtggctgggcctgggcgtgggcagcttcacccagagcgtgtccccagctggcccagaaaatacagcccaggccgagggagatgaggaggaggagggggaggaggagagcagcctgattgaaattgctgaggaggccgacctgatccaggccgacagagtcatcgaggaggaggaggtggtgcggccccagaggaggaagaaggaggagagcggggctgaccaggagctggccaagatgctgctggccatgaggctggaccactgcggcaccggcacagctgctggccaggagcaggccaccggggagtggcagacccagaggaaccagaagaagaagatgaagaagcgggagaaggaggagaagaaggagcgggagaagaggaggaagaagaagtag

SEQ ID NO: 18620 - DNA, 2124 bp, Artificial Sequence
  Description of Artificial Sequence: Synthetic coding sequence
agcaagatggaccggcagagcgtgctgcacgtgctgggcatcctgaagaacagcaagttcctgaaggtgtgcctgcctgcctacgtggtgggcatgatcacagagcccatcccagacatccggaaccagtacccagagcacatcagcaacatcatcagcctgctgcaggacctggtgtctgtgtttcctgccagctctgtgcaggagacctccatgctggtgtccctgctgcccaccagcctgaatgccctgcgggccagcggcgtggacatcgaggaggagacagagaagaacctggagaaggtgcagaccatcatcgagcacctgcaggagaagagaagagagggcaccctgcgggtggacacctacaccctggtgcagcctgaggctgaagatcatgtggagagctaccgcaccatgcccatctaccccacctacaatgaggtgcacctggatgagcggcccttcctgcggcccaacatcatcagcggcaagtatgacagcacagccatctacctggacacccacttccggctgctgcgggaggactttgtgcggcccctgcgggagggcatcctggagctgctgcagagctttgaggaccagggcctgaggaagaggaagtttgatgacatccgcatctactttgacacccgcatcatcacccccatgtgcagcagcagcggcatcgtgtacaaggtgcagtttgacaccaagcccctgaagtttgtgcgctggcagaacagcaagaggctgctgtatggcagcctggtgtgcatgagcaaggacaactttgagaccttcctgtttgccaccgtgagcaaccgggagcaggaggacctgtgccggggcatcgtgcagctgtgcttcaatgagcagagccagcagctgctggccgaggtgcagcccagcgacagcttcctgatggtggagaccacagcctactttgaggcctacagacatgtgctggagggcctgcaggaggtgcaggaggaggatgtgcccttccagaggaacatcgtggagtgcaacagccacgtgaaggagccccgctacctgctgatgggcggccgctatgacttcacccccctgattgagaaccccagcgccactggagagttcctgagaaatgtggagggcctgcggcacccccgcatcaacgtgctggaccccggccagtggcccagcaaggaggccctgaagctggatgacagccagatggaggccctgcagtttgccctgacccgggagctggccatcatccagggccccccaggcaccgggaagacctacgtgggcctgaagatcgtgcaggccctgctgaccaatgaatctgtgtggcagatcagcctgcagaagttccccatcctggtggtgtgctacaccaaccacgccctggaccagttcctggagggcatctacaactgccagaagaccagcatcgtgcgggtgggcggccgcagcaacagcgagatcctgaagcagttcaccctgcgggagctgaggaacaagcgggagttcagaagaaacctgcccatgcacctgcggcgggcctacatgagcatcatgacccagatgaaggagagcgagcaggagctgcacgagggcgccaagaccctggagtgcaccatgaggggcgtgctgcgggagcagtacctgcagaagtacatcagcccccagcactgggagagcctgatgaatggacctgtgcaggacagcgagtggatctgcttccagcactggaagcacagcatgatgctggagtggctgggcctgggcgtgggcagcttcacccagagcgtgtccccagctggcccagaaaatacagcccaggccgagggagatgaggaggaggagggggaggaggagagcagcctgattgaaattgctgaggaggccgacctgatccaggccgacagagtcatcgaggaggaggaggtggtgcggccccagaggaggaagaaggaggagagcggggctgaccaggagctggccaagatgctgctggccatgaggctggaccactgcggcaccggcacagctgctggccaggagcaggccaccggggagtggcagacagtgccctgcctggtgctgatgtctgctgaccctgcccagccctag

SEQ ID NO: 18621 - DNA, 186 bp, Artificial Sequence
  Description of Artificial Sequence: Synthetic coding sequence
atggaggagcggcggccccacctggatgcccggcccaggaacagccacaccaaccaccggggccctgtggatggagagctgccccccagggctgagatcatgcccctgcacagcagcctgggggacaggagcaagaccctgagccagaagaagaagagcttcttcctggtgctggcccccacctag

SEQ ID NO: 18622 - DNA, 963 bp, Artificial Sequence
  Description of Artificial Sequence: Synthetic coding sequence
atgagcaccaagaacttccgggtgtctgatggagactggatctgcccagacaagaagtgtggaaatgtgaactttgcccggaggaccagctgcaacagatgtggccgggagaagaccacagaggccaagatgatgaaggccggcggcacagagatcggcaagaccctggccgagaagagccggggcctcttcagcgccaatgactggcagtgcaagacctgcagcaatgtgaactgggccaggagaagtgagtgcaacatgtgcaacacccccaagtatgccaagctggaggagaggacaggctacggcggcggcttcaatgaaagagaaaatgtggagtacatcgagcgggaggagagtgatggagaatatgatgaatttggaaggaagaagaagaagtaccggggcaaggctgtgggccctgccagcatcctgaaggaggtggaggacaaggagagcgagggggaggaggaggatgaagatgaggacctgagcaagtacaagctggatgaagatgaagatgaagatgatgctgacctgagcaagtacaacctggatgccagcgaggaggaggacagcaacaagaagaagagcaacagaagaagccgcagcaagagccgcagcagccacagccgcagcagcagccgcagcagcagccccagcagcagccgcagccgcagccgcagccgcagccgcagcagcagcagcagccagagccgcagccgcagcagcagccgggagaggagccgcagccggggcagcaagagccgcagcagcagccgcagccaccggggcagcagcagccccaggaagaggagctacagcagcagcagcagcagccctgagaggaacaggaagaggagccgcagccgcagcagcagcagcggggacaggaagaagaggaggaccaggagccgcagccctgagagccaggtgattggagagaacaccaagcagccctag

SEQ ID NO: 18623 - DNA, 993 bp, Artificial Sequence
  Description of Artificial Sequence: Synthetic coding sequence
atgagcaccaagaacttccgggtgtctgatggagactggatctgcccagacaagaagtgtggaaatgtgaactttgcccggaggaccagctgcaacagatgtggccgggagaagaccacagaggccaagatgatgaaggccggcggcacagagatcggcaagaccctggccgagaagagccggggcctcttcagcgccaatgactggcagtgcaagacctgcagcaatgtgaactgggccaggagaagtgagtgcaacatgtgcaacacccccaagtatgccaagctggaggagaggacaggctacggcggcggcttcaatgaaagagaaaatgtggagtacatcgagcgggaggagagtgatggagaatatgatgaatttggaaggaagaagaagaagtaccggggcaaggctgtgggccctgccagcatcctgaaggaggtggaggacaaggagagcgagggggaggaggaggatgaagatgaggacctgagcaagtacaagctggatgaagatgaagatgaagatgatgctgacctgagcaagtacaacctggatgccagcgaggaggaggacagcaacaagaagaagagcaacagaagaagccgcagcaagagccgcagcagccacagccgcagcagcagccgcagcagcagccccagcagcagccgcagccgcagccgcagccgcagccgcagcagcagcagcagccagagccgcagccgcagcagcagccgggagaggagccgcagccggggcagcaagagccgcagcagcagccgcagccaccggggcagcagcagccccaggaagaggagctacagcagcagcagcagcagccctgagaggaacaggaagaggagccgcagccgcagcagcagcagcggggacaggaagaagaggaggaccaggagccgcagccctgagcggcggcacaggagcagcagcggcagcagccacagcggcagccgcagcagcagcaagaagaagtag

SEQ ID NO: 18624 - DNA, 1458 bp, Artificial Sequence
  Description of Artificial Sequence: Synthetic coding sequence
atgctggagcggctgaaggccccctggagcgctgccctgcagaggaagtactttgacctgggcatctggacagcccccatcagccccatggccctgaccatgctgaatggcctgctgatcaaggacagcagcccccccatgctgctgcaccaggtgaacaagacagcccagctggacaccttcaactaccagagctgcttcatgcagagcgtgtttgaccacttccctgagatcctcttcatccacaggacctacaacccccggggcaaggtgctgtacaccttcctggtggatggcccccgggtgcagctggagggccacctggcccgggctgtgtactttgccatcccagccaaggaggacacagagggcctggcccagatgttccaggtgttcaagaagttcaacccagcctgggagcgggtgtgcaccatcctggtggacccccacttcctgcccctgcccatcctggccatggagttccccacagctgaggtgctgctgagcgccttccacatctgcaagttcctgcaggccaagttctaccagctgagcctggagaggcctgtggagcggctgctgctgaccagcctgcagagcaccatgtgcagcgccacagctggcaacctgaggaagctgtacaccctgctgagcaactgcatccccccagccaagctgcctgagctgcacagccactggctgctgaatgaccgcatctggctggcccaccgctggaggagcagagctgagagcagccactacttccagagcctggaggtgaccacccacatcctgagccagttcttcggcaccacccccagcgagaagcagggcatggccagcctcttccgctacatgcagcagaacagcgctgacaaggccaacttcaaccagggcctgtgtgcccagaacaaccacgcccccagcgacaccatccctgagagccccaagctggagcagctggtggagagccacatccagcacagcctgaatgccatctgcaccggccctgctgcccagctgtgcctgggggagctggccgtggtgcagaagagcacccacctgattggcagcggcagcgagaagatgaacatccagatcctggaggacacccacaaggtgcagccccagcccccagccagctgcagctgctacttcaaccaggccttccacctgccctgccgccacatcctggccatgctgagcgcccggcggcaggtgctgcagcctgacatgctgcctgcccagtggacagctggctgtgccaccagcctggacagcatcctgggcagcaagtggagcgagaccctggacaagcacctggccgtgacccacctgacagaggaggtgggccagctgctgcagcactgcaccaaggaggagtttgagcggcgctacagcaccctgcgggagctggccgacagctggattggcccctatgagcaggtgcagctgtag

SEQ ID NO: 18625 - DNA, 1458 bp, Artificial Sequence; identical to SEQ ID NO: 18624
  Description of Artificial Sequence: Synthetic coding sequence

SEQ ID NO: 18626 - DNA, 423 bp, Artificial Sequence
  Description of Artificial Sequence: Synthetic coding sequence
atggctgtggtgctgcctgctgtggtggaggagctgctgtctgagatggctgctgctgtgcaggagagcgcccgcatcccagatgagtacctgctgagcctgaagttcctgtttggcagcagcgccacccaggccctggacctggtggaccggcagagcatcaccctcatcagcagccccagcggcagaagagtgtaccaggtgctgggcagcagcagcaagacctacacctgcctggccagctgccactactgcagctgcccagcctttgccttctctgtgctgaggaagagtgacagcatcctgtgcaagcacctgctggccgtgtacctgagccaggtgatgaggacctgccagcagctgtctgtgtctgacaagcagctgacagacatcctgctgatggagaagaagcaggaggcctag

SEQ ID NO: 18627 - DNA, 423 bp, Artificial Sequence; identical to SEQ ID NO: 18626
  Description of Artificial Sequence: Synthetic coding sequence

SEQ ID NO: 18628 - DNA, 1230 bp, Artificial Sequence
  Description of Artificial Sequence: Synthetic coding sequence
atgattgacctgtggctgtacagctaccagaggctgctgcagaccatcgctgtgctggaggcccagaggagccaggccgtgcaggacctggagagcctgggccgccaccagcgggaggccctgaagaaccccatcggctttgtggagaagctgcagaagaaggctgacatcggcctgccctacccccagagggtggtgcagctgcctgagatcgtgtgggaccagtacacccacagcctgggcaactttgagcgggagttcaagaacaggaagaggcacaccaggagagtgaagctggtgtttgacaaggtgggcctgcctgcccggcccaagagccccctggaccccaagaaggatggagagagcctgagctacagcatgctgcccctgagtgatggccctgagggcagcagcagccggccccagatgatccggggccgcctgtgtgatgacaccaagccagagaccttcaaccagctgtggacagtggaggagcagaagaagctggagcagctgctgatcaagtacccacctgaggaggtggagagccgccgctggcagaagattgctgatgagctgggcaacagaacagccaagcaggtggccagccgggtgcagaagtacttcatcaagctgaccaaggccggcatccctgtgcccggccgcacccccaacctgtacatctacagcaagaagagcagcaccagccggcggcagcaccccctgaacaagcacctgttcaagcccagcaccttcatgaccagccatgagccccctgtgtacatggatgaagatgatgacaggagctgcttccacagccacatgaacacagctgtggaggatgccagtgatgatgagagcatccccatcatgtacagaaacctgcctgagtacaaggagctgctgcagttcaagaagctgaagaagcagaagctgcagcagatgcaggccgagagcggctttgtgcagcacgtgggcttcaagtgtgacaactgtggcatcgagcccatccagggcgtgcgctggcactgccaggactgccccccagagatgagcctggacttctgtgacagctgcagcgactgcctgcacgagacagacatccacaaggaggaccaccagctggagcccatctacagaagtgagaccttcctggaccgggactactgtgtgtcccagggcaccagctacaactacctggaccccaactacttccctgccaacagatag

SEQ ID NO: 18629 - DNA, 2712 bp, Artificial Sequence
  Description of Artificial Sequence: Synthetic coding sequence
atggccgccagccgcagcaccagggtgaccaggagcacagtgggcctgaatggcctggatgagagcttctgtggccgcaccctgaggaacagaagcatcgcccaccctgaggagatcagcagcaacagccaggtgcgcagccgcagccccaagaagaggcctgagcctgtgcccatccagaagggcaacaacaatggaagaaccacagacctgaagcagcagagcacccgggagagctgggtgagccccaggaagaggggcctgagcagcagcgagaaggacaacatcgagcggcaggccatcgagaactgtgagcggcggcagacagagcctgtgtcccctgtgctgaagaggatcaagcgctgcctgcggtctgaggcccccaacagcagcgaggaggacagccccatcaagagtgacaaggagagcgtggagcagaggagcacagtggtggacaatgatgctgacttccagggcaccaagagggcctgccgctgcctgatcctggatgactgtgagaagcgggagatcaagaaggtgaatgtgtctgaggagggccccctgaacagcgctgtggtggaggagatcaccggctacctggccgtgaatggagtggatgacagcgacagcgctgtgatcaactgtgatgactgccagccagatggcaacaccaagcagaacagcatcggcagctatgtgctgcaggagaagtctgtggctgaaaatggagacacagacacccagacctccatgttcctggacagcaggaaggaggacagctacatcgaccacaaggtgccctgcacagacagccaggtgcaggtgaagctggaggaccacaagatcgtgacagcctgcctgcctgtggagcacgtgaaccagctgaccacagagcccgccaccggccccttcagcgagacccagagcagcctgcgggacagcgaggaggaggtggatgtggtgggggacagcagcgccagcaaggagcagtgcaaggagaacaccaacaatgagctggacaccagcctggagagcatgcctgccagcggggagcctgagcccagccctgtgctggactgtgtgtctgcccagatgatgagcctgtctgagccccaggagcaccgctacaccctgcggaccagccccaggagagctgcccccacccggggcagccccaccaagaacagcagcccctacagagaaaatggccagtttgaggagaacaacctgagccccaatgagaccaatgccaccgtgtctgacaacgtgtcccagagccccaccaaccctggagagatcagccagaatgagaagggcatctgctgtgacagccagaacaatggaagtgaaggagtgtccaagcccccatctgaggcccggctgaacatcggccacctgcccagcgccaaggagagcgccagccagcacatcacagaggaggaggatgatgatcctgatgtgtactactttgaaagtgaccacgtggccctgaagcacaacaaggactaccagaggctgctgcagaccatcgctgtgctggaggcccagaggagccaggccgtgcaggacctggagagcctgggccgccaccagcgggaggccctgaagaaccccatcggctttgtggagaagctgcagaagaaggctgacatcggcctgccctacccccagagggtggtgcagctgcctgagatcgtgtgggaccagtacacccacagcctgggcaactttgagcgggagttcaagaacaggaagaggcacaccaggagagtgaagctggtgtttgacaaggtgggcctgcctgcccggcccaagagccccctggaccccaagaaggatggagagagcctgagctacagcatgctgcccctgagtgatggccctgagggcagcagcagccggccccagatgatccggggccgcctgtgtgatgacaccaagccagagaccttcaaccagctgtggacagtggaggagcagaagaagctggagcagctgctgatcaagtacccacctgaggaggtggagagccgccgctggcagaagattgctgatgagctgggcaacagaacagccaagcaggtggccagccgggtgcagaagtacttcatcaagctgaccaaggccggcatccctgtgcccggccgcacccccaacctgtacatctacagcaagaagagcagcaccagccggcggcagcaccccctgaacaagcacctgttcaagcccagcaccttcatgaccagccatgagccccctgtgtacatggatgaagatgatgacaggagctgcttccacagccacatgaacacagctgtggaggatgccagtgatgatgagagcatccccatcatgtacagaaacctgcctgagtacaaggagctgctgcagttcaagaagctgaagaagcagaagctgcagcagatgcaggccgagagcggctttgtgcagcacgtgggcttcaagtgtgacaactgtggcatcgagcccatccagggcgtgcgctggcactgccaggactgccccccagagatgagcctggacttctgtgacagctgcagcgactgcctgcacgagacagacatccacaaggaggaccaccagctggagcccatctacagaagtgagaccttcctggaccgggactactgtgtgtcccagggcaccagctacaactacctggaccccaactacttccctgccaacagatag

SEQ ID NO: 18630 - DNA, 111 bp, Artificial Sequence
  Description of Artificial Sequence: Synthetic coding sequence
atggccgccagccgcagcaccagggtgaccaggagcacagtgggcctgaatggcctggatgagagcttctgtggccgcaccctgaggaacagaagcatcgcccacccctag

SEQ ID NO: 18631 - DNA, 177 bp, Artificial Sequence
  Description of Artificial Sequence: Synthetic coding sequence
atggccgccagccgcagcaccagggtgaccaggagcacagtgggcctgaatggcctggatgagagcttctgtggccgcaccctgaggaacagaagcatcgcccaccctgaggagatcagcagcaacagccaggtgcgcagccgcagccccaagaagaggcctgagcctgtgccctag

SEQ ID NO: 18632 - DNA, 381 bp, Artificial Sequence
  Description of Artificial Sequence: Synthetic coding sequence
atgtctgtgatggacctggccaacacctgcagcagcttccagagcgacctggacttctgcagcgactgtggctctgtgctgcccctgcccggggcccaggacacagtgacctgcatccgctgtggcttcaacatcaacgtgcgggactttgagggcaaggtggtgaagacctctgtggtgttccaccagctgggcacagccatgcccatgtctgtggaggagggccctgagtgccagggccctgtggtggaccggcgctgcccccgctgtggccacgagggcatggcctaccacacccggcagatgaggtctgcagatgagggccagaccgtcttctacacctgcaccaactgcaagttccaggagaaggaggacagctag

SEQ ID NO: 18633 - DNA, 381 bp, Artificial Sequence; identical to SEQ ID NO: 18632
  Description of Artificial Sequence: Synthetic coding sequence

SEQ ID NO: 18634 - DNA, 381 bp, Artificial Sequence; identical to SEQ ID NO: 18632
  Description of Artificial Sequence: Synthetic coding sequence

SEQ ID NO: 18635 - DNA, 381 bp, Artificial Sequence; identical to SEQ ID NO: 18632
  Description of Artificial Sequence: Synthetic coding sequence

SEQ ID NO: 18636 - DNA, 381 bp, Artificial Sequence; identical to SEQ ID NO: 18632
  Description of Artificial Sequence: Synthetic coding sequence

SEQ ID NO: 18637 - DNA, 381 bp, Artificial Sequence; identical to SEQ ID NO: 18632
  Description of Artificial Sequence: Synthetic coding sequence

SEQ ID NO: 18638 - DNA, 381 bp, Artificial Sequence; identical to SEQ ID NO: 18632
  Description of Artificial Sequence: Synthetic coding sequence

SEQ ID NO: 18639 - DNA, 381 bp, Artificial Sequence; identical to SEQ ID NO: 18632
  Description of Artificial Sequence: Synthetic coding sequence

SEQ ID NO: 18640 - DNA, 381 bp, Artificial Sequence; identical to SEQ ID NO: 18632
  Description of Artificial Sequence: Synthetic coding sequence

SEQ ID NO: 18641 - DNA, 381 bp, Artificial Sequence; identical to SEQ ID NO: 18632
  Description of Artificial Sequence: Synthetic coding sequence

SEQ ID NO: 18642 - DNA, 381 bp, Artificial Sequence; identical to SEQ ID NO: 18632
  Description of Artificial Sequence: Synthetic coding sequence

SEQ ID NO: 18643 - DNA, 381 bp, Artificial Sequence; identical to SEQ ID NO: 18632
  Description of Artificial Sequence: Synthetic coding sequence

SEQ ID NO: 18644 - DNA, 381 bp, Artificial Sequence; identical to SEQ ID NO: 18632
  Description of Artificial Sequence: Synthetic coding sequence

SEQ ID NO: 18645 - DNA, 381 bp, Artificial Sequence; identical to SEQ ID NO: 18632
  Description of Artificial Sequence: Synthetic coding sequence

SEQ ID NO: 18646 - DNA, 381 bp, Artificial Sequence; identical to SEQ ID NO: 18632
  Description of Artificial Sequence: Synthetic coding sequence

SEQ ID NO: 18647 - DNA, 381 bp, Artificial Sequence; identical to SEQ ID NO: 18632
  Description of Artificial Sequence: Synthetic coding sequence

SEQ ID NO: 18648 - DNA, 381 bp, Artificial Sequence; identical to SEQ ID NO: 18632
  Description of Artificial Sequence: Synthetic coding sequence

SEQ ID NO: 18649 - DNA, 381 bp, Artificial Sequence; identical to SEQ ID NO: 18632
  Description of Artificial Sequence: Synthetic coding sequence

SEQ ID NO: 18650 - DNA, 381 bp, Artificial Sequence; identical to SEQ ID NO: 18632
  Description of Artificial Sequence: Synthetic coding sequence

SEQ ID NO: 18651 - DNA, 381 bp, Artificial Sequence; identical to SEQ ID NO: 18632
  Description of Artificial Sequence: Synthetic coding sequence

SEQ ID NO: 18652 - DNA, 381 bp, Artificial Sequence; identical to SEQ ID NO: 18632
  Description of Artificial Sequence: Synthetic coding sequence

SEQ ID NO: 18653 - DNA, 381 bp, Artificial Sequence; identical to SEQ ID NO: 18632
  Description of Artificial Sequence: Synthetic coding sequence

SEQ ID NO: 18654 - DNA, 381 bp, Artificial Sequence; identical to SEQ ID NO: 18632
  Description of Artificial Sequence: Synthetic coding sequence

SEQ ID NO: 18655 - DNA, 381 bp, Artificial Sequence; identical to SEQ ID NO: 18632
  Description of Artificial Sequence: Synthetic coding sequence

SEQ ID NO: 18656 - DNA, 381 bp, Artificial Sequence; identical to SEQ ID NO: 18632
  Description of Artificial Sequence: Synthetic coding sequence

SEQ ID NO: 18657 - DNA, 381 bp, Artificial Sequence; identical to SEQ ID NO: 18632
  Description of Artificial Sequence: Synthetic coding sequence

SEQ ID NO: 18658 - DNA, 381 bp, Artificial Sequence; identical to SEQ ID NO: 18632
  Description of Artificial Sequence: Synthetic coding sequence

SEQ ID NO: 18659 - DNA, 381 bp, Artificial Sequence; identical to SEQ ID NO: 18632
  Description of Artificial Sequence: Synthetic coding sequence

SEQ ID NO: 18660 - DNA, 381 bp, Artificial Sequence; identical to SEQ ID NO: 18632
  Description of Artificial Sequence: Synthetic coding sequence

SEQ ID NO: 18661 - DNA, 381 bp, Artificial Sequence; identical to SEQ ID NO: 18632
  Description of Artificial Sequence: Synthetic coding sequence

SEQ ID NO: 18662 - DNA, 381 bp, Artificial Sequence; identical to SEQ ID NO: 18632
  Description of Artificial Sequence: Synthetic coding sequence

SEQ ID NO: 18663 - DNA, 381 bp, Artificial Sequence; identical to SEQ ID NO: 18632
  Description of Artificial Sequence: Synthetic coding sequence

SEQ ID NO: 18664 - DNA, 2133 bp, Artificial Sequence
  Description of Artificial Sequence: Synthetic coding sequence
atggacctgcctgccctgctgcctgcccccacagcccggggcggccagcacggcggcggccctggccccctgcggcgggccccagcccccctgggcgccagccctgcccggcggcggctgctgctggtgcggggcccagaagatggcggccctggggcccggcctggagaggccagcggccccagccccccaccagcagaagatgacagtgatggagacagcttcctggtgctgctggaggtgccccatggaggagctgctgctgaggccgccggcagccaggaggccgagcccggcagccgggtgaacctggccagcaggcctgagcagggccccagcggccctgctgcccctcctggccctggggtggccccagctggagctgtgaccatcagcagccaggacctgctggtgcggctggacagaggagtgctggccctgagcgcccctcctggccctgccacagctggagctgctgccccccggcgggccccccaggccagcggccccagcaccccaggctaccgctgcccagagccccagtgtgccctggcctttgccaagaagcaccagctgaaggtgcacctgctgacccatggaggcggccagggcagaagacccttcaagtgccccctggagggctgcggctgggccttcaccaccagctacaagctgaagaggcacctgcagagccatgacaagctgcggcccttcggctgccctgtgggcggctgcggcaagaagttcaccaccgtgtacaacctgaaggcccacatgaagggccacgagcaggagagcctcttcaagtgtgaggtgtgtgccgagcgcttccccacccacgccaagctgagcagccaccagaggagccactttgagcctgagcggccctacaagtgtgacttccctggctgtgagaagaccttcatcaccgtgtctgccctcttcagccacaacagagcccacttccgggagcaggagctgttcagctgcagcttccctggctgcagcaagcagtatgacaaggcctgccgcctgaagatccacctgcggagccacactggagagcggcccttcatctgtgacagcgacagctgtggctggaccttcacctccatgagcaagctgctgcggcacaggaggaagcatgatgatgaccggcgcttcacctgccctgtggagggctgcggcaagagcttcaccagggctgagcacctgaagggccacagcatcacccacctgggcaccaagccctttgaatgtcctgtggagggctgctgtgcccgcttcagcgcccggagcagcctgtacatccacagcaagaagcacgtgcaggatgtgggcgcccccaagagccgctgccctgtgtccacctgcaacagactcttcaccagcaagcacagcatgaaggcccacatggtgcggcagcacagccggcggcaggacctgctgccccagctggaggcccccagcagcctgacccccagcagcgagctgagcagccctggccagagcgagctgaccaacatggacctggccgccctcttcagtgacaccccagccaatgccagcggcagcgctgggggcagtgatgaggccctgaacagcggcatcctgaccattgatgtgacctctgtgagcagcagcctgggcggcaacctgcctgccaacaacagcagcctgggccccatggagcccctggtgctggtggcccacagcgacatcccccccagcctggacagccccctggtgctgggcacagctgccaccgtgctgcagcagggcagcttctctgtggatgatgtgcagacagtgtctgctggggccctgggctgcctggtggccctgcccatgaagaacctgagtgatgaccccctggccctgaccagcaacagcaacctggccgcccacatcaccacccccaccagcagcagcaccccccgggagaatgcctctgtgcctgagctgctggcccccatcaaggtggagccagacagccccagcaggcctggagctgtgggccagcaggagggcagccacggcctgccccagagcaccctgcccagccctgctgagcagcacggggcccaggacacagagctgtctgctggcaccggcaacttctacctggtgtag

SEQ ID NO: 18665 - DNA, 2577 bp, Artificial Sequence
  Description of Artificial Sequence: Synthetic coding sequence
atggacctgcctgccctgctgcctgcccccacagcccggggcggccagcacggcggcggccctggccccctgcggcgggccccagcccccctgggcgccagccctgcccggcggcggctgctgctggtgcggggcccagaagatggcggccctggggcccggcctggagaggccagcggccccagccccccaccagcagaagatgacagtgatggagacagcttcctggtgctgctggaggtgccccatggaggagctgctgctgaggccgccggcagccaggaggccgagcccggcagccgggtgaacctggccagcaggcctgagcagggccccagcggccctgctgcccctcctggccctggggtggccccagctggagctgtgaccatcagcagccaggacctgctggtgcggctggacagaggagtgctggccctgagcgcccctcctggccctgccacagctggagctgctgccccccggcgggccccccaggccagcggccccagcaccccaggctaccgctgcccagagccccagtgtgccctggcctttgccaagaagcaccagctgaaggtgcacctgctgacccatggaggcggccagggcagaagacccttcaagtgccccctggagggctgcggctgggccttcaccaccagctacaagctgaagaggcacctgcagagccatgacaagctgcggcccttcggctgccctgtgggcggctgcggcaagaagttcaccaccgtgtacaacctgaaggcccacatgaagggccacgagcaggagagcctcttcaagtgtgaggtgtgtgccgagcgcttccccacccacgccaagctgagcagccaccagaggagccactttgagcctgagcggccctacaagtgtgacttccctggctgtgagaagaccttcatcaccgtgtctgccctcttcagccacaacagagcccacttccgggagcaggagctgttcagctgcagcttccctggctgcagcaagcagtatgacaaggcctgccgcctgaagatccacctgcggagccacactggagagcggcccttcatctgtgacagcgacagctgtggctggaccttcacctccatgagcaagctgctgcggcacaggaggaagcatgatgatgaccggcgcttcacctgccctgtggagggctgcggcaagagcttcaccagggctgagcacctgaagggccacagcatcacccacctgggcaccaagccctttgaatgtcctgtggagggctgctgtgcccgcttcagcgcccggagcagcctgtacatccacagcaagaagcacgtgcaggatgtgggcgcccccaagagccgctgccctgtgtccacctgcaacagactcttcaccagcaagcacagcatgaaggcccacatggtgcggcagcacagccggcggcaggacctgctgccccagctggaggcccccagcagcctgacccccagcagcgagctgagcagccctggccagagcgagctgaccaacatggacctggccgccctcttcagtgacaccccagccaatgccagcggcagcgctgggggcagtgatgaggccctgaacagcggcatcctgaccattgatgtgacctctgtgagcagcagcctgggcggcaacctgcctgccaacaacagcagcctgggccccatggagcccctggtgctggtggcccacagcgacatcccccccagcctggacagccccctggtgctgggcacagctgccaccgtgctgcagcagggcagcttctctgtggatgatgtgcagacagtgtctgctggggccctgggctgcctggtggccctgcccatgaagaacctgagtgatgaccccctggccctgaccagcaacagcaacctggccgcccacatcaccacccccaccagcagcagcaccccccgggagaatgcctctgtgcctgagctgctggcccccatcaaggtggagccagacagccccagcaggcctggagctgtgggccagcaggagggcagccacggcctgccccagagcaccctgcccagccctgctgagcagcacggggcccaggacacagagctgtctgctggcaccggcaacttctacctggagagcggcggcagcgccaggacagactaccgggccatccagctggccaaggagaagaagcagagaggagctggcagcaatgctggggccagccagagcacccagaggaagatcaaggagggcaagatgagccccccccacttccacgccagccagaacagctggctgtgtggcagcctggtggtgcccagcggcggccggcccggccctgccccagctgctggggtgcagtgtggggcccagggcgtgcaggtgcagctggtgcaggatgaccccagcggggagggcgtgctgcccagcgcccggggccctgccaccttcctgcccttcctgactgtggacctgcctgtgtatgtgctgcaggaggtgctgcccagcagcggcggccctgctggccctgaggccacccagtttcctggcagcaccatcaacctgcaggacctgcagtag

SEQ ID NO: 18666 - DNA, 546 bp, Artificial Sequence
  Description of Artificial Sequence: Synthetic coding sequence
atgatggacaaccggggcaacagcagcctgcccgacaagctgcccatctttccagacagcgctcggctcccactgacaaggtcattctacctggaacccatggtgaccttccatgttcaccccgaggcccccgtctcctccccatattccgaggagcttcccagattacctttccctagcgattcgttgattctgggaaattattcagagccgtgcccgttcagcttcccaatgccttaccctaactatcgcggctgcgagtactcctacggacccgcattcacgaggaaaagaaatgagcgggagcgtcaacgggtcaagtgcgtcaatgaaggttacgctcagctgaggcatcacctaccagaggagtacttggagaagcgcctttccaaagtcgagactctaagagctgcgatcaaatacattaattatcttcaatctttactctatcccgataaggccgagaccaaaaataacccaggcaaggtgtccagcatgattgcaactacatcacatcatgccgatccaatgttccgaattgtgtag

SEQ ID NO: 18667 - DNA, 546 bp, Artificial Sequence
  Description of Artificial Sequence: Synthetic coding sequence
atgatggacaaccggggcaacagcagcctgcccgacaagctgcccatcttccctgattccgcaagactgcccctgacacgcagtttctatttggaaccaatggtgacgtttcacgtccacccagaggctcctgttagttccccatactcggaagagctcccacggcttccgttccctagcgactcattaatcctcggcaattacagtgagccttgcccattttctttccctatgccctatcctaattatcgcggatgcgaatacagctatgggcccgctttcacaagaaagcggaacgagcgagagcggcagagggtgaaatgcgtcaatgaaggttatgcccaactgcgccatcacttgcctgaagagtacttagaaaagagactttcaaaggtcgagaccctgcgcgcggctatcaaatatataaactacctccaatccctgctttatccagacaaagctgagaccaagaataaccctggaaaagtctcgagcatgatcgcaacaactagccaccacgctgatccaatgttccggatcgtatag

SEQ ID NO: 18668 - DNA, 522 bp, Artificial Sequence
  Description of Artificial Sequence: Synthetic coding sequence
atgatggagacccggaagcccgccgagcggctggccctgccctacagcttgagaactgccccactgggtgtcccagggaccctacctggattgcctcgtagggatcccctgagggtcgcactgaggctggatgcagcgtgctgggaatgggcccgctcaggctgtgccaggggatggcagtacctgcccgtgccccttgatagtgcctttgaaccagctttcctgaggaagagaaatgagcgcgagcgccagagggtgcgatgtgtgaacgaaggctacgctcggctgagagaccatctgcctagggaacttgctgacaagagactgagcaaagttgagaccctgagggccgccatcgactatattaagcacttgcaggaacttctcgagcgccaggcctggggactcgagggcgccgccggggcagtgccccagagaagagctgagtgcaatagtgacggcgaaagcaaggcgtccagcgcccccagtccttccagtgagccggaggagggtggcagctag

SEQ ID NO: 18669 - DNA, 819 bp, Artificial Sequence
  Description of Artificial Sequence: Synthetic coding sequence
atggaggccgaggagagcgagaaggccgccaccgagcaggagcccctggagggcaccgagcaaacactcgacgccgaggaagagcaggaagagtctgaagaagccgcctgcgggtctaagaaaagggtggttccaggtatcgtttatttggggcatatcccccctagattcagaccgctccacgtccgtaatcttttatccgcgtacggggaggtcggcagggtatttttccaggcggaggaccgctttgttcgtcggaaaaaaaaagccgcagcagctgcaggtggaaagaagcggagctataccaaggactatactgagggctgggtcgaatttagggataagagaatagcaaaaagggttgccgccagcctgcacaacactcccatgggtgctaggcgacggagcccttttcgatacgacctttggaacctgaaatatctgcaccggttcacatggtctcacctgagtgagcacttggctttcgaacgccaggtccgacgccagcggctgagagctgaggtggctcaggcaaagcgggaaacagacttttacctgcagtccgtggaacgaggtcagcgttttttggctgcagatggggatccagccaggccagacggctcttggactttcgcacagagacctactgaacaggagttacgggccagaaaagcagcacggcctgggggacgcgaacgggcgcgcctggctaccgcacaggataaagcgcgtagtaacaagggtcttctcgcgcgtattttcggggcaccccccccatctgagagcatggaggggccgtccctcgtgcgcgacagctag

SEQ ID NO: 18670 - DNA, 3396 bp, Artificial Sequence
  Description of Artificial Sequence: Synthetic coding sequence
atgttccagatccccgtggagaacctggacaacatccggaaggtgcgtaagaaggtcaaggggattctggtggatattggcctggattcctgtaaagagctgctcaaagacctcaaaggcttcgacccgggcgaaaaatatttccacaatacctcgtggggggacgtgtccctgtgggagcccagcggaaagaaggtgcgatacagaaccaagccttattgctgcgggctgtgtaaatactccacaaaggtgctgacttccttcaagaatcatcttcacagatatcacgaagatgagatcgatcaggaattagtcataccgtgccccaactgcgtgttcgcttcacagcctaaagtcgtgggccggcacttcaggatgttccacgcacctgtcagaaaagtacagaattacaccgtcaatatccttggcgagaccaagagcagcaggagtgacgtcatcagctttacatgtctaaagtgtaacttctctaacaccctgtattatagtatgaaaaagcacgttctggtggcacattttcattatcttattaactcctactttggactgagaaccgaggaaatgggtgaacagcccaagaccaatgacactgtgagtatagagaagatcccgcctccagacaagtactattgcaagaagtgtaatgcaaatgccagctcgcaagatgctttaatgtatcacattcttacatccgatatccatagggacctggagaataagctgcgaagtgtcatctcagagcacataaaaaggaccggacttctcaagcagacgcacattgccccgaagccagccgcccatctagccgctccagctaacgggtcagcaccctccgctccggctcagcctccttgcttccacctggcactgccacagaactccccctcccccgccgccggccaaccagtgacagttgctcagggtgctcctggttccctaacacacagccccccagccgccgggcagtcacatatgacgttggtcagtagccccctgccagtcggacagaattccctaacactgcagccccccgctccacagcccgtgtttctgtcccacggtgttcccttacaccaatctgtgaatccccccgtactaccactatcgcagcctgtgggcccagtcaacaagagcgtggggacatccgtgttacccataaaccagacagtgagaccaggcgtcctccctctgactcaaccggtgggccccattaatcggcctgtgggccccggcgtactcccggtgagtccaagtgtaacccctggcgtgctccaggccgtgagtccaggagtgttgtctgtaagccgggcagtcccgtctggagttctgcctgctggtcaaatgacacctgcagggcagatgaccccggccggggtgattcccggtcaaaccgctacaagtggagtgctgcctacaggccaaatggtgcagagcggagttcttccagtaggtcagaccgcgccctcccgtgtgctaccaccaggacaaaccgcaccactcagagtaatttcagccgggcaagtcgtgccatctgggctactctcaccaaaccaaacggtgtctagcagcgcagtggtgccggtgaatcagggggtcaacagcggcgtgctgcaattaagccaacctgtcgtgtcaggggttctcccagtgggccagccggtgcgaccaggagtccttcagctcaaccagaccgtcgggaccaatatcctaccggtgaaccaaccagtccgccccggcgcctcccagaacactacttttttgactagcggatcaatactgaggcagttaattcctacaggtaaacaagttaacggtatacctacttatacgctggctccggtcagcgtcactctgccagttccacctggcggcctggccactgtagcacctccacaaatgcccatacagctcctgccaagcggagcagccgcgccaatggccggtagtatgcccgggatgccgtctcccccagtcttggttaacgctgcccagtccgtgtttgtacaagcatcttctagtgctgctgacacaaaccaggtgcttaagcaggccaagcaatggaagacatgtccagtatgtaacgagctctttccttccaatgtctaccaggtgcatatggaagtggcccacaaacacagtgaatctaaaagcggggagaaactggagccagaaaagctggcagcctgcgccccatttcttaagtggatgagggagaagaccgtaagatgtctgagttgcaagtgtctggtgtctgaggaggagctgattcatcacctcctcatgcatggtttagggtgcctcttttgcccctgtacctttcacgacattaagggtctgagtgagcattcccggaataggcacctaggaaagaaaaaattgcctatggactattcaaatcggggattccagctcgacgtcgacgccaatgggaacctcctgttcccacatctggacttcatcactatcctgccaaaagagaagctcggcgagagagaggtctacctggcaattctcgccggcattcattcaaagtcgctggtgccggtgtacgtgaaggtgcggcctcaggcagaagggacaccaggcagcacaggaaagcgtgtctcaacctgccccttctgctttggcccttttgtaaccaccgaggcttacgagttgcatctgaaggaaagacaccatatcatgcccacggtgcacacagtgctcaagagtcctgcattcaaatgcatccactgctgcggtgtgtataccggaaatatgacgctggctgcaattgcggtacaccttgtccgatgccgaagcgcccccaaagacagtagcagcgacctccaggcccagccaggctttatccacaatagcgagttactactagtttctggagaagtcatgcatgattcatcattcagcgtcaagaggaaactgcccgacggccatcttggtgcggaggatcaacggcatggggaagaacagcccccgattctcaatgcagacgctgctcccggccccgaaaaggtgacttccgtcgtaccctttaaacggcaaagaaatgaatccaggactgaagggcccattgtcaaggatgaagctctgcagattctggcactcgatcctaaaaagtacgagggcaggagctacgaagaaaaaaagcagtttttgaaggattattttcacaagaagccttacccaagcaaaaaagagatagagctgctgtcaagcctcttctgggtgtggaagatagacgtggcctccttcttcggtaaacgtcgttacatctgtatgaaggcaatcaagaatcacaagccatctgtcctactgggctttgatatgtccgagctgaagaacgtgaagcatcggcttaacttcgagtatgagccctag

SEQ ID NO: 18671 - DNA, 516 bp, Artificial Sequence
  Description of Artificial Sequence: Synthetic coding sequence
atgttccagatccccgtggagaacctggacaacatccggaaggtgagaaaaaaagtgaagggcattctcgtagacattgggctcgacagctgtaaagagcttctaaaagacctgaaagggttcgatcctggcgagaaatactttcacaacacatcctggggcgacgtgagcctctgggagccttccggcaagaaggtaaggtaccggaccaagccttattgttgtggactttgcaagtactccaccaaagtgctcacatccttcaaaaatcatctgcaccggtaccacgaagatgaaattgaccaggagttggtcatcccttgcccaaattgcgttttcgcaagccagcccaaagttgtcggtcgccatttcaggatgttccacgcccccgtccgcaaagtgcagaattataccgtgaatatactcggcgaaaccaaatcctcaaggtcagatgtgatatcctttacatgcctaaagtgtaactttagcaatacactctactacagcatgaaatag

SEQ ID NO: 18672 - DNA, 1512 bp, Artificial Sequence
  Description of Artificial Sequence: Synthetic coding sequence
atggccgccgccatcaccgacatggccgacctggaggagctgagccgattgtcacctttgccacctggcagccccggttcggccgcccgcggccgggccgagccacccgaggaagaggaagaggaagaagaagaggaagaggaggccgaggctgaagccgtggctgcactgttacttaacggtggatcaggagggggcggcggagggggagggggcggtgttggtggaggcgaggccgaaacaatgtcagaaccttcacccgaatcagcctcccaagctggcgaagacgaagacgaggaagaggacgacgaggaggaggaggacgagtcatcgagttctggtggcggagaggaggagtccagtgccgagagcctcgtcggaagtagcgggggatcaagctcagatgagaccagatcactgtcccctggagccgctagcagcagttcgggtgacggagatggcaaggagggcctcgaagagccaaaaggacctaggggaagccagggcggcggcggtggaggaagctcctcaagctcggtcgtcagctctggaggcgacgaaggctacggtacgggcggcgggggctccagcgccactagcggaggtaggcgtggatctctcgagatgtcgtctgacggggagcctctgtcacgcatggactcagaggattccatcagttctacgattatggatgtggatagtaccatttccagcgggcggagtacgcccgccatgatgaacgggcagggtagcactaccagtagctccaagaacattgcttacaattgttgttgggaccaatgccaggcgtgctttaacagttctcccgatctcgctgatcacattagatctattcatgtggatggacagagggggggtgtcttcgtgtgtctctggaaaggctgcaaggtgtataatacgccctcaacatcccagagttggttacagagacacatgctgacacattccggtgataagccattcaagtgtgtcgtcggcggatgtaatgcgtcttttgcaagccaggggggactggcacgccatgtgcccacgcacttctcccaacagaattcctctaaggtcagctcacagcccaaggctaaagaggagtcaccttctaaagccgggatgaataagcgccggaagctgaaaaataagagaaggaggtctctgccgcgtccccacgatttttttgacgcccagaccctcgatgccattcgtcaccgcgccatatgtttcaatctctctgcccacattgaatcactagggaaaggccactcggtggtcttccactcaacggtcatagctaagaggaaagaagactccgggaaaataaagttgctcctccactggatgcccgaggatatcttgcctgacgtctgggttaacgaatccgaacggcaccaattgaaaaccaaagttgtacacttaagcaaattgcccaaagacaccgctcttttattggaccccaacatatatagaaccatgccacagaaaagactgaagaggtag

SEQ ID NO: 18673 - DNA, 906 bp, Artificial Sequence
  Description of Artificial Sequence: Synthetic coding sequence
atgtacacccggcggtacagcagcatcagcagcaccatcatggacgttgattctacaatttcttcagggcgctcgaccccagccatgatgaatggtcagggatccactactagttcctcaaagaacatcgcctataattgctgctgggatcagtgccaggcctgcttcaattcttcccctgaccttgcagatcacatacgatccattcacgtcgatggacaaagaggaggcgtatttgtatgtctttggaaaggatgcaaagtctacaatacgccctcaacctcccaatcgtggcttcagcgccacatgctgactcatagtggagataaaccttttaaatgtgtagtgggagggtgcaatgcctctttcgctagccagggcggtctagcccggcacgtacccacccactttagccagcagaatagttcaaaagtgtcgagtcaaccaaaagcgaaagaggaaagtcccagcaaagccggcatgaataaacggaggaagctgaaaaataaaagaagacggagcctcccaaggccccatgatttcttcgacgctcaaacacttgatgcaataaggcatcgcgcgatctgtttcaatctcagtgcacacatagagtcccttggcaagggtcactctgtagtctttcactcaaccgttatagctaagaggaaggaagactcaggcaaaattaagctcctgctacactggatgcctgaagacatccttccagatgtctgggtgaatgaatctgagaggcaccaacttaaaacaaaggtagtacacctttctaagctgcctaaagatactgcgttactcttggaccccaacatctataggactatgccgcaaaaacggctgaagcgaacactcatcaggaaggtctttaatctctatctgagtaagcaatag

SEQ ID NO: 18674 - DNA, 1554 bp, Artificial Sequence
  Description of Artificial Sequence: Synthetic coding sequence
atggccgccgccatcaccgacatggccgacctggaggagctgagccggctctctccgcttcctccgggttcgcccggatccgccgcacggggacgtgctgagcccccagaggaagaagaagaggaagaggaggaagaagaggaagccgaggccgaggctgtggccgccctgctgctgaatggcggttctggaggcggtgggggcgggggtggtgggggcgttgggggcggggaggccgaaacgatgagcgagccttccccagagagcgctagccaggccggtgaagacgaggacgaggaggaggacgatgaagaggaggaggatgagtcatccagcagcggcggcggcgaagaagagagttccgctgaatccctcgtgggatcttctggtggctcctcgagcgacgaaacaaggtctctgtcgccaggcgcggccagcagcagctcaggagatggcgatggaaaggaggggttggaagagcctaaggggcctagaggaagtcaggggggcggggggggggggagttcctcgtccagcgtcgtctcttcgggcggagacgaaggctatggcacaggcggcggagggtcaagtgccaccagtggaggccgccgcggaagccttgagatgagcagtgacggcgaaccgctttctagaatggattccgaagactccatctcttccaccatcatggacgtagactccaccatctcttccggaagaagcacccctgctatgatgaatggccaaggaagtaccactagctcttcaaagaatatagcatataattgttgttgggaccagtgccaagcatgtttcaattctagtcccgaccttgccgaccatatccgaagtatacatgtggatggacaacggggtggcgtgtttgtttgcctgtggaagggttgtaaagtgtacaataccccctcgacctctcaatcatggctccagaggcatatgctgacacacagcggagataaaccatttaagtgcgtagtgggaggatgtaacgctagtttcgcctcacaaggaggactcgcccggcacgttcctacccacttttctcagcagaacagctccaaggtttcctcgcagccaaaggctaaggaggaatctccgtcgaaggctggtatgaataagaggagaaaactcaaaaacaaacgacgtcggtcgcttccccgcccccacgacttcttcgatgcgcaaactctggacgcaatccgtcaccgtgctatctgcttcaacctttcagcgcacatagagtccctcggaaaaggccattccgtcgtgtttcacagcacagtgattgctaagcggaaggaagattccgggaagatcaagctccttctccattggatgccggaggacattctccccgacgtctgggttaatgagtcagagcgccaccagctcaaaacaaaggtggtacatttgagtaagcttcctaaggacaccgcactgctcctggatcctaatatatacagaaccatgccccagaagagacttaaacgcaccctgatacgtaaagtgttcaatctatacttgagcaaacagtag

SEQ ID NO: 18675 - DNA, 1314 bp, Artificial Sequence
  Description of Artificial Sequence: Synthetic coding sequence
atggccgccgccatcaccgacatggccgacctggaggagctgagcaggttaagtccgttgcccccgggtagccccggatctgctgcccgaggccgcgccgaacctccagaggaggaagaagaagacgagagttctagtagcggcggaggtgaagaggagagctccgctgagtcgctggtgggatcctccggtggcagcagtagcgatgagactcgatcactgtcccctggggcagcgagttcttcttccggcgatggggacggtaaagaaggactggaagaacctaaaggccctcgcggcagccaaggggggggcgggggaggaagttcttcctccagtgtcgtgtcctctggcggagatgaaggctacggcacagggggcggagggtcgtccgccacttcagggggaagaagggggtcgcttgaaatgtcctctgacggcgagcccctgtcaaggatggacagcgaggactccatctccagcacaattatggacgttgactcgacaataagcagtggacggagcacacccgccatgatgaatggtcagggctctactactagctctagtaaaaacattgcctataactgttgctgggaccagtgccaggcgtgtttcaattctagccccgatttggccgatcatatacggagcattcacgtcgacggtcaaaggggcggggtgtttgtctgcttgtggaaagggtgtaaagtttataatacgccgagcacaagtcagagttggctgcaaagacatatgctgacgcatagtggcgataagccattcaaatgcgtggtggggggctgcaatgcgtcctttgcatcccagggcggtctcgcccggcatgttccaacacacttctcacagcagaactcgtcaaaggtgtcctcacagccaaaagccaaggaggagtccccatccaaggccggcatgaataaacgaagaaaactgaagaacaaacgtaggcggagtctcccccgaccccatgactttttcgacgctcagacgctcgacgccatacgccatagagcaatttgttttaatttatccgctcacattgagagtcttggtaaaggccactctgtggtatttcacagcacagtgatcgccaaaagaaaggaggacagcggcaagatcaagttacttttgcactggatgcccgaggatattttgcccgacgtctgggtgaacgaaagtgaaagacatcaactgaagacaaaggtcgtacatctgtctaaactgcccaaagatactgccctgttgctcgaccctaatatctaccggacgatgccacagaagcgactcaagcgttag

SEQ ID NO: 18676 - DNA, 3681 bp, Artificial Sequence
  Description of Artificial Sequence: Synthetic coding sequence
atggacagcttcgacctggccctgctgcaggagtgggacctggagagtctgtgcgtatatgagcctgatcgcaatgcccttagaaggaaagaaagggagcgtagaaatcaggagacacaacaggacgatggtacattcaactcatcctactcgctcttttcagagccatacaaaaccaataaaggggatgagttgtcgaataggattcagaacacactaggaaattatgacgaaatgaaggacttcctcacagataggtccaaccagtcccatttagttggcgtccccaagcctggggttccccagaccccggtgaacaaaatcgatgaacactttgtggctgacagcagagcccagaatcagcccagctctatttgcagcacaacaacatcaacccctgccgccgtgcccgtgcagcagagcaagcgaggaactatggggtggcagaaggcaggccaccctccctcagacggccagcaaagggcaacccagcagggatctctacgcaccttgttaggcgatggagtgggtagacagcaacctcgtgctaaacaagtttgcaatgtggaggttggacttcagacccaggaacggcctcccgccatggccgctaaacacagcagctccgggcactgtgtgcagaatttcccccctagcctagcatcaaaaccatcgctggtgcagcagaagcctactgcttacgtgaggcccatggacggacaagatcaagcccccgatgagtctcccaaactcaagtccagctcagagacgtcggtgcactgcacctcttaccggggagtcccagcaagcaaaccagagcccgctcgggccaaggctaagctgagtaagttcagtattcccaaacagggagaagaatcccgcagcggcgaaaccaactcttgtgtggaggagattattcgagagatgacttggctgccccctctctcagctatccaagcccctggaaaagtggaaccaaccaagtttccgttcccaaacaaggactctcagttagtgtcgtctggtcataataatcctaaaaaaggggacgccgagcccgagtcacctgactcgggaactagtaacacttcaatgctcgaagacgacctgaaactcagtagcgacgaagaggagaacgaacaacaggccgctcagagaaccgctctgcgggcccttagcgactctgccgtcgtgcagcagcctaactgcaggacttccgtcccgagcagtaaaggatcgtcctcgtcgtcctcctcaggctcgtctagttcaagctcggatagtgaatcctcctccgggtcagatagtgagaccgaatcctccagcagtgagtctgaaggaagcaagcctccacatttctcctcccccgaggccgagcctgcgagcagcaataaatggcagctcgacaagtggctcaataaagtgaatccccacaagcctcccattctgattcagaacgagtcccacggctctgaaagcaatcaatactacaaccctgtcaaagaggacgttcaagactgtggtaaggtgcccgatgtatgccagccctccctgagggagaaagaaattaaatcaacatgcaaagaggagcagcgcccacgaaccgccaataaggcccctgggtcgaagggggttaaacagaaatcgccccctgcagccgtggcagttgccgtatctgctgccgcaccccctccggccgtgccatgcgcgcccgccgagaacgccccagctcctgctaggcggagtgctggaaaaaagcctacccggagaactgaacgtacctctgccggcgacggcgcaaattgtcaccggcctgaggaacctgccgcagcagacgcccttggaacatcggtcgttgtcccaccagagcccacaaagacgcggccctgcggcaataaccgcgctagccacagaaaggaattacgcagttccgtgacatgcgagaagaggaggacacgcggcttgagtaggatcgtgccaaaatcaaaggagttcattgagacagagtcctcctcttcttcctcctcgtccgattctgatttggagagtgaacaggaggagtatcctttgagtaaggctcagaccgtggcggcgtctgccagttctggtaacgatcaaagacttaaggaagccgcggcaaacggagggtcgggccctcgtgcacccgtcggttctattaatgcccgcacaacttccgatatagccaaagagttggaggaacaattctatacactggtgccatttgggcgcaacgagcttctgagtcctctgaaagattccgatgagataaggtcactgtgggttaaaatcgacttgaccttgctgtctaggatccccgaacatttgccccaggagccaggcgtactgagcgccccagccacaaaagacagtgaaagtgcccctccatctcacacatctgatacccctgcggaaaaagctctacccaagtctaagcgaaagcggaagtgcgacaatgaggacgactaccgcgagataaagaaaagtcagggcgagaaggatagcagctccaggcttgcaacttccacaagtaacactttgagtgccaatcactgtaatatgaacatcaacagcgttgcaattcccatcaataaaaacgaaaaaatgctgcgatcaccgataagccccctgagcgatgcgtctaaacacaagtacaccagtgaggacttgacctcatccagcaggccaaatgggaactctttgtttacttcagcaagctcatcaaagaagcccaaggccgactcccaactgcaacctcacggtggagatttgaccaaagccgctcacaataattccgaaaacattccacttcataaaagcaggccacaaactaaaccatggtccccaggctctaacggccatcgcgattgtaaaagacagaagctggtatttgacgacatgccccgcagcgctgactactttatgcaggaggcaaagcgcatgaaacacaaagctgacgcgatggtggaaaagttcggaaaagcattgaattatgctgaggcagctctctccttcattgagtgtgggaatgccatggagcagggacctatggaaagtaagtccccttacaccatgtattcagaaacagtggagcttattaggtatgctatgcgactaaaaactcacagcggccctaacgccactcctgaggataagcagcttgcagcactgtgctacagatgcctggctcttctctattggcggatgttccggctgaagcgcgatcacgctgttaagtacagcaaggctttgattgattattttaaaaattcctcaaaggctgcacaagcccctagtccgtggggagcctcaggaaagtccacaggcactcccagccccatgagcccaaatccatccccagccagttccgtgggctcccaaggatcattgtctaacgccagcgccctctccccttctactattgtgtcaatcccacagcgaatccaccagatggctgctaatcacgtgtctataaccaattccattttacattcgtacgattactgggaaatggccgataacctagcgaaagaaaaccgggagttcttcaacgaccttgacctgttgatgggccctgtcacactacactctagtatggagcacctggtacagtactctcagcagggactgcattggctgaggaacagcgctcacttgtcatag

SEQ ID NO: 18677 - DNA, 3756 bp, Artificial Sequence
  Description of Artificial Sequence: Synthetic coding sequence
atggacagcttcgacctggccctgctgcaggagtgggacctggagtcgctttggggcgaggatattttgaatcagaggaacgactccctggttgtggagttccagtcctcagcttctagatgcaggtcggtatatgagccagacaggaatgccctacgacggaaggagcgggagcggagaaatcaggaaactcaacaggacgacgggaccttcaacagttcttattctttattcagcgagccgtataagactaacaagggagatgagctgtctaatcgaatccagaatacgcttggaaattacgacgaaatgaaggactttctgacagatcgctctaatcagtctcacctggtgggagtcccaaaaccaggcgtcccacagacccccgtgaataagattgacgagcattttgtggcagacagtagggcccaaaaccaaccatcaagtatatgctctactactacctctacgcctgctgctgttccagtccaacaaagcaagaggggcactatgggttggcagaaggccggacaccccccctctgatggccaacagcgggccacacagcaaggttcattaaggactcttctcggagacggtgtgggtagacagcagccacgggctaagcaggtctgtaatgtcgaggtcggacttcaaacacaggaacggccacccgcaatggctgccaaacatagctcttccgggcactgtgtgcagaattttcctccgagcctcgcctccaagccctctttagtccagcagaagccaactgcatacgtcaggcccatggatggtcaggatcaggcgcccgatgagtcacctaagctgaagtcttcatctgaaacatccgtgcactgtacgtcgtaccgcggggtccctgccagcaaacccgagcctgcgcgagcaaaggctaagctgagcaagttttctatccctaaacagggcgaggaatcgcggtcgggagaaaccaattcatgcgtggaagagataatccgggaaatgacctggcttccaccactgtctgctatacaggcgccaggcaaagtcgagccaaccaaattcccgttccccaacaaagatagccagctagtctcctcagggcacaataacccaaagaaaggcgacgcagagcctgaaagtcccgattcagggacttcaaatacatccatgctcgaagacgaccttaagctgagttccgacgaggaggagaatgagcagcaggcagctcaacgaacagccctgcgagccctgagcgattctgctgtggtgcagcagcctaactgtcgtacctctgtcccctcttcgaaggggagttcttctagcagctcgagtggttctagctcatcttcatcggactctgagagcagctccggttctgattccgagacagagtcttcaagttcagagtcagaagggtccaagccaccacacttctcaagccctgaagcagaacctgcgagttcaaacaagtggcagctggataagtggttgaataaagttaatcctcacaagcctccaatcctcattcaaaatgaatcccatggcagcgaatccaaccagtactacaaccccgtgaaggaggacgtgcaggactgcgggaaagtccctgatgtttgtcagccatctctccgtgaaaaagagataaagtcaacttgcaaggaggaacagaggccccgcaccgcaaataaggctcctggatccaaaggggtcaagcaaaagtcccccccagctgctgtcgctgtggctgtgtctgcagcagcacctcctccagccgtcccatgcgctcccgccgagaacgccccagcaccggctcgcaggagcgctgggaaaaagccaacacggcggactgagcgaacctctgcaggcgacggcgctaattgccacaggcccgaggagcctgctgccgccgacgcccttggcacatccgtggtggtaccacccgagcccaccaaaaccaggccatgcgggaacaatagggcttcccaccggaaggaattacgttcgtctgtgacctgtgagaagaggaggactcgggggcttagcaggatcgttcctaaatccaaggaattcatcgagactgaatcaagctccagttcgtcaagctccgattccgacctcgagagcgaacaggaagagtaccctctgtcaaaggcacaaaccgttgccgcctctgcctcttccggaaacgatcagcgcctgaaggaagctgcagccaacggggggtcaggcccacgcgcgccggtgggatccatcaacgctcgaacaaccagcgatatcgccaaggagttggaagaacagttttacacacttgtgccttttggaaggaacgaactgctgtcacccctgaaagacagcgatgaaattcggtccctctgggtaaaaatcgacctgaccttgctctcccggattcccgaacacctaccgcaggagcctggcgtcttgtcagccccggccaccaaggatagcgagagcgcccccccctcccacacatctgacactcctgcggagaaagccttacctaaatccaagaggaagcggaagtgcgacaacgaggatgactatcgcgaaatcaaaaagtcacagggcgaaaaagacagcagctccagattagcgacgagcacttccaacaccctctccgccaaccactgcaacatgaatataaattccgtggctatccccatcaacaagaacgagaagatgctcaggtcacccatctcacctctgagcgatgcatccaaacacaagtatacgtcagaagatttaacttctagctcccgtcccaacgggaactcactctttacttcagccagttccagtaaaaagccaaaggccgactcccaattacagccacatggaggcgatcttaccaaagcagcacataacaacagcgagaacatcccactgcacaaatctcggccacagacaaaaccttggagccctgggtcaaatgggcacagagactgcaagcgccagaaactggtgtttgatgatatgcctcgttctgctgactacttcatgcaagaagctaaacgtatgaagcataaggccgatgcaatggttgagaaatttggaaaggctcttaattatgcagaggcagccctgtcctttatcgagtgcggcaacgctatggaacaaggacctatggaaagcaagtccccttatacaatgtactccgaaacggttgagctcatccgttacgctatgaggttgaaaactcattccggacccaatgcaactccagaggacaagcagctggcagccctgtgttatcgatgcttggccctgctgtactggaggatgtttagattgaagcgtgaccatgccgtaaagtactctaaagccctgattgactacttcaaaaacagttctaaagctgcccaggcgccttccccttggggcgccagtggcaaaagcacggggacgccgtcacccatgtcacctaatcctagccccgccagcagtgtcggaagccagggcagtctaagtaatgcatctgccctcagtcccagcaccatagtgtcaattccacaaaggatccatcaaatggctgctaatcacgtctccatcacaaacagcattctccacagttatgattattgggagatggccgacaacctggccaaggaaaatcgcgagttctttaatgatctagatctcctgatgggcccggtcactctgcatagtagcatggagcacctggtccagtactctcaacaggggctgcactggctccgtaatagtgcccatctatcttag

SEQ ID NO: 18678 - DNA, 3681 bp, Artificial Sequence
  Description of Artificial Sequence: Synthetic coding sequence
atggacagcttcgacctggccctgctgcaggagtgggacctggagtctctttgcgtttatgagcccgatagaaatgcgctgcggcgcaaggagagggaacggcggaatcaggagacacagcaggatgatggcaccttcaactcctcatactctctgttctctgaaccatacaagaccaacaagggagatgagttgagcaacagaatccagaatactcttggtaactacgatgagatgaaggacttcctaactgaccgatcgaaccagtcccacctcgtgggggtccccaagcccggggtcccacagacacccgtcaacaagattgacgaacacttcgtggccgatagtcgcgcgcaaaatcaaccctcatctatttgttcgactactacctctactccagctgcagtgccggtacaacagagtaaacgtggcaccatgggttggcagaaagcggggcaccctccctcggacggccaacagcgcgcgacacaacagggttcactgcggactctgctgggcgatggtgtgggacgacaacagccaagagcgaagcaggtttgtaacgtcgaggttggtctccaaacacaggagagaccacccgctatggccgctaaacattcatcctccgggcactgcgttcagaactttccaccctccctggcctccaaaccatccctggtacagcagaagcctactgcgtatgtcagacctatggacggacaagatcaagcccctgatgaatctccaaagctgaaatcatctagcgaaacttcggtgcactgcacatcctacagaggggtgcccgccagtaagcctgaacccgccagggcgaaagccaagctgagtaagttctccataccaaagcagggggaagaaagcagatccggagagacgaattcatgtgtggaggagattattcgcgaaatgacctggctgcctccgctgagtgcaatccaggccccaggcaaggtagagccaactaaattcccatttccaaacaaagatagccagctggtgtcatcaggccataacaatccaaagaagggggatgccgagcccgagagcccagattccggaacgagcaacacgagtatgctggaggacgatcttaaacttagttctgatgaagaggagaacgaacagcaggccgctcagagaacagccttgagagcgctcagcgacagtgcagtggttcagcaacccaactgtcggacaagcgttccgtcttcaaagggctcaagctcatcatcatcctccggatctagtagcagttcgtcagatagcgaatcatcatccggaagcgattcagagaccgagagctcctccagcgaatctgagggatctaaaccacctcacttttcaagtcccgaggccgaacccgcttcatccaacaagtggcagctagacaagtggctgaacaaggtgaatccacacaagcctccaatacttattcagaacgaatcgcacggttcagagtcaaaccaatactacaacccagtcaaagaggatgtgcaggactgcggtaaagtcccagacgtgtgccagccatccttgcgcgaaaaggagattaaatcaacctgcaaagaagaacagaggccaagaactgcaaacaaggcgcccggttctaagggggtgaaacagaaatccccccccgcagcagtggcagtggcagtcagcgccgcagcgccgccacctgccgttccttgcgccccagcagaaaacgcaccagcaccggccagacggtcagcaggaaagaagcccaccagacgcaccgagagaactagcgctggggacggcgccaattgccatcggcccgaggaacccgcagccgcggatgccttgggcacaagcgtcgtcgttccgcccgagcctaccaagaccaggccatgtggaaacaatcgagcttcacaccgaaaagagctcagaagtagcgtcacttgcgaaaagcgacgtacgcggggactttcacgtatcgtgcccaagtctaaagagtttatcgagactgagtcatcatcatcttcttcttcaagcgattccgacctcgagagtgaacaggaggagtaccccctcagtaaggcacagaccgtggctgctagtgcctcatcagggaatgaccagcggcttaaagaggcagctgcaaatggtggatcaggacctcgggctccggtgggctccatcaatgctcgcaccacctcagacattgctaaggaactggaggaacagttctatacactggtccctttcgggcgcaatgagttactttctccattgaaggatagcgatgagatccgatctttgtgggttaaaatcgatctcacattgctgtcgcgcatccctgaacacctgccacaggaaccaggagtcttaagcgccccagcaacaaaggatagtgagtctgctcccccaagtcacacatcggacacaccagcggaaaaagctctcccaaagtctaaaagaaagagaaagtgcgacaatgaagacgactatcgagagataaaaaaaagtcagggcgagaaagacagcagcagccgcctggccacctctacctccaacacgctcagcgcgaaccactgtaatatgaatatcaacagcgttgccattccaatcaacaagaacgagaagatgctgaggtcacctatatctcccctctctgatgcttcaaagcataagtacacttctgaggacctgactagttcatcaagacctaacggaaactcgctctttacatctgccagctcatccaaaaaacctaaagccgactctcagctgcagcctcacggtggtgacctcaccaaagcagctcataataattcagaaaatatccctctccacaagagcaggccacagaccaaaccttggtcacccggatctaacgggcatagagactgtaagagacagaaactggttttcgacgacatgccgcgttcagcagattattttatgcaggaggcaaagcgcatgaagcacaaagcggacgcaatggtggagaaatttgggaaggcccttaactatgccgaagctgctctatcttttattgaatgtggaaatgccatggaacagggccccatggagtctaagtccccttatacaatgtatagcgagactgtggagcttattagatacgctatgcgcctcaagacccactccggcccgaacgccactccggaggacaagcaactggcagctttgtgctacaggtgtctggctctcctgtactggcgcatgtttaggctgaagcgagaccatgccgttaagtactctaaagccttaatcgactattttaaaaactcaagtaaggctgcacaggctccgagtccttggggggcaagtggaaaatcaaccggcacaccgtccccaatgtccccaaatcctagtccagcatcttctgtgggctctcaagggagcctgtctaatgccagcgcactgtctccgtctacgatagtctcaatccctcagagaattcatcaaatggccgccaaccacgtgagtattacaaacagtatactccattcgtacgattactgggagatggctgataatttagcaaaagagaaccgggagtttttcaatgatctcgacttgcttatggggccagtgaccctacactcaagtatggagcatctggtccagtatagccagcaggggcttcactggctacggaatagtgcccacctgtcttag

SEQ ID NO: 18679 - DNA, 300 bp, Artificial Sequence
  Description of Artificial Sequence: Synthetic coding sequence
atggacagcttcgacctggccctgctgcaggagtgggacctggagtccctgtgcgtctatgagcctgaccgcaatgccttgcgtcggaaagagcgagaacgtaggaaccaggagacccagcaagacgatgggaccttcaacagctcttactctttgttttcagagccctataagactaacaagggcgatgagcttagcaacagaatccaaaataccttaggaaactacgacgagatgaaggatttcttaaccgaccgcagcaaccagtctcacttggttggcgtgcccaagcccgggtag

SEQ ID NO: 18680 - DNA, 468 bp, Artificial Sequence
  Description of Artificial Sequence: Synthetic coding sequence
atggacagcttcgacctggccctgctgcaggagtgggacctggagtccctgtgcgtttatgaacctgacagaaacgcactgcggcggaaggagcgagaacgtaggaatcaagagacccagcaagatgatgggacttttaacagcagctactcacttttcagtgaaccctacaaaaccaataaaggagacgagctatccaatcggatacagaatactctggggaactacgacgaaatgaaagacttcttgactgaccggagcaaccaatctcacttagtcggggtgcctaaaccaggtgtgcctcagacacctgtcaataagattgacgagcacttcgtggccgattctagggcacagaatcagcccagctcaatttgtagtaccacaacaagtaccccggccgccgttccagtccagcagagcaagagagggacgatgggatggcaaaaggccggccatcccccctag

SEQ ID NO: 18681 - DNA, 345 bp, Artificial Sequence
  Description of Artificial Sequence: Synthetic coding sequence
atggacagcttcgacctggccctgctgcaggagtgggacctggagtctctctgtgtttacgaacccgatagaaacgctttgaggaggaaagagagagagaggaggaaccaggagactcagcaggatgatggcaccttcaattcatcctattcgctgttttcagaaccttataagacaaataagggggacgagctctcgaatcgtattcagaacaccctgggtaattacgacgagatgaaggatttcctgaccgatcggtcaaaccagtcccatttagtaggcgttcccaagcccggcgtgccccagacgcccgtaaataagatagacgaacactttgtcgcctag

SEQ ID NO: 18682 - DNA, 54 bp, Artificial Sequence
  Description of Artificial Sequence: Synthetic coding sequence
atggacagcttcgacctggccctgctgcaggagtgggacctggagtccctgtag

SEQ ID NO: 18683 - DNA, 486 bp, Artificial Sequence
  Description of Artificial Sequence: Synthetic coding sequence
atggacagcttcgacctggccctgctgcaggagtgggacctggagtcactgtgtgtgtacgagcctgatagaaatgccctccggaggaaggaacgcgaaaggcgcaaccaggagacccaacaggacgatggcacatttaattcttcgtattccctgttcagtgagccttataaaaccaataagggggatgagctctctaatcgcatacagaatactctggggaattatgatgagatgaaggactttctgactgacagatcaaatcagagtcacctagtgggagtgcccaagcccggcgtgccccaaacccctgtaaacaagattgacgagcacttcgtcgccgattcgcgagcacagaatcagccctcgagtatctgctctaccacaacctctactcctgccgccgtgccagtgcagcagtccaagagagggaccatggggtggcagaaagccggacacccaccctcggacggtcagcagcggtag

SEQ ID NO: 18684 - DNA, 2346 bp, Artificial Sequence
  Description of Artificial Sequence: Synthetic coding sequence
atggacagcttcgacctggccctgctgcaggagtgggacctggagtctctgtggggagaggatatcctgaatcagcgcaatgatagtctcgtagtggagttccagtcatccgcttcgcgttgtaggtccgtgtacgagccggatagaaatgctttgaggaggaaggagagggaacgacgtaatcaggaaacccagcaggatgacggcacctttaattcttcttattcactgttctctgagccttacaaaaccaacaagggtgacgaattgtccaaccggatccagaacactctcggtaattatgacgagatgaaagactttctcactgacagatccaaccagagtcatctcgtcggagtgcccaagcctggtgtgccacagacacctgtaaataagatcgacgagcacttcgttgctgattcaagagcccagaatcagccatctagcatctgttctacaaccacgtctacacctgctgcagtgcctgtccagcagtcgaagcggggcacaatgggttggcaaaaagctggacaccccccttcagatggccagcagagagcaactcagcaggggagcctacggactttgctgggcgacggcgtcggacgccagcagccacgcgccaagcaagtctgtaacgtggaagtcggtctgcagacacaggaacgccctcctgccatggccgcaaaacattccagctcaggtcactgcgtacagaactttcccccctccctggctagcaagccttccctggtgcagcagaagcccaccgcgtacgtgcggccaatggatggtcaggatcaggctcctgatgagagccctaaactgaaatccagttcggaaacaagtgtccactgcacttcctatcgtggggttcccgcgtcaaagccggagcctgctagggccaaggccaagttaagcaagttcagcatccccaaacaaggcgaggagtcacggtcaggggaaactaattcttgtgtcgaggagattatccgagaaatgacctggctgccaccgctgtccgccatccaggcccccggtaaggtggaacctacgaagttccctttcccgaataaggatagccagttagtgtcctccggccacaataatcccaagaaaggggacgcagaacctgagagcccagactccgggactagcaatacgagtatgctggaagacgatctaaaactgtcttcagacgaggaggaaaatgagcagcaggcagcccaacggactgcactgagagctttgagcgattcagcagtggttcagcaaccgaactgtcggacttctgtaccctcatccaaagggagctcttcctcttccagttccggatcatcatcatcatcatccgattcggagtcatcctctggatcagactctgagaccgaatccagttcatctgagtccgaggggtccaaacctccgcacttcagctctcctgaggcggagcccgcctcgagtaacaaatggcagctggataagtggctgaataaggtcaacccccataagccccctatattaattcagaatgaatcccacggcagcgagtctaaccagtattataaccctgtgaaagaagacgtgcaagactgcggcaaggtgccagacgtctgccagccaagccttcgagaaaaggaaatcaagtcaacatgcaaagaggaacagcgccccagaaccgccaacaaggctcctgggtccaagggcgtcaagcagaaaagtccccccgctgccgtggctgtggcagtcagcgcagcagccccaccaccggctgtcccttgtgccccagcggagaacgctccagcccctgccaggcgttcagctggcaagaaaccgaccagacgcaccgaacgaacaagtgcgggcgatggggccaattgccataggccggaagaacccgcagctgcagatgctctcggcacgagtgtggtcgtgcctcccgagccaaccaagacacggccgtgtggaaataaccgtgctagccatcggaaggaactgcgcagctccgttacatgtgagaaacgaagaactagaggcctgagcaggattgtacccaaatcaaaggagtttatcgagactgagtcatcaagctctagctctagctccgactctgaccttgaatcagaacaagaagagtatccactgagtaaagcccagacagttgctgcaagtgccagttccggtaatgatcagcgattgaaggaggccgcggccaacggaggcagcgggccgcgagctccagtaggctcaatcaacgcccgcacaacctctgacattgctaaggagttggaggagcagttttacaccctggtacccttggccgggaccaacttttcaccattgtag

SEQ ID NO: 18685 - DNA, 2610 bp, Artificial Sequence
  Description of Artificial Sequence: Synthetic coding sequence
atggacagcttcgacctggccctgctgcaggagtgggacctggagagcctgtgtgtttacgaacctgatcggaatgcccttaggcgcaaggaaagagagagaagaaatcaggagacacagcaggacgacgggacctttaactcatcttattctttgtttagcgaaccctataaaacgaataaaggagacgaactgtccaaccgaatacagaacacactaggtaattacgatgaaatgaaagatttcctgactgacaggtctaatcagagccacctcgttggggtccccaaaccgggagtacctcaaactccggtaaacaagatcgatgaacacttcgttgcagattcccgtgcccagaaccagccctcgtctatctgctcaaccacaactagcactcccgctgctgtgcctgttcaacaatctaaacgtggaacgatgggttggcaaaaggcaggccatccacctagcgatgggcagcaaagggcaactcagcagggcagtctcagaactctgttaggggacggtgtaggcagacaacagcccagagccaaacaggtatgcaacgtagaggtcggtctccagacccaggaacggccaccggcgatggctgccaaacattcctcctcaggtcactgcgttcagaatttccctccttcgctcgctagcaaacctagccttgtgcagcagaaacccactgcatacgtgcgcccaatggatggccaggatcaggctccagatgagtctccaaagctgaaatcatccagcgaaacgtcagtgcattgtacatcctatcggggggtgcccgcttcgaagcctgagcctgcaagggctaaagccaaactgtctaaattcagcatccctaaacagggagaagagtctagatcaggagaaaccaatagctgcgttgaagaaataattagagagatgacttggctacccccattgtcggccatccaggcccctggaaaggtcgagccaacaaaattcccattccccaataaagattcgcagctggtatcctcaggccacaataatcctaagaagggcgatgccgaacccgaatcccccgattccggcaccagcaacacatccatgctcgaagatgatctgaagctgtctagtgacgaagaggaaaatgagcagcaggcagcccagcggaccgcgttacgagcactttcggattccgccgtagtgcagcagcctaattgtagaacctcagtaccaagctcaaaaggaagctcctcaagtagcagttcagggagtagctcaagctcatccgactcggagtcttcatcaggctctgattctgagacagagtccagctcaagtgaatccgagggaagcaagcccccgcatttttcctccccagaggccgaaccagctagctctaacaaatggcagctcgataaatggctgaataaggttaaccctcacaaacccccgattctgatccagaatgaatcccatgggtcagaatctaatcaatactacaatcctgtgaaggaggatgttcaggattgtggcaaggtgcccgacgtgtgccagccaagcctccgcgagaaggagatcaagtcaacgtgcaaagaagaacagcggcctcggaccgcaaataaggcccctggatccaaaggcgtgaaacagaaaagtccaccagccgctgtggcagttgcagtaagcgctgctgctcccccaccagccgtcccatgcgccccggccgaaaacgcccccgcgcctgctagacggtccgcgggcaaaaaacctacacggcgtacagagcggacatccgccggagatggtgccaactgccatcgaccagaggagcctgccgccgccgacgccctgggcaccagtgtcgtggtcccgccagaacctactaagactcgcccttgcggtaataaccgcgcttcgcaccgaaaggagctgcgctccagcgtaacatgcgagaaacggcgcaccaggggactgtcccgaattgttccaaagtccaaggagtttattgagacggaatctagctcgagctcctcctcatctgatagcgacttagagtccgaacaggaggagtatcccctgagcaaggcccagactgtggcagctagcgcaagcagtggaaatgaccaacgccttaaggaagctgcagcgaacgggggctctggccctagggcccctgtgggatccataaatgcccggaccacgagcgacatagcaaaggagctggaagagcaattttacacccttgtgcccttcggacgtaacgagttgctctcccctctgaaggattctgacgagatccgctctctgtgggtgaagattgacctgaccctgctgtctcgcattccagagcacctgccgcaggaacccggtgtgctttccgctcccgcaaccaaggactctgagagcgcacctcctagccatacctccgacactccggccgagaaagccctccctaaaagtaaaagaaaaaggaagtgcgataacgaggatgattatcgcgaaataaaaaagagtcagggggaaaaagacagctctagtaggctggctacctcgacctctaacaccctgtcggccaaccactgcaacatgaatatcaattctatgcagctccccatttag

SEQ ID NO: 18686 - DNA, 390 bp, Artificial Sequence
  Description of Artificial Sequence: Synthetic coding sequence
atggacagcttcgacctggccctgctgcaggagtgggacctggagagcctctgcgtgtacgaacccgatagaaacgcgcttcggagaaaagagcgggagaggcggaaccaagaaacccaacaagatgatggaacttttaatagctcctattcactgttctccgagccttacaagacaaataaaggcgacgagctatccaaccggattcagaatacattgggcaactacgacgagatgaaagactttctgaccgacagatctaatcagagccatctggtgggtgtaccaaaaccgggcgtcccccagacccctgtcaacaaaattgatgagcattttgttgccgattcacgggcgcaaaaccagccctccagcatctgcagtacaacctag

SEQ ID NO: 18687 - DNA, 3066 bp, Artificial Sequence
  Description of Artificial Sequence: Synthetic coding sequence
atgaccctgcggctggacgccggcggcatccccagcctggcccccagggtgtacatatctggtagtccaagtcagcgctttcttcctaggaagaggaataaaggcgagtctgcaggacgtgacagtctgctggcgggctccgcccggttcggttctcggggagaggcgcagctccaaggttcagagttgctgtcccgaaattctggagagtccctggtccgcattcgttcttgtgggcaggaactgattacctgcctcagcagaccggagacggggggcaaatttgaggttgacacacaacggcctgtctgccccccctctcgggcacgggctgcacgggccagcgctgcagccgtggcggctgccgctactctgacacctcctacaatggatagcttcgatctggccctgcttcaggaatgggacttagaatctctgtggggcgaggatatcttaaatcagcggaatgattccttagttgtggagttccaatccagcgcttcccgatgtaggagtgtttacgagcccgacaggaacgccttgagacgaaaagaaagggagaggaggaatcaggagacccagcaagacgacggcacctttaattcatcctatagcctgttttcagagccttataaaacgaataagggcgatgagctgtctaataggatacagaacacacttggaaactacgacgagatgaaagatttccttactgacagatctaaccagtcccacctagttggggtgcccaagccaggagtgcctcagacccccgttaataagatagacgaacatttcgtggcagatagccgcgcccagaaccaaccatcatccatctgctccacgaccaccagcactcctgccgcagtgccagttcagcagtcgaagcggggtaccatgggctggcaaaaggctggccacccaccctctgacggccagcaaagggcaacgcaacagggatctctgagaacactgcttggcgatggggtggggcgacagcaaccgagagctaaacaggtctgcaatgtggaagttgggctccagactcaggaacgccctcccgcgatggctgccaagcatagcagtagcgggcactgcgtccagaactttccaccgtctctcgccagcaagccctccctggtacagcagaagccgaccgcctatgttagaccaatggacgggcaggaccaagcccctgacgagtctcctaagctgaaatcaagctccgaaacttccgtgcattgtacatcctatcggggcgtacccgcatctaagccagaaccagcacgggcaaaagccaaactctcaaagttctctattcctaagcagggggaagaaagtcggagcggcgagaccaacagctgtgttgaggaaataatcagggagatgacctggctcccacctcttagcgcgattcaggcaccaggtaaagtggagcccactaagttcccattccctaataaagacagccagttagttagctcaggccacaacaaccccaagaaaggcgacgctgaacccgagtccccggactctggaacaagtaacacttcgatgctggaagatgatctgaagcttagttccgacgaggaggaaaatgaacaggctgcacagcggactgccctcagggcactttccgatagcgccgtcgtgcagcaaccaaattgccgcacgagcgtaccctcatcaaaaggcagtagctcttcaagctccagtggatcctcgtcaagttccagcgactcggagtcaagctccggttccgactcagagaccgagtcatccagttctgagtccgaaggtagcaaacctccgcatttcagctctccagaagcagagccggcttcatccaacaaatggcagcttgacaaatggctgaacaaggtaaatccccacaaaccaccgattcttatccaaaatgaatcacacggaagcgagagcaaccagtactacaatccagtcaaggaagatgtgcaggattgcggcaaggtcccagatgtctgtcagcccagcctccgcgagaaagagataaagtctacatgcaaagaggaacagagaccgcgcaccgccaataaggcaccggggagcaagggagtgaaacagaagagcccgcctgcagcagttgccgtggctgtgtccgccgcagcaccaccacccgcagtaccatgcgctcctgccgagaatgcccccgcccccgcccgccgatccgccgggaaaaagcccacccggcggacagaaaggacgtcagccggagacggggctaactgccatcgccctgaagaacccgctgccgcagacgcacttggcacctctgtcgttgtgccacccgaacctacgaaaacgcgtccatgcggaaacaaccgcgcttctcaccgcaaggagcttcgatccagtgtgacctgcgagaagcgaagaacgaggggcttatctagaatagtgcccaaaagcaaagaattcattgagacagaaagtagctcctcgtcttctagttctgacagtgaccttgagtcggagcaggaggaataccccctttcgaaggctcagacggtagcggcctcagcttcatcagggaacgaccagcggcttaaagaggcggcagccaacggcggtagcggcccacgggcacctgtcgggagcatcaacgccagaacaacatcagacatcgccaaggaactggaagaacagttctacactctcgtgcccttcggaagaaacgagctgctgtctccattgaaggactccgacgaaattagatctctctgggtgaagattgatctgactctgctctcgcgaatccccgagcacctgccacaggagccaggagtcttgagcgcacccgcaacgaaagacagcgagagcgcaccaccttcccacacctcagacactcctgctgagaaagcccttccaaagagcaagagaaagcgaaagtgcgataatgaggacgattatcgggaaattaagaagtcccaaggggaaaaagattcgtcctcccggctggcaacttctacatcaaataccctttcagctaatcactgcaatatgaatattaactctctgtcattgccatag

SEQ ID NO: 18688 - DNA, 17388 bp, Artificial Sequence
  Description of Artificial Sequence: Synthetic coding sequence
atgtgcgactgcttccacatggtgctgcccacctggcccggcaccccaggctccgtctccggccgccaattgcaaccaggggagcccggcgctgaaacagaagacgatcactcagtcacggaaggtccagccgatgaaggtatcagaccacggccgcagggcagcagccctgtgtatgagtacactactgaggcggctgatttcggcttgcaggaagatgctcctgggcggcagggatctgccggtaggagaaggtcttggtggaaacgtgactctggtgattccaggactttcttccgcatgagtcgtccagaggccgtccaggaggcgaccgaagttaccttaaagaccgaggtggaggcgggcgcaagtggctacagtgtgacaggagggggtgatcagggcattttcgtcaaacaagtactcaaggactcctctgcagctaagcttttcaaccttagagagggggaccagttgttgtccaccacagtgttttttgaaaatataaagtatgaggatgccctcaagattcttcagtacagcgaaccctacaaagttcagttcaagatccgaaggcagctaccagcaccccaggacgaggagtgggcctcttccgacgctcaacatggaccacaggggaaggaaaaagaggacactgacgtggccgatggatgcagggaaaccccaacaaaaacactggaaggggatggcgatcaggagagacttattagcaaaccaagagtagggcgaggcagacagtcccagagagaaagactgtcctggccgaaatttcaatccattaagtctaagaggggtccagggcctcagcgcagtcactcctcatcagaagcttacgagccacgagacgcccatgacgtgtccccaaccagcaccgacaccgaggcacagttaacagtggaacgacaggagcagaaggctgggcctggctctcagcgacgacggaaatttctcaacttgcggtttcggacgggatcgggccagggaccaagttcaacgggtcagccgggacgcggctttcagtccggagtgggcagggctggggttctcgaagagctggggccttggggcgactcactggaggaaacgggcgccgccaccggcagcaggagggaggagcgcgctgaacaagatcgcgaagtcatgcctgcgcagtccatgcccctgcccacggagctcggcgatcctaggctgtgtgagggcaccccccaggagggcggcttgcgtgctgctagactacatggtaagacactagaaggtcaggctcaagagactgccgtggcgcagagaaagccccgagcacagcctaccccaggcatgtcccgcgaaggtgagggtgaggggcttcaatctcttgagattggcatcgcacgactgtctctacgcgatacgactgaaggtggtacacagatcgggccgcccgaaatccgagtgcgggtgcacgatctgaagacgcccaaatttgccttttcaaccgagaaggaacccgagcgggagcgcaggctttccacacctcagcgcggaaagaggcaggatgcttcgtccaaagccggaacgggattgaagggcgaggaggtggaaggagcagggtggatgccgggtcgcgaacctacgacccatgcagaggcccaaggggatgagggagatggtgaagaaggacttcaacgaacaagaattaccgaggaacaagacaagggtcgtgaggataccgaggggcagatacgaatgcccaaattcaagataccaagtctggggtggagcccctctaagcacactaagacagggcgtgagaaagccacagaagacaccgagcaagggcgagagggtgaagccaccgccacagccgatcggagagagcagcgtagaactgaggagggactaaaagacaaggaggactctgactctatgaccaacacaactaaaattcagctcatacacgatgagaaacgtctcaagaaggagcagatcctcacagaaaaggaagtcgccacgaaagatagcaaattcaagatgcccaagttcaaaatgccgctcttcggggccagtgcccctggcaaatcaatggaagccagcgttgacgtgtcagcccctaaagtggaggccgacgtgagtttgctgtctatgcaaggagatctgaaaaccaccgatctaagcgtgcaaacaccttccgcagacctggaggtccaggatgggcaggttgatgtcaaactgcctgagggtccgcttccagagggcgcctctctgaaaggccacttacccaaagtgcagaggccgagccttaagatgccaaaagttgatctgaagggccccaagctggatctcaaaggcccgaaggctgaggtgaccgctccagatgtgaagatgtccctatcttccatggaagttgatgttcaagccccaagagctaagttggatggcgcgagacttgagggcgatctgtccctcgccgataaggaggtgactgctaaagactctaagttcaaaatgcccaagtttaagatgccaagcttcggtgtgtcagcacccggtaagagtatggaagactccgttgacgtgagtgcgcccaaagtcgaagccgatgttagtctgtctagtatgcagggagatctgaaagccaccgatctatctatacaaccaccctccgcggatcttgaggtccaggcaggccaggtcgatgttaaactcccagaaggccctgtacccgaaggcgcaggacccaaagtgcatctgcctaaggtagaaatgccgagttttaagatgcctaaggttgacctcaagggcccacagattgatgtgaaggggccaaagctcgaccttaaaggacctaaagctgaagtgactgcacccgacggggaagtgtctcttccttctatggaagttgatgttcaggcgcagaaggcgaagctggacggcgcctggcttgaaggcgacctctctctcgcagataaggatgtgaccgctaaagactctaaatttaaaatgcccaaattcaaaatgccttcatttggagtgtccgcgccaggaaaaagcattaaggcccttgtcgacgtgagcgctccgaaagtcgaagccgacctcagcctacctagcatgcaaggagatttgaagactacggacctatctattcagcccgcctctacagacctgaaagtgcaggcggatcaggtggatgtgaaactgcctgaagggcatctccctgagggggctggtctgaagggacatctgccaaaggtagaaatgccatccttcaaaatgcccaaggtagctctgaagggcccccaggtggatgtcaaaggtccgaaactggacctgaagtccccaaaggccgaagtcacagcccctgacgtggaggtgtcattgcccagtgtagaagtcgatgtcgaagctccaggtgccaagttggattccgcccgactcgagggcgaactgagtttagccgacaaggatgttaccgctaaagattcgcgcttcaaaatgccgaaattcaagatgcctagcttcggggcatcggcgcctgggaagtccatcgaagccagtgtcgacgtctcagcacctaaagtggaggcagacgtatctctgcctagcatgcagggcgatttaaagaccaccgacttgtccatccagccacctagcgctgatctggaagtacatgccgggcaggtcgatgtgaaattgctggagggtcatgtgccagaaggagccggcttcaagggccatttacctaaggtgcagatgccatcactgaagatgccgaaagtggacctaaaggggcctcaggttgaagtgagagggcccaagcttgatctgaaaggccacaaagccgaggttacggcgcatgaggttgcggtgtcccttccatccgtggaggtggacatgcaggcacctggagcgaaattagatggagcccagctcgacggcgatctcagcctggccgacaaagacgtcacagccaaggacagtaaatttaaaatgccaaaattcaaaatgcccagcttcggagtgtccgctccaggcaagagtattgaggcaagcgtggatctttccgccccaaaggttgaagccgatatgtcccttcctagtatgcaaggtgatctcaaaaccaccgacctctccattcagccccccagtacggacctagaactgcaggctgggcaactggacgtgaagctccccgagggaccggtgccagaaggggctggactgaagggacacctcccaaaactgcagatgccaagcttcaaagttccaaaggtggacctcaaaggccctgaaatcgatatcaagggtcccaagctggacttgaaggaccccaaagttgaggttaccgcgccggacgttgaggtgtctctgccttccgtggaagtcgacgtggaggccccaggtgctaagttggatgggggccggctggaggaagatatgtctctggcagacaaagatcttaccacgaaggattctaagttcaaaatgcctaaattcaaaatgccgagctttggagtgtcagcaccagggaagagtatcgaggcctctgtggacgtatccgcaccaaaagtcgaggccgatgtttcactgccctctatgcaaggggatctcaaggcaacagacttatcgatccagccccccagcgccgacctggaagtccaggccggacaggttgacgtcaaactcccagaggggcctgtctcagaaggcgcaggcctcaaagggcacctccctaaagtacagatgccatccttcaagatgcccaaagtggatctaaagggcccgcagatcgatgtcaaaggcccaaagcttgaccttaagggacccaaagtcgaagttacggctcctgacgtcaaaatgagcctgagctccatggaggttgacgttcaggccccccgggctaagttggatggcgcccagcttgaaggggatctgtccctggccgacaaagccgtgactgctaaagactctaagttcaagatgcccaaattcaagatgccttcattcggagtgagcgcgcccggcaaatctatcgaagcctccgttgatgttagcgaacctaaggtcgaggccgacgtgtcattaccctccatgcagggagatctaaaaacgactgatctctctattcagtcaccctccgcggacctcgaagtgcaagcaggacaggttaacgtgaagctgccagagggtcccctgccagaaggagccggctttaagggccacctgcccaaggtgcagatgccatcccttaagatgcctaaagtcgccctgaaagggccacaaatggatgtgaaaggcccaaagttagacctcaagggtccgaaggccgaagtgatggctcctgatgtcgaagtctcccttccaagcgtcgaggtcgatgtggaggctcccggcgctaaactggatagtgtgagactggagggggacttatcattggcagataaggatgttacggctaaagattctaagtttaagatgccaaagtttaagatgccatctttcggagtgtcagcaccagggaagtctattgaagcttctgttgacgtcagtgcacctaaagtggaggctgaggtgagcctgccctcaatgcagggagaccttaaaaccacagatctgtgcatcccgctcccgagcgctgaccttgtcgtccaggctggccaggtagatatgaagctgcccgagggccaggttcctgagggggctgggctgaaaggccacctgccgaaggtcgacatgccctcctttaaaatgccaaaagtggatttaaagggaccccagacagatgtgaaaggggccaaactcgaccttaaggggcccaaggccgaagtgaccgcccctgacgttgaggtcagtttaccatccatggaggtcgacgtgcaggcccagaaggcgaagctcgatggagcccgtctagagggggacctcagcctcgcagataaggatatgacggctaaagacagtaaatttaagatgcctaagttcaagatgccttcattcggcgtcagcgcccccggacgatccatagaggcctccgtcgacgtacctgcacctaaagttgaagcggatgtgagcttgccatctatgcaaggcgacctgaaaaccaccgacctatcaattcagcctccgtctgctgatctcaaagtgcagaccggccaagtagacgtaaagctacctgaggggcacgtaccagaaggcgcaggcctaaagggccatctgccgaaggtcgagatgccatccctgaaaatgcctaaggtggatctgaagggaccccaggtggacatcaagggtcctaaactggatctcaaagaccccaaggtggagatgcgggtgcctgatgtggaggtgagcttaccctccatggaagtggacgtccaggctcccagggccaagctggattctgcacacttacagggcgatctgacccttgcaaacaaggatttaactacaaaggattcaaagttcaagatgcccaagttcaaaatgcctagctttggagtgtcggccccaggcaaaagcatagaagccagtgtggatgtgagcccaccaaaagttgaggctgacatgtctctgcccagtatgcagggggacttaaagaccaccgacctgtctatccagcctttgagtgcggatgtcaaagtgcaggccggccaggtggatgtcaagctgctcgaggggcctgtgccagaagaggtggggctgaaggggcacttgcctaagctacagatgccaagtttcaaggttcctaaggttgatcttaagggccctgagatcgatattaaagggcctaaactggatctgaaagaccccaaagtcgaggtgactgcacccgacgtggaggtgagtctacccagcgtggaggttgatgtgaaggctcccggggctaagttagacggggcccgcctggagggagatatgagtctcgctgataaggatgttacggccaaggatagcaagtttaagatgccaaaattcaaaatgctttccttcggcgtttcagccctcggcaagtccattgaggcttcagccgatgtgagcgccctgaaagttgaagctgacgtaagtctccctagcatgcagggcgacttaaaaactacagacctcagcgtccaacccccttctgctgatctggaagttcaagccggacaggttgatgttaagctgccagaaggacccgtcccagaaggggccggactcaagggacatctgcctaaacttcagatgcctagtttcaagatgcctaaggtcgatctcaagggcccgcagattgacgtgaaaggacccaaattggacttgaaaggcccgaaaacagacgtgatggctcctgatgttgaggtcagtcagccaagcgtcgaagtagatgtagaagctccaggagctaagttagatggagcttggcttgagggagacctttcagtggccgataaagatgtgactactaaggacagcaggtttaaaattccaaaatttaagatgccttcttttggagtctcagcccctgggaagtccatcgaagccagcgtcgatgtgagcgctccaaaggtggaggctgacgggtctctttcatctatgcaaggtgaccttaaggctacggacttaagtatccagcctcccagtgctgacctggaggtgcaggctgggcaagtggatgtcaagttgcccgaaggcccagtgccagagggggctggacttaaaggccatttacctaaggtgcagatgccatcatttaaaatgccagagatggacttgaagggcccacagttagacgtaaaaggacctaaattggacctcaaaggaccaaaggccgaagttaccgctcccgacgttgagatgtctttatccagtatggaagtggatgtccaggccccgcgcgcgaaactggacggagcacggttggaaggggacctgtctcttgctgacaagggggtgacggctaaagattccaagttcaagatgcctaaatttaaaatgccatcttttcgcgtgtccgctccaggcgagtctatagaagccctggttgacgtctccgagcttaaagtggaagctgatatgtcccttccctcaatgcagggcgatttaaagacaaccgatatttcaattcaaccccccagtgcccaattagaggttcaggccggacaggtggacgtgaagttgcccgaaggacacgtacccgagggcgcaggtctgaaaggccacctacctaagctgcagatgcctagttttaagatgcccgaggtagatctgaaagggccccagatagatgtcaaaggacctaatgtggacctgaagggccccaaagcagaggtaacggctccagacgtgaaaatgagcctttcaagtatggaggttgatgttcaagctcccagggccaagctggatggagcgcgactggagggcgacctgagtttagccgataaaggaatgaccgcaaaggatagcaaatttaagatgccgaagttcaagatgccatccttcggggtgtccgctcccggtaagagcatagaggcatccgtggacgttagcgagcttaaagtcgaggcggacgggtcatttccttcaatgcagggcgacctcaaaactaccgacattcggatacagccaccatctgcccagctggaggtgcaggccgggcaagtggatgtcaagctgccggagggacacgttcccgagggggccggcttgaaggggcatttgccaaaggtccaaatgccttccttcaaaatgccaaaagtggacttaaaagggccgcagatcgacgtaaaaggccccaagctggacctaaagggaccgaaggccgaagtgactgctccagatgttgaagtgagcttgccgagtgttgaggtcgacgttgaggcaccgagagcgaagcttgatggagcccgccttgaaggcgacctgagcctggctgacaaagacgtcacagccaaggattctaaatttaagatgccgaagttcaagatgccatctttcggggtatctgcacctggaaagtccatagaagtcagcgttgacgtttccgctccgaaagtggaggccgaggtatctttgccaagtatgcagggagacctcaaaaccactgatatctcaatcgagcctccaagcgcccagttggaggtccaggcaggtcaggtggacttaaagctccccgaggggcacgtgcccgaaggcgccggactaaagggccacctgcctaaactgcaaatgccgtcttttaagatgccgaaggtcgatcgtaaaggacctcagatcgacgtgaaagggcctaaattagatctgaagggcccaaaaacggacgttactgcccccgacgtggaagtcagccagccgggaatggaagtcgatgtggaagcaccaggcgcgaagctggacggagctcgtctggagggcgacctgtccctggcagataaagacgttactgccaaagactcaaagttcaaaatgccaaagtttaagatgccctctttcggggtatcagcccctggcaaatcaatcgaagttctcgtagatgtcagcgcacccaaagtggaggcggacctctccctcccatcaatgcagggagatctgaagaatacagacattagcatcgagccccccagcgcgcagctggaagtgcaggccggccaggtagatgtcaagttgcctgagggccatgtactcgagggcgccggactaaagggccacctgcccaagctgcagatgcccagtttcaagatgcctaaagttgataggaagggccctcaaatcgacatcaaaggcccaaagctcgacctcaagggcccaaagatggacgtgacagcccccgacgtagaggtgtctcagccctcgatggaggtggatgtcgaggcccctggggccaagcttgatggggcacgcctggagggggacctgtctctggcggacaaggacgtcaccgccaaagacagcaagtttaaaatgcctaaatttaaaatgcccagctatcgggctagtgcacctggaaaatccattcaggcctcggtggatgtaagcgcccccaaggcagaagctgacgtcagtctgccatctatgcagggcgacctgaagactactgatttgagcattcagttacccagcgtggaccttgaggtgcaggccggacaggttgacgtgaagcttcccgagggtcatgtaccagagggggcaggcctgaaaggtcaccttccgaaggtggaaatgcctagcttcaagatgccaaaagtcgacctcaagtccccgcaggtggacatcaaaggcccgaaactggacctgaaggttcccaaggcggaggtgacagtgcctgatgttgaggtttccctgcccagtgttgaggtggacgtgcaagcaccaagagcaaagctcgacggcgcccggcttgaaggggacctcagtttggctgaaaaggatgtcacggccaaggatagtaaattcaaaatgcccaagtttaagatgcccagcttcggggtgtccgcgccaggcaggtcaattgaagcgagtctggacgtctctgctccaaaggtcgaggctgatgtgtcgctttcttctatgcagggcgacctgaaggctacggacctctccatccaacctccgagcgctgatctggaggtgcaggccgttcaggtggatgtcgagctactcgaaggtccggttcccgagggagccggacttaagggtcatctccccaaggtggaaatgccgagccttaaaactccaaaagtggatttgaagggacctcagatcgatgttaaggggcccaaactcgacctgaaaggccctaaggctgaggtgagagttccagatgtggaagtatcactccccagtgtcgaggtggacgtgcaagcccctaaagccaagttggatgctgggcgacttgagggggatctgtccttagccgataaagatgtcacggccaaagactccaaatttaagatgccaaagttcaagatgcctagtttcagagtatcagcgcctggaaagagcatggaggcaagcgtagacgtgtctgctcccaaggtcgaggccgacgtgagtttgccctccatgcagggcgacctaaaaactaccgatttgtccattcagccgccctcggctgacttgaaggtacaagctggccagatggatgtgaagcttccagaagggcaggtccccgagggcgccggacttaaagagcacctgcctaaggttgaaatgcccagccttaagatgccgaaggtggacttgaaaggaccccaagtggacattaagggtccaaaacttgaccttaaagttagtaaggcggaggttacagctcccgatgtggaggtctccctacctagcgtcgaggtggacgtgcaagcacccagggccaagctcgacagtgcacagctggaaggagacctctccctggcagacaaagacgtgacagcaaaagacagcaagttcaagatgcccaaattcaagatgcccagttttggggtcagcgctcctggaaaaagcattgaggccagcgttcacgtgagcgcacctaaagtcgaagccgacgtgagccttccctcaatgcagggggacctgaaaacgacggatctgagtatccagccccactctgccgatctaaccgttcaggccagacaggtggacatgaaactgctagagggacatgtaccagaagaggcaggactcaaagggcacttacccaaagttcagatgccctcctttaaaatgcccaaggttgacttgaagggacccgagatcgacataaaagggccgaaactggatctgaaagatcctaaagttgaagttacggctccagatgtggaagtatccctgccttccgttgaggtggacgttgaggcccctggggccaaattggacggtgcccgtcttgagggagacctgtctttggccgataaggatatgaccgcaaaggattcaaagttcaagatgcccaagttcaaaatgccgtctttcggagtgtccgccccagggaagtctatggaggcgtcagtggatgttacagctcctaaggtcgaagcggatgtgagcctaccatcaatgcagggcgacttaaaggctacggacctgtcagttcagccccctagcgccgacctggaggtccaggcgggtcaggtagacgtaaagctgcccgagggacccgtcccagaaggggcatcgcttaagggacacctgcccaaggtgcaaatgccctccttcaaaatgcctaaagtggacctgaaagggccacagattgacgtgaaagggcccaagctggatctgaaagggcccaaggccgaggtcacagcacccgatgttaagatgtcactcagtagcatggaagtcgatgttcaagcgcctcgagctaaactggatggtgtccagctcgaaggagacctgtcccttgcagacaaggatgtaacagcaaaggattccaagttcaagatgcccaagttcaaaatgccctccttcggggtttccgcaccggggaaatccatggaagcctcagtcgacgtgtcggagttaaaagctaaggctgacgtatccctcccatctatgcagggcgacctaaagactaccgacttgagtatacagtccccatctgccgatctcgaggtgcaggctggccaagttgatgtcaaactccctgagggtcctttacctaagggtgccggactcaagggccacctgccaaaggtccagatgccatgtctgaagatgccgaaggttgctctgaagggaccacaggtcgacgttaagggtcccaaattagatttgaagggacccaaagccgatgttatgacgcccgttgttgaggttagccttcccagtatggaagtcgacgtggaggccccaggagccaagctcgactctgtccggctcgagggcgacctctccctagccgataaggacatgacagctaaagactctaaatttaagatgcctaaattcaaaatgccttcattcggagtcagtgcaccaggcaagtccatagaggcatccctagacgtgagcgctctcaaggttgaggcggatgtgtcactgccctcaatgcagggtgatttaaaaacaacccatcttagtattcagcctcccagtgctgatctggaggtacaggctggacaggaggacgtaaagttgccagagggacccgtccacgagggcgccggattgaagggacacctcccaaaactgcagatgccttcttttaaagttccaaaagtcgacctgaaaggtccacagatagatgtcaatgtgcccaaacttgaccttaaggggcccaaagttgaagttacatcccccaacctcgacgtgagcctcccatccatggaggtggatatccaggcacctggcgcaaagctcgattctacccgcctggaaggagatcttagcctggccgacaaagatgttacagctaaggacagcaagtttaaaatgcctaaattcaaaatgcccagcttcggcatgctctcgcctgggaaatccattgaggtcagcgtcgacgtgtcagcacctaaaatggaagcagacatgagcatcccctcaatgcagggggacctcaagaccacagatctcaggattcaggcgccatcagctgaccttgaggttcaggctggacaggtggatctgaaactgcccgagggacacatgcctgaagtggctggactcaaggggcacctgcccaaagtggaaatgccctctttcaagatgccgaaggttgatctaaaggggccacaggtggatgtgaaaggccccaagctcgatttaaaggggcctaaggctgaagtgatggctccagatgtcgaggtttcgctaccttccgtagaaacggacgtgcaagcccctggcagcatgcttgacggagcgaggctggaaggcgacctgagcttggcccacgaggacgtggccggcaaggattccaaatttcaagggcccaagctgtcaacaagcggctttgagtggagtagcaagaaggtgtctatgtcttcttctgaaattgagggtaacgtgacttttcacgagaagacctccactttccctatagtggaaagcgtggtgcacgaaggagacctgcacgatccatccagagatggaaatctcggcctggcagttggagaggtcggaatggactctaagttcaaaaagttgcactttaaagtgcccaaagttagtttttcatctacaaaaaccccaaaagattcccttgtccccggcgccaaaagctctatagggctctccactattcctctgtctagctcggagtgtagtagtttcgaactacagcaggtgtctgcctgctccgagcctagcatgcagatgcccaaggtggggtttgccgggttcccatcctctcggctagatctcacaggccctcacttcgaaagttcaattctgtcaccttgcgaagacgtaaccctgaccaaataccaggtcacagtgcctagggccgccttggcccccgagcttgcactggagattccctcagggagtcaggccgatattcccctgcccaagaccgaatgctccaccgacctccagccccccgaaggcgttcccacatcacaggctgagtcacactctggaccactgaacagcatgatacctgtctccctaggtcaggttagctttccgaagttctacaagcccaaattcgtttttagcgtacctcagatggccgtgcccgagggagacctgcatgccgcggtaggagctcccgttatgagcccactttctcccggcgagcgcgtgcagtgccccctgccttcaacccaactgccctcccccggtacctgtgtttctcaggggccagaagagctggtcgcatctctgcagacaagtgtggtcgccccaggagaggcacccagcgaggatgctgatcatgaggggaaaggcagccctctcaagatgcccaagatcaagttacctagcttcagatggagccccaagaaggaaacagggccgaaggttgacccagaatgcagtgtcgaggattctaagttgtctctggtcctcgataaagacgaagtcgctccccagtctgcaatccacatggacttgccacccgaaagagatggggagaaggggcgctctacaaaacccgggtttgccatgcctaagttagccttgcccaaaatgaaggccagcaaaagcggggtgtcgttgcctcagcgagatgtggacccatccctgtctagtgctacggccgggggttcattccaggacactgagaaggcttcaagtgacggtgggcgcggcggtctcggtgcaaccgcgtctgcaaccggcagcgagggcgttaacctccacagaccccaggtccacatcccttctttggggtttgccaagcctgacctcaggtcgtccaaggccaaagtagaggtgtcacagccagaagctgacttgcccctgccaaagcacgacctttctaccgagggggacagtaggggctgcggactgggcgatgtgccagtgtcccagccctgtggcgaggggatcgccccgacacccgaagacccgctccagcctagctgcaggaaaccagacgctgaggtcctgacagtggagtcaccagaggaggaggccatgactaagtacagccaggagagctggttcaagatgcccaagtttcggatgccaagcctgcgtcgctcatttagagaccgcggaggggcggggaaactggaggtggcacagacgcaggcaccagccgccactgggggagaggctgctgcaaaggttaaagagttccttgtgagcgggagtaatgtcgaggccgcaatgtcactccaactacctgaagctgatgccgaggtgacagcgtcagagtccaaatcgagcactgatatcctgagatgcgatttggattctactggattgaaattacatctgtctaccgctggcatgacaggggacgagttgtctacatccgaagtgcgcatacacccgagtaagggccccctgccattccagatgcccggaatgcggttacccgagacccaggtgctccctggggaaattgatgaaacgcctctgtctaaacccggtcacgatttggcctcaatggaggacaagactgagaaatggtcctctcaaccagaaggccctttaaaactgaaggccagttcgactgatatgccgagccagatctccgtggtgaatgtcgaccagctatgggaagatagcgttcttacagtaaagtttcccaagctcatggttcccagattctcttttccagctccctcttccgaagacgacgtgttcatcccaaccgtaagggaggttcagtgccctgaggccaatattgataccgccctgtgcaaagagtctcccggcctgtggggcgcaagcattctcaaggcaggagccggtgtccctggcgagcagccagtggatttgaatcttccattggaggcccctccgatctccaaggtgagagtccatattcaaggggcccaagtggagtctcaggaagtgacgattcactccatagtgacccctgaatttgtggacctctcagtgccccgcacatttagcacacagattgtcagggaatctgagattccaaccagcgagatccaaacgccaagctacggattcagcctgttaaaagttaaaatccctgaaccacacacccaggccagagtgtacaccacaatgacccaacactccagaacccaggaaggcacagaggaggctccgatccaggcaacacctggagttgactctatttcaggcgacctccagcccgacacgggcgaaccttttgagatgataagcagctctgtgaacgtgcttggccagcagaccctgacgttcgaagtgccttcaggtcaccagctggcagactcttgctctgatgaagaacccgccgagatcttggaatttccccctgacgatagccaggaagcaactactccgttggccgatgaaggccgggccccgaaggataaaccagaaagtaaaaagtccggacttctgtggttctggctccctaatatcggttttagctcttctgtggatgaaaccggtgtggactcaaaaaacgacgttcagcgcagcgcccccatccagacacagcctgaggctagacctgaggccgaacttcctaaaaagcaggagaaggcaggctggtttcgcttccccaagctcggcttttcttcttctccaacgaagaaatcaaaaagcaccgaagatggagccgagctggaagaacagaaactgcaagaagagacgattacctttttcgacgcccgcgaaagcttctccccggaggaaaaagaggagggtgagttgattggtcctgtaggcacaggccttgatagtagagtgatggtgacctctgccgcgcggacggagctgatccttcccgaacaagacaggaaagctgacgatgaatctaaaggctcaggcctaggcccgaacgagggctag

SEQ ID NO: 18689 - DNA, 237 bp, Artificial Sequence
  Description of Artificial Sequence: Synthetic coding sequence
atgggccagggccagcaggccatgtgccacgaggccctgagccacatctgggtccccttcgacctcaagcggtggctgctctataccttttgcaactggtttgacgtgacatttcaattgcagctctgcattctaagaacactgaagcggttttgtcgctccattttgtacaatctgaaagatcgaaaaaccttctggctcccacaggcgtacctgtcatttctgctaatccagtag

SEQ ID NO: 18690 - DNA, 579 bp, Artificial Sequence
  Description of Artificial Sequence: Synthetic coding sequence
atggcctgcggcgccaccctgaagcggcccatggagttcgaggccgctttactttcccccgggtctccaaaaaggagacggtgtgcgccactgcccggccccacacccggcctgaggcccccagacgccgagcctcctcctccctttcagacccagactccccctcagtctctccagcaacctgccccaccaggctctgagcgaagactccctacgccggagcaaatttttcagaatatcaaacaggaatatagcaggtaccagagatggcgccacctcgaagtcgtcctaaaccagtccgaggcctgtgccagtgaatctcagccccatagcagcgccctgacagctccctcgagccccgggagcagctggatgaaaaaagaccagccaacatttacacttcgtcaggtggggatcatctgtgaaagacttctgaaagattatgaggacaaaatccgtgaggagtatgaacaaatcttaaatacgaaactggcagagcagtacgagtctttcgtaaagtttacacacgatcagatcatgcgacggtacgggacgcggcctacatcttatgtgagttag

SEQ ID NO: 18691 - DNA, 444 bp, Artificial Sequence
  Description of Artificial Sequence: Synthetic coding sequence
atggcctgcggcgccaccctgaagcggcccatggagttcgaggccgccctgctgtcaccaggctcaccgaaacgccgtagatgtgccccattgcctgggcctacccccggtcttagacctccagacgcagaacctccgccaccctttcaaactcagacaccaccacaatccctgcaacaacccgcgccacctgggtccgagcgcagactcccgacgccagaacaaatatttcaaaatattaagcaagaatacagcagataccagcgatggcggcaccttgaagtcgtcctgaaccaatcagaggcatgtgcttccgagtctcagccacatagctcggccttgacggccccatctagccccgagcaatatgagagttttgtgaagttcactcacgaccaaatcatgagaaggtatggaacacgccctactagctatgtgtcctag

SEQ ID NO: 18692 - DNA, 612 bp, Artificial Sequence
  Description of Artificial Sequence: Synthetic coding sequence
atggcctgcggcgccaccctgaagcggaccctggacttcgaccccctgctttcccctgcttcccccaagaggcggcgatgtgcccccttatccgcccctacttctgcagccgcgagtcctctgtctgcggcggcagccacggcagcttccttttctgccgccgccgccagtccgcaaaagtacttgcggatggagcctagcccttttggtgacgtgtctagccgccttaccaccgaacaaatcctatacaacataaagcaggagtataaacggatgcagaaacgccgacatttggagacctcctttcagcagactgacccctgctgcactagcgacgctcagcctcacgccttcttgctaagtggacccgcatcccccggcacttctagcgcagcatccagccctctcaaaaaagaacagccccttttcacactgcgtcaggtgggcatgatctgtgaacggttgctcaaagaaagggaggaaaaggttcgagaggagtacgaagaaattctgaatacaaaactcgccgagcagtacgatgcattcgttaaattcacacacgaccagatcatgagaaggtacggagaacaacccgcctcctacgtatcttag

SEQ ID NO: 18693 - DNA, 5724 bp, Artificial Sequence
  Description of Artificial Sequence: Synthetic coding sequence
atggaggtggcctggctggtgtacgtgctgggccagcagcccctggccaggcagggcgagggccaatcccgccttgttcctggtcgaggtcttgtgctgtggctgcctggtctcccacgaagttcgccatcctggcctgcagtggatctggcccctcttgctcccgcacgccctcgaggaccattgatctgtcacacggggcatgagcaggccggcagggaacctggcccaggttctagcactaagggccctgtattgcatgaccaagacaccaggtgtgctttcctgcccagacctcctgggcctctgcagaccagacggtattgtcgtcaccagggtaggcaggggtcaggcctgggcgcaggacccggcgctgggacttgggctccggcacccccaggggtctctaaaccccggtgccctgggagagctcgaccaggagagggacagcaacaggttacaacagccaggcctccagctattaaccgcggtgcacgccaacctagagcgggagcggcagctgcggggcggggtcccggcgccggtgcctggcggactggtgaagctgcagccagcgccgggcccgccgtgggtgagggcggggctatgggctcaagacgggcaccgtctagagggtggggagcaggagggagatctggggcaggaggcgacggtgaggacgatgggccagtatggatcccatctcccgcctcaaggagctacctgctctctgtcaggcctgaaaccagtcttagcagtaatcggttgagtcacccttctagcgggcggtcgacattctgcagtatcatagctcaactcaccgaggaaactcaacccctgttcgaaaccacattgaagagccggtccgtgtctgaagacagtgacgtcaggttcacatgtatcgtcactggataccccgagcccgaagttacatggtataaggacgacacagagctggacagatattgcgggcttcctaagtatgagattacccaccagggcaataggcataccctacagttatacaggtgccgcgaagaagacgccgcgatttatcaagcgagcgctcagaatagcaaggggatcgtctcctgttccggtgtactggaagtgggtaccatgaccgagtataaaatccaccaacgctggtttgcgaagctgaagagaaaagccgctgctaaactgagggaaattgagcagtcttggaagcatgagaaggctgtgcccggtgaggtggacacattgaggaagctgagtcccgacaggtttcagcgaaagcgccgcctctcgggtgctcaggccccaggtccgagcgttcccactagagaaccagaaggaggtaccttagccgcgtggcaggagggtgaaactgagaccgcccagcatagcggactaggattaattaattcgtttgcttctggcgaggtgactaccaacggggaggccgcgcctgaaaacggcgaggacggagagcacgggcttctcacctatatttgcgacgctatggagttgggaccccaacgggctttgaaggaagaatcgggcgccaaaaaaaagaaaaaggacgaagagtcaaaacagggccttaggaagccggaactggagaaggccgctcagtcacggcgctcttccgaaaactgcatacccagcagtgatgagccagattcttgtggcacccaggggcccgttggggttgaacaagtgcagactcaaccccgaggacgagccgcgagagggcccggctcgtctggtactgatagcacccggaagcccgcaagcgctgtgggcacgcccgacaaagctcagaaagctccaggtccagggccgggccaggaggtgtatttttctttgaaagacatgtacctcgaaaatacacaagccgtgcgtccccttggtgaagagggccctcagaccctctccgtacgggcccctggagagagtcctaaaggaaaggccccgctaagagctaggagcgagggagtgcccggcgccccaggccagccgacacactccctcacccctcagcccacaaggccctttaatcgaaagaggttcgccccccccaagcccaagggtgaggctacaaccgattcgaaacctattagctcgctaagccaggcccctgaatgcggagcgcagagccttggcaaggcgccacctcaggcatcagttcaggtgcccaccccaccagctaggagacggcatggcacgcgggacagcaccctccagggtcaggctggccatcggacgccaggcgaagtcctcgagtgccagactacaactgcacccaccatgagtgcttcctcgagttccgacgtcgcaagtataggcgtctctactagcggaagtcaaggaattattgagcctatggatatggagacccaggaggatgggcggacctcagcgaaccagagaactggctccaagaagaatgtgcaggctgatggtaagatccaggtcgacggtaggacaagaggggatggcacacagactgcgcaaaggaccagggctgaccgaaaaacgcaagtggatgccggcacccaggagagcaaaaggccccagtccgaccgctctgctcagaagggaatgatgactcagggccgtgccgagacacaacttgaaacaacccaggcaggagagaaaattcaagaagatagaaaagctcaagccgacaagggtacccaggaagaccggcgcatgcagggcgagaagggtatgcagggggaaaagggcacgcagtcagagggaagtgcccctacagccatggagggccagagcgagcaggaagtcgctacctccctgggaccaccctctagaacccctaaattaccccccactgctggaccaagagcacctcttaatattgaatgctttgtgcagactcctgaaggctcatgtttcccaaaaaagcccgggtgcctcccaaggtcggaggaggcagtggttacagcttctcgcaatcacgagcaaaccgtcctcgggccgctgagtgggaatctaatgctgcccgcgcaacctccacatgaaggttctgtcgaacaggttggcggagaaaggtgtcgaggtccccagtcgagcgggccagttgaagccaaacaggaagatagtccgttccaatgcccaaaagaagagcgaccaggtggggtgccgtgtatggatcaaggcggatgccccttggcaggcctgagtcaggaagtgcctacaatgccctcactgcctggaaccggacttactgcctctccaaaagcgggtccttgctccacaccaaccagtcagcacggctctacagcaacttttcttccctctgaagaccaggtgcttatgtctagtgcacctaccctgcatctgggcttgggtacccccacacagtcacacccgccagagactatggcaacttcaagcgagggagcctgtgcccaggttccagacgtggaaggacgcactccaggtccccgtagctgtgatccaggactgattgacagcctgaaaaattatttactgttgctgctcaagctctcctccacagagacgagcggagctgggggggaatcacaggtaggtgccgctaccggaggcctggtgccctcagctactctaacacccacggtggaggtcgccggcctgtccccacgcacgtcgaggaggattctggaacgggtggagaataatcacctcgtacagtcggcccaaaccttgctgctgagcccctgtacaagtcgaagacttaccggtctgctggaccgcgaggtccaagcaggccgccaggcactcgcagctgccagggggtcttggggtcctggcccctcgagtctgacagtgcccgcaatcgtcgtggacgaagaggatcccggcctggcgagtgagggggcttctgaaggggagggggaagtctcacccgagggccccggcttgctgggggcctcccaagagtccagcatggcgggaaggctgggggaggccggcggccaggcggcccccggtcaggggccgtctgccgaaagtattgctcaggagccttcccaagaggagaagtttcctggagaagcgctgactggactccctgcagcaacccccgaggaactggctttgggagccagaagaaaaaggttcctgccgaaagtcagggccgccggcgacggagaagctacgactccagaagagagggagtccccgactgtctccccccgcggccctcggaaatccttggtcccaggaagtccgggaactccggggcgagagaggagaagtcccacccagggtcggaaagcctccatgcttgaggtcccaagagcggaagaggaactagcagcaggcgacctcggcccaagtcctaaggccggaggcttggataccgaagtcgctctggacgaaggcaagcaagagaccttggcgaagcctcggaaggcgaaggacctgctgaaggccccacaagtgatcagaaagatcagggttgagcagttcccggatgcatctggttcactgaaactgtggtgccaattttttaacattctaagcgattctgtgttaacatgggctaaagatcagaggcccgtaggcgaagtcggaaggtccgctggcgacgagggacctgcggctctggcaattgtccaggcatcccctgtcgattgcggggtgtatcgctgtactatccacaatgaacacggcagtgcatcgactgacttttgccttagccccgaggtgttgtctgggttcatttctcgagaggagggcgaggtgggagaggaaattgaaatgactcctatggtgttcgctaaagggttggccgattcaggatgctggggtgataagctgtttggacgtctcgttagcgaagagctgcgtggaggtgggtatggatgtggtcttaggaaagctagtcaggccaaggtcatctatggacttgagcccatttttgagagtggcagaacctgcatcatcaaagttagcagcctccttgtgttcggcccgtccagcgagacctccctcgtggggcgaaattacgacgtgacaatacaagggtgcaagatacagaacatgtcaagagagtactgtaagatctttgccgctgaggctagggccgcgccaggttttggcgaggttcctgagatcattcctttatacctcatctatcggccagctaataacattccctatgctactctggaggaagatttggggaagcctcttgaaagttactgcagccgggaatggggttgcgctgaagcgcccactgcctcagggagctccgaggccatgcaaaaatgccaaactttccaacactggctttatcagtggacaaatgggagtttcttagtgaccgacctggctggggtggactggaaaatgactgacgttcagattgccaccaagctccgggggtatcagggccttaaagaatcctgcttcccagcgttgttggaccggttcgcatctagccatcagtgtaatgcttattgcgagcttctaggcctgacaccgctgaagggcccggaagcagcccacccgcaggcaaaagctaaagggtctaaatctccgtcagctggacgcaaggggtcccagctgagtccccagccccagaagaaagggctgccatctccccaaggaacaagaaaatctgcaccctctagcaaggcaacccctcaagcatctgagcctgtaaccactcagctgctgggccagcctcccacccaggaagagggctctaaagcccagggaatgcgctag

SEQ ID NO: 18694 - DNA, 225 bp, Artificial Sequence
  Description of Artificial Sequence: Synthetic coding sequence
atggacagcgaggtgcagcgggacggccggatcctggacctgatcgacgacgcctggagggaggataagttaccctatgaggatgttgccatcccgctgaatgaattaccagaaccagaacaggataatgggggtacgaccgagtccgtgaaggagcaggagatgaaatggactgacttggcactccagtacctccacgagaatgttcctcccataggcaattag

SEQ ID NO: 18695 - DNA, 225 bp, Artificial Sequence
  Description of Artificial Sequence: Synthetic coding sequence
atggacagcgaggtgcagcgggacggccggatcctggacctgatcgacgatgcttggagagaagataaattgccctacgaggatgtggccattccccttaacgaactgcctgaacccgagcaggacaatggcgggaccacggaatctgtaaaggagcaggagatgaagtggactgacctggccttacagtacctacacgagaacgttcctccaatcggcaactag

SEQ ID NO: 18696 - DNA, 225 bp, Artificial Sequence
  Description of Artificial Sequence: Synthetic coding sequence
atggacagcgaggtgcagcgggacggccggatcctggacctgatcgatgatgcttggcgggaggataaactgccctacgaagacgtggccatcccactcaacgaactcccagagcctgaacaagacaatggagggaccaccgagtccgtcaaggaacaagagatgaagtggactgacttggccctgcaatacttgcacgagaatgtaccgcccattggcaactag

SEQ ID NO: 18697 - DNA, 225 bp, Artificial Sequence
  Description of Artificial Sequence: Synthetic coding sequence
atggacagcgaggtgcagcgggacggccggatcctggacctgatcgacgatgcgtggagggaggacaagctgccatatgaggacgtcgcaatccccctgaatgagcttcccgagcctgaacaggataacgggggtactacggaatctgttaaagagcaggaaatgaagtggactgatctggccttgcagtatttacatgaaaatgtcccacccattggaaattag

SEQ ID NO: 18698 - DNA, 1848 bp, Artificial Sequence
  Description of Artificial Sequence: Synthetic coding sequence
atgtgcagcgaggcccggctggcccggcggctgcgggacgccctgagagaagaagagccctgggccgtagaggaactccttcggtgtggcgccgaccccaacttggttcttgaggacggggctgcggctgtccatttagcagcaggtgcacggcacccccgggggctcaggtgcttgggcgcactcctgcgacaagggggtgaccctaatgctcggagcgtggaagctctgacccctcttcacgtggccgccgcctggggatgcagacgcggactcgagctgctgctttcgcagggcgctgaccctgcactcagagatcaagatggcctgaggccactcgacctggctctgcagcaggggcaccttgagtgcgctcgcgtgctgcaggacctcgatacgagaacgcggacgaggacaagaattggtgcggagacacaggagcccgaacctgcccctggcactccgggcctgagcggaccaaccgatgaaactcttgactccattgccctgcagaaacagccctgccggggggataacagggacatcggccttgaggccgatccaggaccccccagcctgccggttcctctggagacagtcgataagcatggttcttccgcgtctccccctgggcactgggattactctagcgacgcctccttcgtgaccgccgtagaagttagtggcgcagaggatcctgcctccgacacccccccctgggctgggagcctgcccccgacacgccagggactgctgcatgtggttcacgctaatcagcgggtgccccgcagtcaggggacggaggcagaactgaacgcaagattgcaagccctaaccctgacaccacctaatgccgccggatttcagtcctctccaagcagcatgccactgctggaccggtcacctgcacactcaccccctcgtacaccaacgccaggggcgtctgactgccactgcctatgggagcaccaaacatccattgattcagacatggcaactttatggctcaccgaagacgaagcatcatccacagggggacgggagcctgtggggccttgccggcaccttcccgtctccaccgtgagcgatctcgagttgctgaaaggtctgcgcgcacttggtgagaacccccacccgatcaccccatttactcgccagctctatcatcagcaattagaggaagcccagatagcccctggcccagagttttccggtcactcgctggaactcgcagccgctctacgtacaggttgtatcccagatgtccaggcagatgaggatgcgctggctcaacagttcgagcagcctgatccagccagacgctggcgcgaaggcgttgtgaagagtagcttcacctatttgctgcttgaccctagagagacccaggacttgccagctcgagccttttccttgaccccagctgaacgacttcaaacatttatccgggccatcttttacgtaggcaaaggcaccagagcccggccgtacgtgcacctttgggaggcactcggccaccatggtagaagtcgaaagcagccccatcaggcttgcccaaaggttcggcaaatactggacatttgggcctccgggtgcggtgtggttagcctgcactgtttccagcacgtggtggctgttgaagcctacaccagagaagcctgcattgtggaagctctgggaatacagactctgacgaaccagaaacaggggcattgttacggcgtcgtggctggctggcccccagctcggcgtagacgtctgggtgtacacctgctgcatagggctctgctggtatttctcgccgagggggaaaggcagctgcaccctcaggacatccaggcaagggggtag

SEQ ID NO: 18699 - DNA, 1320 bp, Artificial Sequence
  Description of Artificial Sequence: Synthetic coding sequence
atgtggacccccgtgcggcggggcgccgcctggctgggcaccctgttgggtcctggtgaagggcccccggagcccagagggggtgccgcccatgcccataaaccacccgccggttctagaaaatccaccgatcaagctgtgaggtttggcccttctcagggcatgtgctccgaagcccggctggcccggagacttagggatgcattgagagaggaagaaccttgggctgtggaggagctgcttcggtgcggcgcagacccaaatctggtactggaagatggggccgctgccgttcatctagccgctggggccaggcacccccgcggcctgcgatgcctaggagcactcctgcggcaggggggggacccaaacgcgaggagtgttgaagccttgactccactgcatgtggccgccgcttggggatgcaggcgggggcttgaactcctcctgagccaaggcgcggatcccgctctccgtgatcaggacgggctaaggccactggatctggccctgcaacaaggacatctggagtgtgcacgcgtgctgcaggatttggacacacgtactcgaacgcggacacgaatcggagcagagacccaagagcccgagcccgctccaggcactcctggactgagtggccctactgatgagaccctggacagcattgccctgcaaaaacaaccttgccggggggataaccgcgacattggcctcgaggctgatccagggcccccaagccttcctgtgcccctggaaaccgtcgacaagcacggatccagcgctagccctcctggccattgggattattctagtgacgcaagcttcgtgaccgccgtggaagtgagtggcgcagaggatcccgcctccgatacccccccttgggctggaagtctcccacccacccgccagggcctgttgcatgtggtgcatgccaatcagcgggtccctcgatctcaagggactgaagccgagttaaatgcaagactgcaggcccttactctgacacctcccaatgcagccggctttcagtcttctccttctagtatgcctcttttagacagatccccggctcatagcccacccagaacacccacccccggagcgtctgattgtcactgtctttgggagcaccagacttcaatagactcagacatggccactctgtggctaaccgaagatgaggcatctagcaccggaggacgagagcccgtaggcccatgccggcacctgcctgtgtcgactgtgtccgacctcgagctgctgaagggcctgcgtgctctcggacggcttcggacatgtcagcccgagccatcccattag

SEQ ID NO: 18700 - DNA, 1821 bp, Artificial Sequence
  Description of Artificial Sequence: Synthetic coding sequence
atgtgcagcgaggcccggctggcccggcggctgcgggacgccctgcgggaggaggaaccctgggcagtggaggaactcctgcgctgtggggccgaccctaacctcgtgctagaagacggagctgccgcagttcacctagccgcaggggctaggcatcccaggggactaagatgtcttggagctttactgcgccaaggcggtgatcctaacgcgaggtctgtggaggcactcactccgctgcacgttgctgcggcctggggctgtaggagaggccttgagctgttgctctcccagggagccgatcccgcactcagagaccaggacggcctaagaccattggatctggccctgcagcaggggcatctggaatgcgctcgtgtgctgcaagacctggatacaaggacaagaactaggactaggatcggagcagaaacccaggagcccgagcccgctcccggaacgccggggctaagtggacctaccgacgagaccttagattcaatcgccctgcagaagcagccttgtcgaggagataaccgagacatagggctggaggctgacccaggccccccttcattaccagttccactggaaacagtggacaaacatgggtcatccgcatcccctcctggacactgggattattcctctgatgctagctttgtgacagcagtggaagtgtcaggagcagaggaccctgcttcagacactcccccatgggccggtagcctgccccctactcggcaaggactgctgcacgtggtgcacgcaaatcagagggtcccccggtcccagggaacggaagctgaacttaatgccagacttcaggctctcacactaacaccaccaaacgcagcaggttttcagagttcaccgagcagcatgcccctgttagatcggtcgccggcccacagcccgcctagaacgcctacacccggagcatccgattgtcactgcctgtgggagcatcaaacctcaatagactccgacatggccaccctgtggctaacagaggatgaggcctcttctacaggagggcgcgaaccagtggggccatgccggcatcttcccgtgagcacagtctccgatctggagttgctgaaaggactccgtgccctcgggccagagttctcgggtcacagcctggaactggccgccgcactgcgcaccgggtgcatccccgatgtgcaagcagacgaagacgcacttgcccaacagtttgaacagccggatcccgctcggaggtggcgtgaaggcgttgtgaaaagcagttttacatacctccttctggatccaagggagacgcaggatctacccgcgagagcgttctccctaactccagccgagcgcctccagacgtttattcgtgctattttctatgtggggaaaggtacaagagcccgcccttacgtgcatctctgggaagcgctgggccaccatggtcgaagccgcaaacagggatcacgtagatctcctacacgcagcaaggggacagccatggagtggtggcaggctggccacctgctagtggccggagcttgggggtgtacctgttgcaccgtgcccagcctctccagctggctcaaggcctccgacagctttattccccggacttcgcgccccggtgcagagtgttggggggtcggccacccagcctggggcgagatgtttgagtgcagctcatgccccatgctcactgctgctccaatcagcggctttagacgcggcgtttgcgtctgcgtgtgtgtctgtgtatgcgtgtgtgtgtgcgtgtgtgtctgcgtgtgccgcgagcacccagggagaagccctcccggctag

SEQ ID NO: 18701 - DNA, 1848 bp, Artificial Sequence
  Description of Artificial Sequence: Synthetic coding sequence
atgtgcagcgaggcccggctggcccggcggctgcgggacgccctgcgtgaggaggaaccctgggcagtcgaggagctgttaaggtgtggcgctgatccgaatcttgtcttggaggacggagctgctgccgtccatttggccgccggagctcgacacccgaggggcctcagatgtctgggcgcacttctgcgccagggcggggaccccaacgctcgtagtgtggaggcactgactcctttgcatgtggcagctgcttggggctgcagacgtggcctcgagctcctgctgagtcagggtgccgaccctgctctacgcgaccaagacggcctccgtccactggacctggcccttcagcagggacacttggaatgtgccagagttcttcaggacctggatacccggacacgcacacgcacaaggatcggagctgaaacgcaggaacctgagcccgctcctggcacgccgggtttaagcgggccaaccgacgagactttggatagcatcgccttgcagaaacaaccctgccggggagataatcgggatatcggcctggaagccgaccccggccccccatctttgccagtacctctggagaccgtggacaagcacggctcctctgcgtccccgcccggtcattgggactattccagtgacgctagctttgtcactgcagtggaggtttccggcgcagaagacccagcctctgacactcccccgtgggcaggatccctgccccctaccaggcagggcctcctgcacgtggttcacgccaaccagagagtacccagaagccaaggaacagaggctgaactcaacgccaggcttcaggctctcaccctgactccacctaatgccgctggtttccagagctcccctagttccatgcccctcctcgacagaagccccgcccactccccacccaggactccgacccctggcgcttctgactgccactgtttgtgggagcaccagacgagtattgacagcgatatggccacattgtggctgaccgaggatgaggccagtagcacaggcggaagggagcctgttggaccttgtcgacaccttccggtcagtactgtctctgacttggagctgttaaaggggctcagagcccttggagagaatcctcatcccatcacgcctttcactagacagttataccaccagcagctggaggaagcgcagatcgcacccggacctgagttctcagggcactccttggaactggctgcagccctcaggaccgggtgtattccggacgtgcaggctgacgaggatgcactcgcccaacaattcgaacaacccgaccccgcacgcaggtggcgggagggagtcgtcaagagttctttcacttatttgttactggaccctagagagactcaagacctgccagctcgtgctttctccctcactccagccgaaaggctccagaccttcatccgtgccatcttctacgtgggcaaaggcactagggcacggccctatgtgcatctctgggaagcacttgggcatcatggacgctctcggaagcagccccaccaagcgtgtcccaaggtgcgccagattctggacatctgggctagcggatgcggtgttgtaagcttgcactgttttcagcacgtggttgctgtggaagcttatacacgtgaggcgtgcatcgtggaagcgctcggaattcaaacactgacaaatcagaaacagggccattgctacggggtcgtggcggggtggccacctgcacgcagaagacgactgggagtgcacctgctgcatcgagccctccttgtttttcttgctgaaggagaaaggcaactgcatcctcaggacatacaggcaagaggctag

SEQ ID NO: 18702 - DNA, 720 bp, Artificial Sequence
  Description of Artificial Sequence: Synthetic coding sequence
atggagaaggagaagggcaacgacgacggcatccccgaccaggagaatagcctggattttagcgagcatttcaaccaactggaacttcttgaaactcatggacacttaataccaaccggcactcagtctctctgggtcggcaattcagatgaagacgaggagcaggatgataagaatgaggagtggtataggctgcaggagaagaaaatggaaaaggatccttctagactgttgctatgggcagccgaaaagaatagactaaccacagtgcgcagactcctcagtgaaaaagcgacacacgtgaacactcgagatgaggatgagtacaccccgctccatagggctgcgtacagtggccacctggatatcgtgcaggaactgatcgcccagggggcagacgtgcatgctgtgacagtggacggatggactccacttcactccgcctgcaagtggaataatacaagagtggcatcatttctgttacagcacgatgccgacattaatgctcagaccaagggcttgctgacacccctccacttagccgccggcaatcgggattcaaaggacaccctcgaactgctcttgatgaatcgctacgtgaagcccggcttgaagaacaatctggaggagactgccttcgacattgcccggaggacatcaatctaccactacctatttgagatagttgaagggtgtacgaatagcagccctcagagttag

SEQ ID NO: 18703 - DNA, 720 bp, Artificial Sequence
  Description of Artificial Sequence: Synthetic coding sequence
atggagaaggagaagggcaacgacgacggcatccccgaccaggagaattcattagatttctcggaacactttaaccagctagagctacttgagactcatgggcacctgatacctactggaacccagagtctttgggtgggaaactcagacgaggacgaggagcaggacgataaaaacgaggaatggtatcgcctacaggaaaaaaagatggaaaaagatccatcacggctgctgttatgggccgcagagaagaacagattgaccaccgtgcggaggctactcagcgagaaggccacccatgtgaatactcgggatgaagatgagtacacacccctacatagagccgcctacagtggacatcttgacatagtgcaggagcttattgctcagggcgcagatgtacacgccgtcactgtcgatggctggacccctttacattctgcttgtaagtggaataatactagggtcgcctcattcctcctgcagcacgacgctgatatcaatgcacagaccaaggggctgcttaccccgctgcacctagccgccggaaatcgggattctaaagatacactggagttgttactcatgaacaggtatgtgaagcccgggctgaaaaataacctggaagaaaccgcatttgacattgcacgcaggacaagtatttatcactatctatttgaaattgtggaagggtgcactaattcttctcctcagtcttag

SEQ ID NO: 18704 - DNA, 4458 bp, Artificial Sequence
  Description of Artificial Sequence: Synthetic coding sequence
atggccgcccccgcccagcccaagaagatcgtggcccccaccgtgtcccagatcaatgcggaatttgtgacacagctggcatgcaagtattgggctccacacataaaaaagaaatctccttttgacatcaaagtcattgaggacatctacgaaaaggagattgtgaaatcccgttttgcaatccggaagattatgctgctcgagttctcacagtatctggaaaactacctttggatgaattactcgcctgaggtgagctccaaagcttatctgatgtcaatttgttgtatggtgaatgagaagttccgcgagaacgttccagcatgggagatattcaagaagaaacctgaccactttcctttctttttcaagcacattctgaaggccgctctagccgaaacagacggggagtttagcctccacgaacaaaccgtcctgttgctgtttctggaccactgtttcaatagcttagaggtggacctgattagatctcaggtgcagcagctgatatccctgcccatgtggatgggcctgcagctggcaagactggaactggagctgaagaaaacccccaaattgcggaagttctggaaccttatcaaaaagaacgatgaaaaaatggacccggaggcgagagaacaggcttaccaggaacggcgatttctgagtcagctcattcagaagttcatctcagtgctgaagagtgtgcctctgagcgaaccagtcaccatggacaaagtccattactgtgagcgctttattgagttgatgatcgatttggaagccctgctacctactcggcggtggttcaatacaatcttggatgatagccacctcctcgttcattgttacttgtctaatttagtgaggcgcgaggaggatgggcacctgtttagccaactcctggacatgctaaagttttacaccggctttgagattaacgaccagacaggcaacgcccttactgagaacgaaatgacaacgatacactacgacagaatcactagcctgcagagagctgctttcgcacatttccccgagttgtacgattttgcactctctaatgtggccgaggtcgacacacgcgagagcctggtgaaattcttcggtcctctatccagtaatacactgcaccaggtggcctcctatctttgtcttcttccgacactgcctaagaatgaggacactacctttgacaaggaatttcttctcgaactcctggtctcacggcacgagaggagaatctctcagattcagcagctgaaccagatgcctctgtatccaaccgaaaagatcatttgggacgagaatatcgtaccaaccgagtactatagcggcgaagggtgtctcgccctacccaagctgaacctgcagtttctgacgctgcacgattatctgctgcgcaatttcaacctattccggttggagtccacctacgaaatacggcaagatattgaggacagtgtgtctagaatgaaaccatggcaaagcgagtacgggggcgttgtgttcgggggctgggctcgtatggcccagccaatcgtcgccttcaccgttgtggaggtggctaagcctaacatcggtgagaactggcccactcgggtcagagctgacgttaccataaatctgaacgtaagggaccacattaaggacgagtgggaaggcctccgaaagcacgatgtttgctttctaatcacagtccgacccacaaagccctatggcacaaagtttgaccggcgtcggccattcatcgagcaagtgggcctggtatacgtgcgtggctgtgagattcaaggaatgctggacgataagggaagagtgattgaggacgggccggaaccacggccaaacttaaggggcgagagccggaccttccgggtcttcttagaccctaaccagtatcagcaggacatgacaaataccattcagaatggagctgaagacgtctacgaaacatttaatattatcatgaggaggaaacccaaagaaaataactttaaagccgtactcgaaaccattaggaatcttatgaacactgattgtgtcgtccctgattggctgcacgatataatcctcggctatggtgatccctcatccgcccattactccaagatgccaaaccagattgccactctcgattttaacgatacattcctgtccattgaacatctcaaagccagttttcccgggcacaacgtcaaggttactgttgaagaccccgccctgcagattccaccctttcgaattacattccctgtacgctccggcaagggcaaaaaacggaaggatgctgacgtggaggacgaagacaccgaggaggccaagacactcattgttgaaccccacgtgatcccaaatcggggcccttatccctacaaccagcctaagagaaacaccatacagttcacccatacccagatcgaagccattagggccggcatgcaacccggacttaccatggtcgtaggccctcctgggacagggaagacagacgtggctgttcagatcatctctaatatataccacaattttcccgagcaacgcaccttaatagttacacacagtaaccaggccttgaaccaactgttcgagaagattatggccctagatatcgacgagaggcacctgcttaggctggggcatggcgaggaggaactagagactgaaaaggatttctcccggtatggacgggtcaattacgttctagctcggagaatagaactgctcgaagaggtgaaaaggctgcaaaagtctctgggggtgcccggggacgccagttacacttgcgagactgccggatatttcttcctgtatcaggtgatgtctagatgggaggagtacatcagcaaagttaagaacaaaggcagtactctgcccgacgtgaccgaggtctccacgttcttccccttccatgaatactttgctaatgcgccccaacctatcttcaaaggtagaagttatgaggaggacatggaaattgccgaaggatgttttcgacatatcaaaaagattttcacacagctggaggaatttagagccagtgaactgttgcgctccggcctcgacaggtctaaatatctgctcgtcaaggaggccaaaatcatagctatgacctgcactcacgctgcactgaaaagacatgacctggtcaagctcggctttaagtacgataacatcctgatggaagaggctgcccagatccttgaaattgaaacttttattccgctcctgctgcagaacccacaggacgggttctcccggcttaaaagatggattatgatcggggatcaccatcaattacctcctgttatcaagaacatggcttttcagaaatacagcaacatggagcagtctctcttcacgcgcttcgtgagagttggggtacctactgttgacttagacgcacaggggagggcaagggccagtctgtgtaacctgtataactggcgttacaagaacctggggaaccttcctcacgtgcagctgctgcccgagttttcaaccgctaacgccggtcttctctacgacttccagctaattaatgtggaagatttccagggagtgggagagtcagaaccaaacccctatttttatcaaaacctgggggaagccgagtatgtggttgccctctttatgtatatgtgtctgctgggataccctgccgataagatctccatccttactacctacaatggccagaagcacctgattcgcgacatcatcaatagaagatgcgggaataaccctctcatcggacgacccaataaggtcaccacagtcgatcgttttcagggtcaacagaacgattacatactcctatcactagttagaactcgagcggtggggcatttgcgggatgtgcggaggttggtggtggctatgagccgggcgaggctgggcctgtacattttcgcccgggtatccctatttcaaaattgcttcgagctcacccctgcatttagccagcttacggcaagacctttgcatcttcatattataccaaccgagcccttcccaacaacacggaaaaatggagagcggccctcccatgaagtgcagatcatcaaaaacatgcctcaaatggcaaattttgtgtataacatgtacatgcacctgatccagacaactcatcactaccaccagacgcttttacagctaccgccagccatggttgaggagggagaggaagtccagaaccaagagaccgaattggagaccgaggaagaagccatgactgtccaggccgatattataccttcgccaacagacacctcgtgccggcaggagacccccgcgtttcagaccgacactactccctcagagacaggcgcgacttcaacgcccgaggcaatccctgcactatcagaaaccaccccaactgttgtcggggcagtgtcagcgccagccgaggctaatacccctcaggacgccactagtgccccggaggagaccaagtag

SEQ ID NO: 18705 - DNA, 1083 bp, Artificial Sequence
  Description of Artificial Sequence: Synthetic coding sequence
atgcagatcatccggcacagcgagcagaccctgaagaccgccctgataagtaaaaatcctgtactggtgtctcaatatgaaaaactaaatgccggcgagcaacgcctgatgaacgaagcattccagcctgcatcggacctgttcggacctattactctccattctccttctgattggatcactagtcaccccgaagccccgcaggattttgagcagttcttctctgacccatatcgcaaaacgccatccccgaataaacgctctatatacatccagtctatcggttctctcgggaatacgagaatcataagcgaggaatacataaaatggcttaccggttactgtaaagcatatttttatggcctgagagtgaagttgctggaacccgtcccggtatccgtaacccggtgcagtttccgtgttaatgaaaatactcacaatctgcagattcacgcgggagacattctcaaattcctcaagaagaagaaacccgaggatgcattttgtgtggtgggtattacaatgatcgacttatatcctcgggactcttggaacttcgtgttcggacaggcatcccttacagatggagtcgggatcttcagcttcgctaggtatgggtccgatttctactccatgcactataaaggcaaggttaagaaactgaagaagaccagctcatcggattatagcatctttgacaattattacattcctgagatcacaagtgttctgctgctgaggtcttgtaaaaccctcacacacgaaattggacatatttttggactcagacattgccaatggttggcttgcttgatgcagggttccaaccatctcgaggaagctgatcgccgtcccttaaatctgtgtcccatttgtcttcacaagcttcagtgtgccgttggcttctcgattgttgagcgatacaaagctctcgtgcgttggattgacgacgagagttccgacacccctggggccactcccgaacatagccatgaagataatggaaatcttcctaagcccgttgaagccttcaaggagtggaaggagtggattattaagtgcctggctgtgttgcagaaatag

SEQ ID NO: 18706 - DNA, 2172 bp, Artificial Sequence
  Description of Artificial Sequence: Synthetic coding sequence
atggccgagtacacccggctgcacaacgccctggccctgatccggctacgaaatcctcccgtgaacgctatatctacaacactgctccgcgatataaaagaaggtctgcaaaaggctgttatcgatcatacaattaaggccattgtcatctgtggcgccgagggaaagttttctgcaggtgccgatattagaggcttctccgcaccgagaacctttggcttgacactgggccacgtagttgatgagattcagcgaaatgaaaaacccgttgttgccgccatccagggaatggcttttggaggcggcctagagctagccctcggttgccactacagaatcgcccatgcggaggcgcaagttggcttgcctgaagttactcttggtctacttcctggggcacgaggcacccagctgcttccacgcctcactggcgtccctgccgccctagatcttattacatccggtaggaggatcttagcagacgaagccctcaaactgggcatcctggataaagtggttaactccgatcccgtggaggaagccattcgcttcgctcagagggtatctgatcagcccctcgaaagccgacggctgtgtaacaaacccatccagtctctgcctaatatggatagtatattcagcgaagctctcttgaagatgaggagacagcaccccggctgcctggctcaggaggcttgtgtgagagccgtccaggccgctgtgcagtatccctacgaagtgggcatcaagaaggaagaggagcttttcctatacttactgcagtccggacaggctcgggccttgcagtacgcgttttttgccgaaagaaaggctaataagtggtccacaccttccggggcctcatggaaaaccgcatctgctcgtcccgtgagctcagttggagtcgtcgggcttgggaccatggggcgcggcatcgtgatttcgtttgcacgcgccagaatccccgtgatcgcggtggactccgacaagaatcagctggcaaccgccaacaagatgattacgtcggtgctggaaaaggaggcctccaagatgcaacagtccgggcatccttggtccggcccgaagcctcgtcttacatcctctgtaaaggaattaggaggcgtggacctcgtgatcgaggcggtattcgaggagatgtccctgaaaaaacaggtattcgccgaactgtctgccgtgtgcaagcctgaggccttcctgtgcaccaacacctcagccctagacgtggatgagatagcgagcagtaccgaccgcccacaccttgtgataggtactcacttctttagtccagcccacgttatgaagctcctggaggtcattccttctcaatatagctctcctactacgattgcaaccgtgatgaaccttagtaaaaagattaagaaaatcggggtggtggtgggaaactgtttcgggtttgttggtaatcgaatgttgaatccctattataaccaagcatatttcctactagaggagggttctaagccagaagaggtagaccaggttctggaagagttcggctttaagatgggtccattccgagtctctgatctcgccggcctggacgtcggctggaaaagtcgaaaaggtcagggtctcacaggacctacattgctgccaggcacccctgcaaggaaaagaggaaatagacgatattgtcctatacccgacgttttgtgtgagctggggcgatttgggcagaagacaggaaaggggtggtatcaatatgacaagcctctcggtaggatccataagcccgatccgtggctctccaaattcttaagtcggtacagaaaaactcatcacatcgagccccggaccatttctcaagatgagatattagagcgatgcctgtactcactgatcaacgaggccttccgcatcctcggcgaaggcatcgctgcatcccctgagcacattgacgtcgtgtaccttcacggctatggctggccgaggcacaaaggcgggcctatgttctacgcgagcaccgtcggactgccaacagtgctggagaaacttcaaaaatattataggcagaacccagacattcctcaactggagccatcagactacctgaagaagctggcatctcagggtaacccacctctaaaggaatggcagagtttagctgggtcaccatcatctaagctgtag

SEQ ID NO: 18707 - DNA, 1875 bp, Artificial Sequence
  Description of Artificial Sequence: Synthetic coding sequence
atgacccaggccgagaagggcgacaccgagaacggcaaggagaagggcggagaaaaggagaaggaacagagaggagtgaaacgtcccattgtgcccgccttagtccccgaatccctccaggagcagatccaatcaaacttcatcatcgtgattcaccccggatccacgacgctgagaatcggacgcgccaccgacaccctacctgcttcaatcccacatgtgatcgctaggaggcacaagcaacaggggcaacccctctataaagattcctggctccttcgcgaaggtctcaacaagccagaatctaacgagcagagacaaaatggactcaagatggtggaccaggctatatggagcaaaaaaatgtcaaatgggacacgccgcatccctgtatctcctgagcaggcccggtcatacaataaacagatgcgccccgccattcttgatcactgctcgggtaacaaatggacgaatacgtcgcaccatcctgagtatctcgttggtgaagaggcactctatgtgaaccccctggattgttataatattcactggcccattcgtcggggccaactcaatatccatcctggccccggcgggtccttgacagcagtgctggccgatatcgaagtgatatggagtcacgcaattcaaaaatatctggagattcctttgaaggacctgaagtattatcggtgtatcctgcttattcccgacatttataacaagcagcatgtcaaggaactcgtgaacatgatcctgatgaaaatggggttctctggcatcgtcgtgcaccaagagagtgtctgcgccacctacgggtcgggtctcagcagtacatgcattgtcgacgtgggcgatcaaaagacatctgtctgttgtgtggaggatggagtgtctcataggaacaccagactgtgtcttgcatatggagggtctgacgtcagccggtgcttctattggctcatgcagagagccggattcccgtacagggagtgccaactaacgaataaaatggattgcttactgctccaacatttgaaggaaaccttttgccacctggaccaagacatttcaggactgcaggatcatgagttccagatcagacatccggatagtcctgctctcctataccagttccggctcggcgatgaaaagctgcaggcccccatggctttattctatccagctacatttgggatcgtcgggcagaagatgacgacgctccagcaccggtctcaaggcgaccccgaggacccacatgacgagcattatctcctggctactcagtcaaaacaggagcagtcagccaaggccacggccgaccgtaaatccgccagcaagccgatcggatttgagggagacctgaggggacagtccagcgaccttcccgagagactgcactcgcaagaggtcgacctgggcagcgcccagggggacggactcatggctggcaatgacagcgaggaggccttaacagcacttatgtccagaaaaacagccattagcctgttcgaaggaaaagctctgggcttggacaaggccattctgcatagcattgattgctgttcttctgatgatacaaaaaagaaaatgtattcgagtatcctggtagtcggggggggcctgatgttccacaaggcccaggaattcctacagcataggattttgaacaagatgcctcctagcttcagaagaattatcgaaaacgtggacgtcataaccaggcccaaggatatggatccccggctgatagcttggaaaggtggcgctgttctggcttgccttgatactactcaggagttgtggatttaccagcgtgagtggcaacgttttggcgttcgcatgttgcgtgagagggctgcctttgtatggtag

SEQ ID NO: 18708 - DNA, 2364 bp, Artificial Sequence
  Description of Artificial Sequence: Synthetic coding sequence
atggccgccaccaccgccaaccccgagatgaccagcgacgtgccctctctgggaccagcaatagccagtggtaacagtgggcccggcatacagggaggcggcgccatcgttcagagggcaattaaaagacgtccaggcttggactttgacgacgatggcgaaggaaattctaaattccttaggtgcgacgacgatcagatgagcaacgataaagagagatttgccaggtccgacgacgagcaatcatctgccgacaaggagaggctcgcgcgggagaatcattccgaaattgaaagacgccgcagaaataagatgaccgcttatatcacagagctttcagacatggtccctacttgtagcgcactggctcggaaaccagacaaactcacaatcttgcggatggccgtgagccacatgaaaagcttgcgcggtactggtaacacctcgacagatggttcatataagcctagttttttaacagatcaggagctcaagcacctgatccttgaggctgcagatggcttcctcttcatcgtgagttgtgaaacgggtcgcgtcgtgtacgtcagcgattcagtgacaccagtgctaaaccagcctcaatcagaatggttcggaagcaccctttatgatcaggttcaccccgacgatgtcgacaaacttcgagaacaactgtctacctccgaaaacgccctcactggacgcattttggatctgaagacaggcactgtcaaaaaggagggacagcaaagtagtatgcgtatgtgtatgggctctcggaggtccttcatttgccgcatgcggtgcggcagtagctccgtggacccagtcagtgtcaaccgcttgagttttgtgagaaatcggtgccgaaatggactcggctccgtgaaggacggggagcctcatttcgttgtggtacattgtactggatacataaaggcatggccccccgcaggggtctctctgcccgatgatgatccagaagccgggcagggttctaagttctgtttagtggctattgggcggttgcaggttacttcctcccctaattgcactgacatgtctaatgtgtgccagccgacagaattcataagcagacataacatcgaaggcatattcacattcgtagatcaccgctgcgtcgctacggtgggttatcagcctcaggaactactggggaaaaacatcgtggagttctgtcatccagaagaccaacagttgttacgggacagctttcagcaggtggtgaagctaaagggccaagtgctgagtgtaatgttcaggttcagatcaaagaaccaagagtggctttggatgcgaacttccagttttacatttcaaaacccctattccgacgagatcgagtatattatttgtactaacacaaacgtgaagaacagttcccaagagccccggcctacgctttcgaatactatccaacggccacagcttgggccaaccgccaacctgcccctggagatggggagcggacaactcgcacctaggcaacaacagcagcagaccgaattggatatggtgcctgggcgagatggccttgcttcatataaccactcgcaggtggtccagcctgtgacaactaccggtcctgaacattctaaacccttagagaaaagtgatgggcttttcgcccaggaccgagaccctaggtttagcgagatttatcataatattaacgccgatcagagtaaaggcatctccagcagtaccgtgccagctacccagcagctcttttctcagggtaatacgttccctcccacccccagacctgccgagaatttttctggtcttgcaccccctgtgacaatcgtacaaccaagtgctagtgctggtcagatgcttgcgcagatctcacggcactccaaccccactcagggtgccaccccgacctggacccctaccactcgatcagggttctccgcacaacaagtggctacacaggctactgctaaaacaagaacttctcaattcggagtaggaagtttccaaactccttcctccttttccagtatgtcgctaccaggcgcccccaccgcatctccaggagccgcagcatatccaagtctcacaaataggggaagcaacttcgcgccagagaccgggcagacggccggtcagttccagactcgcactgcagagggggtaggcgtgtggccacaatggcagggtcagcagccccatcacaggagctcgagctctgaacagcatgtgcagcagccacctgcacagcagcctgggcagccagaagtattccaggagatgttgagtatgttaggcgaccaatccaattcgtacaacaatgaagagtttcctgacttgaccatgtttcccccattctctgaatag

SEQ ID NO: 18709 - DNA, 2370 bp, Artificial Sequence
  Description of Artificial Sequence: Synthetic coding sequence
atggccgccaccaccgccaaccccgagatgaccagcgacgtgcccagtttgggccctgccatcgcctctggaaatagcggccccggcattcagggaggtggcgccatcgtgcaacgcgctattaagaggcgacccggcctagatttcgacgatgatggcgaaggcaactcaaagtttcttcgatgtgatgacgaccagatgagcaatgataaagaaagatttgcccgctcagatgatgaacagtccagcgctgataaggagcgcctggctagagagaatcacagtgaaatcgagcgccgcagaagaaacaaaatgacagcctacattaccgagttaagcgatatggttcccacctgcagcgctctcgcccgcaagcccgataagctgactatcctgaggatggccgtatctcacatgaagagcctgcgtggcaccggaaacactagcacagacggctcttacaaaccctcatttctaactgaccaggagttaaagcacctcattttggaggccgccgacgggttccttttcattgtctcctgtgagactggcagagtggtgtatgtatctgactctgtgactcccgtcctcaatcagccacagtccgagtggtttggctccaccctgtacgatcaggtgcatccagatgacgtggataaactccgagaacagctgtcgacatctgagaatgcgctgacaggcagaatcctggacctgaagacaggaacagttaagaaagaaggacagcagagcagcatgcggatgtgcatgggatcaagacgctcatttatatgcagaatgcgctgcggctcctcctcagtcgatcctgtgtccgtgaacagactcagttttgtgcggaaccgatgccggaatggcctgggaagtgttaaagacggggagccacactttgtagtagtccactgcactggttacatcaaggcatggccgcctgctggagtgtcgctcccagatgatgatccagaagccggccaaggatcaaagttctgtcttgtcgccatcgggcggctgcaagttacttcttctcccaactgcacagatatgtctaacgtctgccagcccacagagttcatttctcgtcacaacatagaagggatattcacttttgttgatcaccggtgtgtggcaacggtgggatatcagccgcaagaacttttgggaaaaaatattgtcgaattttgccacccagaggaccagcagctgctacgtgatagcttccaacaggtggtgaagctgaaaggacaggtgttatctgtgatgttcaggtttagaagcaaaaatcaggaatggctctggatgcggacaagctccttcacctttcagaatccatacagcgatgagatagagtatatcatttgcacaaacaccaacgttaagaacagcagccaggaacctaggccgacgctctccaacaccatccaaagaccacagctcggacccacagccaatcttcccctcgagatggggtcagggcaactcgccccccgacagcagcagcaacaaacagagctggacatggtgcctggccgggatggtctcgccagttataatcacagtcaggttgttcaaccagtcaccaccacaggaccagaacattccaaacccctcgagaagtctgacggcttgttcgcccaggatagggatcctagattctccgagatatatcacaatatcaatgctgaccagtctaagggaatctcaagcagtactgtcccagcgacccaacaactgttcagccaaggtaatacctttccaccaacccctagacccgctgaaaatttccgcaattcaggtctcgcccctccagtgacaatcgtgcaaccctctgcttcagccggccagatgctggcccaaattagtcggcactccaaccccactcagggtgctacccccacatggacccccacaactcggtcagggttctctgcccagcaggtggcgactcaggccactgccaagactcgcacaagccagtttggggtggggtcttttcaaacaccttcaagcttcagctcaatgtccctacccggcgcacccaccgccagtccgggagccgccgcttacccaagtcttaccaatcgtggttcaaacttcgcccccgagactggacagactgctgggcagttccaaactcgcacagcggagggggtcggcgtctggccacaatggcaaggccagcagcctcaccaccgcagctcaagcagtgagcagcatgtgcaacagccacctgctcagcagccgggccagcctgaggtttttcaggaaatgctgtctatgcttggggaccaaagtaatagttacaacaacgaagaatttcctgacttgacaatgttcccccctttctctgagtag

SEQ ID NO: 18710 - DNA, 1767 bp, Artificial Sequence
  Description of Artificial Sequence: Synthetic coding sequence
atggccgccgaggaggaggccgccgccggcggcaaggtgctgcgggaagagaaccagtgcattgccccagtcgttagcagtagagtgagccccggtacacggccgacagctatgggtagtttctcttcacacatgacagagttccctcgaaagagaaaggggtctgactctgacccgtctcaggaagcgcactcacagacggaaaagaggagacgcgacaagatgaacaacctgattgaagaactgtcagctatgatccctcagtgcaacccaatggcaagaaaactggacaagttgacagtgctcaggatggccgtgcaacacctccgctccctgaaaggattaactaactcctacgtgggcagcaactaccgaccttccttcctccaggataacgagcttcgccatttaatcctgaaaacagccgagggatttctgtttgtcgttgggtgtgaaagaggcaaaatcctgtttgtgtcaaaatccgtgagcaagatcctaaactatgaccaggctagccttactggtcagtccctgttcgactttctgcaccccaaggacgtggcgaaagtgaaagagcaattgagtagttttgacattagcccacgggaaaagctcatcgatgctaagacggggctgcaggtgcacagcaatctgcatgccgggcgtacccgagtttacagcggtagtagacgaagcttcttttgccggattaagagttgtaagatttcggtgaaggaagaacatggctgtctgccaaacagtaaaaagaaagagcaccgtaagttttatacaatccattgtacgggatatctacgcagttggcctcctaacatagtcggcatggaggaggagaggaatagtaagaaagataacagcaatttcacctgcctggtcgctattggaaggttacagccatacattgtgccccagaacagtggtgagatcaacgtcaaaccaaccgaattcatcactcgttttgccgtcaacggtaagttcgtgtacgtggaccagagggccactgccatcttgggttacctgccccaggagttactggggacttcctgttatgaatacttccatcaggatgatcataacaacctgactgacaaacacaaggctgtgctgcaaagcaaggagaaaattctcacagattcttacaagtttagggctaaagacggatcttttgtaaccttgaaatcccagtggttctcctttacgaatccatggactaaggagctagagtatatagtttccgtgaacaccctggtgctgggtcactctgaaccaggggaggcaagcttcctgccatgcagcagtcaaagcagcgaggaaagctccaggcagtcttgtatgtctgtgcctggaatgtctaccgggacagttctcggggcaggatcaatcggaacggacatcgcaaatgagatactggatctgcaacggctccaatccagctcttacctggatgactccagtcccactggactgatgaaggatacccatacagtaaactgtaggtccatgtccaacaaggaattgtttcccccctcgccctctgaaatgggagagctagaagccacaaggcagaatcagtccacggtcgctgttcattcacatgaacctctcctgagcgacggggctcaattggactttgacgctctttgtgataacgatgataccgccatggccgccttcatgaactatctggaagccgaaggcggcctgggggatcctggagattttagcgatatccagtggacgctctag

SEQ ID NO: 18711 - DNA, 1911 bp, Artificial Sequence
  Description of Artificial Sequence: Synthetic coding sequence
atggccgccgaggaggaggccgccgccggcggcaaggtgctgcgggaagaaaatcagtgcatagcccccgtcgtgtctagtcgtgtctcaccagggacccgccctaccgcaatgggttccttctcctcgcacatgactgaattcccccggaagcgaaagggttccgactcagatccatcgcagagcgggattatgactgagaaggttgttgaaaaactttcacagaatccgctgacctacctgttgagcactcggatagaaatctccgccagttccggcagccgtgttgaggatggggagcaccaggtgaagatgaaggctttccgggaagctcattctcagacagaaaaacggagaagagacaaaatgaataatctgatcgaagagttgtccgcaatgatccctcagtgtaaccccatggctcggaaattggacaagttgacggtactacgcatggctgtccagcatctgcggtcactgaagggtttgaccaactcctacgttgggtctaactacaggccttcctttcttcaagacaatgaactcaggcatctcatccttaaaacggccgagggcttccttttcgttgtggggtgtgagcgcggcaaaatactctttgttagtaagtcggtaagcaagatccttaactacgatcaggcttctctgactggccagagcttgttcgactttcttcatcctaaggatgtcgctaaggtgaaagaacagctgtcgtctttcgacatatctcccagggaaaagctgatcgatgctaagacgggccttcaggttcactcgaacttgcatgccggtagaactcgggtgtattcaggaagccgccgctcgtttttttgtcggattaagagttgcaaaatttccgtgaaggaggagcacggctgtcttccgaattctaaaaaaaaggagcacaggaagttttacaccatccactgtaccggttacctacgaagctggcctcctaacatcgttggcatggaagaggagaggaattctaagaaagacaattccaactttacctgcctcgtcgctattgggagactgcagccttacatagtgccccaaaattcaggtgagatcaatgttaagccaaccgaatttattaccagattcgccgttaacggcaagtttgtgtacgtggatcagagagccaccgcgattttgggctacctaccccaagagttgttgggaacttcttgttatgagtatttccaccaggacgaccataacaacctaacagacaagcataaagcagtccttcagagtaaggaaaaaatcctgacagattcatacaagttccgggcaaaagacggctcgtttgtcacactgaaaagtcagtggttctcctttactaacccatggactaaggaactggagtacatcgtgtcagttaacaccttagtcttaggccacagtgagcccggggaagcaagctttttgccctgttccagtcagagcagcgaggagagttctaggcaatcctgtatgagtgttcctgggatgtcaacaggtaccgtcctcggagcgggcagcatcggcacggacatcgcaaacgaaatcctggacttgcagaggcttcagagtagctcatacttggatgacagctcaccaacgggcttgatgaaggatacgcacacagtgaactgtcgatcaatgtcgaacaaagagctgttccccccaagcccctcggaaatgggagagctggaagctacaagacagaatcaaagtaccgtagctgtgcactcgcacgagcccctcctctccgatggagcccagttagattttgacgccctgtgtgataatgacgacaccgctatggctgcttttatgaactacttggaagcagagggcggactcggagaccccggagacttctcagacatccagtggactctttag

SEQ ID NO: 18712 - DNA, 1869 bp, Artificial Sequence
  Description of Artificial Sequence: Synthetic coding sequence
atggccgccgaggaggaggccgccgccggcggcaaggtgctgcgggaagagaaccagtgcatcgctccagtggtgtcttcacgcgtgtcgccaggtacgcggcccacagcgatgggtagctttagctcgcacatgactgagttccctcgaaagaggaaaggtagcgactctgacccatctcagagcgggataatgacggagaaggttgtggagaagttgtcgcagaatcctctgacctacctcctgtctacaaggatcgagataagtgctagctccggtagtagggaggcccattcgcagacggaaaaacgtcgacgagataagatgaacaatctgattgaagagctgtccgccatgatcccccagtgtaacccaatggccaggaagcttgataaactgaccgttctgcggatggccgtacaacaccttcggtccttgaaaggattgactaatagctacgtgggatccaattatcgccctagtttcctgcaggacaacgagctgagacacctcatcctgaaaacagctgagggtttcctttttgtcgtcggctgcgagagggggaagattctttttgtcagtaaatcagtgagtaagattctcaactacgaccaggcatctctgacaggtcagtcactgtttgacttcttacaccccaaagacgtggccaaagtgaaggagcagttgagctcgtttgacatttctcctagggagaagctcatcgacgcaaagacagggctccaggtgcactccaacttacacgcgggaaggaccagagtgtacagcggttccagacgaagcttcttttgtcgtattaagtcttgcaagatttccgtaaaggaagagcatggatgcctgcctaattctaaaaaaaaggaacacagaaagttctatacaatccactgtacaggctacctgagaagttggccaccaaatatcgtcggaatggaagaggagagaaactctaagaaggacaactccaattttacttgcctggtagccataggccgcctccagccatacatcgtcccgcaaaattcaggtgagattaacgtaaaaccaaccgagtttattacacgcttcgcagtcaatggaaagttcgtctatgtcgatcagagggcaacagcgatactcgggtatctccctcaggagctgcttggcaccagctgctatgagtacttccatcaagacgatcacaataatctgactgataagcataaagcagttttgcaaagcaaggagaagatcttgaccgactcatataaattccgtgctaaggacggatctttcgtgaccctgaaatcccaatggtttagcttcacgaacccctggacgaaagagttagaatatatcgtgagcgttaacaccttagtgctgggccacagcgagccgggcgaagcatctttcttgccttgcagctcccagtcatccgaggaaagtagcagacagagctgtatgtctgtaccgggaatgagcacaggtactgtgctgggcgccggatcaatagggactgatattgccaacgagatcttagacctgcagaggcttcagtcctcgagctacttggacgacagttctccaacagggcttatgaaggacactcacacggtgaattgtcggtctatgagcaataaagagctgttccctccctcccccagcgagatgggagaacttgaggccacgcgacagaaccagtcaactgtcgcagtccacagtcatgaacctctgctgtcagacggggcacagttggacttcgacgccctttgtgataatgacgatactgcaatggccgctttcatgaattacctggaagctgagggaggactgggagaccccggcgacttcagcgatatccagtggactttgtag

SEQ ID NO: 18713 - DNA, 1800 bp, Artificial Sequence
  Description of Artificial Sequence: Synthetic coding sequence
atggccgccgaggaggaggccgccgccggcggcgaggtggccggcggcgaagcaaccgctcccggcaaggtgttgagagaagagaatcagtgtatcgctccagtggtctccagcagggtatccccaggcacccgccctacagctatgggatctttttcaagccatatgacagagttccctcgcaagcgtaaagggagtgatagcgaccccagccaggaagctcactcccagaccgagaaaaggcggcgagataagatgaataacctgattgaggaactctcagccatgatccctcagtgtaatccgatggctcgcaaactcgataagcttactgtgctgagaatggccgtgcagcatctgagatctctgaagggactgacaaatagctacgtgggatctaactacaggccatcattcctgcaggacaacgaattgcggcacctaattcttaaaaccgcagagggttttctgtttgtggtgggatgtgaaagagggaaaatcctttttgtttctaagtccgtcagcaaaattctcaactatgaccaggcctcactgacaggacagagcctgttcgattttctccacccaaaagatgtcgcgaaggttaaggagcagctgtcatcattcgacatttccccccgcgagaaattgattgatgcaaagactggtctccaggtgcattccaatctccacgctggtcggacccgcgtgtacagcggctcccggcgcagctttttctgtcgcattaagtcttgcaagatctcggtaaaggaggagcacggatgtttacctaactcaaagaaaaaggaacaccggaaattttatacaatccattgtaccggctatttgcgcagctggcctccgaacatcgtagggatggaagaagaacgtaacagcaagaaggacaattctaactttacctgcctggtggccatcggacgactgcagccttatattgtgccccagaattctggtgaaatcaacgtcaagcccacggaattcattactagattcgccgtcaacggaaagttcgtctacgttgaccagcgtgcaacagctattctaggatatcttccccaggagctgctgggcacttcttgttacgaatattttcatcaggatgatcacaataatcttactgacaagcacaaggctgtcctgcaaagcaaagaaaaaatcttgacagatagctataaattcagggctaaagacggttcttttgtcacactgaaaagtcagtggttctcctttaccaatccctggaccaaagagcttgagtacattgtttctgtgaacaccctggtgttggggcattccgagcctggagaagcctcatttctgccatgctccagtcagtcctctgaggagagcagcagacagtcctgtatgtcagtccctggcatgtcaaccggaacagtcctgggcgccgggagcataggcactgatattgcaaatgagatcctcgacctgcagcgactgcagtccagctcttatttggatgactcatcccctaccggtctgatgaaggatacacacaccgttaattgcaggtctatgagtaataaagagctgtttcccccaagcccctcagaaatgggagagttggaagccacacgccagaaccaaagtactgtggctgtccatagccacgaaccactcttatcggacggcgcccagctggattttgatgccctgtgcgataacgacgacaccgccatggccgcattcatgaattacctcgaggccgaaggtggcctaggcgaccccggggacttcagcgatatccagtggaccctgtag

SEQ ID NO: 18714 - DNA, 1656 bp, Artificial Sequence
  Description of Artificial Sequence: Synthetic coding sequence
atgggcagcttcagcagccacatgaccgagttcccccggaagcggaagggatccgattcagaccctagccaggaagctcactcacaaacggagaaacggcggagagataaaatgaataacttaattgaggagcttagcgctatgatccctcagtgcaaccctatggctagaaaacttgataaactgaccgtgttaagaatggctgtccagcacctcaggtcactgaaaggcctgacaaattcctacgtgggcagtaactatcgaccatcttttcttcaggataatgaactcagacacctgatcctgaaaactgccgagggtttcctgtttgtggtggggtgtgagcgggggaagatcctcttcgtgagcaagagtgtgagcaagatactgaattatgaccaagcttccctaaccgggcaatccttattcgacttcttgcaccctaaggatgtcgctaaggtgaaggaacagcttagcagcttcgacatctcacccagggagaagttaatcgacgctaagacaggcttacaggtgcacagcaacctgcacgctggtcgcacgagagtttacagtgggtctcgccgatctttcttttgtaggatcaagtcatgcaagatttccgttaaggaggaacatgggtgcctgcccaatagcaagaaaaaagagcatcggaaattctacaccattcactgcactggttacttgcggagttggccacctaatatcgtgggcatggaagaagaacgaaattccaagaaagacaactccaatttcacttgccttgttgccatcggacggctgcagccttacatcgtgccccagaattccggcgaaatcaatgtcaaacccaccgaatttatcactcggtttgctgtgaatggaaaatttgtctacgtggatcagagggctactgccatactcggataccttccacaggaattgctgggtaccagttgctatgagtacttccaccaggatgaccacaataacctcaccgataaacacaaggcagtgttacaatctaaggaaaagatcctgaccgactcttataagttccgtgcgaaggatggatctttcgtgactctgaagtctcagtggttctctttcactaacccatggacaaaggagctcgagtacattgtctcagtgaatacgctggtgctggggcactcagagcccggcgaggcatctttcctgccttgctccagtcagagctccgaagagagttcccgccaaagctgtatgtccgtgccaggcatgtctaccggcaccgtgctcggggctgggagcatcggaactgacatcgccaatgagatcttggatttgcaaagattgcagtctagttcctatctggacgattctagtcccacaggactgatgaaggacacccacactgttaactgccggagcatgtcgaacaaggaactgttccctccgtctcccagcgagatgggcgagctcgaggcaacacggcagaaccagagcactgttgccgtccatagccatgagcctctgctgagcgacggagcacagctggattttgatgccttatgcgacaacgacgataccgcgatggccgcatttatgaattacctggaagcagaaggcggactaggcgacccaggcgatttctccgatatccagtggacactgtag

SEQ ID NO: 18715 - DNA, 1809 bp, Artificial Sequence
  Description of Artificial Sequence: Synthetic coding sequence
atggccgccgaggaggaggccgccgccggcggcaaggtgctgcgggaggagaaccagtgcatcgcccccgtcgtgtcctcgcgggtgtcccccgggacacgcccgaccgccatggggagcttttcctctcacatgacagaatttcctcggaagcgaaaggggtccgactcagacccaagccaggtcgaggatggtgaacatcaggtcaagatgaaggcctttagggaagcccattcacagactgaaaaacgtcggcgggataaaatgaacaacctcatagaagaactctccgctatgatccctcagtgcaacccaatggcccgaaagctcgacaaactcactgtcctaaggatggccgttcaacatctgagaagtctcaagggcctcactaattcctatgtaggatcaaattaccgcccatcattcctgcaagataacgagctcagacatctcatcctgaagacagcagaagggtttctgttcgtggttggctgtgaaaggggaaagatcctttttgtgagcaagtcagttagcaaaattcttaactacgaccaggcttccctcacaggccagtccctgttcgactttctgcaccccaaggatgtcgctaaggtgaaggaacagctgtcatcttttgacatttctccaagggagaaactgatcgatgctaaaacagggctgcaggttcactcaaaccttcatgccggcagaacgcgggtatattcaggttctcggcgaagttttttctgcagaatcaagtcatgtaagatctccgtgaaggaggaacatggctgcctacccaactctaagaagaaagagcacagaaagttctacaccattcattgcaccggctatctgcggtcttggcctcccaatatcgtgggaatggaggaggagaggaattcaaagaaggataacagtaatttcacttgtctcgtggctatcgggagactacagccatacatcgttccccagaattctggggaaatcaacgttaagcctacagagtttatcacgcgcttcgccgtcaacggaaagttcgtgtacgtggaccaacgggcaacagccattctgggatacttgccacaagagttacttgggacctcatgctacgaatattttcatcaggacgatcacaacaacttgacagacaaacataaagcagtgctgcagagcaaggagaagattctcacggactcttataagttcagagcaaaagatggttccttcgtaacattgaaatctcagtggtttagtttcactaatccttggacgaaggagctggagtacattgtgtccgtcaacacactggtgttaggtcatagcgagccaggcgaggcttcattcctcccatgcagcagtcagagcagtgaggagtcaagcaggcaatcttgcatgagcgtgcccggaatgtctacaggaaccgttctgggtgcagggtcaattgggaccgacatcgctaacgaaatcttggatctgcagaggctgcagagtagttcttatttggacgattctagccctacgggccttatgaaagacacccacacagtgaattgtaggagtatgtccaacaaggagcttttccctccctctccatcagagatgggtgagttagaggctactcgccagaaccaatccacagtagccgttcacagtcacgagccactgctcagtgatggggcccagctcgactttgatgcactgtgtgacaacgatgacaccgccatggcagcatttatgaattacctggaagccgaggggggcttgggtgatcccggcgatttctcagatatccagtggactctctag

SEQ ID NO: 18716 - DNA, 6858 bp, Artificial Sequence
  Description of Artificial Sequence: Synthetic coding sequence
atggccgcccaggtggcccccgccgccgccagcagcctgggcaacccccccccacctccgccttcggagttaaagaaagccgagcaacaacagcgggaagaggcaggcggtgaggctgccgcagccgcagccgcagaacgcggggagatgaaggccgccgcggggcaagagtcagagggtcctgctgttggccccccccagccgcttgggaaggaattgcaagacggcgctgaatcgaacggtggagggggtggtggcggtgccggttctggcggtggaccgggcgccgaaccagaccttaagaattctaacggaaatgctggcccaagacctgccttgaataacaatctgaccgagccacccggaggcggtggaggaggcagttccgacggcgtgggagcccctccccactcagctgccgctgcactgcctcccccggcatacgggttcgggcagccttacggacgttccccttctgctgttgcggcggctgctgcagctgtgttccaccaacagcatggaggacaacagtcccccggtctggctgccctgcaatcaggtggcggggggggactggagccttatgcgggaccccaacaaaatagtcatgaccatggatttccaaatcatcagtacaacagctactatcccaatcggtcagcatatcctcctcccgctcctgcctacgccctgtcttctcccagagggggaactcccgggagcggtgcagccgctgctgcaggtagtaagccaccgccttcatcctccgcatctgctagctcctccagttcctcctttgcccaacaaagatttggcgccatgggcggcggtggaccttcagctgctggaggcggcaccccacaacctaccgccacaccaacactgaatcagttgctgacaagtccatctagtgccagaggctatcagggctatccaggcggcgactactcaggcggaccacaagacggaggcgcaggcaagggccctgccgacatggccagtcagtgttggggggccgcagctgcagccgccgcagccgccgcggcttctgggggtgcccagcagagaagtcatcacgctcccatgtcacccggatccagcgggggtgggggtcaacccctcgcccgtacgccccagccttcctccccaatggatcagatgggaaagatgcggccccagccttatggcggaaccaatccctactcccagcaacagggacccccttcggggccacaacagggccatggttacccggggcagccatacggatcccaaacgccccagcgttacccaatgactatgcagggaagggcacagtccgctatggggggcctgagctacactcagcagatccctccctacggccagcagggccccagtggttatgggcagcagggccagaccccttactataaccagcagtcacctcatccccaacagcagcagccaccttacagtcaacagcctccatctcagacaccccacgcccagccatcctaccagcagcagccacaaagccagccaccccagctgcaatccagtcagcctccatacagccagcagccttcgcagcctccccatcaacagagtccagcgccatacccgtcccagcaatccaccactcagcagcaccctcagtcacagcccccgtactctcagcctcaggcccagtccccctaccagcagcagcagccccagcagccggctccttcaactttatcccagcaggctgcttatccacagccccagtctcagcagagccaacaaactgcatacagccagcagcggttcccgcctccccaggaactatctcaggattcctttggctctcaggcaagtagtgctccctccatgacctcttcaaaggggggacaggaggacatgaatctgtctttgcagagcaggccttcctctctgcccgatctctctggtagcattgacgatctccctatgggaaccgagggcgctctgagtccaggagtaagtacatccggtatttcctcttctcaaggcgagcaatctaatcccgcccaaagccctttcagccctcatacttcaccgcaccttccaggcatccggggcccctcgccgtcccctgtgggaagccctgccagcgtggcccagagtcggagtggccctttgtccccggcagcggtgccagggaatcagatgcccccacgcccaccatctggacagtccgattccatcatgcaccccagtatgaaccagtccagtatcgcccaggacaggggctacatgcagagaaatcctcagatgccccagtactccagcccgcagcccggcagtgctctgtcacccaggcagccttcaggaggtcagattcatactggcatgggctcctatcagcagaatagtatgggcagctatggcccccagggcgggcagtacggccctcagggtggataccccaggcagcctaattacaatgctcttccaaatgctaattaccccagcgcagggatggcaggcggcattaatcctatgggcgcagggggtcagatgcacggacagcccggaatccctccatatgggaccctgccacctggtagaatgagccacgcttcaatgggcaaccggccttatggcccaaacatggccaatatgccacctcaagtcggctccgggatgtgcccgccgcccggaggcatgaaccgcaaaacacaagagactgccgtcgcaatgcatgtggccgctaattctatccagaacaggccacctggatatccaaacatgaaccagggcggcatgatgggcacgggtcctccatatggtcagggaattaatagtatggccggaatgattaatccccagggcccaccctatagtatgggtggtaccatggcgaataacagtgcaggtatggcggcgagtccagaaatgatgggtctgggagatgtcaagttaacgcccgccaccaaaatgaacaacaaggctgacggaactccaaaaactgagtccaagtcaaaaaagagtagtagcagcactaccactaatgagaaaattacaaagctctatgagttgggcggagaaccagagcggaaaatgtgggtggaccgatacttggcctttaccgaagaaaaggctatgggtatgacaaatcttccagctgtgggcagaaaacccctagatttgtataggctgtacgtttctgtcaaggaaattggcgggcttactcaggtgaataagaataaaaaatggagagaattggcaactaacctaaacgtgggaaccagcagtagcgcagcaagctcactaaagaaacaatatatccaatgtctgtatgcatttgagtgtaaaatcgaacgaggggaggaccccccacctgatatcttcgctgctgctgatagcaaaaaaagccaacccaagatccagcctccaagcccagccggctcaggatccatgcagggcccacagaccccacaatcaactagtagctctatggctgaaggtggagacctgaaaccgcccactcctgcttccaccccacattcacagatcccccctctccccgggatgtccaggtcgaattctgtcggaattcaagatgcctttaacgacgggtcggattccacattccaaaagcggaacagcatgacacccaacccaggatatcagccatcaatgaacacaagtgacatgatgggtaggatgagctacgagcctaacaaagacccttacggatctatgcgcaaagcacccgggagcgacccattcatgagctcgggacagggcccaaatggcggcatgggtgacccatactcaagggcagctggccctggcctgggcaatgtggcaatgggccctagacagcactacccttacgggggaccatatgaccgagttcgaacggaaccggggattggacctgaaggcaacatgtctacgggtgccccacagccgaacttgatgcccagtaatccagacagcggaatgtactctccgtcccgctatccaccccaacagcagcagcaacagcagcaacggcatgatagttatggaaatcaattctctacacagggaaccccgtctggaagcccctttcctagccagcagacaaccatgtaccagcaacagcagcagaactataagagacctatggatggtacttatggcccgcctgctaagagacatgagggggaaatgtatagtgtgccttattctactggtcagggtcagccacagcagcagcagttacctcctgcccaaccccaacccgcttctcagcagcaagccgcgcagccctccccacagcaggacgtgtacaaccagtatggaaatgcctaccctgccacagctacagccgccactgaacgacggcccgcgggcggcccacagaaccagttcccctttcagttcggccgggatcgggtcagcgcccctcccggcacaaatgcccaacaaaacatgcccccacagatgatgggcgggcctatccaggccagcgccgaggtggctcagcaggggaccatgtggcagggaaggaacgacatgacttataactacgcaaaccgtcagtcaacaggttccgcaccacaggggcccgcataccatggcgtgaacaggaccgatgaaatgctgcataccgatcagagagcaaatcacgagggaagttggccctctcatggcactcggcagcccccatacggcccatccgcccccgtgccgcccatgacacggccaccgccgtccaactatcagcctcctccatccatgcagaaccacataccccaggtaagcagtcccgcccccctgccacgcccaatggagaaccgcacaagcccaagcaagtctcctttcttacatagtggaatgaaaatgcagaaagctgggccacccgtcccggcaagccatatcgcccctgccccggtccagcccccaatgatcaggagggatatcacattccctccagggagcgtggaagctacccagcccgttctgaagcagcggaggcgtcttaccatgaaggacattggcactcccgaagcctggcgcgtgatgatgtctttgaagagcgggttgctcgccgagagcacatgggcgctcgacacgattaacattctgctgtacgatgataattctatcatgaccttcaatctgtcccagcttcctggtctgctcgaactgctcgtagagtatttcagacgctgtctgatcgagatctttggcattctgaaggaatatgaggttggggaccctggccaacggactttactcgaccccgggcggttcagcaaagtgagctcccccgcacccatggagggaggggaggaggaggaagaactattaggcccaaaactcgaagaagaggaagaggaggaggtcgtggagaacgacgaggaaattgccttctcgggaaaagataagcctgcctcggagaattcagaagagaaacttatctctaagtttgataagctgcccgtgaagatcgtgcagaaaaacgaccccttcgtggttgattgcagtgacaaattggggcgggtccaggagtttgattccggtctgctgcactggcgaattgggggcggtgataccacggagcacatccaaacccatttcgagtccaagaccgagctgttgccttcgcgcccccacgcaccctgtcccccggcgcccaggaagcacgtgacaacagctgaaggcacccccggaacaacagatcaggagggccccccacctgacggcccacctgaaaagagaatcactgcaacaatggacgacatgttgagtactagatcaagtacgttgaccgaagacggcgctaaaagttctgaagcaatcaaggaatcatccaagttccctttcgggatttcccccgcacagtcccaccgcaatatcaagatcttggaggacgaacctcactctaaggatgaaacgcccctctgcaccctattggattggcaggactccctggccaagcgctgtgtttgtgtgagcaacactatcaggtccctctctttcgtacccgggaacgacttcgaaatgagcaagcatcccgggctgctgctgatcctgggaaaattgattttgctccaccataagcatccggaacggaaacaagcaccactaacctacgagaaggaagaagaacaggaccaaggggttagctgcaacaaggtcgagtggtggtgggactgtcttgagatgctcagggaaaataccctagtgactctggcgaacatttctggccagctggacctgtcgccttacccagagagcatttgcttgccagtgcttgatggtctactgcactgggccgtttgccccagcgccgaggcacaggatcctttctctaccctaggccccaatgccgtcctatcaccccagcgattggtactggagaccctctcaaagcttagtatccaagataataacgttgatttgatcttggccactcctccgttttctaggctcgagaaactgtacagtacaatggtgaggttcttgtcagatagaaagaatccagtgtgccgagagatggccgtcgttctgcttgcaaacctggcgcagggcgatagtcttgccgccagggcaatcgctgtgcaaaaaggatcgataggcaacttactgggatttcttgaagactcactcgctgccacgcaattccagcaaagccaggcctccctgctgcatatgcagaatccaccttttgagcctacttcagtcgacatgatgcggcgagccgcgagagcactgctcgcactggccaaggtcgacgagaatcacagtgaattcaccttgtatgaaagccggcttttggatatttccgtgtcacctctgatgaactcactggtaagccaggtcatctgtgacgtgctattcctaattggccaaagttag

SEQ ID NO: 18717 - DNA, 5709 bp, Artificial Sequence
  Description of Artificial Sequence: Synthetic coding sequence
atggaccagatgggcaagatgcggccccagccctacggcggcaccaacccgtatagtcaacagcagggacctccaagcggtccgcagcagggccatggatatcccggtcaaccatacggatcccagacaccccaacgctaccctatgactatgcaaggccgagcacagagcgccatgggtgggctatcgtatacccagcagattccaccctatgggcagcagggtccgagtgggtacggccagcaaggacagacgccgtattacaaccagcagagcccacatccacagcagcaacagcctccctattctcagcagcctccttctcagacaccccacgcccagccttcctatcagcaacagccccagagccagccccctcaactacagtcctcgcagccgccatatagccagcagccctcacagcccccacaccagcagtcgcctgccccatatccgagccagcagtctacaactcagcagcacccccagtctcagcctccctactctcagcctcaggcccagagtccatatcagcaacagcagccacaacagcctgcaccctccactttgtcccaacaagcagcttaccctcagccacagtcccagcagagccagcagactgcatacagccagcagaggttcccacctccacaggagctgagtcaggactcttttggctcgcaagcatcaagcgctccgtctatgacctcctccaaagggggccaggaggatatgaatctcagtttacagtctaggccctcttcattacccgacctcagcgggtccatagatgatctccccatgggtaccgaaggcgcactttcaccaggggtgtccacctcagggatttccagctcacagggcgaacagtccaatccagcccaaagccctttctccccacacacctcaccacacttgccaggaatcagagggcctagtccctcgcccgtgggtagtcccgcatccgtggcacagtcccggagcggaccactgtccccagccgctgtgccagggaaccaaatgcctccccgccctccttccggacaatctgattccattatgcaccctagcatgaaccagagttctatagcacaggaccggggatatatgcagcgcaacccccagatgcctcagtactcttctccccaaccaggttcagcccttagccccagacagccatccggcggacaaatccatactggtatggggtcttaccaacagaatagcatgggatcttatggtccccaggggggacagtatggtcctcagggcggctaccctcgacagcctaattacaatgccctccccaacgccaactacccctctgctgggatggcaggcggtatcaatcctatgggggccggaggtcaaatgcacggacagcccggtatcccgccctatggtacactacctcccggccggatgagccacgcatcaatgggaaatcggccctacgggccaaacatggcaaacatgccacctcaggtcgggagcggaatgtgccccccccccggcggcatgaaccgaaagacacaagagaccgctgttgcgatgcatgttgcagcgaattcaattcagaatcgtcctccagggtatcccaatatgaatcaggggggaatgatgggtaccggtccgccatacggccaaggcatcaactcaatggccgggatgataaatccacaggggcctccctattcaatgggagggactatggcaaataatagcgccggtatggcagctagtcccgaaatgatgggcctcggcgacgtgaaactcacacccgccactaagatgaataataaagcagacgggactcctaagacagaatcgaaaagcaagaaaagttcttcttccacgactaccaacgaaaaaatcactaagctttatgagctgggaggtgagcccgaacgtaaaatgtgggtggatagatacctcgcttttactgaggagaaggccatgggcatgacaaatttgcctgctgtgggcagaaaacccctcgacctgtatagattatacgtcagtgtgaaagagattgggggtctaactcaggtgaataagaacaagaagtggagggagctggctaccaaccttaacgtggggacctcatcgagcgcagcttcttccctgaaaaagcaatacattcagtgtttatatgcctttgaatgtaagatcgagagaggagaggatcctcctcccgatatctttgcggctgcggactcaaaaaagtcccagccaaagattcagccacctagtcccgccgggagtggctcaatgcaggggcctcagaccccgcagtccacttcttctagtatggccgaaggcggggacctgaagcccccgactcctgcttctactccacacagccaaattccccccctgcccggaatgagccgtagtaactctgttgggatacaggatgcttttaacgatggatccgatagcaccttccaaaagaggaactcaatgactccgaaccctgggtatcagccatccatgaacacgtccgatatgatgggtcgaatgagctatgagccaaacaaagacccgtacggctcaatgaggaaggcacccggtagcgatcctttcatgagctccgggcaagggccaaacggcggaatgggagatccttatagccgagccgcaggaccaggccttggaaacgtggcaatgggcccacgccagcattatccttatgggggtccgtacgacagagtgagaaccgaaccgggcatcggtcctgagggtaatatgagcacgggcgcgcctcaaccaaacttaatgccgagcaaccctgattccggcatgtacagtccatccaggtacccgccccagcaacagcagcagcagcagcagcggcacgacagctatgggaatcagttcagcacacagggtactccaagtggttcaccctttccctctcagcagacgaccatgtaccaacaacagcagcagaattataaacggcctatggatgggacttacggaccccctgctaagagacatgaaggagagatgtatagcgtcccctatagcaccggccaggggcagccgcagcagcagcagttgcctcccgcccagccccaacccgcttcccagcagcaagctgcccagccaagtcctcaacaggatgtgtacaaccagtacggaaacgcctacccagccacggcgactgcagctacggagcgacgccctgcagggggcccccaaaatcaatttccttttcaattcgggagagatagagtttcagccccacccggaaccaacgcgcaacagaacatgccgccccaaatgatggggggaccaatccaggcttccgcggaggttgcacagcaggggaccatgtggcaaggtcggaatgacatgacctacaactatgccaaccggcagtcaacgggctccgctcctcaaggcccagcctatcatggtgtgaacagaaccgacgaaatgctccacactgaccagagggctaatcacgaaggttcgtggccatcacacggtacccggcagccgccatacggcccaagcgcgccggttccacctatgaccaggccacctccctctaactaccagccccctcctagtatgcagaatcacattcctcaggtatcttcgcctgcacctctgcctagacccatggaaaataggactagcccttcaaaatcaccctttctgcattcagggatgaaaatgcagaaggccgggcctcccgtgccagcttcacacatcgctccagcccccgttcaacctcccatgatccggagagacattacgttcccccctggcagtgtggaggctactcagcccgtgctgaagcagagacgtcgcctcactatgaaagacatcggtaccccagaagcttggagagtcatgatgtcactgaagagcggactgctggccgagagcacttgggccttggacacaatcaacatcctcctgtatgatgataactccatcatgactttcaacctgagtcaattgcctggcctactggaattgctcgtcgaatatttccgtagatgcttgattgagatttttgggattctcaaagaatacgaggtgggggaccccgggcagcggaccctgctcgaccctggacggtttagtaaggtgtcttctcctgcccccatggagggtggggaggaagaggaggagctcttgggacccaagcttgaagaggaagaagaggaagaggttgttgagaatgatgaggagatcgccttttcgggcaaggataaacccgcatctgaaaattccgaggaaaaactcatcagtaaattcgacaagttgcccgtcaaaatcgttcaaaaaaatgacccgtttgtcgtggactgctcagataagctgggcagggtccaggaatttgactctgggctgctacattggagaatcggcggcggagacacaacggaacatattcaaacccatttcgagtctaagaccgaactgttgccctccaggccccacgctccgtgtcctcctgctcccagaaaacacgttacaactgctgaagggacacctgggactacggaccaggagggtcctccccctgacggcccaccagagaagcggattaccgccacaatggacgatatgttgtctaccagaagcagcaccctgactgaagacggcgccaagtcttccgaggctataaaggagagctcgaaattcccgttcggtatctcacctgctcaatcacatcggaatatcaagatcctggaggacgagcctcacagtaaagatgagactcctctttgcactcttttagactggcaggactctctggcaaagagatgcgtctgcgtgtctaacacaatacgctctctctccttcgttccaggaaatgacttcgaaatgtctaaacatcctggcctccttttgatactcggcaaactgattcttctgcatcataagcaccctgagaggaaacaggcacccctgacctacgagaaagaggaggagcaggaccagggcgtctcatgcaataaggtggagtggtggtgggactgcttggagatgctgcgggagaacacactggtgacccttgctaatatctctggacagctcgacctgagtccgtacccagaatcgatttgtctgcctgttctggacggactactgcattgggcagtctgtccttctgctgaggcccaggatcccttcagtaccctcggaccaaatgccgtcctgtcaccacaacggctcgtgctggagaccctgagtaagttgagtatccaggataacaacgtggatcttatcctggctacgccccctttcagtaggttggagaaactgtattctacaatggtgcgctttctgagcgatcgaaagaatccagtgtgcagggaaatggctgtcgtcttattggcgaatttagctcagggggactctttagctgccagagccatcgcagtgcaaaaaggcagtatcggcaacctgctaggatttttggaggacagtcttgctgcgacacagttccagcaatcccaggcatcactcctgcacatgcagaatccacccttcgagcctacgagtgtggacatgatgcgcagggcagcaagagccttattggccttagccaaagtggacgagaaccacagtgagttcaccctctacgaaagccgacttctcgacattagcgtctcgcccttgatgaattcacttgtgagccaggtaatttgcgatgtgctgttcttgattggccaatcatag

SEQ ID NO: 18718 - DNA, 6207 bp, Artificial Sequence
  Description of Artificial Sequence: Synthetic coding sequence
atggccgcccaggtggcccccgccgccgccagcagcctgggcaaccctccgccccctcctccctccgaattaaagaaagctgaacaacagcagagggaagaggccgggggagaagccgctgcagcggccgctgccgaaagaggtgaaatgaaggcagctgcaggccaggaatccgagggccctgctgttggcccaccccagcctctgggcaaggagcttcaggatggcgctgagtccaacgggggcggaggcggtgggggggcgggctccggcggtggcccaggggccgaacccgatctaaagaactcaaacgggaacgccgggccacgacctgctctgaataacaacctgacagaaccccccggcgggggggggggtggtagtagcgacggagttggtgccccgcctcacagtgccgcagccgctcttccgccgcctgcctatgggtttggccagccctacggacgatccccctcagccgtcgctgctgccgccgctgcagtgtttcatcagcagcatggcggccaacagtctcccggcctggcagccttgcagtccggtgggggaggggggttagaaccttatgctggccctcagcagaattctcacgatcatggcttcccaaaccaccagtacaattcctactatccgaatagaagcgcttaccccccgcccgcgccagcctatgcactgtcatctccacgtgggggtacacctggaagcggagccgcagcagcagctggaagcaaacctcctccttcaagcagcgcgtcagcatcctcgagcagctccagctttgcgcagcagaggtttggggcgatgggtggcggaggcccctcagccgcgggcgggggcactccacagccgacggcgacacccacactgaatcagctgctgacatctccctctagcgcccgtggatatcaagggtatcccggtggcgattactcgggagggccccaagatgggggtgctggtaaagggccagccgatatggcctcacaatgctggggggccgcagcagccgctgcagccgctgccgctgcttcagggggagctcagcagcggagtcaccacgcccccatgtcaccgggatccagtgggggcggtggccagccgctggctaggacacctcagccctcctcccccatggatcagatgggcaagatgagaccacagccctacgggggcaccaatccctacagtcagcaacagggccctcctagtggcccccaacaggggcacggctacccaggccagccttacggctcccagactccccagcgataccctatgactatgcagggtagggctcagtccgccatggggggcttgagctacacacagcagatcccaccttacggccaacagggcccgtccggatacggccagcagggacagactccttattacaatcagcagagcccacatccccaacagcagcagccaccgtattcccagcagcccccatcgcagactcctcatgctcagcccagttatcagcagcagccacagtcccagccacctcagctgcagagctcacagcccccctattcacaacagccctcccaaccgccacatcagcagtctccagcaccttatccatctcagcagtccaccacccaacagcacccccaaagccagccaccatactcccagcctcaggcccagtctccttatcagcagcagcagcctcagcagccagccccaagtaccctgagccagcaggccgcctatccccagccacagtctcagcagagccagcaaaccgcatatagccagcagcgtttcccacctccccaggaactttctcaagactcatttgggtcacaagcttctagcgccccctccatgacaagtagcaaaggcgggcaggaggacatgaacctgagcctgcagagccggccttccagtctccccgacctctcaggttccatcgatgatcttcctatggggaccgaaggagcactcagccccggtgtaagcacctccggcatttcttccagtcagggggagcaatctaatcctgcccagtctccgttttccccccacacctcaccccatctgcccgggatacgggggccatccccctcacccgtcggcagtcctgcttccgtggcccagagccggtctggtcccctgagtcccgcggcggtgcccggcaaccaaatgccacctcggcctcccagcggacagtcggattcaataatgcacccaagcatgaatcagtcatcaatcgctcaggaccgaggttatatgcagcgcaatccacagatgcctcagtactctagcccccagccgggaagcgctctgagtcctaggcaaccttctggagggcagatacacaccggcatgggcagctatcagcagaattccatggggtcttacggaccccagggtggacagtacggtcctcaaggcggctatcctcgacaaccaaactacaacgcgctacccaacgcaaactacccctctgcgggaatggctggcggaataaacccaatgggggcaggagggcagatgcacggccagcctggtatccccccgtacgggaccctcccgcccgggaggatgtctcacgccagcatggggaataggccttacgggcccaatatggctaacatgccaccccaggttggatctggaatgtgtccacccccaggcggaatgaaccgaaaaacacaagagacagctgtggctatgcacgttgccgccaatagcatacaaaacaggcctccaggttacccaaatatgaaccaggggggaatgatgggcactggccccccttacgggcaaggcattaatagtatggcaggcatgatcaacccccaaggtcctccatacagcatgggaggcaccatggccaataacagcgctggcatggccgcgtcacctgagatgatgggtctgggtgacgttaagctgacacccgcaacaaaaatgaataacaaagcggatgggactcccaaaacagaaagtaagtcaaagaagtccagcagctccacaactacgaacgagaaaattacaaaactatatgagttgggtggagaaccagaaagaaagatgtgggtggatcggtacttggccttcaccgaagaaaaggccatggggatgacaaacctccccgccgtggggagaaaacctctcgatttgtatcggctgtacgtaagcgtcaaagaaatcggcggcctgacccaagtcaacaaaaataagaagtggcgcgaactggccacaaatctgaatgtgggcaccagcagtagcgcggcatcaagcctcaaaaaacagtacatccagtgcctctacgcatttgagtgcaagattgaacgaggagaggacccgcctcctgacatattcgcagctgccgatagcaaaaagtctcaaccgaaaatccaacctccctcccctgccggctccggctctatgcagggtccacagactccccaatctaccagcagctccatggccgagggtggggacctgaaacctccaactccagcttcaactccccactctcagattccacctcttcctgggatgtcccgttctaactcagttgggattcaggatgcctttaacgacggatccgacagcacctttcagaagcgtaattccatgactcctaatccaggttaccagccctcaatgaatacttcagacatgatggggagaatgtcttacgaaccaaataaggatccatacggatcgatgcgcaaagctcccggtagtgacccttttatgtcctcgggtcagggtccaaacggaggtatgggggacccatactcccgtgcagcgggccctgggttaggtaatgtggccatggggcctcggcagcactatccttatggtggcccctatgacagagtgcggacagagcccggtatcggtcccgaagggaatatgagtactggagcccctcagccaaatctgatgccctccaacccggattccggtatgtacagtccaagccggtaccctccacaacagcagcagcagcagcagcaaaggcatgactcttacggtaatcagttcagcacacaagggaccccaagcggatccccttttccgagccagcagacaacaatgtaccagcagcaacagcaagtgtccagccctgcgcccctgccgaggccaatggagaaccgaacctccccatcaaaatctccatttctccattcagggatgaaaatgcagaaagcaggtccccctgtgccggctagccacatagcaccagctcctgtccagcctccgatgatccgccgagatattacttttcccccagggagcgtggaggccacacagcccgtgctgaagcagagaaggagactgactatgaaagatatcggaactcctgaggcatggagagttatgatgtctctgaagtccggtctccttgcggagtctacttgggctctagacaccatcaacatcctcctctacgacgacaactcaatcatgacattcaatcttagtcagctacccggtctgcttgaactgttagtggagtatttcaggcgttgcctgatcgagattttcggcattctgaaggagtacgaggtaggagatccgggacagcggacactgctggatcctggtagattcagtaaggtgtcttcacctgccccaatggagggaggcgaggaggaggaagaactattggggcccaaattagaagaggaggaggaagaagaggtagtcgagaatgatgaggagattgctttcagcggcaaagacaagccagcaagtgaaaattccgaggagaaactgatctctaaattcgacaaacttcccgtgaaaatagtccagaaaaatgaccctttcgtagtggattgctctgacaagctgggccgggtccaggaattcgattcggggctacttcattggaggataggcggcggggacacaactgagcacattcagacacacttcgagagcaagacagagctattgcctagccgaccccatgcaccctgtcctcccgcacctcgcaaacacgtcaccaccgccgaagggacccctgggacaacagaccaggaggggcccccacccgacggccctccagagaagcgaatcacagctacgatggacgacatgttgtcaacgaggtcctcaacattaacggaggatggcgctaagtcctctgaagcaataaaggagtcctccaagtttccattcggaatcagcccggcacaaagccacaggaatatcaaaatcttggaggatgagccccacagcaaagacgagacgcctctgtgtacactgctggactggcaggatagcttggccaaacgctgcgtttgcgtcagcaacaccatcaggagtctctcattcgtgcccggcaacgacttcgaaatgagtaaacatcctggcctgctgctgatcctggggaaactcattctcctgcaccacaaacacccggaaagaaagcaggcacccctcacatacgagaaggaggaagaacaagatcagggtgtgtcctgcaataaggtggagtggtggtgggactgcttggaaatgctgcgcgagaatacgctggtcaccctcgcaaacataagcggccagctggatttaagtccatatccagagagcatatgcctgcctgtgcttgatgggctgcttcattgggctgtgtgcccatctgcagaagcccaggatcctttcagcaccctaggacctaacgctgttctgtctccacagcgcttggtgctagaaactctgtccaagctttcaatccaagataataatgtggatctgatcctggcaactcctccattctcccgattggaaaaactctactcaaccatggtgagatttctatctgataggaaaaacccggtctgcagggagatggccgttgtgttactcgcgaacctcgcccagggcgactcgctggcagccagggcaattgcagtccaaaaggggagtataggaaatctgcttggctttctggaagactctcttgccgcaactcagtttcaacagagtcaggcctccttactgcacatgcagaaccccccttttgagcctaccagcgtggacatgatgcgcagggccgctagggccctcctggcacttgcaaaggtagatgagaaccactccgaatttactctttacgaatcccgactgctggacatatccgtgagccctctaatgaactccctggtgtcgcaagtcatatgtgatgtgctattcctgatcggccaaagctag

SEQ ID NO: 18719 - DNA, 1842 bp, Artificial Sequence
  Description of Artificial Sequence: Synthetic coding sequence
atgatgagcctgaagagcggcctgctggccgagagcacctgggccttggacaccatcaatattctgctgtacgatgacaattcaatcatgaccttcaacttatcacaactgccaggacttttggaattgctggtggaatattttcgtaggtgtctcattgaaatatttggcatattgaaggagtacgaagtcggtgaccctggtcagcggacactgttggatccgggcaggttctcaaaagtctcgagcccagctcccatggaaggtggggaggaagaggaggagttgctgggaccaaaactggaagaggaagaggaagaggaagtcgtggaaaacgatgaagagattgctttctcaggcaaagataagcccgcatctgagaattctgaggaaaaacttatttctaaattcgacaagttgcccgtaaagatcgtccagaagaatgatccttttgtagtagattgtagcgataaactcggccgggtgcaagagtttgatagcggtttactgcactggcggatagggggaggagacaccaccgaacacatccaaactcattttgagagcaagaccgagcttctgccctcccgaccacatgccccatgccctcccgctccacgcaagcatgtcactactgccgaaggcaccccaggcactactgatcaggaaggacctcctcctgacgggccccccgagaagaggataaccgcaactatggatgatatgctctcaacgagaagctcgaccctgacggaggatggcgcaaagtcctccgaagcgatcaaggaaagttccaagtttccatttgggataagccctgcccagagtcataggaatataaaaattttggaagacgagcctcattccaaagacgaaaccccgctttgtaccttattagattggcaggattccttagctaaacggtgtgtttgcgtgagtaacactatcaggagtctgtcatttgttcccggcaacgacttcgaaatgagcaaacacccaggtctcctcctaatcctggggaaactcatcctattgcatcacaaacacccagagagaaagcaagcacctctcacttacgaaaaagaggaagaacaggaccagggggtgagctgcaacaaggtggaatggtggtgggattgccttgaaatgctgcgagagaacacccttgttaccctcgcgaatatttcaggccaattagacctgtccccctatcccgaatctatctgtttgccggtgttggacgggctgctgcattgggccgtctgtccatccgctgaggctcaggaccccttctctacactggggcccaacgcagttctcagtccgcagaggctggtgctggaaacgctgtcaaaattgagtatccaggataataacgtggatttgatcctggctacccccccattcagccgactcgaaaaactatacagcacaatggttaggttccttagtgataggaagaaccctgtctgcagagagatggcggtggtgttattagccaatcttgcacagggcgactctttagcagcaagagctattgcggtgcaaaagggcagcatcggcaatctgctggggtttctggaagattccttggccgccactcagttccagcagtctcaggcctccctcctccatatgcaaaacccaccctttgaacccacaagcgtggatatgatgaggcgggcagcaagagccctcctggctttagccaaggtggacgagaatcattccgagttcaccctgtatgaaagtcgattacttgacatctccgttagccccctgatgaactctctcgtgagccaggtgatttgtgatgttttgttcctgatcggacagagctag

SEQ ID NO: 18720 - DNA, 6696 bp, Artificial Sequence
  Description of Artificial Sequence: Synthetic coding sequence
atggagaccggcctgctgcccaaccacaagctgaagaccgtgggcgaagcaccagcagcgcccccccaccaacagcatcaccaccatcaccacgcccaccatcatcaccatcatgcccatcacctgcaccaccaccatgccctgcagcaacagctgaaccaatttcaacagcagcaacaacaacagcagcagcagcaacagcagcaacaacagcagcaacatccaataagtaataataacagtttgggaggagccggtgggggcgcaccgcagccaggccctgacatggaacagccccagcacggcggcgccaaggacagcgccgctggcggtcaagccgacccccccggaccaccactcctgagtaagcccggcgatgaagatgatgctcctccaaaaatgggtgagcccgcagggggcaggtatgagcaccccgggctgggggctctggggacacagcaaccacccgttgcggtccctggaggcggcggcggtcctgcagccgtacctgaatttaacaactactatggttccgccgcccctgcgagcggtggtcctggggggcgggcagggccctgctttgatcaacatggcgggcagcagtctcccgggatggggatgatgcacagcgcgtccgccgccgccgctggcgcgcccgggagcatggatccacttcagaacagccatgaaggctatccgaacagccaatgtaaccactaccctggatatagtaggcctggcgctgggggggggggaggaggagggggcggggggggaggcggtagtggcggtggaggcgggggaggcggagccggagcaggcggtgcaggcgcgggtgccgtggcagcagctgctgcggctgcagctgccgcggctggcggaggcggcggcggtggctatggtggcagctctgcgggctatggcgttttgtccagtcccaggcaacagggcggagggatgatgatgggtcccggagggggcggagccgcgagcctgagtaaggctgctgcaggctcggcggcaggcggctttcagaggttcgccggtcagaatcagcatccttctggagcaacccctacactcaaccagctgctgacaagcccttctcccatgatgaggtcttatggtgggtcatacccagagtattcaagcccgagcgcccccccccccccgccctctcaacctcagtcccaggcggccgctgctggggccgctgccggtggccaacaggctgcggcgggtatggggctagggaaagacatgggagcccagtatgccgctgcctccccggcatgggccgctgcccagcagcgatcgcatcccgctatgtcaccgggcactcccgggcccactatgggtcgctcccaaggctcccctatggatcccatggtcatgaaacggccccagctctacggaatgggatctaaccctcacagtcagcctcagcagagcagcccataccccggaggatcctatgggccacctggccctcaaaggtaccctatcggcatccagggcagaacccccggagccatggcgggaatgcaataccctcaacaacagatgccgcctcagtacggccagcaaggtgttagtgggtactgccagcagggtcaacagccatactacagtcagcaaccccaaccccctcacctccctccacaagcccagtacctgccatctcagtcacagcagagataccagccccagcaggatatgagccaggaggggtacggcacaaggagccagcctcctcttgcacccggcaagcccaaccatgaggacttgaacttgattcaacaggaacgacccagttcccttccggatttgtcaggcagcatcgacgacctgcctaccggaactgaagcaacactgtcatcagctgtaagtgccagcggatcaacaagcagtcagggagatcagtccaacccggcacagtccccattctcacctcatgcgtctccacacctctcctcgatccctggcggcccgtccccgagtccagtggggtcacctgtcggtagtaaccagtctcgctcaggacctatctcacctgcgtctataccgggctcccagatgcctccgcaacctcctgggtcacagtccgagtcatcaagccacccagcgctgtcccagtcacctatgccgcaggagagaggattcatggccggcacacagagaaaccctcagatggctcagtacgggcctcaacagacgggaccctccatgtcaccccatccaagcccgggtggtcagatgcatgccgggatttcaagcttccagcagtctaatagcagcggtacttacgggcctcagatgtctcagtacggacctcaaggaaactacagccgtccacctgcctactcaggagttcccagcgcaagctacagtggccctggcccagggatgggcatctctgccaacaatcagatgcacggccagggcccttctcagccatgcggcgccgtccctcttggacgcatgccatccgccggcatgcagaatcgtccattccctggcaacatgagctctatgacaccaagctccccaggcatgagtcaacaaggcggccctggcatgggaccaccaatgcctacggtaaaccggaaggcccaggaagcagctgcagctgtgatgcaagccgcagccaattctgcccagagccgccaaggcagctttcctggcatgaatcagtcgggactgatggcttcaagtagtccttatagccagcccatgaataattccagctcattgatgaacactcaggctcctccatactccatggcgccagcgatggtgaacagctcagccgcctcagtcggtttggctgacatgatgagcccaggtgaatccaagctacccctccctcttaaggccgatggaaaggaagaaggcacaccccagcctgaatcgaaatctaaggatagctactcaagtcagggtatctcacaacccccaacacctggaaatctgccggtgccatcccctatgtccccatcctccgccagcatttcgagcttccatggagatgagagtgattcgatcagttcccccggctggcctaagacccctagttcccctaagtcctcttctagtactactacgggcgagaagataacaaaggtttatgaactgggcaacgagccagagcgtaagctctgggtggaccgctatcttacattcatggaggagagaggctccccggtcagcagcttgcctgcggtcggaaaaaagcctcttgacctgtttcgcctgtacgtatgcgtgaaggagatcgggggcttggcccaagtaaacaagaataagaaatggagggagcttgcaacgaatttgaacgttggcaccagctcctcagctgcatcttccctgaagaaacagtacatacaataccttttcgcttttgagtgcaagatcgaacggggagaagagccccctcctgaagtattctccactggagacacaaagaagcagcccaagctgcagccccccagtccagcgaactctgggagcctccaaggcccccaaacaccacagagtacaggctctaactcgatggctgaagttcccggggacctgaaaccccctaccccagctagcaccccccatgggcagatgacccctatgcagggtggccgatcaagtaccatctcagtgcacgaccccttttccgatgtgagcgactcctctttcccaaagcggaactccatgacacccaatgccccataccaacaggggatgtccatgcctgatgtgatgggccggatgccatacgaacccaacaaagatccgttcggtggaatgagaaaggtccctggctcctcggagcccttcatgacacaagggcagatgcccaattccagcatgcaggacatgtataatcaaagtccctctggggcgatgtccaatttgggaatggggcaacgccaacaatttccctacggggcaagttacgatcgcaggcacgaaccttacggacaacagtacccgggccaaggccccccctcaggacagcccccctacggcggccaccagcccggattatacccacagcagcctaattataagaggcacatggatggtatgtatggacccccagccaaacgacacgaaggcgacatgtacaacatgcagtacagcagtcaacagcaggagatgtacaaccagtatgggggatcatacagtgggccggacagaagacctatccagggtcagtatccttacccttatagtcgtgaacgaatgcagggtcctggacagattcaaacgcacgggatccccccccagatgatgggcggcccgttgcaaagcagttctagtgaaggaccgcagcagaatatgtgggctgctcgaaatgacatgccctacccttaccagaatcgccaggggcccggcggccctactcaagcccctccatatccgggcatgaatcgaacagatgacatgatggtgccggaccaacgtattaatcacgaatcccagtggccatcccatgtatcccaaaggcaaccttacatgagcagttcggcatccatgcagccaataacccggcctccccaacctagctaccagactcccccttcgctgcccaaccatatctcccgcgcgccaagcccggcctcctttcaaagatcattggaaaatagaatgtcaccctccaaaagtccgtttctacctagcatgaagatgcagaaagtcatgcctaccgtccccacgtctcaggtgactggcccgcctccacagccccctccaataaggcgggaaataactttcccacccgggtctgtcgaggcttcacagcctgtcctgaagcaacgtcgaaaaattacaagcaaggacatcgtgactcccgaggcttggagagtcatgatgtcactcaagtctggcctactagctgagagcacctgggcactcgacaccattaatatcctgctgtacgatgattctactgtagccaccttcaacctatcccagttatccggctttctggagctcctggtggaatattttcgaaaatgtctaatcgatatatttgggatacttatggagtacgaagtcggcgacccttcacagaaagcccttgatcataatgctgcacgcaaggacgactcgcagagcttggccgatgacagcggcaaggaggaggaggacgctgagtgcatcgacgatgacgaagaggacgaagaagatgaagaggaggattctgaaaaaacagaatccgacgagaagtcatccatcgccttaaccgctcccgatgccgccgctgaccctaaggaaaagcctaagcaggcgagcaaatttgataaattgccaataaagattgtcaagaaaaataatttgttcgttgttgataggagtgataaattggggagggtgcaagaatttaatagtggtctgctgcactggcagctgggaggaggtgataccacagagcatattcaaactcactttgagagtaagatggagattccacccaggcgcaggcctcctcctcctcttagtagcgctggccgaaagaaggaacaggagggaaagggggattccgaagagcaacaggagaagagtattatcgccactatcgatgacgtgctctcagctcgccctggagccctgcccgaggatgcaaatcctggccctcaaacggagtccagtaaatttcctttcggcatccagcaagcgaaatcccatcgtaatatcaagttgctggaagatgaaccacggagtcgggacgaaactccactttgtacgatcgcccactggcaagattctctcgcaaaaagatgcatctgcgtatctaatatcgtgcgatcattgtcctttgtgcccggaaacgacgccgaaatgagtaaacacccaggcctcgtgctaattctgggtaagttgattcttctccatcatgaacaccctgagcgaaagagggccccacaaacttatgaaaaagaggaggatgaggacaaaggggtggcctgtagcaaagacgagtggtggtgggattgtcttgaggttcttagagataatacactggtgacattggctaacatcagcggccagcttgatctgagcgcctacaccgagtctatttgtttaccaattctcgatggcctgttacactggatggtgtgcccatcagccgaggctcaggatccatttccgactgttggtcctaattcagtactttcaccccaacgtttggtgctcgagactctgtgtaagttatccatccaagataacaacgttgatttaatcctggccaccccaccgttttctaggcaggagaagttctatgccacactggtacggtacgtgggcgaccggaagaatccagtgtgcagggaaatgtccatggctttactgtctaatctcgctcagggcgatgccttggccgctcgtgctatcgccgtgcagaagggtagcattggaaacttgataagcttcctggaagatggcgtgactatggcccagtaccaacaatctcagcacaacttaatgcacatgcagcccccacctcttgaaccccccagtgtagatatgatgtgcagagccgctaaggcattgttggctatggcccgagtagacgagaataggtctgagtttctgcttcacgaaggtagactgctcgatatctccatcagcgccgtgctcaatagtctggttgcctcggtcatatgcgacgtcctgttccagattgggcagctctag

SEQ ID NO: 18721 - DNA, 6750 bp, Artificial Sequence
  Description of Artificial Sequence: Synthetic coding sequence
atggcccacaacgccggcgccgccgccgccgccggcacccacagcgccaaatccgggggttctgaggccgcactgaaagagggcgggtctgcagcggccctgtctagcagctcatcatctagtgcagctgcagcagctgccagctcctcaagttcatctggaccgggatccgctatggagacaggccttctcccaaaccacaaattgaagaccgtcggagaagctcctgctgctcctccacaccagcagcaccatcaccatcaccatgcccaccaccatcaccatcacgcccaccatcttcatcatcatcatgccctgcagcaacagctgaaccagttccagcagcagcagcagcagcagcaacaacaacaacagcagcagcagcagcagcagcaccccatctcaaacaataacagcctcggcggggcaggaggaggcgctccccaacctggacccgatatggagcagccacagcacggaggtgccaaagattccgcagccggtggacaggcggacccccccggtccgcccctgttgagcaagccaggtgacgaagatgatgccccacccaaaatgggtgagccagccgggggcagatacgagcacccaggtctcggagcactggggactcagcagccacccgttgccgtgccaggcggaggtggtgggcctgctgcagtgcccgaattcaataattactatggctccgctgcaccagcttctggaggtcctggcggcagagcaggaccctgctttgatcaacatggcggacagcagtcccccgggatgggtatgatgcactccgcctcggccgcagcagccggggcaccaggctcaatggaccctttacagaattcccatgaaggctacccaaactcccaatgcaatcactacccagggtactcccggccaggggcagggggaggggggggtggggggggtggcggaggcggtggcagtggtggtggaggcggcggcggcggtgccggcgctggcggcgcaggtgcgggcgccgtggccgcggctgccgccgccgctgcggccgctgcaggggggggcggtggaggtggctacggtggaagctccgccggctacggagtgctgagctcgccacggcagcagggggggggaatgatgatggggccagggggcggcggagccgcatcactctcaaaggccgccgccggatccgcagctggggggttccagcggtttgccgggcaaaaccagcatccaagtggcgctacaccaactctgaatcagcttttgacaagtccttcccccatgatgcgcagttatggcggcagctatcctgagtatagcagtccaagcgctcccccgccccccccaagccagccccagtctcaggccgccgccgctggagctgcggccggcggtcagcaggcagccgctggaatggggctgggcaaggatatgggcgctcagtacgccgccgctagccctgcatgggccgcagctcagcaaaggagccatcccgcaatgagtcccggcacgcccggccccacaatgggccgatcacagggcagcccaatggaccctatggtaatgaagcgcccacagctctacggcatgggctcaaatccacactcacagccacaacagtcgtccccatatcctggtgggtcctatggcccccccggcccccaacgttatcccatcgggatacagggccggacacctggtgccatggccgggatgcagtatccccagcagcaggactccggagatgccacatggaaagaaacgttctggctcatgcctccacaatatgggcagcaaggcgtgtccggatactgccagcaggggcagcaaccttactattcacagcagccgcagcctcctcatctgcccccgcaggcccagtacttgccttcccagtctcagcagagatatcagcctcaacaagacatgagtcaggagggttacggaactagaagtcaacctccactggctcccgggaaacctaatcatgaggatttaaacctcattcagcaggaaaggccctcatccctaccagacctatccgggtccatcgacgatttgcctactggaacagaggctacactgtcaagtgctgtgtccgcttctggctctactagtagtcagggggatcagtctaatcccgcccagagtccctttagtccacacgcttcgcctcacttgtcctccatccctgggggacccagccccagtccggtgggcagcccagttgggagtaaccaatcccgctcaggccctatttcccctgcctctattcctggttcccagatgccaccgcagccgccgggctcccagtccgaatccagctcccatccggcgctttcccagtcacctatgcctcaagagaggggctttatggcaggtacccagcggaacccccagatggcccaatatggcccccaacagacgggcccctccatgagcccccacccctcccccgggggacagatgcatgccggcatcagctcctttcaacagtccaacagttccggcacatatggcccacaaatgagccagtacggtccccagggcaattattcgagaccccccgcctacagtggggttccgagcgcctcctattcaggacccggaccaggaatgggcatctctgcaaataatcagatgcatgggcagggaccctctcagccctgcggagccgtacctctggggcgcatgcctagtgcaggaatgcaaaaccgccccttccctggaaatatgtctagcatgaccccctctagtcccggtatgagccagcaggggggccccggcatggggccgcctatgccaacagttaacaggaaagcacaggaagccgcagccgctgtgatgcaggctgcagctaactccgcacagagccgtcagggatcgttcccgggcatgaatcagtccgggttgatggcctcatcttctccctatagccagcccatgaataactctagctccttaatgaatacacaggcaccaccctattccatggcccccgctatggtgaactcatcagccgcctccgtcggtctggccgacatgatgagcccgggagaatcgaagctgccactgcccctgaaggctgatggcaaagaagaaggtaccccccaaccagagtccaagagtaaaaagtccagcagtagcacaacaacgggggaaaagattaccaaggtgtatgaacttgggaatgaacccgagcggaaattatgggtcgatcggtatcttaccttcatggaagagaggggttcacccgtgagctctctccccgccgtgggaaagaagccactggatctctttaggctatacgtgtgcgtgaaggaaatcggtgggctggctcaagttaacaagaataaaaaatggcgcgaattggccacaaatctgaatgtcgggacatcttctagtgccgcttccagcctgaagaagcagtatattcagtacctgtttgcgttcgagtgtaaaattgagcggggagaggagccgccccccgaggtctttagcacaggagatacaaagaaacaaccaaagctacagccccctagcccagccaatagcgggagcctccagggaccgcagacgccgcagtctaccggttcaaactctatggcagaggtaccgggggacctgaagccccctacacctgccagcactccacacggccagatgactccgatgcagggagggcgttcctccacaatctctgttcatgaccccttctctgacgtgtctgactcatccttccccaagcggaacagtatgacacccaacgctccttaccagcagggaatgagtatgccagatgtgatgggtcgtatgccctatgaacctaacaaagatccctttggcgggatgcggaaagtgcccgggagcagtgaacctttcatgactcaaggacagatgcccaattcaagcatgcaggatatgtataaccagagcccgtcaggggccatgagcaacctgggcatgggccagagacagcaattcccgtatggggcctcctacgatagacggcacgagccttacgggcagcaatatccaggtcagggaccaccaagcgggcaacccccttatggaggtcatcagcctggactctaccctcaacagcctaattacaaaagacacatggatggcatgtacggtccaccagccaagagacatgaaggagatatgtacaacatgcagtacagcagccagcagcaggaaatgtacaaccagtacggtggtagttacagcggaccagatcgacggccaatccagggacaatatccatatccttactcaagagagcgaatgcaaggaccgggccagattcagactcatgggatcccaccacagatgatggggggccctctgcagagcagttctagtgaaggtccacagcagaatatgtgggcagcccggaacgacatgccttatccgtaccagaatcgccaggggcctggtggccccacccaggcacccccttacccaggcatgaacagaacggacgacatgatggtacccgaccagagaatcaatcacgaatcccagtggccctcacatgtgtcccagcggcagccttatatgtcttctagcgcctccatgcagcctataacaaggccaccccagcccagctaccagaccccccccagcctcccaaaccatatttcccgggctcccagtcccgcgtcattccaacggagtctagaaaaccggatgagccccagtaaaagtccgttcttgccttccatgaaaatgcagaaagtcatgccaactgtgcccacctcccaggtcaccggtcccccaccccagcctcctcccatcaggagagaaattacgtttccaccggggtcagtcgaggcctctcagcccgttctgaaacagaggcgcaagatcacatcaaaggatatcgtcacccctgaagcttggcgagtcatgatgagccttaaaagcggcctgctcgccgaatccacctgggccttggataccattaatatcctcctctacgatgactcaactgtggccacatttaatctctcacagctctccggctttctggaactgttggtcgaatatttccgtaaatgtctcatagatatctttggcatcctcatggaatacgaagtgggagatccaagtcagaaggccctcgaccacaatgccgcgcgcaaggatgacagccagtcacttgcagacgactcagggaaagaagaagaagacgcagagtgtatagacgacgatgaagaagacgaggaagacgaggaagaggactcagagaaaacagagtctgacgagaagagcagcattgctctcactgcacccgatgccgccgccgacccgaaggaaaagcctaaacaagcctctaagtttgacaaactccctataaagattgtgaagaagaataatttgtttgttgtagataggagtgataagctgggtagggtgcaggaatttaatagcgggctgctccattggcaactcggaggtggcgataccaccgagcatattcagactcactttgagtccaagatggaaatcccccccaggaggaggcctccaccgccactctccagtgctgggcgcaaaaaggaacaagagggaaaaggcgattctgaggaacagcaggagaagagcatcatagctactattgacgatgtcctgtcagctcggccaggggcccttcccgaggacgccaatcccggaccacaaacggaaagttctaagtttccatttggaatccagcaggcgaaatctcatagaaacataaaactcttggaagacgaaccccgttccagggatgagactcctctatgcacaatcgctcactggcaagacagcctcgccaaaaggtgcatttgtgtcagtaacatcgtccggtcattgtcgttcgttcccggaaatgatgcagagatgtccaagcaccccgggttggtgctaattctgggaaagctgattctcctacaccacgaacaccctgaacgcaaaagggccccacagacctatgaaaaagaggaagatgaggacaagggcgtagcttgctcaaaagacgagtggtggtgggattgcttagaagtgctcagggacaacacgctggtcacgttggcaaacatatctggacagctggatttgtccgcctacactgagagcatctgcctacctatcctggacggcctcttgcattggatggtgtgtccttccgcagaggctcaggacccattccccacagtcggccccaatagtgtgctgtcgcctcaacgccttgttctggagacattatgcaaactcagtattcaggataacaatgtggatctgatccttgcaactcccccgtttagccgacaagaaaagttctatgccaccctggtgcggtacgttggggaccggaagaatccagtgtgtcgggaaatgtccatggcactcctttccaacctggcacaaggggacgccctggcagcccgcgccattgccgttcagaaaggatccatcggtaacctcatctcgtttctggaggatggagttaccatggcgcagtatcagcaaagccagcataacctgatgcacatgcagccaccgccattggaaccaccctccgtggatatgatgtgtcgagccgcaaaagccctcctggcaatggcccgtgtggacgaaaaccgttctgagttcctgcttcacgagggaagacttctggatatcagtattagcgctgttctaaattccttagtggcttccgtcatttgcgacgtgttgttccaaatcggtcaactctag

SEQ ID NO: 18722 - DNA, 6711 bp, Artificial Sequence
  Description of Artificial Sequence: Synthetic coding sequence
atggcccacaacgccggcgccgccgccgccgccggcacccacagcgcaaagtcgggtggctctgaagccgcccttaaagaaggtggcagcgccgccgccctgagcagtagcagcagttcctccgctgctgccgcggcggcaagcagctcgagcagctctggacctgggagcgccatggagaccggtctcctgccaaaccataaactgaaaaccgttggagaggcccccgctgctcccccgcaccaacagcatcaccatcaccaccacgcccatcatcaccaccatcatgcccaccacctgcaccaccatcacgctcttcagcaacagctcaaccagttccagcagcagcaacaacaacagcagcagcagcaacagcagcagcagcagcagcagcaccccatctccaataataatagcctaggcggcgcgggaggtggagcaccacagcctggccccgacatggagcagccccagcatggcggggcgaaggacagtgcagccgggggacaggctgacccccccggcccaccacttctttctaagccaggggacgaagacgatgcccccccaaagatgggagaacccgctggggggcggtacgaacaccctggactgggagccctgggtacccagcagccaccagtggccgtgccaggaggcggaggcgggccagctgcggtccccgaatttaacaactactatggctcggccgctccggcaagcgggggacctgggggcagagcggggccttgtttcgaccagcacggcggccagcagtccccaggcatgggcatgatgcactcggcatcagcagctgccgctggggctcccggatccatggaccccttgcaaaacagtcacgagggatacccaaatagtcagtgcaatcattatcccggttacagcaggccaggcgccgggggcggtgggggcggcggtggcggcgggggtggaggttccggcggaggtggtggaggggggggggctggggctgggggagccggagctggggctgtggccgccgccgctgccgcggccgctgctgctgctgggggcgggggaggaggtggctacggcggatccagcgctgggtacggcgttctctcctctccgcggcagcaaggaggcggtatgatgatggggcctggtggcggaggcgccgcaagcttgtcgaaagccgcagcagggtctgctgctggcggtttccaacgcttcgccggccaaaatcagcacccatccggggctactcccaccctgaaccagttgctgacctccccaagtccgatgatgcgatcttatggaggatcatatcctgaatactcaagcccatccgcccctccaccacccccttcccagccccagtcacaggcagcagccgccggagctgccgcgggcgggcaacaagctgcggcggggatggggctagggaaggacatgggggctcagtacgctgccgcatctcccgcttgggctgcagcccaacaacggagccacccagccatgagccccggcactcccggcccaaccatgggtcggagtcaaggctcgccgatggatccaatggtgatgaaacgccctcaactgtatgggatggggtccaatccacactcccaaccccagcagtctagcccgtatcctggcggtagctatgggcctcccggcccgcagagatatccaatcggtatacagggaagaacacctggggccatggccgggatgcaatatccacagcagcagatgcccccccagtacggccaacagggtgtcagtggatactgccagcagggccagcagccctactacagtcagcagccacagccaccccatctgcctccccaggcacagtacctcccttctcagagccagcagagatatcagccgcagcaagacatgtcccaagaagggtatggcaccaggtcacagccgccgctcgctcccggaaagcccaaccacgaggacttgaatctgatccaacaggagagaccttcttccctccccgatcttagcggctctattgacgacctccccactggcactgaggcaaccctgtctagcgcagttagtgcctcaggttctaccagtagccagggggatcagtctaaccccgctcagtcgcctttttctccccatgcatcacctcacctgtccagtatccccggagggccgtccccctccccggtgggttctccagttggttccaaccagtcccggtccggacccatcagccctgccagtattcccggctcccagatgccccctcagccccctggcagccagagcgagagtagctcccatcccgccctgtcacagagccctatgcctcaggagcgagggtttatggcaggcacacagcggaacccacagatggcccagtacgggccccagcagacaggccccagtatgagccctcatccttcccccggcgggcagatgcacgcagggatctcatccttccagcagtccaactcttctgggacctatggaccccagatgtcacagtacggtcctcagggcaattattcgcgtccccctgcctattctggggtgcccagtgcctcatacagtggtcccggccccggtatgggcatttctgcaaataatcagatgcacggccagggaccctcacagccatgcggagctgtcccccttggccgaatgcccagtgccggaatgcagaatcgccccttccccggaaatatgtcatccatgaccccctctagtcctggtatgagtcagcagggcgggcccggtatgggccctcccatgcctacagttaaccgaaaggcgcaggaagccgcggctgctgtgatgcaggcggcggcgaacagcgcgcagtccaggcaggggagctttcctggcatgaatcagagcggactgatggcatcaagctcaccttactctcaacccatgaataacagtagttcactgatgaacacacaggcccctccgtactccatggctcctgcaatggtgaattcatccgctgcttccgtggggctggcagacatgatgtccccgggcgagtccaaacttccgttgcctctgaaagccgacggcaaggaggaggggacacctcagccagaatcaaagagcaagaagagcagtagctcaactacaacaggagaaaaaataacaaaagtttacgagcttggcaacgagcctgaacggaagctctgggttgataggtacttaactttcatggaagaaaggggcagtccggtatcaagtctgcccgctgtggggaagaagcctctggacctctttcgcttgtatgtctgtgtcaaagagattgggggactggcccaagtgaataaaaataaaaagtggagggagctggctacaaacctcaatgtgggcacctcatcctctgccgcctcttcacttaagaagcaatatattcaatatctgttcgcatttgagtgtaagatcgagagaggggaagagccacctcccgaggttttttccactggtgataccaagaagcagccaaagctgcagcccccatcacctgcaaattccggctcactgcagggccctcaaactcctcagagcactggctccaacagtatggccgaggtccccggcgacttaaagccgcccaccccagcaagcacacctcacggtcagatgacccctatgcaagggggccggtcaagcactataagtgtgcacgaccccttctcagatgtctctgatagcagctttccaaaacggaattcaatgactcccaatgccccttatcagcagggaatgagcatgcctgacgtgatgggacggatgccttacgagccaaacaaggacccttttggagggatgagaaaggtgcccggctcctcagagcccttcatgacacagggccaaatgcccaatagttctatgcaagacatgtacaaccagtctccgtcaggagccatgagtaaccttgggatgggccagcggcagcagttcccgtatggcgccagctatgatagaaggcacgagccgtatggtcaacaataccctggccagggcccaccatcaggtcagcctccttacggcggtcaccagccggggctatatccccagcagcctaactataaaagacacatggacggaatgtacggacctcctgctaaacgccacgaaggcgacatgtataatatgcagtattcttcccaacaacaggagatgtacaatcaatacggcggcagctactcgggacccgataggagacctatccaggggcagtacccgtatccttatagccgcgagcggatgcaaggcccaggtcagattcagacccacggcataccacctcagatgatggggggccctctccagtcatcctcttccgaggggccccagcagaatatgtgggccgcgaggaacgacatgccgtatccttaccagaacagacaaggacctggaggtcctactcaggctccgccatacccaggaatgaatagaaccgacgatatgatggtgcccgatcagcggattaatcacgagtcacaatggccttcccacgtttcccaaaggcagccttacatgtcatcaagcgccagcatgcagccaatcacacgtcccccccaaccaagctatcagaccccaccatccctgcccaaccatatctctagagctccctctccggcatctttccagcgtagtctcgagaatcggatgtcccctagtaagtccccgttcttaccatcgatgaagatgcagaaggttatgcctactgtcccgacttcccaggtcactggccctccacctcagcccccgcctatccgccgggaaatcacttttccacccggctccgtggaggcatctcagccagtgttaaagcagagaagaaaaattacgtcaaaagacattgtgacacctgaggcctggcgggtgatgatgtcgttgaaatctgggctcttagcagaaagtacatgggccctagacacaatcaacattctgctctacgatgactccactgtagctacgtttaacttatcccagttgtcaggcttccttgagctgctcgtggagtatttcagaaagtgtctgatcgacatattcgggatcctcatggaatacgaagtcggggacccctcccagaaagccctggatcataatgctgccaggaaggacgattcccagagccttgctgacgactcgggtaaagaggaggaagatgccgaatgtattgatgatgacgaggaggacgaggaagatgaggaggaggactctgaaaagactgaatctgacgagaagtccagtatcgcgcttactgcccctgatgcagcagccgaccctaaagaaaaaccaaagcaggcttccaagttcgacaagctgcccatcaagattgtgaaaaagaataacttgttcgtagttgaccgcagtgataagctgggtcgagtgcaggaatttaactctggcctgcttcattggcagctgggaggaggcgatacaacagaacatatccaaacacacttcgaaagcaaaatggagatccccccccgacggagacctccgcccccactcagtagtgccggtagaaaaaaggaacaagaaggaaaaggagattctgaggagcaacaggagaaaagtattattgcaacgattgacgatgtgctcagcgcccggccgggagccttgcccgaggatgctaaccccggaccgcagacagagagcagtaagttccctttcggtattcaacaagctaagtcacataggaacatcaaactgttagaagatgagccacgctctagagatgagactccgctctgcaccatcgcccattggcaggatagtctggccaaacggtgtatctgcgtgagcaatattgtgcggagcctctccttcgtgcctggtaacgatgctgagatgtccaagcaccctggactggtcttaatcctcggcaagttgatactcttgcatcatgaacatcccgagcgcaaaagggccccccagacttacgagaaagaggaggatgaggataagggggttgcttgctcaaaggatgaatggtggtgggactgcctcgaggttcttcgcgacaatacactcgtgacccttgctaatatctccggacaactggatctgagcgcttatacagagtctatatgtctccctatcttagacggtcttctccactggatggtttgtccttcagcagaagcccaggacccattccccactgtcggcccgaactccgtcctgagcccccagcgcctcgtgctggaaacactgtgtaaactaagcatacaggacaataacgtagacctgattctcgccaccccaccattttcacggcaggaaaagttctacgctaccctggtgaggtatgttggagacaggaagaatcccgtctgtcgggaaatgtcaatggcgttgctgagcaacctggcgcagggtgacgcattggctgccagagctatagcagtgcagaaggggagtattgggaacctgattagctttctggaagacggtgtaaccatggcgcaataccagcagtcacagcataaccttatgcatatgcagcctccccccctggagcctccaagcgtcgacatgatgtgcagagctgccaaggccttgctggccatggcccgcgtggacgagaaccgctcagaattcttactccacgagggcagactgctggatatctctatcagtgccgttcttaactccttggtcgctagtgtaatctgcgacgtactttttcaaataggacaactgtag

SEQ ID NO: 18723 - DNA, 2172 bp, Artificial Sequence
  Description of Artificial Sequence: Synthetic coding sequence
atgcccccccagtacggccagcagggcgtgagcggctactgccagcagggacagcagccatactactcacaacagcctcagcctccacacctgccaccacaggctcagtacctcccttcccagtcccagcaacgataccagccacagcaggatatgtctcaggagggctatggtacacgttcccaaccaccactggcacccggaaagcctaatcacgaggatctgaatctaatccagcaggaacgaccttccagtttgcccgatctgtccggctccattgacgacctccctactggcaccgaggctaccctgtccagcgccgtgtccgccagcggctccacctcctcccagggcgaccagtctaatccggctcaaagccccttctcaccccacgcttctccacacctgagctcgatacctggcggaccttcacctagccccgtgggatctcccgttgggtccaaccaatctcgaagcggacccataagtccagcctctattccaggctctcagatgcctccacagccaccaggatctcagtctgagagctccagtcatccggccctgagccaatctccgatgccccaggaaaggggaacccagcgaaatcctcagatggcgcagtacggaccccagcagaccggaccaagtatgtctcctcaccccagtcctggtggacaaatgcacgcggggatctcgtcattccagcagtccaattcatctggaacttacgggcctcaaatgtcccagtatggcccccagggcaactacagccggcctcccgcctactcaggagtacccagtgcatcgtacagtgggcccggcccaggcatgggaatctccgcgaataaccagatgcatgggcagggaccttcacagccttgcggagcggtgcccctgggaaggatgccgtctgcaggaatgcagaatcgccccttccctggcaatatgagcagtatgaccccttcgagccccggaatgtctcaacagggcgggcccgggatgggccctcctatgccaacagtaaacagaaaggcccaagaagcggccgctgcggttatgcaagcggcagccaactccgcgcagagtcgccagggtagcttcccagggatgaaccagtctgggctaatggcttcaagcagcccctattcacaaccgatgaataattcctcatccctgatgaacacacaggccccaccttacagtatggcccccgccatggtaaatagtagcgcagcctcagtggggctggctgatatgatgagtccgggtgaatctaaattaccattgccacttaaggcggacggcaaggaggaggggactccccagcctgagtctaagtcgaaggattcctactcaagtcaggggattagtcaaccaccgacacccggaaatttaccagtgcccagcccaatgagtccctcctcagcctccatctcaagctttcatggagatgagtcagactcaattagttccccgggatggcccaagacgccttcatctcctaagagtagctccagcaccaccactggggagaagatcaccaaggtgtatgagctggggaacgagccagagaggaaattgtgggtcgatcgctatctgaccttcatggaagagcgggggtcacctgtgtcctcactccccgcggttggaaaaaaacccctagatctgtttaggctgtacgtgtgcgtgaaggagatcggaggattggctcaggtcaataagaataagaagtggcgggaactggccactaatctgaatgtgggtacttccagtagtgcagctagtagtctaaagaaacaatacatccagtatctgtttgcttttgagtgcaaaatcgagcgaggagaggagccgcccccggaggtttttagtactggggatacaaaaaaacaacctaaattgcaacctccctcgccggtggtccagatggagccacgcgcctgcgacactggaggtagcgggcgcaaggcatcctggtctcgtcccgccccgagggccagagctggcggctctagacatacacaagcctccggcgggcgaaggcagcgtcacccaggccttcagaagccattggacagcctgcccccaacccagcaagtggccagtcccatccctgtgccatccctcggcaaggtgtccgggaacatcttcgtggtgaagggcaagtag

SEQ ID NO: 18724 - DNA, 6870 bp, Artificial Sequence
  Description of Artificial Sequence: Synthetic coding sequence
atggcccacaacgccggcgccgccgccgccgccggcacccacagcgcaaaatccgggggtagcgaagcagctctgaaggagggtggatcagccgctgccctgtcctcttcatcatcatcttcggccgcagcggcggctgcctcttccagtagcagcagtggtccaggcagcgcgatggagacggggcttttgccaaaccataaactcaagaccgtcggcgaggctccagccgctcctccccatcagcaacaccatcatcatcatcacgcgcatcatcaccatcatcacgcacaccatctgcaccaccaccatgcattgcagcagcagctaaaccagttccagcagcagcaacagcaacagcagcagcagcagcagcagcagcagcaacagcaacatcccatctcaaataataacagcttaggcggagccggaggcggcgcaccccagcccggacctgatatggagcagccgcaacatggcggggccaaggatagcgctgccggcggacaggcggaccctccagggccaccactgctcagtaaacccggagacgaagacgatgctccaccaaaaatgggcgagccagccgggggtagatacgagcaccctggccttggggccctcgggacacagcagcctccagtcgccgtcccaggtggcggtggcggcccagcagccgtccccgaatttaataactattacggaagcgctgcacccgcttctggaggccctggcggaagggccggtccatgtttcgatcaacatggagggcagcaatcccccggcatggggatgatgcacagtgcgagcgccgcggctgcaggcgccccaggatccatggatcctctccagaattctcatgagggatatcctaatagccagtgtaaccactatcctgggtattcccgccccggcgcaggcggcggcgggggcggggggggcggcggcggtggaggttccggcggtggcggaggagggggtggcgcgggcgccggaggtgcaggagcaggcgccgtggccgctgccgcggccgctgcggcagccgctgctggaggggggggtggcggcggttacggtggcagcagcgcaggttacggagtcttgtctagcccaagacagcagggcggcggaatgatgatggggccagggggaggcggggctgccagcctatccaaagcagcggcggggtccgccgccggaggctttcagcggtttgctggccagaatcagcatcccagtggagccactcctaccctaaaccagttgcttacatcgccatcccctatgatgagaagttatggcgggagctatccagaatacagctcccccagcgcgcctcccccccctccgtctcaaccgcaatcacaggcagccgccgctggagccgccgctggaggccagcaggccgctgccggcatggggttggggaaggatatgggcgctcagtatgcagctgcatcccctgcatgggctgcagcgcagcagcggagccatcccgcgatgagtcccggaactcccgggccaactatgggtaggagtcagggctcaccgatggacccgatggttatgaagcgcccgcaactttacggtatgggttcaaacccacattcacaaccccagcaatctagtccttatcctggagggtcatacggtcctcccggcccacaacgctacccgatcggcattcaaggaagaacacctggggcaatggccggaatgcagtatccccagcagcagatgccgccacagtatggacagcagggcgtctccggctactgccaacagggacagcaaccttactatagtcagcagccccagcccccacacctcccaccgcaggcacagtacctccccagccagtcacagcagagatatcagccccagcaggatatgagtcaagaggggtacggaaccaggagtcagccacctctagcccctggtaaacccaaccacgaggacctcaacttaattcagcaggaaagaccttcaagcctgcccgatctctcaggaagcatcgacgatttgccaacgggcaccgaggctactctgtcatctgcagtgtccgcatcaggaagcacctcatcccagggtgaccagtccaatccagcccagagcccgttttccccccatgcttcgccccacctttcatctatccccggaggtccgagcccgagtcctgtggggtctcccgtcgggagcaatcagtcacgatccggtcccatatctccggcaagtattcccggctcccagatgcctccccagcctccaggttcccagtcagagtcctccagtcatcctgcactgagccagtccccaatgcctcaggaacgaggtttcatggccggcacacagagaaaccctcagatggcacagtacggaccccaacagaccggaccctcaatgtctccccaccccagcccaggtggccagatgcacgcaggcatctcctccttccagcagtcgaattcatccgggacctatggcccgcagatgtcccaatatgggcctcagggcaattatagccgcccccctgcctactcgggcgtgccatcggcaagttactccggtcccggacccgggatgggcatcagcgctaacaatcaaatgcacggtcagggaccctctcagccgtgtggagcggtccccttaggcagaatgcccagtgccggcatgcagaatcgaccatttcccggtaacatgtcatccatgacaccaagctctccaggtatgagtcagcaggggggccctggtatggggcctccaatgcctaccgtgaatagaaaagctcaggaggccgcagctgctgttatgcaggctgcggccaattcagctcagtctaggcaaggctcttttccaggtatgaaccagtctggactgatggcttcctcctcgccatacagccaaccaatgaataacagttcttctctcatgaatacacaagcccctccctattcaatggctcctgccatggtaaattcgagtgccgcttccgtgggtcttgctgacatgatgtcccctggagagtccaagctgcctctgccgctgaaggccgacgggaaagaggaaggaactcctcagccagagagtaaatctaaggattcatatagctctcagggaatttcgcagcctccaacacctggaaacttgccggtgccaagtccaatgtcaccctcctccgcatctatctcatcttttcatggggatgagtcagattctatttcgagccccggttggccaaagaccccctccagccctaagtctagctccagcacaacaactggggaaaagattaccaaagtctatgagctgggcaatgaaccagagagaaagctgtgggtcgacaggtacctgacttttatggaggaacggggatccccggtctccagcctcccggccgtcgggaaaaagccattggatctctttaggctttacgtgtgtgtgaaggaaatcgggggtttggcccaagttaacaaaaataagaagtggcgggaattagccacaaacttgaacgtcggaaccagctcaagcgcagcctctagtctgaagaagcagtacatacagtaccttttcgccttcgaatgtaaaatagagagaggagaggaaccaccacctgaggtgttttccacaggcgacaccaagaagcaacccaaactgcaaccaccttcaccagccaactccggaagccttcaggggccccagacgccccagtcaacaggcagtaattccatggccgaagtgccaggagatcttaaacccccaactcccgccagcacgccgcatggacaaatgacgcccatgcagggaggcaggagctcgactatcagcgtacacgatcccttcagtgacgtctctgactcgtccttccccaagcgtaactccatgactcccaacgccccttaccagcagggtatgtccatgccagatgtcatggggcggatgccttatgagcccaataaggacccattcggagggatgcgcaaggtccccggcagcagcgagcctttcatgacccagggccagatgcccaactcaagcatgcaagacatgtacaaccagtcacctagtggcgctatgtcgaacctgggcatgggacaaaggcagcagttcccctacggagcctcctacgatcgccggcacgagccttatggccagcagtatccgggtcaaggacctccatccggccaacccccctacgggggacaccagcccggcctctacccccaacagccaaactacaagcgacatatggatggtatgtatggaccacccgctaagaggcacgagggggatatgtataatatgcagtattcttcccagcagcaagaaatgtataaccagtacggcggctcatattccggtcccgatcgccggcctatacagggacagtatccatacccttacagccgagaaagaatgcagggaccagggcaaattcagacacacggcatcccaccccagatgatgggaggtcccttgcagagtagctctagcgagggcccccagcagaatatgtgggctgccaggaacgatatgccctatccctaccagaaccggcagggaccgggggggcccacccaggcccccccttatcccggaatgaatcggactgacgatatgatggtcccggaccaaaggatcaaccatgagtctcagtggccatcgcacgtgtctcaacgacagccatatatgtctagttctgcctctatgcagccaatcactcggcctccgcagcccagctaccagacacctcctagtctgcccaaccacatatcgagggctccgagtcctgcaagcttccagaggtctctcgagaatcggatgtcccccagcaaatcccccttcctgccctcaatgaaaatgcagaaagttatgcctactgtgcccactagccaggtaactggaccaccacctcagcctccccccatccggcgcgagatcactttccctcccggatcagtggaggcatcgcagccggttctgaagcaaaggcgaaagattaccagtaaagatattgtcaccccagaggcttggcgcgtgatgatgtcacttaagagtggcttgctcgccgaaagcacttgggccctcgataccatcaacatattgttatatgacgactccaccgtagctactttcaacctgagccagctatcaggctttctggagctcttggttgagtacttccggaaatgcctaatcgacatctttggcattcttatggaatacgaggtgggggatccctcacagaaagccctcgaccacaacgcagctaggaaggacgactcccagtcactggccgatgattccggaaaagaggaagaggacgccgagtgtatcgatgacgatgaggaggacgaggaggatgaggaggaggatagcgaaaaaacagaaagtgacgaaaaaagctccattgccctcacggctcctgatgccgctgcggaccccaaagagaaacccaaacaagcttcaaagtttgacaagctgcccatcaagattgttaagaagaataacttgttcgtggtggatcgttccgacaaactggggcgggtgcaggaatttaactccggtctgttacactggcaacttggaggtggagatactacagaacacatccagacacatttcgagagcaagatggaaattccgccccgaaggcggccgccccccccactctcttctgccggacggaagaaggaacaagaagggaagggggactctgaagagcaacaagagaaaagtataattgcaaccatcgacgacgtgctgagtgcacgaccaggggctctacctgaagatgccaacccaggcccgcagacagagagtagcaaattcccctttggaatacagcaagcgaagagtcataggaatatcaaacttctagaagacgaaccccgctcccgagacgagactccactgtgtaccatcgcccactggcaggactccctggccaaacgttgcatatgcgtgtccaatatcgtgcggtcactctctttcgtgcctggaaatgacgccgaaatgtcaaagcatccaggtctggtgctgatattggggaaactcattttgctgcaccatgagcacccggagcggaaacgagctcctcagacatacgaaaaagaggaagatgaagataagggcgttgcgtgtagcaaagacgaatggtggtgggattgcctggaggtcctgcgggacaacactctggttacgctagcaaacatctctggacagctggatctgagtgcctataccgagtccatatgtctccccattttggatggtcttctgcactggatggtctgtccgtccgccgaggctcaggacccatttcccactgttggtcctaacagcgtgttgagtcctcaacgcctggtgctggagactctctgcaaattaagcatccaagacaataacgtcgatctcatattggcaacacctccattctcccgccaagaaaaattttatgccacgttggtaaggtacgtcggtgacaggaaaaaccctgtgtgtagggagatgagcatggctctcttgtctaacctggcgcaaggagatgctctagctgcccgagcgattgccgtacagaagggtagtattggcaacttgataagctttctggaggacggagtcaccatggcccagtatcagcagtctcaacacaatttgatgcacatgcaaccccctcccctggagcctccttccgtggatatgatgtgcagagcagccaaagccttgttagccatggcccgagttgacgagaaccggtccgaatttcttctgcatgaagggagactgctggacatctctatttccgccgtgcttaactccctcgtggcctccgtcatctgtgatgttctgtttcaaattgggcagctgtag

SEQ ID NO: 18725 - DNA, 822 bp, Artificial Sequence
  Description of Artificial Sequence: Synthetic coding sequence
gccgccgtgatgcaggccgccgccaacagcgcccagagccggcagggatcctttcccggtatgaatcagagcgggttaatggcgagctcatcaccttattcccaacccatgaataatagctcaagcttaatgaacacccaagcccctccctactctatggcacctgctatggtgaattcaagtgctgcttccgtcggcctggccgacatgatgtccccaggcgaatcaaaactgccgctgcccctcaaggctgatggcaaggaggaggggacacctcagcccgagtccaagtcgaaaaaatcatcctcttctacaaccactggcgaaaaaataaccaaggtttacgagcttggaaatgaacccgagcggaagctgtgggttgatcgatacctgaccttcatggaggaacgcggctctccagtgtcttcactgcctgcagtggggaagaaaccccttgatctgttcaggctgtacgtttgcgtgaaggagataggcggcctggcacaggttaataagaataagaagtggagggagctcgcaacaaacctgaacgtcggtacttcatcatctgctgctagctctctgaaaaaacagtacattcaatacttattcgcctttgagtgtaagatagagcggggcgaagagcctccaccggaggtgtttagcaccggggacacaaagaaacagccaaagcttcagcctccctctccaggcaagtggcgcaggtgctctcactggccgagaaaggcacaagcccctgggctcggtggctccggcaaagtagtctcccaatcggggcagcaggggacatgggatttctag

SEQ ID NO: 18726 - DNA, 1053 bp, Artificial Sequence
  Description of Artificial Sequence: Synthetic coding sequence
atgagccaggagggctacggcacccggagccagccccccctggcccctggcaaaccaaaccatgaagacttaaaccttatccagcaagaaaggccgtcctccttaccagtggaagtgttggcttcagaagacgccgccttcggactgaaggatctgagtggctccatagatgaccttccgaccggcaccgaggctacgctctcatctgcggtcagcgcctctgggtccactagctcacaaggcgatcagagtaaccccgctcaatctcccttttcaccccatgcttctccgcaccttagttccatccccgggggcccgagccctagccctgtgggctcacccgtcgggtccaaccagagccggtcgggtccaatttcccccgcctcaattcctgggtcgcagatgccaccccagcctcctggcagtcaatccgaatccagctctcaccccgccttgagccagtcacccatgccccaggaacggggattcatggccggcactcagcgtaatccccagatggcacagtacggacctcagcagactggtccctccatgagccctcacccatctcccgggggacagatgcacgccggtatctcatctttccagcaatcaaattcctccggtacatatggaccccagatgagccagtacggcccacaaggcaattactcaaggcctccagcttactcaggggtcccttccgcctcttacagtgggccaggtcccggaatgggcatatccgccaataaccagatgcacggacaaggtcctagccagccgtgcggggctgtgccacttggccgaatgccctcagccgggatgcagaacagaccattccctgggaacatgagctccatgacaccaagcagtccaggaatgtcccagcaggggggaccgggcatgggaccacccatgcctactgtgaatagaaaggcccaggaggcggccgcagcagtgatgcaggccgcagctaacagtgcacagtctagatacgctacacaggagcacgcaccagggaggtatgccgtttgtttaccagtgaccacctag

SEQ ID NO: 18727 - DNA, 5508 bp, Artificial Sequence
  Description of Artificial Sequence: Synthetic coding sequence
atggccaacagcaccggcaaggccccccccgacgagcggcggaagggactggcctttctggatgaactgcgccagttccaccacagtcgcggatcgccatttaagaagatcccagctgttggcggtaaggagttggacctgcacggactctatactcgcgttaccaccctgggaggatttgctaaggtgagtgagaagaatcaatggggagagatcgtggaggagttcaacttccccaggagctgctctaatgcagcttttgcactcaagcagtactatcttagatatttggaaaagtacgagaaagtgcaccatttcggagaggatgacgacgaggttccccccggtaaccctaagcctcagttgcctatcggggctataccatctagctataattatcaacagcacagcgtgagcgactacctgcgccagagttatgggctttctatggacttcaactccccaaacgattataataaactcgtgctgtccctcttgtcaggtttgcccaacgaagtagattttgccatcaatgtgtgcacccttctttccaacgagagtaagcacgtcatgcagcttgagaaggatccgaaaataatcactctgctgctggccaacgcgggcgtgttcgatgatactttagggagcttctccactgtattcggcgaagagtggaaggaaaaaacagatagggattttgttaagttctggaaagacatagtggacgacaacgaggtgagagacctgattagcgacaggaacaagtcccacgaaggcaccagcggcgaatggatctgggagtctttgtttcatcccccaagaaagctgggaattaatgacattgagggccaacgcgtgctccagattgccgtgatcctgaggaacctgtccttcgaagagggtaatgtaaagttgctggccgccaatcgcacctgcttaagattcttactgctctcagctcactcgcacttcatcagcctcaggcagctaggcttagatacccttgggaacatcgctgctgaactgttgctcgatcctgtagactttaaaaccactcaccttatgttccataccgtcaccaaatgcttgatgtcccgtgacaggttcctgaagatgcgcggcatggagatacttgggaatctgtgcaaggcagaggacaatggcgtattaatatgcgagtacgtcgaccaagattcttaccgggagatcatctgtcacttgacgctgcccgacgtactactggtaatctcgacattggaagttctgtatatgctgacggagatgggagacgtggcgtgtacaaaaattgctaaggttgaaaaatcaatagatatgctggtgtgtcttgtgtctatggacatacagatgttcggcccagatgccctggctgccgtgaaactgatcgagcacccgtcatcctcgcaccagatgctgtccgaaattcggccgcaggctatcgagcaggtgcagacccaaacacacgtggcctccgcgcccgcatcaagagccgtggtagcacaacatgtggcgccccctccagggattgtggagattgattctgaaaaattcgcgtgccaatggctgaatgcccatttcgaagtgaaccccgactgctcagtgagcagggctgagatgtattcagagtatttgtccacttgcagtaagctggcaagaggcggcattctgacaagcactggattttataagtgtctcagaaccgtgttccctaatcacacagtcaaaagggttgaggacagttcctccaatggccaggctcacattcacgtggtgggcgtgaaaaggcgggcaattcctctgcctatccaaatgtactaccaacaacaacccgtatccacctcagtggtcagagtagatagcgtacctgacgttagccccgcgcctagccctgctggtatcccacacggaagccagacaatcgggaaccattttcagaggactcccgtggcaaatcaatcttcaaatctgactgctacccagatgtcatttcccgttcaaggggttcacactgttgcacaaaccgtgtcccgtatcccccagaatcccagtccacacacgcatcaacagcagaatgctccagttacagtgattcaatccaaggctccgattccgtgtgaggttgttaaggcaactgtcattcagaactcgattccccagacaggcgtacctgtttctattgccgtgggcggcgggccgcctcaatcttctgtagttcagaatcattccacaggacctcaacccgttacagtcgtgaattctcagactcttttgcaccatcccagtgtcattccccagcagagcccgctgcacactgtggtgccagggcaaatcccaagcggcacacccgtcaccgtcatccagcaggccgtgcctcagtcccatatgttcgggcgagtgcagaatattcctgcctgtacctctaccgtcagccaaggacagcagctgatcacgacatcccctcagcccgtgcaaacatcgtcacagcagacctccgccggttcacagtcccaggatacagttataatagcacctccccagtacgtcacaacttccgcctcaaacattgtgtcagctactagcgtccagaactttcaagtcgccaccggccagatggtcacgattgccggagtcccttctccacaggcctcccgcgttggctttcagaacattgctccaaaaccacttcctagtcagcaggtaagcagtactgttgtgcagcagccgatccagcaacctcagcagcctacacagcagtctgttgttatcgtgagccagccggcccaacagggacagacttatgcgccagctatacaccagatcgtgctcgctaaccccgccgctttgcccgcggggcagacagtacagctcaccggccagccgaacattactccatcttcgagtcctagccccgtgccggcaaccaataaccaggttcccaccgcaatgtctagcagtagtactccacagtcccaaggaccacctcccaccgtgtctcagatgttatctgtgaaacgccagcagcagcaacagcattcccctgccccccccccccaacaggttcaggtgcaggttcaacagccacagcaggttcagatgcaggtgcagccacagcagtccaacgctggggtggggcaaccggcctctggtgagtcgagcttgattaagcaattgcttctcccaaaacgcggaccaagcactcctggcgggaagcttattctgccagccccacagattccacctcccaacaatgccagagcaccttcccctcaggtggtctaccaagttgcaagtaatcaagcagctggctttggcgtccagggacagacacccgcacaacagcttctcgtgggacagcaaaacgtccagctggtgcccagtgcaatgccgcccagcgggggcgtccagaccgtccccatcagcaatctacagatcctgcccggcccgctgatttccaattcgccagccaccatttttcaaggaacttcagggaaccaggtgactatcactgtagtgccaaacacctcgttcgctcctgccacagtcagccagggtaatgcgacacagttaattgcacccgccgggatcacaatgtccgggactcagaccggggtgggtctgcctgtgcagaccttgccagcaacacaggctagtcccgctgggcagtcatcctgtacaactgctacaccaccctttaaaggtgacaaaattatatgccagaaggaggaagaggccaaagaagccactggcttacacgtgcacgaacgaaaaattgaggtgatggagaaccccagttgcaggcgaggcgcaaccaacacttccaatggtgatacgaaggaaaatgaaatgcatgttggatcattgttaaacggcagaaagtacagcgactcatcccttccacccagcaattccggaaagatacaatctgagactaaccaatgttctctgatcagtaacggccctagcctggagcttggggagaacggggcgtcggggaaacagaattctgaacaaattgacatgcaggatatcaagagtgatctccgcaaacccctggtgaacgggatctgtgactttgacaagggggacggttcccatcttagtaaaaacatccccaaccataaaaccagcaatcacgtgggaaatggggaaatttcccctatggagccgcagggaaccctcgacatcacacagcaggataccgcaaaaggagaccaactcgagcggatctccaatgggcccgtcctcacacttggtggctcctccgtgtcatccatccaggaagcttccaacgcggccacccaacagttctctgggaccgatctgttgaatggtccgttagccagcagcctcaactccgatgtgcctcaacagcggccatctgtggtagtgtccccgcattcaacgactagtgttattcaggggcaccaaataatcgcagtacccgattcaggtagtaaagtgagtcattcacctgctctatcaagcgacgtgcgctctaccaatgggactgccgagtgtaaaactgttaagcgcccagctgaagacacagacagggagacagtggctggcattcctaacaaggttggggtgcgcattgtgaccatcagtgatccaaacaacgccgggtgctccgcgacaatggttgctgtccccgcgggggccgatccttccaccgtggccaaggtcgctattgaaagtgcagtccagcaaaagcagcagcatccacctacctacgtccagaatgttgtgccccaaaatactccgatgccaccatcacctgctgtacaagtgcagggacagccaaacagcagccagccaagcccttttagcggctcgagccaacccggggatcctatgagaaaacccggccaaaatttcatgtgtctctggcagagctgcaagaaatggtttcagaccccatcgcaggtgttctaccatgcagccacggagcacggtggaaaggacgtgtacccaggtcaatgcctgtgggaaggctgtgaacctttccaacgacagcggttttcatttattacacaccttcaggacaagcattgttcaaaagacgcacttctagcaggtctgaaacaagacgagcctgggcaggctggaagccagaaaagctctacaaaacaaccgactgtgggcgggacaagttcgacgccgagggcacagaaagccatcgtgaatcacccgtccgcagccctcatggccctgcgccggggcagccgaaatctggtattccgggattttacagacgaaaaggagggaccaatcaccaagcatattagactgactgctgctctgatcttgaagaatattggaaagtactcagaatgcggaaggaggctgctcaaacggcatgagaacaatctgagcgtgctcgcgatttctaacatggaggcaagctccaccctggccaagtgcctctatgagcttaattttacggttcagagtaaagagcaggaaaaagactctgagatgctgcaatag

SEQ ID NO: 18728 - DNA, 2859 bp, Artificial Sequence
  Description of Artificial Sequence: Synthetic coding sequence
atgatgatgcggtaccaccaggccatccagagccacagcttcctgctggtgcagttccacctgcctacaataacaagcaataccgtttgtcggatcatctgcgtgaaagtgatgggatgtccatggacactgatccggcaaatgatcattattaattggtgttttcattgctacttggattcccagatgaaatggaccctcctgctaacatacgccctgagttatcagatgaaagctagcacctcatgcaatctaaagaaaatcttgaagagcagcccggtgccagctactaacaaccaagttccaacagccatgtcaagttcgagtactccccagtcccagggacctcccccgaccgtgtcgcagatgctgtcagtgaagcgacagcagcagcagcagcacagtccggccccccctccacaacaagttcaggtgcaggtgcagcagccacaacaggtgcagatgcaggtgcagcctcagcagtctaatgctggagtaggccaacccgcttcaggagagtcctccctgataaagcagctgctgctcccaaagcgcggcccatcaactcccggtgggaagctgattctgcccgcccctcaaatccccccccccaacaacgcacgcgctccatcccctcaggtggtctaccaggtcgcctccaaccaggccgccggcttcggcgttcagggccagactcctgctcaacagcttctggtcggccagcagaatgtacagctcgtgccttctgccatgccgccctccggaggggtccagactgtcccaattagcaatctgcagattcttcctggccctctgatctctaacagtcccgcaaccattttccagggaacaagtggtaaccaggtgaccatcacggttgtcccaaacacctccttcgctccagccacggtttcgcagggcaatgccactcagctaatcgccccagcaggaatcaccatgagcgggacacagaccggagtcggactgccagtccaaacactgcccgccacccaggcctcccctgctggtcagtcgtcctgcactaccgcaacgcccccattcaaaggtgataagatcatatgccaaaaggaggaagaagcaaaggaggctacaggtcttcatgttcacgagaggaagattgaggtcatggagaacccaagttgtcgacgcggtgcaacaaacacgtctaatggcgacactaaagagaacgagatgcatgtggggtctcttctgaacgggagaaagtacagcgactcttccttacctccttccaatagcggaaagattcagtctgaaaccaaccaatgcagcctgatcagcaacggcccttcacttgagctaggcgaaaatggggcgagtggtaagcagaactctgaacagatcgacatgcaagatattaagtcggatctgcgcaagcctctcgtgaacggcatttgcgatttcgacaagggagatgggtcccacctgagcaagaatatcccgaaccataagacatctaaccatgtggggaatggagagatatccccaatggagccccaaggcaccctggatatcacccagcaagacaccgccaagggtgatcagctggagcgaatttccaatggcccagtcctgaccctcggtggcagtagcgtgtcctccattcaggaagcttcgaacgcagctacacaacagtttagcggtacagacctcctgaacgggcctctggcatccagtcttaatagcgatgtgccacagcaaagaccttccgtggttgtgagtccacactccacgacatccgtaattcaagggcaccagatcatcgctgtgccggacagcggaagcaaggtttctcacagtccagctctgagctccgatgtccggtcgaccaacgggacggccgagtgtaaaactgtcaaacgtccagctgaagatacagacagagaaactgttgccggcattcctaataaagttggtgttcgtattgtgaccatttcagatcctaataacgctgggtgtagcgccactatggtcgccgtccctgcaggcgccgaccccagtaccgtggccaaagtagcaatcgaaagcgctgtgcaacagaagcagcagcatccacctacatacgtgcaaaatgtggtgccacagaacaccccgatgcccccttcaccagctgtgcaagttcaaggccagcccaattcctcccagccttcaccattttcaggcagttcacagcctggtgaccctatgcggaagccaggacaaaactttatgtgtctttggcagtcatgtaagaaatggtttcagactccatctcaagtgttctaccacgcggccacagaacatggggggaaagacgtataccccgggcaatgtttatgggaagggtgcgaaccattccaaagacagcgttttagcttcatcacgcatttacaggacaaacactgctccaaggacgccttgctggcgggcctgaagcaggacgaacctggacaggcaggatcccagaagtcgtcaactaaacaacccaccgtgggcggcacaagttcaactcctcgtgcccaaaaggcaatcgttaatcacccttctgccgctctgatggctctaagaagggggtctcgaaacctggtgtttagagattttaccgacgagaaagaaggccctatcaccaagcatattagactcacagcagcactgatattaaagaatattggaaaatactccgagtgcggtaggagactgctgaagcggcatgaaaataacctttccgtgctagccatcagtaatatggaggcaagctccacactagcaaaatgcctgtacgaacttaatttcaccgtgcagagcaaagagcaagagaaagacagtgagatgctgcagtag

SEQ ID NO: 18729 - DNA, 4338 bp, Artificial Sequence
  Description of Artificial Sequence: Synthetic coding sequence
atgcggggcatggagatcctgggcaacctgtgcaaggccgaggacaacggagtgctaatctgcgaatacgtggaccaggactcatatcgcgagattatttgccacctgacccttcctgatgttttactggttatttcaacgctcgaggtcctatacatgctgactgagatgggtgatgtggcatgtaccaagatagccaaagtcgaaaaatcgatcgccgccgtaaagctgatcgagcatcctagctcttcccaccagatgctttccgagattcggccgcaggccatcgaacaagtgcagactcagacccatgtggcctccgcccctgcctctcgggcagttgtggcacaacatgtggctcctcctcctggaattgtagagatagactcagaaaagtttgcttgtcaatggttaaatgcacactttgaggtgaacccagactgttcggtttctagagctgagatgtactctgaatatctgtcaacatgttccaagttagcacgtggcggcatactgactagtaccggtttttacaaatgtttgaggaccgtgttccccaatcacactgtgaagcgggtagaagactcttctagtaatggccaggcccatattcacgtggttggggtgaagcgaagagcaatccccttacctatccaaatgtactatcaacaacagcccgtgagtacctccgtggtgcgggtggactctgtccccgatgtctcgcctgcacctagccctgcaggaattccccacggcagtcagacaattgggaatcatttccagcgaacccccgtggctaaccaatccagtaaccttaccgcaacccaaatgagtttcccggtacagggagtgcacacagtagcccagaccgtcagccgcataccccagaatcccagtcctcacacgcatcagcagcagaacgcacctgttactgtcatacaaagcaaggcaccaattccctgcgaggtggtaaaggccaccgtgatccagaattccatccctcagacaggagtccccgtgtcaatcgctgtcgggggcggtccaccacaaagctccgtggtgcagaatcatagtactggtccacagcccgtcaccgtagtgaattctcagacgctgttgcaccacccctctgtgatccctcagcaaagccctctccacaccgtcgtccccggccagatcccgagcgggacaccagttacagtcattcagcaagcggtgccccagtctcacatgttcggacgggtccaaaacatccctgcctgcacctcaacagtgagtcaaggacagcagctaataacaacctctcctcagccagtgcagacctctagtcagcaaaccagcgcaggcagccagtcgcaggacactgtgatcatagccccaccacagtacgttactacaagtgcttccaatatcgttagtgctaccagcgtacagaatttccaggtggcaaccggccagatggtgacaatagccggggtgccatccccgcaggcctctcgtgtcgggtttcagaacatcgccccaaagccactgccgtctcaacaggtgtcaagcacggtggtccagcagccaatacagcagccgcagcagccgactcagcagtcagtggtgatcgtcagccagccagcacagcaggggcaaacgtatgccccagcaatccaccagattgtcctggcgaaccccgccgcactaccagcaggtcaaacggtgcagctaacaggccagcctaatataaccccctcaagctcccctagccccgtgcctgcaacgaacaatcaggtgcccaccgctatgtctagtagctctacgccacagtcacaagggccaccacccactgtctctcagatgctgtctgtcaagcgccagcaacagcaacagcacagtccagccccaccccctcagcaggtgcaggtgcaggttcagcaaccacaacaagttcagatgcaggtccagcctcagcagtcgaatgccggagttggccagcccgctagcggtgagtcctcactaattaagcaactgttgctccccaagcggggaccttccactcctggcggcaagttaatcttacctgctccccaaattccccctcccaataacgcacgggctcccagtccacaggttgtataccaagtggcaagtaaccaggccgcggggtttggcgtacaaggccagactcctgcccagcagctcctggtgggtcaacagaacgttcagctggttcccagcgcaatgcctcctagtggtggcgtgcaaacagtgcctatcagcaatctgcagatcctccccgggccactcatcagcaactcccccgctacaattttccaagggacaagtggcaatcaggtgaccatcaccgttgtcccgaatacgtcctttgcacctgctaccgttagtcagggaaacgccacccagctaatcgcacccgccggcatcaccatgagcgggacccaaacgggcgtcggactgccagtccagacactccccgcgacccaggccagccccgccgggcagagtagttgcaccacagctacccctcctttcaagggagataaaatcatttgccagaaagaagaagaagccaaagaggctacaggcctccacgtgcacgaaaggaagatcgaggtgatggaaaacccctcatgcagaagaggcgctactaatacctcgaacggagatacaaaagagaacgagatgcatgtgggaagcctcttaaacgggcgcaagtatagcgactctagtctcccaccatctaactcaggcaagatccagtctgaaaccaaccagtgctccctgatttccaatggtccctctctagaacttggagagaacggcgcatcagggaaacagaactccgagcaaatcgacatgcaagacatcaagtccgatttgcggaaaccattggtcaatggcatctgcgacttcgataagggcgatggaagccatctgtccaagaacattccaaaccataaaacctcaaatcatgtgggtaatggcgagatcagtccaatggaaccccagggcaccttagacatcacacagcaggacactgctaagggtgatcaactggagcgtataagcaatggacccgttctgaccctgggtggatccagcgtgtcttccatccaggaggcctcaaatgctgctacacagcagttctctggcacagacctactgaacggcccactcgcatccagccttaatagcgacgtgccgcagcagcggccatccgttgtggttagcccacattctaccaccagtgtgatccaaggacatcagattattgcagtgccagactccgggtccaaggtcagtcactctccagcccttagcagcgatgtaaggtcgactaatggaaccgctgagtgtaagactgtcaaaaggccagctgaagatacagatagggagaccgtagccggcatccccaataaggtcggagtgcgcatcgtcaccatctctgaccctaacaacgccggctgcagcgcaactatggtcgctgtacccgccggcgctgatcctagtaccgtggctaaggtggccatagaatcagctgtgcaacagaagcagcagcacccccctacatatgtccagaatgtggttccacagaacacccccatgccacctagtcccgccgtacaggtgcaagggcagcctaattccagtcagccatcccccttcagcggatccagtcagcctggcgaccccatgcgtaagcccggccaaaatttcatgtgcctgtggcagtcttgtaaaaagtggtttcagacaccttctcaagtcttctaccacgctgctaccgagcacggcgggaaggatgtgtacccgggccaatgcctctgggaaggttgcgagccttttcagcgccaacgattcagtttcatcacgcatctgcaggataagcactgcagtaaagacgctctgcttgccggtctgaagcaggatgagccaggccaggccggaagtcagaagtcttccactaaacagcccaccgtggggggcacatcgagcacccctcgggctcagaaagccattgtaaatcatccctcggcggccctcatggcactccggagggggtcgaggaatcttgtctttagagatttcaccgatgagaaggaaggcccaattaccaaacacatccggttgaccgctgccttgattcttaagaacatcggtaaatatagcgagtgcggaagaaggcttctgaagcgccacgagaacaaccttagtgtgttagcaatcagtaatatggaggcaagtagtacactagctaaatgcctctacgagttgaattttacagttcagagtaaggagcaggagaaagactcggaaatgctgcagtag

SEQ ID NO: 18730 - DNA, 2859 bp, Artificial Sequence
  Description of Artificial Sequence: Synthetic coding sequence
atgatgatgcggtaccaccaggccatccagagccacagcttcctgctggttcaatttcacctgcccaccataacctctaacaccgtgtgccgcataatctgcgttaaagtaatgggatgtccctggaccctaatacgacagatgatcattattaactggtgcttccattgttatctagactctcaaatgaagtggacactactcctgacctatgcactgtcctatcagatgaaggcctctacctcttgtaacctgaagaagatactaaaaagtagccccgttccagcgactaataatcaagtgccgactgctatgtcttccagcagcaccccgcagtcccaggggccccctccaacagtttcacaaatgttgtcagtgaaaagacaacagcaacaacaacattctccagccccacctcctcaacaggtccaggtccaggtccagcagccacaacaggtgcagatgcaggtgcagcctcagcagagtaacgctggggttggccagcctgcctccggtgaaagctcgctgataaaacagttactcctaccaaaacggggaccgtctacccctggcggaaaactgattctgcccgctccacagattccccctcccaacaacgcacgcgcccctagccctcaggtcgtatatcaggtggcatcaaatcaggctgccggtttcggcgtccagggccagactcccgcccaacagttgctcgttgggcagcagaatgtgcagctcgtcccaagtgccatgcccccttccggcggcgttcagacagtccctatctctaacctgcagatccttcccggaccgctcatcagcaactcccccgccacaatttttcaggggacaagcggtaaccaggttaccattacagtagttcctaacacatcatttgcccccgcgacagtatcccaaggtaatgcaactcagctgattgctcctgccggaattactatgtccggcacccaaaccggtgtagggctaccggtgcagaccttgccggcgacacaagcttcacccgctggccagtccagctgtacgacagcaacccccccctttaagggggacaagattatctgtcagaaggaagaggaggcaaaggaagcgacgggactgcacgtgcacgagagaaagattgaggtaatggagaatccttcttgccgccgcggagctacaaacacctccaacggggacaccaaagagaatgagatgcacgttggtagccttctcaatggtcggaagtatagcgatagtagcttgcccccgagtaactccggaaagatccagagcgagacgaatcagtgctccctcataagcaacggcccctccctagaactgggcgaaaacggcgccagcgggaaacagaatagcgagcagatcgatatgcaggacataaagtctgatttacggaaaccccttgtgaatggcatctgtgattttgacaagggggatggcagccatctcagcaagaatatcccaaaccacaagaccagtaatcacgtaggcaatggggagatttcccccatggagccccagggcacccttgatatcacgcagcaggacactgctaaaggagaccaactggaacggatctctaatggaccagttctaaccttaggcggttcctctgtgtcatctatccaggaggcgagcaacgccgccactcagcagttctccgggacagatctccttaacggccctttggcttcctccctgaactccgacgtcccccagcagagaccctctgttgtggtttcccctcacagcactaccagcgtgatacagggccaccagatcatcgcggtccctgacagcgggtctaaggtgagccacagcccggctctatccagtgatgtgcggagcactaatggaaccgccgagtgcaaaactgttaaacggcctgctgaagatacagaccgtgagaccgtggccggcatcccaaacaaggtgggggtgcggatcgtaacaatctctgatcccaacaatgcaggatgctcagctaccatggttgcagtgccagccggggcagaccctagcactgtcgccaaggttgcaattgagtcggctgtccagcagaagcagcagcatccccctacttacgtccagaatgtggtaccgcagaacacgccaatgcctccttcgcctgcggtccaggtacaggggcagccgaacagttcacagccgtcacctttttctggttcatcccagcccggggatcctatgaggaaaccggggcagaactttatgtgcctatggcagtcttgtaagaagtggttccagacccctagccaggtgttttaccacgcagcaacagagcacggcggaaaagatgtctatccaggtcagtgcctctgggaagggtgtgagcccttccagcgacagcggttctcttttatcacacatctgcaggataaacattgttcaaaggacgcacttctggcaggtctgaagcaggatgaaccaggtcaggccggttctcagaagtcctctacgaagcagccaactgtggggggcacctcgtcaacacctcgcgcccagaaagccatcgtgaaccatccgtcagcagccctaatggcactcaggcgggggagtcgtaaccttgtgttccgtgacttcaccgacgaaaaggagggcccgatcaccaaacatataagactcacggctgccctgatcctgaagaatattggcaagtacagtgagtgcgggcgccgcttactcaaacgacatgaaaataatttgtcagtactggcaatctccaacatggaagcgagcagcaccctggcaaaatgcctgtatgaactcaacttcacagtgcaatcaaaggagcaagagaaagactccgagatgctccagtag

SEQ ID NO: 18731 - DNA, 1044 bp, Artificial Sequence
  Description of Artificial Sequence: Synthetic coding sequence
atgaagatggaggagatgagcctgagcggcctggacaacagcaagctggaagcaatcgctcaggaaatctacgccgatttggttgaggacagctgtctgggcttctgctttgaagttcaccgggcggttaagtgtgggtacttcttcttagacgacaccgaccctgattcaatgaaagactttgagatcgtcgatcaacccggactggacatattcgggcaggtttttaaccagtggaaatcaaaagaatgtgtgtgcccgaactgtagccggtcaattgcggcaagccgcttcgccccacacttagagaagtgcctgggaatgggtcgaaatagttcgcggatcgccaaccgccgcatcgcaaactccaacaacatgaacaaaagtgagagcgaccaggaggacaacgatgatatcaatgacaatgactggtcttatgggagtgaaaagaaggctaaaaagcgaaaatccgacaaaaaccccaactctccacgtaggtccaagagcctaaaacataagaatggagagctttctaactcggacccctttaagtacaataatagcacaggtatttcatacgagaccctggggcctgaggaactgagatccctattaactacccagtgtggcgtcatttccgagcacactaaaaagatgtgcacccgcagtctcaggtgtcctcagcacactgacgaacagcgaagaacggtaagaatttactttctgggaccctcggccgtactccccgaagtggagagctccctggataacgactcatttgacatgacagatagccaagccctgatcagcagacttcagtgggatggtagcagtgatttaagtccgtccgattcaggttccagcaaaaccagtgagaatcagggctggggcctgggcaccaacagtagtgagtcccggaagacaaaaaaaaagaaatcacatctgtctttagtgggaactgcgtcaggtctgggctccaataaaaagaagaagcccaaaccacctgccccaccaaccccctccatatatgatgatatcaactag

SEQ ID NO: 18732 - DNA, 1065 bp, Artificial Sequence
  Description of Artificial Sequence: Synthetic coding sequence
atgaagatggaggagatgagcctgagcggcctggacaacagcaagctggaagcaattgcacaggaaatctacgccgacctggttgaggactcatgtctgggattctgcttcgaggtacacagagctgttaaatgtggatatttttttttagatgacacggatcctgattctatgaaagattttgagatagtggaccagcctgggcttgatatcttcgggcaggtgtttaaccagtggaaatccaaggagtgcgtgtgtcccaactgcagcagatctattgcggccagccgctttgccccacacttggaaaaatgccttgggatgggcaggaacagtagcagaattgctaacaggcgaattgcaaactcaaataacatgaataagtcagagagcgatcaagaggacaatgacgatatcaatgacaacgattggagttatgggagtgaaaagaaggcaaagaaaaggaaatccgacaaactgtggtatctgccattccagaaccctaattccccacgaagatccaagtcattaaagcataagaatggggagctgagcaactctgacccgttcaagtacaataacagcactggaatttcatatgagaccctgggccctgaggaactgcggtcattactgaccacgcagtgcggagtgatttctgaacatactaagaaaatgtgtactcgatctctgcgctgcccccaacatacagacgagcagaggcggacagtcaggatctacttcctcggaccctctgctgtgcttcccgaggtggagtcttctctagataatgactcattcgacatgaccgattcccaagcactgatctctcgcttacaatgggatggaagcagcgacctctcaccaagtgacagcggtagttctaagacatcagagaatcaggggtggggtctggggaccaactcatccgaatcaaggaagaccaagaagaagaagagccacctgtcactggttggtacagcttccggccttggttctaacaaaaaaaagaagccgaagccccctgcacctcctactccaagtatatacgacgatattaattag

SEQ ID NO: 18733 - DNA, 390 bp, Artificial Sequence
  Description of Artificial Sequence: Synthetic coding sequence
atgtgcacccggagcctgcggtgcccccagcacaccgacgagcagcgcagaacagtgcgaatttatttcttgggcccaagtgctgtcctgccggaggtggaaagcagcctggacaatgattcattcgacatgaccgactcccaggcattaatcagccggctccaatgggatggctcttctgacctgtctccatctgattccggttcctcaaaaacctccgagaaccagggctgggggctaggcaccaattctagcgagtcgcgcaaaaccaagaagaaaaaaagccacctatctttggtgggaaccgctagtggcctcggtagcaacaaaaaaaaaaagccgaaacctccagcacctcctactccttctatctatgacgatataaattag

SEQ ID NO: 18734 - DNA, 5031 bp, Artificial Sequence
  Description of Artificial Sequence: Synthetic coding sequence
atgggcctgctgggcatcctgtgcttcctgatcttcctgggcaagacatggggacaggaacaaacatatgtgatcagcgcaccaaagatcttccgggtaggcgctagtgagaatattgttatacaggtatatggctacactgaggcgttcgacgcaactataagtataaaaagttatcccgacaaaaagttctcctactcatccggacacgtgcatttgagtagcgaaaacaagttccagaattcagcaattctgacaatccagcccaagcaactgcccggaggacagaatccagtgagttacgtctacctggaagtcgttagcaagcatttctctaagtcaaagaggatgccgatcacctacgacaatggcttcttgttcatccacacagacaagcccgtgtatacgcctgatcagagcgttaaagtgcgggtttattccctcaacgatgacttgaagcccgccaagagggaaaccgtgctgacattcatcgaccccgaaggtagcgaggtggatatggtggaagaaatcgatcatatcggcatcatctcattccccgatttcaagattcccagcaatcctcgatatgggatgtggaccatcaaggctaaatacaaggaggactttagcacgactggaacagcttatttcgaggtgaaagagtatgtgctgccccatttttccgtgagcattgaacccgagtacaacttcatcgggtataagaactttaagaattttgaaattacgattaaggcaagatatttttacaacaaagtagttactgaagctgacgtgtatatcaccttcgggataagggaggacctaaaggatgaccagaaagaaatgatgcagacagcaatgcaaaacactatgctgataaatgggatcgcccaggtgacctttgatagcgagaccgctgtcaaggagctcagctattactccctggaggacttgaataacaagtacctttatatcgctgtcactgtaatcgaaagcaccggcgggttctctgaggaagcggagattcccgggataaaatacgttctgtccccttataagctgaatcttgtcgcgaccccactattcctgaagcccgggatcccgtatccaattaaggtgcaggtcaaagactcacttgaccagttagtcggcggagtgccagtgacccttaatgcccagactatagatgtaaaccaggaaacgtcagacctagatcctagcaagagcgtgaccagagtcgacgacggtgtagcttccttcgttctcaacttaccttcgggggttacagtacttgaattcaacgtgaaaaccgacgctcccgatctacccgaggagaaccaagcccgggaagggtatagggctatagcctattcaagcttgtctcagagctacttgtacatcgactggaccgacaaccacaaagctctcctggtgggcgagcacctcaacataattgtgactcctaaaagtccttacatcgacaagatcacccactataattacctgatcctgtccaagggtaaaatcattcactttggcaccagggagaaattcagtgatgcctcataccagagtattaacatacctgtaactcagaatatggtgcctagttctcgcctgcttgtgtactatattgtcaccggcgagcaaactgctgagctggtgagtgactcagtttggctgaatatagaagagaagtgcggcaatcagttacaggtccacctgagcccggatgccgacgcgtatagtcccggccaaaccgtcagtctcaatatggccaccggtatggattcctgggtggccctggccgccgtggactcggctgtgtatggtgtgcagcgaggtgctaaaaagcctctcgagagagtcttccagttcctagagaaatccgatctcggctgtggagcggggggaggcctaaacaatgcgaacgtgttccacctcgccggcctcacatttcttactaatgccaatgcggatgatagtcaggaaaacgacgaaccttgtaaggagatactgcgcccccggagaacattgcagaaaaaaatcgaggagattgccgccaaatacaagcattctgtggtgaagaagtgctgctatgacggagcttgcgtcaacaacgacgagacttgcgagcagcgcgcagcgagaatctccttgggtcctcgctgcatcaaggccttcacagagtgttgtgtagtggctagccagctccgtgctaacatctcacacaaagacatgcagctgggcaggttacatatgaagactttactgcctgtgtctaaaccagagatacgtagttatttccctgaaagctggctgtgggaggtccacctcgttcctaggcgcaagcagcttcaattcgccctgccggattctctgaccacatgggagatccaaggggtgggaatttccaataccggtatctgtgtggccgacactgtcaaggccaaagtgttcaaagacgtgtttctggaaatgaatattccatactccgtagtgaggggtgaacagatacaactgaaggggactgtgtacaactaccgtacttcaggcatgcagttctgcgttaagatgtcggcggtggagggaatttgtacctccgagagtcccgtgatcgaccaccaaggcactaaatcttccaaatgcgtccgccaaaaagttgagggatccagcagccatcttgtcactttcaccgtgttgcctctggagattggtctgcacaacattaatttctccctggagacctggtttggtaaagaaatactcgtgaaaaccttgagggtcgttcccgaaggagtgaaacgtgagagttactccggagtcacgctagacccccgaggtatctacggcaccatttctcgacggaaagaattcccctaccgcatcccgctggacctggttccgaaaacggagataaaaaggatcctttccgtgaagggactgcttgtgggcgagatactgagtgctgtcttatcccaggaaggcataaacatcctgacccatctcccaaagggatccgccgaggctgagctcatgtcggtggtgcccgtgttctacgtgttccattacctcgaaactggtaatcactggaatatcttccactccgatccactgattgagaaacagaaattgaagaaaaagttaaaggaagggatgctctccattatgagctatcgcaacgctgactatagctactctgtatggaagggcgggagtgcctctacatggttgacagcttttgcccttagggtgctgggccaggtcaacaagtatgttgaacagaaccaaaattccatttgtaactctttgctgtggctcgtggagaactatcaactagacaacggcagcttcaaagagaacagccagtaccaacccatcaagctgcagggaacgcttccagtcgaagcccgggagaatagcctatacttgactgcgttcaccgttatcggaattaggaaagcctttgacatttgtcctctcgtgaagattgacacagccctcattaaggccgacaacttcctgctggaaaatacactgccagcccagtctactttcactttggctatctctgcctatgcgctgtccctgggcgataagactcatccccaattccggtccattgtgagcgccctgaagagggaagcactggtcaagggaaatcccccaatttatcggttctggaaggacaatctacaacacaaagactcctccgtgcccaataccggtactgctcggatggttgaaacaaccgcttatgctttgctgacgagtctgaacctgaaagatatcaattacgtgaaccctgttataaaatggctctcagaggaacagcgttacggcgggggtttctactctactcaggataccatcaatgccatcgagggcttgacggaatacagcctgctcgtcaaacagctgaggcttagtatggatatcgacgtgtcctataagcacaaaggcgcgctgcataattacaaaatgaccgacaaaaactttctgggccgtcctgtggaggtgcttttgaatgacgacctgatagtttccacggggtttggatccggactggctaccgtgcatgtgactactgtcgttcataagacctctacaagtgaagaggtttgtagtttctacctgaagattgacacccaggacattgaagcatctcactaccgaggctatggcaattccgattacaagaggattgttgcatgtgccagctacaaaccctcccgcgaggagagttcgagcgggtcgagccatgccgtgatggatatctcactgcctacgggaatctccgccaacgaagaggacctaaaggcacttgtggagggggtcgatcagctattcacagattatcaaattaaagacgggcacgtaatcctccaactaaactccatcccatcatctgactttctgtgcgtcaggtttaggattttcgaactgtttgaagttggattcctgagtccagccactttcacagtgtatgaatatcacaggcctgataagcagtgtacaatgttctacagtacctctaacataaagatacaaaaggtgtgtgagggggctgcctgcaaatgcgtcgaggcagactgtggacaaatgcaggaagagctggacttgactatctcagccgaaacccgaaaacagaccgcctgcaaacccgaaatcgcgtacgcatacaaggtgagtatcacaagtataacggtggaaaacgttttcgtcaagtacaaggcaaccctgcttgacatttacaagactggggaggcagtggcagagaaggactccgaaatcacattcatcaagaaggttacatgcactaacgcagaattggtcaaaggccgacagtatctgataatggggaaggaggccctccagatcaagtacaacttctcttttaggtatatatatcctctggattcgttgacttggatagaatactggccaagagatacaacatgctcttcatgtcaagcatttcttgctaacctggatgaatttgcggaggatatattccttaacggatgttag

SEQ ID NO: 18735 - DNA, 4320 bp, Artificial Sequence
  Description of Artificial Sequence: Synthetic coding sequence
atggccagcagcgagaccgagatccggtgggccgagcccggcctgggaaaaggccctcagaggagaaggtgggcctgggccgaagataaacgggacgtcgacaggagctcctcccagagctgggaagaagagcgactgtttcccaatgctacctcacctgagctgctcgaggacttcaggctcgcacaacagcatctaccacccttagaatgggatcctcatccccagcccgatggacaccaggattccgaatccggcgagacaagtggtgaagaagccgaagcagaagacgtggacagccctgcttcgtcacacgagcccctcgcctggttgccacagcagggtagacagctcgacatgactgaggaagagccggacgggactctcggtagtcttgaggttgaggaggctggtgagagcagtagccgactgggttatgaggctgggctgtctctcgaagggcatggcaatacctcccccatggccctcggtcacggccaggcacgggggtgggtagccagtggggagcaggcaagtggagacaaactgagtgagcattctgaggtgaacccaagtgtggaattatcacctgcacggagttggtccagcggaacagtgagtttggatcatccgtctgatagtctggactcaacctgggaaggcgagacagatggtccccagccaactgctcttgcggagactcttcctgaggggccatctcatcacctgctgtcacccgacgggcgtacaggcggctcggtcgcacgcgccacacccatggaattccaggactcttccgccccaccagcccagtcacctcagcacgccacagaccgctggcgaagggagaccacacgctttttctgtccccaaccgaaagagcacatctggaagcagacaaaaactagccctaaacccttgcctagcagattcattggctctatctcccccctcaatccacagcctcggcctacaaggcagggacgccctttgccaaggcaaggcgccactctggctggccggtcttcaagcaacgcacctaaatacggacgcgggcagcttaactatcccttgccggatttttcaaaagtgggccccagggtgagatttccaaaagatgaatcgtatagaccaccaaaaagtcgaagccataaccggaagccacaagcccctgctaggcccctcatatttaaatcccctgctgagatcgtgcaagaagtgcttctcagttcgggagaggcggctctggccaaagacaccccaccggcacatccgattaccagagttccccaggaattccaaacccctgagcaggccactgaactcgtgcatcagctgcaggaggactatcaccgcctccttacaaaatacgcagaagcagaaaacaccattgaccagctgcgactcggagctaaggttaatctcttcagcgatccacctcagccaaatcacagcatccacaccggcatggtgcctcaggggactaaagtgctctctttcacgatcccacaaccccggtcagcagaatggtggcctggaccagccgaagatccccaggcaagcgctgcttccggatggcctagtgcccggggggacctgtcgccaagttctctgacttccatgcccacactggggtggctcccagagaaccgcgacatcagtgaggaccaaagctctgccgaacagacacaagcacttgccagccaggcctcccagttcctcgcaaaagtggaatcttttgaaaggcttatccaggcaggacgccttatgccacaagaccaggtcaaagggtttcagcggctgaaggctgctcacgccgcccttgaggaagaatatctgaaggcctgtcgcgagcaacatcccgctcagccactcgccggatccaagggaacacccggacgttttgacccacggagggaactagaggctgagatctaccggctcgggtcctgcctggaggagttgaaggagcatatcgatcaaactcaacaggagcccgaaccacctggcagtgacagtgccctcgatagcacccctgccctcccttgtctgcatcagcccacccacttacctgcaccctctgggcaggctccgatgccagcaatcaaaacctcatgcccggaacctgccaccacaacggcggcagccagcactgggccctgccctttgcacgtaaatgtagaggtcagcagcggaaactcagaggtcgaagaccgacctcaggaccccctggccagattgcggcacaaggagctccagatggagcaggtgtaccacgggctgatggagagatacctctcggtgaaatccctacctgaagccatgagaatggaggaggaagaggaaggggaggaggaggaggaggaagagggggggggcgacagcttggaggtcgacggcgtcgcagcaacgcctggaaaagcagaagcaacccgtgtgcttccccgacagtgtcccgtccaagcagaaaagtctcacggtgctcccttggaggaggctacagaaaaaatggtgagcatgaaaccgccggggtttcaagcaagcttagccagagacggtcacatgagcggcttgggtaaggccgaagccgcccctccgggtccaggggtgccccctcacccccctggcactaaaagcgctgcctcccaccaatcctcaatgacatccttggagggctcaggcatctccgaacgacttccccaaaaaccgctccacagaggggggggaccccaccttgaggagacctggatggcttcacctgagactgatagcggattcgttggaagcgagaccagcagagtgtcgccgctcactcagactcccgagcaccgtctttcccatatctccacagcagggaccctggcacagcccttcgcggcctcggtgcctagggatggagccagttatcccaaggccagaggcagcctaattccaagaagagcgactgaaccatccactccgcgctcgcaggcacaaagatatctctcctcacccagtggcccattaagacagagggcaccgaacttctccttggagcgcacccttgcagccgagatggcggtgccgggatccgaattcgaaggtcataagcgaattagcgagcagccacttcctaacaaaacaattagccctccacctgctcctgccccagccgccgcgccccttccttgcggccccactgaaacgatcccatcattcctccttacaagagccggtcgcgaccaagccatctgtgagttgcaggaagaggtctctagactacgccttcgcttggaagatagtctgcaccaacctctccagggatcacctacccggcccgctagtgcattcgatcgacctgcccggaccagaggtaggcctgcagattctcctgccacgtgggggtctcactatgggagcaagtcgacagaacgcctgcccggggagccgcgtggcgaggagcagattgtgcctcctggaagacagcgggctcgctcatcatctgtccctcgcgaggtcctgcgattgtccctgtccagcgagtctgagctgcctagccttcctctgttcagcgaaaagtctaagaccacaaaagacagccctcaggccgctagagacggcaagcggggagtcgggtcagcaggctggccagaccgagttacgtttagggggcagtacaccggacatgagtaccacgtactcagccccaaggcggtgcccaagggaaacggaactgtgtcttgtccgcattgccgtcccatccgtactcaggatgctgggggcgctgtaaccggagacccactgggaccgccaccagccgataccctgcaatgtccactctgcggtcaggtaggaagccctcccgaggccgacggtcccggctctgctactagtggggcagaaaaagccacaacacgaagaaaagcaagctctacccctagcccaaagcaaaggagtaaacaggccggctcctccccaaggccaccacccgggctgtggtacctggctacagctccaccagctcctgcgccaccggccttcgcctacatctcttccgtacccattatgccctaccctcccgcagccgtctactacgcacccgcagggcccacgtccgcgcagcccgctgcaaaatggcctcccacagcctctcccccaccagcgagacgacataggcactctatccaattggacctaggagatttagaagaactaaataaagccctgtccagggccgttcaagcagctgagtctgtgcgtagcacgactaggcagatgagaagctccctgtccgccgacctccgccaggctcactctctccggggcagctgcctgttctag

SEQ ID NO: 18736 - DNA, 2496 bp, Artificial Sequence
  Description of Artificial Sequence: Synthetic coding sequence
atggccagcagcgagaccgagatccggtgggccgagcccggcctgggcaagggtccgcagcgtagaaggtgggcttgggccgaagataaacgtgacgttgaccgcagtagttctcagtcctgggaagaggagcgccttttccccaacgccacgagcccagagctcctcgaagactttcgactggctcagcagcatctccctcccctagagtgggacccacatccacagcccgacggacatcaggattccgaatctggtgaaacctctggggaggaggcggaagcggaggacgtggactccccagcctcctcacacgagcccctcgcctggctgccccagcagggtcggcagctcgacatgacagaagaagagcctgacggtacgctggggtcgctggaggtcgaggaggctggagaatccagcagcaggctagggtacgaagccggcttgtccctggaaggtcacggcaacacatcacccatggctctgggtcacggccaagcaagaggctgggtggccagtggggaacaggcctcaggtgataaactgtctgagcatagcgaggtcaatccaagcgttgaactctcacccgctcggtcctggagcagcggcacggttagtctggatcatccctcagactcactagactctacctgggagggcgaaacagatggtccccagcccaccgccctagccgaaacattacccgagggacccagccatcacctcttgtcccctgatgggagaaccggtggaagtgtggcgcgcgctaccccaatggagttccaggatagcagtgcccctcccgcccagtcacctcaacacgccactgaccgctggagacgcgagacaactagatttttctgccctcagcctaaagagcacatttggaaacagacaaagaccagtcccaaacctctcccatctcggtttattggaagtattagcccactgaatcctcagcctcgccccactaggcagggccgcccgctgccacggcaaggggcaactctcgctgggagaagctcttccaacgctcccaagtacggacgcggacagcttaactatccattgccggatttttctaaggtcggacccagagtgcggttccctaaggacgaatcttatcgccctccaaaaagccgaagccataatcgcaagccccaggcacctgccaggcctttgatcttcaagtccccagcagagatagtgcaggaagtcctcctatcatctggggaggccgcgctcgccaaagacacaccacctgcccaccccatcaccagggtcccacaggagttccagaccccggaacaggcgactgagttggtgcatcagctccaggaggactatcacaggctactgactaaatacgcggaggccgaaaacactattgatcagctgcgtctgggcgccaaggtgaacctgttctctgatcctccccagccaaaccactccattcacacgggaatggtaccccaaggaaccaaggtgctctccttcactataccccagcctcgttcggccgaatggtggcctggcccagccgaagatccgcaggccagtgccgcctccggttggccttccgcgaggggagatctgtcccccagctctctaactagtatgccaacacttggctggctaccggagaacagagacatcagcgaagaccagtcaagtgccgaacaaacacaggccctcgcttcccaggcttcacagtttctggctaaggtggaaagtttcgaaaggttgatacaggcagggcgcctgatgcctcaggaccaggtcaaaggcttccagcgacttaaagccgctcacgcagcactggaagaggagtatctcaaggcatgccgtgagcagcaccccgcccagccattagccgggtcaaagggcacccccgggagatttgatccccggagggaattagaagcggagatctaccgccttggctcttgcctagaggagctgaaggagcatattgatcagacccagcaagaacccgagccgcctggcagcgattcagctttagacagtactccagccctgccatgcctgcatcagcccacacatctgcccgctccaagcggccaggcaccaatgcctgccattaaaacctcgtgtcccgagcctgccaccactaccgcagcagcaagcacaggaccttgccccctccatgtaaatgtggaggtctccagtgggaactccgaggtggaggataggcctcaggaccctctggctcgactgagacacaaggagctccagatggagcaggtctaccatgggttgatggaaagataccttagtgtgaagagcctcccagaggccatgcggatggaagaggaggaagagggagaagaggaagaagaagaggaggggggcggtgattctctggaggttgacggcgtggcggccactccgggcaaagcagaggctaccagggtgttaccacgccaatgccctgtccaggccgagaagtcccatggcgccccactggaatag

SEQ ID NO: 18737 - DNA, 1218 bp, Artificial Sequence
  Description of Artificial Sequence: Synthetic coding sequence
ctgaacctgtgcctgagcatcttcctgacccccgcctgctaccaccattgccgtagacagcattggccacttcctatagctcggaagtgcggagctgtacccggcagtgaattcgaggggcacaaacgaatttccgagcagcctttgccaaataagacaatcagtcccccgcccgcccctgctcccgccgccgcaccgttgccttgtggacctaccgagacaatcccatccttcctgcttacacgagctggcagagaccaagccatctgcgagctccaggaagaggttagcaggttgagactccgcctggaggattcactgcaccagcccctgcagggatctcctacaaggccagcctctgcattcgataggcccgcaaggaccagaggacggccagccgattctcctgcgacttggggatcgcattatgggagcaagtcaaccgagcgcctgcccggtgaaccccgcggcgaggaacagattgtgcctcctggaagacagagggcgaggtcatccagtgtcccgagagaagtcttgcggctaagcctgagctcagaaagcgagctgccctctttacctttgtttagtgagaagtctaagacaactaaggattctccacaagctgcaagagacggcaagcgcggagtcggatctgccggctggccggatcgcgtgacctttagagggcaatataccgggcatgagtaccatgtccttctaagaaggtcccagaaggcaatggctcagtcaccagtgccaactgcgggacctttgggaccccgcatgcgtgtcgtcctatcacagggaactcactgggacagactaccactgatccctttttccgttccctgtgtggtgaaactggggctgccacagcgacaaatggtccaagcccaaccacccctcggtcaacggagacctcccagaggggagaaacatctgcagttgcctgcgccgtctcgaggcgcttcacgccgcggccggcgccatgcgcaccctccggattgtggaatatggcagcagagaccacaacaccagcccctccaacctctgccaacaagtcctcgcttcccctcctgtttgatccacctccctctgtgtactatgcggctacaggacctccctcaacctaatcagctgcccagcgggagaccacaacctcttccacatcagcccggggacactggaacacctagctcttccacgtgggccacttag

SEQ ID NO: 18738 - DNA, 4077 bp, Artificial Sequence
  Description of Artificial Sequence: Synthetic coding sequence
atgctgcggagcgagtggcccgtgttccccgaggccgaggccgaggatgtcgactctccagcttcttcacacgaaccattggcctggctgccccagcagggtcgtcagctggacatgactgaggaggagcctgatggtacgctcggctctctcgaagtggaggaggccggagagtctagctctcgacttggctacgaggccgggctgagcctggaagggcacggaaatacatcccccatggccctggggcacgggcaggctcgaggttgggtggcgtccggagaacaggcgagcggggataagttatcggaacatagcgaggtgaacccctctgtggagctgtcccctgcaagatcctggtcatctggcacagtttcgctagatcacccttctgatagcctggacagcacctgggaaggagagacagatggacctcagcccaccgctttggcagaaactctaccagagggaccttcccaccatctgttgagtcctgatggtcgaaccggggggagtgtcgctagggcaacccctatggagtttcaggattcttcggctccccccgcacagagcccgcagcatgccactgatcgctggagaagagagactactagatttttttgcccacagcctaaagagcatatctggaagcagaccaaaacatctcccaaacccctgccttcaaggtttattggctcaataagccctctgaacccacaaccccggccgacccgccaggggcgacccctgcccagacagggagccactctagcaggacggagctcgagtaacgctcctaaatatggcagaggccagctgaactacccactcccagatttctccaaagtcggtcccagggttcgcttccctaaagatgaatcataccggccacccaagagtcgatcccataaccgtaagccccaggcaccggcgagaccactcattttcaagtcacccgcagagattgtccaagaggtgctcctcagtagcggtgaagccgccctcgcaaaggatactccccctgcccacccaatcacaagggtgcctcaggagttccagacacccgagcaagcaactgaactggttcatcaactccaggaagactaccaccgcctactgaccaagtacgccgaagctgagaacactattgatcagctgcgactcggagcaaaggtcaatctcttctctgatccccctcagcctaaccacagcattcataccgggatggtgccacaaggcacaaaggtgctgagctttaccattccacagcctcgttccgctgagtggtggccaggacccgccgaagatccccaggcgagtgccgcctccggctggccctccgcacgaggtgatcttagcccttccagcttgacctccatgcccacactgggttggcttcctgaaaacagggacatcagcgaggaccagtccagtgccgagcaaacccaggccttagcctcacaggccagtcaattcctcgcgaaggttgagtccttcgagagattgattcaggccggtcggctgatgccacaggatcaggtcaaagggtttcagcgcctgaaggccgcacacgctgcactggaagaggaatatctgaaagcatgtagggaacagcatccggctcaacccctcgctggaagcaaaggaacccctggaaggtttgatcctaggagggaattagaagctgagatctaccggttgggaagttgcctggaagaactgaaggagcatattgatcagacccaacaggaaccggagccgccagggtcagatagcgcgttggatagcactcctgccttgccttgtctccatcagcccacccaccttccggcaccatcgggacaagccccgatgccagcaatcaaaacttcctgtccggagccagctaccacaacagccgccgctagcaccggaccatgcccactgcatgttaacgtggaagtttctagcggcaattccgaggttgaagatagacctcaggaccccctagcgagacttcgccataaggagcttcagatggagcaagtgtatcatgggttgatggagcggtacctttctgtcaaatcactgccagaagccatgaggatggaggaggaggaagaaggggaagaggaagaggaagaagagggcggaggcgattccctcgaggtggatggcgtggccgccacccctggcaaggctgaagccactagggtcctcccccgtcagtgtccagtccaggcggaaaagagccacggagctcctctggaagaggccaccgagaaaatggtctccatgaagcccccggggtttcaagcatcgctcgcccgggatggtcacatgtccggcctggggaaggctgaggccgcccccccgggaccaggcgttccaccgcatcccccgggaaccaagtccgccgcctcccaccagtcctccatgacctccctggaggggagcggtatctctgagagactgccacagaagccccttcacaggggaggcggcccgcacttagaagagacatggatggcctcacccgagacagacagcggtttcgtcgggtctgagacgtctcgggtgtctcccttaacccagacaccagagcaccgcttatcgcacatatccactgctggaacgctcgctcagccttttgctgcctccgtcccccgtgatggcgcttcatacccgaaagctcgcggttccttgattcctcgtcgggcgactgaaccaagcacacctcgatcacaggcccaacgctatctgagttctccctctggacctttgcggcagcgggccccaaattttagcttggagcggaccctggcagcagagatggccgtgcctggatccgagttcgaagggcacaaaaggatatcggaacagccactgcctaacaaaacaataagccctcctccagccccagccccagctgctgccccacttccttgtggaccaacggagacaattccctctttcttgttgacgagggctggtcgggatcaggcaatctgcgaactgcaggaagaagtgagtaggcttaggttgcgacttgaagactcattgcaccaacctctgcaggggtcccccacacgccccgccagtgcgttcgatcgaccggcacgaactaggggacgtccggcagacagtcccgccacatggggaagtcactacggtagcaagagtaccgagagactccccggcgagcccaggggcgaagaacagattgtcccccccggacgacagcgcgcacggtcatcctcagtcccgcgcgaagtcctgaggttatcattatcatccgagtctgagttaccctccttgcccttattcagtgagaaaagtaagaccactaaagactcaccccaagccgcccgagatggcaagaggggcgtgggaagcgctgggtggccagaccgggtcacatttcgcggccagtataccgggcacgagtaccacgtcctgagcccaaaagccgttcccaaaggaaacggtactgtttcttgtcctcattgcaggcccattcggactcaggatgcaggtggagccgtaacaggggatccattaggtccacctccggctgataccctgcagtgcccgctgtgcggacaggtgggatctccgcccgaggctgacggaccggggagcgccacaagcggagctgagaaagcgacaaccaggaggaaggcgtcatccaccccaagcccaaaacagcgcagcaagcaagccggatcatcccctcggccacctcccggcctctggtatttggcgacggcccctcccgcaccagccccgccggccttcgcctatatcagttcagtgccaatcatgccctaccctccggccgccgtgtattacgcaccagccggaccaacatccgcacagccagcagctaaatggccccccacagccagcccccctcctgcccgcaggcacagacactcaatccagcttgacctgggagatctcgaggaactgaataaagcactgagtagagctgtacaagcagccgaaagcgtgagatccaccactcgccaaatgaggtcctctttgtcagctgacctcagacaggcacatagtttaaggggctcatgcttattttag

SEQ ID NO: 18739 - DNA, 1155 bp, Artificial Sequence
  Description of Artificial Sequence: Synthetic coding sequence
atgagcgccggcggcggcacccggggctacagcccccggagccccggagctacatcccaggctatctgtgagctgcaggaggaggtgtcaagactcaggctgaggttggaggacagcctgcaccagccactccagggatcacccaccagacccgcaagcgcttttgacagacctgcgaggaccagaggacgcccagcagacagtcccgctacatggggcagtcactacggcagtaagtcaactgagagattacctggggaaccacgaggagaagagcaaattgttccacccggtcgacagcgtgccagatcaagctccgtcccaagggaggtgctgcgcctaagcctgagtagtgagtcagagctgccatccctccccctcttcagtgagaaatcaaagacaacaaaagattccccccaagctgcccgggatggcaagagaggtgtggggtcagctgggtggcccgaccgggtcaccttccgggggcagtatactggacacgaataccatgtattgagcccaaaagccgtccccaagggcaatggtacagtctcttgtccccactgcagacccattaggacccaagacgccgggggagccgtcaccggcgatcctctaggtcctccccccgctgacacactgcagtgccccctttgtgggcaggttggatccccaccagaagcagatggtcctgggagtgctacctctggggcggaaaaggctaccacccgacggaaggctagtagtactcccagtccgaagcaacgctctaaacaggccggatccagtccccgccccccccccggactttggtacctggctacagccccacctgccccagccccacctgcatttgcctatatatccagtgtaccaattatgccatacccccctgcagcagtctattatgctcccgctggtcctacatctgcccagccagcagcaaagtggcctccaaccgctagcccgcccccagcacgcaggcaccgccactccatccagttggacctgggggatctagaggagctgaataaggcgttgtcaagggctgtacaggccgccgaatctgtgcgttccacaacacgtcaaatgaggagcagcctcagcgcagatctgcggcaggcccacagtctacgaggtagttgcctgttctag

SEQ ID NO: 18740 - DNA, 4320 bp, Artificial Sequence
  Description of Artificial Sequence: Synthetic coding sequence
atggccagcagcgagaccgagatccggtgggccgagcccggcctggggaaagggccccagcgtagacgctgggcctgggccgaagacaaaagagacgtggacagaagcagttcacaatcatgggaagaagaacgcctgtttccgaatgccacctcgcccgaactgctggaagactttaggctggctcagcagcacttgcctcccctggagtgggaccctcacccgcagcctgatggtcaccaggactccgaaagtggagaaacaagtggcgaagaagctgaagcagaggacgtagactcgcccgcatcgagccacgagcccctcgcatggctcccccagcagggacgtcagctggacatgactgaggaagagcccgacgggaccctggggagcctggaggtggaagaggcgggcgagtccagttctcgacttggctacgaagccggtcttagcctggagggtcatggaaatacaagccctatggcactggggcacggacaggcccgcggctgggtggcctcaggggaacaggcctccggcgacaagttaagcgaacactcggaggtcaatccttccgtggaattgagccctgcccgatcttggtcctccggcaccgtatctctggaccatccaagtgacagtcttgattctacgtgggaaggcgagacggacggcccacagccaacagcactggctgaaaccctccctgaaggccccagccaccacttattgagcccagacggtaggacgggaggctccgttgctcgggcaactccgatggagttccaagactccagcgctccccccgcgcaatcgcctcagcatgcaacagatcgatggcgccgggagaccacccgctttttctgtccacagccgaaggagcatatttggaaacagacaaaaacgagtccaaagccattaccttcaagatttatcggctcaatctcaccactaaacccccaaccccgtcccactcgccagggaaggccactcccgcggcagggcgccactctggccggccgctcctcttcaaacgccccgaagtatggaagggggcagcttaactatcctctccctgatttttccaaggtgggacctagggttcgatttcccaaagatgaatcctacagaccccccaagagcaggtctcacaacaggaagccccaggcaccagcccggcctctgatttttaaaagccccgcggagatcgtgcaagaagtgctgctgtcttctggggaggccgctctggcgaaggacacacctccggcccacccaatcacaagggttcctcaggagttccagaccccagaacaggccaccgaactggtacaccagcttcaagaggattaccacagactgctgaccaaatatgctgaggcggagaacacgattgaccagttacggctcggcgccaaggtgaatctgttctccgatccgccccagcctaatcactccatccacactggaatggtgccccaaggcaccaaggtgctctctttcaccataccacagccacgctctgcagagtggtggccagggccagctgaggatccacaggcaagcgctgcgtctggatggcctagtgccagaggggacctctccccaagctccctcacgtccatgcccaccctggggtggttgcccgagaatagggacattagcgaggatcagagctccgcagaacagacacaagctctggcatcccaggcctcccagtttctggcaaaagtggagagcttcgaaagactgatccaggcgggtcgcctgatgccacaggatcaagtaaagggctttcagagactcaaagcggcccacgcagcgttggaggaggagtaccttaaagcgtgtcgggaacagcatccagcacagcctctggctggctctaaaggaacccctgggagattcgacccgcgcagagaacttgaggccgaaatctatagactcgggtcttgtctggaggagctgaaggaacacatcgaccaaacacaacaggaaccggaacccccaggctctgatagcgcactggacagcactccagccctcccctgcttgcaccagcctacacacctcccagccccatcaggccaggctcccatgccggctattaaaactagttgcccagagcccgctacaacaaccgctgccgcatcaaccgggccctgtccccttcacgtaaacgttgaggtcagcagtggcaattccgaggttgaggaccggccccaggacccactggctcgcctgcgccataaggaactccaaatggagcaagtttatcatggtctgatggagagatacctgtctgtcaaaagccttcccgaagcaatgaggatggaagaagaggaagagggggaggaagaagaagaggaagaaggtgggggcgattcactggaggtggatggggttgcggccacaccaggcaaagccgaggctactcgagtcctcccccgacagtgtcctgtccaggcagaaaagagccacggggcccctttggaggaggctacagagaagatggttagtatgaaaccccctgggttccaggctagcctggcgagagatggtcatatgtccggtctgggaaaagcagaagccgccccgcctgggccaggggttcctccacaccctccagggaccaagagcgccgcaagtcaccagagctctatgacttcactggaggggagcggcatctcagagaggctgccccaaaaacctctgcataggggcgggggcccacatcttgaggagacgtggatggcttctccagagacagacagtggtttcgtagggtcagagacctctcgagtgtcccccctgacacagacgcccgaacaccgcctctctcacatctctaccgctgggaccctcgcacagccattcgctgcaagcgtgccgcgagatggggcaagctacccaaaagcccggggatccctaataccacggcgcgcaactgaaccctccaccccaagaagtcaagcccagagatatctctcgtccccatccggacccctgcggcagagggctcctaatttctcgctagagcgcaccctggctgctgaaatggctgtgccagggagcgaatttgaaggacacaagaggatcagcgagcagccccttccgaacaaaactatctcaccaccaccggcgccggctcccgccgcggcgccccttccctgcggccccactgaaaccattccgagcttccttctgactagagctggacgcgatcaggctatctgtgagctgcaggaagaggtgagccggctgcggttgcgactggaggacagtcttcaccagcccctccaggggtccccgacgcggcctgcctccgcgttcgatcgccctgctagaactcggggccgccccgcagacagtcctgccacatgggggtcccactacggaagcaaaagtacggagcggctgccaggggaaccacggggtgaagagcagattgtgcctccggggcggcagcgagcccggtcatcttcagtgcctcgagaagtgctaagactgtctttgtccagcgaatccgaactcccatcattgccccttttctccgagaaatcaaaaacaacgaaagattccccgcaagcagctcgggacggcaagagaggtgtgggatctgcaggctggccagaccgagtgactttcaggggccagtacaccggccatgagtaccatgttctgagtccgaaagccgtcccaaaggggaacgggactgttagttgcccgcactgccgtcctattagaactcaggatgccggcggtgccgttacgggggatcccctggggccacctcccgccgataccctacagtgtcctctgtgcggacaggtgggttctcccccagaggctgatgggcccgggagcgcaacgagcggcgccgaaaaggctaccactagaaggaaggcttccagcacgccatctccaaagcagcgctccaaacaggccggttcatcgccacgacctccccctggcctctggtaccttgcaaccgccccccctgcacccgcaccacctgccttcgcctatataagtagcgtacctattatgccttatcctcccgcagctgtgtattatgccccggccgggccaacaagtgctcagcctgcagccaaatggcctcccaccgcgtctcctccgcccgctagacggcacaggcactccatacagctcgatctgggagatctggaagaattgaataaggcgttgtccagggccgtccaggcagcagaaagtgtccgcagtacgacccgtcagatgcgaagttcattatctgccgacctccggcaggcccactctctacgcggctcttgtctgttctag

SEQ ID NO: 18741 - DNA, 1719 bp, Artificial Sequence
  Description of Artificial Sequence: Synthetic coding sequence
atggccagcagcgagaccgagatccggtgggccgagcccggcctgggtaagggacctcagagacgccgatgggcctgggccgaagataagcgtgacgtggacaggagttctagccagtcgtgggaagaggaaagactgtttccaaatgccacaagtcctgagctattggaagacttcagactcgcacagcagcacctgcccccactggagtgggacccacatccgcagccagacggccaccaagactccgagagcggggagacttctggcgaagaagcagaagctgaagatgtggatagccccgcctcttcccacgagccgttagcctggttgcctcagcaggggagacagctcgatatgactgaggaggagccagatggaacgcttggctccctcgaggttgaagaggctggggagtcctccagcagactaggttatgaggccggcctaagtttggagggacacggtaatacatctcctatggcgcttggccacggccaggctagagggtgggtcgctagcggagaacaggctagcggtgacaaattatcggagcactcggaggtgaacccttccgtcgagctgtcccctgccaggtcctggtcaagcggcacagtctccctcgaccaccctagcgacagcctggatagcacctgggaaggggagaccgacggcccacaacctacggcccttgcagagaccttgcctgaggggccttctcaccatcttctgtccccagatggccggaccggggggtctgtcgctcgagcgacccccatggagttccaggactcaagtgctccacccgcccagtccccccagcacgctacagacagatggagacgcgaaactacacgatttttctgtcctcagcctaaagagcatatttggaagcagactaagacctcccccaagccactgccttcccggtttattgggtcgatcagccctctgaatcctcaaccccgccctacacgccagggcagacccttaccccggcaaggtgccactctcgccggccgatctagctctaacgcacctaagtacggtcgaggccagctcaactaccccctccctgacttcagcaaagtcggaccgagggttaggttccccaaagacgagtcatatcggccacccaagtctagaagtcataacagaaaaccgcaggcccccgcgaggccgctgatttttaagtccccagcggagatcgtgcaggaggtgttgctcagctccggagaagcggctctcgcgaaggatacgccaccagcccatcctataaccagagtgccacaagagttccagactccagaacaggctacggagctggttcaccaactccaggtcagcggtacccatggctgcggctgcgttactaaagcaccggtcggactcggatggcggctgatcggtgtgggccggcctggtgtggaggctgggtgggggggagaggcctgggatcgggcatggcttgggtgggaagctctgggacgaaggctggttggttggggtggacttggctggaggctggccagggtgggaagtccggggatggaagcttcaggggtcggtcggcccggcgtgggttctccaggggtcgaaccaggcggggtgggcagacccggtgtcgaggctgggtggggtcgaaaaccttgggatcgcgggtggtggggtggtgaagcttggggaggcggctggctagggcaggaggctctcggctag

SEQ ID NO: 18742 - DNA, 2016 bp, Artificial Sequence
  Description of Artificial Sequence: Synthetic coding sequence
cccggcttcggcaccaagaacagccaggccggccccctgaagctggggcgccaagacggtggaggagctcgggaaagagccgcccagggcgacgtggaccgaagcagtagccagagttgggaagaggagagactgttccctaacgcgaccagcccagaattgctcgaagattttcgagggccggcagctccggccgccccaggcgtaggcccaacacctgccgcccggtgggctagtggtttcagggtgagacgcgatttcggtcggaggacaggcggatcagtagcacgcgccacaccgatggagtttcaagacagcagtgcacccccggctcagtctccccagcatgccaccgatcggtggaggcgagaaacaacccggtttttttgcccgcaacccaaggaacatatctggaagcagacaaagacctctccaaagccattgccgagccgattcataggctctatatcacctcttaacccacaaccaaggcccacaagacaggggcggcccctcccgagacagggcgccaccctggccgggagatcgagtagcaatgcacctaagtacggtcgggggcagttgaattacccactaccagacttctccaaggtgggccctagggtgcggtttcctaaagatgagtcttataggccacccaagtctcgctcccacaatcggaagccgcaagccccggcaagaccactcatttttaagtctccggctgaaatcgtgcaggaagtcctgctctcatccggcgaggcagcactcgccaaggatacacctcctgcccatcccattacccgagttccccaggagttccagaccccagagcaggcaaccgaactggttcaccaactgcaagaggattatcaccggctgttaacaaagtacgctgaagccgaaaatactatcgatcagctcaggctgggagctaaagtcaacctgtttagcgacccaccccagcccaaccatagcatccataccgggatggttccgcaaggaaccaaggtgctctctttcactatacctcagccgagatctgcagaatggtggccagggcccgccgaggatcctcaggcttcagcggcttctggatggcccagcgccagaggggatctcagcccttcaagcctgacatcaatgccgacactgggctggttacctgagaatcgagatatctctgaagaccagtcatcagccgaacagactcaggccttggcatcccaggcgagccaattcttggccaaagtggaatccttcgagcgattgattcaggcaggtcgcctcatgccacaggaccaagtcaaagggtttcagcgtctgaaggccgcgcatgccgccttagaggaggagtaccttaaggcttgtcgggaacaacaccctgctcagcctcttgccggatctaaagggacaccggggagatttgatccacggagagagctagaagctgaaatttatcgactggggagttgcctagaggaattgaaagaacatattgatcagacacagcaggaacccgaaccccccggttcagacagcgctctggacagcacccctgctttaccgtgtctccatcagccaacccatctgcctgccccttctggccaggcgcctatgcccgccatcaagacctcttgtcctgaacccgcaacaacaacggccgccgctagtacaggcccctgtcccctgcatgtgaacgtcgaggtgtcttctggtaatagtgaggtggaggaccgcccccaagatcctctggccaggcttcgacacaaggaactccagatggaacaagtgtaccacggcctgatggaaaggtacctgtccgtgaaatccctgcctgaagccatgcggatggaggaagaggaggagggcgaagaagaggaggaagaggagggagggggtgatagcctcgaagttgacggcgtcgccgccaccccaggcaaggccgaagccacacgtgttcttcctcgtcagtgtcctgtgcaggcagaaaagtcacacggagcaccgttgtag

SEQ ID NO: 18743 - DNA, 2472 bp, Artificial Sequence
  Description of Artificial Sequence: Synthetic coding sequence
atggccgccagcgaggccgccgccgccgccggcagcgccgccctggccgccggtgctcgcgcggtgcccgccgccactacaggcgctgctgctgctgcatctggcccttgggtgccgccaggccctagactaaggggaagtcggcccaggcccgccggagccacccaacagccagcggtgcctgcgccgcccgcaggagaactgatccagccctctgtttctgagctttctcgcgccgttcgaaccaacatattgtgcaccgttcggggatgtgggaaaatactgccaaactcccctgccttgaacatgcatttggtgaagagtcacaggctccaggatgggatcgtcaacccaaccattcgaaaggacctaaagactgggcctaagttttattgctgtccaatcgaggggtgcccacgggggcccgaaaggccattcagtcaattttccttagtcaaacagcattttatgaaaatgcatgcggaaaaaaaacataagtgttctaaatgttcaaattcctatggcacagaatgggacctgaagcggcacgccgaagactgcgggaagactttcagatgtacctgtgggtgcccctacgccagccgaaccgccctccagtcccacatctacagaacgggccatgagattcctgcagagcatagggaccccccttcaaagaaacgcaaaatggagaattgtgcccaaaaccagaaactaagcaacaagactatagagtcgctcaacaatcaacctatccctcggcctgatacccaggagttggaggcctccgagattaaactggaaccctcttttgaggactcgtgtggctccaacactgacaaacagaccctgactacaccacccaggtatccgcagaagctactcctcccaaagccaaaggtggctctcgtcaagctgccagtgatgcaattctcagtgatgccagtgtttgtgcccactgctgactccagcgctcagccagtcgtcctcggcgtggatcagggtagcgccaccggggcagtgcacctaatgcccttgtccgtgggaacactgatcctcggcctggatagcgaagcttgcagcttaaaggagagtttgcccttgtttaaaatcgctaatcccatcgcgggcgaacctatttctacaggcgtacaggtcaatttcggcaagtctcctagtaacccgttgcaggaactgggaaacacttgtcagaaaaactcaattagttcgataaatgttcaaaccgacctgagctatgcctcccagaattttatcccctcggcccagtgggccacagctgactccagtgtcagtagctgttcccaaaccgacctgtctttcgacagccaggtgtcactgccaatctccgttcatactcagacctttctgcctagcagcaaggtgacatccagcattgcagctcagaccgacgcctttatggatacctgcttccagagtggtggagtctctcgcgagacccagacatccggtattgaaagtcccactgatgaccatgtccaaatggaccaagccggtatgtgcggagacatctttgaatcggtacacagctcttacaacgttgctacgggcaacatcataagtaacagcctagtggctgaaaccgtaacacactccctgctcccccagaatgaaccgaagaccctgaatcaagatatcgagaaatccgcgcccatcatcaatttctcagcacaaaatagtatgttaccaagccaaaatatgacggataaccagacacagaccatcgacctgttgagtgatcttgagaacatcctctccagcaacctccccgctcagacattagaccacagatcactcttatcagacaccaatcccggcccagacacccagctgccgtccggccccgctcaaaatccaggcatcgacttcgacattgaagagtttttctcggcgagcaatatccagacacagacagaagagagcgagctgtctacgatgacaacagaacccgtactggagtctctggatattgaaacccagactgacttcttgctggcagatacgagcgcccagagctacggatgtcggggtaattcgaatttcctgggcctggagatgttcgatactcagactcagaccgacctgaacttcttcctggatagtagtccccatctgcctctggggagtattctgaaacactccagtttcagcgtaagcaccgactctagcgacactgagactcagaccgagggggtgtctaccgctaagaacattcctgctctggaatcaaaagttcagctgaactcgactgagacacagacaatgtcctctgggttcgagactctgggatctcttttttttaccagcaacgaaacccagaccgccatggatgactttctcctcgcagacctggcctggaacactatggaatctcagtttagcagcgtcgagacccagacatccgccgaaccacacacggtgtctaacttctag

SEQ ID NO: 18744 - DNA, 1785 bp, Artificial Sequence
  Description of Artificial Sequence: Synthetic coding sequence
atggagaactgcgcccagaaccagaagctgagcaacaagaccatcgaatccctcaacaatcaacccatacctagaccagacacacaagagttggaagcaagcgagataaaactcgagccctcattcgaggattcctgcggtagtaacacagacaagcaaaccttgactactcctccacgctatcctcagaaactgctgctgccgaagcccaaagtggccctggtgaaactccctgtgatgcagttttcagtcatgccagttttcgtgccaaccgccgattcatccgcgcaaccagttgtcctgggagtggatcaaggtagcgcaaccggtgcggtgcacctcatgcccctgtcagtgggcacacttatattggggctggactccgaggcgtgttccttgaaggagtctttacccttgttcaagatagcaaacccgatagcaggagaacctatctccaccggcgtgcaagtcaattttggaaaatcaccttctaaccccctccaagagctggggaacacctgccagaaaaattcaatttcctcaatcaacgtacagaccgacctgtcttatgcgagtcagaatttcatccctagtgctcaatgggcgacagctgattcttcggtatcttcctgttctcagacggacttgtctttcgactcccaggtcagccttccaatatccgtgcatacccaaacgttcctgccaagttcaaaggtcactagcagcatcgccgcacagactgacgcctttatggatacatgctttcagagcggtggtgtcagtagggaaacacagacttccggtatcgaaagtcctacagatgaccacgtgcagatggaccaggcgggcatgtgcggcgatatctttgagtctgttcattctagctacaacgtagccacaggcaatatcattagcaattcactagtggccgagaccgtcacacattctctcctccctcagaacgaacctaagacacttaatcaggatattgagaaaagtgcaccaatcattaacttttccgctcaaaactccatgctgccatcacagaacatgacggacaaccaaacccaaaccattgacttgctgagcgatctggaaaacattctgtcatccaacctcccagcccagacattggaccacagatcgctgctcagcgatacaaatcccggacctgacacccagctgccctctgggccagcccagaaccctggcattgactttgatatagaggagttcttcagcgcctctaacatccagacccagaccgaagagtccgagctgagcacgatgactaccgaacccgtgcttgaatcattagatattgagacccaaacggatttcctattggcggacactagcgcccagtcctacggatgccgtggtaattccaacttccttgggctggaaatgttcgatacccaaacccagacggatttaaatttcttcctggatagctctccgcacctgccattggggtctatactgaagcactcttccttttctgtctccaccgatagctccgacaccgagacccagacagaaggtgtgtctaccgccaagaatattcccgccctcgagtcaaaagtgcaactcaactcaacagaaactcagacaatgtcttctggatttgagactttaggcagcctcttcttcacttctaacgaaactcaaaccgcaatggacgatttcttgttggccgatctcgcatggaacaccatggagtcacagttcagttcagtcgagacgcagacttcagccgagcctcacaccgtgagcaacttttag

SEQ ID NO: 18745 - DNA, 966 bp, Artificial Sequence
  Description of Artificial Sequence: Synthetic coding sequence
atgaagcacatccccgtgctggaggacggcccctggaagaccgtgtgcgttaaagagctgaacgggttgaagaagttgaagagaaaaggaaaggagccagcccggcgcgcaaatggctacaagaccttccgactggacctggaagctccagagccacgggctgtggctacaaacggccttcgagaccgcactcatcgattgcagcctgtaccggtaccagttcccgtcccggtgcctgtcgctccggcagtaccacctcgcggcggtaccgacacggccggcgagcggggggggagtcgcgcccctgaagtctctgacgctcgcaagcgctgttttgctctgggagcagtgggtccaggactaccgactcctccacctcccccacctcctgctccccagtctcaggccccaggaggaccggaggcacagcctttccgcgaaccagggctgagaccgagaatcttactctgtgccccccccgccaggcctgcccccagcgctcctccagcccctcctgcaccacctgaatcaacagtgcgtcccgcgcccccgactcggccgggtgagagctcttacagtagtatcagtcatgtaatctataacaatcatcaggactcaagtgcgtccccccgaaaaaggcccggcgaggcaactgctgcatcttctgagatcaaggcactgcagcaaacgcgtagattactcgccaatgctcgcgaacggactagggtccataccatttcagcggcatttgaggctctgcgaaaacaggtgccctgctactcttatggacagaagctgagcaagctggctattttgcgcattgcctgcaattacattttgtccctggctcggttagccgatctggactattctgccgatcattctaacctgtcattttccgagtgcgtgcagcgttgtactaggactctgcaggctgagggccgcgcaaagaaaaggaaggaatag

SEQ ID NO: 18746 - DNA, 1164 bp, Artificial Sequence
  Description of Artificial Sequence: Synthetic coding sequence
atgaccatggagggcgccagcggcagcagcttcggcatcgacaccatcctgtcctccgcatccagcggatcaccgggaatgatgaacggcgacttccgaccactgggcgaagcccgcacagcggatttccgaagccaggccacacctagcccgtgtagcgaaatcgatacagtgggaactgcgccaagttctccaatctccgtaaccatggaacctcccgagcctcatctcgtggccgatgccacacaacatcatcatcacctgcaccattcccaacaacccccacctcctgccgcggcgcccacccagagtctccaaccactccctcagcagcagcagcccttgccacctcaacagcctccacccccaccaccccagcagctcggtagtgccgctagcgccccccgcacatcaacgagctcctttctgattaaggacatcttgggcgattctaagcctctcgccgcatgcgccccatactcgacttctgtaagctccccccaccatacacccaagcaagagtccaatgcagtccacgaatctttccgaccaaagttggaacaagaagatagtaagacaaaactcgacaaacgggaagattctcaaagcgatatcaaatgtcacggcactaaggaagaaggtgaccgcgagattacctcatccagagagtcacctcccgtgcgtgctaagaagccaaggaaagccaggacggcattttccgatcatcagcttaaccagctggaacgctcattcgagcgccagaagtacctttccgtccaggacagaatggacctggccgccgccttgaacctcactgatactcaagtcaaaacatggtaccagaacagacgcacaaagtggaaaagacagacagctgtgggtctggagctacttgccgaggccggtaactactccgctctgcagcgtatgtttccaagcccatacttctaccatcccagcttgctgggatccatggacagcacgaccgctgctgctgctgcagccgccatgtactcctccatgtacaggaccccccctgcaccgcacccccagctccagcggccactcgttcccagggtattaatccacgggctcggcccaggcggccagccggcgttgaaccctttgtcctctcctattccaggtacaccgcatccacgctag

SEQ ID NO: 18747 - DNA, 321 bp, Artificial Sequence
  Description of Artificial Sequence: Synthetic coding sequence
atgatgaccctggtgccccgggcccggacccgggccggccaggaccattatagtcacccctgtccacgattttctcaggtgctcttgactgaaggtatcatgacttactgcttaacaaagaacctaagcgacgtgaacatcctccacagactgctcaagaatggtaacgtaagaaacacattgctccaatctaaggtggggcttttgacatactacgtgaaactgtatcccggagaagtgactctacttacccggcctagtattcaaatgcgcctctgctgtattactggcagcgtgtccaggccaaggtctcagaagtag

SEQ ID NO: 18748 - DNA, 321 bp, Artificial Sequence
  Description of Artificial Sequence: Synthetic coding sequence
atgatgaccctggtgccccgggcccggacccgggccggccaggaccactactcacacccctgtcctagattcagtcaggtcctgctgactgagggtatcatgacttattgcctcaccaagaacttgagcgacgtcaatatccttcatcgtcttctgaagaatgggaatgtgcggaacacactcttacagtcaaaggtgggccttctcacctattacgtgaagctgtatcctggcgaagtcacacttctaacccgtccatcaattcagatgcggttgtgctgcattacgggaagcgtttctcgaccaagatctcaaaagtag

SEQ ID NO: 18749 - DNA, 570 bp, Artificial Sequence
  Description of Artificial Sequence: Synthetic coding sequence
atgaagaccaagaaccggcccccccggcggcgggcccccgtgcaggatacagaggcaacgcccggggagggaactcccgatggaagcctgcccaatcctggtcccgaacccgccaaaggcctacgatcacgacccgcgcgcgctgctgccagggcccctggagagggcaggagaaggcgaccaggaccatctggccccggcggacggcgagactccagcatccagcgacgtctcgagagcaatgagcgggaaagacaacgcatgcacaagctcaacaacgccttccaggccttgagggaggtgatcccccacgttagagccgacaaaaaattgagcaagatcgaaacgctgacgctcgcgaaaaattatataaaatccctgactgcgaccatcctgacaatgagttctagccgcctgcctgggctggaaggccctggtcctaagctataccagcactaccagcagcagcagcaggtcgctggaggcgctctgggcgctacggaggctcagccccagggacatctgcagcgctattctacacaaatacactcatttagagaaggtacatag

SEQ ID NO: 18750 - DNA, 708 bp, Artificial Sequence
  Description of Artificial Sequence: Synthetic coding sequence
atgctgcggggcgcccccggcctgggcctgaccgcccggaagggcgccgaggattctgctgaagacctgggcggtccatgtcccgagcccggcggagacagtggggttttaggtgccaacggagccagttgttcacgcggagaggcggaggagcctgcaggaagacggagggcccggccggtgaggtccaaggcacgccggatggcggcgaatgtgagggagcgcaaaaggatcctcgattataatgaggcctttaatgctttaagacgcgcactgcgccacgacctggggggaaaacggttgagtaagattgctacactacgtagagccatccaccgaattgctgccttaagcctggtgttgcgcgcctctccagcacccaggggaccatgtggacatctggagtgccacggccccgctgccagaggggacacaggggatactggagcgagcccacccccaccagctggcccatccctcgcccgccctgacgctgcccgtcctagtgtgccttccgccccacgttgcgccagttgcccccctcacgccccccttgctcgcccctccgctgtggctgagggccccggcctggctcaggcctcaggcggaagctggcgtcggtgccccggagcaagttccgccggtccgcctccgtggcccagggggtacctgcgttctgcccctggcatgggacacccccgttcatag

SEQ ID NO: 18751 - DNA, 825 bp, Artificial Sequence
  Description of Artificial Sequence: Synthetic coding sequence
atgcacctgtgcggcggcaacggcctgctgacccagaccgaccccaaagagcagcagcgtcagcttaaaaagcagaaaaacagagcagccgcacagcggagccgtcagaagcacacggataaagcagatgcactccaccagcagcacgaatcgctcgaaaaggataacctggccctccgcaaagagattcaaagcctccaggccgagttggcgtggtggtcaaggactctccacgtgcatgagcgcctgtgcccaatggattgcgcctcctgtagtgctccggggctgctcggatgctgggatcaggcggaagggctgctggggccaggtcctcaggggcagcacggctgccgagaacagctggaactgttccagacacccggcagttgctaccctgcccaacccctgagccctggccctcagccgcatgacagtccatctctgttacagtgcccgctcccatccttgagtctgggacccgctgtagtggcggaaccccctgttcaactgagcccttcgcctctgctcttcgcctcccatacagggagttctctgcagggttcttcttcaaagctttctgcgctgcaacctagccttacagcgcagaccgcccccccacagcctctggagctggagcatcccactagaggcaaactgggaagctcacccgacaacccctcatctgccctgggactggcccgtctgcaaagcagggagcacaaaccagccttgtctgcggctacctggcagggtttggtggttgacccctccccccaccccctgcttgcattccccctcttaagttcagcccaggtgcatttttag

SEQ ID NO: 18752 - DNA, 2031 bp, Artificial Sequence
  Description of Artificial Sequence: Synthetic coding sequence
atgaagaagttcagccggatgcccaagagcgagggcggcagcggcggaggcgctgcaggagggggagctgggggggcgggcgccggagctggttgtggatcaggcggtagcagcgttggcgtgcgggtctttgcggtgggccgacatcaggtcaccctggaagaatccctggccgaagggggcttcagcacggtgttcctagtgcggacccatgggggtattcggtgcgccctgaagaggatgtatgtaaataatatgcccgatctcaatgtttgtaagagggaaattacaatcatgaaagagctttctggtcataaaaacattgtcggttatctggattgcgccgtgaatagtattagcgacaacgtgtgggaagtgctcatcctcatggaatactgtcgcgctggccaggtcgtcaatcagatgaacaaaaagctccagacagggttcaccgagcctgaagtgcttcagatattttgtgacacctgtgaagcagtagcacggttgcatcagtgcaaaaccccgatcatccacagagatctgaaagtcgaaaacattctgctgaatgacggtgggaactacgtgctctgtgacttcgggtcggcaaccaacaaatttttaaacccacagaaagatggggtgaacgtcgtagaagaggagattaaaaaatacaccacacttagttaccgggctccagaaatgattaatctctacggaggaaaaccaatcactactaaagctgacatatgggcgctgggatgcctgttatacaagttgtgcttctttacattacccttcggcgaatctcaggtggcaatttgcgatggcaattttacgattcccgataactctaggtactcgcgaaatattcattgtttgattagatttatgttggaacctgacccggagcatagacctgacatttttcaggtctcatacttcgctttcaaattcgctaagaaggattgccctgtctccaatatcaacaagtgctgcaagcagcttctcaggcacggtgccctactaacagagattctgctgttcttgcagctttttttgaacatgacggctagtgaagcggctgccagaaaaagccagatcaaagctagaattactgacaccatcggtccgaccgagacatcaatcgcccctcggcaacgtccaaaggcaaactccgcaactaccgccacacctagtgttcttacaattcagagtagcgcaacccccgttaaggtcctcgcgcctggtgaatttggcaatcacagacctaagggagctttgcgacccgggaacgggcctgagatacttctcggacaggggccccctcagcaaccaccgcagcagcatcgcgtattgcaacagttacagcagggcgactggagattgcagcagctgcatctacagcaccgccaccctcatcagcaacaacagcaacagcagcaacagcaacaacagcagcagcagcagcaacaacagcagcagcagcagcagcagcagcagcaccaccaccaccatcaccaccacctactgcaggacgcctatatgcaacagtaccaacacgccacccagcaacagcagatgttacagcagcagttcttgatgcacagcgtataccagcctcagccaagtgcgagccagtaccctaccatgatgccgcagtaccagcaggcatttttccaacagcagatgttagcacagcatcaaccttcgcagcaacaggcctcacccgaataccttacaagcccgcaggagttttctcctgcactagttagctataccagttctttgcccgcacaggtcgggacaataatggactcctcttattctgcaaacaggagcgtcgcagacaaggaggcaattgcgaatttcactaatcagaaaaatatcagtaatccgcctgacatgtccggatggaacccgttcggcgaggataatttcagcaagttgactgaggaagagcttctcgaccgtgagtttgacttgttgcgcagcagtaagggacacttaaaagcttacttcgcgtcccagtag

SEQ ID NO: 18753 - DNA, 3486 bp, Artificial Sequence
  Description of Artificial Sequence: Synthetic coding sequence
atgaagaagttcagccggatgcccaagagcgagggcggcagcggcggaggggccgctggaggaggggccggtggagcaggggcaggcgccggctgcggtagcggtggttcctctgtaggggtgcgagtctttgctgtgggccgccaccaagtcaccctagaggagtctctggctgaaggagggtttagtacagtgtttctggtaaggactcacggcggtattaggtgcgccttaaagcgcatgtacgttaataacatgccagaccttaacgtttgcaagcgggagatcacaatcatgaaggaactatccggtcacaaaaacatagttgggtatctggactgtgccgtcaattccatctctgataatgtctgggaagttcttatactcatggaatactgtcgggccggccaggtggtaaaccagatgaacaagaagttacagaccgggtttactgagcccgaggttctacagattttttgcgacacatgtgaggctgtggctcgcctacatcagtgcaaaactccaatcatccatcgagacctcaaggtggagaatatcctgctgaacgacggcggaaattacgtgctatgcgactttggatcagccacaaataaatttctcaatccacagaaggatggggtgaatgtagtggaggaggagatcaagaagtatacaaccctgtcttatcgtgcaccagagatgatcaacctgtatggtggcaagccaattacgacaaaggcggacatctgggcattgggctgcctgctttataagttgtgtttctttaccctgccttttggggaatctcaggttgcaatctgtgacggaaactttactattcccgacaacagtcgatacagcaggaacatccattgccttattaggttcatgcttgagccggaccccgaacatcgaccagacatctttcaggtgagctatttcgcttttaagtttgccaagaaagactgccccgtcagtaacataaacaattccagtatcccttccgccctgccggagccaatgacagccagcgaagccgcggctcggaagtcacagataaaggcgcgcataacggataccatcgggccaacagagacttcaattgcccccagacagcgacccaaggcaaatagtgctaccactgccacacccagcgttctgacaattcagtcaagcgctacacctgtaaaggtgctcgccccgggtgagttcggaaaccataggcctaaaggcgcactgcgccccggcaatggtccagagatactcctgggccagggacccccccagcagcctccacagcagcaccgcgtactgcaacagctgcaacagggagactggcggcttcaacagttgcacctgcagcataggcatccacatcagcaacaacagcaacagcagcagcagcaacagcaacaacagcaacaacagcagcagcaacagcagcaacagcagcagcaacatcatcatcaccaccaccaccacctgctgcaggacgcatatatgcagcagtatcagcatgcaactcagcagcagcagatgttgcagcagcagtttctgatgcactctgtgtatcagccacagccatctgcaagccagtaccccacaatgatgccgcaataccaacaagctttttttcagcaacaaatgctcgctcagcaccaacctagccaacagcaggcctctccagaatatttgacatccccacaagagtttagccctgccttggtgagctatacatcgtcgctgccagcacaagtcggcactatcatggactcttcttactcagctaacaggagcgtggccgacaaagaagcgatcgctaattttacaaatcagaaaaacatttccaatcctccggacatgtccggctggaacccgttcggcgaggataatttcagcaagcttacggaggaagagcttttagacagggagttcgacctactgagatctaatcgccttgaagagagagcgagctccgacaaaaacgttgacagtctgagtgctccacacaatcatcccccggaggacccattcggctcagtacctttcatctcccacagcgggtctccggaaaaaaaagcagagcactcatctatcaaccaggaaaacggcacggccaatccaattaagaacggcaaaacatcgcccgctagcaaagaccagcgaacagggaaaaagacttcggtccaaggacaggtccagaagggaaatgatgagtccgaatctgacttcgagagcgatcccccctcccccaaatcaagcgaagaagaagagcaggacgatgaggaagtgctccaaggggagcagggtgactttaatgacgacgataccgaacccgagaacctcggccatagacccctactcatggactctgaagacgaagaggaagaggagaagcattctagtgatagcgattacgagcaagccaaggcgaaatattctgacatgtcatccgtctacagggataggagcgggtctggacccacccaagatctgaacaccatcctcctgacctcagcccagttgagcagcgacgtcgcagtggaaactcccaagcaggagtttgacgttttcggtgcagtcccttttttcgccgttagggcccagcagccacagcaggagaagaatgagaaaaacctcccacagcaccgattccctgccgccgggctggagcaggaggagtttgacgtattcaccaaggcccccttttcaaagaaagtgaacgtccaagagtgccacgcggttgggcccgaggcccacactattcccgggtatcccaagagcgtggatgtgttcggaagtacaccctttcagcctttcctgacttcaacaagcaagtccgaatctaatgaagatcttttcggactggttccattcgacgagatcaccggtagccagcagcagaaggtcaaacagaggtctctgcagaaactgtcttcccgacagcggagaaccaagcaggacatgagcaagagcaatggaaaacggcatcatgggacgccaacatccaccaagaagactttgaaacctacttaccggacacccgagagggctagacgccataagaaggtgggacgcagggactcccagtcctcaaatgagtttttgaccattagcgactccaaagagaacatttccgtggcccttacagacggaaaggaccggggcaacgtgctacagcccgaagaatcattgttggacccatttggcgccaaaccattccactcacctgatctgtcttggcatccgccccatcaggggctgtctgacattagggccgatcataataccgtactgcccggacgtccccgacagaattctctgcatggctccttccactccgctgacgtgctgaaaatggacgactttggagccgtgccctttacggagctggttgttcagtcaattacaccacaccaatcacagcagtcacaaccggtggaattagacccattcggggctgcaccattccccagtaagcagtag

SEQ ID NO: 18754 - DNA, 1989 bp, Artificial Sequence
  Description of Artificial Sequence: Synthetic coding sequence
atgaagaagttcagccggatgcccaagagcgagggcggcagcggcggcggagccgccggcggcggggccgggggggctggcgctggggccggatgtggttctgggggaagcagcgtgggggttagagtctttgcggtgggcagacaccaggttacactggaggagagcttagccgaaggcggtttcagtaccgtctttttggtgcggacccacggagggatccggtgcgctctcaagagaatgtatgtcaataatatgcctgatctcaatgtgtgtaagcgtgaaatcacaatcatgaaagagctgagtggccacaaaaacatagtcgggtatctggattgtgctgttaattcaattagtgataatgtatgggaggtgctgattctcatggagtattgtagagccgggcaggtagtgaaccagatgaataaaaaacttcaaaccggattcaccgagcccgaagtgctacagatcttctgtgacacatgtgaggccgttgcgaggctacaccaatgcaaaacacctattatacacagagatttgaaagtggaaaatatcctgcttaacgacgggggaaactacgtcctatgcgactttggctccgccacaaataaattcctcaatccccaaaaagacggcgtcaatgtggtcgaggaagaaataaaaaagtacacaacactgagttaccgcgcccctgagatgataaatctctatgggggcaagccaatcacaaccaaggccgacatctgggctctgggttgcctcttgtacaagctttgcttcttcactcttccattcggcgagtcccaggtagctatctgcgatggaaactttacgatccccgacaacagcaggtactccaggaatatccattgcctgattcgatttatgctggaacctgatcccgagcataggccggatatctttcaagtcagctactttgcattcaagttcgccaagaaagattgtcccgtttccaacattaacaactcctctatcccttcagcattgcctgaacccatgacagctagtgaagctgccgctaggaaaagtcagatcaaggcacgtattacggatacaatcgggcccaccgaaacttccatcgcgcctcgtcagcggcccaaagcaaactccgctaccacagctacgccaagcgtcttgaccatccagagcagcgccacaccggtgaaagtgctcgccccaggggaatttggtaatcacagaccgaagggggcactcagaccaggaaatggaccggaaattctgcttggacagggaccccctcagcagcctccccagcagcacagggtcctccagcagcttcagcaaggagattggaggttgcagcagttgcatctgcaacaccggcaccctcatcaacagcagcagcagcagcaacagcaacagcagcagcagcagcagcagcagcagcagcagcaacagcagcagcagcagcaacaccatcatcatcaccaccatcatcttctgcaagatgcctatatgcaacagtaccaacatgccacacaacagcagcaaatgttacagcaacagttcttaatgcatagtgtctaccagccccagccctctgctagccaatatccaaccatgatgccccagtaccagcaagctttttttcagcagcagatgcttgcgcagcaccagccttcccagcagcaggcttcaccggaatacttgacaagtccccaggagttttcaccagcccttgtaagctatacaagcagcctgcccgcccaggtaggtaccattatggattccagttacagcgcaaacagatcggttgctgataaggaggctatcgccaattttaccaatcagaaaaatatcagcaaccctccagatatgtctggatggaacccctttggcgaggacaactttagcaagctgacagaagaggaactactggacagggagtttgatctcctgagatccagcaagggccacctcaaggcttattttgcatcgcaatag

SEQ ID NO: 18755 - DNA, 3849 bp, Artificial Sequence
  Description of Artificial Sequence: Synthetic coding sequence
atggaggccaaggaccagaagaagcaccggaagaagaacagcggcccaaaggccgccaagaagaagaaacgcctgctccaggacttgcagctgggggacgaggaagacgcaaggaaaaggaatcccaaggctttcgcggtgcaatcagcagtccggatggccaggtcattccatcgaacccaggatctaaagacgaagaagcatcatattcccgtagtcgataggaccccactggagcctcccccaattgtggtcgtcgtgatggggccaccaaaggtgggcaaaagtacactaattcagtgcttgattcgcaatttcactaggcagaagctcaccgagattcgagggccagtgactattgtgagcggcaagaagagacgattgactattatagagtgcggctgtgatatcaatatgatgatcgatttagcaaaagtggccgacttagtgcttatgcttattgacgcgtcctttgggttcgaaatggaaacgtttgagtttctgaacatctgtcaggtgcatgggtttcccaagattatgggggtgcttacccacttggacagctttaaacacaataagcagttgaaaaagacaaaaaagagattaaaacaccgcttctggaccgaggtctaccccggagcaaagctattttatttgtccggcatggtgcatggtgagtaccagaatcaagagatccataacctaggacggttcataaccgtgatgaagttcaggcctttgacgtggcaaactagtcacccatatattttagctgatcggatggaagacctgacaaaccccgaggacatccgcacaaacattaagtgtgatagaaaagtgtcgctttatggctatttgcgcggcgcacacctcaaaaacaaatcccaaatacatatgccaggcgttggcgacttcgctgtcagtgacatctcgttcctgcctgacccctgcgctctgcctgagcagcagaagaaaaggtgtctgaatgagaaggagaaattggtctacgctcccctttcaggggttggcggagtgctctacgataaagacgcagtgtacgtggacctgggtggatcccacgtattccaggatgaggtaggcccgactcatgaactcgtgcaatccctgattagcacacatagtactattgatgccaaaatggcatcctcaagagtgaccctctttagcgactccaaacctctggggtctgaagacatcgacaaccagggcctgatgatgcccaaggaggagaagcagatggacctgaacacaggtagaatgcgccggaaagccatcttcggtgatgaggacgagagtggggacagcgatgacgaggaagacgacgagatgtccgaggatgatggtctggaaaacggaagctcagatgaagaggccgaagaggaggaaaacgctgagatgaccgaccagtacatggccgtgaagggcattaagcgaaggaagcttgaactcgaggaggattctgaaatggacctgcccgcattcgccgattccgatgacgacttggagaggagtagcgccgaggagggggaggctgaggaggccgatgagagctcagaagaagaagattgtacggccggagagaagggcatctctgggtcaaaggctgccggcgagggctctaaggccgggttgagtcccgctaattgccagtcagatcgggtgaacctagagaagagcttactgatgaagaaggctgcacttcccacattcgattcgggccactgcacggcggaagaagtcttcgcttctgaagacgagtcagaggagtcctccagtttatcggctgaagaggaggattctgagaatgaagaagccattcgcaagaagctctctaagccttcccaggtcagctcgggtcaaaagctgggaccgcagaattttatagacgagaccagcgatatcgagaatttgctcaaggaggaggaagactacaaggaagagaataacgactctaaagaaacttctggggcacttaagtggaaggaagatctgtcccggaaggccgcagaagcgtttctaaggcagcagcaggcagccccaaacctccggaagctaatctatgggacggtcactgaagacaatgaggaggaggatgacgatacgttagaggaactgggcggcctattccgcgtgaatcaacccgaccgcgaatgcaagcataaggccgacagcctggactgtagcaggtttctcgtggaagccccgcacgactgggatctagaagaagttatgaattccatccgagattgctttgtgacaggcaagtgggaggatgacaaggacgccgcaaaagttcttgcagaggatgaggaactgtatggggactttgaggatctcgaaactggcgacgtccacaagggaaaaagcggccccaatacccagaacgaggacattgaaaaggaggtcaaagaggagatagatccagatgaagaggaaagcgctaaaaaaaaacacctcgacaagaaaagaaagctgaaagaaatgtttgatgccgagtatgacgaaggtgaaagcacctatttcgacgatcttaagggggagatgcagaaacaggcccagcttaaccgcgcagagtttgaagaccaggacgatgaagcgcgcgtgcagtatgaaggattcaggccagggatgtatgtgcgtatcgagatcgagaacgtcccctgcgagtttgtccagaacttcgatccacattatcccatcattctggggggcctgggaaatagcgaaggaaatgtcgggtacgtgcagatgcgactgaagaaacatcgttggtacaaaaagattcttaaaagcagagaccccattatattctctgtggggtggcgccgattccagacaatcccgctctactacatagaggatcataacgggcggcagaggctgctgaagtatacaccacagcatatgcactgcggggctgctttttgggggccaatcacaccacaagggacaggctttctggccatacaatccgtatcagggataatgccggacttcagaattgctgctacaggggtggtgctggacttggacaagagtatcaagatcgtgaaaaagctgaaactgaccgggttcccgtacaagattttcaagaatacgagtttcatcaagggaatgtttaattctgctctcgaggtggcgaagtttgaaggagcggtgattcggaccgtgagtggaattcgtggccaaatcaaaaaagctctcagagcgcctgagggagcgttcagagcaagttttgaggacaagctgctgatgagcgatatagtattcatgcgcacttggtaccccgtcagtattcctgccttctacaatccagtgacttctctgctcaagccagttggggagaaagatacttggagcgggatgcggacaacaggtcaattgcgtctggcccatggagtccggcttaaggcaaacaaggatagcctgtataagcccattcttcgtcagaagaaacatttcaacagcctccatataccaaaagcactccagaaagcgttgccttttaagaacaaacctaaaacccaggcgaaggcaggaaaggtgccaaaggacagaagacgaccagccgtcatccgagagccacatgaacgcaagattcttgccctccttgacgcgctatcgacagtacattcccaaaaaatgaagaaagcaaaggagcaacgccatttgcacaataaggaacactttcgtgctaagcagaaagaagaagaggagaaactcaagcggcagaaggatcttaggaagaaacttttccggatccagggccagaaagagcggagaaatcagaagtcctcactgaagggcgcggagggccaactccagtag

SEQ ID NO: 18756 - DNA, 909 bp, Artificial Sequence
  Description of Artificial Sequence: Synthetic coding sequence
atggtgagctaccacaagcaggcctgcgagatcccccccaccgtgaatccccgtaagaagctctgggcgttcccttccgattcatcccgggatctgccttcgccaaagaaagccaagaccgaagagatgccccagctcaatttcgggatggctgatccaacccagatgggcggcctgtcaatgctgttgctcgcaggtgaacacgcactaggaactcccgaagtatcgtctggcacatgtaggccggacgtatccgagagcccggagctgaggcaaaagtctcccttgttccaatttgctgaaattagctctagcaccagtcactctgatgcctcaacaaagcaatgccagacttctgctctgtttcaatttgccgagatatcttccaatactagccagctgggaggagccgaaccagtgaagagatgcggcaaatctgccttattccagctagccgaaatgtgtctagcatcggaggggatgaagatggaagagtcaaagttgattaaagccaaggagtctgacggagggagaattaaggaactagaaaaaggtaaagaagagaaggagataaaaatggagaaaaccgacgaaacgcggctgcagaaagaggcggaattcgagaaatccgccaaagagaatttaagggatagtaaggaattgagaaactttgaggccttgcagattgatgatatcatggctattaaaatggaagaccccaaagaaattcgtaaggaggaactggaggaggatcataagtgttcccattttccggatttcagttactcggcttcgtccaagattattatctctgatgtgccatctaggaaggatcacatgtgccatccacatggcattatgataattgaggacccagctgccctgaacaaacccgaaaagctgaaatag

SEQ ID NO: 18757 - DNA, 2826 bp, Artificial Sequence
  Description of Artificial Sequence: Synthetic coding sequence
atgaagggcagcaaccggaacaaggaccacagcgccgagggcgagggtgtcggtaaacgaccaaagaggaagtgccttcaatggcacccccttttggcgaaaaaacttctggacttttcggaggaagaggaagaagaagatgaagaggaagatatcgacaaagtgcagctgttgggtgctgacggcttggaacaggacgttggagagaccgaggacgacgaatcccccgaacagcgggcccgtaggcctatgaacgccttcctgctgttttgcaaacgtcatcgttctctggtccggcaggaacaccctaggctcgacaacagaggagccaccaaaattctggccgactggtgggccgtcctggacccaaaagaaaaacaaaagtacactgacatggccaaggaatataaggacgcctttatgaaagctaatccaggttacaaatggtgtcccacgacaaacaaacctgtcaaatctcccacccccacagtgaacccccgaaaaaagctgtgggcattcccctctgattcctcgagggacctcccctctccaaagaaagcaaaaaccgaggaaatgcctcagctaaattttggaatggccgacccgacacagatgggcgggctttcaatgttactgcttgccggagagcacgctctcggcactccggaagtttcttcgggtacttgtcgacccgacgtgagtgagtcccctgagctacggcagaaaagtcccctgttccagtttgccgagatttcttcttcaacatctcatagtgacgccagcacaaagcagtgccagacttctgcactgttccagttcgccgaaatttcttcaaacacctcgcaattgggcggtgcggagcctgtgaaacggtgcggaaaatcagccctgttccaactggcggaaatgtgcctggcctccgagggaatgaagatggaggaaagtaagctgattaaggctaaagaaagtgatggaggtcgcattaaggaactcgagaagggtaaggaagaaaaggaaataaaaatggaaaagacggatgagacacgcctccaaaaagaggcagagttcgagaagtccgctaaagagaatttgcgggactccaaggaactcagaaacttcgaagcacttcagatcgacgatattatggcgataaagatggaggatcccaaagagattcgcaaggaagagctcgaagaagatcacaagtgctcacattttccagactttagctatagcgccagttcaaagattatcatcagcgatgtgccatccagaaaggaccacatgtgtcatccgcatggaatcatgatcattgaggatcctgctgctcttaataaacctgaaaagcttaaaaagaaaaagaagaagtctaaaatggaccggcatgggaacgacaagagtacccccaaaaaaacttgtaagaagagacaaagttccgaatctgacattgagagcgttatttacaccatcgaggccgtggctaaaggtgactggggtatcgagaagctcggcgacacccctaggaaaaaagtccgcacaagttcttctgggaaaggaagcattctggacgctaagcctcccaaaaagaaagtgaagtcccgcgagaaaaagatgtcgaaggagaagtcttctgatacgaccaaggaatcaaggccccccgacttcatcagtatttctgcctccaagaatatatcaggagaaacaccggaaggtatcaaagccgagcccttgactccaatggaggatgccttgccaccctcattgtctgggcaagctaaaccagaggactccgattgccatagaaaaattgagacatgtggtagcaggaaaagcgaacggtcttgcaagggggccttgtataagaccttggtttcggaggggatgctcacctcccttagggccaacgtggacaggggtaaacggagctctgggaaaggcaactcttccgaccacgaaggttgttggaatgaggaatcctggaccttttcccagtcaggcacatctggctctaagaaattcaaaaaaacgaagcccaaggaagattgtctgctgggttccgcaaaactggatgaggagtttgaaaagaaattcaattctctgcctcagtactcgccagtcacttttgatcgcaaatgtgtccctgttccacggaaaaagaagaaaacaggtaatgtgtcatcagagccaacaaagactagcaaaggtcctttccagagccagaagaagaaccttttccacaagatagtgtccaagtacaagcacaagaaagagaagcctaacgtacctgagaagggcagtggcgataaatggtcgaacaaacagctgttcctggacgcaatacaccccactgaagcaatttttagtgaggatcggaatactatggaacccgttcacaaagtaaaaaacattccaagcatatttaacactcctgagccaaccacaacccaagaacctctggtcggctcacagaaacgaaaagccaggaagaccaagattactcacctcgtgcggacggcagacggtagagttagtcctgccgggggaaccttagatgataaacccaaagaacagttgcagagatcgctgcccaaagctactgaaacagattgtaatgataaatgttcccataatactgaggtaggagagactaggtctagtaccccagagatgcctgccgtatctgcgttcttctcactcgctgctctggccgaagtggccgcaatggagaacgtgcacaggggtcagcggtccacacctttgactcacgatgggcagcctaaggaaatgccccaggctccagtgctcatctcctgcgccgaccagtag

SEQ ID NO: 18758 - DNA, 1347 bp, Artificial Sequence
  Description of Artificial Sequence: Synthetic coding sequence
atgaagggcagcaaccggaacaaggaccacagcgccgagggcgagggcgtcggcaaacgacctaagcgcaaatgtcttcagtggcacccacttttggccaagaagctcctggacttttcagaagaggaggaggaggaggatgaggaagaagatattgataaagtgcaacttctgggagccgacggcctcgaacaagacgtgggagaaactgaagacgacgagagtcctgaacagcgagcaaggcgccccatgaacgcattcctgttgttttgtaagaggcataggtctctggtgcggcaggagcacccgcggctcgacaatcgcggcgctactaagatactcgcagactggtgggctgtcttagacccgaaggaaaagcagaaatacacggacatggcgaaggaatacaaggatgcatttatgaaggctaatccaggctacaagtggtgtcccaccacaaataagcctgttaagagtccaacaccaactgtgaacccaagaaagaaactttgggctttcccgagcgattcctcgcgggacctgccctctcctaagaaagccaaaacggaggagatgccacagctcaactttggaatggctgaccctacacagatgggggggctgagcatgctcttactcgctggtgaacacgcattaggcacccctgaagtgtcaagcgggacctgccggcccgacgtaagtgagtcacctgaactgaggcagaaaagccccttattccagtttgctgaaatttctagctccacctcgcactcagacgcctcaaccaagcagtgtcaaacttctgcactcttccagtttgctgagatttctagcaatacctctcaactgggaggagcagagcccgtcaagcggtgtggaaaatcagcactgtttcaactcgcggaaatgtgcttggcaagcgagggcatgaaaatggaggaatccaaattgataaaagcaaaagaatccgatgggggcagaattaaggaacttgagaaaggaaaagaagagaaagagattaaaatggaaaagacagacgagactagactccagaaggaggctgaatttgagaagtctgccaaggagaacctcagagactccaaggagctgagaaacttcgaagctttacagatcgacgatattatggcaattaagatggaggaccccaaagagatccggaaagaggagctggaggaggatcataagtgctcccacttccccgatttcagctattcagcaagcagcaaaatcattatcagcgatgtgccctcccggaaggaccatatgtgtcacccacatggaatcatgatcattgaagaccccgcagctctgaataaacccgagtag

SEQ ID NO: 18759 - DNA, 2736 bp, Artificial Sequence
  Description of Artificial Sequence: Synthetic coding sequence
atgaagggcagcaaccggaacaaggaccacagcgccgagggcgagggcgtaggtaaaaggccaaaaagaaagtgcctacagtggcaccctctactcgccaaaaagctgctagatttttctgaagaagaggaagaggaggacgaggaggaagacattgacaaggtccagctcctgggtgctgatggcctcgagcaggatgtgggggaaaccgaggatgacgagagtccagagcagcgggccaggaggcccatgaacgccttcttactcttctgcaaaaggcacaggagcctagtgcgacaagagcatcctcgactggataataggggcgcgacgaagatcctggccgactggtgggctgtgctcgacccaaaggagaagcagaagtacacagacatggcgaaggaatacaaagacgctttcatgaaagcaaatcccgggtacaaatggtgcccaacgactaacaaacccgtaaaatccccaacacccacagtgaacccccgcaagaagctgtgggccttcccatcggacagctcaagggatcttccgtctccgaaaaaagcaaagaccgaagaaatgcctcagctgaacttcggcatggctgatccaacccagatgggtgggctgtctatgttgctgcttgcaggcgagcatgccctgggtaccccggaggtgagtagtgggacttgtagaccggacgtgtcagagtcacccgaactgagacagaaatcaccgctttttcagttcgccgaaatctcaagttctacatctcacagtgatgccagcaccaagcagtgtcaaaccagcgccttgttccagtttgcggagatttcatcaaatacgagccagctggggggggcggagcctgtgaagcgctgtggtaagagtgccctgtttcaattagccgaaatgtgcctcgcatccgaggggatgaaaatggaagagtctaagctaattaaagccaaggaaagtgatggaggtcgcatcaaggaactggagaaagggaaggaagaaaaggaaataaaaatggagaagacagatgaaactcggctacagaaggaggccgaattcgaaaagtcggctaaggagaacctgagggactctaaggagctgcggaactttgaagccctacaaatcgacgacatcatggcgattaagatggaggatcctaaagaaattcgaaaggaggaattagaggaggaccataaatgtagccacttccccgatttctcttattctgctagtagcaagatcatcatcagcgacgtgccatcccggaaggaccatatgtgccacccccatggtattatgataatcgaggatcccgccgctctgaacaaacctgagaagctcaaaaaaaagaaaaaaaagtctaagatggacagacacggaaacgacaagagcacgcccaaaaagacctgcaagaagcgccaaagctcagaaagcgacattgagtctgtgatctacaccatcgaggctgtggcaaagggagactggggcatcgaaaagctcggcgacaccccccggaaaaaagtaagaacgagctcttctgggaaaggaagcattctcgatgctaagccgcctaaaaaaaaggtgaaatcccgcgagaagaaaatgtctaaggaaaaaagcagcgataccacaaaagaatctcgtccgccggacttcattagcattagcgcctctaaaaacatcagcggagagactccagagggcatcaaagctgagcctctgacccctatggaggacgccttgccgcctagtctctctggccaggccaaacccgaagacagtgactgtcaccgcaagattgagacatgtggttcgcgcaagtccgagagatcttgcaagggggcactgtataagaccttagtctcggagggaatgctgacatcactccgggctaacgtggacagaggaaaaagaagcagtggaaaaggaaatagcagcgaccatgaggggtgttggaacgaagagagttggaccttctcacaatcgggcacctcaggctccaagaaattcaagaagactaaacccaaggaagattgtttgctggggtcggctaaactggacgaagaattcgaaaagaaatttaactcattacctcaatacagccccgtgaccttcgacaggaagtgcgtgcccgtgcctaggaagaagaagaaaacgggaaatgtatcttccgagccaactaaaactagcaagggatcaggcgacaaatggagtaacaaacaattgttcttggatgccattcatcccacagaggcaatcttctcagaagaccgcaacactatggaacctgtccacaaggtaaagaatataccaagcatctttaatacccccgaacccacaacaactcaagagcctttagtggggagccagaaaaggaaggctagaaagacaaaaattacacacctcgtccgcaccgcagatgggcgtgtgtctccagcgggcggtactcttgacgacaaacccaaagagcagctccagaggtcactgccaaaggcgaccgaaaccgattgcaacgacaaatgctcccacaatacagaagtcggagagactaggtcctctactccagaaatgcctgctgtctctgctttcttctctctggccgccttggcagaggtggccgcaatggagaacgtgcatcggggtcagagaagtactccacttacacacgacggacagccaaaggagatgcctcaggcccctgtgctcatatcctgcgcggatcagtag

SEQ ID NO: 18760 - DNA, 450 bp, Artificial Sequence
  Description of Artificial Sequence: Synthetic coding sequence
atgaagggcagcaaccggaacaaggaccacagcgccgagggcgagggcgtggggaaacggccaaagcgcaaatgtctgcaatggcaccctctgcttgccaagaaactgctggactttagcgaggaggaagaagaagaagacgaggaggaagacatcgacaaggtccagcttctcggcgccgatggacttgaacaggatgtaggggaaaccgaagacgacgagtcacccgagcagcgtgccaggcgaccaatgaacgccttcttgctcttctgcaaacgccaccggtcactggtgcgtcaagaacacccgcgcctggataatagaggtgctactaagatcttagccgactggtgggctgtcctcgaccctaaggagaagcaaaaatataccgatatggccaaagaatacaaagatgccttcatgaaggctaacccggggtataagtggtag

SEQ ID NO: 18761 - DNA, 2736 bp, Artificial Sequence
  Description of Artificial Sequence: Synthetic coding sequence
atgaagggcagcaaccggaacaaggaccacagcgccgagggcgagggggtcggcaagcgtcctaagcgaaagtgcctgcagtggcatcccctcctggctaagaagctgcttgattttagtgaagaggaggaggaagaagacgaggaagaagacatcgacaaagtgcaactgttgggtgccgatggattggaacaggacgtgggcgagaccgaggatgacgaaagccccgagcaacgtgcccgccgcccgatgaatgcgtttctcctcttctgcaaacggcacagaagcttagtgagacaggagcatccgcgactagacaataggggcgcgaccaagattctggcagattggtgggcagttctcgaccctaaagagaagcagaagtacactgacatggcaaaggagtataaggacgctttcatgaaggccaaccccggatataagtggtgccccacgactaacaagccagtcaagtcaccaacaccaactgtgaatccgcggaaaaaactgtgggcattcccgagcgacagttcgcgggacctcccatcccctaagaaagccaagacggaggaaatgccacagctgaatttcggtatggccgaccccactcagatggggggcctgagcatgctgctgcttgcgggggagcacgcattgggcacccctgaggtcagttccggcacctgtagacctgatgtgagcgagtcacctgagctacggcagaaaagcccgttatttcagttcgcagaaatttctagctcaacatcgcactctgacgcttcaactaagcagtgccaaacctctgcgttattccagttcgccgaaatcagttcaaatacatcgcagctcggcggtgcggaacctgtgaagagatgcggtaaatcggcactgttccagctcgccgaaatgtgtctggctagtgaaggaatgaagatggaggagtcaaaactcataaaggccaaggagtcagatggaggcagaattaaagagttagagaagggaaaagaggagaaagagatcaaaatggaaaaaaccgatgagacaagactccagaaggaagcagagtttgaaaagtccgccaaggaaaacctcagagacagcaaggaacttagaaatttcgaagcattgcaaatcgatgacattatggcgatcaagatggaggacccaaaggaaatacggaaagaagagttggaggaggaccataagtgcagtcacttccctgacttctcttattccgcctcaagcaaaatcatcatatcagacgttcctagtcgtaaagatcatatgtgccacccccatggcataatgatcattgaagatcccgccgctctaaacaaacctgaaaaactgaaaaagaaaaaaaagaaatcaaagatggataggcacggcaacgataaaagtaccccaaaaaagacttgtaaaaagcggcagtcttcagaatcagatattgaatctgtgatttacaccatcgaggcagttgcgaagggggattggggcatagaaaagttgggcgataccccccgtaagaaagttagaacatcaagcagtggcaagggcagcattctggatgccaagcccccgaagaaaaaggtgaagtctcgggagaaaaaaatgagtaaagagaagtcctctgatacaacaaaagaatcccggccaccagactttatcagcatttctgccagtaagaatatctctggagagaccccagaaggtatcaaagcggagcctctaacacccatggaggatgcactgccaccttccctctctggccaagctaaaccagaggactccgactgccataggaaaattgagacttgtggcagccgcaagagcgaacggagttgcaaaggagcattatataaaaccctggtgagtgagggaatgttgactagcctacgagccaacgtggacaggggaaaaagatcaagcggcaaaggaaactcctccgaccacgaaggatgctggaatgaggagtcgtggacgttctcccaatccggaacctctggaagcaaaaaatttaagaagaccaagcccaaggaagactgcttattgggttcagctaagcttgacgaagaatttgaaaagaagtttaacagtctgcctcagtacagcccagtcacattcgatagaaagtgcgtgcccgttcctcgtaaaaagaagaagacaggcaacgtgtcttccgagccaaccaagacatctaaggggagtggggataaatggtctaataagcaactgtttttggatgctattcatccaacagaggccatcttttccgaggacaggaacaccatggaacccgtccacaaagttaaaaacatcccttcgatcttcaacactcctgaacccactacaacacaggaaccccttgttggcagtcagaaacggaaagcccgcaaaaccaaaatcacacacctcgtacgcaccgccgatgggcgtgtcagtccagccgggggaactttagatgataagcccaaggagcaactccagcggtctctgcccaaggcaacagaaaccgactgtaacgacaagtgttctcacaatacagaggtgggagaaacacgcagctccaccccggagatgcctgctgtcagtgcgttcttctctcttgcagctctcgcagaggtagccgctatggagaatgttcaccggggacagaggtctacccccctgactcacgacggacagcccaaggaaatgccgcaggcccccgtgctcatttcttgcgccgaccagtag

SEQ ID NO: 18762 - DNA, 75 bp, Artificial Sequence
  Description of Artificial Sequence: Synthetic coding sequence
atgaagggcagcaaccggaacaaggaccacagcgccgagggcgagggagtgggcaaaagaccaaaacggaagtag

SEQ ID NO: 18763 - DNA, 582 bp, Artificial Sequence
  Description of Artificial Sequence: Synthetic coding sequence
atgaagggcagcaaccggaacaaggaccacagcgccgagggcgagggggttggaaaacggccgaagagaaagtgtttgcaatggcatcctttgctagccaagaaattattagatttcagcgaagaagaggaagaggaggacgaagaagaggatatcgataaggtgcaattactgggagctgacgggttagagcaggacgttggtgaaaccgaagacgatgaatctcccgaacaacgagctcggcggccaatgaatgccttcctgctgttttgtaaacgacaccggtcactcgttcgccaggagcatccccgcctggataacagaggcgctacaaagatattggccgattggtgggccgttttggatcctaaagagaaacagaagtacaccgatatggcaaaagagtacaaggatgcattcatgaaggccaaccccgggtacaaatggtgtcccacaactaacaagccagtgaaaagccctaccccaactgttaacccgagaaaaaaattatgggctttccctagtgactctagcagagatttgccatcccctaaaaaagccaagactgaggagatgccatag

SEQ ID NO: 18764 - DNA, 501 bp, Artificial Sequence
  Description of Artificial Sequence: Synthetic coding sequence
atgaagggcagcaaccggaacaaggaccacagcgccgagggcgagggcgtgggcaagcgccctaagcgaaaatgtctccagtggcatccactgctagccaaaaaattgctcgactttagcgaagaggaggaggaagaagatgaggaagaggatatagacaaggttcaactattgggagccgacggactggaacaggacgttggggagactgaggacgatgagagcccggagcaacgcgcacgccgacctatgaacgcctttctcctcttttgcaagcggcatcggagcttggtccggcaggaacatccgcgactggacaacagaggcgctacaaagattctggccgactggtgggccgtcctagaccccaaagagaaacaaaagtatactgacatggcaaaagagtacaaagacgcattcatgaaagccaatcctggttacaagtggtgcccgactacaaacaagcccgtgaaatccccaaccccgacagtcaatccatag

SEQ ID NO: 18765 - DNA, 312 bp, Artificial Sequence
  Description of Artificial Sequence: Synthetic coding sequence
atgaagggcagcaaccggaacaaggaccacagcgccgagggcgagggagttggcaagcggcccaagcgaaaatgcctgcaatggcaccctctgctcgctaagaagttgctggacttctcagaggaggaggaagaggaggacgaggaggaagatatcgacaaagtacaacttctgggagcggatgggctggagcaagacgtgggcgaaactgaagacgacgaatccccggagcagcgcgcccgtagacctatgaatgcgtttctgctcttctgtaagcggcataggagcctggtccggcaggagcacccctag

SEQ ID NO: 18766 - DNA, 480 bp, Artificial Sequence
  Description of Artificial Sequence: Synthetic coding sequence
atgaagggcagcaaccggaacaaggaccacagcgccgagggcgagggagtcggcaagcgacctaagcgaaagtgcctacagtggcaccctctcttagccaaaaaactgcttgacttttcagaggaggaggaagaggaagacgaggaagaagacatcgataaggttcagctgctcggcgcagatggtcttgaacaggatgtgggggagacagaggacgatgagtctccagagcaaagagccagaaggccgatgaatgcattcctgctcttttgcaagcgacatcgatccctggtgagacaggagcaccctagactcgacaatcgcggagccacaaaaattcttgccgattggtgggcggttttggaccctaaagagaagcaaaaatatacagacatggcaaaggagtataaagacgcatttatgaaggctaatcctggctacaaatggtgtccaactactaacaagcctgtaaagtcctag

SEQ ID NO: 18767 - DNA, 345 bp, Artificial Sequence
  Description of Artificial Sequence: Synthetic coding sequence
atgaagggcagcaaccggaacaaggaccacagcgccgagggcgagggcgtgggaaagagacctaagcgaaagtgcctacagtggcacccattactagctaaaaagcttctcgatttttctgaggaggaagaagaggaagatgaggaagaagacattgacaaagtccaactcctgggcgcagacggactggagcaggacgttggagaaaccgaggacgacgagagcccagaacagcgagcacgccgacctatgaatgccttcctgttattctgcaagcgccaccggtcactcgtacggcaggagcatccaagactggataataggggagccaccaagatcctgtag

SEQ ID NO: 18768 - DNA, 435 bp, Artificial Sequence
  Description of Artificial Sequence: Synthetic coding sequence
atgaagggcagcaaccggaacaaggaccacagcgccgagggcgagggagtcggaaaacggccgaagaggaagtgcctgcagtggcatcccctgcttgcaaaaaaattgctggactttagcgaggaggaggaggaggaggacgaagaagaagatatcgataaagttcaactactgggggcagatggactcgaacaagatgttggagaaactgaagacgacgagtcgcctgagcaaagggccaggaggccaatgaatgcatttctgctattttgtaaacgtcacaggtcacttgttaggcaagaacatccacggctcgacaatcggggagccacgaagatcctggccgattggtgggcggtattggaccctaaggagaaacagaagtatactgacatggcaaaggaatataaggacgcttttatgaaggcgaactag

SEQ ID NO: 18769 - DNA, 42 bp, Artificial Sequence
  Description of Artificial Sequence: Synthetic coding sequence
atgaagggcagcaaccggaacaaggaccacagcgccgagtag

SEQ ID NO: 18770 - DNA, 618 bp, Artificial Sequence
  Description of Artificial Sequence: Synthetic coding sequence
atgaagggcagcaaccggaacaaggaccacagcgccgagggcgagggcgtggggaaacgaccgaagaggaaatgtttgcagtggcatccgctgttagcgaagaagctgttggactttagtgaagaggaggaagaggaagacgaagaggaagacatcgataaggtgcagttgctcggtgccgacggacttgaacaagacgtaggcgaaaccgaggatgacgaaagtccagagcaacgggcccggcgcccaatgaatgcatttcttctgttctgtaaacgacacagaagcctggttcggcaggaacacccaaggctggacaacaggggcgccacaaagatcctagctgattggtgggccgtgctcgaccctaaggaaaagcagaaatataccgacatggcaaaagagtacaaggatgcatttatgaaagctaatccagggtataagtggtgtcctacaactaacaagcctgttaaaagtccgacacctaccgtcaaccccaggaagaagttatgggccttccccagtgatagctccagagatctcccaagcccaaaaaaagccaaaacagaagagatgccacaacttaatttcgggatggctgaccctacacagatgtag

SEQ ID NO: 18771 - DNA, 216 bp, Artificial Sequence
  Description of Artificial Sequence: Synthetic coding sequence
atgaagggcagcaaccggaacaaggaccacagcgccgagggcgagggagtggggaaacgccccaagagaaaatgcctgcaatggcatcccttgctggctaagaaactgctagatttttctgaagaggaagaagaggaagatgaggaggaggacattgacaaggtgcagttattaggagccgacggattggaacaggatgtaggcgaaacagagtag

SEQ ID NO: 18772 - DNA, 258 bp, Artificial Sequence
  Description of Artificial Sequence: Synthetic coding sequence
atgaagggcagcaaccggaacaaggaccacagcgccgagggcgagggcgtcgggaagaggcccaaacgcaagtgtttacagtggcatcctctactcgcaaaaaagctcctggacttcagcgaggaggaggaggaggaggacgaagaggaggatattgacaaggtgcagctgctgggcgccgacggcctggaacaagacgtcggggaaaccgaggacgacgagagtccagaacagcgcgcacgtagaccaatgaactag

SEQ ID NO: 18773 - DNA, 297 bp, Artificial Sequence
  Description of Artificial Sequence: Synthetic coding sequence
atgaagggcagcaaccggaacaaggaccacagcgccgagggcgagggggtggggaaacgccctaagcgtaaatgtctgcaatggcacccactcttagccaagaagctcctggacttctctgaggaggaggaggaggaggatgaagaagaagatattgataaagttcagctgcttggggccgatgggctggagcaagacgttggcgagacggaggatgacgagagtccggagcagagggctagaaggccaatgaacgcctttctgctcttttgcaagaggcaccgctctcttgtgtag

SEQ ID NO: 18774 - DNA, 2466 bp, Artificial Sequence
  Description of Artificial Sequence: Synthetic coding sequence
atggaccccgagtgcgcccagctgctgcccgccctgtgcgccgtgctggtagacccacgacagcctgtagctgatgatacatgccttgaaaagctcttggattggttcaaaacagtcacagaaggcgagagcagcgttgtcttacttcaggagcacccatgtcttgttgaactgctgagtcatgtactcaaagtgcaagacttgagctcaggagtcctcagcttttctctaagactggctggaacattcgccgctcaggaaaactgtttccagtatctgcagcagggcgaactcctgccaggcctgttcggagagcctggtcctctgggcagagccacttgggccgtgccaacagtacgatccggctggatccaggggttacggagcctcgcccagcacccaagcgctctaaggtttctcgcagatcacggggctgtggacacaatcttttcactgcagggcgatagctctttgttcgtcgcatccgcggcttctcagctgctcgtccacgtacttgccttaagtatgagagggggcgccgaagggcagccctgccttccgggtggcgactggcccgcttgcgcccaaaaaattatggatcacgtcgaggagtccctgtgttcggccgcgacgcccaaagtgacacaagctctgaatgttctgacaacaacatttgggaggtgtcaaagtccttggacggaggctctctgggttaggttgtccccaagggtggcctgtctactggaaagggaccccatcccagcggcccattcatttgtggatcttttgctgtgcgtggcaagatccccagtgttcagttcttctgatggaagcttgtgggaaaccgtcgctcgcgcactgtcatgtcttgggccaacacacatgggcccattggcgctggggatactgaaactcgagcattgccctcaggctctccgcacccaagcatttcaggttctcttgcagcctctagcatgtgtactgaaggctaccgtgcaagctccaggtcctccaggtctccttgacggcacggcggacgatgcaaccacggtcgacacactgctggcatcgaagtcctcttgtgcagggctgttgtgcagaacgctcgcccacttggaggagctccaaccgctaccccaacgaccatctccgtggccacaggccagtctgctgggcgccacagttactgtgctgagattgtgcgacgggagtgcagcacccgcatcttcagtggggggccacctttgcggcacattggccggctgcgtgcgcgtgcaacgagccgcccttgattttctgggcaccctgtcacagggcactggcccccaggaactggttacccaggcgttggccgtgttactagagtgcctagaatctcccgggtcatctcctaccgtactcaaaaaagctttccaagcaacactaaggtggctcttatcctcaccaaaaactcccggatgctctgaccttggcccgctcataccccagttccttcgggagttgttccccgttctacagaaaaggctatgccacccctgttgggaggtcagagactcagccctggagttcctcacccaactgtcgcggcattggggggggcaggccgatttccgctgtgcccttttagccagcgaggtcccgcagctggccttacaacttctgcaagacccagaatcctacgtgcgagcttcagcagtcacagcaatgggacaactctcttctcaaggccttcatgcgccaacctctcctgagcatgcggaggcccgccagagcctctttctggagctgctgcacatcttgtcagtcgactcagaggggttcccccgtcgagccgtgatgcaagtgtttacagaatggctgcgcgacggtcacgccgacgccgcccaggataccgagcagttcgtggcaaccgttttgcaggcagccagtagagacttagactgggaagtgagggctcaggggctggagttggcgctggttttcctgggacagactctggggccgccaaggacccactgcccatacgccgtggccttacccgaagtggctcccgcccaacctttaacagaagccttaagagcactgtgccacgtgggtttattcgatttcgcattctgcgctctcttcgattgcgataggcccgtggcccagaagtcttgtgatctcttgctgttcctgcgtgacaagatcgcgagttactctagcctgcgtgaagcccggggcagtcctaatacagcttcggccgaagccacccttcccaggtggcgtgctggtgaacaagctcaacctcccggagatcaagagccagaagctgttctggccatgctcagatctcttgatctggaggggctcagatctacactggcggaaagttccgaccacgttgaaaagagcccccagtccctgttacaagatatgctggctaccggcggcttcttgcagggcgatgaagccgattgttattag

SEQ ID NO: 18775 - DNA, 720 bp, Artificial Sequence
  Description of Artificial Sequence: Synthetic coding sequence
atggccaagccctgcggcgtgcggctgagcggcgaggcccggaagcaggttgaggtatttaggcagaatctgttccaggaggctgaagaatttctctatagatttctgcctcagaagatcatctatctgaaccagttgctccaggaggatagtctcaacgtcgccgacctcacctcgcttcgagctccactcgatattccgatccctgacccgcctcctaaggatgacgagatggaaactgacaagcaggagaagaaagaggttcataaatgcggattcctcccgggtaacgaaaaagtgttatccctgcttgctcttgtgaaacccgaggtctggactttaaaagagaaatgtattcttgtgattacatggattcagcatctcattcccaagatcgaggatgggaacgacttcggcgtggcaatacaagagaaggttctggagcgggttaatgcagtgaaaaccaaggtcgaagctttccaaacaacaatcagtaaatacttcagcgagcgaggcgacgccgtcgctaaagcttctaaggaaacccatgtaatggactacagagccctcgtgcatgagcgggacgaagcagcctacggggagctgcgggccatggtgttggatctaagggccttctatgcggaactttaccatatcatttcgagtaatctggagaagatcgtcaaccctaagggagaggagaagccctccatgtactag

SEQ ID NO: 18776 - DNA, 828 bp, Artificial Sequence
  Description of Artificial Sequence: Synthetic coding sequence
atggacgacgaggactgcgagcggcggcggatggagtgcctggacgaaatgagcaacttagaaaagcagttcaccgacctgaaagaccagttgtacaaggaaaggctgtcacaagtggacgcaaagctgcaagaggtgatcgcgggcaaagcccccgaatatctagagcccctggcgaccctgcaggagaacatgcagatcagaacgaaggttgccggaatctacagggagctatgtttggagtccgtgaagaacaagtatgagtgcgagattcaggcttcacggcagcactgcgaaagcgaaaaacttctgctgtacgataccgtgcagagtgaattagaggagaagattcggcgtctggaagaagatcgccatagtattgatatcacctccgaactgtggaacgacgaactgcaatctcgcaagaaacggaaagacccattctcaccagacaagaaaaaacccgttgtggtgtctggcccgtatatcgtgtatatgcttcaggatcttgacatcctggaggactggacaactattcgaaaggccatggccacacttggccctcaccgggtgaagactgagcctcccgtcaagctggaaaagcatcttcactccgcacgttccgaagaggggagattgtattacgacggtgaatggtacattagaggccagaccatttgtattgataaaaaggacgagtgccccaccagcgccgtgattacaaccatcaaccacgatgaggtttggtttaaacgacccgatggatcaaagagcaagctctatatcagtcagctgcagaaaggcaaatattccatcaagcattcgtag

SEQ ID NO: 18777 - DNA, 1614 bp, Artificial Sequence
  Description of Artificial Sequence: Synthetic coding sequence
atgggcgccaccggcgccgccgagcccctgcagagcgtgctgtgggtgaagcagcagcggtgcgccgtgtcgttagagcccgccagagcactgcttcgctggtggcgaagtccaggacccggagccggggcccccggagctgacgcgtgcagcgtgccagtgagcgagataatcgccgtcgaggaaacagatgtacacggcaagcaccagggctctggaaagtggcagaaaatggagaagccctatgcctttacagtccattgtgtgaagcgcgctcgcagacacagatggaaatgggctcaggtgactttctggtgccccgaggagcagctgtgtcacttgtggctgcaaacgttaagggaaatgttggagaagctgactagccgcccgaaacaccttttagtgttcatcaaccccttcgggggcaagggccagggaaaacggatttatgaacgaaaagtagcccctttatttaccctcgcttccatcacaacggatatcattgtgacggagcacgccaaccaggcaaaggaaaccctgtacgagatcaatatcgacaaatatgacggaattgtatgcgttgggggggatggaatgtttagcgaggtgctccacggtctcatcggaagaacacagaggagtgctggcgttgaccaaaaccaccctcgggccgtcctggtgccgagctccctgcgcatcgggatcatcccagcaggttctacagattgcgtttgttacagcaccgtggggaccagtgatgcagagacaagcgcactccacattgttgttggcgattccctggccatggatgtgagctcagtccaccataacagtacactactaaggtacagtgtttcccttctcggctacggattttacggagatattatcaaagatagtgagaagaaacgatggctgggtctggcccgttacgacttttctggattaaaaacattcttgtcacaccattgctacgaggggacagtgtcatttttaccagcccaacatactgtgggttccccccgggacaggaaaccctgccgtgcggggtgttttgtatgccggcagagtaaacaacagttggaagaagagcagaaaaaggcactgtacggattagaggccgcggaggacgtggaggaatggcaggtggtttgcgggaaattcctcgcgattaacgccacaaacatgagttgtgcttgccgacgatcaccaaggggactatcgcccgcagcgcacctgggagacgggtcctctgatttaatcctgatcagaaaatgtagtcgattcaatttcctccggttcttaatccgccataccaatcagcaggatcagttcgattttacctttgttgaagtataccgagttaagaagttccagttcacttcgaagcacatggaggatgaggacagtgacctgaaagagggggggaagaagcggttcggacatatctgctccagccaccctagctgctgttgtaccgtctctaattctagttggaactgcgatggcgaggtactgcactcaccagccatcgaggtacgagtgcattgtcaactcgtgcggctctttgctcggggaatcgaagagaatccaaagcctgatagccattcctag

SEQ ID NO: 18778 - DNA, 2355 bp, Artificial Sequence
  Description of Artificial Sequence: Synthetic coding sequence
atgcagagccggaagtgcctgaagcgggactgcgaccagcaggccgatggcctgtgtcgtttcggttccttcgactgctttcgctcctcacgtcgcagcagcagcacgacacgagcgtggacctctgcctctcggacacgaacatccgataggctgaatagaattgcaaatcaggttgcaatccagcgcaagaagcagtttgttgagcgggcccacagctactggctcctgaagaggctgtcccgtaacggcgctccactcctccgccggctgcagagctcattgcaatcacagagatcttctcagcaaagggagaacgatgaagagatgaaggccgcaaaggagaagctaaagtactggcaacggctacgccacgacctcgaacgcgctaggcttttgatcgaattacttagaaagagggaaaaactcaaacgggaacaagttaaggtagagcaggtggccatggaactgagactgacaccattaacagtgctgctcagaagcgtgctggaccagttacaggacaaggaccccgcacgtatattcgcccagccagtcagcctcaaggaggttcctgattacctggatcacatcaaacaccccatggattttgccaccatgcgtaaaagactcgaggcccagggttacaagaatttgcatgaattcgaggaggatttcgacctgatcatcgacaattgcatgaaatataatgctagggataccgttttttaccgtgccgccgtccggcttagggaccagggcggcgttgttctgcgccaggctagaagggaggttgacagcattggtctcgaagaggcttcagggatgcaccttcctgaacgacctgccgccgctccgaggcgccccttcagctgggaggacgtcgaccggctgctggaccccgcgaatcgggcccacttgggcttggaagagcagttgagggaacttctcgatatgctagatttgacctgcgctatgaagagctcaggctctagatctaaacgggccaaacttctgaaaaaagagattgcactcctgagaaacaaactgagccagcagcattcacagccacttccaacagggccgggactcgaggggtttgaggaggatggggcagcccttgggcctgaggctggtgaagagggagacaagagcccaccaaaactagaaccatccgacgctctccccttgccaagcaatagcgaaaccaattcagagccgcctaccctgaagccagttgagttgaacccagagcagtctaagctttttaaaagggttacattcgacaatgaaagtcactccgcatgtacacagagtgccctcgtgagtggacggcctccggaaccaactagagcatcttccggagatgtccccgccgctgctgcatcagcagtcgctgagcccgcctcggatgtgaacaggcggacctcagtgcttttttgcaaatcgaagtccgtgagtcctccgaaatcagctaagaatacggagacccagcccacttctccgcaacttgggaccaaaactttcttgtcagtagttcttcctagattggaaacactgttacagccaagaaagagatctcgatccacttgcggagacagtgaagttgaggaggagagccccgggaagaggctcgatgccggcttgaccaacggcttcggcggcgctcgctctgagcaagaacctggtggagggcttggtcgcaaggccacccctagacgacgctgtgccagcgagtcgagcatctcctcctccaactcaccactgtgtgacagttctttcaatgctccaaagtgtggacgggggaaacccgctctggtgcgccgccatacattggaggaccgttccgagttgataagctgtatagagaatggaaactacgccaaggctgctcggatcgctgccgaggtgggccagagctctatgtggatctcaacagacgctgccgcctccgtgcttgaaccactgaaggtggtttgggcaaagtgcagtggataccccagctaccccgcgttaattattgatccaaaaatgcctagagtcccaggccaccacaacggagtgaccatcccggctcccccactcgacgtcctcaagataggcgaacatatgcagaccaagtcggacgaaaaattatttctcgtactcttctttgataataagagatcttggcagtggttgcccaaaagcaaaatggtgcccctgggcattgacgaaacgatcgataagctgaaaatgatggaaggccgcaacagctctataaggaaagccgttagaatcgcttttgaccgcgccatgaatcatttaagccgcgtccacggagaaccaacctccgatctctccgacatagactag

SEQ ID NO: 18779 - DNA, 3177 bp, Artificial Sequence
  Description of Artificial Sequence: Synthetic coding sequence
atgcggcggaagggccggtgccaccggggcagcgccgcccggcacccttctagcccgtgctcagtcaaacactcgcctactagggagactctcacttatgcccaggcacagagaatggtagaaatcgaaatagaggggcgactacacagaatctctatatttgaccctctcgagataatactagaagacgacctgacagcacaggaaatgagcgagtgtaattccaacaaagagaactcagaacgtcctcctgtttgtctccgtacaaagaggcataagaacaatcgcgtgaaaaagaaaaatgaggccctgccaagcgcccacggcacacctgcatctgctagtgcgttaccggaaccaaaagtgaggatagtggagtatagtcctccgtctgcaccacggcgaccccccgtgtactacaaattcattgaaaagtcagcagaggagctagacaatgaggtggaatacgacatggatgaagaggactacgcctggctcgagattgtgaatgaaaaacgcaaaggggactgcgtaccggctgtgtcccagtcaatgttcgaatttttgatggaccggttcgagaaagaaagccattgtgagaaccagaagcagggagagcagcagagcctgatcgatgaagacgccgtttgctgtatttgtatggatggggaatgtcagaattcaaacgtgatactgttctgcgatatgtgcaacctggccgtccatcaggaatgctacggggtcccgtacatccccgaaggccagtggctctgcaggcactgccttcagtcccgggcacggcctgccgactgtgttctgtgtccaaacaaaggaggcgccttcaaaaaaaccgacgatgaccgatgggggcacgtggtctgtgcgctgtggattcctgaggtgggatttgcaaatactgtcttcatcgagccaatcgatggagtccgcaacatccctccagccaggtggaagcttacgtgctacctgtgcaaacagaaaggggtcggggcatgtattcaatgccacaaggcgaactgctacacagcctttcatgttacttgcgcccagaaagctggattgtacatgaagatggagccagtcaaagagttgacagggggaggcactacctttagcgttaggaagacagcttattgcgacgtacatacccccccaggatgcacaagaaggcctctgaatatttatggggacgtagagatgaaaaacggagtttgccgcaaggaatcctcggtgaaaactgttcgttccacttctaaggtccggaagaaagccaagaaagctaaaaaggctctggcagaaccatgtgcggtgctgcccaccgtttgcgccccttacatcccaccccagagactgaatcgcatcgccaaccaggtggccattcagaggaaaaagcagttcgtggagcgcgcccattcttattggctgctcaagcgtctgagtaggaatggcgccccactactgaggagactgcagtcatcactgcaaagtcagcggagcagtcaacagagggaaaatgatgaggagatgaaggccgcaaaggaaaaattaaagtactggcagagactgagacacgacctggagcgggcccggttgcttatagagctcctgcgtaagcgcgagaagctaaaacgtgagcaagtaaaggtggagcaggtggctatggaactgagattgaccccattaacggtcctgctaagatctgtgttggaccagttacaggacaaagatcctgccaggatatttgctcagccagtctctcttaaggaggtgccagactacctggatcacattaagcacccaatggacttcgcgactatgcgcaagagactggaggcgcagggctacaaaaatttacacgaatttgaggaggacttcgacctcattattgataactgtatgaaatacaacgcgcgtgatacagtcttttacagggctgctgtccgcctgcgtgaccagggtggcgtggtgctccggcaggcgaggcgggaagtggacagcatcggactcgaagaagccagtggcatgcaccttcctgagcggccagccgccgctccaagaaggcccttttcctgggaggatgtggataggctgctggaccctgccaatagagcccatctgggattggaggagcaacttcgagaattgctagacatgctggatctgacatgtgcaatgaagtcatcagggagtcgcagcaagagggctaaactgctaaagaaagaaatcgcccttctccggaacaaattaagccagcagcatagccagccgctgcctacggggcctggtctcgaaggattcgaggaggacggagcggctctcggacctgaggcgggggaggaggttctgccacgcctggagaccctattgcagccccgcaagagaagcaggtctacatgcggggactctgaggtggaggaggaaagtcccggcaagcgcctcgatgcagggctcactaatggattcggtggtgcacggagcgagcaggagcccggcggtggcctggggaggaaagccacccctaggcgtagatgcgcctccgagtccagcatttccagctcaaatagtcccctttgtgattctagcttcaatgccccaaaatgcggccggggtaagccagctctggtgcgacgacataccttggaggataggtctgagttaatctcctgtatagaaaatggcaattacgccaaagccgccaggatcgccgccgaagtaggacagagtagtatgtggattagtaccgacgccgccgcgtcagtcctggaaccactgaaagtggtgtgggctaagtgcagtggctatcctagttaccctgcattgattattgatcccaaaatgcctagggtgccaggtcaccataacggtgtgacaattcccgcaccaccactggacgtcctcaagatcggagaacacatgcagacaaaatcagacgaaaaattgttcttggtattattctttgataataaacgtagctggcagtggctgccaaaatctaaaatggttccactgggaatagatgaaaccattgataagctcaagatgatggaaggccgcaacagctcaatccggaaagctgtgcggattgccttcgacagagccatgaaccatctgagccgtgtccatggggaacccacttcagacctgtccgatatcgactag

SEQ ID NO: 18780 - DNA, 1950 bp, Artificial Sequence
  Description of Artificial Sequence: Synthetic coding sequence
atgaaggccgccaaggagaagctgaagcgggagcaggtgaaggtggagcaggtcgctatggaactgaggctgacccctctcaccgttctgcttagaagcgtcttggaccaattgcaagacaaggatcctgcaagaatatttgcacagcccgtgtcactgaaagaggtgcctgactatctggatcacattaagcatccaatggatttcgccacaatgcggaagcgactcgaagctcagggctacaagaacctgcacgagttcgaagaggattttgatctgattatcgacaactgtatgaagtataacgcccgcgatactgttttttatagagccgccgtcagactccgggatcagggaggcgtggttctgagacaggcgcggcgggaagtggactcgatcggtctggaagaggcctccggaatgcaccttcccgaaagaccagcggcggcacctagacggcccttcagctgggaggatgtcgataggctgttggatccggcaaaccgggcacatttgggccttgaggaacaactgcgggagctgctggacatgctggatttgacatgtgccatgaaatcaagcggatctcgcagcaagcgggccaagctgcttaagaaagagatcgcccttctgaggaacaagttgtcgcagcagcattcccaaccactccctacgggccctgggttggaagggttcgaagaggacggcgcggctttggggcctgaggcaggcgaggaaggtgacaagagcccgccaaaactggagcccagcgacgcactgcctctcccctctaatagcgagaccaactccgaacccccgacactgaaacccgtcgaactcaaccccgaacagagcaagttgtttaagcgcgtcacattcgacaacgagtcccattccgcatgcacccagtcagccctggtgtcgggcagacctcccgagcctacccgcgcctcttctggggacgttcctgcagccgccgcttctgcagtggctgaaccagcaagcgacgtgaatagacgaacgagcgtgcttttctgtaagtcaaaaagcgtgtcacccccaaaatccgctaagaatactgagacacagcccacatcaccacagttgggtaccaagaccttccttagtgtcgtattgcccaggctggagaccctactccaaccgcggaagcgtagcagatcgacctgcggtgattctgaagtcgaagaggagagtcccgggaaaaggctggatgccgggctgacaaatggcttcgggggcgcaaggtcggagcaagagcccgggggcggcctcggaagaaaagccaccccacgcagaagatgtgccagcgagtcctcaatatcttcttctaattctcctctttgcgattcaagcttcaatgcccctaaatgtggcagggggaagcccgcgctggtccgcaggcacaccttggaagataggtctgaactcatctcttgcatagaaaacggcaactacgctaaggcagctcggatcgccgcagaggtgggtcagagctctatgtggatatccaccgatgcagccgcctccgtactggagccactgaaggtagtatgggcaaagtgttctggttatccgagctatccagccctcattatcgaccccaagatgcctcgtgtgccgggtcatcacaacggggtcaccataccagcacccccactggatgtgctgaagattggggagcacatgcagactaaatcggatgaaaagctgtttttggtgctgttctttgacaataaaaggagttggcaatggctccccaagtccaagatggttcccctgggcatcgacgagaccatcgacaagctcaaaatgatggagggccgtaatagctccatcagaaaggcggtccgtatcgcctttgaccgggccatgaatcacctcagccgcgttcatggtgagcctacctccgacctatccgacatcgactag

SEQ ID NO: 18781 - DNA, 2988 bp, Artificial Sequence
  Description of Artificial Sequence: Synthetic coding sequence
atgcggcggaagggccggtgccaccggggcagcgccgcccggcacccttcttctccttgcagcgtcaaacacagccctaccagggaaactctgacctacgctcaggcccagaggatggtggagattgaaatcgagggtaggctacacaggatctccatctttgaccccctcgaaatcatccttgaagacgacctcaccgcccaggagatgtcagagtgcaactcaaataaagaaaacagcgagcgccctcccgtgtgtttacggactaaaagacacaagaacaaccgcgtgaaaaagaagaacgaggcactcccatccgctcatggtactcctgcctccgcctctgcactacctgaacctaaggtgagaattgttgaatacagtcccccaagcgcccctcgtagaccaccagtgtattataaatttatcgaaaaaagtgctgaggagctggataacgaggtcgaatatgatatggatgaagaggactatgcatggcttgagatcgtcaacgagaagagaaaaggggattgtgtgcccgccgtatcacagtctatgttcgaatttcttatggatcgattcgagaaagaaagccattgcgagaaccagaagcaaggcgaacagcaatccctgatcgacgaggacgctgtttgttgcatttgcatggatggcgagtgtcaaaacagtaacgtcatcctgttttgtgatatgtgcaatttagctgtccaccaggaatgttacggagtcccttacatccccgagggtcagtggctgtgcaggcattgtttacagtcacgggcacgtcctgccgattgcgtgctctgccctaataagggtggggcatttaaaaaaacagatgacgacaggtggggacatgtggtatgtgcattgtggatacccgaggtagggttcgctaacacagtatttatcgagcccatcgatggcgtcagaaacatacctccagcccggtggaagttaacctgctacctgtgtaaacagaagggagttggggcatgcatccaatgtcacaaagcgaactgctacaccgctttccatgtgacatgcgctcaaaaggctgggctgtatatgaaaatggagccagtcaaggagcttacaggtggtggaactacattcagtgtgcgtaaaaccgcctactgtgatgttcacaccccgcccgggtgtacgcggcggcctcttaacatttacggcgatgtggagatgaaaaatggtgtatgtagaaaggagagctcagtcaagactgtgagaagtactagcaaagtgagaaagaaagccaagaaggccaagaaagcactggccgaaccatgtgctgtccttccaactgtatgcgctccatatatccccccgcagcgcctcaatcggatagccaatcaggtggctatccagagaaaaaagcagttcgttgaacgggcccacagctactggctgttgaaacggctgagccggaacggagccccgttgcttaggaggctccagtcatccctgcagtcccagcgaagctcacagcagcgcgagaacgacgaggagatgaaggcggccaaagaaaagctgaagtactggcagagactcaggcacgacctcgaaagagctcggttgctgatagaactcctgagaaagagggagaagctgaaacgagaacaggtgaaagtggagcaggtagcaatggaactgcgtttgacaccgctaactgtcctcctgcgctctgtcctagatcagcttcaagacaaagaccccgcgagaatattcgcgcaacccgttagccttaaagaggtccctgattatttagatcacattaagcatccaatggactttgctacaatgaggaagagactcgaggctcagggctacaagaacctgcatgaattcgaggaagattttgacctgattattgataattgcatgaaatacaacgcccgcgacactgtgttttatcgtgctgccgttcggctgagagaccaaggcggagtggtactaagacaggcgcgtagggaagtggactctattggcttggaagaagcttcagggatgcacctgcctgaaagaccggcagctgcgccacggaggccgttcagctgggaggatgtagataggctgctggaccccgcaaacagggctcacctgggcctggaggaacagcttagggaactcctcgatatgctcgacctgacctgtgcgatgaagagctcgggctcgcgtagcaaaagggctaagctgcttaagaaagagatcgctctcctgcgcaacaagctctcacaacaacatagccagcccctcccgacggggcccgggttagagggcttcgaagaggacggtgccgccctggggcctgaggccggcgaggagggcgacaaaagcccccctaaacttgagccgagcgacgctttaccgcttccctctaatagcgagacaaattccgagcctcccacactgaaacctgttgagcttaacccagaacagagtaaattgttcaaacgcgtcacatttgataacgagtctcatagcgcatgcactcagtcagcgctggtaagtggcagaccacctgagcctacccgagctagttcaggggacgtgcctgcggccgccgcctcagcggttgccgaaccggctagcgacgtaaatcgccgcacctcagtgctcttctgcaagtccaagtcttcctttaggggctggcgccttttctgctcccagggcaaggggcgaggcgcacatgcggaaacccctcgatggcgaaggagcccccaggagagcgcatggacccaagtaagcccgacggccctgggagtaagaggcgcatcacggagtagggccgccgcgtggggaggacggccccatcctgatgacgccgtgccccccagccctgcatcccctcctgccaccgcccgatcggcgacacgtgcactaatgcgacctaacgtcggcggggcaaaccgactcctgtgtgacgggacacgatggcggacagctgtgtcatag

SEQ ID NO: 18782 - DNA, 2241 bp, Artificial Sequence
  Description of Artificial Sequence: Synthetic coding sequence
atgaagatggagcccgtgaaggagctgaccggcggcggcaccaccttttcagtacgaaaaaccgcatactgcgacgtgcatactcctccaggctgcaccagaagaccactcaacatctatggcgacgttgagatgaaaaacggcgtgtgccgaaaagaatccagtgttaaaactgtgaggagcacatccaaagtacgcaagaaggcaaagaaggcaaaaaaggctcttgcagaaccttgtgcagtacttcctacagtgtgtgcaccctatattcccccacagcggtttattcggatgcagagtagaaagtgcctgaagagagactgtgatcagcaagctgacggactgtgccgctttggctcatttgactgttttagatcgagccgacgatcctctagcaccacgcgggcgtggacctccgcatccagaacaagaactagtgatagactcaataggatcgcgaaccaggtcgctatacagcggaagaagcagttcgtggagcgcgcacactcgtattggttgttaaaaaggctctctagaaacggggcacccctcttgaggcggctgcagagcagcctccagtcacaacggtccagtcagcagcgcgagaatgacgaggaaatgaaggccgctaaggaaaaattgaaatattggcaaagactgcgacatgacctcgagagggcacgtttactgatcgagctgctcaggaagagggagaaacttaagcgagaacaggtgaaggtggaacaggtggccatggagctgcgcttaacaccactgactgtgctgctccggtctgtactagaccaattgcaagacaaggatcccgcccggattttcgctcagcctgtacctgattacctcgatcatatcaagcatcctatggattttgctactatgcgaaagcgactggaagcgcaaggttataagaatcttcatgagtttgaggaggacttcgatctcattattgacaattgcatgaagtacaacgctagggataccgtcttttacagggccgctgtgcgattgcgggaccaggggggcgtggtactgagacaggcacggagagaagttgattccattggcctcgaggaggccagcggcatgcatctgcccgagaggcccgcggccgcccctaggagaccttttagctgggaagatgtggaccggttacttgatcctgccaatagggctcacctggggctcgaggagcagcttcgcgagctcttagacatgctagatttgacatgcgcgatgaaatcatctggctctcgcagcaagcgggctaagctgctgaaaaaagaaattgccctgttgaggaataagttatctcagcagcattcccaacccctgcccactggtcccggattagagggctttgaggaagatggcgctgctcttggtcctgaggccggggaagaagtcctgcctagactggaaaccctgctgcagcctagaaagaggtcacggagtacatgtggcgactctgaagtggaagaagaatctccaggtaagagactcgatgctggactaaccaatggcttcggaggggcacgtagcgaacaggagccagggggcggccttggcaggaaagctactcctaggaggagatgtgcttctgagtcctccatctcaagctctaactcacctctttgtgattccagtttcaatgcacccaaatgcgggagaggcaagccagcgctggtgcgcaggcacacgcttgaagaccgaagtgagctgattagctgtatcgaaaacggcaactacgccaaggcagctcggatagcggccgaggtcgggcaatcgtccatgtggatttctaccgacgctgctgcttccgtcttggagccgctgaaagtcgtatgggctaagtgtagcggctacccgagctaccccgccctgataatagaccccaagatgcctcgggtccccggacaccacaatggcgtgaccattcccgcacctcccctggacgttctgaaaatcggcgaacatatgcagactaagagtgacgaaaagctatttctagtcctctttttcgataacaagcgcagttggcagtggcttccaaaatcgaagatggttccactgggcattgacgagaccattgataaacttaaaatgatggagggtagaaactctagcattaggaaggccgttaggattgcatttgatagagccatgaaccatctgagtcgcgttcatggggagccaaccagtgacctgagcgatattgattag

SEQ ID NO: 18783 - DNA, 2181 bp, Artificial Sequence
  Description of Artificial Sequence: Synthetic coding sequence
atgagcaccgccaccaccgtggcccccgccggcatccccgccaccccgggcccagttaatccacctccaccagaggtttctaatccaagcaaacccggtcgaaagaccaaccagttacagtacatgcagaacgttgtagtgaagaccctctggaaacaccaattcgcttggccgttctaccagcctgtagatgcgattaaattgaatcttccagactatcacaagatcataaagaatcctatggacatgggcactattaaaaagcgactggagaacaattattattggtccgcatctgagtgtatgcaagatttcaacactatgtttaccaactgttacatctataataagcccactgacgatatcgtgttgatggcacaggctctcgagaagatttttctgcagaaagtagcccagatgccccaggaggaggtggaactcctgcccccagctccgaaaggcaaaggaaggaagcccgcagctggcgctcaatcagcaggcacacagcaagtggctgctgtaagctctgtgtctccagcaacaccttttcagtctgtgcctcccacagtatcacagaccccagtgattgccgccactccggttcccacgattactgccaacgttactagcgtgccggtaccacctgctgcagcccctcctccacctgcaacaccgatcgtcccggtggtgccaccaacaccccctgtggtgaaaaagaagggcgtgaagcgcaaggctgacacaaccactccaacaacatccgcgatcacagctagcagatcggaaagcccgccaccactcagcgacccgaaacaagccaaggttgtggctaggcgagagagcgggggccggcctattaaacctccgaaaaaggacctggaagacggcgaagtaccccagcacgctgggaaaaagggcaagctaagtgagcacctcagatactgtgactcaattctcagggagatgctgagcaaaaaacacgccgcatatgcctggcccttttacaagcccgtggacgcagaggccctggagttgcatgattatcacgatattatcaaacatcccatggacttatccaccgttaagagaaagatggacggccgcgaataccctgatgcccagggatttgccgccgatgtaaggctcatgttctctaattgttacaagtataacccacccgaccacgaggtcgtggcgatggcgagaaagttacaagacgtctttgagatgcggtttgccaagatgccagacgaacctgtagaagcaccagcactcccagcacccgccgcccccatggtgagcaaaggggctgagagctcgagaagctcagaagagtcctcgtccgattctggttcctccgacagtgaggaggagcgggcaacaaggctcgctgaattgcaggagcaactaaaagcagtgcacgagcagctcgcggcactttctcaagcccccgtcaataaacccaagaaaaagaaggagaaaaaagaaaaggaaaaaaagaagaaggataaagaaaaggagaaggagaaacacaaggtaaaggccgaagaagaaaaaaaggccaaggtggccccaccagctaagcaggcccagcagaagaaagcaccggcgaagaaggctaatagtaccaccactgccgggagacaattgaaaaagggaggcaaacaggcttctgcatcttacgactctgaagaggaggaggagggtttgcctatgtcctatgacgagaagagacaattatctttagacataaaccgactgcccggagagaaactgggcagggtggtgcatatcatccagtctagggaaccttctttacgagactctaaccctgacgagatcgagatcgattttgagacattaaagcctacaacattacgggagttggaaagatacgtgaagtcatgtctgcagaagaaacagcgaaaaccattctctgctagcgggaagaagcaagccgctaaatctaaggaagagctcgcccaagaaaaaaagaaggaactcgagaagcgccttcaggacgtgtcgggccaactttctagctcaaagaaacccgctcggaaagaaaagcccggctcagcaccatcaggaggtccttccaggcttagctcgagtagctcttcagagtcgggctctagtagctccagtggctccagtagcgacagctctgatagcgagtag

SEQ ID NO: 18784 - DNA, 1671 bp, Artificial Sequence
  Description of Artificial Sequence: Synthetic coding sequence
atgagcaccgccaccaccgtggcccccgccggcatccccgccaccccgggtccagtcaaccctccgcctcccgaagtaagtaaccccagtaagcccggccgcaagacgaatcagcttcagtacatgcagaatgtcgttgttaaaacactctggaagcatcagttcgcctggccattttaccaacccgtagacgccatcaaattaaacttgccagattaccacaagattattaagaatccaatggatatgggaaccataaagaagcggctggagaacaactattactggtccgcttccgaatgtatgcaggactttaacacgatgtttaccaattgttacatttataacaagcccactgacgatattgtgctaatggcgcaggcccttgagaagatttttctgcaaaaggtggcccagatgccacaggaagaagtggaactgctgcctcccgcccccaaggggaagggtcgcaaacccgcggcgggcgcccagagtgccggcactcagcaggtggcagcagtcagcagcgttagcccagcgacaccctttcagtctgtgccaccaactgttagccagacacccgtgatcgctgcaacccccgtcccaacaatcactgccaatgtgacctccgtacccgtacctcctgccgcagctccaccccctcctgccacaccaattgtaccggtggtgccacctacccctccagtggtaaagaagaagggcgtgaaaagaaaggcggacaccaccaccccaaccacatcagcaattaccgctagccggagtgagagtcccccaccattgtccgaccccaaacaggccaaggtggtcgcgagacgggaaagcgggggccgccccataaaacccccgaaaaaggacctagaggatggtgaggttcctcaacatgccggtaagaaaggcaaactatccgaacacttgcgctattgcgacagcatattgagagagatgctctccaagaagcacgctgcgtatgcatggcccttctacaagcctgttgatgccgaggcgctggagctacacgactaccatgacatcataaagcaccccatggacctgtcaactgtcaagcgtaagatggacggcagagagtatcccgatgcccaagggtttgctgcggacgtgcggctcatgttctctaactgttacaaatacaaccctccagatcacgaggtcgttgcaatggcccgcaagttgcaggacgtgttcgaaatgcgatttgccaagatgcccgacgagcctgtggaagcacctgccctgccggcccctgctgctcccatggtgtccaagggagccgaatcgagcagaagctccgaggagtctagctccgactctggctcgagcgatagtgaggaagagcgggccacgaggctggccgaattacaggagcagctcaaagcggtgcatgaacagttggctgctctaagccaggctcccgtgaacaaaccgaagaagaaaaaagaaaaaaaggaaaaggagaagaagaaaaaagacaaagaaaaagaaaaagaaaagcacaaagtcaaggctgaggaggagaagaaggcaaaagtggcccccccagccaagcaagcacagcagaagaaggcccccgctaaaaaagcaaactccacaacaacagcaggacgtgaccattttctgacgtgcggcgtatag

SEQ ID NO: 18785 - DNA, 1671 bp, Artificial Sequence
  Description of Artificial Sequence: Synthetic coding sequence
atgagcaccgccaccaccgtggcccccgccggcatccccgccacccccggcccggtcaaccctccccccccggaggtctcaaacccctcaaaacccggtcgcaaaactaatcaattgcagtatatgcaaaatgtcgttgtgaaaaccctatggaagcatcaattcgcctggccattttaccagcccgtggacgccataaagctgaacctgccggactatcataagattatcaagaatccaatggacatgggtactattaagaagaggctggagaacaactattactggtcagcatcagaatgtatgcaagactttaatactatgttcaccaactgctacatttataacaagccgaccgacgatattgtgcttatggcacaggccctggagaagattttccttcagaaggtcgcccagatgccacaggaggaggtagagctactcccgccagcccctaaggggaaaggtcgtaagccagccgccggcgcccaatcagccggtacccagcaagtcgcggccgtctcatccgtgagcccagctactcctttccagtcagtaccccctacagtgtcccagacgcctgtgatcgccgccaccccagtgccgactatcactgctaacgtgacaagcgtgcctgttccacccgccgccgccccaccacctccagcaaccccaatcgtgcctgtagtgcctcccaccccacccgtcgtgaagaaaaaaggggtaaagagaaaagcagacaccaccactccgaccacatctgctattacagctagtagaagcgaaagcccgccccctctgtccgacccaaagcaagcaaaagtggtggctagacgggaatcaggtggacgccccattaagcccccgaagaaggaccttgaggacggggaagtacctcaacatgctgggaaaaagggcaagctgtcagagcatttaaggtactgcgatagcatcctgagggagatgctgtctaaaaagcatgccgcttacgcatggcccttttataaaccggtcgacgccgaagcgttagagctgcatgattaccacgatatcataaaacaccctatggatcttagcactgttaagcgtaagatggacggccgagagtatccggatgcgcagggttttgctgcagacgtcaggctgatgttcagcaactgctataagtacaaccctccagatcacgaggtcgtggcgatggcccgaaagctgcaagatgttttcgagatgcgctttgcaaagatgcccgatgaaccagtggaggcccctgcgctcccggcccctgccgcacccatggtgtcgaaaggggcagaaagcagtcgctcttctgaggagtcatctagtgactccggcagttcagatagcgaagaggaaagagccactcgcctggccgagttacaggaacagcttaaagctgtccacgagcagttggccgccttatcacaggcaccggtgaataagccaaagaagaagaaggagaagaaggaaaaggagaaaaagaaaaaagacaaggaaaaggaaaaagagaaacataaggtcaaagccgaagaagagaagaaggctaaagtggctccccctgccaagcaagcacagcagaagaaggcaccagcgaaaaaagccaactctaccaccaccgccgggcgggatcatttcctaacctgcggagtatag

SEQ ID NO: 18786 - DNA, 225 bp, Artificial Sequence
  Description of Artificial Sequence: Synthetic coding sequence
atgagcaccgccaccaccgtggcccccgccggcatccccgccacccccgggcctgtgaatccaccccctcctgaagtctccaatccgtccaagcccggtcggaagaccaatcagctccaatacatgcagaatgttgtcgtcaaaacactctggaagcatcagttcgcatggcctttttatcagccagtggatgcgattaaactgaacctgcctgactaccactag

SEQ ID NO: 18787 - DNA, 63 bp, Artificial Sequence
  Description of Artificial Sequence: Synthetic coding sequence
atgagcaccgccaccaccgtggcccccgccggcatccccgccacccctgggcctgttaactag

SEQ ID NO: 18788 - DNA, 1218 bp, Artificial Sequence
  Description of Artificial Sequence: Synthetic coding sequence
atgctgagcaagaagcacgccgcctacgcctggcccttctacaagcccgtcgacgccgaggccctggagttacacgactatcacgacatcataaaacacccaatggatctaagtaccgttaagagaaagatggatgggagagagtatccagatgcacaaggtttcgctgcggacgttcggctaatgttttcaaactgttataagtataatccacctgaccatgaggtggttgcaatggcgaggaaattacaggacgttttcgagatgcgcttcgcaaagatgccagacgaacccgtggaagccccagctcttccagcccctgcggcccccatggtgtccaagggggcggagagctcccgctctagcgaggaaagcagctctgacagtggctcctcagacagcgaagaggagcgggcgacacggctggcagaactgcaggaacagttgaaagcagttcacgagcagctggctgctttgtcccaagcaccagtaaataagcctaagaagaaaaaggaaaaaaaagagaaagagaagaagaagaaagacaaggagaaggagaaggagaaacacaaggtgaaagccgaagaagagaagaaggccaaggtggctccccccgctaaacaggctcaacagaaaaaggcccccgcgaagaaggccaactctactaccaccgccggtaggcagctaaagaaaggtgggaaacaggcctcggcgtcttatgatagcgaggaagaggaagaagggctcccaatgtcctatgatgaaaagcgacagctgtcacttgacataaaccgcctacccggggagaagttagggcgcgtggtgcacattatccaatctcgggagccctctctcagagacagcaacccggacgagattgagattgactttgagaccctaaaacccacaaccctgcgggaactagagcggtacgttaagagctgcctgcagaagaagcagagaaagccattcagtgcatccggaaaaaaacaggctgcaaagtccaaagaggagcttgcccaggagaaaaaaaaggagcttgagaaacgcctccaggatgtctccggacagctgagcagctccaaaaaacccgccagaaaagagaaaccgggctcagcacccagcggtggtccctcaagactgagcagcagcagctccagtgaatctggctcttcctccagctctggatcatcttctgactcctctgattccgagtag

SEQ ID NO: 18789 - DNA, 1062 bp, Artificial Sequence
  Description of Artificial Sequence: Synthetic coding sequence
atggccgccaccaagcggaagcggcggggcggcttcgccgtgcaggccaagaagcctaagcggaatgagattgatgccgaaccccctgccaagaggcatgctaccgcagaagaagtagaagaggaggagagggaccggattccaggcccagtatgtaagggcaaatggaaaaacaaggaaaggattctgatatttagtagtagaggaataaactttcgtacccgccatctgatgcaggacctgaggatgctcatgccccatagtaaggcagatacgaagatggaccgtaaggataagctgttcgtgatcaatgaagtatgcgagatgaaaaattgcaataaatgcatttatttcgaggcaaaaaaaaagcaggacctgtacatgtggctgtccaacagtccgcatggccccagtgcaaagtttctggtacagaacattcacacactggcggagctgaaaatgaccggaaattgtttaaaaggatctcgcccccttctgagctttgatcccgccttcgacgagctccctcactatgctctgctgaaagaactgctcatccaaattttttccacacccagatatcaccctaaaagtcagccctttgtggatcacgtttttactttcaccatattggacaaccgtatttggttccgcaacttccaaattattgaagaagacgccgccttagttgagattgggccacgctttgttctgaatctgataaaaattttccagggttcttttgggggaccaactctttacgaaaatcctcactatcagagcccaaatatgcacaggagggtgatcaggagtattactgcggcgaagtaccgagaaaagcagcaggtcaaggacgtgcagaagctgaggaagaaagaaccaaaaactctgctgccgcatgaccctacagcagacgtctttgtgacacccgccgaagaaaaacctatcgagattcagtgggtcaagccagaaccaaaggtggacctcaaagcccgaaagaagcggatctataaaagacagcgtaagatgaaacagcggatggacagtgggaagaccaaatag

SEQ ID NO: 18790 - DNA, 1428 bp, Artificial Sequence
  Description of Artificial Sequence: Synthetic coding sequence
atggccggccggccccacccctacgacggcaacagcagcgaccccgagaactgggacaggaagctgcacagcaggccccgcaaattgtataaacacagttcgaccagttcccgcattgctaaagggggagtcgatcacacgaaaatgtcactgcacggcgcctcgggtggccatgagagatccagggaccgtaggcggtcctcagatcgcagcagggatagctcacacgagcggacggagtctcagctcaccccctgcatccgcaatgtcacttctcccacgagacaacaccatgtcgagcgtgagaaggatcattcaagctcacggccctcgagtccacgcccacaaaaggcatcacctaatggaagtatatccagcgctggtaacagttccagaaattccagtcagtcgagttcagatggcagctgtaagaccgccggggaaatggtgttcgtttacgaaaacgcaaaggaaggcgctcggaacataaggacgtcagagcgggtgaccctaatcgtggacaatacaagattcgtagtagacccaagtattttcacagcccagcccaatacaatgctcggacggatgtttgggtcagggcgtgagcacaattttacacgtccgaatgagaagggtgagtacgaagtggcagaagggattggctccactgtgtttcgagcaatcctcgattattacaagactggaatcattagatgccccgatggtattagtataccagaactccgggaggcctgcgattatctttgtatatcgttcgagtatagcactatcaagtgcagggatcttagcgccctcatgcacgagttatccaatgatggagccaggagacagttcgagttttatctcgaagagatgatcttgcctctgatggttgcctcagcccagagtggggagagggagtgccacatcgtggtgcttacggacgatgacgtcgtggactgggacgaggagtaccccccccaaatgggagaggaatattctcaaatcatatactccaccaagctatatcgattttttaagtacatagagaacagagatgtggctaaatcggtactgaaagagagaggcctcaaaaaaattcggctgggcatcgagggatacccaacatacaaagagaaagttaagaagcggcctggaggtcggccggaagttatatacaactatgttcagcgcccattcattcgcatgtcctgggagaaagaggaggggaagagtcgacatgtagactttcagtgtgtcaagagtaagagcatcacaaatctcgccgccgccgctgccgatattccacaggaccagcttgttgtgatgcaccccactccacaggtggacgagctggatatcctccctatccaccccccctccgggaactctgatctggacccagatgcgcagaatcccatgctttag

SEQ ID NO: 18791 - DNA, 195 bp, Artificial Sequence
  Description of Artificial Sequence: Synthetic coding sequence
atggccggccggccccacccctacgacggcaacagcagcgaccccgaaaactgggaccggaagctgcattccagaccacgcaaactgtacaaacacagtagtaccagcagccggatcgcaaaaggaggcgtcgatcatactaaaatgtctctgcacggcgcgagtggggggcacgagcgttcaagagatcggtag

SEQ ID NO: 18792 - DNA, 201 bp, Artificial Sequence
  Description of Artificial Sequence: Synthetic coding sequence
atggccggccggccccacccctacgacggcaacagcagcgaccccgagaattgggatcgcaaattgcacagcaggccccgtaaattatataagcattcctcaaccagttcaaggatcgcgaaggggggagtcgatcacacaaaaatgagtctgcatggagcaagcggcggtcacgagcggagcagagataggcgacgctag

SEQ ID NO: 18793 - DNA, 1137 bp, Artificial Sequence
  Description of Artificial Sequence: Synthetic coding sequence
atggcccggtgcggcgagggcagcgccgcccccatggtgctgctgggaagtgccggagtgtgcagtaagggtttgcagcgtaagggaccttgtgaaagacgacggctgaaagccactgtgtcagagcagctgtcccaagatctgctgagactgcttagagaagaatttcacacagatgtgacttttagcgtagggtgcactctttttaaagcccacaaggctgttctgctggctagggtcccagatttctactttcataccatcgggcaaacatctaattcccttacgaatcaggagccaattgccgtggaaaatgtcgaagcactggaattccgaacattcctgcagattatctactcctccaatcgtaacataaagaactatgaagaggaaatccttcgcaagaagatcatggagattgggatcagtcagaaacagctggatataagtttccccaagtgcgaaaatagcagcgactgttcgctgcagaagcatgagatccccgaagatattagcgaccgcgacgacgacttcatttctaacgataactatgacctggaacccgcttctgaactgggcgaggacttactgaagctgtacgtgaagccatgctgcccagacattgacatattcgtcgacggaaagaggttcaaagcccacagggcgattctttcggccaggtccagctactttgcagcgatgcttagtggttgttgggcagagagctctcaggagtacgtcacccttcagggcatctcccatgtggagctgaatgtcatgatgcacttcatttacggcgggaccctggacatcccagacaagaccaacgttggccagatactgaacatggctgatatgtatgggctggagggcctgaaagaggtcgcgatatatatcctaaggagggactactgtaacttcttccaaaaaccagtgcctagaacactgacctccatcctggaatgcttaattatagcacattctgtgggagtagaaagcctgttcgcagattgcatgaagtggattgtcaaacacttcgcacgcttctggagcgaacgctcattcgctaacatccccccggagatccagaagagctgcctgaatatgctcatccagtcactcgtgagtataacatag

SEQ ID NO: 18794 - DNA, 918 bp, Artificial Sequence
  Description of Artificial Sequence: Synthetic coding sequence
atggcccggtgcggcgagggcagcgccgcccccatggtgctgctgggatcagccggggtgtgttccaaaggactgcagaggaagggaccctgcgagcgacgtagactcaaggcaacagtaagcgagcagttatcacaggacctgctgcgtctactgagggaagaattccatacagacgttaccttttccgtcgggtgtacactctttaaggctcataaagccgtcctgctggctagggtcccagatttttattttcacactattggtcagacctctaatagtcttaccaatcaggagcctattgctgtcgagaatgttgaggcccttgagtttcggacctttctccagataatctactcaagcaatcggaacatcaaaaactacgaggaagaaatattgcgcaaaaagatcatggagattggaatctcacaaaaacaactcgacatcagcttccctaaatgtgagaacagcagcgattgtagcctgcagaaacacgaaatcccagaggacatttctgatcgggacgacgactttatcagcaatgataattatgaccttgaacctgccagcgagctcggcgaagacttgctcaagctatacgtcaagccttgttgccctgatatcgacatctttgtcgatgggaaacgtttcaaagcccacagggctattctgagcgctaggagttcgtacttcgccgccatgctgagtgggtgctgggcagagtccagccaggaatacgttaccttacagggtatcagccacgtcgagctgaacgttatgatgcacttcatctatggcggcaccctggacatacctgataagacaaacgtgggctatgtttttctatttaacaacctgaagtataaaagggtccgattttgtttcgttgagctctgctgtaaggtcctaatgaaatag

SEQ ID NO: 18795 - DNA, 852 bp, Artificial Sequence
  Description of Artificial Sequence: Synthetic coding sequence
atggcccggtgcggcgagggcagcgccgcccccatggtgctgctgggcagtgctggcgtgtgttcgaaaggcctccaacgaaaaggtccctgtgagagaagaagactgaaggcaaccgtttccgagcaactgtctcaggatcttttgcggctgctgcgggaggagttccacaccgatgtaaccttttctgttgggtgtaccttatttaaggcccataaggccgtgttattggctagggtacccgatttttattttcatacgattggccagaccagtaattcacttaccaatcaagagccgatagcggtcgaaaacgtggaggctttagagtttcgcaccttcctgcagattatatattcctccaaccgtaatatcaaaaactatgaagaggagattctgaggaaaaagatcatggaaatcggcatttcccagaagcagctcgatatcagcttccccaaatgcgagaactcatctgactgctccctgcaaaaacatgaaatacccgaagacattagtgacagagatgacgactttataagtaacgataactatgacctcgaaccagcctccgaactgggcgaagatcttctgaaactgtatgtcaagccttgctgtcctgacatcgacatctttgtggacgggaagcgatttaaggcccaccgcgcaatcctgagcgcccgcagctcctactttgccgccatgctgagtggatgttgggcagagtcctctcaggagtatgtgaccctgcaggggatcagccatgtcgagctcaacgttatgatgcattttatttatgggggcacattagacatccctgacaagactaacgtcggactattccccgaacattag

SEQ ID NO: 18796 - DNA, 360 bp, Artificial Sequence
  Description of Artificial Sequence: Synthetic coding sequence
atggccggcctgatgaccatcgtgaccagcctgctgttcctgggcgtttgtgcccaccacattatccccacaggctctgtggtgataccctctccatgttgtatgttttttgtgtcgaagcgcataccagaaaaccgtgtcgtgtcgtaccagctatccagcagatcaacctgcctcaaagccggcgttattttcactacaaaaaagggacagcaattttgcggagatcctaagcaagagtgggtccaacgatacatgaagaacctcgacgccaaacaaaagaaggccagtccacgggctagagccgttgctgtgaaaggcccagtccagagatatcctggaaaccaaaccacttgttag

SEQ ID NO: 18797 - DNA, 435 bp, Artificial Sequence
  Description of Artificial Sequence: Synthetic coding sequence
atgcccaaggtgaagcggagccggaaggccccccccgacggctgggagctaattgagcctaccctggacgagctagatcagaaaatgcgcgaggcagagaccgagccacatgagggtaaacggaaagtggagagcctgtggccgatattccgtatccaccaccagaaaacccgatacattttcgacttgttttataagcgaaaggctatttccagagagctgtatgagtactgcataaaggagggatatgctgacaaaaacctgattgctaagtggaagaagcaaggctatgaaaatctctgctgtctgagatgtatccagacacgggacactaactttggcaccaattgtatatgtcgtgtccctaaatccaaactggaagtcggtaggatcattgagtgcactcactgtgggtgtcgcggatgctcggggtag

SEQ ID NO: 18798 - DNA, 312 bp, Artificial Sequence
  Description of Artificial Sequence: Synthetic coding sequence
atgcccaaggtgaagcggagccggaaggccccccccgacggctgggagcttattgagcccacccttgacgagttggatcagaagatgagggaggaactgtatgagtactgtataaaagagggttatgccgataagaacttgattgccaaatggaagaaacaagggtacgagaacctgtgctgcttgcggtgcatccaaacccgcgacacaaacttcgggaccaactgcatttgtagggtacccaaaagtaaattagaagtgggacggataattgaatgtacacattgtggatgccgtgggtgttccggctag

SEQ ID NO: 18799 - DNA, 1527 bp, Artificial Sequence
  Description of Artificial Sequence: Synthetic coding sequence
atgatctacgaggagagcaagatgaacctggagcaggagcggcccttcgtctgtagcgcgccagggtgttcccagcgattccccacagaggaccatctgatgatccatcgccacaaacatgagatgaccctgaaatttcctagcatcaagactgataacatgctgtctgatcagactccaacaccgacccgatttctgaagaactgcgaagaggtcggcctgttcagcgagctggattgttctctcgagcatgagttcagaaaggctcaggaggaagagtcctctaagaggaatatttcaatgcataacgccgtggggggcgcaatgactgggcctggaactcatcagctttctagcgcccgactgcctaaccacgatactaacgtagttattcagcaggccatgccaagtccacagagctccagcgtcatcacccaagcaccttcaaccaaccggcagattggtcccgtgccagggtccctgtccagtttgctccacctgcacaaccgtcaaaggcagcccatgccagcttctatgcccgggacattacccaaccctaccatgccagggtcatctgcagtgctgatgccaatggaacgccaaatgagcgttaattcatctatcatgggtatgcaggggcccaatctgagtaatccatgtgcctctcctcaggtgcagcctatgcattctgaagctaagatgcggctgaaggccgccctgacgcaccacccggcagcaatgtctaatgggaacatgaatacgatgggccacatgatggaaatgatgggcagccggcaggaccagacccctcaccaccatatgcacagccacccccatcagcaccagaccctccctcctcaccacccatacccccaccaacaccaacatccagcccatcatccacacccacagccacaccaccagcagaatcaccctcatcatcattcccacagccatctgcacgctcaccctgcccatcaccagacttctccgcaccctccattgcacactggcaatcaggcacaggtatccccggctacacagcagatgcagcctacacagaccattcaacctccccagcccactgggggccgcagaaggagagtggtcgatgaggacccggatgagagaaggcggaagttcctggaacgtaacagagcagcagccacccgatgccgccaaaagaggaaggtgtgggtgatgagcctcgagaagaaagctgaagagctcacccaaaccaatatgcaactccaaaacgaggtttctatgctgaaaaatgaagtcgcccagctgaagcaactgctgctgacacataaggattgcccaataaccgccatgcagaaagagtcccagggttacctctcacctgaatcatcaccgcccgctagccctgtgcctgcctgcagccagcagcaggtcatccagcataacacgatcactacttcatcatcggtcagcgaagttgttggctcctctacactcagccagttaactacacatagaacggatttgaaccctattttgtag

SEQ ID NO: 18800 - DNA, 1110 bp, Artificial Sequence
  Description of Artificial Sequence: Synthetic coding sequence
atgttctgcaccagcggcggcaacagcgccagcgtgatgagcatgcgccccgtgcccggaagtctctcttcgcttcttcacttgcacaataggcagcggcagccgatgcccgcaagcatgccagggactctgccaaatccaaccatgcctgggtcctcggccgtcctgatgccaatggaaaggcagatgagcgtgaattcctcgattatgggcatgcagggacctaacctgtctaatccctgtgcctcaccccaggtgcagcctatgcatagcgaggcgaagatgagactcaaagcagctctcacccaccaccctgctgcaatgtctaacgggaatatgaacacaatgggccacatgatggaaatgatgggcagcaggcaagaccagaccccccaccaccatatgcatagccaccctcaccagcatcagactcttcctcctcatcacccctatcctcaccagcaccaacatcctgcccatcatccacatccccagccccatcatcaacagaaccaccctcatcaccatagccatagtcacctgcacgcccaccctgcacaccaccaaaccagcccgcatcctccgctgcatacagggaaccaagcccaggtgtccccagccacccagcaaatgcagccaactcagacaatccaaccccctcagcccaccggaggcaggcgtcgtcgtgtcgttgacgaggaccctgatgaacggagacgtaagtttctcgagagaaatcgagctgctgccacaagatgtcggcagaagaggaaggtgtgggtgatgtcgctcgagaagaaagccgaggaactgactcaaaccaacatgcagctgcagaacgaggtttcgatgctgaagaatgaagtggctcagctgaagcagttgctgctcacccataaggactgtccgattacggcgatgcagaaagaatcacagggttatctttcccctgagtcctcccccccagccagtcctgtcccagcttgcagccaacagcaggttatacaacacaacacaattacaacgagcagtagcgtgtcagaggtcgttggctccagtacactttcgcaactaactacccacaggactgaccttaatcctatactctag

SEQ ID NO: 18801 - DNA, 1428 bp, Artificial Sequence
  Description of Artificial Sequence: Synthetic coding sequence
atgatccaccggcacaagcacgagatgaccctgaagttccccagcattaagaccgacaatatgctgagcgaccaaacgcctacacccactcggtttcttaagaattgcgaggaggtaggcctgttcagtgaacttgactgcagccttgaacacgagttcagaaaggcacaggaagaggagagttcgaaacgtaacatcagcatgcataacgcggtgggtggcgccatgactggtcccggaacccaccagctctctagtgcgcgtctgcccaatcacgacactaatgtggtgattcaacaggcaatgccttcacctcaaagcagttcggtgataactcaggcacccagtactaacaggcagatcggtcccgttcctggaagcttgtcctcactgctccaccttcataacagacagcgccagcccatgcccgcatccatgcctgggactcttcccaacccaacaatgccggggtcctcagccgtgctgatgccaatggaaagacagatgtctgttaatagctcaattatggggatgcagggacctaatttgtctaatccctgtgcatctccccaggttcagccgatgcatagcgaagccaaaatgaggctgaaggccgccctcacacatcatcccgccgctatgtcaaacgggaacatgaacacaatgggccatatgatggagatgatgggatcccgacaggaccagacacctcaccaccatatgcactcccacccccatcagcatcagacacttcctcctcatcacccttacccacaccagcatcagcacccagcccatcatccccacccccagccacaccatcagcagaaccacccccatcatcacagccattcccatttgcacgcccaccccgctcaccatcagacaagcccacatccaccactccacacaggaaaccaggcacaagtatcaccggctacccaacagatgcagcctacacaaaccattcagccgcctcagccaacgggcggcagaaggcggcgtgtcgtcgacgaagacccagatgagcgtagaaggaagtttctggaacgcaaccgtgctgctgcaacaaggtgcagacagaaacggaaagtttgggtgatgtctttagaaaagaaggcagaggagcttacgcagactaacatgcagctccagaacgaggtttccatgctgaagaacgaggtggcacagcttaagcagcttctcctgactcataaagactgccccattacagcgatgcagaaagagagccaagggtacctgtcccccgaatcatctccccctgccagccctgtgcccgcctgttctcagcaacaggtaatccagcacaacacaattaccacatcatcgtcagtctcagaggtcgtaggatccagtacgctgtcgcagttgacaacccaccgcactgaccttaatcccatcctttag

SEQ ID NO: 18802 - DNA, 1506 bp, Artificial Sequence
  Description of Artificial Sequence: Synthetic coding sequence
atgaacctggagcaggagcggcccttcgtgtgcagcgcccccggctgtagtcaaaggttccctaccgaggaccaccttatgatacaccggcacaagcatgagatgacacttaaattcccctctataaaaaccgacaatatgctgtccgaccagacccctacaccgaccagatttctgaagaattgcgaagaggtgggactttttagcgagttggactgcagcttggaacatgaattcaggaaggcacaggaggaagagagttcaaaaaggaatatctccatgcataacgctgtgggcggagccatgaccggtcccgggactcatcagcttagctctgccagacttccaaatcacgacaccaacgtggtgatccagcaagctatgccgagtccccagagctccagtgtcattacgcaggcgccttcaaccaatcgccagataggacccgtgcccgggtccctttcaagcctgctgcacctccacaaccggcagaggcagcccatgcccgcttctatgcccggaacactgccaaacccaacaatgcccggctcctccgcagttctcatgccaatggagcggcagatgtccgtcaacagctcaataatgggcatgcaggggcccaatctctcaaatccctgtgcatctcctcaggtacagcctatgcattctgaggccaagatgcggctgaaggctgcactgacacatcacccagccgcaatgagcaatggaaacatgaatactatggggcatatgatggagatgatgggcagtagacaagaccagacaccccaccaccacatgcacagccatcctcatcaacaccagactttgccgccccaccacccatatccccatcaacatcagcaccctgcacaccatccccacccgcagccacatcaccaacagaaccaccctcaccatcactcccattcccatctccacgcccaccccgcccaccaccagacaagccctcacccccccctgcatactggtaaccaggcgcaggtttcccctgcgacccagcagatgcagccaacccagacaattcaaccaccacagccaacagggggacgccgcaggagggtggttgatgaggatccagatgagcggcggcgcaaattcctggagagaaacagggcagctgccactagatgtagacaaaaacgcaaggtctgggtgatgagccttgagaagaaagctgaagaactgacccaaactaatatgcagctgcagaatgaggttagcatgctgaaaaatgaggtggctcagctaaaacagcttcttttaactcacaaggactgccccatcacagcaatgcagaaagagtcccagggttacctgagtccagaatcgtcgccaccagcatctcctgtgccggcatgtagtcagcagcaggtgatacagcacaacactattactacctcctccagcgtgtccgaggtagtcggcagttcaacactgtctcaactcaccacccatcgcacggacctgaatcctattctatag

SEQ ID NO: 18803 - DNA, 1428 bp, Artificial Sequence
  Description of Artificial Sequence: Synthetic coding sequence
atgatccaccggcacaagcacgagatgaccctgaagttccccagcattaaaacagataacatgctgagcgaccagacaccgacccccaccagattcctcaagaactgtgaagaggtcggcttattctctgaactcgactgttcactcgagcacgagttccggaaagcccaggaagaagagagctccaagcggaatataagcatgcacaacgccgtcggtggggccatgaccggccctggcacccatcaactgagcagcgctcggttgcccaaccatgatacaaacgtggtgatacagcaggcgatgcccagcccccagtccagctccgtgattacacaggccccttctactaaccggcagattggcccggtgcccggaagcctcagttctctcctccatctccacaaccgccagcggcagccaatgccggcatcaatgcccgggacattgcccaatcccaccatgcccggctcatccgccgtccttatgcccatggagcgacaaatgagtgtgaacagctccatcatggggatgcaagggccaaacctgtctaacccctgcgcttctccgcaggtgcaaccaatgcattccgaggccaagatgcgtctgaaggctgcactaacccaccaccctgctgcaatgtccaatggtaatatgaacacaatgggccatatgatggagatgatggggtccagacaagatcagaccccacaccaccacatgcactcacaccctcatcagcatcagacccttccacctcatcacccttatccacaccaacaccaacaccccgctcatcacccccacccacaacctcatcaccaacagaatcaccctcatcatcactcgcactcgcacctacatgcacaccccgcccaccatcagaccagcccccaccctcccctacataccggaaatcaagcacaggtgagtcccgcaacacagcaaatgcagcccacccagactatccagccaccacagccaaccgggggccggcgccggcgcgtggtcgatgaggatcctgacgaaagacggaggaagttcctggaaagaaaccgagctgccgccacccgatgccggcagaaaaggaaagtgtgggtcatgagtctggagaaaaaggccgaagaactcacgcaaacaaatatgcagcttcagaacgaggttagtatgctgaaaaatgaagtcgctcagctgaagcagctactgctaacccataaggactgcccaattactgctatgcagaaggaatcccagggttacctaagtcccgagtcctctcctcccgcttcaccagttcccgcctgttcacaacagcaggtcattcaacacaatactattacaacttctagttcagtaagcgaggtggtgggctcatccacactgagccaacttaccacacacagaaccgacctgaatcccattttgtag

SEQ ID NO: 18804 - DNA, 348 bp, Artificial Sequence
  Description of Artificial Sequence: Synthetic coding sequence
atgaacctggagcaggagcggcccttcgtgtgcagcgcccccggctgttctcaacggtttcccactgaagaccacctcatgatccatcggcataagcatgagatgaccctgaaattccccagcatcaaaaccgacaatatgctcagtgaccagacccctactcccacaagattcctgaagaattgcgaagaggtggggctttttagcgagctggattgcagcctggagcacgagttccgtaaggctcaagaggaagaaagttctaaacgcaatatatcaatgcacaatgccgtcggcggggctatgaccgggccgggtacacaccaactttcctctgctcgactgtag

SEQ ID NO: 18805 - DNA, 453 bp, Artificial Sequence
  Description of Artificial Sequence: Synthetic coding sequence
atgagcaagatcagccagcagaacagcacccccggcgtgaacggcatctccgtgatccatacccaagcgcatgcctccggcctgcagcaagtcccccagctcgttccagccggtccgggcggcggaggaaaggctgtggcaccttcaaagcagtctaagaaaagctcccccatggacaggaactcagatgagtatcggcagcgcagagaacgcaataatatggccgtgaagaaatcacgcctaaagtctaagcaaaaagcccaggataccctccaaagagtgaatcagctgaaggaagaaaacgagagactggaagcaaagatcaagcttctgacaaaggagctgtctgtgctgaaagatctttttctcgaacatgcccacaacctggccgacaacgttcaatctattagtacggaaaatacaaccgctgacggtgataacgcagggcaatag

SEQ ID NO: 18806 - DNA, 1509 bp, Artificial Sequence
  Description of Artificial Sequence: Synthetic coding sequence
atggagaccctgcaggagagcctgaacaccctgctgaagcagctggaagaagagaagaaaacgctggagtctcaggtaaagtactatgctctcaagctggagcaggagtcaaaagcgtaccagaagataaataacgagaggcggacttacttggcagagatgtcacagggcagcggtctgcatcaggtttccaagcggcagcaggtggatcagttacctagaatgcaggagaatctggtgaaaacactgctgcttaaagaagagctggaccctctaaaggccaaaatcgacatactgctagtgggggacgtgactgtgggatatttagcggataccgtgcagaaactgttcgctaacatcgctgaagtgacaatcacaattagcgacacgaaggaggctgctgccctactggacgactgcatttttaatatggtgctgttaaaggtacctagtagcctctccgccgaagaattagaagccattaaacttatccggttcggcaaaaaaaagaatacccactcattgtttgttttcatcattccagaaaactttaagggttgcatctcgggccacgggatggacatagcactgacagaaccgctcaccatggaaaaaatgagcaacgtggttaaatactggaccacttgtcccagtaacacggtaaaaactgagaacgctacaggtccagaggaactgggcctgcccctacaacgttcctattcagagcaccttggctattttcctacagacctgttcgcttgcagtgaatcactcagaaatggcaatggattggagttgaacgcttccctgagtgagttcgagaagaataagaaaatctcactccttcactcttcaaaagagaagttgcggcgagaacggatcaaatactgttgtgagcaactccgcacgctcctgccttatgttaaggggcgaaaaaacgacgccgccagcgtgctagaggcaactgtggattacgtgaagtacatccgggaaaagatatctcctgctgtcatggcccagattacagaggccctacaatcaaatatgcggttttgtaagaaacagcagacccccattgagctcagtctccccggcactgttatggctcagcgggagaatagtgtgatgagtacatatagtccagaacgtgggttacagtttctaacaaacacttgttggaatgggtgtagcactcccgacgccgaatctagcctggacgaagccgttcgggtcccttccagttctgcatccgagaacgcaattggggacccttacaaaacccatatctcctcagcagccctttcgctgaattcattgcacactgtccgatactacagcaaggtgacgccgtcctatgatgccacagccgtcacaaatcagaatatctcaatccacctgccttctgcgatgccccccgtgtccaagcttctgcctcggcattgtacttccggactgggtcaaacatgtacaacacaccctaattgtctgcagcagttctgggcctattag

SEQ ID NO: 18807 - DNA, 1533 bp, Artificial Sequence
  Description of Artificial Sequence: Synthetic coding sequence
atggaggagccccaggccggcgacgccgcccggttcagctgccccccaaattttactgcgaagccaccagcttcggagagccccagattcagcctcgaagccttgactggccccgacactgagctgtggcttatccaggcgccggccgattttgctcctgagtgctttaacggtcgtcatgtgccattgagcgggtcgcagattgtgaaaggtaaactggcaggaaagcgtcatcgctatcgtgttctctctagctgcccccaggctggggaagcaactcttctggcccccagcactgaggccgggggcggccttacatgtgcctccgctccacaggggacgctacgcattttggaaggtccacagcagtctctgtctgggtcaccactgcaaccaatccccgcttccccacctccacagatccccccaggccttaggccccgcttttgtgccttcggcggcaatcccccggtcacagggccacgatcagccctggctccaaacctactgactagcggaaaaaagaagaaggaaatgcaggtgactgaagcccctgttacccaggaagcagtgaatggccacggggctcttgaggtggatatggccctcgggtctcccgagatggacgtgagaaaaaagaaaaagaagaagaatcaacagcttaaagagcccgaagctgctgggccagtgggaacggagcccacagtggaaaccttggagccgctaggggttctgtttccctctaccacgaaaaagcgaaagaaaccaaaagggaaagagacctttgagcctgaggataaaaccgtgaaacaggaacagattaatacagaaccgctcgaggacactgtcctcagtcctaccaagaaacggaaacggcagaagggtacggaaggcatggagcccgaagagggagtgacagtagaatcccagccccaagtcaaggtggaaccattggaggaggcgatcccattgccaccgacaaagaagcgcaagaaggagaagggtcaaatggcgatgatggagcccggaaccgaggccatggagcccgtagagcccgagatgaaaccactggagtccccaggtgggaccatggctccacagcaacccgaaggcgccaagcctcaggctcaggctgcactggctgcccccaaaaagaagacaaaaaaagagaagcagcaggatgcgacagtagagcctgaaacggaggtggttgggcctgagctgcccgatgatttggaacctcaggccgctcccaccagtaccaagaaaaagaaaaagaagaaagaacgcggccataccgtaactgagccaatacagcctttagagccagaactgccgggtgagggccaaccagaggctcgtgccactccgggcagcactaagaaaagaaaaaagcagtcacaggagagtcgaatgcctgagaccgtaccacaggaggaaatgcccggaccacctctgaattcagaatccggagaggaagcccccaccggccgggataagaaacgcaagcaacaacagcaacagccagtttag

SEQ ID NO: 18808 - DNA, 1446 bp, Artificial Sequence
  Description of Artificial Sequence: Synthetic coding sequence
atgcggcacagcaagcggacccactgccccgactgggacagccgggagtcctggggccatgaatcataccgtggctctcacaaacgaaaacgaaggagccatagcagtacacaggagaacaggcattgtaagcctcaccaccaattcaaggaaagcgactgccattatctggaggcacgcagtctgaatgaacgtgactacagagacagaaggtatgtggatgaatacaggaacgattattgtgagggctatgtaccccgtcattaccaccgagacatcgaaagtggctacaggatacattgctccaaatcatccgttcgaagtaggaggtcctcacctaagcggaagagaaataggcactgttcgagccaccagtcacgttccaagagccaccggcgaaagcggagcagatccattgaggatgatgaagaaggccacctcatttgtcagagcggtgatgttcttagagcaagatatgagatcgttgataccctgggagaaggcgcttttgggaaggtcgtcgagtgtattgaccacggaatggacggcatgcacgtcgctgtgaagatcgtgaagaacgtcggacgatacagagaggcagcaagaagcgagattcaggtacttgagcacctaaattccactgatcctaactctgtctttagatgtgtccaaatgctggaatggttcgaccaccacggtcatgtctgcattgtgttcgaactgctcgggctaagcacctacgattttataaaggagaatagctttctcccatttcagatcgatcacatccgccagatggcctaccagatatgccagtcaattaatttcttgcatcacaacaagcttacacacactgacctgaagccagagaacatcctctttgtgaagtcagactacgtagtgaaatacaactcaaagatgaagcgtgatgagagaacattaaaaaacactgatatcaaggtggtcgatttcggcagtgccacttatgatgatgaacatcactccactctggtgtcaacacgtcattatcgggctcctgaggtgatacttgctcttggttggagccaaccctgcgatgtatggagtatcggatgcatacttatagagtattaccttggctttactgtattccaaactcatgattccaaggagcatctggcaatgatggagcgaatcctgggcccgattccacagcatatgattcagaagactcgcaaacggaagtacttccaccacaaccagttagattgggatgaacattcaagtgcaggcaggtacgtcaggagacggtgtaagcctcttaaggaattcatgctctgtcatgatgaggaacatgagaagctattcgatctggtgcgccgcatgcttgagtatgaccccacacagagaattaccctagacgaggctttacagcaccctttcttcgaccttcttaaaaagaagtag

SEQ ID NO: 18809 - DNA, 165 bp, Artificial Sequence
  Description of Artificial Sequence: Synthetic coding sequence
atgcggcacagcaagcggacccactgccccgactgggacagccgggaatcctggggccatgagagctaccgtgggagccacaagagaaaacggcgatcccacagctccacacaggagaacaggcactgcaaaccacatcatcagtttaaggaatcggactggtag

SEQ ID NO: 18810 - DNA, 162 bp, Artificial Sequence
  Description of Artificial Sequence: Synthetic coding sequence
atgcggcacagcaagcggacccactgccccgactgggacagccgggagagctggggccatgagtcttacaggggatctcataaacggaaaaggcgctcccactcttctacccaggagaatcggcattgtaagccacatcatcaatttaaggagagcgattag

SEQ ID NO: 18811 - DNA, 432 bp, Artificial Sequence
  Description of Artificial Sequence: Synthetic coding sequence
atgcggcacagcaagcggacccactgccccgactgggacagccgggaatcctggggtcacgagagctaccggggatcccacaagcgcaaaagaagatcccacagctcaacacaagagaatcggcactgcaaaccacaccatcagtttaaggaatctgattgtcattacctagaagctcgatccctgaatgagagagattatagggacagaagatacgtggatgaataccggaatgactactgcgaaggatacgtgcccaggcactaccatcgggacatcgaaagcggctaccgtatccattgcagtaaaagcagcgtgaggtcacgaagatcttctccgaaaaggaaacgaaacaggcactgctcctctcaccagtcgcgctctatgaagagttggactctgtgggtaaaagaaccattggcaaaactgtag

SEQ ID NO: 18812 - DNA, 270 bp, Artificial Sequence
  Description of Artificial Sequence: Synthetic coding sequence
atgcggcacagcaagcggacccactgccccgactgggacagccgggagagctggggtcacgaatcatacagaggctcccacaaacggaagagacgcagccattcatctacccaagagaacagacactgtaaaccacatcatcagtttaaagagagtgattggacatgtgtggacatcaagacaaatgcactcacgttgatccgcctgggatacctcaagggctactctgaaattttcactggacattcagtcgatatcctgaagaattag

SEQ ID NO: 18813 - DNA, 1122 bp, Artificial Sequence
  Description of Artificial Sequence: Synthetic coding sequence
atgcggcacagcaagcggacccactgccccgactgggacagccgggaatcatggggacacgaatcatatcgaggttctcataaacgcaaaaggagatcacacagctcaacacaggagaacaggcattgtaaacctcaccatcagttcaaagaaagcgattgtcactatctggaggccaggagccttaacgaaagagattatagagacaggcgttatgtggatgaatacagaaacgactactgcgagggctacgtgccgcgtcattaccatcgggacatcgaatcagggtaccgaatccattgctccaaatcgagcgtgcggagccgcagaagttcaccaaagcgcaaacggaaccgccactgttccagtcatcagagtaggagtaagagccacaggaggaagcgaagccgttctattgaagacgacgaggagggccacctcatctgtcagtctggtgatgtgttaagagccaggtacgaaattgtcgacaccctgggcgagggggccttcgggaaggtggtggagtgcatcgatcacgggatggatggcatgcatgtggccgtcaaaattgttaagaacgtgggtaggtatcgggaggctgcgaggtccgagattcaggtgctcgagcacttaaattcaacggacccaaatagcgtttttagatgcgtgcagatgctggaatggtttgaccaccatggacacgtgtgtatcgtgtttgagcttctgggcctgagtacatacgattttattaaagagaactcttttttaccattccaaatcgatcacatccggcagatggcataccagatctgccagagcatcaactttttacaccacaacaaattgacacatactgacttgaaacccgagaatatactgttcgtcaagtcagactacgtggtgaagtacaactcaaagatgaaacgagacgagcatagctccgccggcagatatgttcgccggagatgcaagccactgaaggagttcatgctctgccacgacgaggagcatgaaaaacttttcgatctagtccgccgtatgctcgagtacgaccccacacagaggatcaccctggacgaggccctacagcatcctttctttgacctgctgaagaaaaaatag

SEQ ID NO: 18814 - DNA, 2613 bp, Artificial Sequence
  Description of Artificial Sequence: Synthetic coding sequence
atgttcagccagcagcagcagcagcagctgcagcagcagcagcagcagctgcagcagctgcagcagcagcaactgcaacagcaacaactgcagcagcagcagcttctccagctccagcagctgctgcagcagtcccctccgcaggcccctttgcccatggccgtcagcaggggattgccgccacaacagccacaacaacccctgttgaatctgcagggcactaacagtgcctctcttctgaacgggtcaatgttacagcgggctttactgctgcagcagcttcaggggctagaccaattcgcaatgcctccagcaacctatgacactgcaggtttaactatgcctacagctactttaggtaacctgcgcggctacggaatggctagtcctggattggcggccccttctcttacacccccacagctagcaacaccgaatctacagcagttcttcccgcaggctactaggcaaagcctgctcggcccccctccagtcggggtgccaatgaatcctagccagttcaatttaagtggccgcaatcctcaaaaacaggcccgaacgagctctagtactacacccaatcggaaggactcttcatcccaaaccatgccagtggaagacaaatctgacccacccgagggatccgaggaagccgctgaaccccgtatggacacaccagaagatcaggacctgcccccatgtccagaggatatagccaaggagaaaaggacaccagcccctgaaccagagccgtgcgaagcatcagaactgcctgcaaagcgtctgagaagctctgaggaacctacggagaaagaaccccctggccaattacaggtaaaggctcagccccaggcacggatgactgtcccaaaacagactcagaccccagacctcttgccagaggctctggaggcccaggtcttaccgaggttccaaccacgagtgctacaggttcaggcccaagtgcagtcacagacacaacctagaatcccgtctacagacacccaggtgcaacctaagctccagaaacaggcacagacgcagaccagccccgagcatctggttctccaacaaaagcaggtgcaaccccagctccagcaggaggccgagcctcaaaaacaggtgcagccacaggtacaacctcaggctcactctcagggccctcggcaagtccagctccaacaggaggccgagccgcttaaacaggtgcagccacaggtacacacacaggctcaacctagcgtgcagccacaggagcacccacctgcccaggtttccgtgcagccaccagaacagacccatgaacaacctcatactcagccacaggttagtctgttggcccctgagcaaacacccgtggtcgtgcacgtctgcgggctagagatgccacccgacgccgtggaggccgggggtgggatggaaaaaacactgccagagccagtgggtacccaggtgtccatggaagagattcagaatgagagtgcgtgtggcctggatgtgggcgagtgcgagaatagggccagggagatgcccggcgtgtggggagccggaggctctctgaaagttacgatactgcaatcaagtgactcaagagctttcagcaccgtgcccctcacgcctgtgcctagaccttcagattctgtcagcagcacgccggcagcaacatctacaccctccaaacaggcccttcagttcttctgttatatttgcaaagcctcttgctcttcacaacaggaatttcaggatcacatgtctgagccccagcaccagcagagacttggtgagattcagcatatgagtcaggcttgcctgctctctcttcttccagtgccccgggatgtgcttgagacagaagacgaagagcccccaccacggagatggtgcaatacttgccagttgtactacatgggcgatctgattcaacatcgacggacgcaagatcacaaaatcgcaaagcaaagtttgagacctttttgcacagtgtgcaatagatacttcaaaaccccaaggaagttcgtggaacatgtgaaaagccaggggcataaggacaaggccaaggagcttaagagtcttgaaaaagagatcgcggggcaagatgaggatcactttattaccgtcgatgctgtcgggtgttttgagggtgacgaagaggaagaagaagacgacgaagatgaggaggagattgaggtggaagaagagctttgtaagcaggtgagatcaagagacattagccgggaagaatggaaaggtagcgagacatactcgccaaatactgcttatggggtggacttcctcgtccccgtgatgggctatatctgcaggatttgtcacaagttttaccacagtaattccggagcgcagctgtctcattgcaaatccctgggccacttcgagaatctgcagaaatacaaggcagccaagaacccttcacccactacgagacctgtgtcccgccgttgtgctattaatgcaaggaacgctctgactgccctatttacctccagtgggagacctccatcacagcctaatacccaagacaaaactccctcaaaggtaactgctaggcctagccagcctccccttccccgaaggtctacccgcctgaagacatag

SEQ ID NO: 18815 - DNA, 759 bp, Artificial Sequence
  Description of Artificial Sequence: Synthetic coding sequence
atgttcagccagcagcagcagcagcagctgcagcagcagcagcagcagctccagcagctgcagcagcaacagctccaacagcagcagctgcagcagcagcaattgcttcaactgcagcagctcttgcagcagagcccgccacaggccccgctgcccatggccgtgagtagaggcttgccaccacaacaaccacagcagccactgctgaatctgcaaggcactaattccgcctcgcttctcaacggctccatgctccaacgcgccttattactgcagcaactgcaagggctggatcagttcgcaatgcccccagctacgtacgatacagccggcctcaccatgccgaccgcaacacttggaaatctgagagggtacggcatggcaagcccggggctcgctgccccaagtctgactcctccgcagttggccacccctaatctgcagcagttcttcccacaagctacacgacagagtctgctgggaccccccccagtcggcgtccccatgaatccttctcaattcaatctgtctgggagaaatccacagaagcaggctagaacctctagcagcactacaccaaacaggaaggactcgtcttcacagactatgccggtggaggacaaatctgaccccccggagggcagcgaggaagctgccgagccacgaatggacacacccgaagatcaggatctgcccccatgtcctgaggatattgctaaggagaagcgcactccagcccccgaacctgagccatgttag

SEQ ID NO: 18816 - DNA, 2610 bp, Artificial Sequence
  Description of Artificial Sequence: Synthetic coding sequence
atgttcagccagcagcagcagcagcagctgcagcagcagcagcagcagcttcagcagctacagcagcagcaacttcagcagcagcaactgcagcagcagcagctgctgcagctgcagcaattgctccagcagagtccgccccaagcccccctgccaatggccgtttcaaggggcctccccccccagcaaccacagcagccacttctgaacctgcaaggtaccaattccgcgtctcttctgaatggatccatgttgcagcgcgccttgctcttacagcaactgcaggggaacctcaggggatatggcatggcttccccaggtctggccgcaccatcactgactcctccacagctggctacccccaacctgcagcagttcttcccgcaggccacgcgccaatccctgttgggccctcctccagtcggcgtcccaatgaaccctagccagtttaacctcagtggccggaacccccagaagcaggccaggacctcttcaagtacgacgccaaacaggaagactatgccagtcgaagacaagtcggacccacccgagggaagcgaagaagccgctgaaccacggatggatacaccagaagatcaggacctccccccatgtccggaagatatcgccaaggagaagaggaccccagcacctgaacccgagccatgtgaggcctctgaactgcctgccaagagactgaggagtagcgaggagcctaccgagaaggagcctcccgggcaactgcaggtcaaggcccagccccaggccagaatgaccgtgcctaagcaaacacagactcctgacctgctgccagaggcactcgaagcgcaggtgctgcctaggtttcagccaagagtgttacaggtgcaggcccaggtgcagtcccaaacgcagccccgaattccaagcacagatacacaggtgcaacctaagctccaaaaacaggcccagacccagacgtctccagaacacctcgtgcttcagcaaaagcaggtgcagcctcaactgcagcaagaagcggaacctcagaaacaagtccagccccaggttcagccccaggcccactcccaaggaccaagacaggtacagctgcaacaggaggcagaacctctcaagcaggttcaaccccaggtgcagcctcaagcgcactcccaaccacccaggcaagttcaactccagctccagaaacaggtgcaaactcaaacctaccctcaggtgcatactcaggcccagccaagtgtgcagccgcaagaacacccccctgcccaggtctcagtgcagccccctgaacagacacatgagcagccacatactcaaccccaggtgtccttgctagccccggagcagacacccgtggttgtgcacgtttgtggactggagatgccccctgatgctgtagaggccggcggtggcatggaaaaaactttaccagagcctgtgggtactcaggtgagtatggaagagatacagaatgagtctgcatgtggactggatgttggggaatgcgagaaccgggcacgggagatgcctggggtctggggcgccggaggaagcctgaaggtgactatccttcaaagcagtgactctagagcattcagcaccgtgcctctgactccagttcccaggccatcagatagtgtctcctccacacccgctgcaactagcactccctctaagcaagcgctacagttcttctgctacatttgcaaggcatcttgcagttcccagcaggagttccaagatcacatgagcgagccccagcaccagcaacgattaggagagatccagcatatgagccaagcctgtctcctgtccctgctcccagtcccccgggacgtactggaaactgaggacgaggaaccgccccccagacgatggtgcaacacctgccagctgtattatatgggcgatctcatccaacacagacgtacccaggatcataaaatcgctaagcagagcctacgcccattttgcaccgtatgtaatcgttatttcaaaaccccaagaaagttcgtggaacatgttaaatctcaggggcataaggacaaggcgaaagagctgaagtccctggaaaaagagattgcagggcaggacgaggatcattttattaccgttgacgctgtcggctgtttcgaaggagacgaggaggaggaggaggacgatgaggacgaggaagagatagaggttgaagaggaactctgcaaacaagtgcggtctagagacattagcagggaagagtggaaaggatccgaaacgtactctcccaacacagcatatggggtagacttccttgtacctgtgatgggctacatatgccgaatctgtcacaaattttaccacagcaacagtggagcccaactgagtcactgtaagtcactggggcattttgaaaacctgcagaagtataaagctgccaagaacccgagccccacaactcgtccagtttctcgccggtgtgcaattaacgcgagaaatgcactgactgccctttttacctcatcgggccgacctccatcacagccaaacactcaggacaaaacaccaagtaaagtgaccgctcgcccctcgcagccaccactcccgaggcggtccacaaggctaaagacatag

SEQ ID NO: 18817 - DNA, 2613 bp, Artificial Sequence
  Description of Artificial Sequence: Synthetic coding sequence
atgttcagccagcagcagcagcagcagctgcagcagcagcagcagcaactgcagcagctccaacagcagcaattacagcagcagcagctccagcagcagcaactattacagcttcagcagctgttgcagcagtcaccaccccaggccccactgcctatggcggttagccgcggcctgccccctcagcagcctcagcagcctcttctaaatctccaaggaaccaactccgcgagcctgcttaatgggtctatgcttcagcgcgctttgcttctacagcagctgcagggccttgaccagtttgccatgccccccgccacctatgatacagccggcctgactatgccgacagccaccttgggcaacctccgagggtacggcatggcttcccccgggctggcagcacctagccttacacccccgcaactggctacccccaacctgcagcaattttttccacaggctacccgtcagtcactactgggccctcctcccgtgggggtcccaatgaatccgtcgcagttcaatctgtccggtaggaacccacagaagcaggcacggacctcttccagcactaccccaaacaggaaagactcgagttctcagaccatgccagtggaagacaagtccgacccgcccgaggggagcgaggaggccgctgagcctcgcatggacacaccagaagatcaggaccttcccccctgccccgaagacattgcgaaggaaaagcgcacccctgctcccgagcctgagccctgcgaagcctctgaactaccagcaaaaaggttgcgctccagcgaagaaccaaccgagaaagaacccccgggccaattgcaggtgaaagcacagccccaagctaggatgacagtgccaaaacagacccagacaccagaccttctgcccgaagcattggaggctcaggtcctgcccaggtttcagccccgggtgcttcaggttcaggctcaggttcagtctcagacacagccgcggattccctcaaccgatacacaagtgcagcctaaactacaaaagcaagcccagacccagacaagcccagagcaccttgtgttgcaacagaaacaagtccagccccagctgcagcaggaggccgagccacagaagcaggtgcagccgcaggtgcagccccaggcccactcccagggacctaggcaggtgcaactgcagcaggaagcagagcccctaaagcaagtgcaacctcaggtccacacacaggctcaaccttctgtgcaaccacaggagcacccccccgctcaagtcagtgtccagccgcccgagcagacacatgagcaaccccacactcaacctcaggtctccctgctcgcacccgagcagacccccgttgttgtgcatgtctgcggcctggagatgccccctgatgccgtggaggccggagggggtatggagaaaaccctgccagagcccgttggaactcaggtaagtatggaagagatccagaacgagagtgcatgcggcctggacgtcggtgagtgcgagaacagggcccgcgagatgcccggcgtatggggcgctggtggaagccttaaggtaaccatccttcaaagctctgacagccgagcgttctcaactgttcccctcacacctgtgccacgacccagtgactctgtgtcctccacccccgccgccacaagtaccccctctaagcaggctctccaattcttttgctacatttgcaaagcctcgtgcagtagccaacaggaatttcaagaccacatgtcggaaccacagcaccaacagagactgggcgagatccagcacatgtctcaggcctgcctactctccctgttgccggtcccccgggatgttttggagaccgaggacgaggaacccccacctaggagatggtgcaatacttgccagctgtactacatgggggacctcattcaacatcggcgtacccaggatcacaaaatagcaaaacagtccttgagacctttctgcacagtctgtaaccgttacttcaagacacctcgaaaatttgtagagcatgtgaagagccaggggcataaagataaggcaaaggaactgaagagcctggagaaagagatcgcggggcaggacgaagaccacttcataactgtggatgccgttggctgttttgagggggacgaggaggaggaggaggacgacgaggacgaggaagagatcgaagtggaagaggagctatgtaagcaagttcggagcagggatatctccagggaagaatggaagggttctgagacctacagccctaataccgcttacggtgttgactttctggtgcccgttatggggtacatctgccggatttgccacaagttctaccactccaatagtggtgcacagcttagccactgtaaaagtctgggacattttgagaacctgcagaaatacaaagccgccaaaaacccgtcccccaccacccgccccgtgtcaagacgctgtgctatcaatgcccgtaacgccctgacggccctcttcacgtccagtggaagacctccttcccagccgaatactcaggacaaaacaccgtctaaggtgacagccagaccctcgcagcctccgctgccaagacgctcaacaagattgaaaacctag

SEQ ID NO: 18818 - DNA, 2697 bp, Artificial Sequence
  Description of Artificial Sequence: Synthetic coding sequence
atgttcagccagcagcagcagcagcagctgcagcagcagcagcagcagcttcaacagctacagcaacagcagctacagcagcaacagctacaacagcaacagttactgcagcttcagcaactgttacaacagagccccccccaggccccgcttcccatggctgtctcaagggggctccccccacagcagccccagcagcctttgctcaatctgcagggaacaaactctgcttctctcctcaatgggtctatgctgcagagggcattgttgctgcagcagttgcaaggcctcgaccagtttgccatgcccccagctacttatgacaccgctgggttgaccatgccgactgcaactctgggcaacctccgcgggtatgggatggcctcacccggactggccgctccatctctgacaccacctcagctggctacgccaaacttacagcagtttttcccgcaagcaacgagacagtcgcttctgggtccccccccagtgggcgtgccgatgaacccctcacagttcaacttaagcggccggaacccccaaaagcaggctaggactagtagtagcactacacccaatcggaaggattcctcttcccaaaccatgcctgttgaagacaagagcgaccctccagaaggatccgaagaagctgctgagccacgcatggatacacccgaagatcaggacctcccaccatgtcctgaagatatcgccaaagagaaacgcacaccagccccagagcccgagccatgtgaagcatcagagctgccagctaagcggctaaggtcctctgaggaaccaaccgagaaggaaccccctggacagctgcaggttaaagctcagccacaggctaggatgaccgttcccaagcagactcagacacctgacttgctgcctgaggccctggaggcccaggttctgcccagattccagccgcgggtgctgcaagtgcaggcccaagtccagtctcaaacgcagccaaggatcccctccacggatactcaggtccagcccaaattgcagaaacaagcacagacccagacaagcccagaacacctggtgctgcaacagaagcaggtccaacctcagctgcagcaggaagcggaaccacagaaacaggtgcagccccaggtgcaaccacaggcccactcacaggggcctcgccaggtccagctgcagcaagaggctgagcctcttaaacaggttcaaccacaggtgcaaccccaagcccactctcagcctcctcggcaggtccagctccagttacagaagcaggttcagacccagacctatccacaggtccacacacaggcccagccttcagtgcagccccaggagcatccgcctgcccaggtgtctgtgcagccacccgaacagacccacgagcagccccacacacagccacaagtgagccttctggccccggagcagacaccggtagtggtgcacgtgtgcgggctggaaatgccaccagacgccgttgaagcgggaggagggatggaaaagacactccctgaaccagtggggacccaggtgagtatggaggagatacaaaatgagtccgcctgcggccttgatgtgggggaatgtgaaaaccgcgcacgggagatgccaggcgtctggggagctggcggctcactcaaggttactatacttcaaagcagtgacagccgcgcattctctactgtccccctcacccctgtgccccgcccgagcgattcagtcagtagcactcccgccgccacatccaccccatccaagcaggccctacagttcttttgctatatttgtaaagcttcttgctcttcccagcaggagttccaggaccatatgagtgaaccccagcaccagcagaggctgggagaaatccagcacatgtcacaggcctgcctgctgtcactactcccggtaccaagggacgttttggagaccgaggatgaagagcctccaccacgccggtggtgtaatacttgccagctgtactatatgggggatctgatccagcatagaagaactcaagaccataaaattgccaagcagagcctgaggcccttctgcaccgtttgcaaccgctactttaaaacaccaaggaagttcgtggagcacgtcaagtcacagggccataaggacaaagctaaagagctgaaatcgctagagaaggaaatagcggggcaggatgaggatcactttatcaccgtggatgctgtgggatgtttcgagggcgatgaggaggaggaggaggacgacgaagatgaagaggagatagaagttgaagaggagctgtgtaagcaggttcgaagtagagacatatcccgcgaagaatggaaaggctcggaaacctattcacccaatacagcatatggcgtcgatttcttggttcccgtcatgggctacatttgccgcatttgtcataagttttaccattctaactccggagcccagctctcccactgtaaatcactgggccactttgaaaatctgcaaaaatataaggccgccaaaaatccctcccctacgacaagacccgtgtcacgtaggtgtgctatcaacgccagaaatgcactcacagccctattcacctcatcgggccgcccaccttcgcaaccgaacacccaggacaagactccatctaaggtgactgcccgaccctcccaacctccactgccaaggcggtccacacgactgaagacatag

SEQ ID NO: 18819 - DNA, 1245 bp, Artificial Sequence
  Description of Artificial Sequence: Synthetic coding sequence
atgttcagccagcagcagcagcagcagctgcagcagcagcagcagcaattgcagcagctgcaacagcaacagctccaacagcagcagctgcaacagcagcagcttctgcagctgcaacagttgctgcagcagtcacccccccaagcaccattacctatggctgtgtctagaggcctgccacctcaacagccccagcaacctttgcttaacctgcagggaactaatagcgcgtccttgttgaacggcagtatgctgcagagggctttgctgctgcagcagctgcagggcaatttgaggggctatggaatggcttcccccggcctggcggcacccagcctgacgcctcctcagcttgcgaccccaaacctccagcagttttttcctcaagcaacccgtcagagtttgctaggtcctccacctgtcggcgtaccaatgaacccttcccagttcaatctgtcggggcgcaatccgcagaagcaagccaggaccagtagttccacaacaccaaaccggaaagatagttcttctcagacaatgcctgtggaggacaagagtgaccctccggaaggctctgaggaggcggctgaaccacgcatggacactcccgaggaccaggatctccccccctgccctgaagacattgcaaaggagaaaaggaccccggcccccgagcctgaaccttgtgaggcttcggagttgccagcaaagagactcagaagttccgaggagcctaccgagaaagaaccccccggccagcttcaggtcaaagcacagccacaggccagaatgactgtccctaagcagactcagactccggatctcctgccggaagccctcgaggcacaggtgctgccaaggttccaacctcgggtgctgcaggtgcaggctcaagtgcagtcacaaacacaacccaggatcccttcaacagacacacaggtgcagcccaaactccaaaaacaggcccagacccagacgagtcccgaacatttggttctccagcaaaaacaggtgcagcctcaactccagcaagaagccgagccccagaaacaggtccagcctcaagtccagccccaggcacatagccagggtcctagacaggtgcaactgcagcaggaggcggaacccctgaaacaggtccagccgcaggtccagccccaagcacacagccagccacacctaccacaagtcctgagtcagcagcttagaggtacggcactgcctctgcaggtaccagggcccctgtag

SEQ ID NO: 18820 - DNA, 2529 bp, Artificial Sequence
  Description of Artificial Sequence: Synthetic coding sequence
atgttcagccagcagcagcagcagcagctgcagcagcagcagcagcagttacaacagttacagcagcagcaactccagcagcaacagctgcaacagcagcagctgctgcagctgcagcagctcctgcagcaatcgccaccccaagcaccattgcctatggcagtgtctcgcgggctgcccccccagcagccccagcagcccctgctcaacttgcagggcacgaattccgctagtctgttgaatggatcaatgcttcagcgtgccctcctcctccagcaactccagggcctcgatcagttcgccatgccccccgccacatacgacactgctggacttacaatgcctacagcgaccctcggcaacttgagaggatacggcatggcaagccctggactggccgcgcccagcctgacaccgccacaactcgctacccccaatctgcaacaatttttcccccaagctacccggcaaagtctcctaggtccacctcctgtgggcgtgccaatgaaccccagccagtttaacctgtctgggcgcaaccctcagaaacaggcccgtacatcttcctccactacaccaaataggaaagattcttctagccagacaatgccagttgaggataaatcggaccccccggaggggtcggaggaagccgccgagcctcgcatggatacccccgaggaccaggaccttcccccttgccccgaggacattgcaaaagaaaagaggaccccggcgccggagcccgaaccatgtgaagcatcagaactgcctgctaagcgccttcgatccagcgaggaaccaactgagaaggaaccacccgggcaactgcaggtaaaagcccagccacaggcacggatgaccgtgccaaagcagactcaaaccccggacctcctgccagaggcccttgaagcccaggtgctcccgagattccagccacgcgtgctccaagttcaggcgcaggtgcaaagccagacgcagccacgcattcctagcaccgatacacaggtccagcctaaattgcaaaaacaggcccaaacgcagacctctcccgagcaccttgtcttgcaacagaaacaggttcagcctcagctgcagcaggaagctgagccacagaagcaagtccagcctcaggtgcacactcaggcccagccatccgtccagccccaggaacatcccccggcgcaggtctccgtgcagcctcctgagcagacacatgaacaaccccacactcagccccaggtgtccttgctggcacccgagcagacacccgtcgttgtgcatgtctgtggactggagatgcccccggacgccgtagaagctgggggcgggatggaaaaaacgctgcccgaacctgtcggcacccaggtctccatggaggagatccaaaatgaatccgcatgtggactggatgtcggagaatgtgaaaaccgagcaagagagatgcccggcgtctggggggctggtggtagtctgaaagtgactatcctccaaagctctgacagtagagctttcagtaccgttccgctcactcccgtgccaagaccgtcggattctgtgagctctacccccgctgctaccagcactccctcaaagcaggcgttgcaattcttctgctacatatgtaaggctagctgttcctcacagcaggaatttcaggaccacatgtccgaaccacagcatcagcagcgcctgggggaaattcagcatatgtcacaagcttgtctgctaagtctattgccggtacctcgtgacgtgcttgaaaccgaggatgaggagccgcctccccgtcggtggtgcaacacctgtcagctgtattacatgggtgacctgatccagcaccgtcggactcaagatcataaaattgctaaacagagtctccgcccgttttgcactgtgtgtaaccgatactttaagactccccgtaagtttgtggagcacgttaagagtcagggccacaaggataaggcaaaggaactgaagtctctggagaaagagatcgccggccaggacgaagaccactttataaccgtcgatgccgttggttgtttcgagggagatgaggaagaagaggaggacgacgaggatgaagaagaaattgaagtggaggaagagttatgtaaacaggtgagaagccgcgacatctcccgagaggaatggaaggggtctgaaacctattctcccaacaccgcatacggagtagatttcctggtgccggtgatgggatacatctgcaggatttgccataagttctatcacagtaatagcggcgctcagctcagccactgtaagtctctgggacacttcgagaacttacagaaatataaggctgccaagaacccatccccgactactcgccccgtctcaagaagatgcgccataaatgcacggaacgccctaacagctctttttaccagcagcggtcggcctcctagccagccgaatacacaggacaaaacgcccagtaaggtcactgcccgaccctctcagccgccactgcctcgacgttccacgcgtctcaagacttag

SEQ ID NO: 18821 - DNA, 2457 bp, Artificial Sequence
  Description of Artificial Sequence: Synthetic coding sequence
atgttcagccagcagcagcagcagcagctgcagcagcagcagcagcagcttcaacaattgcagcagcagcagttacaacagcagcaactgcaacagcaacagctgctacagctacaacagctccttcaacagtctccgccacaggcacctctccctatggctgtgagcagggggctcccacctcagcaaccccagcagcctttgctgaacttacaaggtacaaatagcgcgtctctgcttaatggcagcatgctgcagcgtgcacttcttctgcagcagctgcaaggcaacctgcgtgggtatggcatggcatcgcccggactggcagccccctcattgacccccccccaactggctacccctaatttacagcaatttttcccacaggctacacgccagtcccttttagggcccccaccagtgggcgtccctatgaatcccagtcagttcaatttgagcggaaggaaccctcagaaacaggccaggacctcttcctctactaccccaaaccggaaggattcaagttcccaaacaatgccagtggaagacaagagcgacccgcctgaagggagtgaggaggcagcagaaccccgcatggacacccctgaagaccaggacctgcctccctgcccagaggacatcgctaaggagaagagaaccccagctcccgagccagagccctgcgaggccagcgaacttcccgccaaacgactccgaagttctgaggaacccaccgaaaaagagcctccagggcagctgcaggtaaaggcccagcctcaggccaggatgaccgtccccaaacagactcaaacacccgacctactccctgaggccctcgaagcgcaggtgctgcccaggtttcagccgcgggtcctgcaggtgcaggctcaggttcagagccagacccaaccccgcattccctccaccgacacacaagtgcagcctaaactacaaaagcaggcccaaacacagacatcaccagaacacttagtgttacagcagaaacaggtgcaaccgcagctgcagcaggaagccgagccccaaaaacaggttcagcctcaggtccacacacaggcccagcccagcgttcagccacaggaacacccacctgcccaggtgagtgtgcaaccaccggaacagacgcatgagcagccacacacacagccccaagtgtcactactggcacccgagcagacacccgtggtggtccatgtctgtggtctggaaatgccacctgatgcagtggaagcaggcgggggaatggaaaagacactgcctgaacccgtggggacccaggtttctatggaggaaattcagaatgaaagcgcatgtggactagatgtgggtgagtgtgagaatagagcaagggaaatgccgggggtctggggggccggtggcagtttgaaagtgacaatcctgcaaagcagcgattcgagagccttttccaccgtgcctctcacacctgtgccaaggccatcggactcggtgtcctcgacccctgctgccacctctaccccaagtaaacaggccctccagttcttttgttacatttgcaaagcttcatgtagcagccagcaagagttccaagaccacatgtctgagccacaacatcagcagaggttaggagaaatccaacatatgagccaagcgtgcctgctgagccttcttcctgtcccacgggatgtgctggaaactgaggatgaggaacctcctcccagacggtggtgtaacacgtgccagctctactacatgggcgacctgatccaacacagaagaactcaggatcacaaaatagctaagcagagtttaagaccattctgcactgtgtgtaaccgctacttcaagacaccgagaaagttcgtggaacacgtgaagtcgcaaggccataaagacaaggccaaggagctgaagagcctggagaaggagattgctggacaagatgaagaccactttattaccgtagatgccgtgggatgtttcgagggtgacgaggaggaggaggaggatgacgaggacgaggaagagatcgaggtagaggaagaattgtgcaaacaggtgaggtctcgcgacattagtagagaggaatggaaaggaagcgaaacatactcacccaacaccgcctacggtgtggacttccttgtgccagtcatggggtatatctgccgtatttgccataagttctaccactctaacagtggcgcccagctctcccattgtaagagtctgggacactttgaaaacctgcaaaagtacaaagctgcaaaaaatccgtctcccactacaagacctgtttccaggcggtgcgcaattaacgctcgaaatgccctgacagccctttttacctcatccgggagacccccctctcagcccaatactcaagataaaacaccatcaaaagttacagcaagaccgagtcagcctcctcttcccagacgcagtacccggctgaagacctag

SEQ ID NO: 18822 - DNA, 2697 bp, Artificial Sequence
  Description of Artificial Sequence: Synthetic coding sequence
atgttcagccagcagcagcagcagcagctgcagcagcagcagcagcagctacagcagctccagcagcaacagttgcagcagcaacagttacagcagcaacagttgctccagctccagcaactgctgcagcagagccctcctcaggcgccccttcctatggctgttagcagagggctcccaccccagcagcctcaacaacctctactgaaccttcagggaactaacagtgctagcctgctcaacggttccatgctacagagggccctgctgctgcaacagcttcagggactggatcaattcgcgatgcctcccgccacatacgacactgcgggtttaacaatgcccaccgctacattagggaacttgagagggtatgggatggcaagccctggtctggccgcacctagcttgactccccctcagcttgccactcctaaccttcagcagttctttccacaagcaacgcgccagagcttgctgggtcctcctcccgtgggcgtgccaatgaatccatcgcagtttaacttgtctgggcgcaatcctcagaaacaggctcgcactagttcatccactacccccaatagaaaagactcttcgtctcagactatgccagtagaagacaagtccgacccccctgagggcagcgaggaagcagctgagcctagaatggatacaccagaagaccaggacttgccgccctgccctgaggacattgccaaggagaagcggactcccgcgccagagccagaaccttgcgaggcttccgagcttcccgcgaaaagactgcgcagcagcgaagagcccacagagaaggagcctcctggccagttacaagtcaaggcgcagccgcaagccagaatgactgtgccaaagcagacacagacccccgacctgttacccgaggctctagaggcgcaggtcctaccacgtttccaacccagagttttacaggtccaagctcaggtccaaagccagacacagccccgcattccatcgacagacacacaagtccagcctaagctgcagaagcaggctcagacccaaacgagccccgaacatctggtactgcagcaaaaacaagtgcaacctcagttgcagcaggaggctgagccacagaaacaggttcagccacaggtccagcctcaggcacacagccagggaccgcggcaagtacagctgcagcaggaggcagagccactaaaacaggtgcagccacaagtgcagccgcaagcccattcccagcctcccaggcaggtgcagttgcaattgcaaaaacaagttcaaacacagacctacccacaggttcatactcaagcacagccctctgtgcaacctcaggagcacccaccagcccaggtcagtgtccaacccccagagcagacccatgagcagcctcatacacaaccacaagtctctctgctggcccccgagcagacgcctgttgtggtgcacgtctgtggcttggagatgccccctgacgctgtggaggccggtggtggaatggagaaaactttgccagaaccagtcggtacccaggtcagcatggaagaaatacagaacgagtctgcttgtggcctggatgtgggggaatgcgaaaacagagccagggaaatgcctggggtctggggggccggagggtcacttaaggtgactatactgcagagtagcgattctagagctttttccacagtgccactgacccctgtgcccaggcccagtgatagtgtatcgagcacccctgcagccacttccactccttccaagcaagccttacaatttttttgctacatttgtaaagcttcctgctcctcacaacaggaattccaggatcatatgtccgagccccaacatcagcaacggctgggcgagattcaacatatgagtcaggcctgcctactgagccttctgcctgtgccccgggatgtcttggagaccgaggacgaggaaccccctcctagaaggtggtgcaacacgtgtcagctatattacatgggggacttgatacaacatcggcgcacccaggaccataaaattgctaagcagagtttgcgacctttttgcacagtttgcaatcgttattttaaaacgccacgtaaatttgtagagcatgtgaaatcccagggccacaaggacaaagcgaaggagttaaagtctcttgagaaagagatcgcgggtcaggacgaggaccacttcattactgtagacgccgtcgggtgtttcgagggggacgaggaggaagaggaagatgacgaagatgaggaggaaatcgaagttgaggaagagctctgtaagcaggtgaggtccagagatatcagcagagaggagtggaagggtagcgaaacctatagccccaacactgcatacggtgtggactttctggtaccagtgatgggatacatctgtaggatttgtcataaattctatcacagtaatagtggcgcccagctgtcgcattgtaaatcactgggccacttcgaaaatcttcagaagtataaggccgccaaaaaccccagcccaaccacaagacccgtgagcagaagatgtgcgataaatgccaggaatgccctcacagcactcttcactagcagcggccggcctccctcccagcccaacactcaggataaaacacccagcaaagtcaccgcgcgtccctctcagcccccactcccaaggagatctacacgtcttaagacctag

SEQ ID NO: 18823 - DNA, 2463 bp, Artificial Sequence
  Description of Artificial Sequence: Synthetic coding sequence
cccctgcccatggccgtgagccggggcctgcccccccagcagccccaacagccccttctcaatctccagggcaccaacagcgccagtctgctgaatggcagtatgctgcaacgggccctcttactgcagcaactgcaggggaatcttcgggggtatgggatggcgagccctggcttagcagcccctagcttaacgcctccccagctcgctacaccgaacttgcagcagttcttcccacaggccactcgccagagtttactggggccaccccccgtgggcgttcctatgaatcccagccaatttaacctttcagggcgcaaccctcagaaacaggcccggacgtcttcctctaccactcctaatcgcaagaccatgcctgtggaggacaagagtgaccctcccgagggctcggaagaagccgccgaaccacgcatggacacacctgaagatcaggatcttcctccctgtcctgaggacatcgcaaaggaaaagcggactcctgctccagagcccgaaccatgtgaagcaagcgagctgccagctaaacggttaaggagttcagaagagcctacagaaaaagaaccccctggccagctgcaggtgaaggcccagccccaggcaagaatgacagtaccaaaacaaacccagacacccgatctcctcccagaggctctggaggcccaagtgctccctcggttccagccccgtgtgctgcaagttcaggcccaggtccaatcccaaacacagcccaggatacccagtacagatacccaggtccagcccaagcttcaaaagcaggctcaaactcagacttcaccagagcacctcgtgctacaacagaagcaggttcagccacagttgcagcaggaggctgaaccccagaaacaagtgcagcctcaggttcaaccacaggctcacagtcagggtcctcgacaggtgcaactacagcaagaagccgagcccctgaaacaagtgcagccccaggtacaacctcaggcccactctcaacccccgcgccaggtacagctgcagttgcagaagcaggtacagactcagacctacccacaggtccatactcaagctcagcctagcgtacaaccacaggaacacccacccgcacaggtgtctgttcagccacctgagcagacacacgaacagccccacacccagccccaggtcagcctgttggccccagagcagacacccgtggtcgtccacgtgtgtggattagaaatgccccccgatgcggttgaggctgggggaggcatggagaagaccctgcctgagccggttggaacacaagtgtccatggaagaaatccagaatgaatcagcatgcggtctggacgtgggggaatgcgagaatcgggcccgtgaaatgcctggtgtttggggagctggagggtctctcaaggtgaccatccttcagtcttcagactccagggccttctctacagtgcctctgacccccgtgccccggcctagtgactccgtctcatctactccagcggctacctcaacaccaagtaagcaagccctccaattcttttgttacatatgcaaggcgtcatgctcttcacagcaagaattccaggatcatatgtctgaaccacagcaccagcagagacttggggaaattcagcatatgtcccaggcgtgcctgctcagtctgcttccagtaccgcgagatgttctcgagacagaggatgaagagccaccaccgcggaggtggtgtaacacatgccagctatattatatgggcgatctgatccagcatagaagaacccaagaccataaaatagctaagcagtccctcaggcctttctgcacggtgtgcaacaggtatttcaaaactcctagaaagtttgtggagcacgtcaaaagtcaggggcacaaggacaaggcaaaggaactgaagagcttagaaaaggagattgcaggacaagatgaggatcattttattaccgtcgacgctgtgggatgctttgaaggagacgaagaagaggaagaagatgacgaggatgaggaggaaatcgaagtggaagaggagctgtgcaaacaagtgcggtctcgcgatatttcgcgcgaagaatggaagggaagtgaaacatattcacctaacaccgcatacggtgtggatttcctggtgcctgttatgggatacatttgcagaatctgccataagttctaccactcgaatagtggagcccagttatcccattgtaagtcactgggtcacttcgaaaatctccagaaatacaaggcagccaagaacccatctcctacaactagacccgtctccagacgctgtgcaattaatgcacgaaatgcgctgaccgcactctttacctctagcggacgacccccctcacagccaaatactcaggataagacaccaagcaaagtgacggcgaggccatcccagccccccttgccacggcggtcaactaggttaaagacctag

SEQ ID NO: 18824 - DNA, 507 bp, Artificial Sequence
  Description of Artificial Sequence: Synthetic coding sequence
atgttcagccagcagcagcagcagcagctgcagcagcagcagcagcagctgcaacaattgcagcagcaacaattgcagcagcagcagctccagcagcaacaattgcttcagctgcaacaactgctccagcagagccctccacaagcaccactcccaatggccgtgagccgcggactgcccccacaacagcctcagcagcctctgctgaaccttcagggaacgaattctgccagcctgctgaatggatcaatgcttcagcgcgcgttacttttgcaacagctgcagggccttgaccagttcgcaatgccaccagccacatacgataccgccggccttaccatgccgacagcaaccttaggtaatttgcgggggtatggcatggccagtccaggccttgcagcacccagcctgacgcctccccaattggcgacacctaatctacagcagttctttcctcaggccactagacaaagcctgctgggcccccctcccgtgggtgtgccctag

SEQ ID NO: 18825 - DNA, 2514 bp, Artificial Sequence
  Description of Artificial Sequence: Synthetic coding sequence
atgttcagccagcagcagcagcagcagctgcagcagcagcagcaggcaccgctccctatggctgtttcacgtggtctgcccccgcagcagccccagcagccactcctgaatttgcaaggcaccaactccgctagcctcttaaacggatcgatgctgcaacgagcattgctgctgcagcagcttcagggcctcgaccagttcgctatgccccccgcgacatacgacacagccggcttaaccatgccaactgctaccctgggcaacctgcgagggtacggaatggcttcacctggactggccgcgccctccttaactcccccacagctcgccacccctaacctccaacagttctttcctcaagccacccgtcaaagtttgttagggccccctccagtgggcgtgcctatgaaccctagccaattcaacctgtccgggaggaatcctcagaaacaggcacgaacttccagtagtaccacacctaaccgaaaggattccagctcccagactatgcctgtggaagacaaaagtgaccctcctgagggatcagaagaggcagcagaaccccggatggacactccagaggaccaggacctgccaccatgcccagaggacatcgccaaagaaaagcggactcccgcacccgaacctgagccgtgtgaggcatctgagctcccagctaaaaggctcagatcaagcgaagagcctactgagaaggaaccgcccggccagctccaggtaaaagcacagccacaggcccgcatgactgtgcccaaacagacccagactcctgacctgctgcccgaagctctcgaggctcaggtgttgccaagatttcaaccaagggtgctgcaagtccaggctcaggtgcagagtcagactcagccacgcattccctcaactgacactcaggtccagccaaagctacaaaaacaggctcaaacgcagacaagccccgaacacctggtgttacaacagaagcaggtgcagcctcagctgcagcaggaagctgagcctcagaaacaggttcagccacaagtgcagccacaagcccactctcaagggcctcggcaggtgcagctccagcaggaagcagaaccattgaagcaggtccaacctcaggttcatacacaggcccagccaagtgtgcagcctcaggaacacccccctgctcaggtatcagtgcaaccacctgaacagacgcacgagcagcctcacactcagccacaggtaagcctgctggcccctgaacagacccctgtcgtcgtgcacgtgtgcgggctcgaaatgccccccgacgcagtggaagcgggcggtggaatggaaaaaacgctgcccgagccagtcgggacgcaggtttctatggaagaaattcaaaacgaaagcgcatgtggcctggatgtgggcgagtgtgaaaacagggcacgcgagatgcctggcgtatggggtgctgggggctccctgaaagtgactattcttcagtcatccgactctagggctttttctactgtgccgcttaccccagtgcccaggcctagtgattctgtgtcctcaacacccgccgctacgagcacgccaagcaagcaggccttgcaatttttttgctacatttgcaaagcatcatgttcatcccaacaggagtttcaggatcacatgtctgagccacagcatcagcagcggctgggcgaaatacagcatatgtcacaggcgtgtctgttgagccttctgcccgttccaagagacgtgttggaaacagaggacgaggagccacctcctcggcgctggtgcaacacttgccagctgtattatatgggcgaccttattcagcaccgtcggacccaggatcacaagatcgcaaaacagtccctccggcctttctgcactgtgtgcaaccgatatttcaaaactcctcgcaagttcgttgagcacgtgaaaagccaaggccacaaagataaggccaaagagctcaagtctcttgaaaaggagatcgctggacaagacgaagaccatttcatcaccgtggatgcagtgggttgcttcgagggggacgaggaagaggaggaggatgatgaagacgaagaggagatcgaggtggaggaggagttgtgtaaacaggtgcggtccagggatatctcaagggaggagtggaagggtagtgaaacctatagtcctaatacggcttatggggttgatttcctcgtgccggtgatgggctatatttgccgtatatgccataagttctaccatagcaacagtggagctcagctgagtcattgcaaatccctcgggcattttgagaatttgcagaagtataaagcagccaaaaatccatctccgaccactaggcctgtgtcccgccggtgcgccattaacgcaaggaatgccttaaccgcattgtttacatctagtggacggccgccatcccagcccaatacccaggataaaacgccttcaaaagtgacagcgcgaccaagccagcccccattgcctagacgctcaacccggctgaaaacgtag

SEQ ID NO: 18826 - DNA, 2775 bp, Artificial Sequence
  Description of Artificial Sequence: Synthetic coding sequence
atgttcagccagcagcagcagcagcagctgcagcagcagcagcagcagctgcaacagttgcagcagcagcagctgcaacagcagcagctgcagcagcagcagctgctccagctccagcagctcctccagcagagtcccccacaggccccacttccaatggccgtgtctcggggcctccctccgcaacagccacagcagccgctcctgaatctgcagggcaccaacagcgcttctctactgaacgggtccatgctccagagggccctgttgctgcagcaacttcaaggcctggaccagtttgccatgcccccagccacctacgacacggccggtctgaccatgcctaccgccaccttgggcaacctccgcggctatggcatggcttcccctggcctggctgccccctccctgacgcctccgcagttggctaccccaaacttacagcaattctttccacaagctacaagacagagtctgttgggtccccccccggtgggagtaccaatgaatccatcccagttcaaccttagtggacgcaacccacaaaagcaggccagaacctcgagttctacaacccccaaccgtaaagacagtagttctcagacaatgcctgtggaggacaagagcgatccccctgagggaagcgaggaagccgccgagccccggatggacactccagaggatcaagacctgcccccgtgcccagaggacatcgctaaggaaaaacgtacacctgcgccagaacccgagccctgcgaagcttctgagctgccagccaagaggcttcgatcctcagaagagcccacagaaaaggagccacctggccaactccaggtgaaggcacagccacaagccagaatgactgtacccaaacagactcagacgccagacctcctcccagaggccctggaagcacaggtgctgccaagattccagccaagagtgcttcaggtgcaggctcaggtacagagtcagactcagcccagaattccatccaccgatacccaagtgcagcctaagttgcagaaacaggcccagacccagacctcacccgaacacctggtgctgcagcagaagcaagtccaacctcagttgcaacaggaagctgaaccccaaaagcaggtccagccgcaggtgcagccccaagcgcacagccagggtcctcggcaggtgcagttacagcaggaagccgagccgctgaaacaggttcagccgcaggtccagccacaggctcactctcagccaccccgccaggtacagcttcaactccagaagcaagttcagacacagacatatcctcaggtgcatacacaggcgcaaccgagcgtccagccccaggaacatcctcccgcccaggtcagcgttcagcccccggaacaaactcacgagcagccccatacacagcctcaggtctcactgttggccccagaacagacccccgtggtggtccatgtgtgcggacttgagatgcccccagacgctgttgaagcgggcggcgggatggaaaaaactttgcccgagcccgttggcactcaggttagtatggaggagatacaaaacgagagcgcatgtgggttggacgttggggaatgcgaaaacagagcccgggaaatgccaggtgtgtggggggctggaggcagtttgaaagtcaccatcctacaatcgagcgactcgcgcgccttcagcactgtgccactcacccctgtcccacggccctccgatagcgtaagctccacgcccgccgcaactagcacccctagcaaacaggccctccagtttttctgctacatatgtaaggcgtcatgttcctcccagcaggaattccaggaccacatgtccgagccccagcaccaacaacggttgggcgagatacagcatatgagccaggcatgccttctgtccctgctccctgtgccccgcgacgttttggagaccgaggatgaggaacccccaccaagacggtggtgcaacacttgccagttgtattatatgggtgaccttatccagcatagacggactcaggatcacaaaccacctactccaagacgcgacgttttcgctcacgttccagtccaaggatggagtaccgctagactcgtaacagatatgatcgcgaagcagtccctacgccctttctgcactgtgtgtaatcggtacttcaaaacgccccgcaaattcgtcgagcatgttaaatcgcagggtcataaagataaagctaaagagctgaaaagtctggagaaggaaatagcaggccaggatgaggatcatttcattactgtagacgctgtggggtgcttcgagggagatgaagaagaagaggaggatgacgaggacgaggaagagattgaagtggaagaggaactttgcaagcaagtacgatccagagatatcagcagagaagagtggaaaggttccgaaacctactctccaaataccgcttatggagtcgatttcctagtccccgtcatgggctacatttgccgtatatgccataagttttatcacagtaatagtggcgctcagctttcacattgcaaatctttaggccatttcgaaaatctgcagaagtataaggctgccaagaatcccagtccaaccactagacctgtgtcaaggcgttgcgctatcaacgctcggaacgcgctcacagccctgttcacgtctagcgggcggcccccctcccagcctaacacccaggataagacgccatcaaaggttaccgcacgcccaagtcagccaccattgcctaggaggagtacaagactcaaaacttag

SEQ ID NO: 18827 - DNA, 2394 bp, Artificial Sequence
  Description of Artificial Sequence: Synthetic coding sequence
atgccccccgccacctacgacaccgccggcctgaccatgcccaccgccactttgggaaacctgaggggatacggaatggccagccctggtctcgcagctccatctctcaccccgccccagctagctactccgaatctgcagcagttctttcctcaagcaacccgccagtccttgctgggaccgcctcctgtgggcgttcctatgaaccctagccagtttaatttaagcggcaggaatcctcaaaagcaagcccgcacgtctagcagtaccacacccaatcgaaaggatagctcaagtcaaactatgccagtcgaagataaatcagacccccctgaaggctccgaggaggccgctgaacctagaatggacacccctgaggaccaggacctgcctccttgccctgaggacatcgccaaggaaaagaggacccctgctccggagcctgagccttgtgaagcttccgagctgcccgctaagcgcctccgctctagcgaagagccaactgagaaagagccgcctggccagctgcaagtaaaggcccagccacaggcaaggatgaccgtgccaaagcagacccagacgccagatctactccctgaggccctggaggctcaggttctgcctagatttcagcctcgcgtgctgcaggtgcaagcccaagtgcagtcccagactcagccccggattccatccactgacactcaggttcagcctaaactgcagaagcaggcccagacccagacctctcccgagcacctggtgctccagcagaagcaggtgcaaccacagctgcaacaggaagcagaaccccagaagcaggtgcagccccaagtgcagccccaggcccattctcagggcccccgccaggtacagcttcagcaggaagcagagcctctgaagcaggtacagcctcaagtacagccacaggcacactcacagccccctcggcaagtgcagcttcagctgcagaagcaagtacagacacagacctacccccaggtgcacacccaggcacagcccagcgttcagcctcaggaacacccccctgcacaagtttccgtgcagccccctgagcaaacccacgaacagccacatacccagccgcaggtgagtcttctggcacctgagcagacaccagtggtggtgcatgtctgcgggctggagatgcccccagacgccgtggaagctggcggtggcatggaaaaaaccctaccagaacctgtgggcacccaggtgtctatggaggaaattcagaacgaatctgcatgtgggctcgatgtgggggagtgtgaaaatcgtgctagagagatgcctggagtgtggggagctggcggtagcctgaaggtcactattctccagtcttccgatagccgggcgttctctacagttcccttgaccccggtgcctcgcccctcagattcagtgtccagcacaccagctgcgacaagtacccccagcaagcaggccctccagtttttttgctatatctgcaaggcctcctgcagttcccagcaggagttccaagaccacatgtcagagccacagcatcagcagcgattgggagagatacagcatatgtctcaggcctgtctgctgagcctgctgccagtgccacgggacgtattagagactgaggacgaggagccgcctccccgtcggtggtgcaacacttgccagctgtactatatgggagacttaatccagcatcgcagaacacaggaccataaaatagccaaacagagtctgcgtcctttctgtactgtgtgtaatcggtacttcaaaacccctaggaagttcgttgaacacgttaagtctcaaggccacaaagacaaagccaaagaactcaagtcattggagaaagagatagcaggccaggatgaagaccattttataacggtcgacgctgtcgggtgctttgagggtgacgaggaggaggaggaggacgacgaggatgaagaggaaattgaggtggaggaggagttatgcaaacaagtgagatccagggacatatcacgcgaggaatggaagggctctgagacatacagcccaaataccgcttacggcgtggatttcctagtgccagtgatggggtacatttgcaggatttgccacaagttctatcacagcaacagcggcgcccaactgtcacactgcaaaagcctgggacattttgaaaatctgcagaaatacaaggccgctaagaaccccagtcctactacccgccccgtctctaggcgctgcgctatcaacgcaaggaacgcactcactgctctgtttacgagttcgggtaggccaccctcccagcccaatactcaggacaagaccccttcaaaggtcactgccagaccatctcagcctcccctccctcgtcgcagcactcgcttgaagacatag

SEQ ID NO: 18828 - DNA, 1743 bp, Artificial Sequence
  Description of Artificial Sequence: Synthetic coding sequence
atggcccaggaggtgagcgagtacctgagccagaacccccgggtggccgcttgggtggaagctctgcgatgtgatggggagaccgataagcattggaggcaccggagggatttcctgctacgcaatgcaggcgatctggcacccgccgggggggccgcgagcgcaagcactgacgaggccgctgacgccgagagcggaacacggaaccggcaactgcagcagctgatttccttttcgatggcctgggccaatcacgtcttcctgggttgtcgctaccctcagaaagttatggacaagattttgtcgatggctgaaggtatcaaggtcaccgatgccccgacctacactactagggatgagctagtggctaaagtgaagaaaagaggaatttcctcctccaacgaaggcgtcgaagaaccttccaaaaagcgcgttattgaaggtaaaaactcttctgcagtggaacaggaccacgccaagacaagtgccaagactgagcgcgccagcgcacagcaggagaatagcagcacatgtatcggcagcgcaatcaagtctgagtctggtaactcagcccgctccagtgggatctctagccaaaacagcagcactagcgacggagataggtctgttagttcccaaagctcttcttcggtgagctcccaggtgaccacggctggttccggcaaggcttctgaagctgaagccccagacaaacacggctccgcttcatttgtgagtctccttaagagttccgtcaactctcatatgacccagtcaactgacagccggcagcagtctgggtcaccaaaaaagtctgccttggaaggatctagcgcctctgcatcccagtcgtccagcgagattgaagtgccactcctggggagtagcggctccagtgaggtcgagcttccccttttatcatcaaagccttcatcagagactgcaagctccggccttacttcgaaaacctcaagcgaggcctctgttagctctagcgtagctaaaaatagcagtagcagcggaacctcattgcttactccgaagtccagttcctcaaccaacaccagcctgctcacttctaagagcacgagccaggtggccgcctctctactcgcttcgaagagctccagccagacaagcgggagtctggtgtccaagagcacgtcccttgctagcgtctctcagctggcaagcaagagctcatcacaaacctccacatctcaactcccgtctaaatctacaagccagtcatctgagagttccgtcaaattttcatgtaaacttacaaacgaagacgtcaagcagaaacagcctttctttaatcgactgtacaaaacggtggcctggaagcttgtagcagttgggggctttagccccaacgtcaaccacggagagttgctcaacgctgctattgaggccctgaaggcaacactagatgtgttttttgtgcccctgaaagaattagccgacctgccacaaaacaaatcatcacaagaaagcattgtgtgtgaacttcgatgtaagagcgtataccttggcaccggctgtggaaaatcaaaggagaacgccaaggcggtcgccagccgcgaagcattgaagctgttcctcaagaagaaggtggtagtcaagatctgcaagcggaagtaccgtggcagcgaaatcgaggatctggtgttactggacgaggaatctcggcccgttaacctgcctcccgcactgaaacatccacaagagctcctgtag

SEQ ID NO: 18829 - DNA, 564 bp, Artificial Sequence
  Description of Artificial Sequence: Synthetic coding sequence
atgcccggcgagcggcccaccgacgccaccgtgatccccagcgccaagcgggaacgcaaagccatcacactggatctcaaactcgaggtcttgcgtcgcttcgaagcaggagagaagctgtcgcagattgccaaagctctggacctcgccatctccacagtggcaacaatccgtgattctaaagagaaaatcaaagcttctagccaaattgccacgccgctgcgggcttcgcggttaactcgtcaccgctccgcggtcatggaatccatggagcagctgctgtccttatggctagaagatcagagtcagcccaacgccactttgtcggcagcaattgttcaggaaaaggcggagttcgatgaccttcagcgggaacacggtgaaggctcccaaaccgagagattccatgcctcacagggctggctggtgcgctttaaagagtgtcactgccttccgcattttaagatgaactctgccgctccaagtaataaagatatgtacaccgagatgttaaagagcatcatcgaggagggcgagtatacacctcaggtgagtttaacgtag

SEQ ID NO: 18830 - DNA, 312 bp, Artificial Sequence
  Description of Artificial Sequence: Synthetic coding sequence
atggccctgagcaccatcgtgagccagcggaagcagatcaagcggaaggctccgcggggcttcctgaagcgggtcttcaaaaggaaaaaacctcagctgaggctggagaaatctggcgatctgctcgttcggtttcaccctttcagtggatgggagtgggggacaggcgaggtgcatttgaattgcctgctgttcgtgcaccgcctcgccgaggagtcgcggacaaatgcctgcgccagcaagtgcagagtgatcaataaggagcatgtacttgcagcagcaaaagtcattctaaaaaaaagcagaggttag

SEQ ID NO: 18831 - DNA, 204 bp, Artificial Sequence
  Description of Artificial Sequence: Synthetic coding sequence
atggccctgagcaccatcgtgagccagcggaagcagatcaagcggaaggccccaagagggttcctgaagcgggtgttcaaacggaaaaagcctcagctccgactcgaaaagtcaggcgaccttctgaagtcacccggacagactcttgtgcgggtcaacgtggagtccctgacccgctctatgtactggccacaacagcgttag

SEQ ID NO: 18832 - DNA, 267 bp, Artificial Sequence
  Description of Artificial Sequence: Synthetic coding sequence
atggccctgagcaccatcgtgagccagcggaagcagatcaagcggaaggctccaaggggcttcctgaaacgggtctttaaacgcaagaagccacaactgaggctcgaaaagtcaggcgacctgctggttcaccttaattgtttattgttcgtgcatcggctggctgaggaatcacggactaatgcgtgtgcctccaagtgtcgtgtaattaataaggagcacgtgctggctgccgcaaaggtgattcttaagaagtccaggggatag

SEQ ID NO: 18833 - DNA, 3846 bp, Artificial Sequence
  Description of Artificial Sequence: Synthetic coding sequence
atggtgcggaagaagaacccccccctgcggaacgtggccagcgagggcgagggccagattctggaacccatcggaaccgaatccaaagtctctggcaagaataaggagttttctgccgatcagatgtctgagaacacagatcagtcggacgcagccgagttgaaccacaaggaggagcactcactgcatgtccaggacccatcctcaagcagcaaaaaggatttaaagtcggcagtgttatcagaaaaagctggctttaactatgaaagcccgagtaagggtggcaactttccttccttcccacacgacgaagtgactgaccgcaatatgcttgcgttttcaagcccggctgctggcggtgtgtgcgagcccttgaaaagcccccagcgagctgaagccgatgatccacaggacatggcttgcactcctagtggagattccctcgaaaccaaggaggaccagaagatgtcccctaaagcaacggaagagactggccaggcccagtccggtcaggctaactgtcaggggcttagtccagtgtcagtagcctccaaaaaccctcaagttcctagtgacggcggtgtgcggctaaacaaatcaaagacagatcttctcgtgaacgataacccagaccccgcccctctctcccccgagttgcaagacttcaaatgcaacatctgcggctacggatactacggaaacgatccgacggacctcatcaaacactttcgaaaatatcatcttggtttgcacaaccgcacccggcaagacgctgagctggactcaaaaatactcgcattgcataacatggtgcagttttctcactccaaagatttccagaaggtgaatcggagtgtgtttagcggggtcctgcaggacattaactcctcccgcccggtcctcctgaatggcacctacgatgtccaggtcacctcagggggaacatttataggcattggcagaaagacccctgactgccaaggtaatacaaagtacttccggtgtaagttctgcaattttacctacatgggaaattccagcaccgagctggagcagcacttcctacagacacatccaaacaagattaaggcctccttgcctagtagcgaagtggccaagccatccgagaaaaacagcaacaaatctatccctgcgcttcagagtagtgatagtggcgacctcggcaaatggcaggataaaatcacagtgaaggctggcgatgatacacccgtggggtactcagtgcccataaaaccactcgacagcagtcggcagaatggtacagaggcgacctcttactactggtgtaaattttgctccttctcctgcgagagttctagctcactcaagctgcttgagcactatggcaaacagcacggggctgtgcaaagtgggggccttaatccagagctgaacgataagttgtcaagggggtcagtgatcaaccaaaacgacctggcaaaaagcagtgaaggcgagaccatgacaaaaaccgataagtcttccagtggggctaagaaaaaggacttctcatcaaaaggtgccgaggacaatatggttactagctacaattgccagttctgcgattttcgatactcaaagagccatggtcctgacgtcatagtagttggtcctctcctgcgccattatcagcagcttcacaatatacataaatgcaccatcaagcactgccctttttgtccaagagggctgtgttctccagagaagcacctgggagaaataacctacccgttcgcctgtagaaaatctaattgctcccactgcgccctgttactgctgcacctgagccccggcgcggctggatcttctagggttaagcaccagtgccatcaatgttcatttacaactccggacgtggacgtcctgctcttccactacgagagcgtgcacgagtcacaggcatcagatgtgaaacaagaagccaaccatctgcaagggtctgacgggcagcagagcgtgaaggagagtaaggaacacagttgcaccaaatgcgacttcatcacgcaagtggaggaggaaattagccgtcattatagacgggctcacagctgttataagtgtcgacagtgttcatttacagctgcagacactcagtccctgctggaacacttcaacaccgtgcactgccaggagcaggacattaccacggcgaacggagaagaagacggtcacgcaatttcgactatcaaggaggagcccaagatcgactttcgcgtttacaacctgctgaccccggacagcaagatgggcgaacctgtctctgaatccgttgtcaaacgagagaaactggaggagaaggacggcctgaaagagaaggtctggacggaaagctcatcggacgatttgagaaatgtgacatggagaggcgccgatatcttgaggggttccccttcatacacccaggcctcattaggccttcttactccggtgagcgggacgcaagagcagacgaaaacccttcgcgatagtcctaacgtggaggccgctcatctcgctcggcctatttatggactggccgtggagacaaaggggttcttgcagggcgccccagctggtggcgaaaagtctggagcactgccacaacaataccccgcctctggtgagaacaaatccaaagacgagagtcaatctctgcttcgtcgccgtaggggctctggggtgttctgtgctaactgcttaacgacaaagaccagcctgtggcggaaaaacgcaaacggaggatacgtgtgcaacgcatgtggactctatcagaagctccacagcacccccagacctcttaatattatcaagcagaacaatggagagcagatcatacggcgtagaacaagaaagcgcctcaatccagaggctctgcaggctgaacaattgaataagcaacagcgcggatcaaacgaagaacaagtaaatggcagtcccctggaacgtaggagcgaggaccatctcaccgagtcacatcagcgagagatcccattgccatcactgtctaaatatgaggcacaggggtccctgaccaagtcccattctgctcagcagccagtactggtgtcacagacgttagacatccacaagcgcatgcagcctctgcatattcagatcaagagcccacaggaatctacaggcgaccccggcaactcaagctcggtctccgagggcaagggatcttcagaacggggaagcccaatcgagaagtacatgaggcccgccaaacatccaaattacagcccccctgggagccccatcgaaaaataccagtacccattgttcggactaccctttgtgcataacgattttcagtccgaagcagattggctgcggttttggagcaagtataaactgtccgtgccgggcaacccccattaccttagccacgtacccgggctgcccaacccatgccaaaattacgtgccatatcctacattcaatctcccaccccattttagcgctgtgggaagcgataacgatattccgctggatctggccatcaagcattccagacctggaccaaccgccaatggggctagcaaggaaaagaccaaggctccaccgaacgtgaaaaacgagggacccctaaatgtggttaaaacagaaaaggttgaccgatccacccaggacgaactgtcaaccaagtgcgtgcactgtggcatcgtattcttggatgaggtcatgtatgccctccatatgtcttgtcatggggattccggcccatttcaatgttccatttgtcagcacctgtgcactgataaatacgatttcactacacacattcagcggggactgcatcgcaataacgcccaggtcgaaaagaacggcaaacctaaagaatag

SEQ ID NO: 18834 - DNA, 2871 bp, Artificial Sequence
  Description of Artificial Sequence: Synthetic coding sequence
atgctggaggagctggagtgcggcgcccccggcgcccggggcgccgccacagccatggattgtaaggaccgtcccgccttccctgttaagaagcttattcaggcccggctcccattcaaaaggctcaatcttgtgcccaagggaaaggccgatgacatgtcagacgaccaggggacatctgtacagagcaaatcccctgatctggaagcctcccttgacaccctcgagaataactgtcacgtggggagcgatatagacttccggcctaagttggtaaacggaaagggaccactggataactttctgcgcaacaggatcgaaacctcaatcggccagtctaccgtcatcatcgacctcactgaggattctaacgagcagcccgatagcttggttgatcataacaaattaaatagcgaggcatcaccttccagggaggccataaacgggcagcgagaagacacaggggatcaacagggtctgctcaaagctatacagaatgataaactcgcattccccggggagactctgtcagatatcccgtgtaagacagaggaagagggggtgggctgtggtggggccgggaggaggggagattcacaggagtgcagtccccgaagctgccccgagctgacatcgggccctcgtatgtgccccaggaaggagcaagacagctggtctgaagccggaggtatcctttttaaaggtaaagtcccaatggttgtgctacaggacatattggccgttaggcctccacaaattaagagcctgccggctactcctcaggggaaaaatatgacgcctgagagcgaggtgctggaaagttttcctgaggaagacagtgtcctgtcgcactcatcactgagcagcccctcctcaaccagtagcccagagggaccaccagccccacctaagcagcactctagcacctcccccttcccgactagcactccgttaagacgcatcacaaagaagtttgtcaagggctctaccgaaaagaataaactgcgcttgcagagggatcaagagcggcttggaaaacagctgaaactcagggcggagcgggaggaaaaagagaagctgaaggaagaagccaagcgagccaaagaagaagccaaaaagaaaaaggaggaggagaaggagctcaaggaaaaggagcgacgcgaaaagcgcgaaaaagatgaaaaagaaaaagcagagaaacagagactcaaggaggaaaggcgcaaggagcggcaggaagcacttgaagctaagcttgaagagaagcggaagaaagaggaggaaaaaaggttgcgggaggaagagaagcgaatcaaggccgagaaggctgaaattacaagatttttccagaaacctaagacaccccaggctcctaagacattagcaggttcatgcggcaagttcgcacctttcgaaatcaaagaacatatggtactcgcgccacgccgacggacagcctttcaccctgatctctgctcgcagctggatcagctgctgcagcagcagagtggagaatttagcttcctcaaggacttaaagggccgtcaaccactgaggagtggtcccacgcatgtgtccacgaggaatgcggacatcttcaatagcgacgtggtgattgtcgaacgcggaaagggggatggtgtacccgagcgaaggaaatttggccgtatgaagctacttcagttttgtgaaaaccaccggcccgcttactggggcacttggaacaagaaaactgcacttatcagggctcgcgacccttgggctcaggataccaagctgctcgactacgaggttgacagcgacgaggaatgggaggaggaagagcccggggaaagcctgagccatagtgagggagacgacgatgacgacatgggcgaggatgaggatgaggacgacggcttttttgtaccacatggatatctgtcggaagatgagggtgtcaccgaggaatgcgccgacccagagaaccacaaagttcgacaaaagctgaaggcgaaggaatgggatgagttcctggccaaaggcaagcgcttcagggtgctgcagccggtaaaaataggctgcgtgtgggctgcagaccgtgattgtgcaggagacgacctcaaggtgttgcagcagttcgccgcctgctttctcgagaccctccctgcacaggaggaacaaacccccaaagcttctaagcgtgaacggagggacgaacagatccttgcgcagttgctgccactgttgcacggcaatgtgaatggcagtaaggtcattattcgggagttccaggagcactgtagacgtgggctgctgtcaaatcacaccgggagcccaagatcacctagcacaacctatctgcatactcctacgcccagtgaagatgctgctatcccttctaaaagcagactcaagagattgattagcgagaattctgtctacgaaaagcgtcccgattttcgcatgtgttggtatgtacatccacaagtccttcagagcttccaacaagagcacctgccagtcccatgtcagtggagctatgtcacaagcgttcccagcgctcctaaggaggattccgggtctgtgcctagtaccgggccatctcaagggacacccatatccctgaaaaggaaatccgccggatccatgtgcattacccagttcatgaaaaaacggaggcacgatggacagataggagccgaggatatggacggctttcaggccgataccgaggaggaggaagaagaggaaggcgattgcatgatcgtggatgtgccagatgccgccgaggtacaggccccctgcggcgcagcctcaggagctggcggaggcgtgggcgtcgatacaggcaaagccacattgacgtcgtcccctctgggtgcatcttag

SEQ ID NO: 18835 - DNA, 2250 bp, Artificial Sequence
  Description of Artificial Sequence: Synthetic coding sequence
atgctggaggagctggagtgcggcgcccccggcgcccggggcgccgcaactgccatggactgcaaggacaggcccgccttccctgttaagaagttgatacaggccagactgcccttcaagcggttaaacctggtccctaagggcaaagcagatgatatgtctgatgaccaaggcacctccgtacagagcaagagtcccgacttggaggcatccttagatacgttagaaaacaattgtcacgtagggtccgacattgatttccgccctaaactggtcaacggcaagggtccccttgacaactttcttcgcaatagaattgagacatcaatcggccagagtacagtcattatagacctgacggaagattctaacgaacagccagacagtctggtcgaccataataaactgaacagcgaggctagcccttctcgtgaagcaattaatggtcagagggaggatacaggggaccagcagggccttctgaaagccatccagaacgacaaactggccttcccaggagaaactctgagcgatatcccctgtaaaacagaggaggagggtgtcggttgcggaggggccggacgccgcggggattctcaggaatgtagcccacgttcatgtccagaactcacctcaggaccccggatgtgccctcgcaaagagcaggatagctggtctgaagctgggggtatactgtttaaggggaaagtgcccatggtggtcctgcaagatatacttgccgtgagacccccccagatcaaatctctgcccgctacgccccaaggaaaaaacatgacacccgagtcagaagtcctcgagtcttttcctgaggaagattccgtcctgagtcattcttccctgagcagccctagcagtacaagttcccctgaaggccccccggcgccacccaagcagcatagcagcactagccctttccccaccagtacacctctgcgtcggataacgaagaagtttgttaagggctcaacagaaaaaaataagcttcggttgcagagggaccaggagaggcttgggaagcagctgaaactccgggcagaacgcgaagaaaaggagaagctgaaggaggaggccaaacgcgctaaagaggaagcgaaaaaaaagaaagaggaggagaaagagctcaaggagaaggagcgtcgcgagaagcgcgagaaggacgaaaaagaaaaagccgagaaacagcggcttaaggaggagcgacgcaaagaacgacaggaggctctggaggcaaaactggaagagaaaagaaagaaagaagaggaaaagaggctgcgagaggaggagaaacgtataaaggcggagaaggccgaaattacgcgcttctttcaaaagccaaaaacgccacaggccccgaagactctggccggttcctgtggcaagtttgctccctttgagatcaaagaacacatggtgctagccccaagacgtagaacggccttccaccctgacctctgctcacagctagatcagcttttacagcagcagagcggcgaattttcgtttcttaaagatctgaaaggacggcagcctctcaggagtgggccaacacatgtgagcacgcggaatgctgacattttcaatagtgatgtggtgattgtcgaacgtggcaaaggcgatggggttccagaaagacgtaagttcggccgcatgaagctcctacaattttgcgagaatcaccgccccgcttactgggggacctggaacaaaaaaactgccctcatccgtgccagagacccctgggcacaggatactaagctgcttgactatgaagtagactccgatgaggaatgggaggaggaagagcctggcgagtcactcagccatagcgaaggggatgacgacgatgatatgggcgaggatgaagatgaggacgacggattcttcgtgcctcacggctacctatccgaggacgagggtgtcactgaggaatgcgccgacccagagaaccataaggtccgacagaaattaaaggccaaggaatgggacgagttcctcgcgaagggcaagagattccgcgtcttacagcctgtgaaaatcgggtgcgtttgggccgcggaccgagattgcgcaggggatgatctcaaagtcctgcaacaatttgccgcccactgggtccaccccgaatctaggggggatgtatgccggatgttgcgagtatcctccccccagtcgagatatctcaatagattaaattcctgtgtcaagtccactctctcctgcttcacatag

SEQ ID NO: 18836 - DNA, 2352 bp, Artificial Sequence
  Description of Artificial Sequence: Synthetic coding sequence
atgctggaggagctggagtgcggcgcccccggcgcccggggcgccgcaactgccatggattgcaaggataggccggccttccctgtgaagaaacttatccaggcgcgcctcccttttaaacgcctgaacctggtccctaaaggcaaggcggatgacatgtccgatgaccaggggaccagtgttcagagcaaaagccctgacctggaagctagcctggatacactggagaataattgtcatgtgggatccgacattgatttccggcccaagctggttaatgggaagggtccgcttgacaattttcttcgtaatagaatcgaaacctcaatcggacagtcaaccgtcatcatcgacctgacagaagactctaatgagcaaccagactcacttgtggatcacaacaaactaaatagtgaagcctcaccctcgcgagaagcaatcaatgggcagagggaggacacaggggaccagcaggggctgctgaaagccatacagaatgataaactcgcgttccccggcgagaccctttccgacattccatgcaagacagaggaagagggagtgggatgcggtggagctgggcgtcggggcgactcacaggaatgctcgccacggtcctgtccagagttaacatccggcccaaggatgtgccctcgtaaggagcaagacagctggtcagaagcaggcggcatcctcttcaaaggaaaagtgcctatggtcgtcctgcaggatatccttgccgtgagacctccccagataaagtctctgcctgccacaccccagggcaaaaacatgactcccgaatccgaggtccttgaatcgtttcccgaggaggattccgtactgagccactctagcctctcatccccttcgtccaccagctccccggaagggcctccagccccaccgaagcagcatagttctacttcccccttcccaactagtactcccctccggagaattacaaagaaattcgtcaaaggttcaaccgagaaaaataaactgcgcttacagagggatcaggaacgattgggcaaacagctaaaattgagggcggagcgcgaagagaaggaaaaacttaaagaggaagcaaagagggccaaagaggaggccaagaagaaaaaggaggaagagaaagagctgaaagagaaggaacggagggaaaagagggaaaaggatgagaaggagaaagccgaaaaacagagattaaaagaggaaagacgcaaagaaagacaagaggctctggaagcaaaactagaagaaaagcggaaaaaagaggaggagaaaagactcagggaggaagagaagagaatcaaggccgaaaaggcagaaattacgcgattttttcagaagcctaagacaccccaagccccgaagaccctggccggatcttgcggcaaattcgcaccttttgagattaaagagcatatggtgctggcgcctcgcagacggactgcctttcaccctgatctgtgctcccagctggatcagctgttgcagcagcaaagcggggaattctccttcttgaaggacctgaaaggcaggcagcccttgcgttcaggtcctacccacgtatctaccagaaacgccgatatctttaattccgacgtggtgattgtggagcgcggaaagggagacggcgtccccgaacgacggaagttcggccggatgaagctactccagttttgtgagaatcaccgccctgcctactggggcacctggaataagaagacggccctaatcagggctcgggacccctgggcccaagatacaaagctgttagattatgaagtggatagtgacgaagagtgggaagaagaggaacctggagaaagcctctctcactcggaaggtgatgatgacgacgacatgggggaggatgaggacgaggatgacggatttttcgtaccacacggatatctgtctgaggacgagggcgtgaccgaggagtgtgctgatcctgaaaaccacaaggtgcggcaaaaactgaaagccaaagaatgggacgagtttctagctaaaggcaagagattccgggtgctgcagccagtgaagataggttgcgtatgggctgccgatagagactgtgcgggtgacgatcttaaggtcctgcagcaatttgccgcatgcttcctggagaccctccccgcgcaagaggagcagactcctaaagcgagcaagcgagagcgtcgggacgagcaaatccttgcccagctgttgccattactccacgggaatgtgaacggctccaaagtgattatcagggagttccaagagcattgtcggcggggcctgttatctaatcacacaggcaaagcaactctaacctccagtccgttgggagcatcttag

SEQ ID NO: 18837 - DNA, 519 bp, Artificial Sequence
  Description of Artificial Sequence: Synthetic coding sequence
atgaccagcgccagcaccaaggtgggcgagatcttcagcgccgccggagccgcctttaccaaactgggagagctcaccatgcagctgcatcccgtggccgattcctcacctgccggcgcaaaatggactgaaacagagatcgagatgctccgcgctgcagtaaagagatttggcgacgacctgaatcacatttcctgcgtgatcaaggagaggactgtggcacagattaaggccactgtgaaacggaaggtgtacgaggatagcggtattccactccctgcagagtctcccaagaaaggacccaaaaaggtggcgtcaggcgtactttcccctccgcccgcagcaccccctccctcaagttcaagcgtccctgaagccggcggtccacctataaaaaaacagaaggccgacgtaacactctcagctttgaatgactcagatgccaattctgacgtggttgacatagaagggctgggagagacgccgccggcgaagaaactcaatttcgaccaagcatag

SEQ ID NO: 18838 - DNA, 579 bp, Artificial Sequence
  Description of Artificial Sequence: Synthetic coding sequence
atgaccagcgccagcaccaaggtgggcgagatcttcagcgccgccggagcagcctttaccaaactgggcgagttaacgatgcagcttcaccctgtggccgacagtagccccgctggtgccaaatggacagagacagaaatcgagatgttacgggctgctgtgaagcgattcggggatgacctcaatcatatttcatgcgtgatcaaagagcgaacagtggctcagattaaagcgacggtgaaaaggaaagtttacgaggactccggtatccctttgccagccgaaagtcccaaaaaaggccccaagaaagtcgcatctggggtactctccccccctccagctgctcccccccccagctcatcaagcgtgcccgaagctggtggcccacctatcaaaaagcagaaggcggacgtcaccctatccgccctgaatgattcggacgctaatagcgacgtagtggacattgagggattaggtgagaccccaccggccaaaaaactgaacttcgatcaggatagcctgaccctagattccggactgctgatgacgagcgctgaccctcccctgcttagctgctag

SEQ ID NO: 18839 - DNA, 417 bp, Artificial Sequence
  Description of Artificial Sequence: Synthetic coding sequence
atgaccagcgccagcaccaaggtgggcgagatcttcagcgccgccggcgccgcttttacaaagctaggtgaattgaccatgcagctgcaccctgtggcagattctagcccagcaggagcccagatcaaagccacagttaagcggaaagtttatgaggacagtggaatcccactaccggccgagagcccaaagaaaggacctaaaaaggttgcgagtggcgttcttagccctccacctgccgcaccccccccctcgagcagctcagtccccgaagctggtgggccgcctatcaaaaaacagaaagccgacgttactctgagtgccctcaacgactctgacgccaacagtgacgtggttgacattgaaggtctgggcgagactcctcccgctaagaagttaaacttcgaccaagcatag

SEQ ID NO: 18840 - DNA, 306 bp, Artificial Sequence
  Description of Artificial Sequence: Synthetic coding sequence
atggccagcaacaagaccaccctgcagaagatgggcaagaagcagaatggaaaaagcaagaaagtggaagaagccgaacctgaggagtttgttgtggagaaagtccttgatcgcagggtggtgaatggtaaagtggagtactttcttaagtggaagggcttcacagaaaagcttgctaaaaagaaaatggtacagaaggagaatctgtatctgaccgtgaatcttatgaccgccaaccaacggaggaaggaaatgttattaacaaaccaggaagatctacccgaagtcctgatattaaaggaatag

SEQ ID NO: 18841 - DNA, 2049 bp, Artificial Sequence
  Description of Artificial Sequence: Synthetic coding sequence
atgacctgcccccccaccggcctgtacggccccgagggcatcctgcccgcaaggagaacacttcgtccccagggaaagggccgatggcagcagctgtgggaaactcccacccttctgtgggaggctccacggctgggtctggatacagcccagggactcgagcttctgtctctgctaggagcactcgtggccctgggcgccttactgctgtctccactgcgccatccagtcatatacctcttactgtgggcggcatacctgagtgcctgtcaagtgggacaggtgttcttgtacttccaatgggactcgctactgctggaaaccggattcctggccgttctggtggcccccctgcgtcctgcgagccaccgcaaggaggctccacagggaagacaggcgggggcactgccacacgaagatctgcccttttggctagtgcgttggctgttattcaggctcatgttcgcctccggcgtcgtaaaactgacaagtcgatgtcctgcttggtggggactgactgcgcttacttatcactatgagacacagtgcctgcccacccctgctgcctggttcgcccatcacttgcctgtctggcttcacaagctgagtgtcgtcgctacgttcctgatcgagatcgcggtgcccccccttttcttcgctccgatacgaaggcttcgactggcagccttctattcacaggtgcttcttcaggtcttaattatcatcactggcaactacaatttcttcaatttgatgaccctcgtcctgacaactgccctgctggacgatcagcatctagccgcggaaccgggccacggctctcgaaagaaaacagccactagctggcccaaggccctgctagctaccctgtctctgctgctggaattagcagtctatggactactggcatatggaactgttcactacttcggtctggaagtggactggcagcagagaacgatccacagtagaacaacattcaccttccatcagttttcacagtggcttaaaacactgactctaccgaccgtctggttaggagtcgcctccctggtgtgggagctgctatccgctctgtggaggtggactcaggtgcgcgggtggctccgtaaactgtccgcggtcgttcagctttcccttgtgggcacagctacagttgccttgttcctgatcagcctcgtcccatattcatacgtagaacctggaactcacgggcgcctgtggaccggagctcacaggctattcggcgcagttgaacacttgcagctggcaaattcgtacggtctgtttcggcggatgaccggcctgggaggccgccccgaagtggtcttagaaggatcctacgatggtcaccactggaccgaaatcgagttcatgtataagcctggcaacctgagtcggccgccgccggtggtcgtgcctcaccagccacgtcttgactggcagatgtggttcgccgccctgggaccacacacgcattcaccctggttcaccagtttggtccttcggcttctgcaaggaaaggagcctgttatcaggttggtgcaatcccaagtcgctaggtacccatttcacaaacagccacctacatatgttcgcgcccagagatataagtattggttctcccagcctggggagcagggccagtggtggcgcaggcagtgggtcgaggagtttttcccatcagtaagtcttggtgaccccacgttggaaacacttttgcgacagttcgggctccaagaaaagtcgcctccccgcacacgctcagccaacagtaccttggctcaggcgctacattggacgcgctcccagctgtccccactggaagcacctgcactgctgtgggggttactcatggctgtcggagccgtgaggttcgtgcaggccctccttgctccatgcagcctgcgatcctcgcccctggcccccgtttctggcgagaagcggagacctgcctctcaaaaggacagcggggccgcttccgagcaggccaccgctgctccgaatccttgctcatcttcttcacgaaccacacgtaggaaaaagtag

SEQ ID NO: 18842 - DNA, 1239 bp, Artificial Sequence
  Description of Artificial Sequence: Synthetic coding sequence
atggagctgagcgccgtgggcgagcgggtgttcgccgccgagagcatcattaagagacgaatccgcaaaggacgcattgaatacctggtgaagtggaagggatgggccatcaaatattctacctgggagcccgaggagaacattttagattccaggctgatcgcggccttcgagcagaaggagcgcgaaagagagctatacggcccgaaaaaaaggggcccaaaacccaaaacattcctgctgaaggccagagcgcaagccgaagcactgagaatatcagatgtccatttctccgtgaagcccagtgcgtctgcctctagcccaaaattgcattcatccgcagccgtgcacagacttaagaaggacatccgccgctgccaccgtatgagcaggaggcccctgccacgacctgacccacaggggggtagcccggggctccgcccacctatttcaccttttagcgagactgtgcgcatcatcaatcgcaaggttaagccccgagaacctaaacgcaaccggataatcctcaatctcaaggtcatcgacaaaggtgccggcggcgggggggcagggcagggggccggtgcacttgctcgcccaaaggttcctagccgtaaccgagtgattggaaagagcaaaaagttttctgagtccgtcctgcggacacagatccggcatatgaaattcggagcattcgccctgtataagccgcccccagcacccctggttgcgccctcccctgggaaggcggaggcatccgccccaggccctggtctcctgttagctgccccagccgcgccttatgatgccagatccagcgggagttctggatgtccctctccaaccccacaatctagcgaccctgacgatacccctcctaagttgttgccagagaccgtgagcccctccgcaccgtcatggcgggagccggaggtgcttgacctaagcctaccacccgaaagtgctgcaacaagcaagcgcgccccccccgaggttacagcagcggccggtcccgcaccaccaacagcgcccgagccagcaggcgcctctagtgaacccgaggccggagactggcggcctgaaatgagcccatgttccaatgtagtcgttaccgacgtgacttccaacctcctgactgtcacaatcaaagagttctgcaacccggaggactttgagaaagttgccgccggcgttgctggtgccgcaggtgggggggggtcaattggagcttctaagtag

SEQ ID NO: 18843 - DNA, 1170 bp, Artificial Sequence
  Description of Artificial Sequence: Synthetic coding sequence
atggagctgagcgccgtgggcgagcgggtgttcgccgccgaggccctccttaagagacgcatacgcaaaggcaggatggagtacctggtgaagtggaaaggatggagtcaaaaatactccacgtgggaaccggaagagaacatattggatgcaaggctgttggcagccttcgaggagagggagagagagatggagctctacggaccaaagaagagggggccaaagccaaaaacatttcttcttaaggcccaggcaaaagcaaaggccaagacgtacgagtttagaagcgattctgcgcgcggaataaggattccataccccggccgcagcccccaggatctcgcctccacctctcgagcacgagaggggctgagaaacatgggacttagcccacccgcctcctctacgtcaacaagcagcacatgccgtgccgaagctcctcgcgaccgggacagggacagagatcgagaccgagagcgggatcgagagagagaacgggaaagagagcgcgaacgggagcgggaacgagagagagaacgcgggacctctagagtcgacgacaagccctccagcccgggtgacagctccaaaaagcgcggaccgaagccgcgcaaggagttacccgatccatctcagcgcccgctcggggaaccatctgccggcctcggagaatacctaaaaggccgaaaactcgacgacacaccatcgggcgcgggcaaattcccagctggtcattccgtgattcagctggccaggcgccaggacagcgacctcgtgcagtgcggggtcacctccccaagtagtgccgaggccacaggcaagctggcggtggacacctttcccgccagagttattaaacacagagccgcatttctggaagcgaaggggcaaggagctctcgaccccaatgggactagggttagacacggctccggcccaccaagctctggcggtggactctatcgggatatgggtgcccaggggggcagacctagcctcatcgcccggatccctgtggccagaatactgggtgatcctgaggaggagtcctggagccctagtctcaccaatcttgaaaaggtggtggttacagacgtgactagcaactttcttacagtgactataaaggagtctaatactgatcagggcttcttcaaggagaaaaggtag

SEQ ID NO: 18844 - DNA, 2469 bp, Artificial Sequence
  Description of Artificial Sequence: Synthetic coding sequence
atgaagatgaagatccagaagaaggagaagcagctgagcaacctgaaagtacttaatcactctccaatgtccgacgccagcgtcaactttgactacaagtcaccatctccatttgattgctctacggatcaggaagagaagatagaggatgttgctagccattgtcttccacagaaggatctttacacagctgaggaggaagccgccaccctttttccacggaaaatgacctcccataatggtatggaagactccggagggggtgggaccggagtgaagaaaaagcggaaaaagaaggagcctggcgaccaggagggggcagcaaaagggtctaaagatcgtgagcccaaaccaaagagaaaacgtgagcccaaggagcctaaggagcctagaaaagctaaagagcctaaaaaggccaaagaacataaggaacccaaacagaaggacggggccaagaaggctcggaaaccacgggaagccagtggaactaaagaagccaaggaaaagcggtcttgtacagattctgcagctagaactaagagccggaaggcttcaaaggagcaaggacccaccccagtcgaaaaaaaaaagaagggaaaaaggaaatctgagactacagtagagtccttggagttagatcaggggttaaccaaccccagcttacgcagccctgaggagtctaccgagtcaacagattctcagaagagacgttccggcaggcaggtgaaacgcaggaagtataacgaggacttagatttcaaggtggttgatgatgacggtgagaccattgccgtgctcggagccggtaggacttcagcattgtccgcctccaccctcgcctggcaagcagaagaacccccggaagatgatgccaacattattgaaaagatcctggccagtaaaacggttcaagaggttcatccaggtgagccaccattcgacctggagctgttctacgttaagtaccggaactttagctatcttcattgcaagtgggctaccatggaggaattggaaaaggacccccgtatcgcccaaaagatcaagagattcagaaataagcaggcccaaatgaagcatattttcaccgagcccgacgaggacctgttcaaccccgactacgtcgaagtcgataggattttagaggttgctcacactaaagacgcggagacaggggaagaagttactcactatctggtgaagtggtgctcactcccctacgaagaatccacctgggaattggaggaagacgtcgatcctgcgaaggtcaaagaatttgaatctttacaggtactgccagaaattaaacacgtcgagagacctgccagtgactcatggcagaagcttgaaaagtccagagagtataaaaattccaatcagctcagggaatatcagctggaaggtatgaactggctgttgtttaattggtacaatcgaaagaattgcattctcgccgatgaaatgggactgggaaaaactatacagtccatcacatttctgtccgagatctttttgcggggcatccatggcccgttcctgattattgcacccctgtccactatcactaactgggagagagaatttaggacatggacagagatgaatgcgatcgtttaccatgggagccagattagccgtcaaatgattcagcagtatgaaatggtgtatagggacgcacaggggaaccctctgtccggcgtcttcaaatttcacgttgttatcactacattcgagatgatcttggctgattgtccggacctgaaaaaaatattctgggggcgttggaaggatattctgacccacggtcgctttaagtggcacctgaacgaaaaggatatggaaatgatctgccgtgccctccttgtgtactgcgttaagcattataaaggggacgaaaagatcaagtcatttatctgggagctgatcacacccactaaagacggccaagctcagactctgcagaaccacagtggtctctcagctccagttccccgcggaaggaaaggaaaaaagactaaaaatcagctgctcattcctgaattaaaggatgctgattggctggccacatgtaacccagaggttgttctgcatgacgacggatataaaaagcacctgaaacaacattgtaataaggtcctcctcagggtgcgaatgctctactacttgaaagccgagattctcggcgaagcggcagaaaaagcattcgagggcagtcccgctagagaactcgacgttccacttcccgacatcgattatatggagattccggtggactggtgggacgcagaagctgacaagagcctgcttattggagtctttaaacacgggtatgaacgatataatgctatgcgcgctgacccggctctgtgtttcctggaaaaggtgggcatgccggacgaaaagagccttagcgccgagcaaggcgtgacagatggcacatccgatattcccgagcggcagcatcgctag

SEQ ID NO: 18845 - DNA, 1122 bp, Artificial Sequence
  Description of Artificial Sequence: Synthetic coding sequence
atgtgccagagccacatgatcggcttctgcaccagcagcgtgaacgaggagaccgaaacgcaaggggatcagatctcttgcccaaacccaaccactctcgtgttcagaacccaaatctccagtcttccttccctgcaactttctaatcttaaagttttgaaccattcccctatgtctgatgcctccgtaaactttgactataagtcgccttctccatttgactgcagcaccgatcaggaagagaaaatcgaggacgtcgctagccactgtctgccacagaaagacctgtacacggccgaagaggaggcggccacactcttccctagaaaaatgacttcccataacggtatggaggactctggcggaggtggtactggggtgaagaaaaagcggaaaaaaaaagagccaggggatcaggagggggcggccaagggaagcaaggatcgagagccgaagccaaagcgaaaacgtgagcctaaagaaccaaaggagcccaggaaagcgaaagaacccaaaaaggccaaagaacataaggagcctaagcagaaagatggtgccaagaaagcgcggaaacccagggaggcgagcggaactaaagaagccaaagagaagcggtcttgcactgactccgcggccaggaccaagagccgcaaggccagtaaagagcaaggacctactcccgtcgagaagaaaaagaaaggaaagagaaagtcagaaacaacggtggagagcctggagctggatcaggggttgactaatccgagtctgagaagcccagaggagtccacggaatcgaccgactcacagaaaagacggtctggcaggcaggttaaaagaagaaaatataacgaggatcttgatttcaaggtggtggatgacgatggcgagactatcgctgttctcggagcaggacgcacctcagccctgtctgcgagcacactagcctggcaggccgaagagcctcctgaggacgacgcaaatattatcgagaagatcctcgcctcaaaaactgtgcaggaggtacatccaggcgagcccccctttgatcttgaattgttttatgtgaagtacaggaacctctatgtgtatctgaaatactcactgtacctgggattcatctag

SEQ ID NO: 18846 - DNA, 8148 bp, Artificial Sequence
  Description of Artificial Sequence: Synthetic coding sequence
atgaagatgaagatccagaagaaggagaagcagctgagcaacctgaaagttctcaatcatagccccatgtctgacgcttccgttaactttgattacaagtcaccttcaccattcgactgtagcacagatcaagaggaaaagatcgaagatgtggcctctcattgtctcccacaaaaagatctgtacaccgccgaggaagaagcagctacattatttccacgaaagatgacctcacataacggaatggaggacagtggtggaggtggtactggtgttaagaaaaagaggaaaaagaaagagccgggagatcaggagggagccgctaagggctctaaggacagagagcctaaacctaagagaaaaagggaaccaaaggaaccaaaggaaccccggaaagctaaagagccgaagaaggcaaaagagcacaaagagcctaagcagaaagatggcgctaagaaggcgaggaaacctcgcgaagcttcggggacgaaagaagctaaggagaaaaggagctgcaccgactctgcagcaaggacaaaatctagaaaggcatctaaggagcagggcccaacaccagtggagaaaaaaaaaaagggcaaacgtaaaagcgagacaacagtggaatcactggaactcgaccaggggctgactaatccatctttgcggtcccctgaagaatcaacagagagtactgattcccaaaagagacgcagcgggaggcaggttaagcgaagaaagtataacgaggatctggattttaaagtggttgatgacgatggagaaaccatcgctgtcctaggcgccggtcgcacttccgccctgtcagcaagcaccttggcctggcaggcagaagaacctcccgaagacgatgccaacatcatcgagaagattcttgcctccaaaaccgtgcaggaggtgcatcctggagagcccccttttgacctcgaactcttctacgttaaataccgcaattttagctacctccattgtaagtgggccaccatggaggagctggagaaagatccgcggattgctcagaagatcaagcgtttccgtaacaaacaggcgcaaatgaaacacatttttactgagccggatgaagatctgttcaaccctgactatgtggaagtggatcgcatactggaggtagcccacacaaaggatgccgagacaggtgaggaagtgacgcactaccttgtcaaatggtgctctcttccctatgaggagagcacatgggagttagaagaagatgtcgatcccgcgaaagtcaaagaattcgagagcttgcaggtgttgcccgagatcaagcacgtggaacgacctgcctctgactcctggcagaaactggagaagagccgggagtataaaaactctaatcaacttagggagtatcagttggaggggatgaactggctactgtttaattggtacaaccggaagaactgcatcctggccgatgagatgggattggggaagaccatccaatccataacattcctctctgagatttttctccggggaattcacggcccgtttttgattatcgccccgttatccacgataaccaattgggagagagagttcaggacatggactgagatgaacgcgattgtctaccacggctcacaaatcagtcggcagatgattcagcagtatgagatggtctatcgagatgcccagggtaaccccctttcgggcgtgtttaagttccacgtagtgataacaacattcgaaatgatcctggcagactgtcctgagttgaagaaaattcactggtcctgtgtgatcattgacgaagcacaccgtttgaagaatcgcaattgtaagctcctggaaggtctaaaattgatggcattggagcacaaggtgcttctcaccgggacacccctgcaaaattctgtagaagagctgttttcgctcctgaatttcctcgaacctagtcagttcccgagcgagacagcattcttggaagagttcggtgatctgaaaaccgaggagcaggtgaaaaaactgcagtccatactgaagcctatgatgctgcgacgcctcaaggatgatgttgaaaaaaatttggcccccaaacaggagacaatcatagaggttgaactgaccaatattcagaagaaatattacagggcaatactggagaagaacttttcatttctgacaaagggggcgaaccagcataacatgcctaaccttattaatacaatgatggagctgcgcaaatgttgcaatcacccctacctcatcaacggggcggaagaaaagatcttagaggacttcagaaaaacacacagtccagatgccccggactttcagttacaggctatgattcaggcagctggcaagctggttctgattgacaagttgttgcccaagctaatcgctggagggcataaggtgctcatttttagtcagatggtgaggtgcctagatatcctcgaggactatcttattcagaggcgatacacctatgagcgcatcgatggccgcgttagagggaatctgcgccaggccgccatcgatcgtttttgcaagcctgactccgatcgattcgtttttcttttgtgtacaagagctggtgggctcggtatcaacctcacagccgccgacacgtgtattatcttcgacagcgactggaacccccagaatgatttacaagcacaggccaggtgccataggatcgggcaatcaaaggctgtcaaagtctacagattgatcaccaggaacagctacgagcgcgagatgttcgataaggcatcccttaagctcggcctggacaaggccgtgctgcaagacatcaatcgaaagggcggcactaatggggtccagcaactgagcaagatggaagttgaagatctgctgcgcaaaggtgcatatggggcactaatggatgaggaagacgagggcagcaagttttgcgaggaggacattgaccagattttgcaaaggagaactcataccatcacaattcagtcggaagggaaaggatcaaccttcgccaaggcatccttcgtggcctccgggaatagaacagacatctcccttgacgaccccaatttctggcaaaaatgggctaagatagcagagctagataccgaggcgaagaacgaaaaagagtccttagtgatcgatcgacctagagtgaggaagcagacaaagcattacaacagctttgaagaggacgaactgatggagttctccgagctcgattccgactccgatgaacgccccacccgctcccggcggctgaatgacaaagcaagacgatacctgagggcagagtgtttcagagtggagaaaaatctcctcatcttcggatggggccgctggaaagacatcctgactcacggcaggtttaagtggcacctgaatgagaaggacatggagatgatttgtagagcgctgctcgtgtactgtgtaaagcattacaagggagatgagaagataaagtcttttatctgggagctgatcacccctactaaagacgggcaggcacagaccctgcagaaccatagtggcttgagcgcaccagttccgagagggagaaagggcaaaaagactaagaatcagctcctgatccccgaattgaaggacgcagattggctggccacctgcaatccagaagtggttctgcatgatgacggctacaaaaagcatctgaaacaacattgtaataaggtactgcttcgggtgcgtatgctctactacctaaaggctgaaattctcggtgaagccgctgaaaaggcctttgaaggttctccagccagggagctcgatgtcccactacctgatatagattatatggagatcccggtcgactggtgggacgccgaggccgataaatctctattgattggcgtgtttaaacacggctatgaacggtataatgccatgagagccgatcccgcactgtgtttcctcgagaaagttggtatgcctgacgagaaatccctgtcggctgagcaaggcgtgactgatggtacaagcgacatccctgagcgcggcaacacggacaaagaggataatgcagaggacaaggtagatggtcttcaaaaacagacggagtctagctcagacggcggagatggagtgttttcagagaagaaggacgatagccgcgccgcgcaggacggcagcgatccggacaagagcccatggcctgtgagtagcgccctgaccgcccgccttaggagattggtaacagtataccagagatgcaacagaaaggaattgtgcaggcccgaaattttaggccctggcaaccaaggctattgggtacaggaggagatgtttagaaggacctcagaaatggaccttatcaataaagaggcccagaaacggtggactaggcgcgagcaagctgacttctatcggacagtctcctcgttcggcgtcgtgtatgaccaggagaaaaaaaccttcgactggacacaatttagaataataagtaggctggacaaaaagagtgatgaatcacttgaacagtatttctacagctttgtcgcaatgtgtcgaaatgtgtgtagactgcccacgtggaaagatggtggccctcctgatactactatctacgtggagccaataacggaggaaagggccgcccgcaccctgtatagaattgaacttctgcggaaagttcgcgagcaggttctgaagtgtccacagttgcacgaacgcctccagttatgtcggccttctctctacttgcctgtatggtgggaatgcggtaagcacgaccgggatcttctgataggaacagctaagcacggcttaaaccggacggattgttacattatgaacgatccccagctttcatttctggacgcttatcgcaattacgcacagcacaaacgttctgggactcaggcccctggtaatctgtgctgcttatatcaaacaaattctaaactgtacgagtcactgacatacagccaaatgagccgtacatctgaaagccttgaaaatgagcccgaaaatttagtccgtgtggaatccagagacgatcatttgtcactgcccgatgttacctgcgagaacttcatttccaaagtgcaggatgttatttcaattaatcacgacgagtcattactgcccgaatcccttgaatcgatgatgtacggtaagaaagtactttcccaggagccatccagctttcaggagtctccaagcacaaatacagaaagcaggaaggacgtgatcaccatatccatctcaaaggatggaaactgccaaagcggaggacctgaggctgagatcgctagcggccccacatttatgggttccttggaagctggcggtgttgctcaggcaaacattaagaatgggaaacacctgctgatgtccatttctaaggagggtgaactctgctgtagtgaagcaggccagcggcctgagaacatcggacagctggaagcgaaatgcttggctagcccttctttaaacccggggaatgaaagtgggtttgtcgatatgtgctctctgtctgtgtgcgattcaaagcggaacctgtctagcgatcagcagctgatcgacctgctagaaaataagtccctggagtctaagctgatcctgagtcagaaccactctgatgaggaagaggaggaggaagagaacgaggaggagaatctggccatggccgttggaatgggcgaacggcctgaggtgctgcacctcaccgagccaaccactaatatctctcgggaaaagaatcaaggatttcaggacgagaccaagaagggctctctggaggtggccaaccagacccccgggctccagagggccttcccggctcccgcagcttgccagtgccactgtaagcacatggaaagatggatgcacggtctcgagaacgacgagttcgagatcgagaagccaaaggcgtacattcctgacctgttcaagtcaaaaacgaataccatcgcgatggaaggcgaacccactgcaattccctcacagccatttaaagtcaagcacgaactgttaaaagagccttggaaggagagcgccgaagggcagaatgtctttcccacttacccactggagggttccgagctgaagagcgaggatatggactttgagaataaggacgactatgatagggatgggaactgtcattcccaggattaccccggcaagtattctgaagaggaatccaagtcttctaccagcggaattacgggagatattggcgacgaattacaggaggctagggctcccacaattgcccagctgttgcaagaaaagaccttgtacagtttttcggagtggcccaaggatcgtgtgattattaatcgcctggataatatttgtcacgtggtgctgaagggaaagtggccaagctcccaacagtacgaaccctcagggacattaccaactcccgtactcacctccagtgcggggagccgaaccagcctgtccgagcccgaggcggctgagcattccttctccaacggagccgccctggctgctcaaatccataaggaatctttcctggcaccagtatttactaaggacgaacagaagcatagaagaccatatgagtttgaggtggaacgtgacgcgaaggctcgagggcttgagcagttctctgcaacacatggtcatactccaattattctcaatgggtggcatggcgagtctgctatggatctaagctgtagctccgaggggtcccctggagcaacaagtccttttccagtgtccgcctcaaccccgaaaatcggcgctatctcgtctctgcagggagcactaggcatggatctgtctggaatactgcaggctggtcttattcacccagttactggccagatcgtgaatgggtcactgcgccgagatgacgccgctacacgtagaaggaggggcagacgcaaacacgtcgaagggggaatggatctcatttttttgaaagagcagaccttacaggccggtatactggaagtgcacgaagaccctggacaagccacccttagtaccacccatccagaaggacccgggccagccacctctgctcccgagcccgcaaccgcagcatcatctcaggcagagaagagcattccatccaagtctctcttggattggctgagacaacaggctgattattcactggaagtcccaggttttggggcaaacttctcagacaaacctaaacagagaaggccccgttgtaaagaacccggcaaattagatgtcagtagtctcagcggagaagaacgagtacccgccatccccaaggaaccgggtttgcgggggttcctccccgagaataaattcaatcacactctcgccgagcctatactgcgcgacacgggccctagaagacgggggagaaggcctagaagtgaattacttaaggccccatccatcgtggcggattctccaagtgggatgggccctctgtttatgaatggcctgattgcaggtatggacttggtgggattgcagaacatgaggaatatgcctggtattccacttacgggcttggtgggatttcctgccggcttcgctactatgcccaccggcgaagaggtaaagtcaactctatcaatgcttcccatgatgctccccggcatggcggcggtgccacagatgttcggcgtcggcggactcctgagcccacccatggctactacgtgcacttccaccgctccggcgtccctctctagcacaaccaagtcgggaaccgctgtgaccgaaaaaaccgctgaagacaaaccttctagccacgatgttaaaacagatacactggcagaggacaagccagggcccggccctttttctgatcagagtgagcccgcgattactactagcagtcctgtggcctttaaccctttcctgatccctggcgtttccccgggtctcatctatccatctatgttcctgtcccccggcatgggcatggctcttcccgccatgcagcaagctcgccatagcgagatagtgggactggaaagccaaaagcgcaagaaaaagaagacaaagggggataatcctaacagtcatccagaacccgcaccgtcgtgcgaaagggagcctagtggagatgagaactgcgccgaacctagtgctccactcccggcagagcgcgagcatggagcacaagctggcgaaggcgctctgaaggattctaataatgatacgaattag

SEQ ID NO: 18847 - DNA, 450 bp, Artificial Sequence
  Description of Artificial Sequence: Synthetic coding sequence
atgaagatgaagatccagaagaaggagaagcagctgagcaacctgaaggtgctgaatcacagccccatgtctgatgcaagcgttaacttcgattacaagtcaccatcgcccttcgactgttcaaccgatcaagaggaaaagatcgaggacgtcgccagccactgcctccctcagaaagacttgtatacggcagaggaggaggccgctaccttattcccacgcaagatgacatcccacaacggcatggaagactccgggggcgggggaacaggggttaaaaagaaaaggaagaagaaggagcctggggatcaagagggagccgcaaagggatccaaggacagagagccaaaacccaaacgcaaacgggagccaaaagagccgaaggagccgaggaaagccaaagaacccaagaaggctaaggagcataaggagcctaagcaaaaagactag

SEQ ID NO: 18848 - DNA, 1578 bp, Artificial Sequence
  Description of Artificial Sequence: Synthetic coding sequence
tgagccagcaagaccgtgcaggaggtgcaccccggcgagccccccttcgacctagagctgttttatgttaaatataggaatttcagctacctgcactgcaagtgggccacaatggaagaactggagaaagatcctcgaatcgcccaaaagataaagcgcttccgtaacaagcaggcgcagatgaaacacatcttcaccgagccggacgaagacttgtttaatccggattacgttgaggtggaccggattctggaggtggcacacaccaaggacgctgagaccggcgaggaggtcacccattatctggtcaagtggtgtagcctgccttatgaggaaagcacatgggagctggaagaggacgtggatcctgctaaagtcaaggaatttgagtctttacaagtgcttcctgaaataaagcatgtcgagaggcctgccagcgacagctggcagaagctcgagaagtctcgggaatataaaaactcgaaccagttaagggaatatcaattggaggggatgaactggctgttgttcaattggtataacaggaaaaactgtatcctggccgacgaaatgggcctggggaaaacaatccagtcaatcacatttctatctgaaatctttttacggggaatccacggccccttcttgatcatcgcccccttgagtaccataactaactgggagagagaatttcggacatggactgagatgaacgcaatagtctatcatggcagccaaataagccgccagatgatccagcagtatgagatggtgtaccgcgacgctcagggcaatcccttatctggagttttcaagttccatgtggtgatcaccacctttgaaatgattttggctgactgtcccgagctaaaaaagatccactggggccgatggaaggacattctgactcacgggcgctttaagtggcacctaaatgagaaggacatggaaatgatttgccgtgccctgctggtctattgtgtgaaacactataaaggagatgagaagatcaagagctttatttgggagttaataactccaaccaaggatggtcaggcccaaaccctgcagaatcactctggcctgtccgctcccgtgcctcgcgggcgaaaaggaaaaaaaaccaagaatcagttactgatccccgaactaaaagacgctgactggctagccacatgcaatcctgaggtcgttcttcatgacgacggatacaagaaacacctgaaacaacactgcaataaagtcttacttcgcgtgcgcatgctgtactacctgaaagctgagattctgggagaggcagctgaaaaagcattcgagggaagccccgcccgagaactggatgtgccactgccggacattgattatatggagatcccagtggactggtgggacgccgaggccgataagtccctgctgatcggcgtcttcaagcacggatatgaaaggtacaatgccatgcgtgctgatcctgccctatgctttctggagaaggtgggcatgcctgatgaaaaatctctcagcgccgagcagggagtgactgatggcactagcgatatccctgaaagacagcaccggtag

SEQ ID NO: 18849 - DNA, 1521 bp, Artificial Sequence
  Description of Artificial Sequence: Synthetic coding sequence
atggccagcggcgacctgtacgaggtggagcggatcgtggacaagagaaaaaacaaaaagggcaagtgggagtaccttattaggtggaaaggttacggatcgacagaagacacctgggaacccgagcaccatctactgcattgtgaggaattcattgatgaattcaacggcctgcacatgtctaaggataagcggatcaaaagtgggaagcaatcatcaaccagtaagctcctccgggactcgcgcggcccaagcgtggaaaaactgagtcaccgaccctctgaccccggcaagtcaaaaggaacttcccacaagcggaagcgtattaacccaccactggccaagcccaagaaggggtatagtgggaaaccgagctccggcggcgaccgggctacgaaaactgtaagctaccgaactactccttctggcctccaaatcatgcccttgaagaaatcccagaatgggatggagaatggggacgctggttcggagaaggatgaacgccattttgggaatggctcccaccagcccggtctcgacttgaacgaccatgtgggggaacaggatatgggggaatgtgacgtgaatcatgctaccctcgccgagaatggcttaggctctgcactgacaaacggcggcctgaaccttcatagtccagtaaagcggaaactggaggctgagaaggactacgtttttgataagagactgcggtatagcgtgcgacagaacgagagcaattgtcgcttcagagacattgtggtaaggaaggaggagggtttcacacatattcttttgtcttctcaaacgtctgacaacaacgctctgacacccgagatcatgaaggaagtccggagggctttgtgcaatgccgctacagacgactccaagctgctactactctccgccgtgggctcagtattttgttcggggctggattactcctatctgataggccgcctgtcttccgatcgccggaaagaaagtactcggatagcagaagctatcagggactttgttaaagctttcatccaattcaaaaaaccaatcgtggtggctattaatggaccagccctcggcctgggagccagtatcctgcctctgtgcgacattgtctgggcctcagaaaaagcctggttccagactccttatgccaccatccggctgacacccgcagggtgttcctcttatacgtttccccagatcctcggcgttgccctggccaacgaaatgttgttctgcggacgcaagctaaccgcccaggaggcttgcagtcggggtttggtgtcgcaggttttttggccaaccaccttctctcaggaggtcatgcttagggtaaaggagatggcctcctgtagcgcggtcgtcctggaggagtcaaaatgtctggtaagatcattccttaagagcgtcttagaggacgtgaatgagaaagagtgcctgatgctgaaacagctgtggtcctcttccaagggcttagattcactcttctcctacctgcaggataaaatttatgaggtgtag

SEQ ID NO: 18850 - DNA, 1665 bp, Artificial Sequence
  Description of Artificial Sequence: Synthetic coding sequence
atggccagccaggagttcgaggtggaggccatcgtggacaagcggcaggataagaatggcaatactcagtatctcgtgcgatggaagggttatgataagcaagacgacacatgggagccggagcaacacctcatgaattgtgagaaatgcgttcatgacttcaacaggcgccagactgagaaacagaagaaactgacttggacgactacctcacgcattttcagtaacaatgcaagaagacgaacgagtcggtcgacaaaggcaaattattcaaaaaactcaccaaagacaccggtgacagataagcaccatcgttctaagaatagaaaactcttcgcagctagtaaaaacgttcggcggaaagccgcaagcattctcagcgacacaaagaacatggaaattatcaatagtaccatcgagacactggcacctgatagtcccttcgaccacaagacggtctctgggtttcaaaagttggagaaattagaccctatcgccgcagatcagcaggatacagtagtttttaaggtgaccgagggtaagctgctgcgtgatccactctccaggcctggggcagaacaaactggtattcagaataaaactcagatacatcccttgatgtctcagatgtcaggtagcgttacagcctctatggctaccggatccgccacgcgaaaagggatcgtggtgctaatcgacccactagcggccaatggcactacggatatgcacacaagcgtgcctcgcgtgaaaggaggacaacggaatatcactgatgacagccgtgaccagccatttattaagaaaatgcacttcacaatccgactgacggagagcgccagtacctaccgcgacatcgtggtcaagaaggaagatgggtttacgcaaatcgtactaagcacacgttcaacagagaagaacgctctgaatactgaggttattaaagagattgtgaatgcacttaattctgcggctgccgatgattctaagcttgtgctgttttccgccgcaggcagtgtattctgttgcggtctcgacttcggatattttgttaagcaccttcggaataacagaaacactgcctcgttagagatggtggataccataaaaaattttgtcaatacattcatacaattcaagaaacctatcgtggtctccgtgaacgggccagccatcgggctgggggcctcaatcctgcctctgtgtgacctcgtctgggctaatgaaaaggcctggtttcagaccccctatacaacgttcggtcagtccccagacggatgtagtagtattacattcccaaaaatgatgggcaaagcatccgcaaatgagatgttgatcgctggtcgtaagctgaccgcgcgggaagcctgtgccaagggactggtctcacaggtttttctgacaggtacattcacgcaggaagtgatgattcagattaaggaactagcgagttataaccccatcgtgcttgaagagtgtaaggcactggtgcgatgcaacatcaagcttgaactggagcaggccaatgagagggagtgcgaggtgttgcggaagatctggtcttcagctcagggcatcgaaagcatgctgaagatcccgcttctggggtacaaggccgcattccccccaaggaagactcaaaatgaccaaagatggtgcccatag

SEQ ID NO: 18851 - DNA, 1623 bp, Artificial Sequence
  Description of Artificial Sequence: Synthetic coding sequence
atggccagccaggagttcgaggtggaggccatcgtggacaagcggcaggacaaaaatggaaacacacagtatcttgtccgatggaaaggatacgataagcaggatgacacatgggagcccgaacagcacctgatgaactgcgagaagtgtgttcatgattttaatcgcaggcagactgaaaaacaaaagaagctgacctggactacaacgtcccggatcttcagcaacaacgctcgccggaggacttcccgtagcactaaagccaactactctaaaaacagtccaaagactccggtgaccgataagcatcacagatctaagaataggaagttgtttgctgctagtaagaatgtgcgccggaaggcagcttccattctcagtgataccaagaatatggagattatcaacagtaccatcgaaacccttgcacccgattcgccttttgaccacaagaccgtcagcggattccaaaagcttgaaaagctcgatcctatcgcagccgaccagcaggacaccgtagtcttcaaggttacggaaggaaagctgttgcgggaccctctgtccagacctggcgcagaacaaacgggcatccagaacaagacccaaatccatccactcatgagccaaatgtccgggtcagttaccgcttcgatggccactggcagcgctacgcggaagggtatcgtagtactgatagaccccttggcagcaaatggaactaccgatatgcacacgtcggtaccacgagtgaaagggggccagaggaacatcacagatgactctagagaccagccgttcatcaaaaagatgcatttcacaattaggcttaccgagagcgcaagcacttatcgggacatagttgtgaaaaaggaggacgggttcacacagattgtattgagtacccgaagtacggaaaaaaacgcgctcaacacagaggtcattaaggaaatagttaacgctctcaattcagcggcggccgacgatagcaagctagtgttattctcagccgcaggttctgtattctgttgtggactagacttcgggtactttgtgaagcacctgcgaaacaacagaaacacagcctctctggagatggtcgacaccataaagaatttcgtgaatactttcatacagtttaaaaagcctattgtcgtgtctgtgaatggcccagcgatcggattgggggcctccatcctgcctctgtgtgaccttgtgtgggcaaacgaaaaagcttggtttcagaccccttacacaacgtttgggcagagccccgatggatgttcaagtattacattccccaaaatgatgggaaaggcatctgccaatgagatgctgatcgcgggtagaaaattgaccgccagggaagcctgcgccaagggccttgtttcacaggtgtttctcaccggcacctttacacaggaggtgatgattcagataaaagaactcgctagttacaatcccatcgttctggaagagtgcaaagcgctggtccggtgtaatattaagctggaattggagcaggctaatgagcgagaatgcgaggtgctgaggaagatctggagtagtgcacagggtatcgaatcaatgttaaagtacgtggagaataaaatcgatgagttctag

SEQ ID NO: 18852 - DNA, 1626 bp, Artificial Sequence
  Description of Artificial Sequence: Synthetic coding sequence
atggccagccaggagttcgaggtggaggccatcgtggacaagcggcaggacaaaaacggaaacactcaataccttgtgagatggaaaggctacgacaagcaggatgatacgtgggaacccgaacagcacttgatgaactgtgaaaaatgtgtgcacgatttcaaccgaagacaaaccgagaaacagaagaaactcacttggactaccacctcgcgaatcttcagcaataatgcccggcgtagaacgtccaggtcaacaaaggccaattactcaaagaattcacccaagactccggtcacagataagcaccatcggtcaaagaactgcaaactattcgccgcaagtaagaacgttaggagaaaggctgcatctaccttgagtgacacaaagaatatggaaatcatcaacagcacaatcgaaacgttggctcccgactcgccatttgaccataaaaagacagtatccggattccagaaactggaaaaactggatcctatcgcggccgatcagcaggacaccgtagtatttaaagtgacggaggggaagttactccgcgaccctttaagccacccaggcgccgaacagacgggcatccagaacaaaacgcagatgcaccctctaatgagtcagatgtccggcagcgtcacagcgagcatggctacgggttccgcaaccaggaaaggcattgtggttctgatcgacccacttgcagctaatggcaccaccgacatgcacaccagcgtgccgagggtaaagggagggcaacggaacataacggacgattcccgcgggcagccttttataaaaaaaatgcacttcaccatcaggctcactgagagcgcaatcacgtaccgcgatatcgtggttaaaaaagaagatggcttcacccagatcgtcttgagcacccgatccacggagaaaaatgctctgaacactgaagtgattaaagagatggttaacgcccttaattctgccgctgcggatgatagtaaacttgtgctattctctgccgcaggcagcgtgttttgctgcggcctggatttcggctactttgtacgccacttgcggaacgatcgtaataccgctagtctggagatggtggatacgataaaaaactttgtgaacactttcattcagttcaaaaagcctattgtcgtgagtgtcaacggccctgcaattggtctaggcgccagtattcttccattatgcgatttagtctgggctaatgagaaagcatggtttcagacaccgtacacgaccttcggccagtcgccagacggatgttccagcataacattccctaagatgatgggaaaagcctccgctaatgaaatgctgatagctggtcgcaaactcaccgcgcgggaggcctgtgctaagggattggtttctcaggtgttcctgacaggaacgttcacacaggaggtcatgattcagattaaggaattagcttcctacaacgccattgtcctcgaagagtgcaaagcactggtgagatgcaatattaagctggagctggagcaggcaaatgagcgagagtgcgaagtccttagaaaaatttggagctccgcacaggggatagagagcatgctcaaatacgtggaaaataaaatcgacgaattctag

SEQ ID NO: 18853 - DNA, 1668 bp, Artificial Sequence
  Description of Artificial Sequence: Synthetic coding sequence
atggccagccaggagttcgaggtggaggccatcgtggacaagcggcaggacaaaaacgggaacacccagtatcttgtgcgctggaaaggttacgacaaacaggacgatacttgggaacctgaacagcatttgatgaattgcgagaaatgtgtccacgactttaatagaagacagaccgaaaagcagaaaaagctgacctggactaccaccagccgtattttttccaataatgccaggaggagaacatctagatccactaaggccaattattcgaagaatagccccaaaacgcccgtgaccgacaagcaccatcgctctaagaactgcaaactgtttgccgctagcaagaacgtccggagaaaggctgcttctacactgtcagacacaaaaaacatggagatcataaattcaacaattgagacccttgcgccagactccccgtttgaccataagaaaacagtgtctggattccaaaaacttgagaaattggatccgattgccgcggaccagcaggacactgtggtattcaaggtgacagaaggtaagctgttaagagacccgctatctcaccctggggccgaacagactgggatccagaataaaacccagatgcacccactgatgagtcaaatgagtggttcagtcactgccagcatggccacaggttctgctacgaggaagggtatcgtggtgctcatcgatcctctggccgccaatggaaccaccgacatgcacacaagtgtgcccagggttaaaggtgggcagcggaatataactgatgattctagagggcagccgtttataaagaagatgcacttcacaatccggctcacagagtccgccataacctaccgggacatcgtggtgaaaaaggaggatggcttcacccagattgttctcagcacaagatcaactgagaagaacgcactgaacactgaggtgatcaaagagatggttaacgcactgaacagcgcagcagccgacgatagcaaactggtcctattttctgctgccggatcggttttctgctgtggcctggacttcggttacttcgttaggcacctcagaaatgataggaataccgccagcctggagatggtggacacaattaaaaactttgtgaacacattcatacagtttaaaaagcctattgtcgtgagcgtcaatggacctgcaattggcctgggtgcatcaatacttccactctgcgatctggtctgggccaacgaaaaggcatggttccaaacaccgtataccacatttggccaatcgccagacggctgctcttcaataacattcccaaaaatgatgggcaaagcatccgcaaatgagatgctcattgcagggcggaaacttacagcgcgagaggcttgcgcaaaggggctagtgagccaggtgtttctcaccgggacctttactcaggaagtgatgatccaaattaaggaactggcttcgtacaacgctatcgttctagaagaatgtaaagctctggtgaggtgtaacattaaattagagctcgaacaagccaacgaacgcgaatgtgaggtgctcagaaaaatctggtccagcgcacagggaatcgaatctatgttgaagattccacttctgggctataaggctgcatttccccccaggaagactcagaacgaccaacggtggtgcccatag

SEQ ID NO: 18854 - DNA, 423 bp, Artificial Sequence
  Description of Artificial Sequence: Synthetic coding sequence
ggcccccccgagcagagcctgctgctgaccgaggcctggagctgggcatctaaaaaaaagcagccgcatctgttttcaggtgtgatcgtgggtggtcacttatggctcctggggtttagccctggtgctggcggattctgcactactcttccccccagcttcttgcgggtggacgatagggccacctcctccaccaccgactcctctcgagccccttcttcaccgcgccctcctggaagcacgtcgcactgcggtatctctaccaggtgcaccgagagatgcctctgcgtactgcccctgaggacctctcaggtccctgatgtaatggcacctcagcacgatcaggagccaaagcggcgcatgtatttcatttggctaggatggattccatctgataagcctagtcagttaacggaacgctag

SEQ ID NO: 18855 - DNA, 510 bp, Artificial Sequence
  Description of Artificial Sequence: Synthetic coding sequence
ccccccgagcagagcctgctgctgaccgaggcctggagctgggcctctaaaaagaaacaaccccaccttttctctggtgtgatcgtggggggtcacctctggctgctgggtttctctccgggtgctggtgggttctgtaccacactccccccttcattcctgagggtggatgatcgagctacttcttctaccaccgacagttccagggctccctcaagtcccagaccacctggaagcacttctcattgcgggatctccacccgctgcaccgaacggtgtctgtgtgtgctgcccttgcgtaccagtcaggtccctgacgttatggcgccccagcacgatcaggagaaatttcatgatttggcctactcctgcctcggaaaatcattttcaatgtccaatcaggacctctacggatacagcacatccagtctggcattgggcctagcctggttaagctgggaaactaagaagaagaatgtgttgcacctggttggactggattctctgtag

SEQ ID NO: 18856 - DNA, 567 bp, Artificial Sequence
  Description of Artificial Sequence: Synthetic coding sequence
tgagcccagcggggccccggcaaggccggcctgaccggcggccgggagaggctggagaggggggccagagcggcccgcactgatcagcaccaaaggatccaggaagaggagagggacctcactggctctggcgacatctcccctccgcaacatccttctagacatagtttcagtcccggagcaggtgggttttgtactactctgcccccctcatttttgagggtggatgatcgcgccacatcctctactaccgacagcagtagggcaccttccagtccaagacccccggggtcgaccagccactgtgggataagcacacggtgcaccgagagatgtctgtgcgtgctcccattgcggacgtctcaggtcccagacgtcatggcaccgcaacatgaccaagagaagttccacgacttggcttactcatgcttaggcaagtccttctcaatgtcaaatcaagatttatacgggtattcaacctcatcccttgccttgggcctggcatggctttcctgggaaaccaaaaaaaaaaacgtcttacacctggtcggtctggatagcttgtag

SEQ ID NO: 18857 - DNA, 471 bp, Artificial Sequence
  Description of Artificial Sequence: Synthetic coding sequence
atgttcctgaccgaggacctgatcaccttcaacctgcggaacttcctgctgtttcaactttgggagtcatcgttttcacctggtgccggcggtttctgcacaactcttcccccttccttcttgcgggtcgatgacagggcaacttctagtacaacagactccagccgcgccccttcttccccgagaccccccggctccacgtcacattgcgggatcagcactcgctgcactgagaggtgtctgtgcgtgctaccactccgcacctcacaggtaccagatgtgatggccccacagcacgatcaggagaagtttcatgaccttgcctatagttgtctcgggaaatcttttagtatgtctaaccaggacctctatgggtactctacgagctccctcgcgctggggctggcctggttgagctgggagaccaaaaagaagaacgtcttacacctagttggcctcgatagtctgtag

SEQ ID NO: 18858 - DNA, 201 bp, Artificial Sequence
  Description of Artificial Sequence: Synthetic coding sequence
tgacagccccagggcccccccgagcagagcctgctgctgaccgaggcctggagctgggcttctaaaaaaaaacagcctcacctcttctcaggcgttattgttggggggcacctctggctccttgggcccaaacgccgaatgtattttatctggctgggttggatccccagcgataaaccctctcagcttacagagcggtag

SEQ ID NO: 18859 - DNA, 3615 bp, Artificial Sequence
  Description of Artificial Sequence: Synthetic coding sequence
atgggcgacgccaaggaggccggcgccgagggcccccccgccggcgctgccgcaagaggcggcctgtccttgctgagccaaggggaaagcgaggagtcgagcgcacagggttctgcgctttttctcggggggaacgaggttaaaagtcgggcagttgtcaagtactcttccgcccccccacgtactgcttttgcgcgcctcgaagagaaaaccgatttgaagctgcctcctgccaactggctgcgggagagcgctaaactgggccccgccggcacgactatcctgggaaattctaaaaagagtaaaccattctcttccttcggtatggcctacgacttcatcgattccgtgggcaatgacgttgacgtcgtgtcagacagcgagaatattaaaaagttactgaagatcccgtattcaaaaagtcatgtcagcatggctgtccacagaattgggcgtacactgctgctcgatgaactggacatacaggagctcttcatgaggtcctctcagactggcgattggacctggctgaaagaattctatcaacgccttatcgaccaaaagtggcaaagaaagaaaaagagcaaggaacattggtatcaaaaagcaatcctgagcaagtttctgtattactctatcaatggggatggggccgcccagccggtgtccagcaccgctgagcaacaagagtcttccagctccgaccagaccaacgacagtgagggcgcctcctggcctgctcccttcgagatgcccagctcagtttccgaagacccgtcagcttcatcacaaggcctgaaaaacgacttcgtgcgtaacattttatggactttcgaggacatccatatgctggtcggaagcaacatgccgatcttcgggggcggcagataccctgctgtaagcctccggttgcgagacaacaacaagccgatcaacgtgctcacaggaatagattactggctggacaatctgatttgtaatgtgccagagcttgtgatgtgtttccacgttaacggcatcgtgcaaaagtacgaaatgattaaaaccgaggaaattcctaacctggagaacagcaattttagtaccaaggtgattaaagacattgctcaaaatatactgtcttttcttaaatctaactgcactaaagagggacatacctattggctgttcaaggcttccggctcagatattgtaaagctctacgaccttacaacattatgcgaggagactgaggacaaatatcagaacccatttactatgccggtcgcaattctactgtataaagtcgcctgtaacatgatgatgaagaagaatcagaacaaaaagcactatggcacaattcgtaccctgctgctgaattgtctaaaactgctagataaaagtcggcaccctcagattatagcaagcgctaactacatgctctccgagctcttccagcttgacgaaccgaagaaagaggagaactccgaatcgccccttaacgagaactccgatgagagttactctgaagaagaggaagaaatgcctgactcagatgagaacggctcctatagcacttcctccgatccgagtgatgattccaaagcagttgcaattattaagagcgtcggggaactttctgtgccagagaagtataagtccatacatcaaattcggcctagttgcgcatttccagtgtgccatgacacagaggaaagatgtcgcctcgtcctctcctacgttcttgagggtttgaagtccgtggactctagcatcaagaaggaaagtgatttgcccgcagccgatccaagcactcctattccactaaaatacgaggatgaatccagcaggggaggccctgagggcttagagaaacagatggctcttttccttgataaaatgggttccctgcagaaaggcaattactcctcacagtccggaatgatcccgggcagttggcagcataagatgaaactgcagctcattctgaagtcatctaaggcctactatgtgctgagcgatgctgcaatgagtctccaaaagtatggccgcgcactgcggtatattaagctggctcttcagagtcatgatacttattgctgcctatgcaccaacatgctgagtgaggtgctgctgtttctgtcacagtacctcactctctgcggcgacattcagctcatgctcgcccagaacgccaataatagggccgcacacctagaagagttccattatcagactaaggaagaccaggaaatcctgcattctcttcaccgggagagcagctgtcagggctttgcatgggccaccgacctgtctacagacctagagtctcagctgtccgtctcatgcaagtgttacgaagcggcaaacgaaattctacaatttagcgatctcaagtcgcagaaccctgaacattatgtgcaggtgctgaaacgcatgggaaacataagaaatgagatcggcgtgttctacatgaaccaggccgccgctctgcagtctgagcggctcgtgtctaagagtgtttccgccgccgaacagcaactctggaagaaatccttctcttgtttcgaaaaggggatccataactttgagtccattgaagatgcgaccaacgccgctttattactgtgtaacactgggaggctcatgagaatttgtgcccaagcccattgtggagccggagatgagcttaaacgcgagttttcccccgaggagggtctctactataataaagcgatagattattatttaaaagccctgcgctccctgggaacaagagatatccatccagccgtctgggactctgtaaattgggagttgagtaccacgtattttaccatggccaccttgcagcaggattacgccccattatctagaaaggcccaggaacagatcgagaaagaggtgagcgaggctatgatgaagagcctgaagtactgcgacgttgattccgtttccgcccgacagcccctttgtcagtaccgagccgccacaattcatcatcggctcgcctccatgtaccatagttgtctccgaaaccaggtcggagatgagcatctgaggaagcagcatagggtgctagcagatctgcactatagcaaggccgccaaactctttcagctgcttaaggacgcgccatgcgaactgctcagggtgcagcttgagcgtgtagccttcgcagaattccagatgacctcccagaacagtaatgtcggaaagttaaagacactgtctggagctttagatattatggtcagaactgagcatgccttccagctgatccagaaggagcttattgaggagtttggtcaacctaagagcggtgacgctgcggccgccgccgacgcttctccaagcctgaatcgggaggaggttatgaagctgcttagcatattcgaatctcggttaagtttccttctgctgcagtcgatcaagctcttgtcgagcactaagaagaagacatccaataatatcgaggacgataccatcttgaaaaccaataagcacatctactcccagctgctgcgggctacggccaataagaccgccactctgctagagcgcatcaatgtaatcgtacatttgttaggccagctcgctgcaggatcagccgccagcagcaatgcagtccaatag

SEQ ID NO: 18860 - DNA, 3717 bp, Artificial Sequence
  Description of Artificial Sequence: Synthetic coding sequence
atgggcgacgccaaggaggccggcgccgagggcccccccgccggcgcggcagcgcgaggcgggctgtcactgctgagccaaggcgagagcgaggagagcagcgcccagggatccgcattgtttttgggaggcaacgaggtaaagagccgggcagtagtaaaatattccagcgctccccccagaacagccttcgctcggcttgaggagaagacggacctgaaactgccccccgcaaattggctgagggaatctgcaaagcttggccctgcaggtacaaccattctggggaactccaagaagtccaaacctttttccagtttcgggatggcgtacgattttatagattctgtgggtaacgacgtcgacgtagtttcagactccgagaacataaaaaagctcttaaaaattccctatagtaagtctcatgtttctatggctgttcatcggattggacgaaccctattactggatgagctggatattcaagaactgtttatgaggagcagccagaccggagattggacatggctaaaggaattctaccagagactaattgaccagaagtggcaacgaaagaagaagtctaaggaacactggtatcaaaaagcaattctcagcaagtttctctactatagcatcaacggggacggcgcagcccaacccgtgtctagcacagccgagcaacaggagtcatcctcctcagatcagacaaatgatagcgagggcgcatcttggccggcccccttcgaaatgccgtcctccgtgagtgaggatcccagtgcttcctctcaggggtctgagccactcgagccaagctacattgtgggccacgtggctagcgcgcctaaagagcagaatttaataacactatttaatgacggagagcattcacagggccttaagaatgattttgtacggaatatcctgtggacctttgaagacatccacatgctcgtcggctctaacatgccaattttcgggggaggccggtaccctgccgtgagccttcgcttgagggataacaataagcctattaacgtcctcaccggaattgactactggctcgacaacctcatatgtaacgtgcctgagttagttatgtgcttccatgtaaacgggattgtgcagaagtacgagatgattaaaacagaagagattcccaacctggagaatagtaacttttcgacaaaagtcatcaaagatatagctcaaaacattctgtcatttttgaaaagcaattgtacaaaagaaggacacacttactggctgtttaaggcatccgggagtgacattgtgaagctctacgacctaaccacgttgtgtgaagagaccgaggataaataccagaaccccttcactatgcccgttgcgattctcctgtacaaagtcgcatgtaatatgatgatgaagaagaaccagaataaaaagcattatgggaccatccggacactcttgctgaattgcctcaagctcctggacaagtcacggcacccacaaataatcgccagtgccaattatatgctcagtgaactgttccaactagatgagcctaaaaaggaggagaattcggaatcgccacttaatgaaaactccgacgaatcgtacagcgaggaggaggaagaaatgcctgactccgacgagaatggatcctacagtacctcaagcgacccatctgatgactccaaagcagtcgccatcatcaaatccgtcggggagctgagtgttcccgaaaaatacaagagcatccatcagatcaggccttcctgcgccttccctgtttgccacgacacagaagagcgctgcaggctagttttgtcgtacgtgctggaggggctgaaatctgttgactcctccatcaaaaaagagagcgacctcccagcagccgatccatcaaccccaattcctctgaagtatgaagacgagtcttctagaggaggtccggaaggactagagaaacaaatggccctgtttcttgacaaaatgggatcattgcaaaaaggcaattacagctcgcagtcaggcatgattcccggctcttggcagcacaagatgaagctgcaattaattctaaagtcgagcaaggcttactatgtcctgagcgacgcagctatgagtctccagaaatatgggagggcgctccgctatatcaagcttgctcttcagtctcacgacacctattgctgcttgtgcacaaatatgctgtctgaagttctgttattcctgtcccagtatctaacactttgcggtgatatccagttaatgctggctcagaatgctaacaatcgcgctgcacacctggaagagtttcattaccagactaaggaggatcaggagatcttgcattcgctgcacagagaatcttcttgccagggcttcgcctgggccactgatctgtcaacagacctggagtcacagttgagtgtatcttgcaaatgttacgaagctgctaacgaaatactccagtttagcgacttgaagtcccaaaatccagagcactatgttcaggtgcttaagcgaatggggaacataaggaacgagatcggggtcttttatatgaaccaggcagctgccctgcaaagcgagcgactggtatctaagtccgtatcagctgccgagcagcaattatggaagaagtcattttcctgcttcgagaaaggaatccataacttcgagtctatagaagatgcgacaaatgccgctctccttctgtgtaacacaggccgtctcatgcgtatttgcgctcaggcccattgcggagctggggatgagttgaaacgggaattctcaccagaggagggtctgtattataataaagcaattgattactatttgaaggcactcaggtcattgggaacccgtgacatccatcccgcagtgtgggattcagtaaattgggaattgtctaccacatatttcaccatggccacactgcagcaggattacgcccctttgtctaggaaggctcaggagcaaatcgaaaaggaggtgagcgaagctatgatgaaaagcctgaaatattgtgacgttgatagcgtgtcagctcgacagccgctatgccagtatcgggcagcaacaatccatcaccgcctagctagtatgtaccatagctgccttaggaaccaggtgggtgatgagcacctgaggaaacagcaccgggtgctggcggatctccactatagcaaggcagccaaattgtttcaactgctcaaagatgctccgtgtgaacttttgcgtgtccaactggaacgcgtggcattcgcagagtttcaaatgacctctcagaattccaatgtcggaaagttaaaaacccttagtggcgctttggatatcatggtgcgcaccgaacatgccttccagctcattcaaaaagagcttattgaagaatttggtcagcctaagtcgggagacgctgcagctgcagccgacgcatccccttccttaaacagggaggaagtaatgaagctgctgtctatctttgagtccagactctcgtttctgttattgcaaagcataaaactgctcagcagtacgaagaagaagacaagtaataacatcgaggacgatacgattctgaagactaataagcacatttactctcaacttctgagagctactgcaaacaaaactgcaacccttctagaacgaatcaatgtcatcgtacacctgctaggtcagctcgcagctggtagcgccgccagcagcaacgcagtacagtag

SEQ ID NO: 18861 - DNA, 954 bp, Artificial Sequence
  Description of Artificial Sequence: Synthetic coding sequence
agcatccaccagatccggcccagctgcgccttccccgtgtgccacgatactgaggagagatgccggttggtgctgtcgtacgtgttggaaggtctgaagtccgtggactcgagtatcaagaaagaatcggacctgcctgccgctgatccttccactcctatcccactgaagtatgaggacgagtcatctcggggtggcccagagggactggagaaacagatggctctctttctcgacaagatggggtccttgcagaagggtaattacagttcgcagtcaggtatgattcctggaagctggcagcacaaaatgaaacttcaactcattctgaagtcatcaaaagcatactatgtgctgagtgatgccgccatgagtctgcagaagtacggcagggccttgcgatacatcaaactagcactgcaaagccacgacacctattgttgcctgtgcaccaacatgctgtccgaagtgctgttgtttctctcacagtatctgacattgtgtggcgacatacagctcatgttggcgcagaacgccaacaatagagctgctcacctggaggaatttcattaccagaccaaagaagaccaagagatcctgcatagtctccatagagagtcttcttgtcaaggagtgccccaggcatggaccacatggtttactgtgggcctgtgcagcttggcccacgcttatctttccatccagaaacgtggcagaaacatcagggtgctgattttcgccttgtacctctttatctacttcttgcggaggtcatttgcactggtggcccaggctggggtccagtggtgcaacctcggctccttaaagcccccaccccccggcttcaagcagttctcctgtttatctttaccgagctcttggaattatagacacgcaccaccctgtcctgctagccctccctggcctccaaaggtgctggggctccaggtgtag

SEQ ID NO: 18862 - DNA, 2391 bp, Artificial Sequence
  Description of Artificial Sequence: Synthetic coding sequence
atgggcgacgccaaggaggccggcgccgagggcccccccgccggcgccgcggccagaggcggcctgagcctcctcagccagggagagagtgaggaaagcagtgcacaagggtctgccctgtttttgggaggtaatgaggtcaaaagcagagcagttgttaaatatagttcggcccctccccgcactgctttcgctagactcgaggaaaagaccgacttgaagttacctcctgctaactggctccgggagtcagctaagctgggccccgcaggcaccactatactagggaattctaagaagtccaaacccttcagttcatttggaatggcctacgattttatagacagcgtcggcaacgacgtcgacgtggtgtcggattctgaaaatattaagaaactgctgaagatcccttacagcaagagccatgtgagtatggcagtgcaccgaataggacggactctcctgctcgacgagctcgatatccaggagctgtttatgcgttcttctcagacgggggactggacatggttaaaggaattttatcaacggctgatagatcagaaatggcaacggaagaagaaaagcaaggagcactggtaccagaaggccatcctgtctaaattcttgtattacagcattaatggagatggcgctgctcagcccgtcagttcaactgccgaacagcaagagtcctcttcttcagatcagaccaacgattcagaaggcgcctcatggcccgcccccttcgagatgccctcttccgtgagtgaagacccatctgccagtagccagggctcagagcctttagaaccgagctatattgtggggcatgtcgcgtcagcgccgaaggaacagaatctcataacactgtttaatgatggcgaacactcgcagggtttgaaaaacgatttcgtgcgaaacattttgtggaccttcgaggacatccatatgctcgtgggcagcaatatgcccatctttggcggagggcgctatcccgcagtatcactgagattgagagacaacaacaaacctattaacgtactgaccgggattgactattggctagacaacttgatttgtaatgtcccagaattagtcatgtgttttcacgtcaacggcatcgtgcaaaagtacgaaatgatcaagactgaagaaatccccaacctggagaacagcaattttagcactaaagtcatcaaagacattgcccaaaatatcctgagctttctcaaaagcaattgtacgaaagagggccatacctactggctgttcaaggctagtggttccgacattgtgaagctgtatgatcttacgactctgtgcgaggagaccgaagataagtaccagaaccccttcaccatgcccgtggctatattgctatataaagtggcttgcaatatgatgatgaagaagaaccagaataaaaaacactacggcacaatacgcactctgctacttaactgtctcaagctgctagataagtctcgccatccacagattattgcatcagctaattacatgctgtcagagctcttccagttagacgaaccaaagaaggaagaaaatagtgagtcacccctgaacgaaaattccgacgaatcttactccgaggaggaggaagaaatgcccgactctgatgaaaatggatcgtattccacatcttctgatcccagcgatgattcaaaggccgtggccatcatcaagtctgtgggtgagctgagtgtgcccgagaagtataagtccatccatcagatccgcccctcctgcgcctttccggtttgtcacgacacagaagagcggtgccgtctcgtactttcatacgtcctcgaagggctgaagtctgtcgatagctccatcaagaaagaaagcgacttaccggccgctgatccctctacaccaatccccctaaaatatgaggatgaatctagtcgtggcggccctgaagggttggagaagcagatggctctgttcctcgacaagatgggttccttgcagaaaggcaattactcttcgcagagcgggatgatcccaggcagctggcagcataagatgaagctccaactgatacttaagtcctccaaggcttactacgtgctgtcagacgctgcaatgagcctgcagaaatatgggcgggcacttagatacattaagctggctctgcagagccatgatacctactgctgtctgtgtacaaatatgttgagcgaagtcttactctttctctctcagtatctgactctctgcggtgacatccagctgatgctggctcagaatgccaataaccgcgccgcacacctggaggaatttcactaccagacaaaagaggaccaggagatcctccatagcctgcatagagagtctagttgtcaggtttttagaaaaggcgtctag

SEQ ID NO: 18863 - DNA, 2490 bp, Artificial Sequence
  Description of Artificial Sequence: Synthetic coding sequence
atgggcgacctgaagagcggcttcgaggaggtggacggcgtgcggctggggtaccttatcataaaaggcaagcagatgttcgccttgtctcaggtctttactgacctgctcaagaacattccgaggaccaccgtgcataaaaggatggatcatttaaaggtgaagaagcatcactgcgacctagaggagttacgaaaactaaaggccatcaactccattgccttccacgcggcgaagtgtaccctgataagtagggaggacgttgaggctctgtacacctcgtgtaaaaccgagagagtgttgaaaactaaacgtcggcgggtgggtagagcactggcaaccaaggcccctcctcccgagcgagccgctgctgcttcgcctcgaccaggcttctggaaagataagcaccagttgtggagaggcttaagcggagccgcccgtccgctgccaattagcgcgcagagccagcggcccggcgcagctgctgcccgcccagctgcccacctcccccagatctttagcaaatatcctgggagtcactatccagagatcgtgcgcagtccctgcaagcctccactgaattacgagaccgcccccctgcaaggcaattatgtggcgtttccttctgaccctgcgtatttcaggtcgcttctgtgctctaagcacccagcggccgccgcggcggcggcagctgcagccgctgcagctgctgcagccggcgcgacctgtctggagagatttcacctggtgaacgggttttgccctccgccccatcaccaccaccatcatcatcatcatcaccatcaccaccatcacagagcgcagccccctcaacagagccatcacccaccacaccatcacagaccccagccacacctggggagctttcctgaaagctgcagcagtgattcggagagcagctcttactctgaccacgcagctaacgacagtgatttcggctcttctctcagcagctctagcaatagcgtcagctcggaggaggaagaagaagagggcgaggaagaggaagaggaagaggaggaagaaggaggctccggggccagcgactcaagcgaagtctctagtgaggaagaggatagctcaacggagtctgatagttctagcggctcttcccaggtgtcagtgcaaagtatccggttcagacgtacatctttctgcaaacctccgtcagtccaagcacaggccaatttcctgtatcatctagctagcgctgcagccgccactaaacccgccgcgtttgaagacgcaggacgattacctgacctgaaatccagcgtgaaagcggaaagtccagcagaatggaaccttcaatcctgggcccctaaagccagtcccgtgtattgccccgcaagtttgggaagttgttttgcagaaataaggaatgacagagtgtctgagatcacttttccccactcggaaatctcaaatgccgtgaagcgaactgatctcaccattaactgcctggccgagggtgcatcttccccaagtcccaaaaccaataacgcctttcctcagcagaggattctgagagaggccagaaagtgcctccagacaacccctacaacacattgtgcagacaacaatactatagccgccagattcctgaataatgacagctccggtgctgaggctaactcggagaagtactctaagattctccactgtcccgaatttgctaccgacctcccatcttcccagactgacccagaagtgaacgctgccggagccgctgctacaaaggcagagaacccctgcaccgacacaggagataaaaccctgccattcctccacaacatcaagattaaagtcgaggactcctctgccaatgaagagtatgaaccccacctgttcaccaataagctaaaatgtgagtgcaacgacacaaaaggagagttttattccgtcaccgagtcaaaagaagaggatgctctgcttacaacagctaaagaaggattcgcctgccctgaaaaagaaacaccatccctgaatccactggcccaaagccagggcctgagttgcaccctggggtcacctaagccagaggacggcgagtataagtttggtgcaagggtgcgaaaaaattataggactctggtactcggcaaaaggcctgtcctgcagacaccacccgttaagcctaacctgaagagtgctcggtctccacggccaacagggaaaactgaaacaaacgaaggcactctggatgacttcactgtcatcaatcggcgcaagaaggtggccagcaacgtcgcttccgcagtcaagcgtccattccattttatggctaacttcccctgtccccccagtctcattattggacgtgacggggatttgtggccagcttacagccttaataccactaaggacagccagacaccccacaaggcgcacccaatctggaagtggcagctcggcgggtccgcgatcccactacctcccagtcacaaatttcgaaagtttaattcatag

SEQ ID NO: 18864 - DNA, 2727 bp, Artificial Sequence
  Description of Artificial Sequence: Synthetic coding sequence
atgggcgacctgaagagcggcttcgaggaggtggacggcgtgcggttgggatatctcataattaaagggaaacagatgttcgctttgtcacaagtctttaccgacctgctcaagaatatcccaagaactaccgttcataaaagaatggatcacctgaaggtcaagaagcatcactgtgacttggaggagttaagaaaactgaaagcaatcaactcaattgcatttcatgcagctaagtgtacacttattagcagggaggacgtcgaagccttatacacttcctgcaagacggagagagttcttaagacgaagcggagacgcgtggggcgcgccctggccactaaagccccgcctcctgagagggctgctgccgccagtccccgtccgggcttctggaaagacaagcaccagctctggcggggcctgagcggggccgctcgaccattgccgatttcggcccagtctcagcggccaggcgcagccgccgcgcgcccagccgctcaccttccgcagattttctccaagtacccaggctctcactaccctgagatcgtccgatctccttgtaaaccgcctctgaattatgagaccgcaccgctccagggcaactatgtggcatttcccagtgaccccgcgtattttcggtcactcttatgttccaaacaccctgcggctgccgccgccgctgccgccgccgccgcggcagccgccgcagcagcagcagcagccgcctattaccaggtgtctgccgcaggccctcagccaaaagccgctgcaggggctggaggtccggggtccttatcttaccgttgcaaacgtaagagagggggggctaaagactgccttttggcacctcacgccggggcccgacggctgctacttctcccgcgcagctataaagctaaggcggccgccgcagccgccgctgcagccgccgccgctgctgccgccgctggcgctacctgtttggaaagattccatctcgtaaatggcttttgcccacctccccaccatcaccaccatcaccatcaccatcaccatcaccatcaccatagggcccagcctccgcagcaaagtcaccaccccccccaccatcatcgcccacagccgcacctcggtagttttcctgagagctgctctagcgacagcgagtctagttcgtatagcgatcacgccgccaatgactctgacttcggatcaagcctgtccagctcttctaattcggtctcctccgaggaggaggaggaagagggcgaagaagaagaggaggaggaagaggaagaaggaggtagcggcgcctccgactcgtcagaggtgagttccgaagaagaggactcttcaacggagtctgatagctcatctggctcgtctcaggtgtctgtgcaatcgatacgctttcgccgcaccagcttttgcaaaccaccgtcggtacaggcgcaagcgaactttctgtaccacttggcaagtgcggccgccgctacaaaaccagctgccttcgaagatgcgggacggctacctgacctgaaaagctctgtgaaagctgagtccccggcagagtggaaccttcagtcttgggcccccaaagcaagtcctgtgtactgccccgctagcttaggcagttgctttgcggaaattagaaacgatagagtgtctgagattaccttcccacactcagaaattagcaacgccgtgaagcgtacggacctcacaataaactgcctggcagagggagcttcatccccatcaccaaagaccaacaacgcctttcctcaacaaagaattctgcgagaggctcgcaaatgtctacagaccacgcccactacacattgtgcggacaacaacaccattgccgctagatttttgaataacgactcatctggcgcagaggccaatagcgagaaatattccaagatccttcactgtccagagtttgctacagaccttccttcaagtcaaaccgatcctgaggtgaacgccgccggtgcagccgccactaaagcagagaacccctgcaccgacactggtgataagacacttccatttctacataacatcaaaatcaaagtcgaggactcaagcgcaaatgaagagtacgaaccccacctgttcactaacaagctcaagtgcgaatgtaacgatacaaagggcgaattttattccgtgactgaatccaaggaagaagatgcactgttgacaaccgctaaggagggttttgcatgtcccgaaaaagaaacaccaagtctgaaccctcttgctcagtcgcaaggactctcctgtaccttgggtagcccaaaacccgaggatggtgaatataagtttggggccagagtgcgaaaaaactaccgaactctggtcctgggtaagcgtcctgtgctccagactcctcccgtgaagcccaatcttaaaagtgcccgttcaccccgaccaactggaaaaaccgaaaccaatgaaggtacattagatgacttcacagttatcaatcgcaggaaaaaggtcgccagcaacgtcgcctcggctgttaagcggccattccacttcatggcaaactttccgtgtcctccaagcttgatcatagggagagacggcgatctctggcctgcctacagcttaaatacgactaaagattcccagacccctcacaaagcccatccaatttggaagtggcagctcggaggctccgccattcctctccctccctcacacaagtttcggaagtttaactcttag

SEQ ID NO: 18865 - DNA, 453 bp, Artificial Sequence
  Description of Artificial Sequence: Synthetic coding sequence
atggccgccagccagtgcctgtgctgcagcaagttcctgttccagcgccagaacctggcttgctttttgacaaacccccattgtggaagtctggtcaacgccgatggtcatggagaagtgtggacagattggaacaacatgtcaaagttctttcagtatggctggcggtgtaccaccaatgagaatacgtatagcaataggactctgatgggcaactggaaccaggaacgctacgatcttcgcaatattgtgcagcccaaaccactccctagccagtttggccactacttcgagaccacgtacgatacatcttataataacaaaatgccactgtcgacccaccgttttaagagagagcctcattggttccccggccatcagcctgagctggaccctccacggtacaagtgcaccgaaaagtctacctatatgaacagttacagcaagccttag

SEQ ID NO: 18866 - DNA, 948 bp, Artificial Sequence
  Description of Artificial Sequence: Synthetic coding sequence
atggcctgcgccgagttcagcttccacgtgcccagcctggaggagttggcgggcgtgatgcaaaaagggcttaaagacaacttcgccgacgtacaagtttccgtggtggattgcccagatctgaccaaggaaccattcacctttccagtgaagggcatctgtgggaaaactcgtatcgcagaggttggtggtgtgccgtatctactgcccttggtgaaccaaaagaaagtatacgacctcaataaaatcgcaaaggagatcaagctgcccggtgccttcatcttgggagcgggcgccgggccctttcaaacactgggctttaattccgaattcatgcccgtcatccagacagagagcgagcacaaaccaccggttaacggctcttacttcgctcatgtaaaccccgctgacggggggtgcctgctcgaaaagtacagcgagaagtgtcatgatttccaatgcgccctgttagccaacttatttgccagtgagggtcagcccggtaaggtcatcgaggtgaaggccaaacgacgcacaggaccccttaactttgtgacatgcatgcgggaaactttagagaaacactacggcaacaaacctatcggaatgggtggaaccttcattattcaaaaaggtaaggtgaaaagccacatcatgcctgccgagttttcatcatgcccgctcaacagtgacgaagaggtgaataagtggctccatttttatgagatgaaggccccacttgtgtgcctgcctgtgttcgtgagtagggaccctgggtttgacctccgcctggaacatacccactttttctcaaggcatggtgagggcggtcattatcactatgacactactccagatattgtggaatacctcggttactttcttcctgccgagtttctttataggatcgatcagcctaaagaaacacacagcatcggacgagattag

SEQ ID NO: 18867 - DNA, 948 bp, Artificial Sequence
  Description of Artificial Sequence: Synthetic coding sequence
atggcctgcgccgagttcagcttccacgtgcccagcctggaggagctggctggcgtgatgcaaaaaggcctgaaggacaacttcgcagacgttcaagtgtccgtcgttgattgtccagatcttactaaagagccatttacatttcctgttaagggtatctgcgggaaaacacggattgctgaggtgggcggagttccttacctgctaccactggtaaaccagaagaaagtgtacgatcttaacaagattgctaaagaaatcaagctgcctggcgcttttattctgggagcaggtgccggcccattccagacgctcggcttcaacagcgaattcatgcccgtgatccaaacagaatcagagcacaaacctcccgtgaatggatcctacttcgcacacgttaatcccgcggacggaggatgcctcctggaaaagtacagcgaaaagtgccacgactttcagtgcgcccttctggccaatcttttcgcctccgaggggcaacctgggaaggtgatagaagtaaaggctaaacgaagaacaggaccattgaactttgtgacatgtatgagagagacgttggagaaacattacggaaataaacccattggtatgggaggcaccttcatcatccagaaggggaaagtgaaatcccatataatgccagccgagttctcttcttgtccattgaactctgacgaggaggtgaacaagtggctccacttctacgagatgaaggcgcctctggtctgtctgcctgtgttcgtgtcgcgtgaccccggtttcgatctgagacttgagcatacacacttcttctcgcggcacggtgaagggggccactaccactacgataccacaccagatatcgtcgagtacctgggctacttcttgcctgcggaatttctatatagaatcgaccaacccaaggagacccatagcatcggcagagactag

SEQ ID NO: 18868 - DNA, 891 bp, Artificial Sequence
  Description of Artificial Sequence: Synthetic coding sequence
atgcagaagggcctgaaggacaacttcgccgacgtgcaggtgagcgtcgtggattgtccagaccttacaaaggagcctttcacattccctgttaaaggaatctgcggaaaaactaggatagccgaagtaggcggcgtcccttatctgctgccgcttgtcaaccagaagaaggtttatgatctaaataagattgccaaggaaattaaacttcctggggcctttatactgggcgcaggagcagggccttttcagacactgggtttcaactccgagtttatgcctgtgatccagactgagagcgaacataaaccccccgtgaatggatcctactttgctcatgtcaacccagcagatggcggatgtttattggagaaatactctgagaagtgccacgactttcaatgcgcgctgctggctaatcttttcgcaagtgagggacagcccggaaaggtgatcgaggttaaagccaagcggcgaaccggccctctcaattttgtgacatgcatgagggagacgctcgaaaagcactacggcaataagcccataggcatgggcggaacttttataatacaaaaagggaaggtgaaaagccacatcatgccagccgaattttcgagttgtccccttaattcagacgaggaggtaaataagtggctgcacttttacgagatgaaggctccactcgtttgcctgcctgtgtttgtctcacgggatccaggattcgacttacgcttagagcacacccacttcttttcccgccatggggagggcggtcactaccactatgataccactcccgatattgtagaatacctgggttattttctgcccgctgaatttctgtacaggatagaccagccaaaggagacccatagcattgggagggattag

SEQ ID NO: 18869 - DNA, 450 bp, Artificial Sequence
  Description of Artificial Sequence: Synthetic coding sequence
atggcctgcgccgagttcagcttccacgtgcccagcctggaggagctcgcaggagtgatgcagaaaggcttgaaagacaactttgccgatgttcaggtgagcgtcgtggactgtccagatcttaccaaggagcctttcacctttccagtcaaagggatttgcggcaagacaagaatcgccgaagtcgggggggtcccctacctcctcccacttgtaaatcagaaaaaggtgtacgacttaaacaagatagctaaggagattaagttgccaggcgcattcattctcggtgctggagccggacctttccagacactgggatttaacagcgaatttatgcccgtcatccagaccgaaagcgagcataagccaccggtgaatgggagttactttgctcatgtcaatcctgctgacgggggctgtcttctggaaaagtatagcgagaagtgttag

SEQ ID NO: 18870 - DNA, 234 bp, Artificial Sequence
  Description of Artificial Sequence: Synthetic coding sequence
atggcctgcgccgagttcagcttccacgtgcccagcctggaggagcttgccggggttatgcagaagggcctcaaggacaattttgcagatgtgcaggtgtctgtcgtggattgccctgacctaaccaaagagccgtttactttccccgtgaaggggatttgtgggaaaacacgcatcgccgaagtgggcggagtcccctatctgctaccacttgtgaaccagaagaaggtatag

SEQ ID NO: 18871 - DNA, 516 bp, Artificial Sequence
  Description of Artificial Sequence: Synthetic coding sequence
atggcctgcgccgagttcagcttccacgtgcccagcctggaggagctggcgggagtgatgcaaaagggcctcaaggacaactttgccgacgttcaggtgagtgtagtcgactgtccagatttaaccaaagaaccgtttacctttccagtcaagggaatctgtggcaagacaaggatagccgaggtaggtggcgtgccatacctccttcccctggtgaatcaaaaaaaagtgtacgacctcaacaaaatagcaaaggaaattaagctacccggggcatttattttaggcgccggggctggccccttccagacacttggcttcaactctgagttcatgccagtgatccagaccgagtcagagcacaaacctcccgtcaacgggagctattttgcccacgttaatcccgcagatggaggctgcctcctggagaaatatagcgaaaaatgtcatgactttcagtgtgccctgctggcaaatttgtttgccagcgagggtcagcctggcaaggtaatctag

SEQ ID NO: 18872 - DNA, 948 bp, Artificial Sequence
  Description of Artificial Sequence: Synthetic coding sequence
atggcctgcgccgagttcagcttccacgtgcccagcctggaggagctggccggggtgatgcagaaaggcttaaaggacaattttgccgacgttcaggtcagcgtggtggattgtcccgatctgacgaaagagccattcacctttcctgtcaaagggatttgcgggaagacgagaattgccgaagtcggcggcgtgccataccttcttccccttgtgaatcagaagaaggtgtatgatttgaacaaaattgccaaggagattaagcttcccggtgctttcatcttgggggcaggtgccggaccattccagaccctgggctttaactccgagttcatgcctgttatccagactgaaagcgagcacaagccccctgtcaacgggtcttactttgctcatgtgaatcctgcagatggggggtgcctcctggagaagtactccgagaagtgccatgatttccaatgcgcactgcttgcaaacctattcgctagcgaaggccagcccggaaaggtcattgaggtgaaggcaaagcggagaacagggccactgaatttcgttacatgcatgagggagactctggagaagcactatggcaataagcctatcgggatggggggtaccttcattatacagaagggtaaggtgaagagccacatcatgcccgcagaattttcttcttgtcccctcaattcagatgaggaagtaaataagtggttgcacttttacgaaatgaaagctcctctcgtctgtctgcctgtgtttgtgtcgcgcgatcccgggttcgacctccggctcgagcacacccatttcttttctcgacatggggaaggaggccactatcactatgacactactcccgatatcgtggagtacctgggctactttctgcctgccgagttcctctaccgtatcgatcagcctaaggagacacactctataggtagagactag

SEQ ID NO: 18873 - DNA, 798 bp, Artificial Sequence
  Description of Artificial Sequence: Synthetic coding sequence
atggcctgcgccgagttcagcttccacgtgcccagcctggaggagctggcaggcgtcatgcagaaggggttaaaagataactttgccgatgtccaagtgagtgtagtggactgtccagatctcacaaaagaaccgtttacatttcccgtaaaaggtatttgtgggaaaactcggattgcagaagtgggaggcgttccttatctcctgcctctcgtgaatcagaagaaggtgtacgatcttaataaaattgccaaggaaatcaaactgccaggcgctttcatcctgggggccggggcggggccctttcagacccttgggttcaacagcgaatttatgccagttatacagacagagtcagaacataaacctcccgtcaacggctcctatttcgctcatgtgaaccctgctgatggcggttgcctgctcgaaaagtactccgaaaagtgccatgattttcaatgtgctcttttagccaatctctttgcttctgaaggacaacctggaaagccagcggagtttagctcgtgccccctgaactctgacgaagaggtgaacaagtggttacacttctatgagatgaaagcaccactcgtgtgcttaccggtcttcgtgagcagggaccccggcttcgatttgagactcgagcatacacactttttctccaggcatggtgaaggcggccactatcattacgatactacacccgatatcgtggaatacttaggttacttcctgcccgccgagttcctctataggatcgatcagccaaaagagactcatagtatcgggcgagattag

SEQ ID NO: 18874 - DNA, 291 bp, Artificial Sequence
  Description of Artificial Sequence: Synthetic coding sequence
atggcctgcgccgagttcagcttccacgtgcccagcctggaggagctggctggggtcatgcagaagggcctgaaggacaattttgcagacgttcaggtgagcgtcgtagactgtcctgatttaactaaagaaccttttacattccccgtcaagggaatttgcggcaaaacacggatcgcagaagttgggggtgtgccctatctgctgcccctcgtgaatcagaagaaagtgtatgatctgaacaaaatcgccaaggaaatcaagctcccaggtgccttcattctcggctag

SEQ ID NO: 18875 - DNA, 720 bp, Artificial Sequence
  Description of Artificial Sequence: Synthetic coding sequence
atgcagaagggcctgaaggacaacttcgccgacgtgcaggtgagcgttgtggattgccccgacctaaccaaagaaccctttacattcccagtgaaagggatttgcgggaaaaccagaatcgccgaagtgggcggcgttccctatcttctgcctcttgtgaaccagaagaaggtgtatgatctgaataagattgccaaagaaataaagctgcccggggccttcatcctgggagctggcgcaggacccttccagacattgggtttcaattccgagttcatgcccgtcatacaaaccgagtcggagcacaagcctcctgtcaacggctcttactttgctcacgtcaaccccgcagatggtgggtgcctcctggaaaaatattcggagaagtgtcacgacttccaatgtgctttgctggcgaacctattcgcctctgagggacaacccggaaaagtcatcgaggtgaaagctaaacgccgcacggggcccctcaattttgtcacgtgtatgcgggagactctggaaaaacattacgggaataaacctatcggcatggggggaacattcataatccagaaggggaaagtgaagtctcatattatgcctgctgagttcagttcctgtccattgaacagcgacgaggaggtaaataagtggcttcacttttatgaaatgaaggcaccactggtgtgcctgcctgtgttcgtaagtagagatccttag

SEQ ID NO: 18876 - DNA, 303 bp, Artificial Sequence
  Description of Artificial Sequence: Synthetic coding sequence
atggcctgcgccgagttcagcttccacgtgcccagcctggaggagcttgcgggggtgatgcagaagggactgaaagataactttgcagacgtgcaggtttccgtggttgactgccccgacttaacaaaggaacccttcaccttccccgtaaagggtatctgcggtaaaacccgcatcgctgaagtggggggcgtcccttatctgctgccactggtgaaccagaaaaaagtatacgacctgaacaaaatcgccaaggagatcaaactccctggcgcttttatcttaggcgccggggccggttag

SEQ ID NO: 18877 - DNA, 891 bp, Artificial Sequence
  Description of Artificial Sequence: Synthetic coding sequence
atgcagaagggcctgaaggacaacttcgccgacgtgcaggtgagcgttgttgattgtcccgacttgaccaaggagccattcacgttcccagttaaggggatttgtggcaagacccgtatcgcagaagtggggggcgtgccgtacctgctgccactggttaaccagaaaaaagtatatgatttgaacaaaatagccaaggagattaaactgcctggggcctttatccttggcgctggtgctggtccttttcagaccttaggattcaactcagagttcatgcccgttatccagaccgaatctgagcacaagccaccagtgaacggctcttattttgcccacgttaacccagctgacggaggatgtctgctggaaaaatacagcgagaaatgccacgacttccagtgcgctctgctggcgaacctcttcgcgtctgagggccaaccaggtaaggtcattgaagtaaaggcaaaaaggagaaccggccccctgaatttcgttacttgcatgcgagaaacccttgagaagcactacggtaacaaacccattggaatggggggaacgtttattatacagaagggaaaggttaagagtcatatcatgcccgccgaattcagtagctgtccactgaattcagatgaagaagtgaacaagtggctacatttctatgagatgaaagccccgctggtttgtctgcctgtgtttgtgagccgggaccctggctttgacctgcgcctggagcatacgcacttcttctcccggcacggagagggaggccattaccactatgataccactccagacatagtcgaatacctgggctactttctccccgctgaatttctgtacagaatagaccaacctaaagaaacgcacagtatcggccgcgactag

SEQ ID NO: 18878 - DNA, 1221 bp, Artificial Sequence
  Description of Artificial Sequence: Synthetic coding sequence
atgacccagaccctggacacccgggaggaccccctgaacctgggcggtggcggcggcgggggatgtggctgcggttgggctcattcagctagcctgtctagctggagctcttgccataggaggcgccccggagcacctgcttataataggccccacaggtatagccctaaaactgagtatggccccccccggaaacaacctaaacagcagcacggccccggattttggttccagccacctgtgtgctctaactggggctgctgggggggaccatggaggccaccacctccaggattctggaaattcccctgtccagtgcaggtctttagagtctacgggttgcatcccctttgtttctgctgctgcagttgttggtcaggaagctggaatccagggtgggttaagccaccaggccgcaaaaagcgctggggccgaagggggcgaggtcttcgccaccatccaagacattcttaccctcgatctcctccagccgacgtaagtacattaccgaggcccgtcaagctgtatgaatggagggaacccggcatgcgagctccacccaataccacccagttcatcatgaaccaaatttatgaagacatgagacaacaagagaaggttgaaaggcagcaggaagccctgagagcccagaaggccacggtgtccggagaagcgtcgcccgcccgctcttcaggcaatgacgcacctcctggtggctccaaggagacatggggattacaggagacactctatggattcgtgcagaatcctagcctggctttcagccctaacccggaggaaaaccagtccctggccccgctgctggtggaagaggaggaggagaaaaagaatgacgatgaggaagaatacgaccaggaagtgtgcgacgcgaaagaggcttcggaagaagaagaggaagtcgaggatgaggaggaagaagttgaagacgaagaggaagaagaggtggaagaggccgagtatgtggaggagggcgaagaggaactagaggaagaggaattggaagaagaggaggaagtattagaggagaacgagcagaggggtgaagaatttcacctgccattagagatgcctttgtctatttttgtcgaggccgaggagaaacgcgaaaactttattagctgtactttcttgaaccccgagcagatcatcccaaaggtcccccaagaaagcctattcatggcccaggactttaactgttag

SEQ ID NO: 18879 - DNA, 195 bp, Artificial Sequence
  Description of Artificial Sequence: Synthetic coding sequence
atgcccccccggaagaagcggcggcagcccagccagaaggcccccttgcttttccatcagcagcctctcgaaggccccaagcactcctgtgcgagcacccagctgcccatcacccatacaagacaggtgccatccaagcccatcgatcactccactattacctcctgggtctccccagatttcgatacggcgtag

SEQ ID NO: 18880 - DNA, 717 bp, Artificial Sequence
  Description of Artificial Sequence: Synthetic coding sequence
atgcccccccggaagaagcggcggcagcccagccagaaggcccccttgctgttccatcagcaacctctcgaaggccccaaacatagctgcgcctctacgcaactgcctatcacgcacaccaggcaagtaccttccaagcctatagaccattcaacaattaccagctgggtatcccctgactttgataccgctgccggaagcttatttcctgcataccagaagcatcagaatagagccagacacagcagcagaaaaccaaccacaagtaagtttcctcaccttaccttcgagtctcctcaaagcagcagctcagagactttgggtattcctctgatccgggagtgcccctcggaatcagaaaaggacgtctctcggagaccgctcgtcccagtgctttcaccccagagttgtggcaatatgagtgtacaggcgctgcagtccttaccctacgtatttatccctccagacatccaaactcctgaatcaagctctgttaaagaggaattgataccacaggatcagaaggaaaattcactcctaagctgtactttgcacaccgggaccccaaacagtcctgagccagggcccgtgctggtgaaggacacccccgaggataagtacggcatcaaggtgacctggagacgacgacaacaccttctcgcatacctgagggaaaggggaaaactttctagatctcagtttctggtgaagtcttag

SEQ ID NO: 18881 - DNA, 399 bp, Artificial Sequence
  Description of Artificial Sequence: Synthetic coding sequence
atgcccccccggaagaagcggcggcagcccagccagaaggcccccctactcttccatcagcagcctctggaagggcccaaacacagctgcgccagcacacagcttccaataacccacacaagacaggtaccctccaaacccatcgaccacagcaccattacctcttgggtttccccggatttcgacacagccgcgggcagcttatttcctgcctatcaaaagcaccagaatagagcgagacattccagtcggaaaccgacaacctccaaatttcctcacctgacgtttgagtcaccacagtcaagctccagcgagactttaggtattcctcttatccgtgagtgtccctcagagagcgagaaagacgtgtcaagacgtcccctcgtgcccgtgctttag

SEQ ID NO: 18882 - DNA, 318 bp, Artificial Sequence
  Description of Artificial Sequence: Synthetic coding sequence
atgcccccccggaagaagcggcggcagcccagccagaaggcccccctccttttccaccagcagcctttggaggggccaaagcacagttgtgccagtacacagctccctattacacatacccgccaggtgccctctaagcctatcgatcactcaactatcacgtcttgggtgagccccgatttcgataccgcagcggggagtctgttccctgcgtatcagaagcatcagaaccgagctcgtcactcttctagaaagccaacgacaagtaaatttccacacctcacctttgaatcgccccagagcagcagtagcgagtag

SEQ ID NO: 18883 - DNA, 3138 bp, Artificial Sequence
  Description of Artificial Sequence: Synthetic coding sequence
atgaacctgcaggcccagcccaaggcccagaacaagcggaagcggtgcttgtttggcggccaggagccagctcccaaggagcaaccccccccattacagccaccccagcagagcatccgcgtcaaggaggagcagtatctcggccatgaaggacctggaggtgcggtgagcacgtcccagcccgtagagttgccaccaccatcttcgctggctctactaaactctgtcgtgtatggaccagagcggacatctgccgctatgctctcacagcaagttgctagtgtgaaatggccaaatagcgtgatggcaccaggcagagggccggagaggggcgggggcggcggcgtcagtgacagctcctggcaacagcaacccggccaacctccccctcactctacttggaactgtcactcactgagcctttactcagccaccaaaggctctcctcatcccggagttggagtgcccacatactacaatcatccggaggccctcaaaagggagaaggccggcggaccacagcttgataggtatgtacggcccatgatgccgcagaaagtccaattggaggtgggtcgtccacaggccccactgaactctttccatgccgcaaagaagcctcctaaccagtcgctgcctctgcagccttttcagctcgccttcgggcaccaggtgaaccgacaggtgtttcgccaggggccccctccccctaaccctgtggcggccttcccaccccagaaacaacagcagcagcagcagccccagcagcagcagcagcaacagcaggcggccttgccccagatgcctctgttcgaaaatttctactccatgccacagcaaccgtctcagcaacctcaggacttcggacttcagcctgccggtcctctcggacaaagccacctggctcaccactcaatggcgccctaccccttcccacctaaccctgatatgaaccctgagcttcgcaaggcgctcctgcaggattcagcccctcagcctgcccttccccaggttcaaattcccttcccgcgtcgttctcgccgtctctccaaggaaggtatcctgccaccttccgcactggacggagcaggaacccagccaggtcaagaagcaaccggcaacttgtttttgcatcattggccgctgcaacagcctcccccgggctccctggggcagccccaccctgaggctttaggattcccacttgagctcagggaaagtcagctgcttcctgatggagaacgccttgctcccaacggccgtgagcgggaggcacccgccatgggcagcgaggagggtatgcgcgctgtctcaacgggtgattgcggtcaggtgctgaggggcggggtgattcaatctactcgaaggaggaggagagcctcccaggaagccaacctattaacactcgcacagaaggccgtcgagctggcctctctacagaacgctaaagacggtagtggatcagaagagaaacgtaaatccgtgcttgcttcgacaacgaaatgtggtgtggaattttccgagccctcacttgctaccaagagggcaagagaagactctggaatggtcccactcattatccctgtgtccgtgccagtgagaaccgtagatcctacggaggcagctcaggccggtggtctagatgaagacggcaaaggacccgaacagaatccggctgagcacaagccctccgttattgtgaccagaagacggtccacccggattcctgggactgatgcccaggcccaggccgaggatatgaacgtgaagctcgaaggagagccaagcgttcgcaaacctaagcagcgaccccggccagaacccctgataatacctacaaaagccggtacattcatagccccccccgtttattcaaacattactccttatcagtcccatctgaggagccccgtgcgactagccgaccacccgtctgaaagaagtttcgaacttcccccctatactccgccaccaattttatcccccgtgcgcgagggatccggactatactttaacgctatcatttctacgagtactatcccagcacctccccccataacacccaagagtgcccaccggactctgctgcgcacgaattccgccgaggtgactccccccgtgctttccgtgatgggcgaggctacacccgtctctatcgaacctaggatcaacgtggggtccaggtttcaggctgaaatcccactgatgagagaccgagccctcgctgccgcagatccccataaagctgatttggtctggcaaccatgggaggatctggaaagttctagagaaaaacaaaggcaggtggaggatctactgaccgctgcttgttcctcaattttcccaggcgctggtaccaaccaggagttggcacttcattgcctgcatgagagcaggggtgatatcttagagacactcaataagcttttactgaaaaaacctctgagaccccataaccaccccctggccacctaccactacactggatcagaccagtggaaaatggcagaacgcaagctgttcaacaaaggaatcgctatctataaaaaagatttctttctcgttcagaagctgatccagacaaaaactgtcgcccagtgtgtagaattctattacacttataagaaacaggtgaaaattggcaggaatgggacgctcactttcggagacgtcgacactagcgatgagaagagtgcgcaggaggaggtcgaggttgatatcaagactagtcaaaagtttcctagagttccccttcccaggagagagagtccctcagaggagcgactggaacctaagcgagaggtcaaggagccgcggaaggaaggagaagaggaggtgcccgagatccaagagaaggaggaacaggaagaggggcgggaaagatccaggagggcggccgccgtgaaagccacccaaacactccaggccaacgaaagtgcttccgatatccttatccttcgctcccatgaatcaaacgcccctgggtccgccggcggccaggcctccgagaaaccaagagaaggtaccggaaagtctcggcgggccctccccttctcagagaagaaaaagaaaacagaaacatttagtaagacccaaaaccaagagaacactttcccctgcaagaagtgtggaagatag

SEQ ID NO: 18884 - DNA, 3138 bp, Artificial Sequence
  Description of Artificial Sequence: Synthetic coding sequence
atgaacctgcaggcccagcccaaggcccagaacaagcggaagcggtgtttgttcggcggacaagagccagcgcctaaggaacagccccctcccctgcagcctccccagcagagcatccgagtcaaggaggaacaatatctgggtcacgagggcccaggaggggctgtgagcacaagccaacctgtcgaactgccccctccatcatctcttgcactgcttaatagcgtggtttacgggcccgaaaggaccagcgcagccatgctttcacagcaggtcgcatctgtaaaatggccaaattcagtgatggcccccggcagaggaccagagcgtggtggaggcggcggtgtctcagactcctcatggcagcagcaaccaggacaaccaccaccacacagcacgtggaactgccactctctgagcttgtattccgctaccaagggtagtccccacccaggcgtaggagtgcccacatattacaaccatcctgaggccctcaagagggagaaggccggagggcctcagctggacagatacgtgagacccatgatgccccagaaggtgcagctggaggtgggtaggcctcaggcgccactgaacagcttccatgctgcaaagaaaccaccgaatcagtctctccctctgcagccctttcaactcgctttcggccaccaggtgaaccggcaagtgtttcggcagggtcctccccctccaaacccagtggccgcctttcctccacagaaacagcagcaacagcaacagccacagcaacagcagcagcagcagcaggccgcacttccacaaatgcccctgttcgagaacttctactcaatgccccagcagcccagtcagcagccacaggacttcggtctccagcctgctgggcctttaggccaaagccatctcgcccatcacagcatggctccctacccgtttcccccaaacccagacatgaaccccgaacttcgcaaggctctccttcaggattcagccccacaacctgccctgcctcaggttcagatcccttttccgaggcgtagtcggcgactcagcaaggaaggaattctgccaccgtcagcactggacggggctggaacacagccggggcaggaggctaccggaaatctatttctgcatcattggccactgcaacagcccccacccggttccctgggccagcctcacccagaggccttagggttcccactcgagcttcgcgagtcccagctgctgccagacggggagcggctagcgcccaatgggagagagagagaagccccagctatgggttccgaggaggggatgagagccgtttcaacaggcgattgcggccaggtgctcaggggcggagtcatacaaagcactaggcgccgcagaagggcctcacaggaagcgaatcttttgacactagcgcagaaggccgtggaacttgctagcttacagaatgccaaggacgggtccgggagcgaggaaaagagaaagagtgtgctggcttcaaccaccaaatgcggtgtggaattcagcgagccgtcacttgccactaagcgcgctcgggaggatagcggcatggttcctctcatcattcctgtgagtgtcccagtccggactgtggatcctactgaggcagctcaggctggcggacttgacgaagacggcaaggggcctgaacagaatccagccgaacataaaccctcagtgatcgttacgcgccggagatccacaagaattccagggaccgatgcccaggcccaagccgaggatatgaatgtgaaactcgaaggcgagcctagcgtgcggaagccgaagcagagaccacggccggagcccttgatcatacccactaaggcgggaacgttcattgccccaccggtgtactctaatatcacaccgtaccagtcacatttgcggtcgcctgtgcggctggctgaccatccttctgagcgttcttttgagctgccaccttatacacccccacccattttatccccagtcagggaaggaagcgggctctactttaatgctataatctcaacgtctaccattcctgctccacctccaattactcccaagtctgctcacagaacactcctgagaacaaatagcgcggaggtgactccccctgtgctgtccgttatgggagaggcaacaccagttagtatagaaccgagaattaacgtgggatccaggtttcaggccgaaatccctttaatgcgggatcgtgcactggccgcggccgatcctcacaaagccgatcttgtttggcagccctgggaggacctggaatcaagcagagaaaagcaacggcaggttgaggacctgcttaccgctgcctgctccagtatcttcccaggcgccggaaccaaccaggaattagcgctacactgcctccatgagagtcgaggagatatcttggagacattgaacaagctgcttctgaagaaacctctgcgtcctcataatcacccactggccacataccactacaccgggagtgatcagtggaagatggctgaaagaaagctttttaataagggaatcgccatctataagaaagatttcttccttgtgcagaagttgatccagactaagactgtggcccagtgtgtggaattctattatacgtacaaaaaacaggtcaagatcggccgaaacggcacactgacatttggagatgtggatacgagcgatgagaaaagcgctcaggaagaggtggaagtcgacatcaaaaccagccaaaaattccctcgggtacctttacctagacgggaatcaccatcagaagaaaggctggagcctaagagggaggtgaaagagcccagaaaagagggagaagaggaggtgcccgagatccaagaaaaagaagaacaagaagaaggccgggaacggtcccgccgtgctgcggctgtgaaggctacgcagaccctgcaggctaacgaatctgcatcggatatactgattttgaggagccacgagtcgaacgccccgggtagcgctggtggacaagcatccgaaaagcccagggagggcaccggcaagtctagaagggcacttcccttttccgaaaagaaaaaaaaaaccgagaccttctccaaaactcagaaccaggaaaatactttcccctgcaaaaaatgcgggcgatag

SEQ ID NO: 18885 - DNA, 201 bp, Artificial Sequence
  Description of Artificial Sequence: Synthetic coding sequence
atgaacctgcaggcccagcccaaggcccagaacaagcggaagcggtgcctcttcggagggcaagagcccgcgcctaaggagcagccccccccactccagcctccacagcaatcgatccgggtgaaggaagagcagtacctgggccacgaagggccgggtggggccgtcagtacatctcagcccgtagagctgcccccatag

SEQ ID NO: 18886 - DNA, 3138 bp, Artificial Sequence
  Description of Artificial Sequence: Synthetic coding sequence
atgaacctgcaggcccagcccaaggcccagaacaagcggaagcggtgcctgttcgggggtcaggaaccagctccaaaggaacaaccacctccccttcagccacctcagcaaagtattagagtgaaggaggagcagtacctcgggcacgagggacccggaggggccgtgtccacttcacagcctgtcgagcttccaccaccgagctctctcgcccttttgaatagcgtagtgtacgggccagaacgtacaagcgcagccatgctgtcccagcaggtggctagcgttaaatggcctaacagcgtcatggcgccagggaggggacctgaaagaggcggcggcggtggtgtgtccgactcaagctggcagcagcagcctggacaacccccgccacactccacatggaactgccactcactgagcctgtactccgccaccaaggggtcgcctcatcccggggttggagtccctacatactacaaccacccagaagccctcaagagggaaaaggcgggtggcccgcagttggataggtacgtcaggccaatgatgccgcagaaagtacagctggaggtgggccgtccacaggcaccactaaacagctttcacgccgcaaagaagccacctaatcaatccttgccgctgcagcctttccagcttgcatttgggcaccaggtgaatagacaggtgtttcgtcaaggaccccctccgcccaacccagttgcagcctttccaccacagaagcaacaacagcaacaacagccacagcagcagcagcagcagcagcaggccgcgctcccacagatgcccctgttcgaaaacttctactctatgccgcagcagcccagtcagcaaccacaagactttggccttcagccagccggaccacttggacagtcgcatctcgcccaccattctatggctccatacccatttccaccaaatcctgatatgaaccctgaactgcgaaaggccttgctccaggattcagccccccagccagcattaccacaggtacagattcctttcccccggcggtccaggagattgagcaaggagggcatcttaccacctagcgcactggatggggctgggactcagccaggacaggaggccacgggcaatttgtttctacaccactggccattgcagcagcccccccctggctctcttgggcagccacaccccgaggccctgggttttcccttagagctgcgcgagagtcagttattacccgatggcgaacggttggccccgaacggaagagagcgggaggcgcctgcaatgggctcagaggaaggaatgagagccgtttccacgggagattgcggtcaggttttgcggggcggggtgatccaatccacccggcgtaggagacgagcctctcaagaggcaaatcttttgacactcgcacagaaggccgtcgaactggcctccctacagaacgccaaggatggatcaggtagcgaagaaaaacgcaaaagcgtgttagccagcactactaaatgcggggtggagttttccgagcccagcctcgcaacaaaacgcgccagggaggacagcggcatggtgcctcttatcattcctgtatctgttccagttcggaccgttgacccaacagaggcggcccaagccggaggcctggatgaggacggcaagggccccgagcagaatcctgctgaacacaagccatctgtcattgtgactaggcgtaggtccactcgcattccaggcaccgacgctcaagctcaggctgaggacatgaatgtgaaactagaaggtgaaccctccgtgcgcaaaccgaagcagaggcctcggcccgaacccttgataatccccacaaaggccggaacctttatagcacctccagtctacagcaacattacaccataccagtcacatttgagatcacctgtgcgccttgccgatcacccatctgaacggagtttcgaactgcccccttacacacccccccctatcctttcccccgtcagagaaggctcagggctctactttaatgcgattatttctactagtacgatcccagcaccccctccaataacacctaagtccgctcatcgcaccctgctccggactaactccgccgaagtgaccccacccgttctgtctgtgatgggggaggcaactcccgttagtatcgagcctagaattaacgtgggcagccggttccaggccgagatccccttaatgagagatagggctctcgctgccgctgacccacacaaggctgatttggtgtggcagccctgggaggatcttgaaagtagcagagagaaacagcgtcaggtggaggacttgcttacggctgcctgcagttccattttcccaggtgccggtacaaaccaggaactggcattacattgcttgcacgagtcaagaggtgatatcctcgagactctcaacaagcttctgttgaagaaacccctgcggccccacaatcatccgctggcaacttatcattacactggttcagatcagtggaagatggcagaacggaagctcttcaataaagggattgcaatctacaaaaaagacttttttctggtgcagaagctgatacaaaccaaaacggtggcccagtgcgtggagttttactatacctataaaaagcaagtgaaaattggccgcaacggaacacttacttttggtgatgtggacactagcgatgaaaagtctgcacaagaagaggtagaggtggatatcaagacttcgcaaaagttcccacgagtcccattgccaaggcgggaaagcccctctgaggaaaggctggaacccaaaagggaagtgaaggagccacgcaaggagggcgaggaggaagtcccagagattcaggaaaaagaggaacaggaagaaggaagagaacgcagtaggagagccgccgctgtgaaggctacgcagacgctccaggccaacgaaagcgcatccgatatactgatcctgcgtagtcacgaaagcaatgctcccgggtctgccggaggccaggctagcgagaagcctcgtgaagggaccggcaagtctcgtcgggcactgcctttctctgagaaaaagaaaaagacagagaccttctccaagacccagaaccaagagaatacgtttccatgcaaaaagtgtggccgttag

SEQ ID NO: 18887 - DNA, 3060 bp, Artificial Sequence
  Description of Artificial Sequence: Synthetic coding sequence
atgaacctgcaggcccagcccaaggcccagaacaagcggaagcggtgcctatttgggggtcaagagccagccccaaaggagcaacctccccctctccagccacctcagcaaagcatcagggtgaaagaggagcagtacctgggccacgagggccccgggggagcagtgtcaacctctcagcctgtggagctgcccccgccctcttcactagctctattgaactccgtcgtgtatgggcccgaacgtacgagcgcagccatgctgtctcaacaggtggcgagcgtcaagtggccaaacagtgtgatggcccccggtaggggaccagagcgtggagggggtggcggagtatcagactccagctggcagcagcagccagggcagccccctcctcattctacttggaactgtcacagtctctccttatacagtgccaccaagggctcgccacaccccggcgttggcgtgcccacatactataaccatccagaagctctcaaacgagaaaaagcggggggccctcagctggacagatacgtccgccccatgatgcctcaaaaagttcagctggaggtcggccgccctcaggctcccctcaacagctttcatgccgctaagaagcctccaaaccaatcactgcctctgcagcccttccaactcgcattcgggcatcaggtgaaccgccaggttttccgacaaggtcctccccctccaaatcccgtggccgcctttccacctcaaaagcaacagcaacagcagcagccccaacagcagcagcagcagcagcaagccgccctgcctcagatgcctctttttgagaatttctatagcatgccccagcaaccttcccagcagccccaggacttcggacttcaacctgcggggccgctgggtcagagccacctcgcccaccatagtatggccccctacccgttcccccctaacccggatatgaatcctgagttgaggaaggctcttttgcaggacagtgccccccagcccgcactgccccaagtccagattcccttccccagaagaagccggcgcctttccaaggagggaattctccctccatccgccctggacggagctgggactcaaccaggccaggaggccacaggcaatctattcttacatcactggcccctgcagcagcccccgcctggctccctgggtcaaccacacccagaggctctagggtttcccctggaacttcgggagagtcagttacttcctgacggcgagcgcctggcccccaatgggcgcgagcgtgaggcccccgctatgggttctgaagagggaatgagggccgtgagcaccggtgattgcggacaggtcttacgtggcggcgtaatacagtccactaggcgtcggcggcgggcctctcaggaagccaatctgcttaccttggcacagaaggccgtggaactagccagcctgcagaacgcaaaagacgggtctggaagtgaggagaaacgcaagtccgtattagcttccaccactaaatgcggtgtagagttctccgaaccgtctttggctacaaagagagcgcgggaggatagtggcatggtaccactgataatcccagtgtccgtcccagtgcggaccgttgacccaaccgaggctgcacaggcagggggacttgatgaggatgggaagggcccagagcagaacccagccgaacacaaaccctccgtgatagtaacgcgtcgacgcagcaccaggatcccaggcactgatgcccaggctcaggctgaggatatgaatgttaagttggagggggagcccagtgtgcgtaagccgaagcagcgccctcggcctgagccgctcataatccctaccaaggcaggaacctttatcgccccccccgtttacagtaatataacaccataccaatcccaccttaggtctccagtgcgtcttgcagatcacccgagtgagcgatccttcgaacttcctccttacactccgccccctatcctctcaccagttcgggaaggtagcggactctacttcaacgccatcatttcaacttctacgattccggcacccccccctatcactcctaaatctgcccatagaaccctcctgaggaccaattctgcagaggtgacaccacctgtgctatccgtaatgggcgaagccaccccagtatccattgagccgcgtattaacgtggggagccgattccaggctgagataccactgatgagggatcgggccctggcagcagcagaccctcacaaagctgatctcgtatggcagccctgggaggacttggagtcgagccgcgaaaaacagaggcaggtggaggacttacttacagccgcctgttcctctatctttccgggcgctgggactaaccaggaactggccctccactgcctccacgaaagtaggggagacattcttgaaacactgaacaagctgttgctgaaaaagcccttacggccacacaaccaccctcttgctacctaccactacacagggagtgaccagtggaagatggcagaaagaaagttgttcaataaaggaatagcaatttacaaaaaagacttctttctggtccagaaattaatccagacgaaaaccgtcgcccagtgcgtcgagttctattatacctacaagaagcaggttaaaatcggaaggaacggaacgttaacttttggcgacgtggatactagcgatgaaaagtctgcccaggaggaggtggaagtggatattaaaacttcgcaaaaattccccagagtccccctgcctcggcgcgagtcaccctcagaggaaagactggagcccaagcgcgaggtcaaagagccaaggaaggagggagaggaagaggtacccgaaatccaggagaaggaagaacaggaagaggggcgcgaacgtagccgtcgtgctgctgctgtcaaggccacccagaccctccaagctaacgagagcgcatcagacatcctcattctgagatcccatgagtccaacgcaccgggaagcgctgggggccaggcatcagaaaaaccacgggaaggcacggggaagtcacggagagccctcccattttcttag

SEQ ID NO: 18888 - DNA, 951 bp, Artificial Sequence
  Description of Artificial Sequence: Synthetic coding sequence
atggccgcccccgaggccccccccctggaccgggtgttccggaccacgtggcttagtacagagtgtgactctcaccctttaccaccttcatacagaaaatttctgttcgaaacacaagcagccgacctggcagggggaactacagtggccgcaggaaacctgttgaacgaatccgaaaaggactgcggccaagaccgccgtgcccctggtgtacaaccttgccgtctggtcactatgacatctgtggtgaaaaccgtctactcgctgcaacccccaagcgccttatctgggggccagcctgctgacactcagacgcgcgccacatcaaaaagcctgctccctgttcgaagtaaagaagttgatgtgagcaagcagctgcactcaggtggtcccgagaatgacgtgactaaaataaccaagttaaggagggaaaatggacagatgaaggctacagacaccgccactaggcgcaacgtcaggaagggctataagccactctcaaagcagaagtccgaagaggagctgaaggataaaaatcagttgctagaggcagttaataagcagctccaccaaaagctcactgaaactcagggcgagctcaaggacttaacccagaaggtggagctcttggagaaattcagggataactgtctggctatcctcgagtcaaagggactggatcctgccctgggatctgagacccttgcaagcaggcaagaaagcactactgaccacatggactctatgctgttgctcgagacactacaggaagaactgaagttgtttaacgagacagccaaaaagcaaatggaggagttgcaggcacttaaagtgaaactcgagatgaaggaggagagagtcaggttcctggagcaacagacactctgtaacaatcaggtcaatgacctcaccaccgccctaaaggagatggaacagttattggaaatgtag

SEQ ID NO: 18889 - DNA, 861 bp, Artificial Sequence
  Description of Artificial Sequence: Synthetic coding sequence
atggccgcccccgaggccccccccctggaccgggtgttccggaccacctggctgtcaactgagtgtgattctcatcccctaccaccctcatatagaaaattcttattcgaaacacaggcagccgacctggccggagggaccacagtagctgccggaaacttgctcaatgagagtgaaaaagactgtgggcaagacagacgagcacctggcgtccagccttgccgactggtcacaatgaccagcgtcgttaagaccgtatatagtctacagccgccttctgccctgtcaggcggccagcccgccgatacccagactcgggctacgtccaaatcacttctgccggtgagaagcaaggaggtggacgtctcaaagcaactgcactccggcggccccgaaaatgacgttaccaaaattactaagctcagaagggagaatggacagatgaaagcaacggacacagcaacacgccgcaatgtgcggaaaggctataaacctctgtccaaacaaaagtccgaggaagaactgaaggacaaaaaccaactgctggaggctgttaacaagcagctccaccagaagcttaccgagacccagggagagctcaaggatttgacacaaaaagtcgagttgctcgaaaagttcagagacaactgtctggctattcttgaatccaaaggactggatccagccctcggatctgagactctagcctctaggcaagaaagtacaactgaccatatggactcaatgctacttctcgagacgttacaggaagaactaaaactgttcaatgagactgccaagaagcagatggaagagctgcaaatcgcctggatgaaccacggtattttgcaccagatgtag

SEQ ID NO: 18890 - DNA, 726 bp, Artificial Sequence
  Description of Artificial Sequence: Synthetic coding sequence
atggccgcccccgaggccccccccctggaccgggtgttccggaccacttggctgagcactgaatgcgacagccacccgctgcctccaagctacaggaagtttctattcgagacacaagcagccgacctggcgggaggaacaacagtggccgccggaaacttgctgaacgagtccgagaaagactgcgggcaggacaggagagctcccggagtccagccttgcaggttagttacaatgactagtgttgtgaaaaccgtctacagccttcagcctccctccgccttgagtggcgggcagcctgcggatacccagacccgagctacctccaagagcctcctgccagtccggagcaaagaagttgacgtctcaaagcagttacactccggtggaccagaaaacgacgtcactaagataacaaaactgcggagggaaaacggccagatgaaagcgactgatactgcaactagaagaaacgtgcgaaaagggtacaagccactctccaaacagaaaagtgaggaagaacttaaagacaaaaaccagctcctggaggccgtgaataagcaactacatcagaaattgacagagacacaaggggaactaaaagatctaactcagaaagtggaacttcttgaaaaattcagagataattgtttggccattctcgaaagcaagggactggacccagttgcagtccgaaactttgcccgaggcgctgaagccttttag

SEQ ID NO: 18891 - DNA, 915 bp, Artificial Sequence
  Description of Artificial Sequence: Synthetic coding sequence
atggccagcgagacccacaacgtgaagaagcggaacttctgcaacaagattgaggaccactttatagatctgcctaggaaaaagatctcaaacttcaccaataaaaatatgaaggaggtgaagaagtcgccgaagcagctggctgcctacatcaaccggacagtggggcagacagtcaaatccccagacaagttgcgcaaggtcatctaccgacgaaaaaaagtccatcatcccttccccaacccgtgctatagaaagaagcagtcccctggctcaggcggatgcgatatggccaacaaagaaaatgagttggcttgtgccggacacctgccggagaagctgcaccatgattcccgaacatacctcgtgaactcttccgactctggtagtagccagactgagtcaccatctagtaagtacagcgggtttttttcagaggtcagtcaggaccacgagaccatggctcaagtcctgttctcccgcaacatgcgcctgaacgtggcactgacattctggaggaagagaagcatttccgagctggtggcgtatttattgcggatcgaggatctgggggttgtcgtcgactgcttacctgtcttaaccaactgtctgcaggaagagaagcagtacatctctttaggttgctgtgtggatctgctcccgttggtcaagtctctgcttaaatccaaattcgaggaatatgtaatcgtgggccttaattggctgcaggctgtcattaaaaggtggtggtcggagctctcaagtaagaccgaaataataaacgatggcaatattcaaattcttaaacaacaactcagcggactctgggagcaggagaaccatctgacgctggtgcctggctacacaggcaatatcgccaaggatgtggacgcttacctgttgcagttacactag

SEQ ID NO: 18892 - DNA, 537 bp, Artificial Sequence
  Description of Artificial Sequence: Synthetic coding sequence
atggccagcgagacccacaacgtgaagaagcggaacttctgcaacaagatcgaggaccattttatcgacctgccaaggaaaaagatttcaaactttacaaataaaaatatgaaagaggtgaagaagagccccaagcagctggctgcctatatcaatcgaaccgtgggtcagacagtgaaaagcccagacaagctgcgcaaagtcatttatcgacgtaagaaagtccatcacccctttccaaacccttgttaccggaaaaaacaaagtcccgggtctggcgggtgtgacatggccaacaaggagaacgaactcgcatgtgcaggccacttacctgagaagctccaccatgattcacgtacctacctcgtgaattcgtcagacagcggtagctcacaaaccgaaagccctagctcaaagtattcaggctttttcagtgaagtgtctcaggatcacgagacaatggcccaggtcctgtttagcagaaatatgagactcaacgttgcccttaccttctggcggaagcgatctatctcgtag

SEQ ID NO: 18893 - DNA, 120 bp, Artificial Sequence
  Description of Artificial Sequence: Synthetic coding sequence
atggccagcgagacccacaacgtgaagaagcggaacttctgcaacaaaattgaggaccatttcatcgacctcccccggaagaaaatatctaattttactaataaaaacatgaaagagtag

SEQ ID NO: 18894 - DNA, 225 bp, Artificial Sequence
  Description of Artificial Sequence: Synthetic coding sequence
atggccagcgagacccacaacgtgaagaagcggaacttctgcaacaagatcgaggaccattttatagacctccccaggaagaaaatctctaacttcaccaacaaaaacatgaaggaggtgaaaaaatccccaaagcagctggcagcttacataaaccggaccgtgggccagaccgtcaagtcgccagataagctcagaaaagtcatttaccggaggaagaaatag

SEQ ID NO: 18895 - DNA, 534 bp, Artificial Sequence
  Description of Artificial Sequence: Synthetic coding sequence
atggccagcgagacccacaacgtgaagaagcggaacttctgcaacaagatagaggaccatttcattgatctgccccggaagaaaatcagtaattttaccaataagaatatgaaagaggttaagaagtctcctaagcaactggcggcatatattaatcgaactgtgggccagacggtgaaatcccccgataaacttaggaaagtcatataccggcggaaaaaggtgcaccacccctttcccaacccgtgctatcgaaagaaacagagccctggatcgggcggttgcgatatggccaataaggagaatgaacttgcttgcgcggggcacctgcctgaaaagctgcaccatgacagccggacctatttggttaactccagcgacagcggctcctctcagaccgagtctccctcaagcaaatacagcggctttttctcggaagtctcacaggatcacgaaaccatggctcaggtcctgttctcccggaacatgcgtttgaatgtggctctgacgttctggcggaagcggagtatatag

SEQ ID NO: 18896 - DNA, 1887 bp, Artificial Sequence
  Description of Artificial Sequence: Synthetic coding sequence
atgctgctggcccggatgaacccccaggtgcagcccgagaacaacggtgcggatactggacccgagcagccactcagagcacgaaagaccgcagaattgcttgtcgtgaaagaacggaatggcgtgcagtgcctattggcccctagggacggggatgcgcagcctcgcgaaacctgggggaagaagatagacttcctcttatccgtagtcggcttcgctgttgacttagctaacgtctggagatttccatacctttgttacaaaaacggcggaggcgcctttctgataccttacacactgttcctgataattgccggaatgcccctgttttatatggagctcgccctggggcagtacaatcgcgagggggcggcgacagtctggaagatctgtcctttcttcaagggggttgggtacgccgtcatcctcattgctttgtacgtcggtttctattacaacgtgataattgcatggtcactctactatctgttcagtagctttacattgaacctgccttggacagactgtgggcacacgtggaactctcctaactgtactgatccaaagctacttaacgggtccgtgctgggcaatcacactaaatactctaaatacaagtttacccctgccgccgaattctatgaacgcggcgtactccacctgcacgagagctccgggattcacgacattggactgccccagtggcagctcctgctgtgcctcatggtggtcgtcatcgtgctttacttcagtttgtggaagggggttaagacgagcggcaaggtcgtgtggatcaccgccacgctcccttacttcgttctctttgtgcttctggtacatggagtgacattgcccggggcgtctaatggcatcaatgcttatctacatattgacttttaccggttaaaggaggccactgtctggatcgacgctgctacgcagattttcttttccctgggcgctggattcggcgtgctgattgccttcgccagttataataagtttgataacaactgctatcgcgatgccctgctgacctcaagtattaactgtatcacgtctttcgtgagcggctttgcaatcttttccattttggggtacatggctcacgagcataaggttaatatagaggatgtcgccacggagggggccgggttagtgtttatactgtaccccgaggcgatatccactttgagtggcagcacattctgggccgtggtgttctttgtcatgttgcttgcacttgggcttgactcttccatgggcggtatggaagccgttattaccgggctcgcggatgacttccaagtcttaaaacgtcatcgtaagctgtttacattcggggttactttttcaacattcctgctggcattgttctgtatcaccaaggggggcatttacgtcttgactctccttgacacttttgccgccggcacaagcattctcttcgctgttttgatggaagctataggcgtctcttggttttatggggtggatcgcttcagtaatgacatacagcagatgatgggctttaggccaggcctctattggagactatgttggaaattcgtgtcaccagccttcctccttttcgtagtagttgtgtctatcatcaactttaaaccccttacatacgatgactatatcttccccccatgggcaaactgggttggatgggggatagctctgagctccatggtattggtcccaatttatgtaatctataagttcctgtcaacacaaggctcactgtgggaacggctggcctatggcatcacaccagaaaatgagcaccacctggttgcccagcgcgacataaggcagttccagatgaaaacccgccagggaagacgacgggcaacaaacagttgccagatcagttgctag

SEQ ID NO: 18897 - DNA, 519 bp, Artificial Sequence
  Description of Artificial Sequence: Synthetic coding sequence
atgaccagcgccagcaccaaggtgggcgagatcttcagcgccgccggcgccgccttcaccaagcttggcgaactgaccatgcagctgcaccccgtggcagattcatcccctgcaggagccaaatggactgagaccgaaatagaaatgctcagagcagcagtcaagcgctttggtgacgacttgaaccatatttcgtgcgtaatcaaggagaggactgtggctcagatcaaagccacagtgaaaagaaaggtctatgaggactctggcattcccctgcctgccgaaagtccaaaaaaggggccaaagaaagtcgcaagtggggtcctttcgcccccccccgcagctccaccacccagctcctcgagcgtgcccgaagctggcggcccaccaatcaaaaaacaaaaagccgacgtaaccctaagcgcactgaacgacagcgatgctaatagtgatgtcgtggatattgaaggtctaggagagacccctccagccaagaagctcaactttgatcaggcttag

SEQ ID NO: 18898 - DNA, 417 bp, Artificial Sequence
  Description of Artificial Sequence: Synthetic coding sequence
atgaccagcgccagcaccaaggtgggcgagatcttcagcgccgccggagctgctttcaccaagctgggcgagttaacaatgcagcttcaccccgtggcagacagttcaccagctggcgcacagataaaggccacagtgaagcgaaaagtgtacgaggatagtggtattccacttcctgccgagtccccaaagaagggacccaagaaggtggcatctggcgtcttgtcacctcctccagccgctccccccccaagctcttccagcgtaccagaggcaggaggtccgccgattaaaaagcagaaggcagacgtgactctcagcgcccttaatgattccgatgcaaacagcgacgttgtcgatatagaaggtctaggggagactccccccgcaaagaaactgaacttcgatcaggcgtag

SEQ ID NO: 18899 - DNA, 555 bp, Artificial Sequence
  Description of Artificial Sequence: Synthetic coding sequence
atggacctgcaggccgccggcgcccaggcccagggcgccgccgagccgagcagaggaccccccctgccctcagccagaggcgcccccccctctccagaagccgggtttgccaccgcggatcacagctcgcaggagcgcgagacagagaaagccatggaccgcctggctcggggtacacagtccatccccaacgattccccagccagaggcgagggaacccattccgaggaagaggggtttgctatggacgaggaggattcggatggggaactcaacacatgggaactttcagaggggactaattgcccccctaaggagcagcccggtgacctgttcaacgaggactgggacagtgagctgaaggccgaccaaggaaacccatacgatgcggatgatatccaggagagtatttcccaggagctgaagccttgggtctgctgtgccccacagggagatatgatctacgacccatcttggcaccacccccctccgcttattccgtactactccaaaatggtcttcgagacggggcaatttgatgatgcagaggattag

SEQ ID NO: 18900 - DNA, 519 bp, Artificial Sequence
  Description of Artificial Sequence: Synthetic coding sequence
atgggcggcgacgccggcgaccgggagcccggccccgccgcccggtccttgggcgaggggcaggcgggatttgcaactgcagaccattcatcacaagaacgggaaaccgaaaaagctatggacaggctagcgagagggacccagtctatccccaacgatagtcctgctcggggcgaggggacacacagtgaggaagaggggttcgctatggatgaagaggactccgacggagagctgaatacgtgggaactgtccgaaggcactaactgtccacctaaggagcagcctggggacttgttcaacgaggactgggacagcgagcttaaggcagaccagggaaacccctatgacgccgacgacatacaagagtcaattagccaagagctgaagccatgggtatgttgcgcaccccagggcgacatgatttatgaccccagctggcaccacccacctcccctgattccttattatagcaaaatggttttcgagaccggacagttcgacgatgcggaggactag

SEQ ID NO: 18901 - DNA, 1956 bp, Artificial Sequence
  Description of Artificial Sequence: Synthetic coding sequence
atgggccccgccagccccgccgcccggggcctgagccggcggcccggtcaaccgcccctgcctttgttactgcccctgctgcttttgctgttacgtgctcaacctgccatcgggagcttagccggaggatcccctggcgcagctgaagctccaggctcagcccaggtcgccggactttgtggaaggctgacactgcaccgcgacttgagaactggacggtgggagcccgaccctcagagatctcgccgctgcctccgtgacccacaaagggtgcttgagtactgtcgccaaatgtatccagaactccaaatagcaagagtggagcaggctactcaggcaatacccatggaaagatggtgcggcgggagtcgttcaggatcctgcgcccaccctcatcaccaggtcgtgcccttccggtgtttaccaggagaatttgtctctgaggccttattggttcccgaggggtgtcgcttccttcaccaagagcggatggatcagtgcgagagctccacaagaagacaccaggaagctcaagaggcctgttctagccaggggcttattctccatggcagcgggatgctattaccatgcggctccgaccggtttaggggggtcgagtatgtctgctgcccaccacccggtactcctgatccaagcggcaccgccgtgggggatccttctactaggtcctggccgccaggctccagagtggaaggcgccgaggatgaagaagaggaagaatccttcccacaacctgtggatgactactttgttgaacccccccaagcagaggaggaggaagagacggtgccccccccctcttcacacactttggcggtcgtgggcaaggtgacacctactcctaggccaacagatggtgtagatatatactttggaatgccaggtgaaatatcagagcatgaaggctttctcagagctaaaatggacctggaagagcggaggatgaggcaaatcaacgaagttatgcgggagtgggctatggctgacaatcagtccaagaacctgcccaaagccgatcgtcaggctctcaatgagcactttcagagtatcctgcagactctcgaagaacaggtgagcggtgagcgtcaacggctggtggagacgcatgcgactcgagtcatcgcgctgattaacgatcagagaagggccgccctggaaggctttctcgctgcactgcaggctgacccccctcaagctgaaagagtgctgctggccctgcgccgttatttgcgggccgaacaaaaagagcagcgccatactctgcgccactaccagcatgtggccgcagtggacccggagaaagctcaacagatgcgattccaggttcacacccacctccaggtgatagaagagagggtgaaccagtctctgggcttgctagaccaaaatccacacctcgctcaggagctgcgccctcagattcaggagctactccattctgagcatctgggtccttccgaactggaggcccccgctcctggaggcagcagcgaagacaagggtggcctgcagcccccggactcaaaggacgccgacaccccaatgaccctgcctaagggcagtactgaacaagatgcagctagtccagaaaaggagaaaatgaatccgctcgagcagtacgaacgcaaggttaatgcgtccgtgccccgcgggtttccattccattcttctgagatccagagagatgagctggcccctgccggtactggggtttcccgtgaagctgtgtccggtcttcttattatgggggcagggggaggttccctcatcgttttgtcaatgctgttactgagacggaaaaaaccctacggcgccattagccatggtgtggttgaagtggacccgatgcttacccttgaagagcagcagctgagggagctacagagacacggctacgaaaatcctacttataggttcctcgaggaaagaccttag

SEQ ID NO: 18902 - DNA, 2277 bp, Artificial Sequence
  Description of Artificial Sequence: Synthetic coding sequence
atgggccgggacacccggagccggagccggagcgccggccggcggggccggcgtcgccagtcgcagtcaggttctcgatctcggtcaagatcgcacggtcgacggaaccggcggaggagagaggacgaaggcaggagacggcgccgacgccggtcaagggaacgcaggtctgacagcgaagaagagagatggcagaggtctgggatgaggagccgctctcctcctcgccccaaatggcactctagagacggttcatctcagtctgacagtggagaagagcagtcccgcggacagtgggcccgaagacgccgacgcgccaggagctggagccctagttcttccgcttcctcgtccgcctcacctggtaggtctcagtcaccccgggcagccgccgcagccctcagtcagcaacagtctctccaggagcgactgaggctacgtgaggaaagaaagcagcaggaggaacttatgaaggctttcgagaccccagaggagaagagggctaggaggctggcgaaaaaggaggcgaaggaaagaaaaaagcgcgaaaagatgggctggggtgaggaatacatgggatacacaaatacagataacccattcggggacaacaatctcttagggacattcatctggaacaaagccctggagaaaaaaggcatctcccaccttgaagagaaggaactgaaggaacgtaacaagcggattcaggaggataatagactggagctccagaaagtcaagcagctgcgactggagcgtgaacgcgagaaggccatgcgagagcaagaactggagatgctccagcgggaaaaagaagcagagcactttaaaacctgggaggaacaggaagacaactttcatctccagcaagcgaagcttaggagtaagatacggattagggatggaagggctaaacccatcgacttactcgccaagtatatttcagcagaggatgatgatttggccgtcgagatgcatgaaccttacacctttttgaatggactcaccgtcgcagatatggaggatctactggaagacatccaggtgtacatggagctagaacagggaaaaaatgcggatttttggcgtgacatgaccaccatcaccgaagacgaaatttctaaattgcgtaaactcgaggcttctggcaaggggccaggggagagacgcgaaggggtgaatgcgtccgtctccagcgacgtgcagtcagtttttaaaggaaagacttataatcagctccaggttatttttcaggggattgagggcaaaatccgcgccggcggccccaatcttgacatggggtactgggagtctctccttcagcagctacgcgcgcatatggccagagccaggctgcgggaaagacaccaggacgttctgcggcagaaactgtacaagttgaaacaggagcaaggtgtagagagcgaaccactattcccgattttaaaacaggaacctcaatcccctagcaggagcctagagccagaggacgctgctccgactccgccgggaccctcaagtgagggcggcccagctgaagccgaagtcgacggagcaacacccacggagggcgacggggacggagatggagagggtgagggcgaaggcgaggcagtcttaatggaagaggatctgattcagcaatcgctggacgactacgacgccgggcgatatagtccgcgccttctgacagcacatgagctacccctcgacgcccatgtacttgaacctgatgaagatcttcagcgacttcagctgtcccgtcagcagctccaggtgactggagacgcctctgaatctgctgaggatatctttttccgccgagcaaaagaaggcatgggtcaagatgaggctcagttttcagtcgagatgcctctgacagggaaagcttacctgtgggcagataagtataggcctagaaaaccccgattttttaacagagtgcacaccggcttcgagtggaataaatacaatcagacacactatgacttcgacaatccacctccaaaaatcgtccaagggtacaagttcaacattttctaccccgaccttattgacaagcggtctacacctgagtactttcttgaggcttgcgccgacaataaggactttgcaattctgagatttcacgcaggtccgccctacgaagacatcgccttcaaaattgtgaaccgtgagtgggagtactcacaccgccacggttttcgctgtcaattcgccaatgggatattccagctatggttccacttcaagcgctacaggtacaggcgctag

SEQ ID NO: 18903 - DNA, 2277 bp, Artificial Sequence
  Description of Artificial Sequence: Synthetic coding sequence
atgggccgggacacccggagccggagccggagcgccggccggcggggaagaaggcgacagagccaaagcgggtcccggagtaggtcaagaagccatggcagaaggaacaggcgccgaagagaagacgagggtagacggagacggcggcgacgctcacgagagcgccggtcagactctgaggaggaacggtggcagagatcgggaatgcgatcgaggagccctccacggcccaagtggcatagtcgagacggaagctctcagagtgactcaggagaagagcaatcaaggggacaatgggcccggagacgcagacgggcaagatcttggagtcctagctccagcgctagcagctcagctagccccgggagaagccagtctcctagagccgctgctgctgctcttagtcagcaacaaagtttacaggagagattgcggctccgtgaagagagaaaacagcaggaggaactaatgaaggcttttgagactcctgaggaaaaacgagcccgcagactggcaaagaaggaagctaaagagcggaagaaaagggagaagatgggctggggagaggagtatatggggtacaccaatacggacaacccgttcggcgataacaacctgctgggcacgttcatatggaacaaggcacttgagaagaaaggcatttcacaccttgaggagaaagagctgaaggagaggaataagaggattcaggaagacaatcgcctggaactgcagaaagtcaagcaacttagactcgagcgggagcgcgaaaaagccatgcgagagcaggaattggagatgttacagcgagaaaaagaggctgagcattttaagacctgggaagaacaggaagataactttcacctccagcaggccaaactccggagcaagattaggattcgcgatgggcgtgccaagcccatcgatttactagctaaatacatctctgcagaagatgacgacttggccgttgagatgcacgaaccttatacctttctgaacggactgacagtggccgatatggaagacttgctggaagatatccaagtctatatggagctagaacaaggaaagaacgcagacttttggagggatatgacaacaataactgaggacgagatcagtaagctcagaaaactggaagctagtggcaaaggacccggagaacgccgggagggcgtaaacgcttccgtctctagcgacgtgcagtctgtctttaagggaaagacctacaatcagctgcaggttatttttcagggaatcgaagggaaaatccgcgccgggggccccaaccttgatatggggtattgggaatcacttttacagcaattgagagctcatatggcacgggcccgactccgggagagacatcaggacgtgttgcggcagaagctgtacaagttaaagcaagaacaaggagtggagtctgaacctctgttcccaatcctgaagcaagaacctcagagcccctcgaggagtctcgagcccgaggatgccgcccctacacctccgggtccgtcgtccgaagggggccccgcggaggccgaggttgatggggccacacccacagaaggcgatggggacggggacggtgaaggcgaaggcgagggtgaagcagttttgatggaggaggacctgatccagcagtctctggatgactatgatgctgggagatacagtcctcgcctcttgaccgctcacgagctaccactggatgcccacgtgctggaaccagatgaagacctgcagaggttacagctgagccgccagcaactgcaggtgactggggacgcatccgaaagcgcagaggatatatttttcaggcgggccaaagaaggtatggggcaagacgaggctcaattcagcgtcgaaatgcctctgaccggtaaggcgtacttgtgggccgacaagtataggccccgcaagccacggttcttcaaccgagtgcacactggtttcgagtggaacaagtacaatcagacccattacgacttcgacaacccaccccccaaaatcgtgcaggggtacaaattcaatatattctatccagaccttatagacaaaaggtcaactcctgagtacttcctggaagcttgcgcagataataaggattttgcgattctgaggttccacgctggaccaccctacgaggacatcgcatttaaaattgtaaaccgcgagtgggagtactctcacaggcatggttttaggtgtcagtttgcaaacgggatctttcagctgtggttccacttcaagcgttacaggtataggcgctag

SEQ ID NO: 18904 - DNA, 792 bp, Artificial Sequence
  Description of Artificial Sequence: Synthetic coding sequence
atgggccgggacacccggagccggagccggagcgccggccggcggggccggaggaggcaaagccaatccggatcaaggcgcggcccttccccgttcccccggagcgtgcatcagcctcggcatctgagaaccaatccgtgtgcccaggggtcatgggtgaaggcgggaccgcccgtgaaacagttaagattggagcgggaacgggagaaggcgatgcgcgagcaggaactggagatgcttcagcgcgaaaaagaagcagaacactttaagacatgggaggagcaggaagataacttccatttgcagcaggccaagctccgttcaaagatcaggatccgcgatggacgcgccaagcccatagacttgctggctaagtatatttccgcggaagatgatgatcttgctgtggagatgcacgaaccatacaccttcttgaacgggttaaccgtcgcggacatggaggatttacttgaggacatccaagtgtacatggagctggaacaaggtaaaaatgccgacttttggcgagacatgactaccatcacagaggacgagatatctaagctgaggaagctcgaggcctcaggaaaaggcccgggggagcggcgggagggcgtgaacgcatccgtgtccagtgacgtgcagagcgtttttaaagggaaaacgtacaaccagctgcaagtgatcttccaggggattgagggaaaaattcgcgcaggcgggccaaacctcgacatggggtattgggaatcattacttcaacaactgcgggcccacatggcacgggcctag

SEQ ID NO: 18905 - DNA, 321 bp, Artificial Sequence
  Description of Artificial Sequence: Synthetic coding sequence
atggagttcgacctgggcgccgccctggagcccaccagccagaagccaggtgtcggcgctggacacggcggggatcccaaacttagccctcataaggttcagggcagatcagaagccggcgcagggccgggtccgaagcagggacaccatagcagctctgatagttcaagctcctcatcagactcagacacagacgttaagtctcacgccgcaggatcaaaacagcatgagtcgattcctggcaaggcaaaaaagccaaaagtgaagaaaaaagagaaggggaaaaaagaaaaaggcaaaaagaaagaagcaccgcactag

SEQ ID NO: 18906 - DNA, 543 bp, Artificial Sequence
  Description of Artificial Sequence: Synthetic coding sequence
atggccggcgtgaagtaccccggccaggaccccgtggacctggacatctaccaatctagccatatggtggactatcagccttatcgcaaacacaaatatagtagagtcactcctcaagaacaagcaaagctggacgcacagctccgggacaaggaattctataggccaattcccaacccaaaccctaagctcaccgacggataccctgcgtttaaacggccccacatgactgcaaaggatctggggctgccgggcttcttcccctcacaggagcacgaggctacgagagaagatgagcgtaagttcacatcaacatgtcactttacgtaccccgcatcccacgatctccatctcgcccagggcgacccgaaccaggttctgcaaagtgccgatttcccttgcttggtggaccccaagcaccagcctgcagccgaaatggctaagggttacttgctccttccaggctgtccttgcctgcactgccatattgttaaagttcccatactgaacaggtggggtcctttgatgccgttttatcagtag

SEQ ID NO: 18907 - DNA, 1041 bp, Artificial Sequence
  Description of Artificial Sequence: Synthetic coding sequence
atggtgggcggcggcggcaagcggcggcccggcggcgagggcccccagtgcgaaaaaactacagacgtcaaaaaatccaagttctgtgaggctgacgtcagttccgatcttcgcaaagaggtcgagaaccattacaagctaagtctcccagaggatttttaccatttctggaaattctgcgaggagcttgaccccgagaaaccgtccgactcactgtccgcttcactggggttgcagctggtgggtccctacgacatccttgccgggaaacacaagacaaagaagaaatcaacgggtctcaactttaatctgcactggcggttctactacgacccccctgagtttcagaccattatcatcggggacaacaaaacacagtaccacatggggtactttcgcgattcaccagatgaattcccagtgtatgtcggcatcaatgaggcaaagaaaaactgcattattgtgcccaatggtgataacgtcttcgcggcagtgaaactcttcctaactaagaaactccgggaaatcactgataaaaaaaaaatcaacctgctcaagaacattgacgaaaagttgactgaggccgcccgagagcttggatacagcttagagcagcgaacagtaaagatgaagcagcgggataaaaaggtagtgactaagacttttcacggagccgggctggtggtacccgtggacaaaaacgacgtgggctaccgggagttgcccgaaaccgatgccgacctaaaaaggatttgcaagaccatagtagaagcagcgtcggatgaagaacgcctcaaggctttcgccccaatccaggaaatgatgaccttcgtgcaatttgcaaatgatgagtgtgattacggcatgggcttagaactgggaatggacctgttttgttatgggtcccactactttcataaggtcgctggccaattgctcccattagcctataatctccttaagcggaacctctttgcagaaatcattgaggagcacttggccaaccgttcccaggagaatattgatcagttggccgcatag

SEQ ID NO: 18908 - DNA, 780 bp, Artificial Sequence
  Description of Artificial Sequence: Synthetic coding sequence
atgcgggaccggcggggccccctgggcacctgcctggcccaggtgcaacaggccggaggaggcgattctgataaactcagttgtagcctgaagaagcggatgccagagggtccatggcctgcagatgccccatcgtggatgaataaacccgtggtcgacggcaattcacagtccgaggctttatcccttgaaatgcggaaggaccccagtggagctggcctatggcttcacagcggcggtccagtgctgccctatgtcagggagtcagttcgaaggaatcctgcatccgccgccaccccttccaccgctgtaggcctctttcccgctcccaccgagtgctttgcgcgcgtgtcatgctctggtgtggaagctttaggaagaagagactggctcggcggcggccctcgcgccaccgacggtcaccgcgggcagtgccctaagggtgagcctagggtcagtcgtctaccaaggcaccaaaaggtacccgaaatggggtccttccaggatgatcccccttctgccttccctaaaggattagggtctgaactggaacccgcctgtctgcactctatcttgagcgccactctgcacgtctatcccgaggtccttctgtcagaggagacgaagcgcattttccttgaccgtttgaagcccatgttttctaagcaaaccatagagttcaagaaaatgcttaagtctaccagtgacggcctccaaatcactctagggttgctggctctacagccttttgaactggccaataccttgtgccattcatag

SEQ ID NO: 18909 - DNA, 363 bp, Artificial Sequence
  Description of Artificial Sequence: Synthetic coding sequence
atgcgggaccggcggggccccctgggcacctgcctggcccaggtgcagcaggccggtggtggggatagtgataagttatcatgttcgctaaaaaagcggatgcccgagggtccttggcccgccgacgcaccctcttggatgaataaacccgtggtggacgggaactctcagagcgaagcccttagtctggagatgcgcaaggatcccagtggtgctgggctttggttgcactcgggtgggccagtactcccatatgttagagaatcggtgaggcgcaatcccgcgtcagccgctaccccctcgaccgccgtcgggttatttcctgcacctaccgaatgcttcgctcgcgtgagttgctcatag

SEQ ID NO: 18910 - DNA, 330 bp, Artificial Sequence
  Description of Artificial Sequence: Synthetic coding sequence
atgcgggaccggcggggccccctgggcacctgcctggcccaggtgcagcaagccggaggaggagactctgataaactgtcttgttcactgaaaaaacgcatgcctgaagggccatggcccgccgacgcaccttcttggatgaacaagcccgtcgtggatgggaattcacagagcgaggccttatcattagagatgcgtaaggacccctccggcgctgggctgtggctgcactctggtggtccagtgctcccctacgtcagagaaagtgtgagacgcaacccggccagtgcggccactcctagcaccgctgtgggtctgttccctgcctag

SEQ ID NO: 18911 - DNA, 2391 bp, Artificial Sequence
  Description of Artificial Sequence: Synthetic coding sequence
atggccgagaccaaggacgtgttcggccaggagccccaccccgtggaggatgacctgtataaggagagaacacgaaaaagaagaaaatctgatagggaccagcgttttcgcgcttttcccagcatggagcagtcagccctcaaggaatacgagaaactcgagtctcgcactagaagagtgctgagcaatacttatcaaaagctgattcagagcgtctttctcgatgacagcattcccaatggcgtgaagtacctgatcaatcgcctgctggccctgatcgaaaaacccactgtggaccccatctacattgctctttttgggtcaaccggcgccggaaagtccagcctaattaacgctattatacagcaggcaatgtttttgccagtaagcggcgaaagcatctgtacatcgtgcatcgtgcaggtgagctcaggatgctgcgtgcagtacgaagccaagatccacctcctgtcggaccaagagtggagagaagagcttaagaacctaaccaaattattgcataggactgaagaactatccagagaagaggctgatgcttggaaccgagatgaagccgttgaagaagccacttggaagcttcagatgatctacggcaacggggccgaaagcaaaaattatgaggagctgctccgggcaaaacccaagcgcaaaatccccacctccagagtaatcactctgaaagcagaagaggcagaggaattgtctattaaactggacccttatatacggacacagaggcgcgactgggacggggaagccgcggaaatgaggatctggcccctgatcaaacacgtggaggtgaccctgcctaagagcgatctgatccccgagggggtggtgctggtcgacattcccggaactggcgacttcaactcaaaacgcgacgagatgtggaaaaagacaatagacaaatgcagcgtgatttgggtgatcagtgatatagagcgggtaagtggggggcaggcccatgaggatctgctgaacgagagcatcaaggcctgtcagcgggggttctgcagagacgtggctctggttgtaacgaagatggataaactgcaccttcccgagtatctacgcgaggaacgcaagggctggcaggcaattcagtcccagcgcgaagcggtgctggaacgaaatgaaatgattaaactgcagcgtacgagaattctgaaggagaagctgaagcggaaactgcctgcggactttaaagtgctggaggcttccgacctagtttacacggtgtccgcacaggaatactggcagcaggcccttttgacagaggaggagaccgaaatccctaagctccgcgagtatattcgtaaaagccttctagataagaaaaagagaacagtgaccaagtacgtaactgaagcgttcgggcttctcctcctcacagatagctttaattctactcaaaacctgcccaacgaacatcttcatatgtccgtgctgcgacgcttcgccgaagagaaggttgagctgctggaaaaagcaatcgcccagtgctttgcttgcatggagcagcctctgcaggagggcgtgcgcacagcaaggacttcctaccggtgcattctgcgggcatgtctcgtgcggtcaaagggcaatcagggcttccaccagacactgaaggccgtgtgcctaaaaaacggcatttatgcctctaggactttggcgagaattgacctcaatgaagccctaacgcaaccggtatacgatcagattgaccctgtattcggatccatcttccggaccggcaaaccaaccggcagcgccttgatgccccatatagatgcctttaagcaatcgctgcaggaaaaaatgacagaaatcggaatcaggagcggatggaagtacgacagttgtaagaagaattttctcattcaggagattagcgccatcttaggtggattggaggatcatatcctaagacggaaacggagaatctacgagtctctgactgcgagcgtgcagtccgatctgaagctgtgctatgaggaggccgcccagattacggggaagaaagcatgtgagcggatgaaagatgccatccggagaggcgtggacaggcaggtggcagagggaatgtttgagcgcgctcaggaaaggatgcaacaccagtttcagcaactcaagactggtattgtggagaaggtgaaaggcagcatcactacgatgctggcactggcaagttctcagggtgacggtttatataaggaactagccgatgtagggagcgagtacaaagaaatggagaagctgcacagaagtctccgagaagtcgcggaaaatgcgcgcctcaggaaaggcatgcaggaattcctcctgagggcatccccttcgaaagccggacctccaggcacctccttgtag

SEQ ID NO: 18912 - DNA, 2391 bp, Artificial Sequence
  Description of Artificial Sequence: Synthetic coding sequence
atggccgagaccaaggacgtgttcggccaggagccccaccccgtggaggacgacctctacaaagagcggacccgtaagagacgcaagagcgatcgggatcagagatttagagcttttccgtcgatggaacagtcagcattgaaggagtacgagaagctcgagtcacgaactcgccgggttttaagcaacacctatcagaaactcatccagagcgttttcctggatgattccattcctaacggcgtcaagtacctgattaacaggttgctcgctttgattgaaaaacctacggttgaccctatttacattgcactattcggctcaaccggggctggtaagtccagccttatcaacgctatcatccaacaggctatgtttctgccagtgagcggggaatccatatgcacttcatgcatcgttcaggtctcttccggttgttgcgtgcagtacgaggccaaaatacatttgctctccgaccaggaatggagggaggagctcaagaatctgacaaagctcctgcacaggactgaagagctcagccgcgaagaggccgatgcttggaatcgggatgaggccgtggaggaagcaacatggaagctgcaaatgatctacgggaatggtgcggaaagcaaaaactatgaggagcttctcagagccaagccgaaacggaaaatccctacttcaagagtgatcacgctcaaggctgaggaagccgaggagttgagtattaagctggacccctacatcagaactcagcgcagagactgggacggagaggctgccgaaatgaggatctggcctctgattaaacacgtggaagtcacgttacctaagtctgaccttatcccagaaggagtggtgctggtcgatatccccggcacaggtgactttaactctaaacgagacgagatgtggaaaaagactatcgacaaatgctccgtgatctgggtgatctccgatatcgagagggtgtctggcggccaggcacatgaagacctactgaacgagagcattaaggcttgccagcgcggattttgccgtgatgtcgccctggtggtgacaaagatggacaagctacacctccccgaatacttaagagagagaaaagctggcaaccaggctatccaatcccagagggaagcagttttggagaggaatgagatgattaagcttcaaaggacccgcatccttaaggaaaaactgaagaggaaacttcctgcggattttaaagtgctcgaagcttccgatctcgtctacactgtcagtgctcaggaatattggcagcaggctctgctgactgaagaggaaacagagattcccaagctgcgggaatatattcggaaatcactgcttgacaagaagaaacggaccgtcaccaaatatgttactgaggcttttggtttgttgttgttgactgactcttttaattctactcagaacttacctaacgaacacttacacatgtctgtgctgcggcgatttgcggaagaaaaggtagagctcctggaaaaggcaatcgcccagtgtttcgcctgcatggagcagccgttacaagagggagttcggaccgcccgtaccagttatcgatgcattctaagagcctgcctagtgcgctcaaagggcaatcagggctttcaccagactctaaaggcagtctgtctgaaaaatggcatttatgcctctcggactctcgctagaatagatctgaacgaggctctgacgcaacctgtgtatgaccaaatcgacccagtattcgggtccatctttcgtacaggcaaacctactggctcagccctgatgccacatattgatgcgtttaaacagagtctccaggaaaagatgaccgaaattggaatccgcagcggatggaagtacgattcctgcaagaagaacttccttattcaggagatctctgccattctggggggcctcgaggaccatatcctgcgacgcaagaggcgcatctatgagtccttaactgcatctgtgcagtctgatctgaagctttgttatgaagaggctgcgcagatcacaggtaaaaaagcttgtgagaggatgaaggacgccataagacggggtgtcgatcggcaggtggccgagggtatgtttgagcgggctcaggaacgtatgcagcaccagttccagcagctgaaaaccgggatcgtagagaaagtgaagggctctattaccaccatgctcgcccttgcttcttcacagggagacggactgtataaggaactggctgatgtcggttcagaatacaaagagatggaaaagctgcaccggtcgctgcgtgaggtggctgaaaatgcccgcctgcgcaaaggcatgcaggagtttctgctacgagcctctccgtccaaggccggccctccgggaacatcactttag

SEQ ID NO: 18913 - DNA, 3999 bp, Artificial Sequence
  Description of Artificial Sequence: Synthetic coding sequence
atgaccggcgaggtgggcagcgaggtgcacctggagatcaacgacccaaacgtaatttctcaagaagaggctgacagccctagtgattctggccagggtagctatgaaacgattgggccgctctcagagggcgatagcgacgaggaaatcttcgtcagtaagaagttgaagaacagaaaagttctgcaagactccgattccgagaccgaagacaccaacgcttcccctgaaaagacaacctacgactctgccgaggaggaaaacaaggagaacctgtatgccggtaagaataccaaaataaagagaatctacaaaacagtggccgacagtgacgaatcgtatatggagaaatccctttaccaagagaacctggaagcacaggtcaagccatgtctggaattatcgttgcaatcaggcaacagcacagactttactactgatcgcaaaagtagtaaaaaacatatccatgacaaggaggggactgctgggaaagctaaggtgaagtctaaaagacgtctcgaaaaggaggaacgcaaaatggaaaaaatacgccagctgaaaaaaaaggagacgaaaaatcaggaggacgacgtcgagcagccttttaatgattccgggtgtcttcttgtcgacaaggatctgttcgagaccggtctggaggatgagaacaatagtcccctagaggacgaggaatccctggagagcatacgagcagctgtgaagaataaggtcaagaagcacaagaagaaagagccttcacttgaaagcggagtgcattccttcgaagaagggagtgaactaagcaagggaactacgcggaaggagagaaaagccgcccggctcagcaaagaagctttgaagcaactccactctgaaacccagaggctgatcagggagtcagctttgaacttgccatatcacatgcccgagaataagactatacacgatttttttaagagaaagcccagaccaacctgccacggcaatgccatggccctacttaagagtagcaaatatcaaagcagccatcacaaggagattatagataccgcgaatacaaccgaaatgaacagcgatcaccactcaaagggttccgaacagaccactggggctgaaaatgaagtagaaactaatgcgttgccagtggtcagcaaagagactcaaataatcaccgggagcgacgaatcgtgcaggaaggatctggtcaaaaatgaagagctggagattcaggaaaaacagaaacagagcgacattcgaccttcacccggggattctagcgtactgcagcaggagtctaattttctcggcaataaccactcggaggagtgtcaagtcgggggattagtggcctttgaacctcatgcacttgaaggcgagggcccacagaaccccgaggagacggacgaaaaagtcgaggaacccgaacagcagaacaagagctccgcagtgggccctcctgaaaaggtcagaaggtttacattggatcggctgaagcagctgggcgtcgatgtgtctatcaagcctagactcggagcggatgaagattccttcgtgatcctcgaacctgaaacaaaccgcgagctggaagcactgaagcagagattttggaaacacgccaacccagcggcaaagcctcgtgccgggcagacagtcaatgtcaatgtgatcgtaaaagacatgggcactgatggtaaagaggagctcaaagccgacgtcgttcctgtgacacttgcgccgaaaaagctggatggagcttcccatactaaacccggcgagaagctacaggtgctgaaggctaagctgcaggaagccatgaagctccgaaggtttgaggagagacaaaaaaggcaagccctgtttaagttagataacgaggacgggtttgaggaagaagaggaagaagaagaagagatgactgatgaatcagaggaggacggcgaggagaaagtggagaaggaggaaaaggaggaggagctggaagaggaggaagaaaaggaggaggaagaggaagaggaaggcaaccaggagacggcagaattcctgcttagcagcgaggagattgagactaaagatgaaaaagagatggataaagagaataatgacggatcatctgagataggaaaagccgtaggctttctgagcgtgcctaagagcctctcatctgacagcactttgctgttgttcaaggactcatcgagcaagatgggctatttccctactgaggagaagtctgaaactgacgagaatagcggcaagcagccatctaaacttgacgaagacgattcttgctcactcctgaccaaagagagctcacacaatagcagttttgagcttatagggagtactattcccagctaccagccttgcaaccggcaaactgggaggggaactagctttttccccactgcaggaggatttcgaagcccatcccctggcctttttcgtgcttcccttgtttctagtgcctctaaatcatcaggaaaattaagcgaaccatctcttcctatcgaagacagtcaggacctgtacaacgcgtcaccagagcctaagactctcttcctgggagccggcgactttcagttctgcttagaagacgacacacaaagccaattgctggacgcagatgggttcctgaacgtgaggaaccatcgaaatcagtaccaggccctgaagccgcgccttcccctcgcctctatggacgagaatgccatggatgcgaacatggacgagttactcgacctgtgcactggcaaatttacgtcacaggccgaaaagcacctgcctcggaagagcgacaagaaagaaaatatggaggagttactaaatctgtgcagcggaaagttcaccagccaagacgcctcgacacccgctagcagcgaacttaacaagcaggagaaagagagttctatgggggatcccatggaagaagccctggccctctgttccgggtcattccctaccgataaggaggaggaagatgaggaggaggaattcggtgattttcggctggtaagtaatgacaacgaatttgattctgatgaggatgagcactccgattccgggaatgacctcgcactagaggatcacgaagatgatgatgaagaagagctcctaaagaggtcagagaagctgaaacgtcagatgcgcctgcgaaagtatctggaagacgaagccgaagtttcagggagcgatgttggtagtgaggacgagtatgacggtgaggaaatcgatgagtatgaagaagatgtcattgacgaggtgctaccgtctgacgaagagctacaaagtcagattaagaagattcatatgaaaactatgctggacgatgacaaacgccagctccggctctatcaggaacgctacttggccgacggggacctccattctgacggacctggcagaatgcgaaaattcagatggaagaacatcgatgacgccagccagatggatctttttcacagggattccgatgacgatcagaccgaagaacaacttgatgagtctgaggctagatggcgcaaggaacggatcgaacgggagcagtggctgcgcgacatggcccaacagggaaagattactgcagaggaggaggaagagattggagaggacagccagttcatgatactcgcgaagaaagtcactgcaaaggctctccagaagaatgcctcaaggccaatggtgatccaagagtcaaaatccctgctgcgcaaccccttcgaagccattcgccccgggtctgcacagcaagtgaagactggctcattgctgaatcaacccaaggccgtgttgcagaaactcgccgctctctcagatcacaaccctagtgcaccccgaaatagtagaaattttgtttttcatacgttatcgcctgttaaagccgaagcagccaaagaaagtagtaagtcacagaagattcccgagaaggacagtgactggctcacctggtccggcgctcctatccctgggttttttcgactgagtttcgatccccatggttag

SEQ ID NO: 18914 - DNA, 4020 bp, Artificial Sequence
  Description of Artificial Sequence: Synthetic coding sequence
atgaccggcgaggtgggcagcgaggtgcacctggagatcaacgaccccaacgtaatctcccaggaagaggctgactcaccttcagattcaggccaaggctcctatgaaacgattggtccattgtctgaaggtgacagcgatgaagagatcttcgtgtccaaaaaattgaagaatcgcaaggtgctccaggactcagacagcgagacagaggatacaaacgctagccccgagaagacaacctatgactcagccgaggaagagaacaaggagaatctgtacgccggcaagaataccaaaatcaaacgcatatataagacggtggctgattcagacgagtcctacatggagaagagtctgtaccaggaaaacctcgaagcccaggtgaagccatgtctcgagctgagtctgcaatccggcaacagcacagacttcactacagaccgtaagagctctaaaaaacacatacacgacaaggagggaacagctgggaaggcaaaggtgaagtctaaaagaagactcgaaaaagaagagcggaaaatggaaaaaattagacaactgaagaagaaggaaaccaaaaatcaggaggatgatgtggagcagccttttaacgactcggggtgcctgctggtggacaaggatctttttgaaaccgggctggaagatgagaataactcacccctggaagacgaggagtctttggagtctatccgggccgcggtgaagaataaggtcaagaaacataaaaagaaggaacccagcctagagagtggcgtccattcattcgaagaaggatcagaacttagcaaggggacaacccggaaggaaagaaaagccgcccgacttagcaaagaggccctgaaacaactgcacagcgagactcaaagactgattagagaatctgccctgaacctcccatatcacatgcctgaaaacaagactatccacgattttttcaaacgcaaaccccgccccacttgccatggtaatgcaatggccctgctcaagtcaagcaaatatcagtcctcacatcacaaggagatcatcgataccgcaaacactactgagatgaacagcgaccatcatagcaaggggtcagaacagaccaccggagctgagaacgaagtggaaactaacgccctgcccgtcgtgtctaaagaaacccagatcattaccggttctgacgaaagttgcagaaaggacttagttaagaatgaggagctcgaaatacaagaaaagcagaagcagtccgatattaggccttctccaggcgactcatccgtgttacagcaggaaagcaatttccttgggaacaaccatagcgaagaatgtcaggtcggcggattagtggcctttgagccgcacgctcttgaaggggaggggcctcagaatcctgaggagacagatgaaaaggtcgaagaacctgagcagcagaataagagctctgcggtggggcctcctgaaaaagtgagacgcttcacactggaccgactgaagcagctgggcgtggacgtgtcgattaaacccagactcggggcagacgaggacagcttcgtaattcttgagcctgaaaccaaccgcgaactcgaggccctcaaacaaaggttctggaagcatgccaaccccgcagcaaagccgcgagccggccagaccgtcaatgtgaacgtaatcgtgaaggatatgggcacggacggtaaagaggagcttaaggcagatgtggtcccagtgaccctagcccccaagaaactagatggggcttcgcataccaaacctggagaaaagttacaggttctgaaagcaaaactgcaggaggcaatgaaactccggagatttgaggaacgccagaaacgccaagcactcttcaagcttgataacgaggacgggttcgaggaagaagaagaagaggaagaggagatgacagatgaaagtgaggaggacggggaggaaaaagtggagaaggaggagaaagaggaagagctcgaggaggaagaggaaaaggaggaagaggaggaggaggagggaaatcaagaaacagccgagttcctgctcagctcggaagagatagagacgaaagacgaaaaagagatggacaaggagaataatgacgggtcaagtgaaatcggaaaggcggtgggatttctttctgtcccaaagagtttgagttctgattccactctactcttgtttaaagattcaagcagtaagatgggctatttccctacggaagagaagtcagaaacggatgagaattccgggaaacagcctagcaaactagacgaagatgattcctgttccttgctgaccaaggaaagcagtcataactcttcatttgaattgataggctccacaattcccagctatcaaccttgtaaccgtcagactgggagggggaccagttttttcccaacggccggaggctttagatcaccttcacctgggttgttcagagctagcttggtgagtagcgcctctaagagctctggaaagctctcagagccatccttacctattgaggactctcaagatctgtacaatgcctcacccgaaccgaaaacattattcctgggcgcaggggattttcagttttgtctcgaagatgatactcagtcacagttgctcgatgccgatggcttcctgaacgtccgaaaccataggaaccagtaccaagcactcaagccccgcctgcctcttgccagtatggacgaaaacgctatggacgccaacatggatgaactgctggacctctgtactggcaaattcacgagccaggctgagaagcacttgcctcgcaaatccgacaagaaagaaaacatggaagagttgcttaacttgtgttccggcaagtttaccagtcaggacgctagcacccctgcaagttctgaacttaacaagcaggagaaggaatcctctatgggagaccccatggaggaggccctagcactgtgctcaggctctttccccaccgataaagaagaggaggatgaggaagaggagtttggcgatttcaggctcgtttctaacgataatgaattcgactctgacgaagacgaacattctgacagcggtaatgacctggcgctggaagatcacgaggacgacgacgaggaagagctactgaaacgctccgagaaactgaaacgacagatgagactgcgtaagtacctagaggatgaggccgaggttagcggaagtgatgttggctcagaggatgaatatgatggcgaagagatcgacgaatatgaggaagacgtcattgacgaggtgctcccgtctgatgaggagctgcagagccaaatcaaaaagatccatatgaagaccatgttggatgacgacaagcggcaactgcgcttgtaccaggagcgctacctggcagacggggacctgcactccgatgggccggggaggatgcgaaagttcaggtggaaaaacatcgatgacgcatcccagatggacctgttccacagggactctgatgatgatcagaccgaagaacagttggacgagagtgaagctcgctggagaaaggagcgaattgagagagaacagtggctccgggacatggcccagcaagggaaaatcacagcagaagaagaggaggagatcggcgaggactcgcagtttatgattcttgccaaaaaagtaaccgctaaggccctgcaaaagaatgcgtcacggcccatggtgatccaggagtcaaagagcctcttgcgcaatccatttgaagcaattcgtcctggcagcgcccagcaggtgaagacgggatccctcctcaaccagcccaaggctgtgctgcagaaactggcagcactttccgatcacaatccttctgcaccgcgtaatagcagaaatttcgtatttcacaccctgtcaccagtgaaagccgaagccgccaaggagagtagcaaatcacaagtgaaaaaaaggggccctagtttcatgacatcaccttctccgaagcacttgaagacggacgactcaacgtctggtctgactaggtcgatttttaagtatctcgagtcatag

SEQ ID NO: 18915 - DNA, 3828 bp, Artificial Sequence
  Description of Artificial Sequence: Synthetic coding sequence
atgaccggcgaggtgggcagcgaggtgcacctggagatcaacgaccccaatgtaatcagccaagaggaagcagacagcccatccgattcagggcaggggagttatgagacaatcggacccctatccgaaggcgactccgatgaggagatattcgtgagcaagaagctaaaaaatcggaaggttttacaggattcagactctgagacggaagatacaaacgccagtccggaaaagacaacttatgactcagcagaggaagaaaataaagagaatctttatgcaggtaaaaacacaaagatcaaacgaatctacaaaacggtggcagacagtgatgagtcgtatatggagaagtccctttatcaggagaacctagaggcgcaggtgaagccatgtctggaactgagccttcaatctggcaattctacggactttacaaccgatagaaagtcgtctaaaaagcatatccatgataaggagggcacggctggcaaggcaaaagtgaaatcgaagcgacgcctcgagaaagaagagcgcaagatggaaaagataaggcaactgaagaagaaagaaaccaaaaatcaagaagatgatgtcgagcagccttttaacgacagcggctgcttgctcgttgataaggatctgttcgagaccgggctggaagacgagaacaactcacctctggaggacgaagagagtctggaatcgataagagctgctgtgaagaataaggtcaagaagcacaaaaagaaggagccctcactggaatctggggtgcattcctttgaggaaggatccgagctgtctaagggcacgacccgtaaagagaggaaggccgcccgcctgtctaaggaggcactaaagcagctgcactctgagacccaaaggcttattagagagtccgccctgaatcttccataccacatgcctgagaataaaacaatacacgactttttcaaaagaaaacctcggccaacatgccatggaaacgcgatggctttacttaagtcctccaagtatcagtcctcacaccacaaagaaattatagataccgctaatacgaccgaaatgaattcagaccatcattccaagggttctgagcagaccacaggcgcggaaaacgaggtggaaacaaatgcgttgccggtggtgagtaaagaaacccagattattacagggtctgatgagagttgccggaaggacctggtcaagaacgaggaactcgagatacaggagaagcagaaacagagcgacatcagaccttctcctggtgactcctcggtcctccagcaggagagtaacttcctgggcaacaaccactccgaggagtgccaagtgggaggccttgtggcattcgaaccacatgccctggaaggcgagggaccacagaaccccgaagagacagacgagaaagtggaggagccggagcagcagaacaagtcttccgcggttggccctcctgagaaggtgcgtcggtttacgttggaccgcctgaaacagctgggggtagacgtatcaatcaagccacgcttaggcgccgatgaggatagtttcgtgattttggagcccgagacaaatagaggcgagaagctacaggttctgaaagcaaagctgcaggaggccatgaaactgcgcaggtttgaggaaagacaaaagaggcaggccctgttcaagctggacaacgaggacggctttgaggaggaggaggaagaggaagaggagatgaccgatgagtccgaggaagacggagaagagaaggtggaaaaggaggaaaaagaggaggaacttgaagaagaagaagagaaggaggaggaggaggaagaggaagggaaccaggagacagcggaatttttactgtcttcagaagagatcgaaacgaaggacgagaaggaaatggacaaggagaacaatgatggctccagcgagatcggaaaagcagtgggattcctctcagtgccaaagagtctcagcagcgactcaaccttactgctgtttaaggacagctcctctaaaatgggttacttcccaaccgaagaaaaaagtgagactgatgagaattcaggtaagcaaccttccaaactagatgaggatgatagttgctccctcttaaccaaggaaagttcccacaattccagttttgaactcatcggatctacgatccctagttatcagccatgcaatcgacaaaccggaaggggcacgagtttctttccgaccgctgggggctttagaagcccttcacctggattattccgtgccagtcttgtctctagcgcctctaagagttcaggaaaactatcagagcctagcctgcctatcgaggactcacaggatctgtacaatgccagcccagagcctaagactctcttcctgggggcgggagatttccaattttgcttggaagacgatactcaaagccaactcctggacgcagacgggtttctgaatgtgcgcaatcataggaaccaatatcaggcattgaagcctaggcttccactggctagcatggacgagaacgcgatggatgctaatatggatgagcttttggacctgtgcacggggaaatttacctcacaggctgaaaagcaccttccgaggaaatcagacaaaaaggagaacatggaagaactcctcaatctgtgctcggggaagttcacatcccaggatgccagcaccccagcttcgtcagagctgaataagcaagagaaggagtcttcaatgggcgacccgatggaggaagcgctggctttgtgcagcggatctttccccacggataaggaggaggaggatgaagaagaagagtttggtgactttcgcctagtctctaacgataacgaatttgatagcgacgaggatgaacatagcgactccggaaatgatctcgcactggaagaccatgaagatgacgatgaggaagaactgctcaaacgcagcgaaaagctgaagcggcagatgagactcagaaagtatctcgaagatgaagctgaggttagcgggtccgatgtggggtctgaggacgaatacgatggagaggaaattgatgaatatgaagaggatgttattgatgaagtgctcccctctgacgaagagcttcaatcacaaatcaaaaagatacatatgaagacaatgcttgatgacgataaaagacagctgcggctgtaccaagaacgctacctcgctgacggagacctgcactctgatggccctggtcgcatgcggaagtttagatggaaaaatatagacgatgcaagtcagatggacttgttccatcgtgacagcgacgacgaccagaccgaagagcagctagatgagtcagaggctagatggcggaaggagcgaatcgagcgtgaacagtggctgcgcgatatggcccagcagggaaagataactgccgaggaggaggaagaaataggcgaggattcacaatttatgatccttgctaagaaagtaaccgccaaagcattgcaaaagaatgcatcgagacccatggtgatccaggagagcaaaagtctcctgagaaatcctttcgaagctatcaggcccggtagcgcccagcaagttaagaccggatccctgctcaatcagccgaaggcggtgctccaaaagctggccgccctctcagaccataaccctagtgctccaaggaacagccgaaacttcgtgttccatacgctttctcccgtgaaagccgaagctgctaaagaatcttccaagagtcaggtgaagaaacggggaccaagctttatgacatctccctctcccaaacatcttaagactgacgattccacatcgggactcactcgatctatattcaaatacttagagtcctag

SEQ ID NO: 18916 - DNA, 1977 bp, Artificial Sequence
  Description of Artificial Sequence: Synthetic coding sequence
atgaccggcgaggtgggcagcgaggtgcacctggagatcaacgaccctaatgtcatctcccaagaggaagcggatagcccttccgacagcgggcagggaagttatgaaacaattggccctctgtctgagggggatagcgacgaggagatcttcgtcagtaagaaactaaagaacagaaaggtgttgcaagatagcgattcagagacagaggacacaaacgcctctcctgagaagaccacatacgacagtgctgaagaggaaaataaagaaaacctgtacgctggaaagaataccaaaatcaaacggatttataaaacggtggccgactcagatgagtcatatatggagaagagcctttatcaggaaaatctcgaggcccaggtgaaaccatgccttgagttgagcctacagtccgggaattccaccgacttcaccaccgacagaaaaagctccaaaaagcacattcacgataaggaaggaaccgcaggcaaggctaaggtaaagtcaaagcgcagattagaaaaggaggagagaaaaatggaaaaaatcagacagcttaaaaagaaggaaactaagaaccaggaggacgatgttgaacagccctttaacgactcaggttgtctactcgtcgataaagacttatttgagactgggctggaggacgaaaataattcccctttggaggatgaagagtcattggaatccattagagcagccgtgaaaaacaaggttaagaagcacaagaaaaaggaaccatcccttgagagcggcgttcatagcttcgaggagggcagtgagctgtcaaagggcaccacaagaaaggaaagaaaggccgcacgactgagcaaagaggcccttaagcagctacatagtgaaacccagaggctcatcagggaaagcgccctgaatctgccttaccatatgcctgaaaataagaccatccatgacttctttaagcgcaaaccccggcccacctgtcacggtaatgcaatggccctacttaaatcatcgaagtaccagagttcacatcacaaagagatcatcgacaccgcaaataccacggaaatgaactccgatcaccactctaaaggctccgaacagactacaggagccgaaaatgaggtggagacaaatgctctgccagtggtgtcaaaggagacacagattataaccggtagcgatgagtcatgcaggaaggaccttgtgaagaacgaagaactcgaaatccaagaaaagcagaagcagtccgacattagaccctcacccggcgattccagcgtgctgcagcaggagagcaatttcttaggcaataaccattccgaggaatgtcaagtcggcgggttggtcgcatttgaaccccacgcactcgagggagagggcccacagaacccagaagaaaccgatgagaaggtcgaagagccagaacagcagaacaaatcatcagccgtgggacctccggagaaggtcagaagatttaccttagacagactgaagcagctcggggtggatgtttctatcaaaccgcgtctgggagctgacgaggactcgtttgtcatactggaacctgaaacaaaccgcgagctcgaagctctgaagcagcgattctggaagcatgccaatcccgcagcgaagcctcgcgcagggcagactgtgaatgttaatgtgattgtaaaagacatgggcaccgacggaaaagaggagctcaaggccgatgtggtgcccgtaacgctggccccaaagaagctcgatggcgcatcccacaccaagccaggcgaaaaactgcaggtgctgaaagccaagctgcaggaggccatgaaactgcgcagatttgaagagagacagaagagacaggctctattcaagctggacaacgaggatgggttcgaagaggaggaagaggaagaggaagaaatgactgatgaatccgaagaagatggcgaagagaaaaaaaagaaaaaaaaaaaaaaaaaaaattag

SEQ ID NO: 18917 - DNA, 3393 bp, Artificial Sequence
  Description of Artificial Sequence: Synthetic coding sequence
atgcggtgcctggccccccggcccgccggcagctacctgagcgagccccaaggctcatcccaatgcgctacaatggagcttggccctctggaaggagggtacctggagttgctgaattcggacgcggaccctctctgcctctaccacttttacgaccaaatggacctggcaggggaggaagaaatcgaactttacagtgaacctgacactgacacaataaattgtgatcagttttcgcgcctcctgtgtgatatggaaggcgatgaggagactcgtgaagcctatgcgaatatagccgagttggaccaatatgtgtttcaagactcccagctggaaggcctgagtaaggacatcttcaagcacattggtccagacgaggtcatcggcgagtccatggagatgccggccgaggtgggccagaagtcccaaaagcggccctttcctgaagagttgcctgcagatctgaagcactggaaaccagcggaaccaccgaccgtggttacaggttctcttctggttcgccctgtaagcgactgctcaacacttccatgcctgcctctgcccgccctcttcaaccaagagcctgctagcggtcaaatgcgccttgagaaaacagaccagatccctatgcccttttcaagcagctccctctcatgcctcaatctgccagagggtcccatccagttcgtgccaaccatatcgactcttcctcatgggctgtggcagatctctgaggcggggaccggggtctcttccatcttcatttaccatggtgaggtgccccaggcttcccaggttcccccaccttcaggctttacagttcacggtctgccaacctcaccggaccgtcctggctcaaccagtcccttcgcaccatccgccaccgatctgccatccatgcccgaacccgccttaacgtcgagagccaacatgaccgagcacaaaacatcaccaacgcagtgcccagccgcaggcgaggtctctaacaagctgcccaaatggcccgaacccgtcgagcagttctataggtcgctgcaggatacctacggcgctgagccagctggaccagacggcatcctggtagaggtcgatctcgtgcaggccaggctggaaagatcctccagcaaatctctagaacgcgagctcgccactcccgattgggcggaaaggcagttggctcagggaggcttggccgaggtgctactggccgctaaggagcaccgcagacccagagagacgcgcgtgattgccgttttgggtaaggctggccagggcaaatcctattgggctggcgccgtgtcccgtgcctgggcctgtggtcgattaccacagtacgacttcgtgttctctgtgccttgccattgtctgaatcggccaggcgatgcctacggtttgcaagacctgttgttctctctgggcccacagccgctcgtagctgctgatgaagtgttttctcacatcttgaagagacccgatagagtcctgttaattctggatggctttgaagagctcgaggcacaggacggctttctgcattcgacctgtggtcctgccccagctgagccatgttcactccggggcttactggcgggcctgtttcagaagaagctgttgcgcgggtgcactctgctgctgactgctaggccgcggggtcggcttgtgcaaagtctgagcaaggctgacgcactgtttgaactgagcggattcagcatggagcaggcacaggcttatgtgatgcgctatttcgaaagtagcggcatgaccgagcatcaggatagagccctaacactgttgcgagatagacctctgctgctgtcacatagccacagtcctacattgtgccgagcggtgtgtcaacttagtgaggcactgctcgagctgggggaagacgccaaactgcccagtaccctcaccggactctacgttggacttctggggagggccgcactcgactctccaccaggtgcactggccgaactggcgaagctggcatgggagctagggcggcgccaccaatccacactccaggaggatcagtttcctagtgctgacgtcagaacttgggcaatggctaaaggactcgttcagcatccgccacgcgccgcggaatcagagcttgctttcccttcgttcctgttacagtgctttttgggggccctatggctggcgctctccggggagattaaggataaagaattgcctcaatacttggccctcacaccacggaaaaaaagaccgtacgataattggctcgagggtgtcccccggtttctcgccggcctaatcttccagccacctgcgcggtgtctaggagctctgctgggaccctctgctgccgcgagcgtggacaggaaacagaaagtgctggccaggtatctgaaaagactgcagcctgggacgctgcgtgccaggcaactgctggagctcctccactgcgctcatgaagcggaggaggccggcatttggcagcacgtcgtccaagagctccctgggcgccttagctttctcggaacaagactgaccccgccagatgcccatgtgctcggcaaggcactggaagcggcaggccaggatttcagcctagacctgcggtccacgggtatctgcccctctgggttgggatctttggtcggcttgagctgtgtcacccgctttcgagccgctttatctgatacagtcgctctgtgggagtccttgcagcagcacggcgagaccaaacttctccaggccgcggaagagaagttcacaattgagcccttcaaagctaagtctctcaaagacgtggaggacctgggcaaactcgtgcagactcagcgtacacggagcagcagcgaagacaccgctggtgagctgcccgccgtcagagacttgaagaaactcgaattcgcattagggccggtgtcggggccgcaggcctttcccaagcttgtgaggattcttactgccttctctagcctacaacacctcgacctcgacgccctctcagaaaacaaaatcggagacgaaggagtgtcacaactttccgcaacttttccacaactgaagtccttggagacgctgaatctgtcccagaataatattacggatctcggggcttataagttggcagaagcattgcccagtctggccgcttccctcctgaggctctctctgtacaataactgcatttgtgacgtgggagccgagagtcttgctcgggtgctgcctgacatggtgtcccttagagtcatggacgtgcagtataataagtttacagctgcaggagctcagcaacttgctgcaagcctgaggaggtgcccgcacgtagagactttggctatgtggacccccacaattcctttttcagtgcaggaacatctgcagcagcaggactccagaatctctttacgttag

SEQ ID NO: 18918 - DNA, 1641 bp, Artificial Sequence
  Description of Artificial Sequence: Synthetic coding sequence
atgcggtgcctggccccccggcccgccggcagctacctgagcgagccacagggaagttcacagtgtgctacaatggaactgggccctctggaaggagggtacttggaactcctgaactccgacgctgacccgctgtgtctttatcacttctacgaccagatggacctcgcgggagaggaggagatcgagctatacagtgagcctgatacggacactattaactgcgatcagttcagccgactgctgtgtgatatggagggggacgaagagacgcgtgaggcttatgccaatatagccgaactcgaccaatatgtgttccaagactcgcagcttgagggtttaagtaaggatattttcaaacatattggtcctgacgaagtcattggagaatcgatggagatgccagccgaggtgggacagaaaagtcaaaagcggccattccccgaggaactaccggcagatttaaagcactggaaacccgtgcccttttccagcagcagcctcagttgcctgaacctccccgaaggaccaatacaattcgtccctacaatttctaccctcccacacggcctctggcaaatctccgaagcaggcacaggggtgagcagcatattcatttaccacggagaagtgccgcaggccagccaagtccctccacctagtggtttcacagtccacggcctcccaaccagccccgaccgccctggctcaacttctccattcgcgccctcggctaccgatctgccctctatgcccgagccagccctgacctcgagagcaaatatgaccgagcacaagacgtctccaacacagtgccccgcagctggagaggtgagtaataaactgcccaagtggcccgggctggcctggagtccttgtctcgggctgaggccttctctgcatcgagctgccctctccgatacggtcgctctttgggagtctcttcagcagcatggagaaaccaagcttctgcaggctgcggaggaaaaatttacaattgagccgtttaaggccaagtcgcttaaagacgtggaggatcttggtaaactggtgcagacacagcgaacaagatcaagttcggaggacactgctggagagctccccgccgtccgggacctgaagaagttggagttcgctttgggcccagtttccggaccccaagcgtttcccaaactcgtcaggatcctgacagcctttagcagtctccaacatctggacttagacgccttgtcggagaacaaaatcggagacgaaggtgtgtctcaattgtccgcgaccttccctcagttgaagtcattagagactcttaacctgagccagaataacataaccgatctcggtgcatataaactagctgaagctcttcctagcctggcagccagcctattaagactcagtctctacaacaactgcatctgcgatgttggagcagaaagcttagctcgagtcctgccagacatggtgtccctgagggttatggacgtgcaatataacaaatttacagcagctggagcgcaacaattggccgcatccctgcgccgctgcccccatgtggagactctagcgatgtggacgcccacaattccttttagcgttcaagagcacctacagcagcaagacagtagaattagcctccggtag

SEQ ID NO: 18919 - DNA, 2655 bp, Artificial Sequence
  Description of Artificial Sequence: Synthetic coding sequence
atgcggtgcctggccccccggcccgccggcagctacctgagcgagccacagggctctagccaatgcgccaccatggagttgggacccctggaaggaggatatctcgaactccttaatagtgacgccgacccattatgtctgtatcatttttacgatcagatggacttggccggcgaagaagaaattgaactttattccgaacccgataccgacacaatcaattgcgaccagtttagccgactgctatgcgacatggagggagacgaagagacccgagaagcatacgccaatatcgctgaattagatcaatatgtcttccaggactcccagttggaggggctgagcaaggatatcttcattgaacacattggacccgacgaagtgatcggagagtcgatggagatgcctgccgaggttgggcagaagtctcagaagagacctttcccagaagagctcccagccgaccttaagcattggaagccagtcccttttagcagcagttccttgtcgtgtctgaacttaccagagggtcccatacaatttgtgcctaccatttctacattgccacatgggctctggcagattagcgaggcaggcactggagtgagctcaatctttatataccatggggaagttcctcaagcctcacaggtgcctcccccttcaggtttcacggtccatggcctccccacatcccccgacagaccagggtccacgtcaccttttgcgccatcagccaccgacctaccctcaatgcccgaacccgcactgaccagcagagccaacatgacggaacataagacaagcccgacacaatgccccgccgctggtgaggtgagtaataaattacctaaatggcctgagcccgtggaacagttttatagaagtctgcaggatacatacggggctgaacctgccgggccggatggtattctcgttgaggtggatctggtccaggcaagactggagcggtccagctcaaagagcctggagagagagctcgcaacaccagactgggcggagagacaactggcacagggtggactcgccgaagtcctacttgcagccaaggagcacagaaggcctagagagacaagagtgatagcagttttgggaaaggcggggcagggtaaaagctattgggcaggcgctgtgtctcgtgcatgggcatgcgggagacttccccagtacgatttcgtcttctctgtgccttgccactgcctgaacagaccaggcgacgcatatgggttgcaggatctgttattttcactggggccacaaccgctagtcgctgcggacgaagttttcagccacattctgaaaaggccggaccgggttttactaattctggatggatttgaagagcttgaagcacaggacggttttctgcattccacctgcggtcctgcacctgcggagccatgttccctacggggactgctcgctgggttgttccagaaaaaactactccgcgggtgtacccttttgctcacagctcgcccccgaggtcgcctggtgcagagtttgagcaaggcagatgccctgtttgagctgagcgggttctcaatggagcaggcgcaggcatatgtgatgcgctacttcgaatcttccggtatgacagaacaccaagaccgcgcgcttacacttctcagggatcgccccctgctgctgtcgcacagccacagtcctacgctctgtagggccgtttgtcagttatccgaggctctgcttgagctcggagaagacgctaaactgccttccacactgacaggcctttatgttggcctcttggggagggctgccttggatagcccgccaggagccctcgccgaactggctaaattggcttgggagcttggccggcgccaccagtcaaccctgcaagaggatcagtttcctagcgccgacgtgcgaacttgggccatggccaaaggcctcgttcagcacccaccaagggccgccgagtcagagcttgcttttccctcatttctcctgcagtgcttcttgggcgcgctttggctggccctttctggagaaattaaagacaaggaactgccgcagtaccttgcactgacgccacggaaaaagcggccctacgataattggctggagggtgtgcctcgcttcctcgcaggtctgatttttcagcctcctgctaggtgtcttggtgcgctgctgggcccatccgcagccgcttctgttgaccgaaagcagaaagtactcgctcgatacctgaagcggctccagcctgggacactgcgcgcccgccagctgttggaactgctgcactgcgctcacgaggcagaagaggccggaatttggcagcatgtggtgcaagaacttcccggccgtctgtctttcctcggcactaggctgacaccccccgacgcacacgtgctcggcaaagctctggaggccgcaggacaggatttctccctcgatctgaggtctactggaatttgcccttctgggctgggctctcttgtgggcttatcttgcgtgacccgattccgctggggtgaagggctgggtcgggacatccttgtcttaggtataaattgcgggttgggtgctaagcctagtgccctttgggggtcatttagcatgcagagctcccgtgtgggacagaacggatttagcccatttctgaggtag

SEQ ID NO: 18920 - DNA, 1062 bp, Artificial Sequence
  Description of Artificial Sequence: Synthetic coding sequence
atgcggtgcctggccccccggcccgccggcagctacctgagcgagccgcagggcagtagccaatgtgctaccatggagcttggacctctagaggggggctacttggagctactgaacagtgacgcagacccactatgcctctatcacttttatgatcagatggatttggctggtgaggaggagatagagctgtacagcgagcctgacactgatactattaactgcgatcagttctcccggcttctttgtgacatggaaggtgacgaagaaacaagagaggcatacgccaacatcgccgaactagaccagtatgtcttccaggacagccaactggaagggctcagcaaggatatctttaagcatataggaccagacgaggtcatcggcgagtccatggaaatgcctgcagaggttggccagaagtctcagaagagacctttcccagaggagctgcccgccgaccttaagcattggaagcctgctgaaccacctaccgtggtaacaggatctctgttggtgagacccgtgtccgattgctctacactgccttgcctcccccttcccgccctgttcaaccaggaaccggccagtggacaaatgcggctggagaaaaccgatcagatacctatgccttttagttcttcttccctgtcttgcctgaacctgccagagggacccatccaattcgtgccaaccatttctaccctacctcacggactgtggcagataagtgaagccggaactggggtctcgagtatcttcatataccatggagaggtgccgcaggcctctcaagtaccccctccctccgggttcacagtgcatggtctgcctacttctccagatcggcctggatccactagtccctttgcaccatcggccaccgaccttccaagcatgcccgaacctgccctgacttcacgggctaacatgacagaacacaaaacctctcctacacagtgccccgccgcaggtgaggtctccaacaagctgcctaaatggccaggcagggaggtgccgagaaagacccaactcggctcaagtctgctatttggaacctag

SEQ ID NO: 18921 - DNA, 4332 bp, Artificial Sequence
  Description of Artificial Sequence: Synthetic coding sequence
atgtacgccgtgtacaagcaggcccacccccccaccggcctggagttttccatgtattgtaacttctttaacaattccgagcgaaacctggtagtcgcagggacttcccagctttatgtataccggcttaaccgcgatgccgaagccctcacaaagaacgatagatccacagaaggcaaagcacaccgcgaaaaacttgaattagccgccagcttttcctttttcggtaatgtgatgtcaatggcgagtgtgcagctggccggcgccaagagagatgcgctgttgctgtcatttaaggatgccaagctttccgtcgttgaatacgatccgggcacgcatgatctgaagacactcagcctccactatttcgaggagccagaactccgtgacggcttcgtccagaacgtccatactccacgcgtgagagtcgaccctgacgggaggtgtgctgccatgctggtgtacggcactcgtctggtagtgcttccctttagacgagaatccctggcagaggaacacgagggcttagtaggggaaggtcagcggagttcttttctgccatcctacattattgatgtgagagccctcgatgaaaaactgttaaatattattgacctgcaattcctgcacggatactacgagcccacactacttattctgtttgaacccaaccaaacctggccgggtcgcgtcgctgttcgccaagacacctgctccatcgtcgcgatctccctcaacattactcaaaaggtgcaccccgtgatctggtctctcacgagtctgccgtttgattgtacacaggcgctggctgttcctaagcctatcggtggcgtggttgtgtttgcggtgaacagtctcctgtaccttaaccagagcgtccccccatatggcgtggctttgaatagcctgactactggaacaaccgcgttcccactgcgaacacaggagggagtacggatcactctagactgtgcacaagctacattcatctcatatgataaaatggtgatctcccttaaggggggcgagatttatgtactgactctgattactgatggcatgcgcagtgtgcgtgcgtttcatttcgataaagcggccgcgtctgtgttaaccaccagcatggtgacgatggagcccggatatctattcttgggctcaaggctgggtaatagcctcctgctgaagtacacagagaagctgcaggaacctcctgcctctgccgtgagagaagccgctgataaggaggagccgcctagtaaaaaaaagagggtggatgccacagctgggtggtcggcagctggaaaaagtgtcccacaggatgaagtagacgagattgaggtttatggatcagaggcccaatccggcactcagctggccacctattcatttgaagtgtgtgatagcatcttgaatattgggccctgtgctaacgccgccgtgggcgagcccgcatttctgtcggaggagtttcagaacagtccagagcccgatctggaaatcgtggtttgctccggtcatggaaagaatggtgcgctctccgtcctccagaagtctatccggccacaggtggttaccaccttcgaactgccaggttgttatgacatgtggaccgtaatcgctccggtcagaaaagaggaagaagacaatccaaagggcgaaggtacggaacaagagccctccactactccagaggccgatgacgacggcagacgccatggatttctgattctgtcccgggaggactcaaccatgattctccagaccggacaagaaatcatggagctcgacacgtcggggttcgctactcaggggcctaccgtgtttgccgggaatatcggggataaccggtatatagtacaagtgagcccgcttggtatcaggctgctggagggggttaatcagttgcacttcatccctgttgatctgggggcccctatcgtccagtgtgctgttgcggacccctacgtcgtgataatgtcagccgaggggcacgtcacaatgttccttttgaagtcagactcatacggcgggagacatcatcgcctcgcgctgcacaaacccccattgcaccaccaaagcaaagtgatcaccctgtgtctttaccgcgacctgagcggtatgtttactactgagtctagacttggcggagccagggatgaactgggtggtcgaagtggtcccgaggctgagggacttgggtctgagacctctcccaccgttgatgatgaggaggagatgctgtacggagactctggttccttattctcaccttccaaagaagaagctcgtcgctccagtcagccacccgcagacagagacccagctcccttcagagccgaaccgacgcattggtgtctcctggtgagggagaacggaactatggaaatatatcagctgccagactggagactcgttttcctggttaaaaactttccggttggtcagagggtgctggtggactcttcatttggacagcctactactcagggggaggcaaggagagaggaggctacgcggcaaggagagctccctctggtgaaggaggttctgcttgtggccctgggtagccgccagtcacggccctacctgctggtgcatgtcgaccaggagctactcatctatgaggcctttcctcacgacagtcagctggggcaggggaacctgaaggtcagattcaagaaagtgccacataacatcaatttccgtgagaagaaacctaagccatcaaagaagaaggctgaggggggcggggccgaggaaggcgcaggagcacgtggtcgggtcgccaggtttcgatatttcgaggatatttacggatactcaggcgtctttatctgtggacccagcccacactggttactcgtgactgggcgtggagccctgagactgcacccaatggccatcgatggacctgtggactcattcgcgccctttcacaatgtgaattgtccacgcggcttcctgtatttcaataggcagggggaactcagaattagtgtgctgccggcttaccttagctacgacgcgccttggcctgtgagaaaaattcccctgaggtgcacggcacactacgtggcctaccacgtggagtcaaaagtctatgccgtcgccacaagcactaatactccttgcgcccgaatcccaagaatgaccggcgaagagaaagagtttgagacaatcgagcgcgacgaaagatatatacaccctcagcaagaggccttttcgatccaactgatatcacctgtatcctgggaggcaattcctaatgcccgaatagaactccaggagtgggaacacgttacttgcatgaagactgtctccctgcggtctgaggagaccgtgtcagggctgaaagggtacgtggccgctgggacctgtctcatgcagggagaagaggtgacttgccggggaaggatcctgattatggacgttatcgaagtggtgcccgagccaggccagcccctgacaaaaaacaaattcaaagtcctgtacgaaaaagagcagaaggggcccgtaactgccctgtgccactgtaatggacatctggtgagcgctataggccagaagatctttttgtggagtctgcgcgcatctgagttaactggaatggcctttatagatacccagctttacattcaccagatgatctcggtcaaaaactttattctagccgcagacgtgatgaagtccatctctctgctgagataccaggaagaatcaaagacattgtctttggtctcccgagatgccaaacctctggaggtctactccgtcgatttcatggtagataatgcacagctcgggttcttggtgtcagaccgcgatcggaatctcatggtatacatgtatctgcccgaagccaaagagtcctttggtggcatgagactcctgaggcgggccgacttccacgtgggagctcacgtcaacactttctggcggactccttgccggggagctacggagggcctgtcaaagaaatccgtggtgtgggaaaacaagcatatcacatggtttgccacacttgatggggggatcggcctgttactgcctatgcaggaaaagacgtatcgaaggctcctgatgctgcagaacgctctgacgacaatgctgcctcaccacgccggacttaatccccgagccttccgtatgctacacgttgatcgtcgcaccttgcaaaacgccgtgaggaacgtgctcgatggggaactgctgaaccgttatctctacctctcgacaatggagcggagtgaattggccaagaagattggaacaacacctgacattatcctggatgacctattagaaaccgacagagtaacggcccacttctag

SEQ ID NO: 18922 - DNA, 2349 bp, Artificial Sequence
  Description of Artificial Sequence: Synthetic coding sequence
atgaccagcatcatcaagctgaccaccctgagcggcgtgcaggaggaatccgccctctgttacctgctgcaggttgacgaatttagatttctcttggattgcgggtgggacgagcatttctctatggacataattgatagcctgcggaaacacgtgcaccaaatcgacgcagtccttctgagccaccctgatccactccacctgggagcactcccttacgctgtggggaagctggggctcaactgcgcgatctacgccacaatacccgtatacaaaatgggccagatgtttatgtacgatctgtatcagagtcggcacaatactgaggactttaccctgtttacactagacgatgtcgacgctgccttcgacaaaattcagcagctcaaattttcccagatcgttaatttgaaggggaagggacatggcctgtctattacaccacttcccgcgggtcatatgattgggggtactatctggaaaatagtcaaggacggcgaggaggagatcgtctatgccgtcgactttaaccacaaaagggagatccacctcaacggttgtagcctggaaatgttatcacgtccaagtctcctcattacagattcattcaacgccacatatgttcagcctcgccgcaaacagcgggatgagcagctgctgacaaatgttctggagactctcaggggcgatggaaacgtactgattgctgtggataccgcagggcgggtgttagaattggcccagctgctggatcagatttggcgaacgaaggacgccggcttgggcgtctactccctggcactgcttaacaacgtctcctataacgtcgttgagttttctaaaagccaggtggagtggatgtcagacaagctgatgagatgcttcgaagataagcgaaataacccattccagttcagacaccttagcctgtgtcatgggctgagtgacctggcccgcgtgccatccccaaaagtggtgctggcaagtcagcctgacctcgaatgcgggttttctcgagatctgttcatccagtggtgtcaggatcccaagaatagcataatccttacatacagaaccactcccggaaccctggcccgatttcttatcgataacccatcggagaagataacagagatcgagctgaggaagagggtcaagctggaaggtaaagaattggaagagtacctggagaaggagaagcttaagaaagaagcagccaagaaacttgaacaatcaaaggaggccgatattgactcttccgatgagagcgatattgaggaagacattgaccaaccatccgcccacaagactaaacacgatctgatgatgaaaggcgagggctcacgcaaagggtcctttttcaaacaggcaaagaagagctatcccatgtttcccgctccagaagagagaataaaatgggatgagtatggggagatcattaaaccggaggatttccttgtcccggaactccaggcgacggaggaggaaaagtcaaaattggaaagtggcttaacaaatggggacgaacccatggatcaagacttaagtgacgtgcccaccaagtgtatttctactaccgagtcaattgagattaaggcccgagtaacatacatcgattacgaaggtaggtcggatggagactctattaagaagatcattaatcagatgaagccacgacagctcattatcgtacacggccccccggaagcctcccaggatctggccgaatgctgcagggcttttggcgggaaagacatcaaggtgtacatgcccaagttacacgaaactgtggatgccaccagcgaaacccatatataccaggtgcgcctgaaagattccctggtcagtagcttgcagttttgtaaagcaaaggacgccgagctggcttggattgacggggtcttggacatgcgggtttcaaaggttgatactggcgtaattttggaggagggggaactgaaagatgatggtgaggactctgaaatgcaggtcgaagccccttccgactcttctgtcatcgctcaacagaaggcgatgaaatccctgttcggggatgatgagaaagagaccggcgaagaaagtgagattatcccaacactggaaccactgcctccgcatgaggttcctggccaccagtcagtgtttatgaacgagcctcgcctctccgacttcaaacaagtgttgcttcgcgaggggatacaagcggagttcgtcggtggcgtgcttgtgtgtaacaaccaagttgctgttagacggaccgaaaccggtcggatcgggctcgaggggtgtctgtgccaggacttctaccgcattcgcgaccttctgtatgaacagtacgcaatcgtctag

SEQ ID NO: 18923 - DNA, 243 bp, Artificial Sequence
  Description of Artificial Sequence: Synthetic coding sequence
atgaccagcatcatcaagctgaccaccctgagcggcgtgcaggaggagtccgcactttgttatcttttacaggtggacgaatttcgtttccttctcgactgtgggtgggacgagcatttcagcatggatatcattgattctcttcggaagcacgtacaccagattgatgctgtgcttctgtcccaccccgatccacttcacctgggtgctcttccctacgccgtcggcaagctcggtctgtag

SEQ ID NO: 18924 - DNA, 2055 bp, Artificial Sequence
  Description of Artificial Sequence: Synthetic coding sequence
atgagcgccatccccgccgaggagagcgaccagctgctgatccggccgctgggcgctggtcaggaggttggtcggagttgtatcatcctggagtttaagggcagaaagatcatgctcgattgtgggatccaccccgggctggaaggcatggatgccttgccctatatagatctgatcgacccggcggagatcgaccttttgctcataagccatttccacctggaccattgtggagctctgccatggttcttgcagaagacctcatttaaggggaggacctttatgacccacgcaacgaaggccatataccgctggctgctaagtgattacgtgaaagtctctaatatttccgccgatgatatgctgtacacagaaactgaccttgaagaaagcatggataaaatcgagaccattaatttccacgaggtgaaggaggtcgccgggattaaattttggtgctaccacgccggccatgtgcttggagctgctatgtttatgattgagatcgccggcgtcaaattgttatatacgggcgacttcagtaggcaggaggaccggcacttaatggcagcagagataccaaacattaaacccgatatcctcatcatcgaatcgacctacggcacacacatccatgaaaaacgagaggagcgtgaagcgcgtttctgtaacacagttcacgatatcgtaaatagaggcggcagaggcttaatccctgtattcgccttgggcagggcccaggaattattactcattttggatgaatactggcagaaccaccccgagttgcatgatatcccaatctattatgcctcctcccttgccaagaagtgcatggcagtgtatcagacctatgtaaacgccatgaacgacaagatccggaaacagatcaacattaataacccctttgtctttaagcatatttcaaacctaaagtccatggatcacttcgacgacattggcccctcagtcgtgatggccagtccaggaatgatgcagtctggcctctcccgcgagctgttcgaatcctggtgcacagataagcgtaatggcgtgatcatcgcgggatattgcgtggaaggcaccctggcaaagcatattatgagtgagccagaagaaatcacaacaatgtctgggcaaaaactcccactcaaaatgtctgttgactatatttcattctccgcccacacggactatcagcagacatcagaattcatccgggctttgaaacctccccacgttatcctggttcacggagagcaaaacgagatggcccggttgaaagccgctctgattagggagtatgaggacaacgacgaggttcacatcgaagtgcacaatccaaggaatacagaagcagtgactctgaatttccgtggagagaagttggccaaggtgatggggtttctcgccgacaaaaagccggagcaaggccaacgagtgtcaggaattctggtcaaaaggaactttaactatcacattctctcgccatgcgatctttctaattacaccgatcttgcaatgtccaccgtgaagcagacacaggctattccttataccggccctttcaatctactttgttaccagctgcagaaactgactggtgacgtggaggaactcgagatacaggagaagcccgctctcaaggttttcaaaaacattaccgtaattcaggaaccaggcatggtcgtcctcgaatggctggccaaccccagcaatgatatgtacgctgataccgttaccacagtgatcttagaggtgcagtccaacccgaaaatcagaaaaggcgccgtgcaaaaggtgtccaagaaattggagatgcacgtttactccaagcgtcttgagatcatgctgcaagacatttttggagaggactgtgtctctgttaaggacgacagcatcctgtccgtgacagtcgacggcaaaactgctaacctcaacctggagaccagaaccgttgagtgtgaggagggctctgaagacgatgaaagtttgcgggagatggtggaactcgccgcccagcggttatatgaggcccttacgcctgtgcattag

SEQ ID NO: 18925 - DNA, 1641 bp, Artificial Sequence
  Description of Artificial Sequence: Synthetic coding sequence
atgagcgccatccccgccgaggagagcgaccagctgctgatccggcctctcggagctgggcaggaagtgggtcggtcatgtatcatcctggaattcaaaggccggaaaatcatgctcgattgcggcatccacccgggtcttgaggggatggatgcactcccatatatcgacctcatcgaccccgctgaaattgacttgctgctaatatcacacttccatttagaccactgcggcgctctgccatggttcttacagaaaacgtcttttaaaggaagaacgttcatgacacacgcaaccaaagctatttataggtggctgctttcggattacgtgaaggtctccaatattagtgcagacgacatgctatataccgaaacggatttagaagagtccatggacaagatagaaacaatcaacttccacgaggtcaaagaggtcgcaggaattaaattttggtgctatcatgcaggccacgtactgggcgctgctatgttcatgatagaaatagctggagtcaagttactctacaccggggatttttctaggcaagaagatagacatctcatggctgctgaaatccccaacatcaaaccagacatattgatcatcgaaagcacatacggcacacacatacacgagaaaagggaggaaagggaagccaggttttgcaatactgtacatgatatcgttaacagaggcggccggggtctgattccggtgtttgcactcgggcgagcccaggagctgctccttattctggatgaatattggcagaatcatccagagttgcacgatatccccatctactacgcctccagtctcgccaagaagtgtatggccgtgtatcagacatacgttaacgctatgaacgataagatcaggaaacagatcaatatcaacaatccattcgtcttcaagcacattagtaatctgaaatccatggaccacttcgatgatatcggcccctcagtggtcatggcatctcccggtatgatgcagtccggactttcccgcgaactcttcgagtcctggtgcaccgataagagaaatggcgtcataatcgcaggttactgcgtggaaggcacactcgccaaaatacttgtgcatggagaacagaacgagatggcacgactgaaagcagcgctgattcgggaatacgaagataatgacgaggttcacatcgaggtgcataacccaaggaacacagaggctgtgactctgaattttcggggcgaaaagctggccaaggtcatgggattcctcgccgataagaagcccgaacaaggacagcgcgtgagtggtatcctggttaagcgaaattttaattatcacattctcagcccttgtgatctaagcaactatactgacttggcgatgtcaacagtgaaacaaactcaagccataccctatacaggacccttcaacctactgtgttatcaacttcagaaactcaccggagacgtcgaggagctcgagatccaggaaaagcccgccctgaaagtcttcaagaacattacagtcatccaagagccaggtatggtcgtcttggaatggctagctaatccttctaatgacatgtacgcggacactgtaactaccgtgatcctggaggtccagtcgaatccgaaaatcagaaagtag

SEQ ID NO: 18926 - DNA, 1221 bp, Artificial Sequence
  Description of Artificial Sequence: Synthetic coding sequence
atggccgtgtaccagacctacgtgaacgccatgaacgacaagatccgcaaacagattaacatcaacaaccccttcgtgttcaagcatatttctaaccttaaatcaatggaccactttgacgacatcggtccttccgtagttatggctagtcccggcatgatgcagagtgggctgagcagagaactgtttgagtcgtggtgcactgacaaaagaaatggtgtcatcatcgccgggtattgcgtggagggcacacttgcaaagcacattatgagcgaacccgaagagatcaccaccatgagtggtcagaagctacctttgaagatgtccgttgattatatcagcttctcagcccataccgattaccagcagaccagcgagttcattagagccttgaagccaccccacgtgattttggtgcacggtgaacagaatgagatggcgagacttaaagctgctctgattcgggaatatgaggacaacgatgaggtccacatcgaggtgcacaatcctcggaacacagaagcagtgacccttaacttccggggagagaaactggcaaaggtaatgggcttcttggccgacaaaaagcccgaacaagggcagcgtgtgtcgggaattctggtcaaaaggaacttcaactaccacattctgtctccctgcgatctgtctaattataccgacctggccatgtctacagtgaagcagacacaggccatcccctacactggcccattcaatctgctttgctatcagctgcagaaactgaccggcgatgtcgaggaactcgaaatccaagagaaacctgccttgaaggtgttcaaaaatatcactgtcattcaagagcctggtatggtcgtcctggaatggctggcaaatccttccaatgacatgtatgcggatacagtgaccaccgtcatcctggaagtgcagagtaatccaaaaatccgcaagggtgcagtgcagaaagttagcaagaagctggaaatgcatgtctacagcaagcggctggaaattatgttgcaggacatttttggagaggactgtgtaagcgtaaaggacgactctattctcagcgtgaccgttgatggaaagactgccaacttgaacttagaaacaagaactgttgagtgcgaagaaggctcagaggacgacgagagtctgagggaaatggtggaactggccgcccagcggctttacgaggccctgacacccgtgcactag

SEQ ID NO: 18927 - DNA, 1545 bp, Artificial Sequence
  Description of Artificial Sequence: Synthetic coding sequence
atgggccggcccgagagcgccggcggcggcagccggggccccttcgagggcggcggccgcgcacgtcgcgctgggggtatcttcttaaccctgtcgattctgagaactagggaccttccctcaggagcaatgagcgagggcgtcgatctgatcgatatctacgctgacgaggagtttaatcaggaccctgagttcaataatacggatcagattgatttgtacgatgacgttttgactgccacttctcagccatctgacgaccggtctagcagcactgagccacctccgcccgttagacaggagccctcccctaagccaaacaataagacaccagccatcctttatacctatagcggactccggaataggagggctgcagtgtacgttggtagcttctcctggtggactaccgatcaacagctgatacaggttattcggagcatcggggtttacgacgttgtggaactcaaatttgcagaaaaccgggcgaatggtcagagtaaagggtatgctgaagttgttgtggcgagcgaaaatagtgtccacaagctgcttgagctcctccccggtaaggttctcaatggggaaaaagtcgatgtgcgaccagccaccagacagaatttatctcagttcgaagcccaggcccgaaaaagggaatgtgttcgggtgccgcgcggcggaattcccccgcgcgcgcactcacgggattcctcggactccgccgacggccgtgctaccccttcggaaaaccttgtgccatcgagtgcaagggtggacaaacctccaagcgtgctgccatatttcaatcggccgccctcagctctaccattgatggggttacctcccccgcccatcccaccacctccccctctgtcttcaagttttggagttccaccgcccccacccggcatccactatcaacacttaatgcccccccccccgcgcctgcctcctcacctggcggttcctccccccggggccattcccccagcccttcatctcaacccagcttttttcccaccgccaaacgccaccgttgggccgccccctgatacttacatgaaggcaagcgccccttacaatcaccacggttcacgcgactccggaccacctcctagtaccgtgagcgaagctgagttcgaggatatcatgaagagaaacagagcaatctccagttcagccatctcaaaagccgtgtcaggcgctagcgccggcgactattcagatgcaatagaaactctgctcacggccattgccgtaattaagcagtcccgtgtagcaaatgacgaaagatgccgcgtcctgatctctagcctcaaagattgcctccacggtatcgaagctaaaagctatagcgtcggcgcatctggttcaagcagccggaaaaggcataggagcagggaaaggtcccctagccgaagtagggagtctagtaggcggcaccgggatctgctccataacgaggacaggcacgatgactacttccaagagcgtaaccgcgaacacgagcgccatcgagaccgtgaacgagacaggcaccattag

SEQ ID NO: 18928 - DNA, 1416 bp, Artificial Sequence
  Description of Artificial Sequence: Synthetic coding sequence
atgagcgagggcgtggacctgatcgacatctacgccgacgaggagttcaaccaagatcctgagttcaacaacactgaccagattgacttatacgacgatgttctcactgcaacttcccagccatctgatgatcgtagcagcagtactgagccccccccccctgtgaggcaggagccctcacctaagcccaataacaagacacctgccatcctatatacatattccggtttacgcaacagaagagctgctgtgtacgtagggagttttagctggtggacgacagaccagcaactgattcaggtcataagatccatcggcgtctatgatgtggttgagctcaagtttgctgaaaacagagcaaacggccaatctaaggggtatgccgaggtagtagtggcaagcgagaactctgtacataagctcttggaactcctacccggcaaggtgctgaatggtgagaaagtggatgtccgtcccgctaccaggcagaacctctcccaattcgaagcacaggctagaaaacgcgagtgcgtgcgcgtgcctaggggaggcattcctccacgtgcccacagtcgcgacagcagcgattccgccgatggccgcgctactcccagcgagaatctcgtgcctagtagcgcaagggttgacaaaccaccctcagtgctgccatatttcaaccgtccccccagcgcactccccttaatgggcctcccacctcctcccatacccccacctcctcccctttctagtagtttcggtgtgccccctcccccgcctggcatccattaccagcacctaatgccaccacctccccggctgccaccacacttggccgtgcccccccctggggcaattcccccagcactacatctgaatcccgccttttttccccccccaaacgcaacagtgggaccaccaccggatacctacatgaaagcttcagccccgtataaccaccacggctcaagggacagcggacctccccctagcacggtgagtgaagccgagttcgaagacatcatgaagcggaaccgcgccataagttccagtgccatctccaaggcagtgagcggcgcgtctgcaggggattattctgatgccatcgaaactctactcactgcaatcgcagttatcaaacagtcacgtgtggcaaacgatgagagatgccgagttctgatttcttccttaaaggactgtctccacggaattgaggctaagtcctactctgtgggagcctccggctctagctctagaaagagacaccgtagccgggaaagaagcccatcccgatctagagaaagcagccggagacacagggaccttctgcacaatgaggatcgccatgacgattactttcaggagcggaaccgggagcacgaacgccacagagatcgagagagggatagacatcactag

SEQ ID NO: 18929 - DNA, 618 bp, Artificial Sequence
  Description of Artificial Sequence: Synthetic coding sequence
atgagcgagggcgtggacctgatcgacatctacgccgacgaggagttcaaccaggacccggaattcaacaataccgaccagatcgacctctacgatgatgtgctcaccgccacctctcagccctctgatgatcgaagctccagtactgagccccccccccctgttcgccaggaaccaagtcctaaaccaaataacaaaacccccgcaatcctttatacctactccggactgcgcaatcggcgggctgcagtctacgtgggatcattctcctggtggaccactgaccaacagctcatccaagtgatcagatcaatcggtgtgtacgacgttgtggaactgaaatttgccgagaatcgcgctaacgggcaaagtaaaggttacgcggaagttgtcgtggcatcagaaaactctgtccataaactcctcgaactcctgcctgggaaagtgctgaatggcgagaaggttgacgtacgccctgccacgcgtcagaacctgagtcagttcgaggcccaggctaggaaacggatcccccccagggcccactcccgagactcatccgattctgcagacgggagggccacgccatctgaaaatctggtgccgtcttccgctaggtag

SEQ ID NO: 18930 - DNA, 1389 bp, Artificial Sequence
  Description of Artificial Sequence: Synthetic coding sequence
atgagcgagggcgtggacctgatcgacatctacgccgacgaggagtttaatcaggatccagagtttaacaacacggatcagatcgacctttacgatgatgtgctgaccgccacatctcagccatccgacgataggtcaagttccacggagccccccccccccgttcgccaagagccatcccccaagcctaacaataagacaccagcaatcctgtacacctattcaggcctgaggaatcggcgggccgctgtctacgttggctcgttctcttggtggaccacggatcagcagctgatacaggtgatcaggagcatcggcgtttacgacgtcgtggaattaaaattcgcagagaatcgggcaaacggacagtcaaaaggctacgctgaggtcgtggtggcaagcgagaatagcgtacataagctcctggaacttttgccaggcaaagtcctgaacggcgaaaaagtggacgtacggcctgctacgagacaaaatctctcccaattcgaagcgcaggcaaggaaacgcataccaccacgggcccatagccgcgactcgtctgattccgctgatgggagggcaactccctctgaaaatctagtgccgtccagtgccagagtggataagcccccctctgtgcttccttactttaatagacctccctctgcccttcctctgatgggtctgcctccacctccgatcccccccccccctccgctcagtagttcattcggggtaccccccccccctcctgggattcactaccagcacctaatgcccccaccaccccgcctgccacctcatctcgccgtgccacctccgggtgccatccccccggccctacaccttaatcccgcctttttcccccctcccaatgccaccgtcgggccgcctcccgatacatacatgaaggcttcggcgccctataaccaccatggctccagagactccggtccgccacccagcacggtatctgaagcggaattcgaagatattatgaaacggaatcgcgcaatcagttccagtgccatctcaaaagcagtgtccggtgctagcgccggggattacagcgatgctatcgagacccttctaacggctattgccgtcattaagcagtctcgtgtggctaatgacgagagatgccgggtgctgatcagctcactcaaagattgcttgcacggtattgaagcaaaatcgtattcagttggggcttcgggctcttcaagccggaagcggcacagaagtcgcgagaggagcccttcaaggtcccgagaatcatcaaggaggcatcgagacttgctgcacaacgaggaccgccatgacgattacttccaggagagaaatcgggaacatgaacgacaccgcgatagggagagggaccgtcaccactag

SEQ ID NO: 18931 - DNA, 1389 bp, Artificial Sequence
  Description of Artificial Sequence: Synthetic coding sequence
atgagcgagggcgtggacctgatcgacatctacgccgacgaggagttcaaccaggaccccgagtttaataacaccgaccagatcgatctgtacgatgacgtactaaccgcaacctctcaaccctcggatgacaggtcttccagtacagaaccgccgcctcccgtgcgacaggaaccgtccccaaaacccaacaacaaaactcctgctatactctatacgtattctggccttcgcaataggcgcgccgccgtgtatgtggggtcgttttcgtggtggacaacagaccagcaactgatacaggtgatccggtccatcggggtttacgatgtcgtcgaactaaagtttgccgagaacagggctaacggccaatcaaagggttatgccgaagtcgttgtcgcctcggagaatagtgtccacaaactgctggaactgctgccaggtaaagttttaaacggcgagaaggttgatgtgagacctgccaccaggcagaacctctcacagtttgaggctcaagctcgtaagcggatccctccccgagcacactccagagattctagcgacagtgccgatggtagggcaaccccaagcgagaacctggtgccttctagcgcgcgtgtagataagcccccaagcgtcctcccgtatttcaataggccaccatcggcactgcctctcatgggactcccgccgccccccatccctcccccgcctcccttatcctcctcatttggagttccacctccccctccgggcatccattatcaacacctcatgccgccacccccccgacttccaccacatctggcggtacccccacccggggccatcccgcctgcattgcatctcaaccctgcattttttccaccaccaaacgctactgtggggcctccacccgatacgtacatgaaagcctccgccccttataatcaccacgggtctagggactccggtccccccccatctacagtgagtgaagcggaattcgaagatattatgaaacgcaacagagccataagttcttctgccatctccaaagctgtttctggagcaagcgccggcgattactctgacgccattgaaaccctcttgacagctatcgccgtaattaagcagtctagggtggcaaatgatgagcgatgccgcgtcttaatctcctccctgaaggactgcttacacgggatagaggcaaaaagctacagtgtaggagcatccggctcctcctccaggaagcgacatcgcagcagggagcggtccccctccagatcccgcgagtcaagtcggcgtcacagggacttgttacacaatgaagatcgccacgatgactatttccaggagaggaaccgggagcatgagcggcaccgggatcgggagcgcgatcgacaccactag

SEQ ID NO: 18932 - DNA, 435 bp, Artificial Sequence
  Description of Artificial Sequence: Synthetic coding sequence
atgagcgagggcgtggacctgatcgacatctacgccgacgaggagttcaatcaggacccggagttcaataacactgaccagatagacctctatgatgacgtgttgacagcaacgagtcagcccagcgatgatagaagttcttccacagaacctccccctcctgtccgtcaagagccaagccctaaacctaacaacaagacgccggcaatcctgtatacctacagcggactcaggaatagacgagctgcagtgtacgtgggaagcttcagctggtggacaaccgaccagcaattaatccaggtcattcgcagcatcggtgtgtatgatgtcgtagaactgaaatttgcagaaaatcgggcaaacggccagtctaagggctatgcggaggtggtggtcgccagcgaaaactcagtgcacaagctcctggaactctag

SEQ ID NO: 18933 - DNA, 441 bp, Artificial Sequence
  Description of Artificial Sequence: Synthetic coding sequence
atgagcgagggcgtggacctgatcgacatctacgccgacgaggagtttaaccaggacccagagttcaacaacacggaccagattgatctatatgatgacgtgttgacggcaacatcccagccctccgatgaccggtcttcctctaccgagccccctccacctgtgaggcaagagcctagccccaaacccaataacaaaacgccagccatcctttacacatattcaggcctgcgcaatcgccgggctgctgtgtacgtgggttcttttagctggtggacaaccgaccagcagctgattcaggtgatccgctccatcggagtgtatgatgtggttgagctcaaatttgccgagaatcgagcgaacggccaatccaaaggctatgctgaggtcgtggttgctagcgagaatagtgtccataagctgcttgagctgctcccctag

SEQ ID NO: 18934 - DNA, 867 bp, Artificial Sequence
  Description of Artificial Sequence: Synthetic coding sequence
atgagcgagggcgtggacctgatcgacatctacgccgacgaggagttcaaccaggacccagaattcaacaacaccgaccagattgacctctacgacgacgtgctcactgcaacctcccagccttcagacgaccgcagttcctctaccgaacccccgcccccagtccgtcaagaacccagccccaaacccaacaataaaacacctgccattctatacacctatagtggtctccggaaccggcgcgccgcggtgtatgtggggtctttctcttggtggacaacggaccagcagctcatacaagtaatcagatcaattggcgtgtacgacgtagtggagttgaagtttgctgaaaatagggcaaatggacaaagtaaaggctacgctgaggtggtagtagcctctgaaaactctgtgcacaaactccttgagctgctgcccgggaaggttctcaacggggagaaggtggacgtgagaccagccacccggcagaacctttctcagtttgaggctcaggctagaaaaagaatcccgccgagagcccactcccgggattcatctgactctgccgacggtagggccacgcccagcgaaaacctggtcccctccagcgcaagggtggataagcctccaagcgtcctcccatattttaaccggccccctagcgccctccctcttatggggctgccacctccacctattccgcccccacctcccttaagctcctcttttggagtgcctccacctccaccgggcatccattatcagcatctgatgccaccccctccaagactgcccccgcaccttgcagttccaccacccggagctattccccccgctctgcatctgaacccagcattttttccctag

SEQ ID NO: 18935 - DNA, 3162 bp, Artificial Sequence
  Description of Artificial Sequence: Synthetic coding sequence
atgagccggcggaagcaggccaagccccagcacatcaacagcgaggaggaccagggagaacaacagccccaacagcagactcccgaatttgctgatgccgcccctgctgcccctgctgccggtgagctgggtgctcctgtaaaccaccccggtaacgacgaagttgcttctgaggacgaagccacggtcaagcggcttcgcagagaggagacccatgtctgtgagaagtgttgcgccgaattttttagtatatctgaatttctggaacataaaaagaactgcacgaaaaatcctccggtgctgatcatgaacgactccgaaggaccagtgccaagcgaggatttttctggagcggttctatcccatcaacctacctctcctggctccaaagactgccatcgagaaaatggtggcagtagtgaagacatgaaggaaaagccagacgccgagagtgtggtgtacttaaagactgagaccgccttaccgcccactcctcaggacatctcttatctagcaaaggggaaagtggccaatactaacgttaccctgcaggcactcagaggtactaaggtggcagtcaaccagaggtcggcggacgcactgcccgccccggttcctggggccaactctattccctgggtactagagcagatactgtgcctccaacagcaacagctccagcagatccaacttaccgaacagatcagaatccaagtaaacatgtgggcgtcccatgcgctccattcttcaggggcgggggccgatacactgaagacattagggtcccacatgagccagcaagtgtcagccgccgtggccctgctgagtcagaaagctggctcccagggccttagccttgacgctctcaaacaagcaaagttacctcacgcaaatatcccgagtgcaacctcaagcctgtctcccggcctggcaccatttacgctgaaacctgatgggactagggtgctgcccaacgtcatgtcacgcctccccagcgctctgctgccccaggcccctgggtctgttctgttccagtctccgttcagcacagtggccttagataccagtaaaaagggcaaaggaaaaccgcccaatataagcgctgtcgatgtgaaaccaaaagatgaagccgccctgtataagcacaaatgcaagtactgtagtaaggtcttcggcacagacagttctctgcaaattcatctgagaagccatacaggcgagcgtcctttcgtgtgtagtgtttgcggtcacaggttcacaaccaaagggaatttgaaagtacactttcataggcacccccaggtgaaagccaatccgcagctctttgccgagttccaagacaaggtcgccgctggaaatggaattccgtacgcactgtccgttcctgaccctatcgatgagccatctttgagccttgacagcaaaccggtgttagtcaccacctccgtcggactgccccaaaatctgtcctccggcacaaatcctaaggatttgacagggggctccttgcccggggacctgcagcccggccctagcccagaaagcgagggtgggcctactttgcctggagtgggtcctaactataactcaccgagggccggcgggtttcaaggctctggtacgcctgagcccggttcagagacgcttaagctccagcagctggtggagaacatcgacaaagccactacagatcctaacgaatgcctgatctgtcaccgggtgctgtcttgtcagtcttccctgaagatgcactaccggacgcatactggcgagcgccctttccagtgcaaaatatgcggaagagccttctccaccaaaggtaatctgaaaactcatcttggcgttcacagaacaaacaccagtatcaagacccagcattcctgccccatctgtcagaagaagttcactaacgccgtcatgctgcagcagcacattagaatgcatatgggtggacagatccctaacacccctctccccgagaatccctgtgacttcacaggatcagagcctatgacagtcggagaaaatggttccacaggagccatctgccatgatgacgtgattgagtctatcgatgtcgaggaggtatcatctcaggaggcacctagctcaagttccaaggtacccacacccctaccaagtattcactctgcctcaccgacacttggcttcgccatgatggcctccctggatgctccaggcaaggtcggtccggccccattcaacctccagaggcagggctctagggagaacggcagtgtagaatccgacgggttgactaacgacagtagctcattgatgggagaccaagaataccaatcaaggtccccggacattctggagaccacatcttttcaggctctgtcacctgccaacagccaggctgagtcaatcaagtctaaaagccctgacgcagggtcaaaggccgagagtagtgagaactccaggacagagatggagggccggtcctctttgccctctaccttcattagagctccgccgacatatgttaaagtcgaggttccagggacatttgtcggacccagtactctgagccccggcatgactccacttctggcagcacagccacgcaggcaagccaaacaacacgggtgtactaggtgcggaaagaatttctcaagcgcctccgcgctgcagatccatgagagaactcatacgggagaaaaaccttttgtgtgcaatatctgcggtagagcttttacgactaaggggaacctgaaggttcactacatgacccacggggcaaacaacaactcagcacgccgagggcggaaactggcgattgaaaataccatggccctgttggggacagatggtaaaagggtgagcgaaatctttccaaaagagattctcgcacccagtgtgaacgtggacccagtggtgtggaaccagtacacttccatgctgaacggcgggctggcagtgaagacaaatgaaatatctgtgattcagtccggtggtgttcccacccttcccgtgtcccttggggctacgtctgttgtgaataacgccaccgtctctaaaatggatgggagccagtccggaataagcgccgacgttgagaagcccagcgccacggatggagtgcctaagcatcagtttccgcattttctcgaagaaaacaagatagccgtgtcgtag

SEQ ID NO: 18936 - DNA, 1038 bp, Artificial Sequence
  Description of Artificial Sequence: Synthetic coding sequence
atgtaccggaccaaggtgggcctgaaggaccggcagcagctgtacaaactgatcattagtcagctgctctacgacggctatattagcattgcaaatggcctcatcaatgaaatcaagccacagtcagtatgcgcacccagtgagcagctccttcatctgattaaactcggcatggagaacgatgacacggcagtccaatacgccatcggtcggagcgacaccgtcgccccaggaacagggatcgatctggagtttgatgccgacgtgcagactatgtctcccgaagcttcagagtatgaaacttgttatgtcaccagtcacaagggcccatgcagggttgctacatacagccgtgacgggcaattgattgccacggggtccgcagatgcgagtattaagatcctggacactgaaagaatgctggctaaaagcgcaatgcccatagaggtgatgatgaatgagacggctcagcaaaatatggaaaaccacccagtcattaggactctgtacgatcacgtggatgaagtgacatgcctcgcctttcatcccaccgagcagattttggcctccggatctcgcgattacacactgaaattgttcgattatagtaaacccagcgcaaagcgcgccttcaagtatattcaagaggccgagatgttgagatcaatcagttttcatccttctggggacttcatactcgtggggacacaacacccgacactaaggctttacgatatcaatacttttcagtgtttcgtctcatgcaaccctcaggaccaacacactgatgccatctgcagtgtgaactacaatagcagcgcaaacatgtatgtcacaggttcaaaggacggatgtataaaactgtgggatggagtgtcaaatcgatgtattacgacattcgagaaagctcatgacggggccgaggtgtgtagcgctattttctctaaaaactcgaaatatatcctcagtagcggaaaggacagcgtagcaaagctttgggaaatctctaccggcaggaccttggtaagatacacctag

SEQ ID NO: 18937 - DNA, 1257 bp, Artificial Sequence
  Description of Artificial Sequence: Synthetic coding sequence
atgtaccggctgatcatcagccagctgctgtacgacggctacatctctattgccaatggcctgataaacgaaatcaagcctcaatccgtgtgtgcgccgagcgagcagctgctccatttgatcaaattggggatggaaaacgacgacactgcggtgcagtatgcgatcggcaggtccgataccgttgcacctgggacaggtatcgatctggagtttgacgccgacgtacagactatgtccccggaagcctcggagtatgagacttgttatgtgacctcacacaagggtccatgtagagtggccacatattctagggatgggcagctaatagccactggctctgcagatgcgtctatcaaaattttggatactgagaggatgctcgcaaaatcagcaatgcctatcgaagtgatgatgaatgaaaccgcacagcaaaacatggagaaccatcccgtgatcagaactttgtacgatcacgtcgatgaagtgacatgtctcgcttttcacccgacagagcagatactagcttctggctcgagggactacacacttaagctgtttgactattctaaaccatcagcgaaacgagcattcaaatacatacaggaggcagaaatgctccgcagtatctcgttccacccaagcggtgactttattctggtcggaacccaacacccaactcttcgcttgtatgatatcaacacattccagtgttttgtttcttgtaatccccaagaccagcacacggacgccatatgctctgtcaattataattcaagcgctaatatgtacgtcaccggttccaaggacgggtgtatcaaactatgggatggcgtgagcaaccggtgtattactacgttcgaaaaagcccacgacggggcagaggtctgttcagcaatctttagcaaaaactccaaatacatactgtcttcagggaaggattccgtggcgaaactgtgggaaatttcaactggcagaaccctggtgcgatacactggcgccgggctctcgggtcggcaggtccatcgaacacaggccgtctttaaccacaccgaagactacgtgctgctccccgatgagagaacaatatccctgtgctgttgggatagtagaacagccgagcgaaggaatctgctgtccctgggacataacaatattgttcggtgtatcgtgcattcacctaccaatcctggcttcatgacttgcagcgatgacttcagagcccggttttggtacaggcggagcactacagactag

SEQ ID NO: 18938 - DNA, 429 bp, Artificial Sequence
  Description of Artificial Sequence: Synthetic coding sequence
atgtaccggaccaaggtgggcctgaaggaccggcagcagctgtacaaactgatcatttcacagctattgtacgacggctacatcagtatcgccaacggcctgattaatgagatcaagccccagagcgtgtgcgcgccttctgagcagctgctgcacctgatcaagctaggcatggaaaacgatgatactgcagttcaatacgcaattggacgctccgacaccgtggccccaggcaccggcatcgatcttgagttcgacgccgacgtacagaccatgagccctgaagccagcgaatacgaaacatgttatgttacttctcataagggtccatgtcgagtggccacgtattccagagacgggcagctcatcgcgacggggagtgccgatgcttcaatcaaaattctggacaccgagcgcatgctagcctag

SEQ ID NO: 18939 - DNA, 1038 bp, Artificial Sequence
  Description of Artificial Sequence: Synthetic coding sequence
atgtaccggaccaaggtgggcctgaaggaccggcagcagctgtacaagctcatcatctctcagctcctgtatgatgggtacattagtatagcaaacgggctgattaacgaaattaagccccagagcgtatgtgcccctagcgaacagcttttacacttgatcaagctcgggatggaaaacgatgacacagctgtgcaatatgcgattggccggagcgataccgtcgcacccggtactggcatcgatcttgagttcgacgcggacgtccagactatgtctccagaggcttctgaatatgagacctgctacgtaacaagccacaagggcccatgcagggtggcaacctactcccgtgatggccagctaatcgccaccgggtccgccgatgctagcattaaaatcctggataccgagcggatgttagccaagagcgccatgcccatcgaggttatgatgaacgagaccgctcagcagaatatggagaatcatcctgtgattaggaccctgtacgatcatgtcgacgaagtgacatgcctggcctttcaccccactgaacagatcctcgctagcgggtccagggattatactcttaaactgtttgactattctaagccaagcgccaagagagccttcaagtacattcaagaggccgaaatgctgagaagcatttcatttcacccatctggcgacttcatcctggtcggcacacagcacccgacccttagactgtacgatatcaacacattccagtgcttcgtgagctgcaatccgcaggatcagcacacagatgccatttgcagcgtgaactacaactcctcagccaacatgtatgtgacaggttccaaagacggctgtatcaagttgtgggatggggtgagcaacaggtgtataacaaccttcgaaaaggcacatgatggtgctgaggtgtgtagcgctatcttctccaagaactcaaaatatatcctgtcatccggtaaagattcagtcgcaaagctctgggaaatcagtacgggtcggaccttggtgcgttacacctag

SEQ ID NO: 18940 - DNA, 1734 bp, Artificial Sequence
  Description of Artificial Sequence: Synthetic coding sequence
atggccggcctgaccgtgcgggaccccgccgtggaccggagcctgaggtccgtgttcgttggcaacatcccctacgaggcaacagaagagcagctcaaggatattttttctgaggtcggcccagtcgtgtcttttcgcctcgtatacgatagggagacggggaagcccaagggatatgggttttgtgagtatcaggatcaggagacagcgctgagtgcgatgagaaacctcaatggacgcgagtttagtggccgagcgctgagggtcgacaacgcggccagtgagaaaaataaagaagaactgaagagcttaggcaccggtgccccggtcatagaatccccttacggagagacaatctcgcccgaagacgcgccagagagcattagcaaagccgtggcatcattgccacccgagcagatgttcgagttgatgaagcagatgaagttgtgcgtccagaatagcccacaggaagcaagaaacatgctcctacagaacccccaactggcttatgccctgctgcaggcacaagttgtgatgcggatcgtggatccagagatcgcacttaagattctgcatagacagaccaacattccaaccctgatcgctggtaatcctcagcccgtgcacggcgcaggtcccggaagcggtagtaatgtatctatgaaccagcagaaccctcaagctccgcaagcccagagtctgggcggtatgcatgtgaacggcgctccaccccttatgcaggcaagcatgcagggcggagtccctgcacccggccagatgccggctgctgtgaccggtcccgggcccggtagtctggccccaggaggcgggatgcaagctcaggtaggcatgcccggaagcggtcctgtctccatggaacgaggacaggtgcctatgcaggatcctagagcagcaatgcaaagaggttccctcccagccaatgttcccacccctagggggctgcttggcgatgcacctaacgacccaagaggagggactctgttaagtgttaccggcgaggtggagccccgaggttacctgggcccaccccatcagggacccccaatgcaccacgtaccagggcacgagagccgcggacctccgcctcacgagctgaggggtggccccttgcccgaaccaagaccactgatggctgagcccaggggaccaatgttggatcagaggggtccccccctcgacggacggggaggccgcgacccacgtggtatcgatgcacgaggaatggaggctagagccatggaagcgcggggactggacgcacgagggctagaagcccgtgccatggaagctcgcgctatggaggcccgggccatggaggcccgagccatggaagcaagggccatggaagttcggggtatggaggcgagaggcatggacactaggggccccgttcccggaccccgtggccccattccaagcggtatgcaagggcccagccctattaacatgggggccgtggtgccccaagggagcagacaggtacccgtgatgcagggaacgggcatgcagggagcttcaatccagggggggagtcagcctggaggatttagtcccggacagaatcaggtgacacctcaagaccatgagaaagcagcattgattatgcaggtgctgcagttaaccgccgatcagatcgcaatgctacccccagagcaaaggcaatctattttaatcctcaaggagcagatacaaaaatctacaggggccccgtag

SEQ ID NO: 18941 - DNA, 1662 bp, Artificial Sequence
  Description of Artificial Sequence: Synthetic coding sequence
atggccggcctgaccgtgcgggaccccgccgtggaccggagcctgcgcagcgtgttcgtgggcaacatcccctatgaggctacggaggaacaactcaaggatatttttagcgaggtgggaccagttgtcagctttcggttagtctacgatagggagactggcaaacctaaagggtacggcttttgtgagtatcaggatcaggagaccgcactgagcgccatgagaaatctgaatggcagagagttcagcggccgagccctgagagttgacaatgccgcttctgagaaaaacaaggaggaactgaaatcgctcggcactggagcccccgtgatagaaagcccatacggggagacaattagccccgaagatgcacccgagtctatttctaaagccgtcgccagcctgcctcccgagcagatgttcgaactgatgaagcagatgaaattgtgtgtacagaacagcccccaagaggcacgaaacatgttattgcagaatccccagctggcctatgccttgcttcaagcccaggtggtgatgcggattgtggatccagaaatagccctgaagatcctgcatcgtcagactaatataccaactctgatcgccggcaatccccaggcacagtcgctgggaggaatgcatgttaatggcgcccccccactgatgcaggccagcatgcagggcggagtgcctgccccaggacagatgcctgccgccgtcacaggtccgggcccaggcagcctcgcacccggaggcgggatgcaggcccaggtggggatgcctgggagcggtcctgtgagcatggagagaggacaggtcccaatgcaggatccgagggcagcaatgcagcgcggctcactacccgctaacgtccctaccccgaggggacttctcggcgacgctccaaatgatcccagaggaggaactctgctgagcgttacaggcgaggttgaaccaagaggttatctggggccaccacaccagggtccccctatgcaccacgtgcctggtcacgagagtagaggcccaccaccccacgagcttcgcggcgggcctctcccagagcccagacccctgatggccgagccgcgggggccgatgctcgaccagcgcgggcctccactggatggccgcgggggtagagacccccggggcattgatgccagggggatggaggcccgggccatggaggcaagaggcctcgacgcccgaggcctggaggctcgcgccatggaagccagagcgatggaggctcgcgccatggaggcccgcgcaatggaagcacgggctatggaagtgcgaggaatggaggcccgcgggatggacacccgaggccccgtgcccggaccacgggggccaatcccgtccggcatgcaaggaccatcccccatcaatatgggcgcagttgtgccccagggaagtcgccaggtgcccgtgatgcagggaactggcatgcagggggccagcattcagggggggtcacagccaggtggtttcagtcccgggcaaaatcaagtgacccctcaggatcatgaaaaagctgcactaattatgcaagttcttcagctcaccgcagatcagatcgctatgcttcctcctgaacaaagacagagcatcctgatcttgaaagagcagattcagaaatccaccggcgccccatag

SEQ ID NO: 18942 - DNA, 2154 bp, Artificial Sequence
  Description of Artificial Sequence: Synthetic coding sequence
atgagcggcgacggcgccaccgagcaggccgccgagtacgtgcccgaaaaagtgaaaaaggcggaaaaaaagttggaggaaaatccctatgatctggatgcatggagtatactcatccgagaggcccagaatcagccaatagataaggctaggaaaacttatgaacgtcttgtcgcacaattcccctccagcggtcgcttttggaagctctatattgaggcagaaatcaaagcaaagaattacgataaagtagagaagctgttccagagatgtttgatgaaggttctccatatcgatctctggaagtgttacctatcttacgttcgggaaaccaaaggcaagttgcccagctacaaagaaaaaatggctcaggcctacgatttcgcgctcgataagattggaatggagatcatgagttatcagatatgggtcgactatattaatttcctgaagggcgttgaagccgtcgggagttacgctgaaaatcagcgaattaccgccgtaagacgggtgtaccagcggggctgcgttaaccccatgatcaacattgagcagctgtggcgggactacaataagtacgaagagggtattaatatccacctggcaaagaagatgatcgaggacagatcccgtgattacatgaacgcacggcgtgtggctaaggagtatgagacggtaatgaaggggctggaccggaacgctccatcggttccgccacagaataccccacaggaagcacagcaggtcgacatgtggaagaaatatattcagtgggaaaaatccaatccccttcgaacagaggatcagacattaattacaaaacgtgtcatgttcgcctacgaacagtgtctgctcgtgctcgggcaccacccagatatttggtacgaagccgcccagtacctcgaacagtcaagtaagttgctggctgagaagggggacatgaataatgcgaagttgttctcggatgaagctgctaatatctacgagagagcaatctccactttgctcaagaaaaacatgctcctgtattttgcctacgccgactatgaagaatcacgcatgaaatacgaaaaagttcatagcatatataacaggctgctcgccattgaagacattgaccctacactggtgtatatccagtacatgaagtttgctagacgggccgaaggtatcaaatcagggagaatgatctttaaaaaggctagagaagataccaggacacggcaccatgtgtatgtgaccgcagcactgatggaatattactgttccaaagacaagagtgtggcgtttaagattttcgagttgggcctcaagaagtacggagacatccccgaatatgtgctagcctacattgattatttgagtcacctgaatgaagacaataataccagagttctttttgagcgcgtcctgactagcggctctttacccccagaaaagtcgggagagatttgggcaaggtttctcgccttcgaatctaacatcggtgacttggcctcaattctgaaagttgaaaaaaggagatttacggctttcaaggaagagtacgaagggaaagaaaccgcgcttctcgtagacagatataagttcatggatctctatccttgctccgctagcgaattgaaggctttgggctataaggacgtgtctagagcaaaattggctgctatcatccccgaccccgtggttgcacccagcatcgttccagtgctgaaggacgaagtggatcggaagccagaataccccaagccggatacgcaacagatgataccgtttcaacccagacacttagcaccacccgggcttcatccggttcccggtggcgtgtttcccgtgccccccgccgcagtcgtgctgatgaagttgcttcccccccctatctgctttcaaggcccattcgtacaggtcgacgagcttatggagattttcaggcggtgcaaaatcccaaatacagttgaagaggctgtccggataattaccggcggggcacccgagctggccgtggaagggaatggtcccgtcgaaagtaatgctgttttgacgaaagctgtgaaacggcccaatgaggactccgatgaggatgaggaaaagggtgctgtggtcccgccagtgcacgacatctacagggccaggcagcagaaaagaattcgttag

SEQ ID NO: 18943 - DNA, 135 bp, Artificial Sequence
  Description of Artificial Sequence: Synthetic coding sequence
atgagcggcgacggcgccaccgagcaggccgccgagtacgtgcccgaaaaggtcaagaaggccgagaaaaagctggaggagaatccctacgaccttgacgcctggtcgatccttatcagagaagcacaagtctag

SEQ ID NO: 18944 - DNA, 312 bp, Artificial Sequence
  Description of Artificial Sequence: Synthetic coding sequence
atgagcggcgacggcgccaccgagcaggccgccgagtacgtgcccgagaaggtgaaaaaagcagaaaagaagctggaggagaacccgtatgacctcgacgcttggtcgatcctgattcgcgaagcccagaatcaacctatcgacaaagcccgaaagacctacgagcgactggtggctcagtttccctccagcgggagattctggaaactgtacatcgaggccgaagttacaatcctcttttactttttcctgtatcagtattgctccatccactgtagtgatcgaaaacaggtgagaaatattgcaaattag

SEQ ID NO: 18945 - DNA, 186 bp, Artificial Sequence
  Description of Artificial Sequence: Synthetic coding sequence
atgagcggcgacggcgccaccgagcaggccgccgagtacgtgcccgaaaaggtgaagaaagcagagaaaaaactggaggagaatccctatgatctcgacgcttggagcattttaatccgggaggcccagaatcaaccaatcgataaggctcgcaaaacctacgagagactggtggctcaattttag

SEQ ID NO: 18946 - DNA, 1953 bp, Artificial Sequence
  Description of Artificial Sequence: Synthetic coding sequence
atgaccctgatgctgggcgcccagatcaaggccaagaactacgacaaggtcgaaaagttattccagcgatgtctgatgaaagtgctacacatcgacctgtggaagtgctatttgagctatgtcagggaaacaaaaggcaagcttccgagctataaagaaaagatggcccaagcatatgacttcgccttggacaaaatcggtatggaaatcatgtcctatcagatctgggtggactatattaatttcctaaagggagtggaggccgtgggtagttacgccgaaaaccagcgcatcaccgcagtgaggagggtgtatcaacgcggatgcgttaatccgatgattaacattgagcagttatggagggactataataagtatgaggagggaatcaacatacatctggcgaagaaaatgattgaggacagatcaagggattatatgaacgcgagacgtgtcgcaaaggaatacgagacagttatgaagggcctcgatcggaatgccccatccgtcccaccccagaacactccccaggaggctcagcaggtggatatgtggaagaagtacattcagtgggagaagtctaacccacttcgtaccgaggatcaaactttaattaccaaaagagtgatgttcgcctacgaacagtgcctcctcgttctggggcatcatcccgatatctggtatgaggctgcgcagtacctggagcagagcagtaaattactagcggagaagggcgatatgaataatgccaagctcttttccgacgaagccgcaaatatatacgagcgggccatatccactctgttgaagaaaaacatgctgttgtatttcgcctacgctgactacgaagagtctagaatgaaatatgaaaaagtccatagcatatacaataggctgctagcaatcgaggacattgaccctacgctggtgtacatccagtatatgaagtttgcccgcagagctgagggcattaaatcagggcgcatgattttcaagaaggcaagggaagatacaaggaccaggcatcatgtttacgttactgcagccctgatggagtactattgctcaaaggataagagtgtcgcttttaaaatttttgagctgggactgaagaagtacggtgacattccggaatatgtgcttgcctatattgattatcttagtcacctgaacgaggacaacaatacccgtgtgttgtttgaacgggtcctcaccagtggctcccttccgccagagaagagcggagagatatgggccaggtttttggcctttgaatctaacattggcgatctggccagcatactgaaggtggaaaaaaggcgcttcacagcctttaaagaggagtacgagggcaaagagacggccctgctggtagaccggtacaaattcatggacctgtacccatgttctgccagcgaactcaaggcattgggctataaagatgtgagccgggctaagctggccgctatcatccccgatccggtggttgcgccttctattgtgcctgttctcaaggacgaggtggaccggaagcctgagtacccgaaacctgatactcagcagatgatccctttccagccccggcacctcgccccccccggtttgcatcccgttcccggcggggtatttccagtccctcccgccgccgtggtcttaatgaagttgctgcccccccccatttgtttccagggacccttcgtgcaggtggatgagttaatggagattttcagaagatgtaagatcccaaacacagttgaggaagctgtgaggattataaccggcggtgcccctgagctcgctgttgaggggaacggtcctgttgagtccaatgctgtactgaccaaagccgttaaaaggcccaatgaagatagcgatgaggatgaggaaaagggggcagtggttcccccagtccatgatatctaccgagcgcgccagcagaaaaggatacgctag

SEQ ID NO: 18947 - DNA, 1740 bp, Artificial Sequence
  Description of Artificial Sequence: Synthetic coding sequence
atgctgcggagcggccccgccagcggccccagcgtgcccaccggcagggctatgccctccagaagagtggctcgaccccccgctgcccccgagctcggcgccctggggtcaccagacctgagcagcttgtccttggccgtaagcaggagcacggacgagctggagatcatcgatgagtacatcaaggagaatggcttcggtctggacggcggtcaacctggcccgggagaaggactcccccggctagtgtccagaggagccgcttccttaagtactgtgacacttggccctgtggcccctcccgcgacgcctcccccttggggctgccctctaggacggctcgtctcacccgctccaggaccaggaccccagccccacctggtgatcacggagcagcccaagcaaaggggtatgagatttcgctacgaatgcgaaggtaggtctgctggatccatattaggggaaagttctacggaggcgagcaaaactttgcccgccattgagctcagggactgcggcgggctcagggaagtggaggtcacagcctgcttagtgtggaaggattggccacatcgcgtgcatccacactctctggtgggaaaagattgtaccgatgggatttgtcgggtgcggcttcggccccacgtaagccccagacatagcttcaataacctgggcatacagtgcgtgcggaaaaaggaaattgaggccgctatcgagagaaagatccagcttgggatagatccgtataatgccggatctctgaagaaccaccaggaagtggacatgaacgtagtaaggatctgctttcaggcgagttacagagatcaacagggccagatgcgtaggatggacccagtactgtctgagcctgtctatgataaaaaatccacaaatacttctgagctgcggatctgtagaatcaacaaagaatccggtccttgcacagggggagaagaactgtacctgctgtgtgataaagtgcagaaagaggatatcagcgttgtgttttcaagggccagctgggagggccgagcggactttagccaggcagacgtgcacaggcaaatcgccattgtgttcaagacccctccttacgaagacctcgaaattgttgaacctgtgacagtcaacgtgttcctgcagcggctgacggatggagtttgttctgagccattaccattcacatacctgccccgagaccatgatagttacggggtggacaaaaagagaaagagggggatgcctgacgtgttgggcgagctgaattcatcggacccacacggcatcgaatctaaaaggagaaaaaaaaaacccgcaatcctggaccacttcctgcctaaccatggctcgggaccttttctcccaccatctgccctcctcccagatcccgatttctttagcggtaccgtctcgctgcccggacttgaacctcctggcgggcctgacctgctggatgatggctttgcttatgacccaaccgctccaacactttttacgatgttggacttgctgccgcccgcccctccccacgcctcagctgtagtctgctccgggggagccggggcagtcgtgggcgaaaccccggggcccgagcctctcactctggacagctatcaggctcccgggccgggcgatgggggcacagcaagcttagttggctccaacatgttcccaaatcactatcgcgaggccgccttcggtggaggcttgctaagccccggcccagaagcaacatag

SEQ ID NO: 18948 - DNA, 1785 bp, Artificial Sequence
  Description of Artificial Sequence: Synthetic coding sequence
atgtggcacgaggcccggaagcacgagcggaagctgcggggcatgatggttgactacaaaaagcgggccgaaaggaggcgggagtactatgaaaagatcaaaaaagacccggcccagtttctccaggtgcatggcagagcatgcaaagtccatctggacagcgctgtggccttggcagcagagtcccccgtcaacatgatgccttggcagggagatactaacaacatgatcgatagatttgacgttcgtgcccatctcgaccacatacccgactatacacccccgctcctgaccacaattagtcccgaacaagaatccgacgagcggaagtgtaactacgaacggtaccgagggctcgtccagaacgacttcgctggcattagcgaggagcagtgcttgtaccagatctacatcgacgagctgtacggagggctccagaggcctagcgaagacgaaaaaaagaagctggccgagaagaaagcatctattggctacacctacgaggactccaccgttgcaaaggtggaaaaggccgcggagaagcccgaggaagaggaaagtgccgcagaagaggagagcaatagcgatgaggacgaggtcattcccgatatcgacgtcgaagtcgatgtcgatgagctcaatcaggagcaggtggcagatctgaacaaacaggctactacatatggtatggccgacggtgactttgtgaggatgttgaggaaggacaaagaagaggccgaagccattaagcatgctaaggcccttgaggaagagaaagccatgtacagcggccgacgcagcagacggcagcggcgagagttccgcgagaagcgcctcagaggccggaaaataagtcccccctcctatgcccggagagatagcccaacctatgatccctataaacgctctcctagtgagtcttcttccgaaagccgctccaggagccgcagccctacacctggccgggaggagaagatcacctttatcaccagctttggcgggagcgatgaagaagcagcggcggctgctgcagccgccgccgcttcaggagtgacgaccggtaagccgccagcacctcctcaacctggcgggcctgcgcccggccggaacgctagtgcgcggcgccgttcctcatcaagctccagctcttcaagcgcaagccgcacaagcagttctcgctctagcagccgctcttctagccgttccaggcggggaggaggctattacaggagcggccggcacgcacggagcagatcaaggagttggagcagatctcggagcaggagccgcaggtacagcagaagtaggtctaggggaagacgacactctggtgggggcagcagagacggacacagatattccaggtcgcctgcgaggcggggtggatatggtcctagacggagatccagaagccgcagccacagtggcgacaggtatcgccgcggtgggaggggtttaagacaccatagttctagccgtagtcggtcatcgtggtctctaagcccttcccgctcacgctctctcaccagatcacgttcacacagtccctccccatctcagtcaagatcaaggtcgaggtccaggtcgcaatcacccagccctagcccagcacgcgagaagttaacacgccctgccgccagtccagcagttggagaaaaactaaagaagactgaaccagcagctggcaaagaaaccggtgctgccaaggtgacgcaggcagacgcctctggagaagcggagaccgaagacgccgagggagcggaacaagcagtccaaggcggctag

SEQ ID NO: 18949 - DNA, 1839 bp, Artificial Sequence
  Description of Artificial Sequence: Synthetic coding sequence
atgtggcacgaggcccggaagcacgagcggaagctgcggggcatgatggtcgattacaagaaacgagcagagcgccgacgggagtactatgagaagattaagaaggatcctgcccagttcttgcaggagtctgacgagcggaaatgcaattacgaacggtatagaggcctggtgcagaatgactttgcagggatttccgaggaacaatgcctttatcagatatatattgacgagctctatggcggcctgcagagaccgagcgaagatgagaagaaaaagctcgctgagaagaaagccagtatcggttatacgtatgaagattccaccgtagccaaagttgagaaagcagcagagaaacccgaggaagaagagagtgccgcggaggaagaatcaaacagtgacgaggacgaggtgatacccgatatcgacgtggaagtggatgtcgatgaacttaaccaggaacaggttgccgaccttaataagcaggctacaacttacggaatggcagatggagacttcgtccgtatgctgagaaaagataaggaggaagctgaggccatcaagcatgccaaggcgctcgaagaggagaaagccatgtattctgggcgccgttctcggcgtcaaaggcgcgaattcagggaaaaaaggctgaggggtcggaagatctccccaccatcttatgctaggcgcgattctcccacttatgacccctataagcgcagccctagcgagtcgagctccgagagtagatcgagaagccggagtcctacacctgggagggaagagaagatcaccttcataaccagcttcgggggttctgacgaggaggctgccgctgccgccgcagctgcagcagcctcaggcgtgaccactgggaagccaccggcaccaccacagcctgggggtccagccccaggaagaaacgcttctgcccggagaaggagctccagttcctcttcgtctagctccgcaagtagaaccagcagcagtcggagttcaagtcggtcatcctctagaagtcggagaggcggcggatattataggagtgggagacacgcaagatcacgttcccggtcttggagcaggtcgcgatcacggagccggagatacagccgttccagatcaagaggccgccgacactccggcggtggctcgagagatggtcaccggtactccagaagtcctgctagaagaggcgggtatgggccccgccgaagaagccggtccaggagccatagtggcgatcgctataggcgcggggggaggggacttaggcatcactcgtcctctaggtcccgcagtagttggagtctgagtcctagccggagtcgctccctcactcggtccagatcccactccccatcgccctcgcagtcacggtcaaggtcgaggtctaggtcacaatccccgtcaccctcgcccgctagagagaagctgacccggccagctgctagcccggcagtgggggaaaagctcaagaagaccgagccagctgcaggtaaagaaaccggcgccgcaaaaccaaaattgaccccacaggagaagttgaaattgagaatgcagaaagccctgaatcgacagtttaaggcagacaagaaagcagcgcaggagaagatgattcagcaggagcacgagcggcaagagcgcgaggacgaactgagggccatggcgcgcaaaatccggatgaaggagcgggaacgccgggagaaggagagagaagaatgggaaaggcagtatagtcggcagtctcgctctccgagtcccaggtactcacgcgagtattccagttccaggagacgctctcgctctaggagcaggagcccccattaccgccactag

SEQ ID NO: 18950 - DNA, 1968 bp, Artificial Sequence
  Description of Artificial Sequence: Synthetic coding sequence
atgtggcacgaggcccggaagcacgagcggaagctgcggggcatgatggtggattataaaaagcgggcagagaggcgacgggagtactatgagaaaattaagaaggatccagctcagtttctgcaagtgcacggtcgcgcatgtaaagtgcaccttgattccgcagttgctctcgccgccgagagccccgtcaacatgatgccctggcagggggacaccaacaatatgattgatagatttgacgtccgggcccatctcgatcacatccctgattacacacccccgttgctgacaaccatttcacccgagcaggaaagtgacgagcgcaagtgtaattacgaaagatacagaggactcgtgcagaacgattttgctgggatatcagaggaacagtgcttatatcaaatctacattgacgagctctacggtggtctgcagaggccctctgaggatgaaaaaaaaaagctggctgagaaaaaagcttcaatcggttacacatatgaggactcaaccgtggctaaggttgagaaagccgctgagaagcccgaagaggaggagtcagccgccgaggaagagtccaactctgatgaggacgaggtcatccctgatattgatgtggaagtggacgtcgatgaactgaaccaggagcaagtggctgaccttaataagcaggccaccacttatggcatggccgacggcgattttgttcgcatgcttaggaaggacaaggaggaggccgaagcaataaagcatgcaaaagcccttgaggaagagaaagccatgtattcgggaagacgctcccgccgtcagcggcgagaattcagggaaaagcgcctgcgaggtagaaaaatttcacccccatcctatgccagaagagacagcccaacatatgacccatacaagagatcgcctagcgagagctcatccgagagccggtctcggtctaggtcgcctactcccggaagggaagagaaaatcacgtttatcacctcttttggtggatctgatgaagaggccgctgcagcagctgcggcagctgctgcgagcggcgtgactacagggaaacctccagctcctccccagccaggtggccccgcccccggccggaatgcgagcgctcgccgaagaagttcttcttcatccagcagctctagcgcctcgcgcacttcctcttcaagatccagctcacggagttcgagtcgctctcgtcggggtggcggttattatcggagtggcaggcacgccagatcacgttccagaagttggtctcgcagtaggagcagatctaggagatactcacggagtcggagccgcggaaggcgccacagtggcggtgggagccgcgacggacatcgatactcaagatctcctgctcggcgtggcgggtatggcccccgcaggcgctcccgtagtaggtcacactccggagataggtatcgcaggggcgggcggggcttgagacatcactcctccagtcgcagccggtcatcgtggtctctcagtccttcaaggtcccgatccttgacccgttcccgttcccacagtccatctccgtctcagtcacgctctcgaagcagatctaggagccagtcaccaagtccttcccccgctcgggagaaactgacacgaccagcagcttccccagccgtgggagaaaagctgaagaagacggaaccggccgccggcaaagaaacaggagctgctaaggtgataaaggccgacaaaaaggccgcacaagagaagatgattcagcaggaacacgaacgccaagaacgggaagatgagctgagggccatggctaggaaaatacggatgaaggagcgtgagcgcagagaaaaagaaagagaagaatgggaaaggcaatactcccgccagtctcgttccccatctccacgatattctcgggagtatagcagctcccgtcgaagaagtcgcagccgctccaggtccccacactaccgtcactag

SEQ ID NO: 18951 - DNA, 1242 bp, Artificial Sequence
  Description of Artificial Sequence: Synthetic coding sequence
atgagcttccgggacctgcggaacttcaccgagatgatgcgggccctgggttatccaagacacattagcatggaaaacttccgcacccctaactttggcttagtcagcgaagtcctgctctggctcgtcaagcgttacgaaccacagactgacattccgcccgatgtggatacagaacaagatcgagtcttctttattaaagcaattgcccagttcatggccaccaaggcgcatatcaagctgaacaccaaaaaattataccaggctgacgggtatgccgtcaaagagttactgaagatcaccagtgtgctatacaatgctatgaaaaccaaaggcatggaggggtccgaaatagtggaggaggacgtgaacaaattcaagtttgacctgggctctaaaatcgccgacttaaaagctgcccggcaactagctagcgaaattacctcaaaaggcgccagtctctacgatctacttggtatggaagtggagttacgagagatgaggacagaggcaattgcccgtcctctcgagattaacgaaacagagaaggtgatgcgaatagctattaaagaaatcctgactcaggtgcaaaagaccaaggatttgctaaacaatgtcgcttctgatgaggccaatttggaggctaaaatagaaaagcgtaaacttgaactagagagaaatcgtaagaggctcgagacactccagtccgtccgcccttgctttatggatgagtacgaaaagaccgaagaggagctgcagaaacagtatgatacctatctggagaagtttcagaacctaacttacctcgagcaacagttagaagaccatcataggatggagcaagaaagattcgaagaagccaaaaatactctgtgccttatccaaaacaaattaaaagaggaggaaaagcgtctcctaaaatccggatcgaacgacgacagtgacatcgacatccaggaggacgacgagtccgatagtgaactcgaggagaggcgcctgccaaaaccgcagacagcaatggagatgctgatgcaggggagacccggtaaacgtatagtggggacaatgcaggggggcgattcagatgacaatgaagatagtgaagagtctgaaatcgatatggaggatgacgacgacgaagacgatgatctggaagatgagagtataagtctgagcccaactaaacccaataggcgagtgaggaagtcagaacctcttgacgagagcgacaatgatttctag

SEQ ID NO: 18952 - DNA, 744 bp, Artificial Sequence
  Description of Artificial Sequence: Synthetic coding sequence
atgcggaccgaggccatcgcccggcccctggagatcaacgagaccgagaaggtcatgcgaattgcgatcaaagagatccttacacaggtgcagaaaactaaagatcttctaaataatgtggcatctgatgaagccaacctggaggccaaaatcgagaagcgcaagcttgagctcgagagaaaccggaagcggcttgagaccctccagtctgtgcgcccctgctttatggacgaatacgagaagactgaggaagagctgcagaagcagtatgatacctatcttgagaaatttcagaatctgacatacttggaacagcagctggaggatcatcatcgtatggagcaggaaagatttgaagaagcgaagaacacactatgtctgattcagaataaattgaaagaggaggagaaacggctactcaagtcagggagcaacgacgactcagacatcgatattcaagaggatgatgagtccgactcagagctggaggagcggagactcccgaaaccccagaccgctatggagatgctgatgcagggacggcccggaaaaaggatagtggggactatgcagggcggcgattcagacgacaacgaagacagcgaagaatctgaaatagatatggaagacgatgacgatgaggatgacgatctcgaggacgagtctatctccctctcccctacaaaaccgaaccgcagagtccgcaagagtgaacccctagatgagtccgataacgatttctag

SEQ ID NO: 18953 - DNA, 576 bp, Artificial Sequence
  Description of Artificial Sequence: Synthetic coding sequence
atggacgagtacgagaagaccgaggaggagctgcagaagcagtacgacacttatctagagaagtttcagaacctgacgtatctggagcaacagctggaggatcatcataggatggagcaggagaggtttgaagaggctaagaacacattatgcctcattcagaataaacttaaagaggaggagaagcgtctgctgaaaagcgggtcgaacgacgattctgacattgatattcaggaagacgatgagtcagactcagagctcgaagagcggaggttacctaagccgcagacagccatggagatgttaatgcagggcaggcctggcaagcgcatcgtgggtacgatgcaaggtggtgatagcgacgataatatggaggctgctcccgcgctcctggggaagtgcaaaacgtctagctccaagaaacaggaagattctgaagaaagtgagattgacatggaagacgatgacgatgaggacgacgatctggaagatgaatctatcagtttgtctcccaccaaaccaaatagaagagtccggaagagtgagcccctcgacgaatcagataatgatttctag

SEQ ID NO: 18954 - DNA, 1242 bp, Artificial Sequence
  Description of Artificial Sequence: Synthetic coding sequence
atgagcttccgggacctgcggaacttcaccgagatgatgcgggccctcgggtatccgcggcatattagcatggaaaactttaggacacctaactttgggctagtgtccgaggtgctgttgtggttggtgaagaggtatgagccccaaaccgatattcctccagacgtggatacagaacaggatagggtcttcttcatcaaggctattgctcagttcatggccaccaaggctcatattaaactgaacacgaaaaagctctatcaggcggacggctatgccgtaaaagaacttctgaagattacctccgtgctctataacgccatgaaaacaaagggcatggaaggcagtgagattgtggaggaggacgttaataaattcaagttcgacctcggatctaagattgctgatcttaaggccgcccggcagttagcgtccgagataacaagtaaaggcgcttcactctacgatctactgggcatggaagttgaactccgagagatgcgcactgaggctatcgctagacctctggaaattaacgaaacagaaaaagtaatgcgaatcgccattaaagagatcctgacacaggttcagaagactaaggacttgctcaacaacgtcgcctcagacgaagccaatcttgaagctaagattgaaaaacggaagttggagctggagcggaatcgtaagcggctggaaacactgcagagtgtgcggccttgcttcatggatgaatatgagaaaactgaggaggagcttcagaagcagtatgatacttaccttgaaaagtttcagaacctgacatacctcgagcagcagctcgaggaccaccatagaatggagcaggaacgtttcgaggaagctaagaataccttgtgcctcattcaaaataaactgaaagaggaggaaaaacgcctgctcaagtcaggcagcaatgacgacagcgacattgatatccaggaagacgatgagtcagactctgagctcgaggaacggaggttgccgaaaccccagaccgccatggagatgttaatgcagggacggccaggcaagcgcattgttgggacaatgcaaggcggggacagcgatgacaatgaggactccgaggaaagtgaaatcgacatggaggatgatgatgatgaggacgatgatctggaggatgagtccatttctctgtctcccacaaaacccaaccggcgtgtaaggaagagcgagcccctcgacgaatccgacaacgacttttag

SEQ ID NO: 18955 - DNA, 1116 bp, Artificial Sequence
  Description of Artificial Sequence: Synthetic coding sequence
atggccgccgccgccgccggcctgggcggcggcggcgccggccccggacctgaggcaggtgacttcttagccagataccgactggtaagcaacaagctgaaaaagcggttcttacggaaacctaatgttgctgaggctggcgaacagttcggtcagctgggaagggaactgcgagcccaggagtgtctgccctatgctgcctggtgtcagctcgcggtggcgaggtgccagcaggcactgtttcacggccccggtgaggcgttagcccttacagaggcagcacgtctctttcttcgccaggagcgcgacgctaggcaacgactggtctgtcccgccgcatacggagagccactccaggctgccgccagcgcattaggcgctgctgtgcggctgcaccttgagctgggccagcctgctgctgcagcagctctgtgtctggaactggcagctgcccttcgcgacttagggcagcccgccgccgccgccggacactttcagagagcagcacaactccaactgcctcaactgccacttgctgcccttcaagcactgggcgaagcggcaagctgccagctgctcgccagagactataccggggcactggcagtattcacacgaatgcaacggctggcaagagagcacggctctcacccagtgcagtccttacctcccccgccgccaccagcaccccagcccgggccaggcgcgacccctgctctgcctgcggctctcttgcccccaaatagtggcagcgcagccccctcacctgcagccttaggcgcattttcagacgtgttagtccggtgcgaagtaagccgagttttgctgctgctgttactgcagccacctcctgctaagctgctacccgaacacgcccagactctggagaaatattcctgggaggcttttgattcccacggacaagagtcttctggacagctgcctgaagaactgtttttattactgcagagcctggttatggccacgcatgaaaaggatactgaggcaatcaaaagccttcaggtcgaaatgtggccactgttgacagctgagcagaatcatctgctgcacctggttctacaggaaaccatctctccatctgggcaaggagtgtag

SEQ ID NO: 18956 - DNA, 1116 bp, Artificial Sequence
  Description of Artificial Sequence: Synthetic coding sequence
atggccgccgccgccgccggcctgggcggcggcggcgccggccccggtccagaggctggagactttctcgcacggtatagacttgtgtctaataaactgaaaaagcgattcctgaggaaaccgaacgttgcagaagccggtgagcagtttgggcagcttgggcgtgaactcagagctcaggagtgcctcccttatgccgcctggtgtcaactcgctgtggctcgatgccagcaggccttatttcatgggcccggcgaagcactcgctctgacagaggctgctcggctgttcctcagacaagaacgggacgcccggcaacgcctagtgtgccctgcagcgtacggagaaccccttcaggccgctgcatccgcgctgggtgccgcagttcgtctgcatttggaacttggccagcctgccgctgctgcagcactgtgcctagaactggcggccgctttacgtgacctgggtcagcccgctgctgcagccggccactttcaacgcgcagctcagctccagctacctcagctccctctggctgctcttcaggcactcggcgaagccgcttcatgtcagctcctggctagagactatacaggggctctcgccgtgtttactcgcatgcagcgcttggcacgagagcatgggtcccatccagtccagagtctgccccctccaccgcctcctgccccccagcctgggcccggagcaactccagccctcccagcagccctgctcccccccaatagcggctccgctgcgccttctcctgcagccttgggcgcctttagcgatgtgcttgtgcgatgcgaggtcagtcgagtgctactgcttttgcttctgcagcctccaccggctaaactcctgcccgaacacgcacagactctggagaagtactcttgggaggcattcgactcccatggccaggagagtagcggacagctcccagaggaacttttccttcttctgcaatctttagtgatggccactcacgaaaaagacacggaggcgatcaaatccctgcaggttgaaatgtggccgttattgaccgccgaacagaaccatctgctgcacctcgtgttacaagagacaatttccccttcagggcaaggtgtttag

SEQ ID NO: 18957 - DNA, 1116 bp, Artificial Sequence
  Description of Artificial Sequence: Synthetic coding sequence
atggccgccgccgccgccggcctgggcggcggcggcgccggccccggacctgaagccggcgatttcctcgcccggtaccgcttggtttctaataaactgaaaaaaagattcctgcgaaaacccaatgtcgccgaggcaggtgagcagtttggacagttggggcgtgagctccgcgcacaggaatgtctgccttacgcagcatggtgccaactcgctgtggcccgctgtcagcaggcactgttccacggacccggggaggcacttgcgctgacggaagctgcccgcctgtttttgagacaggagagagacgccaggcagcggttggtgtgcccagctgcctacggagaacctctccaggcagcagcttctgctctgggtgcggcagtgagattgcacctggaattgggtcagcccgctgccgcagccgcattatgtctcgagttggccgcggccctgcgcgacctcggccagccagcagccgcagccgggcattttcagcgagccgcccaactgcagctgccccaactgcctctggctgctctgcaggctctgggggaggctgccagctgccagctgctggctcgcgattacacaggtgcgcttgccgtgttcacgcgaatgcagagactggcgcgtgaacatggcagtcaccccgtccagtcccttcccccaccacccccccccgcaccacagcctgggcctggggctacccccgccctccccgctgctcttctgcctcccaacagcggaagcgctgctccctccccagccgcactcggggctttcagcgatgttttggtgcggtgtgaagtgtctcgcgttctgttgctcctgttacttcaaccccctcccgctaaactactacccgaacacgcccagacgttggagaagtacagctgggaagcttttgactcacatggtcaggagagttcaggccagttgccagaagaactgttcctgctcttacaaagtctcgtgatggcgactcatgagaaggacactgaagccatcaagagcctccaggtggaaatgtggcccctgctaacagccgagcaaaaccaccttctgcatcttgtgctccaagaaacaatcagcccgtccggccaaggtgtgtag

SEQ ID NO: 18958 - DNA, 2502 bp, Artificial Sequence
  Description of Artificial Sequence: Synthetic coding sequence
atgagccccgagaagcagcaccgggaggaggacgaggtggacagcgtccttctcagcgcctccaagatcctgaactccagtgaaggggtgaaagaatccggctgctcagatacagagtatggttgcattgcagagagtgaaaatcagatacaacctcagtcagccctgaaggttctgcaacagcagttggagtcctttcaagcccttaggatgcagaccctgcaaaacgtgtccatggtgcagagtgaaatctcagagatacttaacaaatccataatcgaagtcgaaaatccacagttttcatccgaaaagaatctggtgttcggaacacgtattgaaaaggacctgccaactgagaatcaggaggagaacttgagcatggaaaaatctcatcacttcgaggattcaaaaacactgcatagcgtcgaagaaaagctgtctggggactctgtgaatagtcttccacagagcgttaacgttccttcacagattcattccgaggacaccctgaccctacggacctccacggacaacctctcctcgaacatcatcatccacccttctgagaatagcgacatcttaaagaactataacaacttttatagatttctgccaactgcccctcctaatgtcatgagtcaggctgacactgtgatcctggataaatccaaaatcactgtgcctttcttgaagcatggcttctgtgaaaatctcgacgacatctgtcatagcatcaagcagatgaaagaggagctccagaaatctcacgatggggaggtagcccttactaacgagctgcagaccctccaaacagaccccgacgtacaccgcaatggaaaatatgacatgtctccgatccaccaggacaagatgaattttattaaggaggaaaacttggatggtaacctgaatgaggacatcaagtctaaaaggatcagcgaattggaggctcttgtgaagaaactcttgccattcagggaaacagtcagcaagttccacgtccacttttgtaggaagtgcaaaaagctcagcaaatccgagatgcacaggggtaagaagaacgagaaaaataacaaagagataccgatcacgggcaaaaatatcaccgacctcaagttccacagcagagttcccaggtatacactatctttccttgaccaaactaaacacgaaatgaaagataaggaaagacaacccttcctcgtgaaacagggcagtatcatatctgaaaatgagaaaaccagtaaagttaactctgtcaccgaacagtgcgtcgctaaaatacagtacttacaaaattatctcaaggagtcagtgcaaattcaaaaaaaagttatggagctagagagtgagaatctgaatctcaagtcaaagatgaaaccacttattttcacgacacaaagccttatccagaaggttgaaacttatgaaaagcagctgaagaatcttgtggaagaaaagagcaccatacagtcaaagctaagtaaaactgaggagtattcgaaggaatgtctgaaggaattcaaaaaaattattagcaaatataacgtgttgcagggccagaacaagacactggaggaaaaaaacatccagctgtctttagagaaacaacagatgatggaagctctagaccagttgaagtctaaggagcacaagacccaaagtgatatggccattgtcaacaatgaaaataacaggatgtccattgaaatggaggccatgaagactaacatcctgctgattcaggacgaaaaggaaatgctggagaagaagacacaccagctgttgaaagagaaatctagcctaggaaacgagctgaaagaaagtcagctggagatcatacaattgaaggaaaaagagcgcttagctaaaacagagcaggaaaccctcttgcaaattatcgagaccgtaaaggatgagaagctgaatctggagacaactctgcaggagtccacagctgccagacaaattatggagagagaaattgagaacatccagacataccagagtacagcagaggaaaactttttacaggagattaagaacgctaaatccgaggccagcatatataagaattccctgagcgaaatcggcaaggaatgcgaaatgctgtccaaaatggtcatggaaacaaaaacagacaatcagatcctgaaagaagaactaaagaagcacagccaagaaaacattaaattcgaaaattctatctccaggttgaccgaagataagatcctcctggagaattacgtgcgctccatagaaaatgagagggacaccctagaatttgaaatgagacacctgcagagggagtatctgtctctgagcgacaagatctgtaaccaacacaatgacccctccaagacaacctatatcagtcgcagggagaaatttcattttgacaactacacccacgaggatacctctagcccgcaaagtaggccactggcctccgaccttaaaggttatttcaaagttaaggaccggactctcaaacaccactag

SEQ ID NO: 18959 - DNA, 2391 bp, Artificial Sequence
  Description of Artificial Sequence: Synthetic coding sequence
atgagccccgagaagcagcaccgggaggaggacgaggtggacagcgtgttgctgagcgcttccaagattttaaactcctccgagggagtaaaggaatctggctgctccgatactgagtatggctgcatagccgagtcagagaaccagatacaaccacagtccgctttgaaagtgctacagcaacagctggaatctttccaggcattgcgcatgcagactcttcaaaatgtctctatgcccacagagaaccaggaagagaatctgagtatggagaagagccaccacttcgaagacagtaagaccttacattcagtggaggagaagttatccggcgattccgtgaacagccttccccaaagtgtgaacgtcccgagtcagatccacagcgaagacaccttaaccctaaggacatctactgataacctgtctagcaatataatcatccacccatccgaaaactccgacatcttgaaaaactacaataacttctaccgtttccttcccactgcaccaccaaacgtcatgagtcaggcagacacggtgattctcgataagagtaaaatcacagtgccctttctgaagcatgggttttgcgagaatcttgacgacatctgtcacagtataaaacaaatgaaggaagaactgcagaagagtcacgatggagaggtggcactgacaaatgaactgcaaacactgcagacggatccggacgtacaccggaatgggaaatacgatatgagtccaatccatcaggataaaatgaactttatcaaagaggagaatctggacggcaatcttaacgaggacattaaaagcaagcggatttccgagctagaggccctagttaagaagttacttcccttccgtgagaccgtgtccaaatttcatgtccacttctgccggaagtgcaagaagctgagcaagtcagaaatgcatcggggaaagaaaaatgaaaagaacaataaggagattcccatcaccggaaaaaatataactgatcttaagttccactccagggtacctaggtatactctttcttttttggaccagaccaaacatgaaatgaaagataaggagagacagccatttctggtgaagcagggaagcatcatcagcgaaaacgaaaagacatcgaaagtgaacagtgtgactgaacagtgtgttgccaaaatacagtatctccagaactacttgaaagagagcgtgcaaattcaaaagaaagtgatggagttagaatccgaaaatcttaacttgaagagcaaaatgaagcccctgatttttactacgcagtccctaatccaaaaagttgagacgtatgaaaaacaactaaagaacctggtggaggagaagtccaccattcagagtaaactgtctaagacagaagagtactccaaggagtgcttaaaagaatttaaaaagattatatcaaagtacaatgtcctccagggacagaacaagacccttgaggaaaagaacatccagctgtccctggagaagcagcagatgatggaggcccttgaccaactgaaatctaaagagcataaaacgcagagcgacatggcaattgtgaacaatgagaataaccgaatgagcatagagatggaagccatgaaaacgaacattctgctgattcaggatgagaaagagatgttagaaaaaaaaactcatcagttgttgaaagagaagtccagtctgggaaatgagcttaaggaaagtcagctggagataatacagctgaaggagaaagagagactggctaagacagagcaggagaccctgctacagatcattgagaccgtgaaagacgagaaactcaatctcgagacaacactacaggaatctaccgccgccagacagattatggaaagggaaatagaaaatattcagacatatcagtcaaccgctgaagagaacttccttcaggaaatcaaaaatgccaagagcgaagcaagcatctacaagaattcactgagcgaaattggcaaggaatgtgagatgttaagtaagatggtgatggaaaccaaaacagataaccagatattaaaggaggagctcaagaagcacagccaggagaacatcaaatttgaaaacagtatcagtagactcacagaggataaaatccttctggaaaactacgtcagaagtattgagaatgagagggatacgctggagttcgagatgcgccacctgcaaagggagtacttgagcctatccgataagatttgtaaccagcacaatgaccccagcaaaactacttatatttcccgccgggagaaattccatttcgataattacacgcatgaagacacgagttcaccacagtcccgacccctggcctcagacctaaaagggtactttaaggtcaaagaccggacgttaaaacatcattag

SEQ ID NO: 18960 - DNA, 726 bp, Artificial Sequence
  Description of Artificial Sequence: Synthetic coding sequence
atggcccccgtgcggcggagcgccaagtggcggcccggcggcatcgaggctaggggagagggcgtgagcacagtcggataccggaacaagaatgtaagacagaagacttggcgccccaaccacccccaggcattcgtggggagtgtccgtgagggccaaggcttcgccttccgtaggaaactgaagatacaacagtcgtacaaaaagctacttcgcaaggaaaagaaggcccaaacctccctggaatcccagttcaccgaccgctaccccgataacctcaaacacttgtaccttgctgaagaagagcggcaccgcaagcaagctcgaaaggttgaccatccgttgagcgaacaagttcaccagcctcttctggaagaacagtgtagcatcgatgaacctctctttgaggatcagtgttccttcgaccagcctcaaccggaggagcagtgtataaaaacagtgaattcgttcacgattccgaagaaaaataagaagaaaaccagtaaccagaaggctcaggaggagtacgagcaaatccaggcaaaacgtgctgccaagaagcaggagtttgagaggcgaaagcaagaacgggaggaagctcaacggcaatacaagaaaaagaagatggaggtttttaaaattttgaataagaaaacgaagaagggtcagcctaatctcaacgttcagatggagtatctgctgcagaagattcaggagaaatgctag

SEQ ID NO: 18961 - DNA, 888 bp, Artificial Sequence
  Description of Artificial Sequence: Synthetic coding sequence
atggagcaccagctgctgtgctgcgaggtggagaccatccggcgggcgtatccagatgctaacttactgaacgatagagttttgagagccatgctgaaagctgaagaaacctgtgccccaagcgtatcctatttcaagtgcgttcaaaaggaggtgctaccctctatgcgcaaaatagtggcgacctggatgctcgaggtctgcgaagagcaaaaatgtgaggaagaagtgtttccattggccatgaactatctcgatcgctttctcagtctcgagccagtgaagaagtccagactgcagctgctcggcgctacatgtatgttcgttgcatccaagatgaaggagactattcccctgacagctgagaagttatgtatctacaccgacaacagcatccggcccgaggagttacttcaaatggaactgctcttggtgaacaagcttaaatggaacctcgcagcaatgaccccccatgattttatagagcatttcttgagtaagatgcccgaagccgaagagaacaagcagatcatccgtaaacatgcacagacatttgtggccttgtgcgcaaccgatgttaaattcatctcaaaccctcccagtatggttgctgctggcagcgttgtggctgcagttcaaggcctcaacctgaggtcaccaaacaacttcctgtcttattacaggctaaccagattcctcagtagagtcatcaagtgtgaccccgactgcctgcgggcgtgccaggagcagattgaggccctgctggaatcatccctccgtcaggctcagcagaatatggatcccaaagccgcagaagaggaagaagaggaggaggaggaggtggatctggcttgtaccccaaccgatgttagggacgttgatatctag

SEQ ID NO: 18962 - DNA, 492 bp, Artificial Sequence
  Description of Artificial Sequence: Synthetic coding sequence
atggacacccccctgcggcggagccggcggctgggcggcctgcggcctgagtcaccggagtctctgaccagtgtgagccggactaggcgagccctcgtggaattcgaatctaatcccgaggaaaccagggagcccggcagtccaccctccgttcaaagggcaggtctcgggtctccagagcgtccccctaaaaccagcccgggctccccgcggctccagcagggtgctggcctcgagtcacctcagggacaaccagagcccggggcagccagccctcagcggcaacaagatctccatctagagtctcctcagaataaggaggagctcacccccggagccccccagcaccagctgccacctgttccaggttcacccgagccttatccgggacagcaagcaaccagttcttggggcgacggtgatcgacgtcttaggggaaaggaggcaaagaggttctttatccctgggccatctgtgcaagaggtggaatag

SEQ ID NO: 18963 - DNA, 315 bp, Artificial Sequence
  Description of Artificial Sequence: Synthetic coding sequence
atgctgcaggacaagcccctgcggaccagctggcagcggaagatgaaagagaggcaagaacgcaaactggctaaggactttgccagacacctggaggaggagaaggagagacgtcgacaggaaaaaaaacagaggcgcgccgagaatctgaaacggaggttggaaaatgagagaaaagccgaagtggtccaagtgatccgcaaccccgccaagttaaaaagggccaagaagaaacagctgcggagcatcgagaaacgggacactctcgccctgctccaaaagcagcctccacagcagcccgcagccaagatctag

SEQ ID NO: 18964 - DNA, 819 bp, Artificial Sequence
  Description of Artificial Sequence: Synthetic coding sequence
atggaggaggaggccatcgccagcctgcccggcgaggagaccgaggatatggacttcttatccggattagaactggcggatctgctcgatccaaggcagcccgactggcacctcgacccgggactgagttcccccggccctctgtcttctagcgggggaggctcagactcagggggtctttggcggggtgacgacgacgacgaagcggccgctgctgagatgcaacggttcagcgacctcctacagcgtttgctcaacggcatcggcggatgctccagctcctcagacagtggctcggcagaaaagagacgcaggaagtcccccgggggcgggggaggtggaggctcgggcaacgacaataaccaggcagcaactaagtcacctaggaaagctgccgccgcggctgcgcgtcttaatcggctgaaaaagaaagaatacgtcatggggctcgagtcacgagtccgaggcctggccgctgaaaatcaagagttgcgggcggagaatcgcgagctgggtaaacgggtccaggctttgcaggaggagtcaagatatcttagagccgtgcttgcaaacgaaacaggcctggcacgacttctttctcgactcagcggtgtggggctaagactaaccacttcgctgtttcgcgacagcccagcaggggaccacgattatgccttgcctgtcggaaagcagaagcaggacttactggaagaggatgactctgccggcggcgtttgcctccacgtggacaaggacaaagtctctgtagagttctgttctgcctgcgcacgcaaggcctccagtagcctcaagatgtag

SEQ ID NO: 18965 - DNA, 1065 bp, Artificial Sequence
  Description of Artificial Sequence: Synthetic coding sequence
atgcggcacagcctgaccaagctgctggccgccagcggcagcaactcccccaccagatctgagagccccgagcccgctgcgacgtgcagcttaccatcggacctgaccagagccgctgccggtgaagaggagacggccgccgctggatcgcccggcagaaaacagcaatttggcgatgagggcgagctggaggccggtagggggtccaggggtggcgttgcagtgcgagcgccctcacccgaggaaatggaagaagaggcaatagcttctctccccggtgaagagactgaagatatggacttcctctctgggctagagttggcggacctactggatccaaggcagcctgattggcacttggaccctgggctatcttcacccgggccactatctagctcaggaggcggatccgacagtggcggcctatggcgcggagatgatgatgatgaggctgcagctgccgagatgcagaggttttctgacttactgcagcgcctgctcaacggcatcggtggatgtagctcctccagtgattccggatctgcagagaagaggcggcgcaagtcaccggggggagggggcggcggcggaagtggaaatgataataaccaggccgcgacaaagagcccgcggaaagctgcagccgccgcggcgcggcttaatcggctcaaaaagaaggagtatgtgatgggtctggagtctcgcgtcagagggcttgcagctgagaatcaggaactgcgagccgaaaaccgagagctaggaaaacgcgttcaggctctacaggaagaatcccggtatctgcgggccgtgctggcgaacgagacgggcttggctcgcctcttaagccgcctgtctggagtcggcctccgcctaaccacttcactcttcagggactcccccgccggagatcacgactatgcgctgcctgtaggaaagcagaagcaggacctgctggaagaggacgacagtgcgggcggtgtctgcctgcacgtggacaaggacaaagtgtcggtggagttttgctccgcttgtgcccggaaggcttcgtcttcactcaaaatgtag

SEQ ID NO: 18966 - DNA, 1065 bp, Artificial Sequence
  Description of Artificial Sequence: Synthetic coding sequence
atgcggcacagcctgaccaagctgctggccgccagcggcagcaactctccaacaagatccgagtctcccgagcctgccgctacctgcagtctgccctctgacttgacacgagccgcggcgggcgaagaagagactgctgctgcgggaagtcctgggcgcaagcagcagtttggggatgaaggggagctggaagctggaaggggtagcaggggtggcgtggctgttagggcccctagccccgaagagatggaagaggaggcaattgctagcctgcccggcgaggaaacggaggatatggattttctgagcggcctggagctggccgatctgctcgacccccgtcagcctgattggcacctagaccctgggctctctagccctggtcccctgtcatcaagtggaggcggctctgactccgggggtctctggaggggtgacgatgacgacgaagcagcagcagcagagatgcaaaggttctccgacctactccaaagactacttaacggaattggtggttgctctagttcgtcagattctggctctgccgagaagcgccggcggaaatcccctgggggaggagggggcggaggcagcgggaacgataacaaccaagccgcaactaagagtcctagaaaagcagctgcagctgccgctcggctcaataggctgaagaagaaggagtatgtgatgggcttagaatctagggtgcgtggattagccgctgagaaccaagagctcagagccgagaacagagagctgggcaagcgcgttcaggccctccaagaggagtcacgatatctgagagccgtgctggcgaatgagacagggctggcacgactgctctctcgcctgtccggggttggcctgagactgaccacatccctgttccgcgattccccggctggggatcacgactacgccttacccgtgggaaaacagaagcaggatttactagaggaggacgattcagctgggggcgtctgcctccacgtggataaggataaggtgtccgtcgagttttgttccgcctgtgcccgtaaggctagtagttcactcaaaatgtag

SEQ ID NO: 18967 - DNA, 816 bp, Artificial Sequence
  Description of Artificial Sequence: Synthetic coding sequence
atggagcacggcagcatcatcacccaggcccggcgggaggacgccctggtgttgaccaagcaggggcttgtctcaaagagttcccccaagaagccccgaggacgcaacattttcaaggctctgttctgctgctttcgggcacaacacgtcgggcaatctagctcttccacagagctagccgcatacaaggaagaagctaatacaattgccaaaagtgacctcctgcagtgcctccagtaccagttctatcagataccaggcacttgtcttctccccgaagtgaccgaggaagaccagggtaggatttgtgtcgttatcgatctggacgagacactggttcacagctccttcaagcctatcaataacgccgatttcatcgttccgattgaaattgagggtactacccatcaggtttatgtcttgaaaaggccctacgttgacgaatttcttcgccgaatgggagaattatttgagtgcgtcctgttcactgcctcattagccaagtacgcagatcccgtgactgacctgctcgaccgttgtggggtgtttagggccaggttatttagggagtcttgcgtgtttcatcaagggtgctacgtgaaggatttgagcaggctgggccgggatcttcgcaaaacactgattctggacaacagcccggcttcgtatattttccatcctgaaaacgccgtgcccgtccagagctggttcgatgacatggccgacacagaactgttgaatctcatccccatcttcgaagaactatctggagctgaggacgtgtacacatctctgggccagcttcgcgcaccatag

SEQ ID NO: 18968 - DNA, 831 bp, Artificial Sequence
  Description of Artificial Sequence: Synthetic coding sequence
atggacggccccgccatcatcacccaggtgaccaaccccaaggaggacgagggacgcctccctggggctggtgaaaaggccagccagtgtaacgtgagtttgaaaaagcagagatccagatcaatcctgtccagcttcttttgttgtttcagggactataatgtggaggcgccacctccttcttcgccctcagtgctgcctcccctggtcgaggagaatgggggcctccagaagggagatcagaggcaagtgatcccaatcccaagtccccccgccaaatatctgctgccggaggttactgtactcgactatggcaaaaagtgcgtggtgatcgacttagacgaaactttagtgcacagctcctttaaaccaataagtaacgctgatttcatcgtgcccgtggaaatagatgggaccattcaccaggtctatgttctcaagcgaccacacgtggatgagttcctccagcgaatggggcagctattcgagtgtgtgctcttcaccgctagtttagcaaagtacgctgacccagtggccgaccttctcgatagatggggtgtgttcagagcgagactgtttcgggaaagctgtgtcttccatcgcggcaactatgtcaaagatctcagcaggctcgggagagaactttcgaaggtgataattgttgacaactccccagcctcttatatcttccatcccgaaaatgcagtgcctgtccaatcctggtttgatgatatgacagataccgagctgttggatttaatccctttcttcgaggggctgtcccgtgaggacgacgtgtacagcatgctccaccggctgtgtaaccgctag

SEQ ID NO: 18969 - DNA, 798 bp, Artificial Sequence
  Description of Artificial Sequence: Synthetic coding sequence
atggacggccccgccatcatcacccaggtgaccaaccccaaggaggacgaaggtcgcctgccgggggccggagagaaggcctcacaatgcaatgtctcattgaagaaacagcggagtcgaagcatcttgtccagcttcttctgttgctttcgagattacaacgtagaagccccgccgcccagttccccctccgtgctgccccctctcgtggaagaaaacggcggcctgcagaagccacctgcaaaatatcttctgcccgaagtgaccgttctggattatgggaagaaatgtgtagtaattgacctggatgaaactcttgtacactccagctttaagccaatcagcaatgctgactttatcgtgccggtggagatcgacggaaccatacatcaagtatatgtcctgaagagaccacacgtggatgaatttctccagcgaatgggccagctgttcgaatgcgttttattcacagcttccctagccaagtacgccgaccctgttgcagaccttctcgatcggtggggagtttttagggcacggctcttccgagagtcttgtgtgttccacagaggcaactacgtgaaggatctgtctcgtttgggtcgggaattaagcaaggtgattattgtggataattcccccgccagctatatcttccacccggagaatgcggtgcctgtccagtcgtggtttgacgatatgaccgacacagaactgttggatctgataccgttttttgagggccttagccgggaggacgacgtgtacagcatgctccacaggctgtgtaatcgctag

SEQ ID NO: 18970 - DNA, 3522 bp, Artificial Sequence
  Description of Artificial Sequence: Synthetic coding sequence
atgagccggggcagcatcgagatccccctgcgggacaccgacgaggtgatcgaacttgacttcgaccaactaccggaaggcgacgaagtcatcagtatcctgaaacaggagcatacccagctacatatctggatagctctagccctagagtactataaacagggaaagaccgaggagttcgttaaactcttggaagccgcccgcatcgacggaaacctagattacagggaccacgagaaggaccagatgacctgtcttgacaccctcgcagcgtattacgttcagcaggcacgtaaggaaaagaacaaggataataagaaagatcttattacacaagctactctcctgtataccatggctgataagatcatcatgtacgatcagaatcacctgctcgggagagcctgcttctgcttgctcgagggcgataagatggaccaggccgatgcccagtttcattttgtccttaaccagtcccctaacaatatccctgctttgctgggcaaagcctgcatttcgttcaacaaaaaggactatcgtggagctttggcctattataagaaggctctcagaactaatccaggttgtccagcagaggtgagattagggatgggacattgtttcgtgaagctgaataagctcgaaaaggccagactggccttttctcgcgccttagagcttaacagcaagtgtgtgggcgcactggtcgggcttgctgtgttagagctgaacaataaagaggctgatagcattaaaaacggtgttcagttgcttagtagggcttacaccattgacccatcgaacccgatggtgctcaatcacttggcaaatcactttttctttaagaaggattactcaaaagtccaacatcttgcgctacatgccttccacaacactgaagtcgaagctatgcaagcagagtcttgctatcagctcgccaggagtttccatgtgcaggaggattatgatcaagcatttcagtattactaccaagctactcaatttgcctccagttcatttgtgcttcctttcttcggcctgggccagatgtacatctatcgcggcgacaaggaaaatgctagccagtgcttcgaaaaggtattgaaagcataccccaataactacgagaccatgaagatccttgggagtctttacgctgcttcagaagaccaggaaaaacgcgatatagctaagggccatctgaaaaaagtgactgaacagtacccagatgacgtggaggcttggatcgagctggcacagattctggagcagaccgacatacaaggagcgctcagtgcatatggcaccgctaccagaattctgcaagaaaaagtgcaggctgatgtccctcctgaaattctcaacaatgtcggcgcactccattttcgcctaggaaacctcggggaagccaagaagtacttcttagcgagccttgatagagcaaaggcagaagccgagcacgatgagcattactacaatgcaatcagtgtgacaacgtcgtacaatctcgcccgcctgtacgaggccatgtgtgaattccacgaggccgagaagctatataaaaatattcttcgcgagcatccaaattacgtagactgctatctaagactgggtgctatggcacgcgataaggggaacttttacgaggcatccgattggttcaaggaagccctccagattaaccaagatcatccagacgcctggtcgctcattggaaatctgcatttagccaagcaggagtggggcccaggccagaaaaagttcgagcgaatcctcaagcagccctccacacaaagcgatacatacagcatgctggccctcgggaacgtgtggctgcagacccttcatcagccgacacgtgatcgtgagaaggaaaagcgccatcaggaccgggctctggcaatttacaaacaggtgttaaggaatgatgcaaagaacctgtatgcagcaaacggaatcggcgcagtgctggctcataaagggtacttccgcgaggccagagacgtgttcgcccaggtgagagaggccactgccgatatctccgacgtatggctaaacctagcccatatttacgtggagcagaagcagtacataagcgcagttcagatgtacgaaaactgcttgcggaagttctacaagcatcagaatactgaggtagtactgtacctcgcccgggctctctttaaatgtggaaagctgcaggagtgcaaacaaactctcctgaaagcgagacatgtggccccaagcgacactgtgttgatgttcaacgtggctctggtcctccagaggctcgcaacctctgtccttaaggatgaaaagtcaaacctaaaagaggtcctgaacgccgtcaaggagctggagctggctcaccgttactttagctacctgtcgaaggttggcgacaagatgcgcttcgacctagcacttgccgctaccgaggcacgtcagtgttctgatcttttgtctcaggcacagtatcatgtggcacgtgcccggaagcaagacgaagaggagagagagttgcgcgccaaacaggaacaggagaaggaattgctgagacagaagctgctcaaggaacaagaagaaaagcgactccgggagaaagaagaacagaagaagctgttagagcaacgggctcagtacgttgagaaaactaagaatatcttgatgtttactggagaaacggaggccacgaaagaaaaaaaacgaggaggcggcggaggccggcggagcaagaaagggggagaattcgatgaatttgtcaatgacgacaccgacgatgatctgcctatatctaaaaaaaaaaagcggaggaagggttctggctcagaacaggagggagaagatgaggagggtggcgaaaggaaaaagaagaagcgtcgacggcatcccaaaggggaggagggcagcgatgacgacgaaaccgaaaacggaccaaaacccaaaaagcgcagaccccccaaggcagagaaaaagaaggcacccaagcccgagcggttaccgccatctatgaagggaaaaatcaaatcgaaggctatcatttccagcagcgacgattcttcggacgaagacaagctgaaaattgccgatgaaggacatccgcgcaattccaacagcaattctgattctgatgaggatgagcagaggaagaaatgcgcttcaagtgagtcagatagcgacgaaaaccagaataagtcgggcagtgaagccgggtccccacgccggccacgccggcaaagaagcgatcaagatagtgatagcgatcagccatcgcgaaagagacgccctagtggctctgagcaatccgataatgaatcagtgcagtcgggaagatcccatagcggcgtttcagaaaacgattccagaccagcatcaccgagcgcagagtccgaccatgagtccgaaagggggagcgacaacgagggatctggccaagggtccgggaacgaaagcgaaccagaaggcagtaacaacgaggcttctgacaggggctcggagcatggctctgatgactcggattag

SEQ ID NO: 18971 - DNA, 3693 bp, Artificial Sequence
  Description of Artificial Sequence: Synthetic coding sequence
atggccagcgccagctaccacatcagcaacctgctggagaagatgaccagctccgacaaagacttcaggttcatggcgacaaatgatttgatgacagaacttcaaaaagactccatcaagctggatgacgattcagagagaaaggtggtgaaaatgattttaaagctgctggaagataaaaatggagaagtgcagaacctggccgttaagtgtctcggaccgttggtcagcaaagtgaaagagtaccaggtcgaaaccattgtggacacgctgtgtacgaacatgttgtctgacaaggagcagctccgagacatttcgtcaataggacttaagaccgtgatcggcgaactaccacctgcttcatctggttccgccctagctgccaatgtttgtaagaagatcaccggccggctgacgagcgcaatagctaaacaggaagacgtttctgttcagctcgaggccctcgacataatggccgacatgctgtcacgccagggcggactgctggtgaatttccacccaagtatcctgacatgcttactcccacagctgacatcaccgcgattggcagtccgcaaacgaactataatcgccttgggccatctggttatgtcatgtggaaacattgttttcgtcgacctgatagagcatctgttgtccgaattatctaagaatgattccatgtccaccactagaacgtacatccaatgtatcgctgccatcagtcggcaagcagggcaccgaattggcgaatacctggagaaaattattccattggtggtgaaattttgtaatgtggatgatgacgaactgcgcgaatattgtattcaggcctttgagtccttcgtgagacgctgccccaaagaagtttacccacatgtctcgacaattataaatatttgtctgaagtacctcacctatgaccctaattacaactatgatgacgaagacgaagacgagaatgctatggatgccgacggcggggacgatgatgatcagggctctgatgatgagtattccgacgatgacgatatgtcctggaaggtacggagagcagctgcaaaatgcttggatgctgtcgtgtccacccgacatgagatgctgcccgagttctataagaccgtctcacccgcactgatttctcgcttcaaagaaagagaagagaatgtgaaggctgatgtgtttcatgcctacctgtcactgttaaaacagacaagacctgtccaatcctggctatgcgacccagacgccatggaacagggcgagacacctcttaccatgttgcagtctcaggtgcccaatatcgtgaaggctctgcataaacagatgaaggaaaagtcagtcaagaccagacagtgctgttttaatatgctcacagagctggtgaatgtcctccccggcgcactgacacaacacatccctgtactcgttcctggtatcatcttctctctgaatgataagtcttcctctagcaacctgaagatagatgccctgtcctgtctgtacgttattctttgtaaccacagtccacaggtgttccacccgcacgtgcaagcattggtgcctccagtggttgcttgtgtaggagaccccttctacaagatcacaagcgaggccctactggtgactcaacagctagtgaaagttattagacccctcgatcagccctcctcgttcgacgccacgccatacatcaaggatctctttacatgcactattaagcggctgaaagccgctgacatcgaccaggaggtcaaggagagggcaatttcatgcatgggtcagatcatctgcaacctaggtgataatttgggcagcgacctgcctaacaccctgcagattttcctggagcgactgaaaaatgaaattaccaggcttactaccgttaaagcactaacgctcattgccgggtctccattgaagattgacctgaggcctgtcctgggggagggcgtacccatcctggccagctttttaagaaagaatcagcgggccctaaagctggggaccttgtccgccctggacattctgatcaagaactatagtgactccctcacagccgcgatgatagacgctgtactggacgagttgccaccccttatttccgaatccgacatgcacgtctctcagatggccatctcattcctcacaacactggcaaaagtgtacccatctagcctgtcaaagataagtggcagcatcctgaacgagttgattggtcttgtgaggtctccgctactgcagggtggggctctctcggctatgctggactttttccaagcgctggtagttaccggtaccaacaatctgggatatatggacctcttgagaatgctcaccggacccgtttactctcagtctacggctttaacccacaaacagagctactactccattgccaagtgcgtagcggcacttacaagggcctgtccaaaggagggtcccgcggtggtggggcagtttatccaggatgttaaaaactctagatccacagactcaatacgacttctagctctgctgagcctgggtgaggtaggtcatcacatagacctgtccggccagttagaactcaagtcagttatcctggaagccttttcgagcccatccgaggaggtgaaatcggctgcttcgtacgccctgggcagcataagcgttggaaacctgccggaatatttgcctttcgttctgcaggagatcaccagtcaacctaagcgtcaatacctgctgcttcactcccttaaagaaatcatctcatccgcctcagttgtaggactgaaaccttacgttgagaacatttgggcgctgctcctgaagcactgcgagtgcgcggaagagggcactaggaacgtggtggcagaatgtctcggcaagcttaccctgatcgatccagagactcttctccctagactgaaagggtacctgatttcagggtcgtcttacgccagatccagcgtagtgacagcagttaagttcacgatttccgatcaccctcagccgattgatcctctcctcaagaactgcatcggagacttcctcaagacactggaagatccggacctgaacgtgagacgcgtggcgctggtgacattcaattccgccgctcataacaaaccatcgttgatacgggacttactggacactgtcctgccacatctgtataatgagacaaaggtgcgcaaagaactgattcgggaggtggaaatgggcccatttaagcacacagtagatgatggcctcgatattcgcaaggccgcctttgagtgcatgtacaccttgctggactcgtgcttggacagacttgatatatttgaatttcttaaccacgtggaggatgggttaaaggaccactacgatatcaaaatgttgactttcctcatgttggtgcgtctcagcacgctttgtcccagcgccgtactgcaacggctggatcggctggtggagcccctcagggcaacatgcaccactaaagtcaaagcaaattcagtgaagcaggaattcgagaagcaggatgagctgaagcgatcagcgatgcgtgctgtggctgccctgctcacaatcccagaagcagagaaatcacccctgatgagcgagtttcaatctcagatctcgtctaatcctgagctcgctgccatctttgaaagcatacagaaagacagctcctctaccaacttagagagtatggatactagttag

SEQ ID NO: 18972 - DNA, 1209 bp, Artificial Sequence
  Description of Artificial Sequence: Synthetic coding sequence
tacgagctggtgagccggcagggcggcctgctggtgaacttccaccctagcattctcacatgcctgcttccccagctaacctcgcctcgtctcgcagttagaaagcggactatcatagccctgggccacctcgtcatgtcttgtggcaacatcgttttcgtggatctcatagaacatctgctgtctgaactcagcaagaatgatagcatgtctacaactcgtacttatattcagtgcatcgctgccatctctcgtcaagccgggcatcgaattggcgagtacctggagaaaatcatcccattagtggtgaaattctgtaacgtggacgacgatgagctgagagaatattgtattcaggcttttgagtcctttgtgaggcgctgccccaaggaagtgtatcctcacgtgtcaaccattatcaacatttgcctgaaataccttacttacgatcctaattataattacgatgatgaagatgaggatgagaatgccatggacgccgacggaggtgacgacgacgaccagggtagcgatgatgagtactctgatgatgacgacatgtcatggaaggtgagacgggcagcagctaaatgcctcgacgccgttgtttctaccagacacgaaatgctgcccgaattctacaagaccgtcagcccagccttgatcagcagattcaaagaacgagaagagaacgtgaaagccgacgtgtttcatgcttacctctccctgctgaagcagacgagacctgtgcaaagctggctttgtgatcctgacgccatggaacagggagagactccattaacaatgctgcagtcccaagtgccaaacattgtaaaggcattgcataagcagatgaaagaaaagtccgtaaagacgcgccagtgttgtttcaatatgctaacggaactggtcaacgttctgcctggagccttgacacagcacattccggtcctggttcccgggatcattttttctctgaacgacaagagctcatcctccaatctgaagatcgatgccttgtcatgtctgtacgtgattctttgtaaccactctccgcaagtattccatccacacgtccaggccctcgtcccaccagtcgttgcatgcgtaggagacccattctacaaaataacttctgaggccctccttgtgacccagcagttggtcaaagctcatcatatgccagaggctcagtggctcagactgtag

SEQ ID NO: 18973 - DNA, 3693 bp, Artificial Sequence
  Description of Artificial Sequence: Synthetic coding sequence
atggccagcgccagctaccacatcagcaacctgctggagaagatgacctctagcgataaggattttagattcatggctaccaatgatctcatgacggagctgcagaaagattctattaagctggacgacgactccgagaggaaagttgtgaagatgatactgaagctcttggaagacaagaatggagaggtgcagaatttggcggtgaagtgcctcggacccttagtcagtaaagtgaaagagtatcaagttgagacaattgtggataccttgtgcacaaatatgttatccgacaaggagcagctccgcgatatcagcagcatcggccttaagactgtgattggtgagctgcctcccgctagctccggcagcgccctcgctgccaacgtctgcaaaaagatcactggccgcttgacatccgccatagcaaagcaggaggatgtgtccgtccagttggaagcactcgatataatggcagacatgctgtcacgccaaggaggactgctggtcaactttcacccctccatcctgacctgcctcctgccacaattgaccagcccacggctcgccgtccgaaagagaactattatcgccctcggtcacctggtgatgagttgtgggaatatagtgtttgtggatctcatcgaacacctgctgtcagaactgtcaaaaaacgacagtatgtctaccacccgcacatacatccaatgtattgccgccataagtaggcaggcagggcataggataggcgaatatttggagaaaatcatacccctcgtagtcaagttctgcaacgtggacgacgatgaactccgggagtactgcattcaggcgttcgagagcttcgtcaggagatgtcctaaggaggtatatccccacgtctccaccattatcaatatatgcctcaagtatctgacttacgatccaaactacaactacgatgacgaggacgaagatgagaacgccatggacgcagacggaggtgatgatgacgaccagggttccgatgacgagtactccgacgacgacgatatgtcctggaaggtgaggagagcggctgccaagtgcctggatgccgttgtgtcaacccggcacgagatgctccctgagttctacaaaaccgtaagccccgcgctgatttccagatttaaagagcgtgaagagaatgtgaaggcagatgtttttcacgcctacctgagtctgctgaaacagactcgcccggtgcagtcttggctctgcgacccggacgctatggagcagggtgagacacccttgacgatgttgcagagccaggtgcctaatatcgtgaaagcactccataaacaaatgaaagaaaaaagtgtcaaaactaggcagtgttgctttaatatgcttacggagctggttaacgtgctgcccggtgcattaactcaacacatccccgtgcttgtgcccggaatcattttttcactcaatgataagagttcgtccagcaacttgaaaatcgacgccctatcctgcctttacgtcatcctttgcaaccactcacctcaagtgttccacccacacgtgcaggccctcgtgccacctgtagttgcatgcgtgggcgatcctttctataaaattacatccgaggcgcttttggtgactcagcagttggtgaaagtgatccgccctttggaccagcctagctcttttgacgcgactccatacatcaaggacctattcacgtgcaccatcaaaagattgaaggccgccgatatagatcaggaagttaaagagcgagccatctcgtgcatgggtcagataatctgcaatctgggcgataatctgggttccgacctccccaacactcttcaaattttcttggaacggttgaagaacgaaattacaagacttactacagtcaaggccttgaccttaatcgcagggtctccattgaagatagacctccgccccgtgttgggagagggcgtgccgatcttagcttccttcctcaggaaaaatcagagggctctgaaactcggcacattaagcgctctcgacattcttatcaagaactactcagatagtctgactgctgctatgatcgatgcagttctggacgaactgccgccgctgatttctgaaagtgatatgcacgtgtcccagatggcaattagcttcctgaccacgctcgccaaggtctatccgtcgtccttgtccaaaatctccggaagcatcctgaatgaactgatcggcttagttaggagcccactcctacagggtggcgcgctgtctgctatgcttgacttttttcaggctctcgtggtcacgggcaccaacaacttaggatacatggacttgcttaggatgttgacaggccccgtgtactctcaatcgactgctctgacacacaaacagtcatattattcgatcgctaagtgcgttgccgccctcactcgtgcatgtccaaaggaggggcccgcagtcgtggggcagttcatccaggatgttaagaattcaagaagcaccgactccatacggctgctggccctcttgtcactcggtgaggtggggcatcacatcgacctgagtggccagctggagctgaagtcggtgatcctggaggcctttagctctccctccgaggaggtaaaatcagccgcctcttatgcgctgggctcgatttctgtggggaatctgccagagtatctccccttcgtcctgcaagaaatcacgagccagcccaagcgccagtacctattgcttcacagcctgaaagagatcataagcagcgctagtgtcgtcggcctcaaaccttacgtggaaaacatttgggcactcttgctgaaacactgcgaatgtgccgaggaaggaaccaggaatgtcgtggcagagtgcttgggaaagctgacccttatcgaccccgagacactgctccccaggctaaaaggttacctgatttccggctcaagttacgcccgatcaagcgtggtgactgccgtgaagttcaccatcagcgatcatccacagccaatcgatcccttacttaagaactgtattggcgattttctaaagacacttgaagacccggacctgaacgtgcgccgggtggcattagtgacctttaactccgccgcacacaataagccctcactcattcgggacctcctggacacggtgttgccacatctgtataatgagaccaaagtcagaaaggagctcattagagaggtggagatggggccttttaaacacacggttgacgatggtttagatatccgcaaagccgcctttgagtgtatgtatactctgctagactcatgcctcgacaggttggacatctttgaattcctgaaccatgtcgaggacggactgaaagatcattacgatattaagatgttgacctttttgatgcttgtgagactctcgactctgtgtccttccgctgtgttacagcgtcttgataggctagttgagcccctccgggcaacttgtaccaccaaagtcaaggcaaactctgtcaaacaagaatttgagaagcaagacgagcttaaacgctccgcaatgagagccgtggccgcgctgctgacaattccagaggccgaaaagtcccctctgatgtctgaattccagtcccagatcagttccaacccagagctagctgcaattttcgaatccatccagaaggacagcagctcaaccaatctggagagcatggacacgtcatag

SEQ ID NO: 18974 - DNA, 3360 bp, Artificial Sequence
  Description of Artificial Sequence: Synthetic coding sequence
atgagcaccgccgccttccacatcagcagcctgctggagaagatgacaagctcggataaggactttcggttcatggctacctcagacctgatgtctgaattacagaaagacagcattcagttggatgaagactccgaacgtaaggtggtgaaaatgctgctcagattgctggaagacaagaatggcgaggtccagaacctggccgtgaaatggctgggggtgccgttgggtgcctttcatgcttcactgttgcattgcctgctgccacagcttagcagcccccgtcttgccgtcagaaagagggccgtgggagccttaggtcacctcgctgccgcctgcagcacagacctctttgtcgagttggcggaccacctgctggatcgcctgcctggccctcgcgtgcctacgtccccgacagccattaggaccttgatccaatgcttaggcagtgtcggtcggcaggcagggcatcgcctgggcgcacatcttgataggttagtgcctcttgtagaagatttttgcaacctggacgacgacgagctgcgcgagtcttgtctccaggcctttgaggcgtttctccgaaaatgtccgaaggaaatggggccccacgtgcctaatgttacatccttatgcctccagtatatcaagcacgatcccaattataattacgacagcgacgaggatgaagagcagatggagacagaggacagcgagttcagcgaacaggagagtgaggatgagtactctgatgacgacgatatgagctggaaggtccgccgggctgcagctaaatgcatagcagcccttatatcttctcgacccgaccttctgcccgattttcactgcacattggctcctgtgctaattaggaggttcaaggaacgcgaagagaatgtgaaagctgacgtctttactgcctacatcgtgctgctgcggcaaacacaacctccgaaggggtggcttgaagctatggaggagccgactcaaacaggaagcaatcttcatatgcttagagggcaggtcccactggtcgtcaaggctctgcaaagacaactaaaggatcgaagcgtgagggccagacaggggtgcttttcactcctcacagagctggcgggcgtcctccctggctcgctcgccgaacatatgcccgtgctggttagcggcattattttttcccttgcagatagatctagctcctcaacgatacggatggatgcacttgccttcctgcagggactgctgggcaccgagccagctgaagcgtttcacccgcacctgcccattctgcttccgcctgtcatggcctgtgtcgcagactcattttataagattgctgcagaagccctggttgtgctccaggagttggtccgggcgctgtggcccctgcacaggcctcggatgctggaccctgaaccctacgttggggagatgtcggctgttaccctggcccggctaagggcaacagatctagaccaggaggtgaaagaaagggccatttcttgtatgggacatctcgtggggcacctcggtgatcgcctcggggacgatctcgagccaaccttgttgctgcttttggatcgcctgcggaacgagatcacacggctcccagccataaaggccctgacccttgtggcagtttcccccctccagctagatctgcagccgatattggccgaggccctgcacatcctggcctccttcttgcggaaaaatcagcgtgccctccgactggcaacccttgctgcactagatgcgctggctcagtcgcagggtctaagtttgcctccaagcgcagtgcaagctgtgctggccgagctgccggctcttgtgaacgagtctgatatgcatgtagcgcagctggccgtcgattttctcgcaactgtgacacaggcccagccagcttcactagtggaagtgtctggcccggtgctgtctgagcttttacggctcctacgctctccactgctccctgcaggcgtgctggccgccgctgagggtttcctgcaggcattagttggtactaggcccccatgtgtcgattatgccaaattaatatccttactcacagcccctgtctacgagcaggcagtggacggcgggcctggcctccacaagcaagtattccattccctggcccggtgtgtcgccgctctgagtgctgcctgccctcaggaagctgcctccactgcctcccggctggtttgcgacgctcgtagtccccattcctctacaggtgtgaaagtgttggcttttctctctttagccgaggtgggtcaggtcgccggccccgggcatcagagggagctcaaggcggtattgctcgaggcgctggggtctcccagtgaagacgttcgtgcagccgcctcctacgcccttggcagagtgggcgcaggtagcctgcccgacttcctgcccttcctgctggagcagatcgaagcagaaccgcgcagacagtacctcttattgcactccttaagggaggccttaggcgctgcccaacctgactcactgaaaccatatgccgaggacatttgggccttgctttttcagagatgcgaaggcgcggaggaaggaaccaggggcgtcgtggcagaatgcattggaaagctagtgctggtcaacccatcctttctgttgcctcgcctgagaaagcagctcgccgccggcagaccccacacgaggtcaaccgtgatcacagctgtcaagtttctgatcagcgatcagccacaccccatcgatccccttctgaagagtttcatcgcagtccacaacaaaccgtcccttgtgcgagatttgctggatgacattttaccccttctgtaccaggaaacaaaaatccggcgggatctgatccgggaggtggaaatggggcctttcaaacatactgtggatgatggccttgacgtccgtaaagcggcattcgagtgcatgtatagcctgctggagtcctgcctggggcagcttgatatttgcgagttcttgaatcatgtggaagatgggctgaaggaccactacgacatcaggatgctcaccttcataatggttgcccggttggcaacactgtgccctgctcccgtcctacagcgagtggaccgtctcatagagcctctgcgcgcgacatgtacggccaaggtcaaagctggcagcgtgaaacaggaattcgagaagcaggacgaactcaagcggtccgctatgcgtgccgtggcggccctgcttacaataccagaggttggaaagtccccaatcatggcagatttctcctctcaaatcagatcaaatcctgaactggctgccctgttcgagagtatccaaaaggacagcgcgagtgcaccctccactgactccatggaattatcctag

SEQ ID NO: 18975 - DNA, 3711 bp, Artificial Sequence
  Description of Artificial Sequence: Synthetic coding sequence
atgagcaccgccgccttccacatcagcagcctgctggagaagatgacaagctctgataaggactttaggttcatggcaacctctgatttaatgtccgagctccagaaggacagcattcagctggacgaggatagcgagcgaaaggtggtgaagatgctgctgcggttgctcgaggataagaatggagaggtgcagaacctggccgttaaatgcttaggtccgttggtggttaaggtgaaagagtatcaagtcgagactatcgtggataccttgtgtaccaatatgagatcggataaagaacaactacgggacatcgccggaattggactgaaaaccgtgctgagtgaattacctcctgctgcgactggttctggcttggccaccaatgtttgtaggaagattacaggacaacttacaagcgccatcgcccagcaagaggatgttgcagtgcagctggaagccttagacattctgagcgatatgttgagccggttgggcgtgcctctgggagcttttcatgctagcttattgcactgcctgctgccacagctgtcttccccaaggctggccgtgaggaagcgggctgtcggcgccctgggccatctggcggccgcgtgcagcacagacttattcgttgagctggcggaccaccttttggaccggcttccaggtccacgtgtgcctacctctccaactgctattcgtactctcattcagtgtttaggaagcgtgggcagacaggccggccatcgcctaggggcgcatctagatcgtctggtgccattggtggaggacttctgcaacctcgacgacgacgagctacgcgagtcttgtttacaagctttcgaagccttcttgaggaagtgccccaaggaaatgggcccccatgttccaaacgtgaccagcctgtgccttcaatatattaagcatgaccccaattataattacgacagtgatgaggatgaagagcagatggagaccgaggactctgagttcagcgaacaggagtccgaggatgagtattcagacgatgacgatatgagttggaaagtgagacgggcggccgccaaatgcatcgccgctctgatttcctctaggccagacctgctaccagacttccactgcaccctggcccctgtgctgattcggagatttaaggaaagggaagagaatgtaaaggcagacgtgtttactgcttacatcgtgcttctcaggcagacccaaccacccaaggggtggctcgaagccatggaggaaccaacacagacagggagcaacctccatatgcttaggggtcaggttccccttgtggttaaagcgcttcagcgccagctgaaggatcgatccgtccgagctcggcagggatgcttcagcctgttgacagaacttgcgggcgtgttgcctgggagtcttgctgagcacatgccagttctcgtgtccggaattatattttctctagccgaccgcagtagttcaagtactatacgaatggatgccctcgcatttctgcaaggcctgctggggactgaaccagccgaggcctttcacccacacctgcctatcctgctccctccggttatggcatgcgtcgctgattccttctataaaatcgccgccgaagctctggtcgttttacaggaactagttagagctttatggcccctgcacagaccccgcatgctggacccagagccatacgttggggaaatgagcgcagtcactcttgcacgcctaagagccaccgatctcgatcaggaagtgaaggagcgggctataagctgtatgggccaccttgtgggccacctgggagatcgccttggcgatgacctggaacccaccttgctactgttactggatagactgcggaatgagataacaagactgccagctattaaagccctaactttggtggccgtgagccccctgcagcttgacctgcaacctatcctggcagaagccctgcatatactagcttctttcctgaggaaaaaccaacgagctctgaggctcgctacacttgccgcgcttgacgcccttgcacaaagccaggggctgtccctgcctcctagcgctgtgcaagccgtgctggctgagctgcccgcgctggttaacgagtctgatatgcatgtcgcacaactggccgtggactttttagctactgtgactcaggctcagcctgcgagtttagtggaagtgtcgggccccgtgctcagcgaattgctacggctcctacgatcacccctgctgcctgcaggcgtgctcgcggccgctgagggctttctccaggctttggttggcacacgacctccatgcgtggactacgctaagctaatttccctgcttacagcccccgtgtacgagcaagccgtggacgggggtccgggactacacaaacaggtgttccatagcttggctaggtgtgtggcggccctctctgcagcctgtccccaggaagcagcatccaccgcctctagactggtgtgcgatgctagatctccacattcctctacaggggtcaaagtattagcctttttgtccctggccgaagtgggacaagtggctggtcctggacaccagcgagaattaaaggcggtcctcctggaggccttgggttctccatccgaggacgttagagctgctgcatcctacgctctgggacgggttggcgcagggtcgctcccagatttcctcccctttctcctggaacagatcgaggcggaaccgagacgccaatatctcctgctacattccttgcgcgaggcacttggcgccgcccagccggatagcctgaagccctacgctgaggatatctgggcattgctgtttcaaaggtgcgaaggggccgaggagggcaccagaggagtggtggccgagtgcatcggtaaactggtcctggtgaacccctcctttctgctgccccgactgagaaaacagctggcggccggcagaccccacaccaggagtaccgtaattacagctgtcaaatttcttatctctgaccagccacaccctatcgatccattacttaaatctttcataggtgagtttatggagagtttgcaggatccggatctcaatgtcagaagagcgacacttgccttctttaactcagcagttcacaataagccttcgttggttcgagaccttttagatgacatccttcccctactctatcaagagacaaagatccggcgagacttgattcgcgaagtggagatggggccattcaagcacacagtggacgacggactcgatgtgagaaaagcagctttcgagtgcatgtacagcctgcttgaatcctgcttggggcagcttgacatttgtgagtttctgaatcacgtggaggatgggctgaaggaccactacgacataagaatgcttacgtttatcatggtggctcggctcgcaactctgtgccctgcacctgtgctccagcgcgtcgaccgcttgatagaacctcttagggctacctgcactgctaaggtgaaagctggctccgtgaaacaggaattcgaaaagcaagatgaacttaaacggagtgctatgcgggcagtggcagcccttctcaccatccctgaggtgggcaagtctccgattatggcggatttctcctctcaaataaggtctaacccagagttggcagctctgttcgagtcgatccagaaagattccgcttccgctccctccacagattctatggagttgtcttag

SEQ ID NO: 18976 - DNA, 4461 bp, Artificial Sequence
  Description of Artificial Sequence: Synthetic coding sequence
atggccgccaacgtgggcagcatgttccagtactggaagcggttcgatctgagaaggcttcagaaagaactgaactcagttgcgtcggagctgtcagctcgccaagaagagagcgaacattcccataagcacctgattgagctccggagagagtttaaaaagaacgtccccgaagagattagggaaatggttgcccccgtcctgaagagtttccaggcggaggtggtggccctgtcgaagcgctcccaagaggccgaagccgcttttctgtccgtctataagcagctgatcgaggcccccgaccccgtcccggtgttcgaggctgcccgatccctggacgatcggctgcagccaccctcgttcgatccgagtggacaaccgcggagagatctccacacgagctggaaaaggaatcccgagcttcttagtcccaaggaacagcgcgagggcacgtcacctgctgggcctaccctgaccgaagggtctcgactcccaggaattcctggtaaagccctgctgacagaaaccctgttgcagcggaacgaagctgaaaagcagaaaggactccaggaggttcagattacactggctgctaggctaggcgaggcggaggaaaagattaaagtgttgcatagcgccttgaaagcgacccaggccgaactgcttgaactcaggaggaagtatgacgaagaagctgcatcaaaggcagacgaagttggactgattatgacgaatttagagaaggcaaatcagagggctgaagcagcccaacgtgaagttgaatctctccgggagcagcttgcatccgtgaatagcagcatcaggctcgcctgctgttctcctcagggtcctagcggggacaaagttaatttcacactgtgttctggaccgaggctggaagcggcactcgccagtaaggaccgagagattctgcgacttttaaaggacgtgcaacacctgcagagctccctgcaagaattagaagaagcatctgctaaccagattgctgaccttgagaggcaactgactgcaaaatccgaagcgatcgagaagctcgaagagaagctgcaggcccaatctgactacgaagaaattaagacggagctttccattctgaaggctatgaagctcgccagctcaacatgctcgctcccccaggggatggcaaagcccgaggattccctcctgatcgcaaaggaggcattctttcctacccagaaatttctcctggaaaagccatctcttcttgcaagccctgaggaggacccctctgaagatgactcaatcaaggattccctgggtacagagcaaagttatccctcgcctcaacaactcccccctccaccaggtccggaagacccactgagcccgagccctggacaaccattgctgggaccttctttggggcctgacggaacccgtacctttagtctctctcctttcccaagcctcgcctctggggaacgtctgatgatgcctccagctgccttcaaaggagaggcagggggtctactcgtattcccacccgctttttatggagccaaaccgcccacagcccccgccacccctgctccgggtcctgaaccgctggggggacctgagcccgctgatggtgggggaggaggggctgccggcccaggggccgaagaggaacaattggacaccgccgagattgccttccaggtcaaagagcagctcctcaagcacaatatcggacagcgcgtgtttggtcactacgttttgggactgtcccaagggtcagtgagtgaaatattagctcgcccgaagccttggagaaagcttaccgtcaagggcaaagagcccttcatcaaaatgaagcagtttttgagcgacgaacagaacgtattagcgctacggactatccaggttaggcagagggggtcgatcacaccccgcattagaacacccgaaactggttctgacgatgccatcaagtccatactggagcaggctaaaaaagaaattgagtctcagaagggcggggaacctaagactagcgtcgcaccattgtccatcgcgaacgggacaacccccgccagtacctccgaagatgccatcaaatctatcctggagcaggctaggcgcgagatgcaggcacagcaacaggccttactggagatggaagtggcccctcggggtcgatctgtaccacccagtccgccggagcgtccctctctggctacagcctcgcagaacggcgctcccgccctggtgaaacaggaggagggctctggcggcccggctcaagcaccgttgcccgtcctctctcccgctgcattcgtgcaatcaatcattcgcaaagttaaaagtgagattggagacgccggatactttgaccatcactgggcatccgatagaggactactgtcccggccttacgcaagcgtttcgccaagcctctcttcaagtagtagctcgggctactcgggccagcccaatggaagagcctggccccgcggggacgaggcccccgtgcctcctgaagacgaagcagccgcaggggccgaggatgaaccccctagaacaggggagctgaaggctgaaggggctacagctgaagccggggcgcgcctcccctactatcccgcctacgtgccacgcactctgaaaccgacagtgcctccactgacaccagaacaatacgaactctacatgtaccgcgaggtggatacccttgagctgacacggcaagttaaggaaaagctggcaaagaatgggatctgtcaaaggatctttggcgagaaagtgctagggttaagtcagggctctgtttctgacatgctctccagacctaaaccatggtctaagcttacacagaagggtagggagcctttcattcgcatgcaactctggctcagcgatcagttgggtcaggctgtagggcagcagccgggcgcatcccaggcctctcccaccgagccaaggagcagcccctcaccaccccctagtcctactgagccagaaaaaagcagccaggaacctctgtctctgtccctagaaagctcaaaggaaaaccagcaaccagaaggcaggtccagctcatctctgtcaggcaaaatgtattccggatcgcaggctcctggggggattcaggaaatcgtcgcgatgtctcccgagcttgacacatactccataaccaaacgggtgaaagaggtgctgaccgacaataacctcggacagcggttattcggggaatctatcctcgggttgactcagggatccgtgtcggatctcctgtcacgccctaagccttggcataagttgagtttgaaaggtcgcgagccttttgtccgcatgcagctatggctgaatgacccccataatgtggagaagttgcgcgatatgaagaagcttgaaaagaaggcctatttgaagaggcgttatggccttatcagcacagggtccgactccgagagccccgctacaagaagtgaatgccctagcccttgcctgcagccacaagatttgtctctgttgcagatcaagaagccacgcgttgtcctggccccagaggagaaggaagccttacgaaaggcataccaattggaaccatacccctctcagcagaccattgagctgctgtcgtttcagctgaatctgaaaaccaataccgttattaattggtttcataattatcgatcaagaatgcggcgtgagatgctcgtggaaggcacacaagatgaacccgacttagatccatctggcggacccgggattcttcctccaggccactctcaccccgacccaaccccacaatcccccgattctgagacggaggaccagaagcctactgtcaaggaattggaacttcaggagggaccagaagaaaactcaactccgctgacgactcaggataaggcgcaggtgcgaatcaaacaggaacaaatggaggaagacgctgaggaagaggccggctctcagccacaggacagtggggagctggacaagggccaaggcccacccaaagaggagcatccagaccctcctggtaacgatgggctccccaaagtagcccctgggccactcctccccgggggctcaacccccgactgccccagccttcacccacaacaagaaagcgaggccggagaacgacttcaccctgacccactcagttttaaaagtgccagcgagtcttcccgctgttcgctggaggtgtcactgaactcccctagtgcggctagtagccctggcctcatgatgagcgtgtcgcctgtaccatccagcagtgcgcccattagcccaagcccacccggcgcccctcctgccaaagtgccttccgcgagccccactgcggacatggccggcgccctacacccatcagcaaaggtcaacccgaacctacaacggaggcatgagaaaatggccaacctgaataatatcatttatcgagtcgagcgcgcagcaaaccgagaggaagcactagaatgggaattctag

SEQ ID NO: 18977 - DNA, 375 bp, Artificial Sequence
  Description of Artificial Sequence: Synthetic coding sequence
atggtggcccccgtgctgaagagcttccaggccgaggtggtggccctgtccaaacggtcccaggaagccgaagcagctttcttgagcgtgtataaacaattaattgaggctccagatcctgtgcctgtctttgaggcagcgcggagcttggacgacagactccagccaccatccttcgaccccagtgggcagcctagaagagatctgcacacaagttggaaacggaatccagaactgctgtccccaaaggagcagcgagagggcacttcaccggccggaccgaccctgacagagggaagtaggctgccgggcatccccgggaaggctttgctcacggaaacattgttacagaggaacgaggccgagaaacaatag

SEQ ID NO: 18978 - DNA, 2727 bp, Artificial Sequence
  Description of Artificial Sequence: Synthetic coding sequence
atgaagagcagcgtggcccagatcaagcccagcagcggccacgaccgccgcgaaaatttgaatagctaccagcgcaactctagcccggaggaccggtatgaagaacaggaaagatcaccgagagatagggactactttgattactccaggtccgactacgagcattcacgaaggggaaggtcttacgattcaagtatggagtcccggaacagggatcgcgaaaaaaggcgggaacgggagcgagacaccgatagaaaacgatccaggaagtccccgtctcctgggcggcgcaaccctgagacctcagtcacccagagcagctctgctcaggacgagccagcaactaagaagaaaaaagacgagttggatccactgttgacaagaaccggtggcgcttacattccgccggcgaagctgaggatgatgcaagagcagattacagataaaaattcacttgcctaccagaggatgtcatgggaagcactaaagaaaagcatcaacgggctcatcaataaagtgaacattagcaacatttctataatcatccaggagctgttgcaagaaaacatcgtgagagaccgcggtctgctgagccgcagtgtgcttcaagcacagagtgcttctcctatttttacccacgtatacgcagctctggtcgcaattatcaattccaagtttcctcagataggcgaactgattctcaagcgcttgattctgaactttcggaaaggctatcggagaaacgacaagcaactgtgcctcaccgctagcaaattcgttgcccacctgatcaatcagaatgttgcccacgaggtgctgtgtctggagatgctaacgcttctgctggaaaggcctaccgacgattctgtagaggtggctatcggatttctcaaagaatgcgggctgaaactgacccaggtgtcccccaggggaatcaacgcgatcttcgagagactgcgaaacatcttgcacgaatctgaaatcgataagcgcgtccagtacatgatcgaggttatgttcgccgtgcgcaaggatggatttaaagatcatcccatcatcctggagggtctagatcttgtcgaggaggatgaccaattcacacacatgcttccgttggaggacgactacaaccctgaagatgtgctgaatgtgtttaagatggacccgaacttcatggagaacgaggagaagtacaaagctatcaagaaggagatcttagacgaaggggatactgatagtaatactgatcaggacgcaggcagctcagaggaagatgaggaagaggaagaagaggaaggtgaagaggatgaggaaggacagaaagtcacaatccatgacaaaacagagattaatctagtgtcattccgacgcacaatctacctggcaattcaatcatctctggatttcgaggagtgcgctcacaagctcctgaagatggaattcccagagagtcaaaccaaggagctgtgtaatatgatcttggactgttgcgcccaacaaagaacctacgagaaattttttgggcttctcgccgggagattctgcatgttgaagaaagagtatatggaaagcttcgagggaatctttaaggagcagtacgacaccatccatagactggagaccaacaaactccggaatgttgccaaaatgttcgcccacctgttgtatacagacagtctgccctggtccgtgcttgagtgcatcaaactttctgaggagactactactagcagctcacgcatattcgtaaagatcttctttcaagaactgtgtgagtacatgggcctgccaaaacttaatgctcgcctaaaagatgagacacttcagcctttttttgagggactgctccccagggataaccctcgcaatacacgctttgcaatcaatttcttcaccagcatcggactgggcggtctgacagatgagttgcgggaacacctaaagaacactcccaaggttatcgtagcacagaaacccgacgtagagcagaacaaaagttcaccatcaagctctagtagtgcttcctccagcagcgaatcggactcttccgactctgatagcgactccagcgattcatctagtgaatcttcatcagaagagagtgattccagctccatttcctcccattcttcagccagcgccaacgatgtccgaaagaaagggcacggtaaaacccgaagtaaggaggtggacaaactcattaggaatcagcagactaatgataggaaacagaaggaaagaaggcaggaacatggacaccaggagacgcgaaccgaaagagagaggcgatcagagaaacacagggaccagaatagctccgggtctaactggcgggacccaataacaaagtatacctccgacaaggatgtgccctctgagcgtaataattatagcagggtggccaacgacagagaccaggagatgcacatagacttggaaaataagcatggagaccccaagaaaaagagaggagagcgccggaactcatttagcgagaatgaaaagcacacacatcgaatcaaggacagtgaaaatttccgcagaaaagatagatccaagtcgaaagagatgaatagaaaacatagcggatcccgatcagatgaagatcggtatcagaacggggccgaaaggagatgggaaaagagcagtcggtacagcgagcaatctcgagaatcgaaaaagaatcaggatcgccgtcgtgagaagtcaccggcaaaacagaaatag

SEQ ID NO: 18979 - DNA, 2238 bp, Artificial Sequence
  Description of Artificial Sequence: Synthetic coding sequence
atgaagagcagcgtggcccagatcaagcccagcagcggccacgaccggcgggagaacctgaacagctatcagagaaattctagcccggaagataggtacgaggagcaggaaagaagcccaagagatagggactacttcgactactcgcggagtgactacgaacactcacgacgcgggagatcttacgactcatctatggagtctcgcaacagagaccgcgaaaaaaggagggagagggagcgagacacagataggaaacggtcgaggaagtcaccctcacctggacgacgaaaccctgagacctcagtcacgcagtcatcgtcagcccaggacgaacctgcaactaaaaaaaaaaaggatgaactagatcctctgcttacgcgcacagggggtgcatacataccccccgccaagctgcggatgatgcaggaacagattaccgacaaaaacagcctcgcttatcagcgcatgtcctgggaggccctcaagaagtctatcaacggactaattaacaaggtgaatatctcaaacataagtattattatccaagaactcctgcaagagaacatcgtgcgaggtcggggtctgttgagtagatcggtgctgcaggcacagtctgcctctccaatttttacgcatgtgtatgccgcactggtggccattatcaatagtaagttcccccagatcggagagctaatcttgaagaggcttatactcaacttccgaaaaggatatcggaggaacgataagcagctatgtttgaccgcatcgaaattcgtggcccaccttatcaatcaaaatgtggcacatgaagtgctctgtcttgagatgctgacacttctcctggaacggccgaccgatgacagcgttgaagtggccattggcttcctgaaggagtgcggcctaaagcttacccaagtatcccctagggggatcaacgcgattttcgagagacttaggaacattctgcacgagtccgaaattgacaaacgagttcagtatatgatcgaggttatgtttgccgtgcgcaaggacgggtttaaggatcatcccattatcctcgagggactggatctcgtggaggaggatgaccaattcacccatatgttgcctttagaggatgactacaatccagaggacgttttaaacgtgttcaagatggacccaaatttcatggaaaatgaggagaagtacaaggcaataaagaaggaaatcttggacgaaggtgatacagattctaatacagatcaagacgcggggagctcagaagaggacgaggaagaagaagaagaggaaggagaggaagacgaagaggggcagaaggtcacaatccatgataagaccgaaatcaatcttgtttcttttcgtcgaaccatttatttagccatccagtcgagtctggacttcgaggagtgcgcccataagctattgaaaatggaattccctgagtcccagaccaaagaactttgcaacatgatcctggattgctgtgcccagcagcgtacctacgagaaattcttcgggctgctcgctggcagattctgtatgcttaaaaaagagtatatggagagttttgaaggcatttttaaggaacagtatgacacaattcatcggctggagaccaataagctgaggaacgtggccaaaatgttcgcccatctgctgtatacagactctttgccttggtcagtactggaatgtatcaagctttctgaggagaccacgacctcatcttcccggatatttgttaaaatattctttcaggagctctgcgagtacatgggattgcccaagctaaatgccagactaaaagatgagacactgcaaccttttttcgagggtctgctcccacgggataaccccaggaatactcgctttgcgattaatttttttactagtattgggctgggaggcctgacagatgaactacgcgaacacctgaagaacacgccaaaagtcattgtggcacagaaacctgatgttgagcagaacaaatctagtccaagctccagttccagcgcttcctcgtccagtgaatccgattcatctgattccgatagcgactccagtgactcttcctccgagtcttcaagcgaggagtcagactccagctcaatcagtagtcacagctccgcctctgccaacgacgtgagaaaaaagggccacggaaagacacgttctaaggaagtcgacaaattaatccgtaatcaacagacaaacgatcggaaacagaaatag

SEQ ID NO: 18980 - DNA, 2727 bp, Artificial Sequence
  Description of Artificial Sequence: Synthetic coding sequence
atgaagagcagcgtggcccagatcaagcccagcagcggccacgaccggcgtgaaaatctcaactcttaccagcgcaactcctcaccagaggataggtacgaggaacaggaaaggagcccaagggacagagattatttcgattacagtcggagcgattacgaacattctcggcggggcaggagttacgatagcagtatggaatcacgaaaccgcgacagggaaaagcgacgcgaacgtgagcgcgacactgacaggaaacgctcccggaagtcacccagcccaggccgacgcaatccagagacttcagtgacccagtctagcagcgcccaggatgaacccgccactaagaaaaagaaagatgagctggaccctctcctgacaaggactggcggtgcatacatcccccccgctaagctccggatgatgcaggagcagatcaccgataaaaactctcttgcataccagcgaatgtcctgggaggctctgaaaaagtcgattaacgggctgatcaataaagtgaacatctcaaacatcagcatcataatccaagagctcctgcaggaaaatattgttagggggcgcggcctgttgagccgttccgtcttgcaggcacaaagtgccagtcccatctttacccatgtatacgccgcattggtggcaatcatcaacagtaagtttccccagatcggtgaacttattctgaaaaggctgattctcaactttaggaagggttataggcgaaacgacaagcagctgtgtctgaccgcctcgaaattcgtggcccacctgattaatcagaacgttgcgcatgaagtcctgtgtctggaaatgctgactttattattggaaaggcccacggatgatagcgttgaagttgcaatcgggttccttaaagagtgcggcctgaagctgacacaggtatcacccagaggcattaatgcgattttcgaacgactgagaaacatattacatgagtcagaaatcgacaaaagggtccagtacatgattgaggtgatgtttgccgtcagaaaggatggattcaaagatcatcctattattttggagggccttgacctggttgaagaagacgatcagtttactcacatgctcccgttggaagacgattacaatcctgaggatgtcctgaacgtgtttaaaatggatcctaacttcatggagaacgaggagaagtataaagctatcaagaaggagatcctggacgagggtgataccgatagcaataccgatcaggacgccgggtctagcgaagaagacgaagaagaggaagaagaggaaggtgaagaggacgaggaggggcaaaaggttaccattcacgataaaacagagataaacctcgtctccttccgacgtaccatctatttagcaattcagtccagccttgatttcgaagagtgcgcacacaaactcctgaaaatggagttccctgagtcacagacaaaggagctgtgtaacatgatcctagactgttgtgcacagcagcgaacatatgagaagttttttgggcttctagctggccgattctgtatgttaaagaaggaatacatggagtcatttgagggaatattcaaagagcaatatgacactattcaccggcttgaaacgaacaaactaaggaacgttgccaaaatgttcgcccatctgctgtacaccgactccttgccctggtccgtcctcgaatgcatcaagctatctgaggaaacaacgacatccagttctagaatttttgtgaaaattttctttcaggagttgtgcgagtacatggggctccctaagctgaatgcacggctgaaggacgagaccctgcaaccattctttgagggcctgctccctagggacaatcccaggaatactcggttcgcgatcaatttcttcacttctatcggcctggggggccttaccgatgagctcagggaacaccttaagaacacaccaaaggtaatcgttgcccagaagcccgacgtagagcaaaataagtcttctcctagctcctctagctcagcaagttcatcaagcgagtccgattctagtgatagcgatagtgacagcagtgactcgtcctcagaaagtagctctgaggaatccgactcaagtagtatcagcagtcattctagcgcatcagccaatgatgtgcgtaagaaaggacacgggaaaacccggtcaaaggaagtggacaaactgatccgaaaccagcagacaaatgacagaaaacaaaaagaacggcggcaggagcatggccaccaagagactagaactgaacgcgagcggcgttcagagaaacatagggaccaaaactccagcgggtctaactggagggatcctattaccaagtacacatcagataaagatgtccctagtgaaagaaacaattattcccgggtcgccaatgatcgggatcaggagatgcacatcgatctcgaaaacaagcatggagaccctaagaagaaacgtggagagcgacggaactcgttttccgaaaatgagaaacacacccaccgcattaaagactccgaaaactttcgccggaaagacaggtcaaagtcaaaggaaatgaacaggaaacatagcggctcaaggagtgatgaagacaggtatcagaacggcgctgagaggcgatgggagaagagctccagatatagtgagcagagtcgggagtccaagaaaaatcaagatagaaggagggagaagtcaccagcaaagcagaagtag

SEQ ID NO: 18981 - DNA, 1419 bp, Artificial Sequence
  Description of Artificial Sequence: Synthetic coding sequence
atgagcaacatctacatccaggagccccccaccaacggcaaggtgttgctaaaaacaacagcgggcgacatcgacatagaactgtggtccaaggaggcccctaaagcttgccgtaatttcattcaactgtgcttggaggcctactacgacaataccatattccaccgcgtggttcctgggttcatcgttcagggaggcgaccctactggcaccgggagcggaggtgaaagtatctacggggcacccttcaaggacgagtttcattccaggttgcgcttcaaccgcaggggcctcgtggccatggccaacgccggctcccacgacaatgggtcccagttctttttcaccctgggaagagctgatgagcttaacaataaacatactatctttggaaaagtcacgggcgacacagtgtacaacatgcttcggctctctgaagtcgatatcgacgatgacgaaaggcctcacaatccccataagataaaatcctgtgaggtgctttttaaccccttcgacgatattatccctcgagaaatcaagaggctgaaaaaggaaaagccggaagaggaggtgaaaaaattaaagcctaagggcacaaagaatttcagcctccttagcttcggggaggaagccgaagaagaagaggaggaggtaaatcgcgtatcacaatcaatgaagggtaagtctaaatcaagccatgatctgctgaaggatgacccccatctatcttctgttccagtggtggagagtgaaaagggtgacgcgcccgatcttgtcgacgatggggaagatgagagcgccgaacacgatgaatacatcgacggtgacgagaagaacttgatgcgcgagcgaatcgcaaaaaagttgaagaaggataccagcgctaacgtgaagagcgcaggagagggcgaagtcgaaaagaaatccgtgtcccgaagtgaggagctgcgtaaagaagctcggcagctgaaaagagagttgctcgcagccaagcagaaaaaggttgagaacgccgcaaagcaggcggaaaaaagatccgaggaggaggaggcacccccagacggtgcagttgccgaataccgtcgagaaaaacagaaatacgaagccttgcggaaacagcaaagcaagaagggcacttctagggaggaccaaactcttgcactactgaaccaattcaagtcaaaactgacacaagccattgctgaaacccctgagaatgacattcccgaaacagaagtggaggacgatgaaggctggatgtcacatgtactgcagtttgaggacaagtctcggaaggtgaaggacgccagcatgcaagattccgatacttttgagatttatgacccaaggaatcctgtaaacaagcgccgtagggaggagtctaaaaaactcatgagagaaaaaaaggagcggcgctag

SEQ ID NO: 18982 - DNA, 1173 bp, Artificial Sequence
  Description of Artificial Sequence: Synthetic coding sequence
atgagcaacatctacatccaggagccccccaccaacggcaaggtgctgctgaaaactacagcgggtgatatcgacattgaattgtggagcaaggaagccccaaaagcttgccggaattttatccaactctgcctggaggcctattatgataacacaatttttcatcgagtcgtgcccggatttatcgttcaagggggagatcctactggcacgggctcagggggggaaagcatttatggggcacccttcaaagatgaatttcatagccgtcttcggttcaaccgaagggggctggtggcgatggcgaatgccggatcccacgataacggatcccaattcttctttacactcggaagagcagatgaactcaacaataagcacaccatctttggaaaggttacaggggatacagtgtacaacatgctgaggcttagcgaggtagatattgacgatgatgaaaggccgcacaacccccacaagataaaatcatgcgaggttctctttaacccttttgacgatattattcctagagagattaaacgactcaaaaaggagaaacccgaagaagaggtcaagaagttgaagccaaaaggtaccaaaaacttctcccttctcagtttcggggaggaagctgaagaagaggaagaggaggtgaacagggtgtcacaatcaatgaagggcaagagtaagagctcacacgatctgctcaaggacgaccctcatctaagcagcgtccccgtagttgaatcggagaaaggcgatgcacccgatttggttgacgacggggaggatgaatccgccgagcacgacgagtacattgacggcgacgaaaagaacctgatgcgcgagaggatcgcaaaaaagttgaaaaaagacacctccgccaacgtaaaaagtgcaggggaaggggaagtagagaaaaagagcgtgtcgagaagcgaggagttacggaaggaagcccgccagctgaagagagaattactggcagccaaacaaaagaaagtagagaacgcagccaaacaggcagagaagaggtcagaggaagaggaggctcctccagacggagccgtagccgagtatagacgcgaaaaacagaaatatgaggccctgcgcaagcagcagagtaagaaggggacatccagagaggaccaggagatcacaaaaagcagctag

SEQ ID NO: 18983 - DNA, 1971 bp, Artificial Sequence
  Description of Artificial Sequence: Synthetic coding sequence
atggagggcgacggcagcgaccccgagccccccgacgccggcgaggactctaagtcagagaacggcgagaatgcacctatctactgtatttgcagaaaacccgatatcaattgtttcatgatcggctgtgataattgcaatgagtggtttcacggcgactgtatccgcatcacagaaaaaatggctaaggcgattcgcgagtggtactgccgggagtgtagggagaaggatcctaaactagaaatccgctacagacacaagaaatcccgagaaagggatgggaatgaacgagacagcagtgaacctagagatgagggaggaggacggaaaaggccagtcccagaccctgatctgcagaggcgggcagggagcggcaccggagtgggcgccatgctggcccgcgggagcgcctcccctcacaaatccagtccccagcctctggtggcgaccccctctcagcatcatcagcagcagcagcagcagattaaacgcagtgcccgcatgtgcggcgagtgtgaagcttgtcgccgcaccgaagactgtggccattgcgatttctgccgcgatatgaaaaaatttggcggtcccaacaaaattaggcaaaagtgtcgactgcggcagtgccagctcagagcccgagagtcctataaatacttcccttcctctctctcacctgtgaccccctctgaaagtctcccccgtcctagaaggccacttccaacccaacagcagccccagcccagccagaaactaggacgcatcagggaggacgagggcgcggttgcaagttcaacggtcaaagagcccccagaggccaccgccacaccagaacccctcagcgatgaagatctccccctagaccccgatctgtaccaagatttctgtgctggggcctttgacgatcacggtctaccctggatgtcagacaccgaggaatctccatttcttgatcccgccctgcgaaaaagggccgtgaaggtaaagcacgtgaaaagacgagaaaagaagtcagagaaaaagaaggaagaaaggtacaaaaggcatcgccagaagcagaaacacaaggataagtggaaacaccccgagcgcgccgatgccaaagatcctgccagcctgccgcagtgcttagggccaggctgcgtgaggcccgcacaacccagctccaaatactgtagtgacgactgtgggatgaagctggcggctaatcgaatttacgagatcctgccccagagaatccaacagtggcagcagagcccatgcattgcagaagaacacggtaagaagctgttggagcggattaggcgggagcagcagtctgctcggactagacttcaggaaatggagaggcgcttccatgagctcgaggcaattatcttgcgagcgaagcagcaggccgtcagggaggatgaggagagtaacgagggagattctgatgataccgatctgcagatcttttgtgtgtcttgtggccacccaattaatccccgcgtggctcttcgacacatggaacggtgctacgctaagtatgagagccagacttcctttggcagcatgtatcctactcgtattgaaggagccactcggctattctgtgacgtgtataacccccagtctaagacgtattgcaagaggttacaggtgctgtgtcccgagcactcaagagatcccaaagtgccagcggacgaagtgtgcggttgcccgctcgtcagagacgtcttcgaactgacaggagacttctgtcgtctgccaaaacggcaatgcaacaggcattactgttgggagaagctgcgccgcgccgaggtcgacttggagcgcgtaagagtctggtacaagctagacgagctatttgaacaggagcgaaatgtacgcacagccatgacaaatcgagctggattgctcgccctgatgctgcatcagaccatccagcacgaccccctgaccactgacttaagatctagcgctgaccggtag

SEQ ID NO: 18984 - DNA, 1983 bp, Artificial Sequence
  Description of Artificial Sequence: Synthetic coding sequence
atggagggcgacggcagcgaccccgagccccccgacgccggcgaggattccaaaagcgagaacggcgaaaacgccccgatatactgtatttgtcgcaagccggacataaattgctttatgatcggatgtgacaattgcaatgagtggtttcacggggattgtataaggattactgagaaaatggccaaggcgatcagagaatggtattgtcgggaatgtcgagagaaagaccctaagttggaaattagatacaggcataagaagtctagagaacgagatggtaatgagcgggactcttccgagcctcgtgacgaaggtggaggccggaaaagaccagtccccgacccagacttacagaggcgggccggaagtgggaccggcgtgggggcaatgttggcacgcggaagcgcgtcgccacacaaaagcagtccccaacctcttgtcgccacacctagtcaacaccatcagcagcagcagcaacaaatcaaacgttctgcccgcatgtgcggcgagtgcgaagcctgtagaaggaccgaagactgtggccactgtgacttttgccgggacatgaaaaagttcggggggcctaataagatccggcagaaatgtcgcctccggcagtgccagctcagggcacgcgaatcttacaaatactttccaagttccctgtctcctgtgacaccttccgagtcactgccccgcccacgccggcctctgcctacacagcaacagcctcagccatcacagaaattagggcgcattcgggaagatgagggagccgttgccagctccaccgtgaaggagcctcctgaggcaacggctaccccagagcccctaagcgacgaggatctcccactggaccctgacctttatcaggacttttgtgcaggagctttcgacgaccacggacttccatggatgagcgacacggaggaatctccattcctcgacccagcgctgcggaaacgagctgtgaaggtgaaacacgtgaagaggcgcgagaagaagtctgagaagaaggttatggagaggaaagaggagcggtacaaaagacacaggcaaaagcagaagcataaggacaagtggaaacaccccgaaagagcggacgccaaagaccccgcatctctgccacagtgtctcggtccgggttgtgtcaggcctgcgcagccttcttcaaagtattgttccgacgattgtggaatgaaattggctgcaaatcgcatctatgagatactaccccagagaatccagcagtggcaacagtccccctgcattgccgaagagcatggcaagaagttactggagagaatccgcagagagcaacagtccgccaggacgcgtttgcaggagatggaacggaggtttcacgagctggaagctataattttgagggctaagcaacaggccgtgagagaggacgaggagagcaacgaaggagattcggatgatacagacctgcagatcttttgcgtgtcgtgcggtcaccctatcaatccacgggtggcactgcgacatatggagaggtgctacgcgaagtacgagtctcagacctccttcggtagtatgtatcctacacggatcgaaggagctacccggcttttctgtgacgtgtacaatccgcagagcaagacatactgtaagagacttcaggtgctctgtcccgaacacagccgagacccaaaagtgcctgctgacgaggtctgtggttgccccctcgtgcgcgacgttttcgagctgaccggggacttttgccgactgcctaagagacagtgtaaccgacactactgctgggaaaagcttagacgggcggaagtagatctcgaacgtgtccgcgtgtggtacaagttggacgaacttttcgagcaggagcgcaacgtgcggaccgcaatgacaaacagagccggcctcttggccctcatgttgcatcagaccatacagcacgaccccctgacgacagatttgcgctctagcgcagaccggtag

SEQ ID NO: 18985 - DNA, 834 bp, Artificial Sequence
  Description of Artificial Sequence: Synthetic coding sequence
atgagcctgtgcgaggacatgctgctgtgcaactaccggaagtgcaggatcaagctcagtggctacgcttgggtgactgcctgctctcatattttctgcgatcagcacggtagtggggaattctctcggagtcccgctatctgtccagcctgcaattctacgctgtctggaaagctcgacatcgtaagaacggagttatcacccagtgaagagtataaggcgatggtgctcgccgggctacgaccagagattgtacttgacatctcctcgcgggctcttgctttttggacatatcaggtgcatcaggagcggttataccaagaatataatttctctaaggctgaaggccacctaaagcagatggaaaagatttacacgcagcagatacagagcaaggacgtcgagctgactagcatgaagggtgaggttacgtccatgaaaaaggtgctggaggagtacaaaaagaaattcagcgatatttccgaaaaattaatggaacgaaatcgtcagtatcaaaaactgcaaggtctttacgatagcctgcgcctccgcaacattactatagcaaaccacgaaggcaccttagagccttccatgatagcccagagtggggtgctcgggtttccattaggtaacaatagtaagtttccactagataacaccccggtccgcaacaggggagacggcgatggagatttccaattcagacccttcttcgctggctcaccaaccgctccagagccaagtaactctttcttttcttttgtaagccccagtagagagctggaacagcagcaggtttctagcagagcctttaaggttaaacgaatctag

SEQ ID NO: 18986 - DNA, 834 bp, Artificial Sequence
  Description of Artificial Sequence: Synthetic coding sequence
atgagcctgtgcgaggacatgctgctgtgcaactaccggaagtgcagaatcaaactgtctggatacgcatgggtgactgcctgctctcatatcttctgcgaccagcacggaagtggtgagtttagccggtcccccgcgatctgtcctgcctgcaattccactctgagtgggaagttggacatcgttcggacagagcttagtccctcggaggaatataaggctatggtgctagctgggcttagaccagaaattgtgcttgatattagttctcgggctctggcgttctggacatatcaagtgcaccaggagcgcttataccaggagtacaacttttctaaggccgagggtcatctgaagcagatggagaagatctacacccagcagatccaatcaaaagatgtggagctgaccagcatgaaaggcgaagttacgtcaatgaaaaaggtattggaagagtataagaagaaattcagtgacatcagcgaaaagctcatggagcgaaatagacagtatcagaagttgcagggcctatatgatagtcttaggctcagaaacatcaccatcgccaaccatgagggcacactcgaaccttctatgatagcccaaagcggggtgttggggtttcctctggggaataattcaaagtttcccctggataacacccctgttaggaatagaggcgacggggacggggactttcaattccggccattcttcgccggctcaccgacagctcccgaaccctcaaactctttcttcagtttcgtctcccccagcagagagctggaacagcagcaggtgtcctcacgagctttcaaggtgaagcgcatctag

SEQ ID NO: 18987 - DNA, 834 bp, Artificial Sequence
  Description of Artificial Sequence: Synthetic coding sequence
atgagcctgtgcgaggacatgctgctgtgcaactaccggaagtgcagaattaagctgtccggatacgcttgggttacagcttgtagccatatattctgcgatcaacacggctctggcgagttctcaaggtctccggccatttgccctgcctgcaactctaccctgtcggggaaactggacatcgtgcgcacagagctttccccctctgaagaatataaggctatggtactggctggactgcgccctgaaatcgttctagatatcagttcccgggcactcgcattctggacctatcaagttcatcaggagagactttatcaggagtacaatttctcaaaagctgaagggcatcttaagcagatggagaaaatatatacgcagcaaatccagtcaaaggatgttgagttgactagcatgaaaggtgaggttacttccatgaaaaaggtccttgaagaatataaaaagaaattttccgacatctccgaaaaacttatggagcgcaacaggcagtatcagaaacttcagggcttatatgacagcctacgactgcgcaacatcactatcgctaaccacgagggtacactcgagcctagcatgattgctcagagcggggtcctgggttttcccctcgggaataactcaaaatttcctctagacaatacgcctgttagaaacaggggggatggagatggtgatttccagtttcgaccttttttcgccggcagtccgacggcgcccgaaccttccaattccttctttagctttgtgtccccatctagggagctcgagcagcagcaggtgagcagtcgagccttcaaggtcaaacggatctag

SEQ ID NO: 18988 - DNA, 834 bp, Artificial Sequence
  Description of Artificial Sequence: Synthetic coding sequence
atgagcctgtgcgaggacatgctgctgtgcaactaccggaagtgccgtattaagctgtctgggtacgcatgggtgacagcatgctcacatattttctgtgatcagcacggatctggagagttctccaggagccccgctatctgtcccgcctgcaactcaacactgagtggcaagttagatatcgtccggacagagcttagcccgtccgaggaatacaaggcaatggtactggccggcctcaggcccgagatcgtgctcgatatctcctcccgagccctcgcgttttggacttaccaggtgcaccaggagcgcttataccaggaatataatttcagcaaggccgagggccatttaaaacaaatggagaagatctacacccagcaaatccagtctaaggatgtcgaacttacgagcatgaagggtgaggtgacctcgatgaaaaaagtgcttgaagaatacaagaaaaaattctctgacatctccgagaagttgatggaaaggaatcggcagtatcagaaactacaagggctgtatgactccctgcgtctccgtaacatcaccattgcaaatcacgaaggtaccttagaaccctccatgatcgcccagtctggagtgcttggttttcctctgggtaataattcgaaattccccttagacaacacgcccgtccgcaacaggggagatggcgacggagattttcagtttcggcccttttttgcgggctccccgactgcccccgagccttcaaattctttttttagcttcgtgagcccaagccgtgagctggagcaacagcaggtcagttctagagccttcaaggtcaagcgcatttag

SEQ ID NO: 18989 - DNA, 834 bp, Artificial Sequence
  Description of Artificial Sequence: Synthetic coding sequence
atgagcctgtgcgaggacatgctgctgtgcaactaccggaagtgcaggattaaactctctggttacgcttgggtgactgcatgttcccatattttctgtgaccagcacggctctggcgagttcagtcggagtcctgccatctgtccagcctgcaactctacactgagcggtaaactggatatcgtacggactgaactgtcgccctctgaggaatacaaggccatggttctcgctggcctgcggcctgaaatagttttagacatatcttcacgggctctggctttctggacttatcaggtccatcaggaaaggttgtatcaagagtacaattttagcaaggcggagggccacctgaagcaaatggagaagatttacactcagcaaattcaatcgaaagacgttgagctcaccagcatgaaaggcgaagttacttccatgaaaaaagtgctcgaagaatacaaaaaaaaattcagcgatataagtgagaagcttatggaacgtaatcgccagtatcaaaagctgcaaggcctgtacgactccttgcgcctccggaacattacaatagctaaccacgagggaactcttgagccctctatgatagctcaaagcggcgtactggggttcccgcttggtaataactccaaattccccctggacaacaccccagtccgcaatcggggcgatggcgacggtgattttcaattccgccctttcttcgcaggtagccccaccgcccccgagccatccaatagcttcttcagcttcgttagcccctctagagaactggaacagcaacaggtgagcagcagagcttttaaagtcaagcggatttag

SEQ ID NO: 18990 - DNA, 834 bp, Artificial Sequence
  Description of Artificial Sequence: Synthetic coding sequence
atgagcctgtgcgaggacatgctgctgtgcaactaccggaagtgccggattaagttgtccggatatgcatgggtgacagcctgttcacatatcttctgtgatcaacacggctcaggcgaattttcacgttctcctgccatctgccccgcctgcaattccacgttaagcggcaaactcgatatcgtgagaacagagttgtctccatcagaggagtataaagccatggtgctggcagggctgagaccagagattgtgctcgatattagctctagggcgctggcgttctggacctaccaggtgcatcaggagcgcctctaccaggaatacaatttctccaaagcggaggggcatttgaaacagatggagaaaatttacacacaacagattcaatcaaaagacgttgagctgacctctatgaaaggcgaagtgactagtatgaaaaaggtgttggaggaatacaaaaagaagttcagcgatatttccgaaaagctgatggagaggaaccgtcagtaccagaagcttcagggactatacgacagtctccgactccggaacataacaatcgccaaccacgaggggacacttgagccatcaatgattgctcagtccggggtacttggatttccacttgggaacaactctaaatttcctctcgacaataccccagtgcggaatcgcggagatggtgatggggatttccagtttagacccttctttgccgggtcaccaaccgcccccgaaccgtccaactcctttttcagcttcgtgtctcccagcagagaactggagcaacagcaagtctcttccagggcctttaaggtgaagagaatttag

SEQ ID NO: 18991 - DNA, 15 bp, Artificial Sequence
  Description of Artificial Sequence: Synthetic coding sequence
atgagcctgtgctag

SEQ ID NO: 18992 - DNA, 465 bp, Artificial Sequence
  Description of Artificial Sequence: Synthetic coding sequence
atgagcctgtgcgaggacatgctgctgtgcaactaccggaagtgcaggatcaaactgagcggctatgcttgggttacagcatgctcccatatattctgcgatcagcacggctcaggagagttcagccgatccccagcaatctgcccagcttgcaactccacgctgtcagggaaactcgatattgtccgtacggaactaagccccagtgaagaatataaggccatggttctggcagggctccggccggagatagtgctggacatcagctcacgtgcgctggccttttggacttaccaggttcaccaggaacggctctaccaggagtacaacttcagcaaagcagagggtcatttaaagcagatggagaaaatctatacccagcaaatccagtcaaaagacgtagagctcacaagtatgaagggtgaagtgacatccatgaaaaaggtcctcgaggaatataagtag

SEQ ID NO: 18993 - DNA, 1119 bp, Artificial Sequence
  Description of Artificial Sequence: Synthetic coding sequence
atggagctggagggccagtggtggcggggccagctggccgccgacatccatcaggcactgcgctacaaagagctgaagctgccaagttataagggacagtccccacagctgtcgctgcgtcggtattttgctgacctgatcgccatcgttagcaatcgcttcaccctgtgcccctcggcacgtcacctggccgtgtatttgctcgaccttttcatggatcgttacgatattagcatccagcagcttcaccttgtcgctctgtcctgcctgttgctcgcatctaagttcgaagagaaagaagattcagtgccaaagctggagcagctgaacagcttaggctgtatgacaaacatgaacttggtactgacaaagcagaacctactccacatggagttgttgcttctggagacattccagtggaatctgtgcctcccaacggcggcgcattttatcgaatattacctgtccgaagccgtacacgaaaccgacctccacgatggatggccaatgatttgcctcgaaaagaccaagctgtatatggcaaagtacgcagattattttctggaagttagcctgcaagtggccgccgcttgcgttgcaagcagtcgaataattctacgtctgagtccaacatggcctacgaggctgcacagactgaccgcatactcctgggatttcctggttcagtgcatcgaacgcctgcttatcgcgcacgacaatgacgtcaaggaggcgaataagcagaggggacaggccggaccccagagtgcccagctgagcgtgttccagacggccagtcagccatctcgccccgttcattttcagcagccacagtatctccaccagactcaccagacatctttacaataccgacacccaacatccgagcagcctagctgccaacaaatcgtctctactacccataccagcagttatacccttcagacatgtccggccggatttcagacctccgtccaaggccttggccacatgcaaaccggtgtcggcatgtcgctcgcgattcctgtggaggtcaaaccatgcctctctgtgagttataatagaagctatcaaattaacgaacactatccatgtatcaccccctgcttcgagcgatag

SEQ ID NO: 18994 - DNA, 1116 bp, Artificial Sequence
  Description of Artificial Sequence: Synthetic coding sequence
atggagctggagggccagtggtggcggggccagctggccgccgacattcaccaggcattgagatacaaagagctcaagctgccttcatacaaaggccagtcccctcaactttcactccgaagatatttcgccgatctgatcgccattgtctccaatcgattcacactatgcccctctgccaggcacttggccgtttacttgttagacctgttcatggatagatatgacataagcatccagcaactgcacctggtcgccctgagctgcctcctcctggcatccaagttcgaagagaaggaagatagcgtgcccaaacttgaacagctgaattccctgggttgcatgaccaacatgaatctggtcctcactaaacagaacttgcttcacatggagttacttcttctggaaacattccagtggaatctttgtctccccaccgccgcccattttattgaatattacctgtccgaggcagtgcatgagacagacctccatgacggatggccgatgatctgcctggaaaaaactaagctctacatggcgaagtatgcagattatttcctcgaggtgagccttcaagcggccgcctgtgttgcatcttctaggatcatcttaaggcttagccccacttggccaacccgtttgcacagactaactgcatattcctgggactttctggtccagtgcatagagagactgctaattgcacacgataatgacgtcaaggaggccaataagcaaaggggacaggcagggccccagtcggcccaactgtcagtatttcagaccgcatctcagccttcaagacctgtccactttcagcagccacagtatctgcatcagacccaccagacttcgcttcagtaccgtcacccgacatctgagcaacccagctgtcagcagatcgtttccactacacatacctcatcctatacattgcaaacatgtccagccggcttccagaccagcgtgcaggggctgggccatatgcagaccggggttggaatgtccttggctatccccgtggaagtaaaaccctgtctcagcgtttcctacaatcgctcctatcagatcaacgaacactacccatgtatcacaccctgtttcgagcgctag

SEQ ID NO: 18995 - DNA, 1152 bp, Artificial Sequence
  Description of Artificial Sequence: Synthetic coding sequence
atggagctggagggccagtggtggcggggccagctggccgccgacatccatcaggctctcagatataaagagctgaaactgccctcttataaaggacagagcccacaattgtcattgaggagatacttcgccgacctgatcgccatcgtaagcaaccggtttacactctgcccctcagccagacacctcgctgtttacctgcttgatctgttcatggaccgatatgatatcagcattcagcagctccacctggttgctctctcctgcctgctcctggcaagtaagtttgaagaaaaggaggacagtgtgcctaaactggaacaattgaacagcctggggtgcatgaccaacatgaatcttgtgcttaccaagcagaatctgttacatatggagctcctgctcctcgaaacatttcagtggaacctgtgcctccccactgccgcccatttcattgagtactacctgagcgaggccgtccacgaaaccgacctgcacgacggatggcccatgatatgcctcgagaagactaagctttatatggctaaatacgccgactattttctggaggtgtcgttacaagactacgctttcttgaattacgctcctagcttggtcgcggctgcctgcgttgcgtcaagccgcatcatcctacggctgagcccgacttggcctaccagactccatcgcttaaccgcctactcttgggacttcttggtgcagtgcatcgaacgactgttgatcgcccatgacaatgatgtcaaggaggctaacaagcagaggggtcaagccggcccacagagcgctcagctgagtgtatttcagactgcgagtcagccatcccggccggtgcatttccagcagcctcagtacttacatcagacacaccaaacttccttacagtaccgacatccaacttccgaacagcccagctgccaacagattgtgagtactactcatacctcctcttatacacttcagacgtgcccggctggtttccagaccagcgtgcagggacttggccatatgcagactggtgttggtatgagtctggcaattccggttgaggtgaagccatgtctgtccgtctcttataacagatcttatcaaatcaatgagcactacccatgcataacaccttgttttgagcggtag

SEQ ID NO: 18996 - DNA, 1119 bp, Artificial Sequence
  Description of Artificial Sequence: Synthetic coding sequence
atggagctggagggccagtggtggcggggccagctggccgccgacattcatcaggcgctgcggtataaggaacttaaactgccaagctataagggtcaaagcccacaactgtccctgaggaggtacttcgcagacctgattgctatcgtgtcgaatcggttcactctatgtcccagcgcgaggcacctggcagtgtatttactcgacttattcatggatcggtacgatatcagtatccaacagctccatctggtggcgctgtcttgcttgctgcttgcaagtaagtttgaagagaaggaggatagcgtgcccaaactggagcagttgaacagcctgggttgcatgaccaatatgaatctggtgctgacaaagcagaacttgttgcatatggaacttttgttgctcgagaccttccagtggaacctgtgtctacccaccgccgcccatttcatagagtattatctgtctgaagctgtgcacgagaccgatttacatgacgggtggcccatgatttgtctggaaaaaacgaaactgtacatggccaaatacgcagactacttcctcgaggtgagcttgcaggttgccgccgcctgcgtcgcctcaagccggatcatcctgagactgtccccgacatggcctacacgcctgcatcgcctcacagcctattcctgggatttccttgtgcaatgtatagaaaggctgctgattgcgcatgacaacgatgtgaaagaggcaaataagcaaaggggacaggccggcccccagagcgcccagctaagcgtctttcagactgcaagtcagcccagtaggcccgtccattttcagcagccccagtatctacaccagactcatcagacctctctgcagtacagacatccaacctctgaacagccctcctgtcaacagattgttagcaccacccacacttcaagctacacattgcagacttgcccagccggctttcagacctccgtgcaaggtttgggccatatgcagacaggagtcggcatgagcctcgccattcctgttgaggttaagccctgcctgtccgtgtcatacaaccgttcgtaccagatcaacgaacactacccatgcatcacgccgtgtttcgagaggtag

SEQ ID NO: 18997 - DNA, 4446 bp, Artificial Sequence
  Description of Artificial Sequence: Synthetic coding sequence
atgcccaacagcgagcggcacggcggcaagaaggacggcagcggcggcgcaagcggaaccttgcaaccttcatctggtggaggttcgagcaatagtagggagcggcataggttagtcagcaaacataagagacacaagagcaagcactctaaggacatgggcctcgtgaccccggaagccgcgtctctggggacagtgattaagcccttggttgagtacgacgatatctcgtcagattctgacacattcagtgacgatatggcttttaaactagaccgacgcgaaaacgacgagaggaggggcagcgaccgttcagaccggctgcacaagcataggcatcatcagcatcgcagaagcagagacctgttgaaggctaagcagactgagaaggagaaatcccaagaggtgtcttctaaatccggctcaatgaaggatcggatcagtggaagttcaaagagaagtaacgaggaaactgacgactatggtaaagcccaggttgccaagagctcatctaaggaaagcaggtcttcgaaactgcacaaggagaagacaaggaaggaaagggagttgaaatctggacataaagataggagcaagtctcacagaaaacgagaaacacccaagtcctacaagaccgtggactcgccaaagaggcgctcacggagtccgcaccgaaaatggtccgattcttcaaagcaggacgatagcccttcaggagctagctacggtcaggattacgacctgtccccaagccgttctcacactagctcaaattatgactcttataagaagtctcctggatccacaagccggcggcagagtgtttcgcccccctacaaagagccctcagcctatcagagctctacccgttcgccctccccttactcaagacgtcaaagaagcgttagcccatactcgcggcggcggtcttcgagctacgagcgctcagggtcctattccgggcgttctcccagcccctacggacggcgaaggtcatcctcaccttttctgtccaagaggagcctcagccggagcccactgccttcccggaagtccatgaaatccaggagccgctctccagcctacagtcggcattcatccagccactcgaaaaaaaagcgctccagttctcgctctcggcacagcagcataagtcccgtccgtctgccacttaactcatctctcggcgcggaactctctaggaagaaaaaagagagggcagctgcagctgctgccgccaaaatggatggaaaagaaagtaaagggtcaccagtcttcctgccaagaaaagagaactcatctgtcgaggcaaaggattccggcctggaatcgaaaaagttgccgcgctctgtgaaactggaaaaaagtgcaccagacacagagctagtgaatgtcacacaccttaacaccgaggttaagaatagcagcgatacaggcaaggttaagctggatgagaacagtgagaaacacctggtgaaggatttaaaagctcagggtaccagagacagcaagcccattgccctgaaagaagagattgtgactccaaaagagaccgagacttccgaaaaggagactcctccccctctgccaactatcgcttcgccaccaccaccactgcctaccacaaccccccccccgcagacaccccccttacccccactgccccccatcccagccctgccccaacagccccctctgcccccatcccagcctgctttcagtcaggtgccagcttccagtacttcaaccttgccccctagcacacattccaaaacatctgccgtgagcagccaggccaacagccagccccctgttcaggtaagtgtgaagacacaggtgagtgttacagccgccattccacatctgaagacgagcactttgccccccctacctctcccgcctctgctgcccggcgatgacgatatggacagtcccaaagagacactgccatctaagcccgtaaaaaaggaaaaagagcagagaactcgccatttactgaccgatctgcccctccctcccgaattaccaggcggcgatctatcacctcccgatagccctgaacccaaggctatcacgccgccccagcagccgtataaaaagcgcccgaagatatgctgcccccgatatggtgaaaggaggcaaaccgaatccgactggggaaaacggtgcgtggacaagtttgacattattggaattatcggagaaggcacatacggccaggtatataaagccaaagataaagataccggggaactcgtggctctcaagaaggtccggctcgacaacgaaaaggaaggtttcccgattaccgccatcagagagatcaaaatcctgaggcaactcattcaccggtctgtcgtaaacatgaaagaaatcgtgacagataagcaggacgccctggacttcaagaaggacaaaggcgctttttacttggtcttcgaatatatggatcacgatttaatggggttgttggagtccggtctcgtgcacttctcagaagatcatattaaatcttttatgaaacagctaatggagggcctcgaatattgtcataaaaagaacttcctgcacagggatatcaaatgcagcaatattcttcttaacaactctggacaaattaaacttgcggactttggcttggctaggttatacaattcagaggagtccagaccctataccaacaaagtgatcacactgtggtatagacctccagagctgctgcttggcgaagaaagatatactccagcgatagatgtgtggagttgcggctgcattctgggcgaactctttacgaagaaaccaatttttcaggctaacctcgaactagcacagctcgagctgatctcccggctctgcggttccccttgccccgcagtgtggcccgacgtgataaaactcccctactttaacacaatgaagccgaaaaaacagtatagaagaagactccgtgaggagttctctttcatcccctcagcagcgctagatctgctggaccacatgctgacgctggacccttcaaaacgctgcaccgccgaacagactttacagagcgattttctgaaagatgtggagctctcaaaaatggcaccccctgatttgcctcactggcaggattgtcatgagctctggtccaagaagcgaaggagacagcgccaatccggcgttgtcgtggaagaaccgccacccagcaaaacgtctagaaaggagacaacatccggcacgagtaccgagcccgtgaaaaattctagtcccgcccccccccagccagcccccggaaaggttgagtcgggcgcaggggatgccatcggcctggccgatataacccagcaactcaatcaatcggagctcgccgtgctcctgaacctactccagtctcagacagacctttcaatcccacaaatggctcaactgctgaacatccactctaaccctgaaatgcagcagcagctggaggcattgaaccagtccatctccgcattaacggaggctacatcccaacagcaggattcagagacaatggccccagaagagtctctgaaagaggcaccttccgctcccgtcattctgccaagcgcagaacaaactaccctcgaagctagctcaactcccgccgatatgcagaatattctggctgtcttactgtcccagttgatgaaaacccaagagccagcagggtcccttgaagaaaacaatagcgacaaaaatagcgggccccaaggaccccggcgcactcctactatgccccaggaagaagccgcggaaaagcggccacctgaaccacctggcccgcctccacccccacctcctccccccttggtagagggcgatctgtctagcgccccccaagaacttaaccccgccgtcaccgcggcattactacagttgcttagccagcccgaggccgaaccccctgggcatctaccacatgagcatcaggccctgcgacccatggaatactctacccgtccccgtcccaatagaacctacggaaatactgatggccccgagaccggctttagcgccatcgacaccgacgaaaggaactccggccctgctctgactgagagtctcgtgcaaacactcgtgaagaatcggaccttttccggatccctgtcccatttgggagaatcctcttcttaccagggaactggatctgtgcagttccccggggaccaggacctgcggtttgcacgggtccccctggcgttgcatcccgtggttgggcaacctttccttaaagcagaggggtcaagtaactcagtggtacacgcggaaactaaactgcagaattatggcgagcttggaccaggcacaacgggagcctcaagctccggggcagggttacattggggcggaccaacccagtcctctgcatatggcaaactctaccggggccccacacgggtgcctccacgaggaggtcggggccgtggtgtgccttactag

SEQ ID NO: 18998 - DNA, 4473 bp, Artificial Sequence
  Description of Artificial Sequence: Synthetic coding sequence
atgcccaacagcgagcggcacggcggcaagaaggacggcagcggcggcgctagcggaacactacaaccaagttccggtggaggcagctcaaattctcgggagagacaccggctggtgagcaagcacaagagacacaagagcaaacatagcaaggatatggggctggtgacacctgaggccgcttctctcggtaccgtgatcaagcctttggtagagtatgacgacattagcagcgatagcgacaccttttctgatgatatggccttcaaactggatcgtcgtgaaaatgacgaacggcgaggatctgatcgctcggacaggttgcacaaacaccggcaccaccaacacagacgatctcgggacttgcttaaggccaagcaaacagaaaaggagaaaagccaggaggtgtcctccaagagcgggtctatgaaagacagaatctcaggctcctctaaacgtagcaacgaagagaccgacgactacggcaaggcccaggtggcgaaaagtagttccaaggaatctcgcagttctaagttacacaaagaaaagacaagaaaggaacgcgagctcaagagtggacataaggacaggtctaagtctcataggaagagggaaactcccaagtcctataagactgtcgactctcctaagaggcggtctcggagcccacatcgtaagtggagtgactcgagcaagcaagacgacagcccttcgggtgcttcatatggtcaagactacgatttatctccctctagatcgcacacatcaagtaactatgactcctacaagaagagtcccgggtctacctcccggcggcagagcgtgtcacccccctataaggaaccttcagcataccagtcttcaactagatcaccttcaccctatagtagacgccagcggtctgtgtctccctatagcaggcgtagaagttcgagctacgaaagatcagggtcttatagcgggagaagcccctccccgtacggcaggaggagaagttcgagcccatttctgtccaaacgatctctcagtcggagcccactgccgagtcggaaaagcatgaagagccggtctaggtctcctgcatacagccgccactctagttctcatagcaaaaagaaaagatctagtagcagatctcggcactcatcaatttcacccgtgagactacccctgaatagcagtctgggagcggagctcagcagaaagaaaaaggagcgagctgccgccgctgccgcagctaagatggacggaaaggagagtaaaggatcccctgtgtttctccctaggaaagagaattcctccgtggaagctaaagactccgggttagagagtaaaaagctgccacggtccgttaaattagagaaaagcgctcccgacacagagttggttaacgtgacccacctgaatacggaagtcaaaaacagttccgacaccggaaaggtgaagttggatgagaactcagaaaaacacctggttaaggacctaaaggctcagggtacgagggacagtaaacccatcgcactcaaggaggaaatcgtgacccccaaagaaaccgagacctcagagaaagaaacccctcctcctctgcctacaattgcatcaccacctccccccctgcctactactacccctccacctcagacccctcctctgccacccctaccacctatccctgcccttcctcaacagccgcccctgccaccctcgcagcccgcattctcccaagtgcctgccagcagtacttccaccctgcctccttcaacgcattccaagacctcggcagtgtccagccaagccaacagccagccgcccgtgcaggtgagtgtgaaaacgcaggtctccgtgaccgccgccatccctcatttgaagacttcaaccctaccaccgcttccccttccccctctcctgcccggggatgatgatatggactcccccaaagagaccttaccctcaaaaccagtgaagaaggagaaagaacagagaacacgccaccttctgacagacctgcctcttccccctgagttacccggcggcgacctgtcaccaccggacagtccagagccaaaggcaattacacctccacagcaaccatataagaagcggcccaaaatttgctgcccacgctacggagaaaggagacagacagagagcgactggggcaaaagatgcgtggacaaatttgatatcatcggcatcataggggaaggcacttacggtcaggtgtataaggccaaggacaaggacaccggagagctggtcgcccttaaaaaggtgaggctcgacaacgaaaaggaaggattccctatcactgccataagggagataaagatactgcgccagctgatacatcgatctgtggtgaacatgaaagagatcgtaacagataaacaggacgctctggacttcaagaaagacaaaggggctttttacctggtatttgagtacatggaccacgatttgatgggactgctggaaagcgggctggttcactttagtgaagatcacatcaagtcctttatgaagcagctgatggagggacttgaatactgccataagaaaaatttcctgcacagagacatcaaatgcagcaatatccttctgaacaactctggccagatcaagctggcagactttggcttggcaaggctttataattcagaggagtcccgcccttatactaataaagttattacactgtggtataggccccctgagctcctccttggagaggagcgatatacccccgcgatcgatgtctggagctgtggatgcatcctaggcgaactcttcaccaagaaacctatttttcaagctaatcttgagttagctcagttggagctgatatcacggctttgtgggtcaccctgtcccgccgtttggccggatgttattaagttaccatactttaacactatgaagccaaagaaacagtaccgtcggaggcttagggaagaattctctttcattccatctgccgcactagatctcctggaccatatgctgacacttgacccttcaaagaggtgcaccgccgagcagactttacagtctgactttttaaaagatgtcgaattgtccaaaatggctcctcctgacctgccccactggcaggattgccacgagctgtggtcaaaaaagcggagaaggcagagacagtcaggtgtggtggtcgaggagcctcctccgtcaaagacttcacggaaagagacgacctccggaacttctactgagcccgttaagaattcctctcctgccccaccacagcccgctcctggaaaggtagagtcaggagcaggtgacgctattggcctcgctgacataactcagcagctgaaccaaagcgaactggcggtcctgctgaacctgctgcagtctcagaccgacctttccatcccacaaatggcacaacttctgaatatccattccaacccagaaatgcagcaacagcttgaggctctaaaccagagcatctctgccttgacggaggctacgagtcagcagcaggacagtgagactatggcgcccgaagaatctcttaaagaagctccctccgccccagtaattctgccctccgctgaacagaccaccttagaggccagcagcactccagctgacatgcagaacatcctagcggtcctcctctcgcagcttatgaagacgcaggaacctgctggaagtcttgaagagaacaattccgacaagaatagtggcccacaagggccccgaaggacacctaccatgccccaggaggaggcggcagcctgtcctccccacattctcccccctgaaaagcgacctcccgagccccctggcccaccccccccgccgcccccaccacccctcgtggaaggagatttgtcttcggccccccaagagttaaatcctgcagtgacagctgcattactccagcttctatcccaacctgaggcagaacccccaggccacctgccccatgaacatcaggccctgcggcctatggaatacagtaccagacctcggccgaaccggacctacggaaataccgatggtccagagaccggattctcagccatcgatacagatgaaaggaactcaggcccagccctcaccgagagcctggtgcagacactggtgaaaaaccggacattttcgggttccctgtcccatctcggcgagtcctcaagctatcagggcacagggtcggttcaatttccaggtgaccaggatctgaggtttgcacgagtccccttggcgcttcatcccgtggtgggacagccctttctgaaagcagaaggttcatcaaattccgtggtgcatgctgaaactaaactacaaaactacggagagctcggacctggcaccactggcgcaagcagctccggagcaggtctgcattggggcggaccaacacagagtagcgcatacgggaaattgtatcggggccctacccgcgtcccccccaggggcggcagaggtcgaggggtgccctactag

SEQ ID NO: 18999 - DNA, 4539 bp, Artificial Sequence
  Description of Artificial Sequence: Synthetic coding sequence
atgcccagcagcagcgacaccgccctgggcggcggcggcggcctgagttgggctgagaagaagctggaagagcgaagaaagcggagacggttcctgtccccacagcaaccgcctcttcttctgccgctgctccaaccccagctgcttcagcccccgccacctccacccccactcctttttctggcggcccctggaacagccgctgcagccgccgcggcagcagcagcatcctcatcttgtttttctccggggccccctctcgaggtaaaacgccttgcccgggggaagagaagggctgggggtcggcagaaaagacgccgcggtccccgggccgggcaggaggccgagaaacggcgtgtcttttcattacctcagccccagcaggatggaggtggtggcgcctctagcggaggcggggtgacacccctagtggagtacgaagacgtgtcatcccaatccgaacagggcctgctccttggtggtgccagcgccgccaccgccgccacagccgcaggtggaacgggcgggagcgggggctcaccagctagctcgtccgggactcaacgcagaggcgaagggagtgagcggagaccacggcgggaccgacgtagcagcagcggtaggagtaaagaaagacaccgggaacataggcgccgcgatggacaacgaggtggaagcgaggcaagtaaaagcagatccagacactcacactcgggagaagaacgtgcagaggtggcaaagagcggatcttcatcgagttccggcggccgccgcaaaagcgcgtctgcaacatcgtcttctagtagcagtcgaaaagacagggactctaaggcccatcgatctcgcactaagagcagcaaggagccaccctctgcatataaggaacccccaaaggcttaccgcgaggataagacggagccaaaagcctaccggcgaagaagatctctgtcccctctcgggggtagagacgattcgccggtctcacaccgtgcctcacagtcactgcggtcacgcaaaagcccttctcccgcagggggcggctcttccccctatagcagacgtttgccgcggtcccccagtccatatagccgtcgcaggtccccatcttacagtcgccattcctcatatgagagggggggggacgtgtctccttcaccctatagctcaagctcatggcgtcgctcgagatccccatactctcctgtgctccgcaggagcggcaaaagccggtcccgttcaccttacagttctagacatagcagatccagatctcgccaccggctctccaggtccagatcacgccactcctccatctcaccttcaacacttacactgaagtccagcctggccgcagagctaaacaagaataagaaagcccgagcagcagaggccgctagggcggccgaagctgctaaggctgcggaagccactaaggccgccgaagcggctgccaaggccgctaaggcctccaacacctcaaccccgaccaaaggcaataccgagacctctgccagtgctagtcagacgaaccacgtcaaggatgtaaagaaaataaaaattgaacacgccccttcccccagcagcggaggcactttgaaaaacgacaaggccaagacaaagcccccattgcaagttaccaaagtggagaacaacttgattgtcgataaagcaaccaagaaagcagtgatcgtaggaaaggaaagcaaaagcgcagctaccaaagaggagagcgtcagcctgaaagaaaagaccaaaccactcacaccaagtatcggtgccaaggaaaaggagcaacatgtggccctagttacaagtactctgcctcccctgcctctgcccccaatgctgcccgaggacaaggaggccgacagcctcaggggaaatataagcgtgaaagctgtaaaaaaagaagtcgagaaaaaactgagatgtctcttggccgatctgccattgccgcccgaactgcccggtggcgatgacctgtccaaatccccagaggaaaaaaagactgccactcagttacatagcaaaaggagaccgaagatctgcggaccaagatatggagagacaaaggagaaagacattgactggggcaagagatgcgtagataaattcgacatcattggtatcattggagaggggacatacggacaggtctataaggcaagagataaggatacaggagagatggtcgcactgaaaaaggtgcgcctggataatgaaaaagagggattccccataacagccattcgtgaaattaaaattctgcgccagctcactcaccagtcaatcattaatatgaaagaaatcgttacggataaagaggacgctttggacttcaagaaggataagggcgccttttacctcgtgtttgaatatatggatcatgacctcatggggctgcttgagtcaggcctcgttcattttaatgaaaaccacatcaaatcttttatgcggcagcttatggaagggctggactattgccataaaaagaatttcctacatcgcgatattaagtgtagcaatattctactcaataacaggggacagataaaattggcagattttggtttagccagattatactcaagcgaagagtcaagaccatacacgaataaagttatcaccctgtggtataggccccccgagctccttttgggagaagagaggtacactcctgccatcgatgtgtggagttgtggctgcatcctaggggaactgttcacaaaaaaacctatatttcaggcaaaccaggagctcgcacagctcgagctgatctctcgcatctgcggtagcccttgcccagccgtatggccagatgtcattaagctcccgtactttaacactatgaagcccaagaaacagtataggcgcaaactgcgcgaggagttcgtatttattccagccgctgcgcttgatctgtttgattatatgcttgcattggatccgtctaagaggtgcacagccgaacaagcactgcagtgtgaattcctaagggatgtagagccaagcaaaatgccccccccagacctgccgctctggcaagattgccacgagctgtggtctaaaaagaggaggcgtcagaagcagatgggtatgactgacgatgtgagcactatcaaggctccaagaaaggatctcagtcttggcctcgacgattccagaacaaacacacctcagggcgtgttaccgagcagccagttgaagagtcaggggagtagcaatgtagcgcctgttaagactggacccggacagcatctgaaccactctgaactggcaatattgctgaacctgctgcagagtaagacttcagtcaacatggctgattttgtccaggtgctcaacattaaggtgaacagcgagactcagcagcagctgaacaaaataaatcttccggcaggtatcctggccacaggggagaagcagacagaccccagtactccccagcaggaatctagtaaacccctgggcggtattcagccctcctcacaaaccatccagcccaaagtggaaactgacgccgcacaggctgcagtacagagcgcatttgcggtactgctcacacagctgatcaaggcacaacaaagcaaacagaaggacgtgctcctagaagaacgcgagaatgggtctggacatgaggcctctcttcagcttcggccacctcccgaaccatcaacacctgtgtctggacaggatgacctaatccaacaccaggatatgcgcatactggagctgactccagagcccgacaggccccggatactgccaccagatcagcggcctcccgagccccctgaaccaccccctgtgacggaggaagacctggattacagaaccgagaatcagcacgtgccaactacatcctctagtctcaccgaccctcacgccggcgtgaaagcggcactgcttcaattattagcccagcaccagccccaggatgatccaaagcgcgaggggggaatcgattaccaagctggtgatacttacgtctcaaccagcgattataaagataactttgggagctcttcgttcagcagtgcaccgtatgtgtcaaacgacggtctgggatcatcgtctgccccacctttagagaggcgcagttttataggtaattcggatatccagagtttggataactattccacggctagctcccattcgggtggccctccccagccctccgccttttccgagagctttcccagttcagttgcagggtacggggatatttatcttaacgcggggcctatgctatttagcggtgacaaggaccacagatttgagtactcgcatgggcctatcgctgtccttgctaattccagtgacccgagcacaggccccgaatctacccacccactgcctgccaaaatgcacaattataactacggcggaaatctacaggagaatccaagtggaccctcgctgatgcacggccagacctggacctcacccgcccagggccccgggtactcacagggataccgggggcacataagtacaagcaccgggcgcggccgtggcagaggcttgccttattag

SEQ ID NO: 19000 - DNA, 4359 bp, Artificial Sequence
  Description of Artificial Sequence: Synthetic coding sequence
atgcccagcagcagcgacaccgccctgggcggcggcggcggcctgagttgggccgaaaagaagctggaggaacggcgcaaacgccgacgctttctgtcaccacagcaaccaccactactcctgccgctcctccagccccagctgctgcagccgccgccgccacccccccctctgttgttcctcgccgcgccgggaacagcggcagcagctgcagccgctgccgccgcctccagtagctgttttagtcctggccccccccttgaagtcaagagactggcccgaggcaaacggagggcaggaggtcgtcagaagagacgcaggggaccaagagccggtcaggaggccgagaaaaggagggtcttctcccttccccaaccgcagcaagatgggggggggggggcaagtagcgggggcggcgtcactcccctggtggagtatgaagatgtttcttctcaatcagaacagggcttgctgctcggaggcgccagcgccgccaccgccgccacggcagcaggtgggactggcggctccgggggaagccctgcctcttcctctggaacacagaggagaggtgaaggttctgaaaggcgtcctagaagagaccggagatcatctagtggccgcagcaaggagcggcatcgcgaacataggagacgcgacggccagaggggcggcagcgaggcctctaaatctaggtcaagacactcccattccggagaggagagggcggaggtagcgaagagcggctcttcctcctcatctggaggcagaagaaagtcggcatcagcaacctcatcctcgtcttcttcgaggaaagatagagattccaaagctcatagaagccgcactaaatcctcaaaagaacctccttctgcctacaaagagcctcccaaagcttatcgggaagataagaccgagccaaaggcatacaggcgtcgaaggtcactatcgccactcggaggcagagacgattctcctgtgagtcatagagctagccagagtctccgctcccgcaagagtcctagcccggccggtgggggctcttctccttacagtcgtcggctccctcgaagcccttcaccatactcacgccgtagaagtccttcatatagccgccactctagttatgagcgaggcggtgatgtaagcccgtccccttactcctcctctagctggaggagaagtagaagcccctacagccctgtcttaagaagaagtggaaagtcaagatcaagatcgccatacagctcacggcattcccgctctaggagtcgacatagactttctagaagtcggtctcgccactccagtatttcacccagtactctgaccctcaagtccagcctggccgccgagttgaacaagaataagaaggcacgagccgccgaggccgcgcgggccgcggaagctgcaaaagcagcggaggctaccaaggctgccgaggcagcagccaaagctgctaaggcaagtaatactagcacacctaccaaggggaacaccgaaactagtgcctcagcaagtcagacaaatcacgtcaaagacgtgaagaaaatcaaaatagagcacgcccctagcccaagtagcggaggaaccctgaagaacgacaaagccaagacaaaaccacctctccaggtcactaaggtggagaacaatttgatcgtggataaggccactaagaaagcagtgatagtagggaaggaatccaagtctgccgcgactaaagaagaaagcgttagtctgaaggaaaaaaccaagcctcttactcctagcatcggcgctaaagaaaaggaacaacacgtcgcattggtcacctccactctccctccactccctctacctcccatgttacccgaagacaaagaggcggattcactgaggggaaacatcagcgttaaggctgtcaaaaaagaggttgaaaaaaagctccgatgtctgctagctgatttacccctgcccccagagctacccgggggcgatgatctcagcaagagtccagaagaaaagaaaacagccactcaactccatagcaaacgcagacccaagatctgtgggccacgctacggtgaaactaaggagaaagacatcgattggggaaaaaggtgtgtggataaattcgacattatcggtattattggggaagggacttacggtcaagtgtataaggcccgcgataaagataccggcgagatggtagctttaaaaaaggtgagactcgacaatgagaaggaagggttcccaatcaccgcgattcgtgagatcaaaatcctcaggcagctgacgcaccaatctattataaacatgaaggagatcgtgacagataaagaggacgcgctggactttaagaaggacaagggcgctttttatctggttttcgaatatatggatcatgacctgatgggacttctcgagtcagggttggtgcacttcaacgaaaaccacatcaagtcttttatgcggcagttgatggaaggattagactactgccacaagaaaaatttcctccatcgggatattaagtgcagcaatattcttctgaacaatagaggccagataaagcttgcagattttgggttagcgagactctactcttcggaggagagcagaccgtacaccaacaaggtaataacattgtggtaccggccaccagaactgctgcttggcgaagagagatacacaccagccattgacgtgtggtcctgcggctgtattttaggtgagttattcacaaaaaagcctatcttccaggccaaccaggaactggcacagctggaattaatttccaggatttgtggtagcccatgtcctgctgtatggccagatgtgattaagctaccgtattttaataccatgaagcctaaaaagcagtatcggagaaaactccgggaagagtttgtgttcatccccgcagcagccctagatctctttgactacatgttagcactggacccttcaaagaggtgtacggcggaacaggctctgcagtgcgaattcctgagggacgtggaaccttcaaaaatgccccccccggacctgcccctgtggcaggactgtcatgagctctggtcgaagaagcgccgcagacagaaacagatgggaatgactgacgacgtctctacaattaaggcaccccgcaaggacctctccctaggcctcgatgactctaggactaacaccccacagggtgtgcttccctcatctcaactcaaaagtcaggggtccagcaacgtcgcccccggagaaaaacagaccgatccctcgacccctcagcaggaaagctcaaagcctctaggcggaatccagccatcatcccaaactattcagcctaaggtagaaactgacgccgctcaggccgctgtccagtcagcctttgctgtgctattaacacagctcatcaaggcgcaacaaagtaagcaaaaagatgtgctgctggaggagagggaaaatggcagcggccacgaggcatcccttcagctccggcctcctcccgagccctcgacaccagtcagcggtcaagacgatctaattcagcaccaagatatgcgaattcttgagctgacccctgagcccgaccgcccacggatcctgcccccagatcaacggcctcctgaacctcccgagccaccacccgttactgaggaggacttggattaccgtacagagaaccagcatgtccccaccacctcctcaagcttaacagacccccatgcaggagtgaaggcagccctcctccagctgctagcacaacaccagcctcaagacgaccccaagagggaaggagggattgattatcaggctggagacacctacgtttcgacctccgactacaaggacaattttggcagcagttctttctcttccgcaccctacgtgtcaaacgacgggctgggttccagcagcgcccccccgttagaacggcggtccttcattgggaactccgacatccagtctctggataactatagcaccgcctcctcacacagtggcggcccaccccagccctccgcattctctgaaagcttcccgtcgagcgtagcaggctacggcgatatatacttgaacgccggccctatgctgttctcgggcgataaggaccatagatttgaatattctcacgggcctatcgccgttctagcaaactcttccgatcctagtaccggccccgagagtacgcaccctttgccagccaagatgcacaattacaattacggcgggaacctgcaggagaacccatcaggcccttccctgatgcatggtcagacttggacttcacctgcccagggtcctggttacagtcagggatatcgaggccacatctccactagtaccgggcggggacgggggagagggctcccatactag

SEQ ID NO: 19001 - DNA, 1770 bp, Artificial Sequence
  Description of Artificial Sequence: Synthetic coding sequence
atgaccggcctgctgaagcggaagttcgaccagctggacgaggacaatagtagcgtgtcttcttcaagctcatctagcggatgccagtccaggtcttgcagtccttcctctagcgtgagtcgggcctgggatagcgaagaggaaggtccatgggaccaaatgccactgccagaccgggacttctgcgggccacggtcttttaccccactgtctatcctaaagagagcgcgcagggaaagacctggccgggtggcatttgatggaatcaccgttttttatttcccccggtgtcagggattcactagcgtgcccagcaggggcgggtgcacccttggtatggctctgagacattcggcttgccgccggttttctctggccgagtttgcccaggagcaggccagggctcgccatgagaagctgcgtcagagacttaaagaagagaaactggaaatgcttcaatggaagctgagcgctgccggcgtcccccaggctgaggccgggctccccccagtagtggatgctattgacgacgcaagcgtcgaggaggacttagccgtagccgtggccggcggtagactcgaggaggtgagcttcctccagccgtaccccgcacggcgtcgaagggccctgctgcgggcttcaggtgtgaggagaatcgaccgggaggaaaaacgcgaattacaggccctgagacaatcgcgagaagactgcgggtgccattgcgatagaatctgcgatcccgagacttgctcctgcagcctggcaggaattaagtgtcagatggaccatacggccttcccgtgcgggtgctgcagggaaggctgtgagaaccccatgggccgggtggagttcaaccaggccagggtgcagacacactttatacatactctgacccgactgcagttagaacaggaggccgaatccttcagagagctagaggctcccgcccagggatcacctcccagtcctggggaagaagctctcgtgcctaccttccctctagccaagccaccgatgaataacgagcttggcgacaattcgtgttcctcagatatgactgattcttccaccgcctcctcttctgcctctgggacttctgaggcccccgactgccctacccaccccggccttcccggaccagggtttcagcctggggtcgatgacgactctttagcacgcatcttatcattctccgattctgatttcgggggggaggaggaagaagaggaggaggggtctgtgggaaatctggataacctgagttgtttccatcctgccgacattttcggaacctccgatccaggtggtcttgcttcttggacccacagttacagtggctgttccttcacgagcggggtgctggatgagaacgcaaacctcgacgcctcctgctttctgaatggtgggctggagggctcaagggagggttcacttccaggaacctctgtcccccctagtatggatgcggggcggagcagtagcgtggatcttagtctctcaagctgtgactcatttgagctactgcaggccctgcctgactatagtctagggccacactacaccagtcagaaggtcagcgattctctggataacattgaggctcctcactttccgctgcctggattgtcgcctcccggggacgcgagcagttgctttctggagtccttgatgggcttctctgagcccgcggccgaagcactcgatcccttcattgactcccagttcgaagacaccgtgcccgcatccctgatggagccagtgcccgtgtag

SEQ ID NO: 19002 - DNA, 744 bp, Artificial Sequence
  Description of Artificial Sequence: Synthetic coding sequence
cggcggcggtgccggacccggcgggcccggggcggctggaccgacgggtgccgggctgagcggactgaatcccgccggcggggccgtccccgacccgggaggggctcccgccggtgtcctccacgcgcatctgggctgcaagcggtctgtccgcaaactcccgagcatgtccggcaccatcacgattgggccgtggaggaggaggagggcagcgtaggcaatctggataacttaagctgttttcatcctgcagatatctttggcacatcagaccccggcggcctggcctcctggacccactcttattctgggtgtagctttacctccggcgtcctggacgaaaacgctaatttggacgcaagctgtttccttaacggaggtctcgagggctcgcgggaaggtagcctgccagggacatccgtacccccttcaatggacgccggcagatcctcttcagtggacctgagtctgtcaagctgcgacagcttcgagctattgcaagctcttcccgattattccctgggtcctcattatactagtcagaaggtgtctgactctttggacaacatagaagccccccattttcctctgcccggtctgtctcctcctggcgatgcaagttcatgcttcctggagagccttatgggcttttcagagccagctgctgaggccttagatccgttcattgactcgcagtttgaggacaccgtcccagcctctctcatggagccagtgccagtttag

SEQ ID NO: 19003 - DNA, 1770 bp, Artificial Sequence
  Description of Artificial Sequence: Synthetic coding sequence
atgaccggcctgctgaagcggaagttcgaccagctggacgaggacaactcttctgtgtcctcctcatcctcctcatccggatgtcagagccgcagttgctcccctagcagcagcgtctcccgggcctgggattcagaggaagaggggccatgggaccagatgccactgcccgacagggacttctgtggaccacgctcatttacgccactaagcattctgaagagagcacgacgggaacggcccggtcgcgtcgcattcgacggaatcactgtgttttatttcccgcgttgtcaggggttcacatccgtgccctctcggggtggatgcaccctgggcatggctttgcgccattccgcttgtcgccgctttagtctggccgaattcgcccaggaacaggcacgagctaggcatgagaagttgaggcaaaggttgaaggaggagaagctggaaatgctccagtggaaactctccgccgctggggtgcctcaggccgaagccggactgccgcctgtggtcgacgcgattgacgacgcatctgtggaagaagacctcgccgtcgcagtcgccggcggccgcctggaagaagttagctttcttcagccatatcctgcgagaaggcgccgcgctctccttcgcgcatcaggggttagacgaatcgaccgggaagagaaaagagaattgcaggctctcaggcaaagtagggaagactgcggctgccactgtgacagaatctgtgacccggaaacgtgctcttgttctcttgccgggataaagtgccagatggatcatacagcatttccctgcgggtgctgtcgagaagggtgcgagaacccgatgggccgcgtggagttcaatcaagcgagagtccagacccactttattcacaccctcaccaggctgcagctagagcaggaggccgagtccttcagagaacttgaggccccagctcaaggatctccaccaagtcccggggaggaggcgctggtcccaaccttccccttagctaagcctcccatgaacaatgaactgggagacaacagctgcagcagcgatatgaccgactcttcgactgcctccagctcagcttccggtacatccgaggcacctgactgccccactcatccaggcttgcctggccccgggttccaacctggcgtagatgacgattctctcgcacgaatcctctctttctccgactccgattttggaggcgaggaagaagaagaagaagaagggtctgtaggcaacctggataatctctcttgcttccatccggcggacattttcggcacaagcgatccgggtggcctcgcctcttggacgcatagttacagcggctgtagctttacatccggcgtgctggatgagaatgcaaacctggacgcttcctgtttcctcaatggtggacttgaagggtcccgtgaagggagcctacctggtactagcgtgcccccttctatggatgcaggtaggtcgtcctctgtcgacctgtcccttagttcatgtgacagcttcgagctgctccaagccctgccagactacagtcttggtcctcattatacatctcaaaaggtgtccgactcacttgataatatcgaagctccgcattttcccttgcctgggctgtcgccccccggcgacgcctcctcatgctttttagagtcgttgatgggatttagcgaaccagcagcggaagccctcgatccattcatcgactcgcagtttgaagacaccgttcccgcgtcactgatggagcctgtgcctgtctag

SEQ ID NO: 19004 - DNA, 1191 bp, Artificial Sequence
  Description of Artificial Sequence: Synthetic coding sequence
atgctgagcgaggtgctgctggtgagcgcccccggcaaggtgatcttgcacggcgaacatgcagtcgtccacggtaaggtggcactcgccgtgtccctaaacctccgcacgtttctgcgtcttcagcctcacagcaacggaaaggtggatctttccctgccgaacatcggcataaagcgagcttgggacgtggccaggctccagtctctcgacaccagtttcctagaacagggagacgtaacaacacccacaagcgagcaggttgagaaacttaaggaggtggctgggctgccagacgattgtgccgtaacagaacgtttggctgttctggcctttttgtatctgtacctgagcatctgccggaaacagagggcactcccaagcctggacatcgtggtgtggtctgaactgcccccaggagctggcctgggttcctcggctgcatatagcgtgtgccttgccgccgcactcttgacagtgtgcgaggagatacccaacccgttaaaggatggtgattgtgtcaacaggtggaccaaggaagatctggagctcatcaacaaatgggctttccagggggaacgcatgatccacggcaaccctagtggagtagacaacgccgtgtcaacttggggtggagccctgagatatcaccagggtaagattagctctcttaagagatctcctgccctgcagattctgcttaccaatacaaaagtgccgcggaacactcgtgccctcgtagcaggcgtgcggaaccgtctgttgaaattcccagagatcgttgccccgctgctcacttccattgacgctatcagtctagagtgcgaacgtgtgctgggagaaatgggggaagcccccgcacctgaacaatatctggtactggaggagcttatcgacatgaaccagcatcacctgaacgccctcggcgtgggtcatgcatctttggaccagttgtgccaggtcacacgtgcacgggggctgcattccaagttgaccggggcaggtggcggaggctgcggtatcaccttgctcaaaccaggcctggaacagccagaagtggaggcaacaaagcaggctctcacaagctgtggttttgactgtttagagacgtcgatcggtgccccaggtgtttccatacacagcgccactagtttagattcgagagtgcaacaggccctcgacggactatag

SEQ ID NO: 19005 - DNA, 177 bp, Artificial Sequence
  Description of Artificial Sequence: Synthetic coding sequence
atggacgccttcaccggcagcggcctgaagcggaagttcgacgacgtagatgtcggctcctcggtctcaaattcagatgacgaaatcagctcaagtgattccgcggatagctgcgactccctgaatcctccaaccacggcgagtttcactccaacctccatactcaagaggcagtag

SEQ ID NO: 19006 - DNA, 345 bp, Artificial Sequence
  Description of Artificial Sequence: Synthetic coding sequence
atggacgccttcaccggcagcggcctgaagcggaagttcgacgacgtggacgtgggttcctcggtatctaatagcgatgacgagatatcctcttcagactctgcagatagctgcgattcccttaacccacctaccactgcctctttcactcccacgtctattttgaaacggcaaaaacagctcagacgtaagaacgtccgtttcgaccaggtcaccgtttactactttgccagacgacaggggtttacgagcgtgccatcacagggaggaagttccctggggatggcccagcgccacaattccgtacgatcgtacacactctgtgagttcgcacaggagcagtag

SEQ ID NO: 19007 - DNA, 261 bp, Artificial Sequence
  Description of Artificial Sequence: Synthetic coding sequence
atggacgccttcaccggcagcggcctgaagcggaagttcgacgacgtggacgtgggcagctctgttagcaatagcgatgatgaaattagttctagcgattctgcagactcttgtgactctcttaatccccccactaccgcttcatttacacctaccagcatcctgaaaaggcagaagcagctccgtcgcaaaaatgtgcgctttgaccaagtgactgtttattactttgctcgtcgccagggttttactagcgtcccgtag

SEQ ID NO: 19008 - DNA, 1758 bp, Artificial Sequence
  Description of Artificial Sequence: Synthetic coding sequence
atgagcggcatcctgaagcggaagttcgaggaggtggacggcagctctccatgtagttctgtgagagaatctgacgatgaagtctctagttctgaatctgccgattcgggtgacagcgtcaatcctagtacgtccagccactttactcccagcagcatactgaagcgcgagaaaagactccgcacaaaaaacgtgcatttttcctgtgtgacagtctattacttcactcgacgccagggctttactagtgtcccttcgcagggcggctccacattagggatgagtagcaggcacaatagcgtgagacagtacactcttggagagtttgctcgggagcaggagcggttacatcgggagatgttaagagaacacctcagggaggagaagctaaatagcctgaagctgaagatgactaaaaatggcacagtggaaagtgaggaggccagcaccctgaccttggatgacatttcagatgatgatatcgacctcgataatacagaagtcgatgagtacttcttcttacagccactcccaaccaaaaagagacgggccttgctccgcgcgtctggagtcaagaagatagatgtagaggaaaagcacgagctccgggcaatcaggctgtcaagggaggactgtggctgtgattgccgggtcttctgcgaccccgatacatgtacatgctcgctggctggcatcaaatgccaagtcgaccgcatgtcctttccgtgcggctgcactaaggaaggatgcagcaataccgctggtaggatcgaattcaatcccataagggttaggactcactttctgcacacaattatgaaactggaactggagaaaaaccgggagcagcagatacccacactgaacgggtgtcattctgagatatcagcccattcctcttcaatgggacccgttgcgcacagcgtggagtattctattgcagattcatttgaaatagaaacagagccgcaggcggcagttcttcacttgcagtccgctgaggagctggattgccagggagaagaggaggaggaggaagaggacggtagctccttctgttccggagtgactgactcctcaactcaatcactggcaccaagcgagtctgacgaagaggaggaggaggaggaggaggaggaagaagaagaggatgacgatgacgacaaaggcgatggctttgtggaagggctgggcacgcacgcggaggtcgtgcccttgccctccgtgctttgttattccgacggcaccgctgtccacgagtctcatgccaaaaatgcatccttctatgcgaattcaagcacactctattaccagatcgattcccacatacctggcactccaaatcagatctcagagaactatagcgaacgagacaccgttaagaatggtaccctatcattggttccgtatacaatgactccagagcagttcgtggattacgcccgtcaggccgaggaagcatatggagctagccattaccccgcagccaatcccagtgtaatagtttgctgtagctcatctgaaaacgacagcggcgtcccttgcaactcattataccccgagcacaggtctaaccacccccaggtcgaatttcattcttatctcaaagggcccagtcaggagggtttcgtatccgccctgaatggcgatagtcacataagcgaacaccccgcagaaaactccttgtccctggcagagaagtctatcttgcacgaagagtgtatcaaaagccccgtggtcgagacagtaccggtatag

SEQ ID NO: 19009 - DNA, 1758 bp, Artificial Sequence
  Description of Artificial Sequence: Synthetic coding sequence
atgagcggcatcctgaagcggaagttcgaggaggtggacggcagcagtccttgttctagtgtgagggaaagcgacgacgaggtatcctccagtgaatccgcggactccggagactctgtgaaccctagtacctcctcccactttaccccttcctcgatcctgaaacgcgagaaaagactccgtaccaagaatgtgcacttttcttgcgttacagtgtactattttaccagaaggcagggtttcacctccgtgccttcccaaggggggtcgacgcttgggatgtcctccaggcataattcagtgaggcagtatacactgggggagtttgctcgcgagcaagaacgtttgcaccgggagatgctgagggaacatctgagggaggagaagctgaactccctgaagctgaagatgaccaaaaacgggactgtcgagtccgaagaagccagtacactgaccctggacgacatctcagatgacgatattgatctggataatacagaggtggatgaatatttcttcttgcagcccttgcccaccaaaaagcgccgcgcactcttgcgcgcctccggcgtgaaaaagattgacgtggaagaaaaacacgagttgagggccattcgtctgagccgggaggactgcggttgcgattgtagggtcttctgcgaccctgatacctgtacatgcagcctggccgggatcaagtgccaggtagacaggatgtcgtttccatgcgggtgcacaaaagagggttgttcaaatacggcaggacgcatagagtttaatcctattcgcgtcagaacgcatttcttgcacacgatcatgaagctagagctggaaaaaaacagggaacagcagatcccgacactcaacggctgccattcagagatcagtgcacacagctctagtatggggccggttgcgcactccgtggagtattctattgcagattcatttgagatagagaccgaaccccaggctgctgtgctacatctgcagtcagctgaggaactagactgtcagggggaagaggaagaagaagaggaagatggatcttctttttgtagtggggtgactgacagcagtactcaatccctcgcgccatcagagagtgatgaggaggaggaagaagaagaggaggaggaggaagaagaggacgatgatgatgataagggggatggatttgtggaaggcctgggcactcatgccgaggtagttccattaccttcagtcttgtgctactctgacgggaccgccgttcatgaatctcatgccaagaacgcctctttctatgccaatagctccactctgtattaccagatcgactctcacatacccggcacacctaatcagatctcagagaattatagtgaacgggatactgtcaagaacggtactctcagcttggttccttatacaatgacccccgaacagttcgttgattacgcccgccaggcagaagaagcttatggagcctctcattaccccgcggcaaacccttctgtgatcgtctgctgctcttcctccgagaacgactccggtgttccttgtaactccctgtatccagagcaccggagcaaccacccccaggtcgaattccatagttacctgaagggcccatcacaggaaggcttcgttagtgcacttaacggagattctcacatctcagagcaccctgcagagaactctttgagtctagccgagaagagtatcctccacgaagaatgcataaagtcgcccgtggttgagacagtgcctgtctag

SEQ ID NO: 19010 - DNA, 1854 bp, Artificial Sequence
  Description of Artificial Sequence: Synthetic coding sequence
atgaagtgcgccctgttcctgcgggtgaagatcctgcagcgggtgtgccgctccaggtacattgtgcacgcaggaacctgtgattccactgccgctatgtctggcatcctaaagcgaaagtttgaggaggttgatggcagtagcccttgcagctccgtgcgcgagagcgatgatgaagtttcttcctccgagtcggcggattctggcgactccgtgaatcctagcaccagcagccactttacacccagctctattttaaaaagagaaaagaggctgcgaaccaagaatgttcactttagttgcgtgaccgtgtactacttcacaagacgtcaagggtttacctccgtcccttcgcaggggggctctacattaggcatgtcttcccgtcacaactccgtgagacaatacactttgggagagttcgctagagagcaggagagactgcatcgcgaaatgctccgagagcacctgcgggaggaaaagctaaactcccttaagctcaagatgacaaagaatggtactgtcgaatctgaagaagcttctacccttactctggatgatataagtgatgatgatatagatttggataataccgaggtggatgagtacttctttctacagcctttgcctactaagaagcgtagggcgttactgcgggccagtggcgtaaagaaaatcgatgtggaagagaagcatgagcttcgggcgatccgcctctcacgggaggattgcggatgcgattgccgggtgttctgcgatcccgatacgtgcacttgcagcctggctggcatcaaatgccaggtcgaccgaatgtcattcccgtgcggttgcacaaaggagggctgtagtaacactgctggacgcattgaattcaatccaataagggtacggactcattttcttcatacaatcatgaaactggagctcgaaaaaaacagggagcaacagattccaacactaaacggatgtcacagcgagatcagtgctcattcttcttctatggggcctgtagcccacagcgttgaatattccatcgctgatagcttcgagatagagacagaaccccaggctgcagtgctgcatcttcagtctgccgaggagcttgactgccaaggtgaagaggaggaggaagaggaggacggaagttccttttgtagtggtgttaccgattccagcacacagagccttgccccaagcgagagtgatgaagaagaggaagaggaggaagaggaagaagaggaggaggatgacgacgacgataagggggatggattcgtggaagggctgggcacgcacgcagaagtggtgccgctgccttcagtcctgtgctactctgatggtaccgcagttcacgagtcccatgctaagaacgccagcttctatgcaaacagttcgacgctctattaccaaatcgatagccacatccctggtacgcctaaccagattagtgagaattactcagagcgcgacacagtgaagaacgggaccctctcattagtgccatacacaatgacaccagagcaattcgtggactacgcccggcaggccgaggaggcctatggagcgtcccactaccctgcagctaatcccagcgtgattgtatgttgttcgagctccgagaatgacagcggagtcccttgcaacagcctgtacccagagcacaggagtaatcacccgcaagtcgaatttcactcttacctgaaaggtccgtcacaggaaggattcgtcagcgcactcaacggggattcacacatctctgaacatccagcagagaactccttgtccttggcggagaagtctatcttgcacgaggagtgtatcaagtccccagtggtggaaacagtgcctgtctag

SEQ ID NO: 19011 - DNA, 417 bp, Artificial Sequence
  Description of Artificial Sequence: Synthetic coding sequence
atgagcggcatcctgaagcggaagttcgaggaggtggacggcagctcgccctgttcttcggtaagagagtctgatgacgaggtcagttcctcagagagcgccgactctggcgattctgtgaaccccagcacaagctcacactttaccccatctagcatcctgaaaagagagaaacggctccgcacaaagaatgtccacttttcatgcgtcacggtttactacttcacaagacggcaagggttcacgagcgtccccagtcaaggtggaagcactctgggcatgtcatcccggcataatagtgtgagacagtacactctcggtgagttcgctcgggagcaggagaggttgcaccgggaaatgttacgtgagcacctccgtgaggagaagctgaacagcctcaaactgaagatgacctag

SEQ ID NO: 19012 - DNA, 1314 bp, Artificial Sequence
  Description of Artificial Sequence: Synthetic coding sequence
atgagcggcatcctgaagcggaagttcgaggaggtggacggcagcagtccctgttcgtcagtgagggagtcagacgatgaagtgagttcttctgaatccgccgattcaggggatagcgtgaacccttctacttcgtcacacttcactccatcatcgatactcaagcgagaaaaaagactgcggactaagaacgtgcatttttcttgcgtgacggtgtactatttcacccgtagacagggtttcacctcagtgccctcccagggagggagcactctcgggatgagctctagacataattctgtccggcagtacacgctaggggagttcgcacgagagcaggagaggttacacagggagatgctgcgggagcatctgcgtgaggagaaactgaattcactgaagctgaagatgacaaagaacggcaccgtggagagtgaagaagcttcaaccctcactttggatgatatttcagatgacgacatagatctcgataataccgaggtagatgagtattttttcctgcagcctctgcctaccaagaaaagaagagcattgcttcgagcatccggggtgaagaaaattgatgtcgaggaaaaacatgaattgcgtgcaatccgcttatcccgagaggactgcggctgcgactgcagagtgttttgcgaccccgacacgtgcacatgcagcctcgctggcattaagtgtcaggtcgatcgcatgagttttccatgtggctgtactaaggagggatgcagtaacaccgccggccggatcgaattcaaccccatccgcgttcgaacgcatttcctccacactattatgaagctcgaacttgagaagaaccgcgagcaacaaattcctaccttaaacgggtgccacagcgagatctcagctcacagttcatctatgggccccgtagctcattcagtggagtactctatcgccgacagcttcgaaatcgagaccgagccccaggcagcagtcctgcatcttcagtccgcagaggaactggattgtcagggcgaagaggaggaggaagaggaagatggcagttccttctgttcgggggtgactgactcctctacccagtccttagcaccctccgagtccgacgaggaagaagaagaagaggaggaggaggaggaagaggaagacgatgatgatgataagggcgacggctttgtagagggcctcggaacccacgccgaggtggtccccctccccagcgtcttgtgctatagcgacggcactgctgttcacgagtcacacgccaagaacgcatccttctatgcgaattcatctacattgtactattag

SEQ ID NO: 19013 - DNA, 1569 bp, Artificial Sequence
  Description of Artificial Sequence: Synthetic coding sequence
acctgcgacagcaccgccgccatgagcggcatcctgaagcggaagttcgaggaggtcgatgggtcgtccccgtgtagtagtgtgcgggagtctgatgacgaggtgtctagcagcgaatccgcagacagtggcgattcagttaacccctctacctcaagccactttaccccgtcatctatcctgaaacgcgaaaagcgcctgagaactaaaaatgttcatttcagctgtgtcaccgtgtattacttcacccgcagacagggttttacctccgtgccgtcacagggagggtccactctgggtatgagctcacggcataacagtgtgcgacagtatactctgggagagttcgcaagagagcaggaaagactacatcgggagatgctcagggagcatcttagagaagaaaaactgaacagcctgaagctgaagatgacaaagaacggaaccgtcgaaagcgaggaggcgagcaccctaacactagacgacatctccgacgacgatatagacctggataataccgaggtggacgaatacttttttctgcagcctcttcctaccaagaaaagaagggccttgctgagggcgtcaggggtcaaaaaaatcgacgttgaagagaagcatgagctcagggcgataagactgagtagagaagactgtggctgtgattgtagggtgttctgtgaccccgatacctgcacttgctccctggcaggaataaagtgccaggttgaccgcatgtcattcccatgtggttgtactaaggaaggatgtagcaatacagccgggaggatcgagttcaaccctatccgtgtccgtactcacttcctgcataccatcatgaagctggaattggaaaagaatcgcgagcaacaaatcccgacactgaatggttgtcacagcgaaatcagcgctcattctagtagtatgggcccggtagctcactctgtcgaatattccatcgcagatagttttgagatcgagactgagccccaggctgccgtactgcacctgcagtctgcagaggagctggattgccagggagaagaggaagaggaggaggaggatggtagcagcttctgtagtggggtgacagacagtagcacgcaaagcttggcaccatcagagtctgacgaggaagaagaagaggaggaggaggaggaggaagaggaggacgacgacgacgacaagggtgacggctttgtggaaggattggggacacacgccgaagtcgtgccactccccagcgttctgtgctacagtgacggaactgctgtccacgagtcccatgctaagaatgcttctttttatgctaattccagcacattgtactaccaaaacgactcaggcgtgccatgcaacagtctctaccctgagcaccgtagcaatcatccgcaggtggaattccattcatacttgaagggacccagccaggaaggtttcgtgtctgcactcaatggcgactcgcatattagcgaacacccggccgagaactctctgtccctcgccgagaaatcaatcctacatgaggagtgcatcaagagtcctgtggtggaaaccgtacctgtctag

SEQ ID NO: 19014 - DNA, 2127 bp, Artificial Sequence
  Description of Artificial Sequence: Synthetic coding sequence
atggccgtgcccgccgccctgatcccccccacccagctggtgcccccccaaccccccatttcaaccagcgcttcctcttccggtactacaactagtacaagttcagccacaagctcgcctgcacctagcatcggtcctccggcttcctctggacctactctcttccgccccgaaccaattgcctctgctgctgccgccgccgcaactgtcacaagcacaggggggggaggcggaggtggcgggggcggctcaggaggaggggggggcagctcgggcaatgggggaggggggggaggcggcggggggggaagcaattgtaatcccaatttagccgctgcttccaatggctctggtggggggggaggcggaatttctgctggcgggggcgtcgcatctagtacccccattaatgcatcaacagggagctcgtcctcatcaagctcctcctcttcatcgagcagcagcagtagcagttcttcttcctcaagcagctcatgcggtcctttgcccggaaagccagtatacagcaccccttcccccgtggagaacacgccgcagaataacgagtgtaaaatggtcgacctgaggggcgcgaaagtcgcatccttcaccgtcgagggctgtgaacttatatgtttgccccaggctttcgacctctttctaaagcacctggttggggggcttcacactgtctacactaagctcaaacggctggagatcacgcctgtcgtatgcaatgtcgaacaggtacgcattctcagagggttaggggccatacagccaggcgtcaatcggtgtaagctgattagcagaaaagattttgagaccctgtataatgattgcactaatgcatcctctagaccagggaggcctcctaagcggactcagtctgtcacttcccccgaaaatagccacatcatgccacatagtgttccggggctgatgtcccctgggatcatcccgcctaccggcctcacagccgcagcagccgcagccgcagccgctactaatgccgccattgcggaagctatgaaggtcaagaagattaagctcgaggccatgtctaattatcacgcctctaataatcagcacggggcagacagtgagaatggggacatgaactcttcagtcgggctcgagctgccctttatgatgatgccgcatccactgatccctgttagtctcccgcccgcctcagtaactatggctatgtcacagatgaatcacctttccaccattgctaatatggccgcagctgcacaggtgcagtcgccccccagccgtgttgaaactagtgttatcaaagaaagagtccccgactcgccctcccccgcaccctccttggaggagggtaggcgtccagggtcccatccgagctcacatcggtctagctccgtctcgtcatccccagcaaggacagagtcgagctcagatcgtatcccagtgcaccagaatggcctgtctatgaaccagatgctgatgggattatccccaaatgtccttcccggacccaaagaaggagatctcgccggacacgacatgggccacgagagtaaaagaatgcacatcgagaaagatgagacacctttaagtacaccaaccgccagagattcactggataagctgtccctgactggccacgggcagccgttaccacccggattccctagccccttcttattcccagatgggctgtcatctattgagactctccttacaaatatccagggcctcttgaaagtagcaatcgataacgcccgcgcccaggagaagcaggtgcagttggaaaaaacagagctcaaaatggactttttgcgcgaaagagagctgcgagagactcttgaaaaacagctggccatggagcagaagaatagagcgattgtgcaaaagcgactgaagaaggagaaaaaggctaagcgaaagctgcaggaggcactggagtttgaaaccaaaagacgagagcaggccgaacagaccctcaagcaggccgcatctacggactcactgagagtgctcaacgactctctaacgccagaaatagaggccgacagaagcggaggcaggacagacgcagagcgcacgattcaggatggacgtctttacctgaaaactacagtcatgtactag

SEQ ID NO: 19015 - DNA, 1683 bp, Artificial Sequence
  Description of Artificial Sequence: Synthetic coding sequence
atggccgtgcccgccgccctgatcccccccacccagctggtgcccccacagccccccatttccacttctgctagctcttccggaactacgaccagcacctccagtgcgacttcaagtcccgccccctccattggcccacccgctagctctgggccaacactgtttaggccggaacctattgcttcggctgccgctgctgccgctaccgtcacatccactggtggcggtgggggggggggcgggggcggcagcggagggggtggaggcagctcagggaatgggggcgggggggggggtggggggggaggatccaattgcaacccaaaccttgctgcggccagcaacggctcaggaggaggcggaggcggcatctctgcagggggcggggtggctagtagtacccctattaatgcatctacaggatcatcctcgagtagcagctcctcatcctcctccagctcgtcctcaagctcttccagctccagcagttcatcttgtggcccgctgcccggcaaaccagtgtatagtacaccaagtcccgttgaaaacaccccccagaataatgagtgcaaaatggtggatctgagaggagcaaaggtcgcttcattcacagtggaggggtgcgagctgatatgtctgcctcaagccttcgacctgtttttgaaacatctggtcggtggtctgcataccgtatacacaaagctgaaacggctcgaaataacccccgtggtgtgtaatgttgagcaagtgcgcatacttaggggactcggagccatccagcccggcgtgaatcggtgtaagttgatttcacgcaaggattttgagaccttatataatgattgcacaaacgcctcatcccggccgggtaggcctcccaaacgaactcagtcagttacatcaccagaaaatagtcacattatgccccattcagtacccggcttaatgagccctggtattatacccccgaccggtctgaccgctgctgcagctgcagctgctgctgcaaccaacgctgccattgccgaggctatgaaggtgaaaaagataaagctggaggcaatgtctaactatcacgctagcaataaccaacacggtgcagactcagagaacggggacatgaactccagcgttgatgagacgccgctcagtacccctacagccagggactccttagataagctgtccttgaccggccatggccagcccctgccgccgggattcccatccccctttctcttccctgacggtctctcgagtattgagacactcctgaccaatatccagggcttgctgaaggtcgccatcgataacgcacgtgcccaggaaaaacaagtccaactagagaagacagaactcaagatggatttccttagggagcgcgaattgagagaaactcttgaaaagcagctggctatggagcaaaaaaatagagccatcgttcagaaacgcctgaagaaagagaagaaggccaaacggaaactacaagaggcccttgagttcgaaacaaagcgacgagaacaagcagagcagactctgaagcaggccgcctctacagatagcctgcgggtacttaacgactctctgactcccgaaattgaggccgatagatctggcggaaggacggatgctgagcgaactatccaggacgggaggctttaccttaaaacaactgtgatgtactag

SEQ ID NO: 19016 - DNA, 1521 bp, Artificial Sequence
  Description of Artificial Sequence: Synthetic coding sequence
atggccgtgcccgccgccctgatcccccccacccagctggtgccccctcagcctcctataagtacttctgccagctcttctgggaccactacatccactagctcagctacgagcagccctgcaccaagcatcggacctcctgcgtcttccggtccaaccctttttcgacccgaaccaatcgctagtgcagcggccgctgcagcaaccgtgacctctacgggcggggggggcggcggagggggtggaggaagcggaggaggtggcggctcttctggaaatgggggtgggggaggcggagggggtggcgggagtaactgtaacccaaacctcgctgccgcctctaacggttccggtggcggtggcgggggtattagtgccggtggaggcgtggcctccagtacaccaataaatgccagcaccggcagctcttcctctagtagctcatccagttctagcagcagctcttcctcctccagttcatcctcatcatcttcctgcggcccattgccgggcaagcctgtgtactcaacacccagtcccgttgagaatactccccagaacaacgagtgtaagatggtggacctccgtggggcaaaggtcgccagcttcaccgtagaaggttgcgaactgatttgcctcccacaggccttcgacctcttcctgaaacacttggtcggtggattgcatacagtttataccaagcttaaacggctcgagattactcctgtggtatgtaacgtggagcaggtcagaatactgagaggtctgggagccatccagcccggggtgaaccgatgtaaattgatctctcggaaagattttgagactctttataacgattgtactaacgcttcctccagacctgggaggccacccaagcgcacgcagtctgtgacctcaccagagaacagtcacatcatgcctcattcagtacccggcttgatgagccccggaatcatccccccaaccgacgaaacccctttaagcactcccacggcgagggactccctcgacaaattgtctttgactggccatgggcagcctttgccccccggatttcccagcccctttttatttcccgacggactgtcctccattgagacattattgacaaacatccaggggctcctgaaggtggctatcgacaacgcccgggcacaggaaaagcaggtccagctggagaagacggaactgaagatggacttcttgagagagagggagcttcgggagacactcgagaagcagttggctatggaacagaagaaccgcgctattgtccaaaaacgcctaaagaaggaaaagaaggctaaaaggaaactacaggaggccctggagtttgagacaaagaggcgcgagcaggctgagcagacactcaaacaagcagctagcaccgactctctacgagtgctgaatgactccctgaccccagagatcgaagctgaccgtagtgggggcaggactgatgccgaacggactatacaggatgggcgtctatatctgaaaaccacagtgatgtattag

SEQ ID NO: 19017 - DNA, 2283 bp, Artificial Sequence
  Description of Artificial Sequence: Synthetic coding sequence
atggccgtgcccgccgccctgatcccccccacccagctggtgccccctcaacctccgatatccacttccgcctcatcaagtggcacaaccacaagcacctcttcggccacatctagcccagccccatccattggtcccccagcaagcagcggaccgactctttttcgccccgagccaattgcatcggcagccgcagcagctgctactgtcaccagcaccgggggaggaggaggagggggtgggggaggttctgggggcggaggggggtcctcagggaatgggggtggcgggggtggaggtgggggtggaagcaactgcaatcccaacttagctgccgcctcaaacggctctggaggtggagggggtgggatttcggctgggggaggggtggcttcaagtacccctattaatgcctccactgggtcttcaagtagcagcagtagtagctcttcatcaagctcatctagttctagctcctcaagttcctcatccagttgcggtcccctccctggaaaaccagtatactccaccccctcaccagtggaaaacacccctcaaaacaacgagtgtaagatggtggacttgcgcggtgccaaagtggctagtttcacagtggagggctgcgagctgatctgtctaccacaggcattcgacctctttcttaaacatctggtgggcgggttgcatacagtgtacactaaattaaaacggctggagattacacccgtagtctgcaatgtcgaacaggtgcgcatactccgggggcttggggcaattcaaccaggagtgaatcggtgtaagctaattagccggaaagattttgaaacattatataacgactgtactaatgccagctctcgcccaggacggcccccaaaaaggacccagtcggtgacttcgcctgagaattcgcacattatgccccactcggtgcccggcctgatgtcaccgggcatcattccccccaccgggctgacagccgccgccgcggccgccgccgctgccaccaatgctgcaatcgctgaagcaatgaaggttaaaaagattaagcttgaggctatgtccaattaccacgcttcaaataatcagcacggggcagattctgaaaacggcgacatgaacagcagtgtggggtcctctgatggatcttgggacaaagagaccctgcctagcagcccttcgcaaggccctcaggcctctatcacccaccctcggatgcctggggccagatctctcccgttatctcatcctcttaaccacctgcaacagagtcacttactccccaatggcctggagcttccctttatgatgatgccacatccgctgattccagtgtccctgcccccagcgtccgttaccatggccatgtctcagatgaatcatctctccaccatcgccaatatggctgctgccgcccaggttcaatccccaccctcaagggtggaaacgtctgtgataaaagagagagttcctgactctccttcccccgccccttcactcgaggaaggccgacgccctggaagccacccatcatcccataggagctccagcgtgtcctctagccctgcccgtacagagagctcttctgatagaattccagttcaccagaacggcttgagcatgaaccagatgttgatgggcctgtcacctaacgtgttgcctggtcccaaggagggggatctcgcggggcacgacatgggtcacgaatctaagaggatgcatatcgagaaagatgagacccccttgtcgacccccaccgctcgtgactcgcttgacaagctatcactgaccggtcacggtcaacctctcccgcccggcttcccctctccgttcctgttcccggacggtttgagtagcatagaaactttgctgaccaacatccagggcctgctcaaagtcgctatcgacaacgccagggcacaggagaaacaggtccagctggagaaaactgaattgaagatggactttctgagagagagggaactacgcgagaccctcgagaagcaactcgctatggaacagaagaatcgcgctattgtccagaagcggctgaagaaagaaaaaaaagccaagcggaaacttcaagaggcacttgagtttgagactaaacgtcgagaacaggcagagcaaaccctcaaacaggcagcatctacagattctcttcgggtgcttaacgactcactcacacccgagattgaggcagacagatccggcgggcgcaccgatgctgagcgtacaattcaggatggacgcctgtatctcaagaccactgtaatgtactag

SEQ ID NO: 19018 - DNA, 2283 bp, Artificial Sequence
  Description of Artificial Sequence: Synthetic coding sequence
atggccgtgcccgccgccctgatcccccccacccagctggtgccccctcagcccccaataagcacctccgcctcttcatcgggcactaccactagcacttccagcgctaccagcagccccgccccttcaatcgggcccccagcatcctccggtccaacgttgttcaggccagagccaattgctagtgctgccgccgctgccgccaccgtgacaagtactggcggtggcggaggcggaggtgggggcggcagtggaggcgggggcggcagctccgggaacggtgggggaggtggtggaggcggcggaggctcgaattgcaatccaaacttggcggcagccagcaatgggagcggcggcggaggaggtggcatcagtgccggtggcggcgtggcttccagcacccccattaatgcttcgacaggcagctcctcctctagttctagctcgagttcttcgtccagctcctcctcctcatcttcctcttccagttcttcttgcggtcccctccccgggaaacctgtgtattcaacccccagcccagttgagaatactccgcagaacaacgaatgcaaaatggtcgaccttaggggtgccaaggtggcttcattcaccgttgaaggctgtgaacttatctgtctgccccaggcctttgacttgtttctgaaacaccttgtgggagggctccacaccgtatatacaaagctgaagcgtctggagatcacccccgtggtgtgcaatgtcgaacaggtgcgcattttacgaggcctgggagctattcagccaggggtgaaccggtgtaaactgattagccgaaaggattttgagaccctctacaacgattgtaccaacgctagttcacgccccggtcgacccccaaaaaggacccagtccgtgacctcacctgagaatagccacataatgccccattctgtcccaggcctgatgtcacccggcattatcccgcctactggcctgacggctgccgccgctgctgccgccgcagctacgaatgccgccatcgcagaagctatgaaggttaagaaaatcaagctggaggccatgtctaattatcatgctagcaataatcagcacggcgcagattcagagaacggggatatgaactcgtctgtgggaagtagcgatgggtcctgggacaaggagaccctgccaagttccccatcccaagggccacaggcctccataacccaccctcggatgcccggggcaaggagcctgccactaagccatcccctcaatcatctgcagcagagccacttgttgccaaacggcctggagctcccttttatgatgatgccccatcctctcattcctgtatcactgccaccagcctctgtgacgatggctatgtcgcagatgaatcacctttctaccatcgccaacatggcagccgcagcccaggtccaatctccgcctagcagagtcgaaaccagtgtcataaaagaacgagtacccgattccccatcccccgctcccagcctagaggaggggcggaggccaggctctcaccccagtagtcaccggtcttcaagcgtgtcaagctcacctgcccggactgagtcttcttccgataggatccccgtgcaccagaatgggctatctatgaatcagatgctgatggggctaagccccaatgtcctgcccggacccaaggaaggggatctggccggccacgacatgggacacgagtccaagagaatgcacatcgagaaggacgaaacgcctctgtctaccccaacagcccgcgattcattggataaactaagtctgacaggccatggccaacctctgcccccgggattcccctcaccatttctatttcccgacggactgagctctattgagacactgctgactaatatccaagggttactgaaggtggccattgataacgcacgagctcaggaaaagcaggtccagttagagaagacagaattgaaaatggactttctgcgcgagcgagaactgagagagacactcgaaaaacagctcgccatggagcagaagaatcgcgcgatagtgcagaagcgcctgaagaaggaaaagaaggctaaacgaaaattacaggaagccctcgagtttgaaacgaagagacgggaacaggcagagcaaaccttgaaacaggccgcatctactgactcacttagggttctgaacgacagcctcacaccggagatcgaagctgatagatccggaggcaggacagatgctgaacggacaattcaagccgcccggctctatattaagacagtgtgcatgtattag

SEQ ID NO: 19019 - DNA, 1800 bp, Artificial Sequence
  Description of Artificial Sequence: Synthetic coding sequence
atggccgtgagcgccagccccgtgatcagcgccaccagcagcggcgctggcgttcctggtgggctgttccgcgccgaacctctgtacagtacgccccgtgaacctccccgccttacaccaaatatgatcaactccttcgtggtgaacaaccactctaactcagcagggggaggcgggagggggaataccaacacaaatgagtgtagaatggtcgacatgcacgggatgaaggtggcctcatttctgatggatggtcaagagctgatctgtcttccacaggtcttcgatctttttcttaaacacttggtggggggattgcacacagtttacacaaagcttaaacggcttgacattagccctgttgtctgcacagtcgagcaggtgcgtatcctacgcgggttgggagcaatccagcctggcgttaatagatgtaagctaataaccaggaaagatttcgagacccttttcaccgactgcactaatgctcgaagaaagcgccaaatgacgcgtaaacaggccgtcaacagctcaaggcctggacgcccccccaaaagatctctgggtgtgctccaggagaacgcccgtctgttgacccacgccgttcccgggttgcttagccccggattgatcacaccaaccggcatcacagctgcggctatggctgaggccatgaaattgcagaaaatgaaactcatggcaatgaacaccctgcagggaaacggctcccagaatgggaccgaatccgagcccgacgatttaaattcaaataccggaggatcagaaagtagctgggataaggataagatgcagagtccctttgcggcacctggcccccagcacggcatcgctcatgctgccctcgctgggcaacctggcataggtggggcccctacgctaaacccactgcagcagaaccaccttctcacaaatcgactcgacctgccttttatgatgatgccccacccgctgctgccagtcagtcttcccccagcatccgtcgctatggcaatgaaccagatgaatcatttgaatacgatcgcgaacatggcagcagcggcccaaatccattcgccgctgagtagggccgggacctccgtcatcaaggagaggattccagagtcccctagtccagcccccagtttggaggagaatcaccggcccggatcccagactagctctcatacctcatctagcgtgagctcaagccccagccagatggaccaccatctcgagaggatggaagaggttcccgtgcagatacccatcatgaaaagccccctcgacaagatccaactgactccgggccaggcactgcctgctgggttccccggaccctttatttttgctgattcgctgagctccgtggagaccttacttacaaacatccaggggctgttaaaggtcgcgctcgataacgcccgaatacaggaaaagcagattcagcaggagaagaaagaactgcggttagagctttacagagagagagaaatccgcgagaacttggagaggcagctggccgtggagctacagagccggaccaccatgcagaagagactgaagaaagagaagaaaaccaagagaaaactgcaagaggccctcgagtttgaaagcaagcggcgcgagcaggtagagcaggctctgaagcaagcgaccacatctgattctggcctgcgcatgctcaaggacaccgggattccagacatcgagattgagaacaatggaacaccgcatgacagtgcagcaatgcaggggggcaactactactgtctggaaatggcccagcagctgtacagtgcgtag

SEQ ID NO: 19020 - DNA, 1800 bp, Artificial Sequence
  Description of Artificial Sequence: Synthetic coding sequence
atggccgtgagcgccagccccgtgatcagcgccaccagcagcggcgcgggcgtccccgggggtttgtttcgcgcagagcccttatattccactcctcgcgagccccctagactgacccctaacatgataaactcatttgtggtgaacaatcactcaaattctgccgggggaggaggcaggggtaataccaataccaatgaatgcaggatggttgatatgcacggaatgaaggtggcctctttcttgatggatggccaggagcttatttgcctccctcaggtgtttgatctatttctgaaacatcttgtgggcggccttcatacagtgtacacgaaactgaaacggctagatatcagccctgtggtatgcacggtggaacaagtgcgcattctaaggggcttaggcgcaattcaacccggggtcaatcgatgtaagctgattacaaggaaggacttcgagactctgttcacggactgtacgaatgccagacgcaagcgccagatgacccggaagcaggccgtgaactcctcacggcccggcaggccccctaagaggagcctgggagtcctgcaggagaatgcccggctgctgacccacgccgtacctgggcttctctctcctggcctgatcacaccaaccggcattaccgcagccgctatggccgaggccatgaaactgcaaaagatgaagctaatggcaatgaacaccctacagggcaatggcagccagaacggcaccgaaagcgagcccgatgacttgaatagcaacactggaggatcagaaagcagttgggataaggataagatgcaaagtccctttgccgcgccaggacctcagcacggcattgcgcatgccgcgctagctggccaacccggaatcgggggggcccccaccttgaacccactacagcagaaccatctactgaccaacaggctggacttgccattcatgatgatgccacacccactgcttccggtgtccctcccccctgcatcagttgcaatggccatgaaccagatgaatcatctgaatacaatagctaacatggcagccgctgcccagattcactctccactgagcagggctggaactagtgtgattaaagagaggatccctgagagcccctctcctgctccgtctctggaggagaatcatcgcccggggagtcagacgtccagccataccagcagctcagtgagctcatctcccagccagatggatcaccacctagagcggatggaagaggtgccagtgcaaatcccaattatgaagagccctctggataagatccagctcacccccgggcaggccttgcctgctggcttccccggtccttttatcttcgccgattcactgagcagtgtagaaacactgttgaccaatatccagggcttgctgaaagtggctctggacaacgcgaggatccaggagaaacagatccagcaggaaaagaaggaactaagactggagttgtaccgagagagggaaatccgggagaatctggagagacagttagccgtggaacttcagtctaggaccactatgcagaagcgcctaaagaaggaaaagaagaccaaacgcaaactccaagaagctctcgaatttgaatccaaacgtcgcgaacaggttgagcaggccttgaagcaggctaccactagcgactccggcttgcgcatgctgaaggacaccggtatacctgatatagagattgaaaacaacggaactcctcacgacagcgccgctatgcaaggaggcaattattactgtctcgaaatggctcaacagttatactccgcatag

SEQ ID NO: 19021 - DNA, 1716 bp, Artificial Sequence
  Description of Artificial Sequence: Synthetic coding sequence
atggccgtgagcgccagccccgtgatcagcgccaccagcagcggcgcaggtgttccaggcgggctgttccgcgcagagcccctgtactcaaccccgcgcgaacccccacgtttgacgcccaatatgattaactcctttgtggttaataaccacagcaattcagcgggcggcggaggacgaggcaataccaacaccaacgagtgccgaatggtggacatgcatggtatgaaggttgcttccttcttaatggacggccaagaactgatctgcctgccccaggtgttcgatttgttcctgaagcacctggtgggaggcctgcacaccgtatacactaagctgaaacgccttgacatttcgcccgtcgtgtgcacagtggagcaagttcgtatcctgcgcgggctaggggccatccagccaggcgtgaaccgctgtaaactgatcaccagaaaagacttcgaaacgctatttaccgactgcacaaacgccagctccagaccaggacgaccacccaaaagaagtctcggagttctccaggaaaatgcacgcctgctgacccacgccgtgcccggactgctctctcctggtttaattacccctactggtatcactgccgccgccatggcagaagcaatgaagcttcagaaaatgaagctcatggcaatgaatactctgcagggtaatggaagccagaacggcaccgaaagcgagccagacgatttaaatagcaacaccggtggcagcgaatcctcttgggacaaggataaaatgcaaagtccattcgctgctcctgggccgcaacacggcattgcccatgccgctttagccggtcagccgggcatcggcggcgccccaaccctgaatcctctccagcaaaaccatttactgaccaaccgccttgacctaccgttcatgatgatgccacaccccctgctgccagtgtcgctgccgccagcctcagtggcgatggcgatgaaccagatgaaccacctcaacaccatcgcaaacatggcagcagcagcccagatacactcgcccctgtctcgggccggcacttccgtcattaaggagcggattccagagtcaccatcccctgcccccagtctggaggagaatcaccgcccagggtcgcaaacatccagtcacacatctagcagtgtatcttccagtccctcccagatggatcaccacttggagagaatggaagaggtgcctgttcagatccctatcatgaaatcccctctggacaagattcagctgacaccaggccaggcgctgcctgcggggtttccaggtccttttatattcgcggattctctgtccagtgttgagaccctgttaacgaacatccagggactgctgaaagtagcactggataatgctcgcatccaggagaagcaaattcagcaggagaagaaggagttgcgcctcgagctttaccgagagagggagattagggagaatctagagaggcagttagccgtggagctgcagagtagaaccactatgcagaagcggttgaagaaggagaaaaaaacaaagcggaaacttcaagaagccctggagtttgaatcaaaaaggagggaacaagtggagcaggctctaaagcaggccacgacttctgactccgggctccggatgttaaaggacactggcatcccagatatagagatagagaataatggtacccctcatgattctgcagctatgcaggcctag

SEQ ID NO: 19022 - DNA, 1299 bp, Artificial Sequence
  Description of Artificial Sequence: Synthetic coding sequence
atggcccagaaccagttcttcaacagcagccggcccggccggccccccaaaagaagcctgggggtcctacaggagaacgctaggctgcttacacacgctgttcctggactgctgagccccggtctaatcacaccgaccggaataaccgcagccgcaatggccgaagctatgaaactgcagaagatgaaactgatggccatgaacaccctgcaaggcaacggaagtcagaacgggacagagagcgagcctgacgacctgaactctaacaccggaggatctgaaagcagctgggacaaggacaagatgcagagcccgtttgccgccccaggtccacagcatggtatcgcgcacgccgcattagccggtcaaccaggaatcggtggcgctcctacgctcaacccactgcagcagaaccatttgctcaccaacaggctcgacctgcctttcatgatgatgccccatcccctcctgccggtcagcttgccccctgcatccgtggctatggcaatgaaccagatgaaccatctaaacacaattgctaatatggcagccgcagcccagatccactctcctttaagcagggccggcaccagtgtaatcaaggaaaggattcccgaaagtccctcaccagctcccagcctggaagagaatcacaggccaggatctcagacctcctctcatacatcatctagcgtaagtagttcccccagtcagatggatcatcatctcgagaggatggaggaagtccccgtgcagatccccataatgaagtccccactggacaaaattcagttgacccctggccaagctctccccgccggctttccaggcccttttatttttgcagattccctctccagtgtggagactcttctaactaacattcaaggtttacttaaggtggctctggacaacgcaaggatacaagagaaacagatccagcaggagaagaaggagctgcggctcgagctgtaccgcgagcgggaaattcgggaaaatctcgaacgccagcttgctgttgagctgcagtcaaggaccaccatgcagaaaagactgaaaaaagagaaaaaaacaaaacgaaagcttcaggaagcattagaatttgaaagcaagcggcgcgagcaggtggaacaagctctgaagcaagcaaccacctccgatagtggtttacgtatgttgaaggatacaggaatacctgacattgaaatcgaaaacaatggcactcctcacgattcagcagccatgcagggcggcaattactactgcctagaaatggcacagcaactgtattcagcatag

SEQ ID NO: 19023 - DNA, 1299 bp, Artificial Sequence
  Description of Artificial Sequence: Synthetic coding sequence
atgacccggaagcaggccgtgaacagcagccggcccggccggccccccaaacgctctctgggggtgctccaggagaacgctaggctgctgactcatgccgtgcccggactgctctcacctggtttgatcaccccgaccggaattacagctgccgcaatggcagaagctatgaagctgcaaaagatgaagctgatggccatgaatacgttgcagggtaacggatcgcaaaatggcactgaatcagagccagatgatctcaattcgaataccgggggtagtgagtcatcctgggacaaggataagatgcagagcccttttgccgcccccggaccgcagcatgggattgcccacgctgcccttgccgggcagcccggtattggaggtgcccccactctcaacccgttgcagcaaaaccacctgctcactaatagactggacctgcccttcatgatgatgccgcaccctttactacccgtgtcccttcctccggcaagcgtggctatggccatgaaccagatgaaccacctgaataccatcgcaaatatggcagcggccgcacaaatacatagccctcttagccgggcaggaacgagtgtgatcaaagagcgaattcccgagtcaccctcccctgcacctagtcttgaggagaaccatagacccgggtctcaaacatcttctcacaccagctcgagcgtgtcatcgtcgccaagtcaaatggaccaccacttggagaggatggaagaagtgcccgtgcagatccccatcatgaagtcccctctggacaagattcagcttacaccgggccaggccctgcccgctgggttcccaggtcctttcatatttgccgattctctgagcagtgttgaaacactcctaactaatatacagggcctcctcaaagttgccctggataacgctcggattcaagagaagcaaatccagcaggagaagaaagaattaaggttggagctttaccgagaacgagagattagggagaacctggaacgacaactggctgtggagctccagagtcgcactacaatgcaaaagcgcctgaagaaagagaaaaaaactaagcggaagctgcaggaggccctggagttcgagagtaaacgccgggagcaagtggaacaggcattgaagcaggccactaccagtgatagcggactgaggatgttaaaagatacgggcatccctgatatcgagatcgaaaataatgggacccctcatgactccgcagcaatgcaggggggcaattattactgtctggagatggcccagcagctctattccgcgtag

SEQ ID NO: 19024 - DNA, 1143 bp, Artificial Sequence
  Description of Artificial Sequence: Synthetic coding sequence
atggccgaggccatgaagctgcagaagatgaagctgatggccatgaatacactacagggtaacggctcacaaaacggcaccgagagtgagcctgatgatctgaactctaacaccggtgggtccgagagttcatgggacaaggataaaatgcaaagtcctttcgcagcgccaggccctcagcacggcattgctcatgcagcactcgccgggcagccaggaatcggaggagcacctaccctgaatcccctccaacaaaaccatcttctgacgaacaggctcgatttgccgtttatgatgatgccccatcctctactgcctgtttcccttcctcccgcatctgtggccatggcgatgaatcagatgaatcatctgaacaccatcgctaacatggcagctgcagcgcaaatccactcaccacttagccgggccgggacaagtgttataaaagaacgcatccctgagagcccttcacctgcaccatctcttgaggagaaccataggcccggtagtcagacatcaagccacacgagcagctctgtgtcatcctcccctagccagatggaccaccatcttgagagaatggaggaggtccctgtccagatccccataatgaagtccccgctggataaaatccaactaacccctggccaggctctcccagccgggtttcctgggcccttcatctttgctgatagcttgagtagtgtggaaacgctgctcactaatattcagggcctcctgaaagtggctctggataacgcaagaatacaagaaaaacagattcaacaggagaagaaagaactgaggcttgagctttacagagagagggagatccgcgagaatctagagcgtcagctggctgtcgagctccagtcccgcactactatgcagaaaagactgaagaaagagaaaaaaacaaagcgcaaactccaagaggcactggagttcgaatccaagcgacgagaacaggttgaacaggccctgaagcaagctacaacctctgattctgggctccgcatgttgaaggacactggaattcctgatattgaaattgaaaataatgggacacctcatgactccgcggccatgcaaggaggaaactactactgcttggaaatggcacagcaactttattcggcatag

SEQ ID NO: 19025 - DNA, 1794 bp, Artificial Sequence
  Description of Artificial Sequence: Synthetic coding sequence
atgcagtggccccccccctggcggcggagccccctggtgagcgccactcccccaccagggcccaccagaggcctgctgtgccctcgaagggtgagcgaagccggagactcctccacagagggcgcaagaaccggacacagacactatgtcacccccgccgagtctgccatggaggggaggagccaacccctgccctccctgcgccccgcaagcccaaccaacgcgcctgcacacgggcgcggctccgactgtactgccaaagaaccccccctcgctaacgtgtgccgtcagaactatggagccgcccaagaccccgttgagccagcaggccggcgatccgcttcccatgtcaccgggagcagtctgggaaaggccgaggtcgcctgcggtcgccgttggaggtgggcagaactgctagcagatacgagctggagcccggcgggccgcgccactgaaatgaaagtcaagatgctgagtcggaaccctgataactatgttcgtgagacaaagctggacctacaaagagtgccccgaaactacgaccccgccctacacccatttgaagtgccacgagaatatatccgtgcacttaatgctaccaagctggaaagagtattcgccaaaccctttctcgctagcctcgatggccacagagatggagtaaactgtctggcaaagcatccggagaagttggcgacagttctgagcggggcttgcgatggtgaagtccgcatttggaacctgacccagcgtaactgcatccggactattcaggcccacgagggattcgtcaggggaatttgcaccaggttctgtggcacctctttctttactgtgggagacgataaaaccgtgaaacagtggaaaatggacggtcccggatacggcgacgaggaggagcctctgcacacaatcctcggcaagaccgtgtacactggcattgaccaccactggaaggaggccgttttcgccacgtgtggacagcaagtagacatttgggatgagcagcgcacgaaccccatttgttccatgacctggggattcgatagcatcagttctgtcaagtttaacccgatcgaaacattcctcctgggatcgtgcgcgagtgatcgaaacattgtgttgtatgacatgcgccaagcaacaccactgaagaaagttatacttgacatgagaactaacaccatttgctggaaccccatggaagcattcattttcacggccgcaaatgaggactataacttgtacaccttcgacatgcgcgccctggacacaccagtgatggtccatatggaccacgtctcagcagttcttgatgtggattattcaccaacaggaaaggagtttgtgtcagcttctttcgacaaaagcattagaatctttccggtggacaaaagcaggagtcgcgaagtgtaccacactaagcgcatgcagcacgtcatctgcgtcaaatggacaagcgattccaagtatataatgtgcgggtccgacgagatgaacattaggttgtggaaggccaacgcgtccgagaaactcggggtgctgacgtctagagaaaaagcagccaaggattacaaccaaaagttaaaggagaagttccaacactaccctcacataaaacgcatcgcccgccaccggcatctacctaaatccatatactctcagattcaggaacaacggatcatgaaagaagcaagaagacgcaaagaagtgaaccgaataaagcactctaaaccgggtagcgtgccattggtgagcgaaaaaaaaaaacacgtggtcgctgttgttaagtag

SEQ ID NO: 19026 - DNA, 291 bp, Artificial Sequence
  Description of Artificial Sequence: Synthetic coding sequence
atgaaggtgaagatgctgagccggaaccccgacaactacgtgcgggagaccaaattggatcttcaaagagtgcctagaaattacgaccccgcactgcacccattcgaagtacctcgtgagtatatccgggctcttaacgccacaaaactggaacgtgttttcgctaaaccttttctcgctagtctggatggccaccgcgatggcgtcaactgtttagccaagcaccctgagaagctggcaaccgtgctttctggtgcttgcgatggcgaattaaatatgatcaagttgtag

SEQ ID NO: 19027 - DNA, 2583 bp, Artificial Sequence
  Description of Artificial Sequence: Synthetic coding sequence
atgagccggggcggcagctacccccacctgctgtgggacgtgcggaaacgcagtctcggacttgaggatccctctcgattgaggtcccggtaccttggaagacgggagttcatccagcgcctaaagttggaggccactttgaacgtccacgatgggtgcgtgaatacgatctgctggaacgacaccggcgaatacatcttgtccgggtctgacgataccaagttagtgatctcaaatccgtattcaaggaaggtgcttaccaccattcgtagcggacaccgggcgaatattttttctgccaagttcctcccatgcacaaatgacaaacagattgtgtcctgctccggagatggcgtgatattctacacaaatgtcgaacaggatgcggagacaaacagacaatgtcaatttacctgccactacgggacaacctatgagattatgacagtacctaatgacccatacacctttctgagctgcggtgaagacggcaccgtgagatggtttgacaccaggatcaagaccagctgtactaaggaggattgtaaggatgacatcctgataaactgtagaagagcggctacaagcgtggcaatatgcccgcccatcccctactatttagcagtggggtgcagcgacagtagtgtacggatatacgaccgtcgcatgttgggaaccagagccaccggcaactacgccgggagaggtactacggggatggtggcccggttcatccctagtcatctgaacaataagtcatgccgggtaaccagcctgtgttactcagaggacggtcaagaaatactagtcagctattccagcgattacatctacctgttcgatcccaaggatgacaccgctcgtgaactgaaaactccttctgccgaggaacgcagagaggagcttaggcagcctccggtgaaaaggcttcgtctacgaggtgactggtccgataccggccccagggcccggcccgagtctgagagagagagagacggagaacagtcccctaacgtgtccttgatgcagagaatgtcagacatgttgagccgctggttcgaagaggccagtgaggttgctcagtcaaatagaggccgaggccggtcccgtccaagaggtggtacttcgcaatcagatataagcaccctgcccacggtaccaagcagccccgacttggaagtgtccgaaactgccatggaggtggatacccccgctgagcaattcctacaaccctccacttcatcgaccatgtccgcccaggctcactccacaagcagtccgacagagagcccacatagcacgccactgctctcaagccctgatagcgagcagagacagtctgtggaagctagcggccatcatacacatcaccagtcagacaacaacaacgaaaagctgtccccaaaaccaggtacaggtgagccagtgcttagcttacactactctaccgaggggaccactaccagcactattaaattgaacttcactgatgagtggtcctccatcgcttcctctagtagagggatcgggtcacactgcaaatcagaggggcaggaggagagtttcgttccccagtccagtgtgcaaccaccggagggcgattcagagacaaaggcccccgaagagagcagcgaggatgtcacgaagtaccaggaaggtgtgagcgctgaaaatcctgtcgagaatcatattaatatcacccagtcggacaaattcacagcaaagcccctagactcaaactcaggggagcgcaatgacctgaatctcgataggtcttgcggggtgccagaggaaagcgccagctcagaaaaggctaaagaacccgaaacaagtgaccagacttctactgaaagcgccaccaatgaaaacaataccaacccggaaccccagttccagaccgaggccacagggccgtctgcgcacgaggaaacctctacccgagactcagccctacaggacaccgacgacagtgacgatgatcctgtactaatccctggtgccagataccgtgcaggccctggtgataggcgctctgccgttgccaggatccaggagttctttcgtcgccgaaaggaaaggaaggagatggaagaactggataccctgaatattaggcgccccctggtcaagatggtgtacaaagggcatcggaattcccgcacaatgatcaaggaggctaacttttggggtgcaaattttgtgatgtcaggctccgactgcggccacatctttatttgggatagacacaccgccgagcatcttatgctgctcgaggctgacaaccacgtggtaaactgtctgcaaccacacccattcgaccccattctcgcctcatccggaatcgattacgacattaagatctggagtcccctggaagaatcccggattttcaataggaaactggctgatgaggtcattacgcgcaatgagttgatgctggaagagaccagaaatacaatcacagttcctgcatcttttatgctgcgcatgttggcttctttaaatcatatcagagccgacaggctggaaggagacaggagtgaaggcagcggtcaggagaatgaaaatgaggacgaggagtag

SEQ ID NO: 19028 - DNA, 2856 bp, Artificial Sequence
  Description of Artificial Sequence: Synthetic coding sequence
atgagccggggcggcagctacccccacctgctgtgggacgtgcggaagaggtcgttaggcctggaggatcccagtcgcctccgctctagatatctaggtcggcgggagtttattcaaaggttgaaacttgaagctactctgaatgtgcatgatggctgcgtgaatactatttgctggaacgataccggtgaatacatcctctcaggttccgatgacactaaactagtgatttccaatccctattcacgaaaagtactcaccactataagatctggtcacagggccaacatcttctcagcgaaattcttgccatgcacaaacgataagcagattgtctcttgctcaggtgatggcgtcatattctatactaacgtggagcaggacgcagaaaccaaccggcagtgtcagttcacatgtcattacggcacaacatatgagatcatgacagtgcctaacgacccgtatacgttcctgtcttgtggtgaggatggaacagttcgctggttcgatacgcggattaagacgtcttgtacaaaggaggattgtaaggacgacatactgataaactgtcggcgcgctgctacatctgtcgccatctgcccacccatcccgtattatctggctgtcggatgttccgatagctccgtgcgaatttacgatagacgaatgctgggcacgagggcgactggcaattacgccggcaggggaactaccggcatggttgctcgcttcattcctagtcatctgaataacaaatcctgccgggtcacttccttatgctactcagaggacggtcaagagattttggtgagctactcctctgattatatttacctgttcgacccgaaggacgacacggcccgggagctcaagacccccagtgccgaggagcgcagagaggagctgcgccagccccctgtgaaacgtctgcggctaagaggcgactggtctgacacaggccctcgggctaggcccgagtctgagcgtgaacgcgacggcgaacaaagcccaaacgtctccctgatgcaacggatgtccgacatgctgtcccggtggttcgaagaggcttcagaagtggcccaatctaaccggggccgtggaaggtcccgccccagaggcgggactagccagtctgacatcagtacactccccactgtaccatcctcacccgatctcgaggtgtctgaaacagctatggaagtggacacccctgctgaacagtttctgcagccctctacatcctccacaatgtccgcgcaggctcactctacctccagccctacagagagcccccattctacccccctgctctctagtcctgactccgagcagcgccaaagtgtggaagcatcaggtcaccatacccaccaccaaagcgaattcttgcgcgggccagaaattgcgctactgagaaagcgactccaacagctgcgcttgaagaaagccgaacagcagcgccagcaagagcttgccgcccatacacaacagcagccctctacctctgatcagagttcccatgagggaagttcccaggacccacacgcatctgacagtccatcaagcgtggtcaataaacaactggggtcaatgtctctggatgagcagcaagacaacaataacgagaagctgtctccaaaaccgggaaccggggagccagtgctatcactccactattccacagaagggactacaacatccaccatcaagctaaactttactgacgagtggtcctcaatcgctagttcctcaaggggtattgggagtcactgcaaatcagagggccaggaggagtccttcgttccccaaagcagcgttcaacctcccgagggcgattccgaaacaaaagccccagaggagtcttctgaggacgtaacaaaataccaggagggagtcagcgccgagaaccctgtggagaaccatataaacatcactcaatcagataagtttacagctaagccacttgatagcaacagtggtgagcgcaatgaccttaaccttgatcgaagctgcggagtcccagaggaatcagccagttctgaaaaggccaaagagcccgaaactagtgaccagacctcaactgagtccgccacgaacgagaataacacaaaccccgagccgcagttccaaactgaggccacaggtccctcggcacacgaagaaacttccacgagggactctgctctccaagacacagacgactctgacgacgacccggtgctcatacccggcgcaaggtatagagctgggccaggtgacaggtttaatatccgaggcactaccatcggcgatcggatcatgagaaggagcgccgtcgctcgcattcaggagttcttcaggcgacgaaaggaacgcaaggagatggaagaacttgacactttgaatatcagaaggcctcttgtgaaaatggtctacaaagggcaccggaactctaggaccatgattaaggaggctaacttttggggggctaactttgtgatgtccggaagtgattgcggacatatctttatctgggatcgtcataccgccgagcacctgatgctcctggaagctgataaccacgtggtgaattgcctacagcctcatcctttcgaccctatcctcgcgtcctccgggattgattacgatattaaaatttggagccctttggaagaatcccgcatctttaatcgcaagctcgcggacgaagtaatcaccagaaatgaactgatgctagaagagaccaggaatacaatcacagtgcccgcttcattcatgctgagaatgctagcttcactgaatcatattcgcgcggacagactggaaggtgacaggagtgaaggctctggtcaggagaatgagaacgaagacgaagaatag

SEQ ID NO: 19029 - DNA, 2643 bp, Artificial Sequence
  Description of Artificial Sequence: Synthetic coding sequence
atgagccggggcggcagctacccccacctgctgtgggacgtgcggaagcggtcgctgggactagaggacccttctcggctaagatcccgctacctcggcaggagggaatttattcagcgcctgaagctcgaggccaccctgaacgtgcatgacggatgtgttaatactatctgttggaacgatactggcgagtatattctttcagggagcgacgatacaaaactcgtcatatccaatccctactctagaaaagtcctgacaactattcggtctggtcaccgggcgaacatcttctccgcgaagttcctaccctgtaccaacgataaacagattgtctcatgtagtggagatggagtgattttctatactaacgtagagcaggacgcggaaaccaaccgtcagtgccagtttacttgccattatgggaccacatacgagataatgaccgtgccgaatgatccctacacattcctttcatgtggtgaggacgggacagtcaggtggttcgataccagaataaagaccagttgtacaaaggaagactgcaaagacgatattctcatcaactgcagacgcgccgccacatctgtcgccatctgccccccaatcccttattacctggccgtcggctgctctgattctagtgttcgtatctatgaccgccgcatgctggggacaagagccaccggcaactacgcggggagggggaccacaggcatggttgcccggtttattccctcgcacctgaacaataaatcttgtcgggtaacctctctctgttactccgaagacgggcaggaaattctagtcagttactcatcggactacatctacctctttgatccaaaggatgacactgcccgcgagctgaagactccttcagctgaggagcgtcgagaagaacttaggcagcccccagtgaaaagactccgtctgcgaggcgactggagcgacacaggaccccgagcaagaccagaatctgagagggagagagatggcgaacagagcccaaacgtgtccctcatgcagcgcatgagtgatatgctttctaggtggtttgaggaggccagcgaagttgcgcagagtaaccgggggcgcggacgaagcagaccgaggggtggcacctctcagagcgacatctctactttgcctacagtgccatcatctccagacctggaggtgtccgaaacggcgatggaagtggacacaccggccgaacagttcctgcaacccagcacatcttcgacaatgtcggcccaggcgcactcaactagcagccccaccgagtcacctcactcgactcctctactgtcctcaccagattcagaacagcgccagtctgtggaggccagcggccaccacactcatcaccagagtgactctccatcttccgtggtaaacaaacagttgggttctatgtccctagacgaacagcaggacaacaataacgaaaagctgtctcccaaacccggaacaggagagcccgttcttagtctgcactactccacagagggaactacaactagcacgattaagttgaactttacagatgagtggtcctctatcgctagctccagcagaggcatcgggagccattgcaagagtgagggccaggaagagtcattcgtccctcaatcaagcgttcagccaccagagggagattctgaaaccaaggcaccggaggaatccagcgaagacgtgactaaataccaggagggtgtgagcgctgagaaccccgttgaaaatcacatcaacattacacaatctgacaagtttacggcaaagccattagacagcaactctggggagcgaaacgacctgaatcttgaccgaagctgtggcgtccctgaggagtctgcctcctccgaaaaggcaaaagagccagagacttctgaccagacgtctactgagagcgccacgaatgaaaataatactaacccagagccccagtttcaaaccgaggcaacgggcccaagcgctcatgaggaaacttccacaagggactctgcactacaggataccgacgacagcgatgatgacccagtattgattcccggagcacgctatagggcaggccctggcgatcgacgcagcgccgtcgctcgcatccaggagtttttccgacgaagaaaagagcgaaaagaaatggaagagttggatacactcaatatccgccggcctctggttaaaatggtatacaagggccacaggaatagccgcactatgattaaggaagctaatttctggggggccaattttgtgatgtccggatcagactgtggacacatcttcatttgggatcgacacacggcagagcatctcatgctcttggaagcagacaatcacgtcgttaactgtctgcagccacacccatttgaccccattcttgcgagctccggtattgactacgacattaaaatttggagcccactggaagagagcaggattttcaacaggaaattagccgatgaggtcatcacacggaatgagttaatgctggaggagactaggaacacaatcactgttcccgccagctttatgctgaggatgcttgccagcttaaaccatatccgagctgaccgactcgagggggacagatcagaagggtccggccaagaaaatgaaaatgaggatgaggagtag

SEQ ID NO: 19030 - DNA, 2763 bp, Artificial Sequence
  Description of Artificial Sequence: Synthetic coding sequence
atgagccggggcggcagctacccccacctgctgtgggacgtgcggaaacgcagcctggggcttgaggatccctcccgacttcgctcacgatacctgggccggcgagagttcatccagcggctaaaactggaagctactctaaacgtccacgatgggtgcgtactgacaaccatacgcagtggccaccgagctaatatattcagcgctaagttcctgccatgtacaaatgacaaacagatagtgtcatgctcaggcgatggtgtgattttctacactaacgtagagcaagacgccgagaccaaccggcagtgccagtttacctgccactatggcaccacatatgaaataatgaccgttcctaatgacccgtacacctttctctcttgcggcgaggatgggaccgtgcgatggttcgatacaagaattaagacttcctgtaccaaagaggactgtaaagacgatatcttgattaactgcaggagagcagcaacgagcgtcgctatctgtccgccaatcccctactacctcgccgtgggctgctcagattcatcggtgagaatctacgacagacggatgctcggcacaagggccacgggaaattatgcaggcaggggcactaccggcatggtcgcacgcttcattccttctcacctgaacaacaagagctgcagggtcacgtctttgtgctattctgaggatgggcaggagatcttagttagttactcttctgactatatctacctgttcgaccctaaggatgatacggccagggagctgaagacaccatctgccgaggagcgaagagaagaactcaggcagcctcccgtgaagaggcttagactgcgcggagattggagtgataccgggcctagggcccgccccgagagcgagcgagaaagggatggtgaacaatccccaaacgtgtcactgatgcagcgaatgtcggacatgctgtcccggtggtttgaggaggcctccgaagtagcacagtctaacagagggcgaggccgctctaggcctcgcggtggcacttctcagtccgacatctcgaccctgcccactgtccccagctccccggatctcgaagtgtcagagaccgctatggaagtggacacccctgccgagcagtttctgcaaccaagcaccagctccaccatgagcgcgcaggcacactccacgtcttcgccaaccgaaagtccccacagtaccccactcctctcatcacctgacagtgaacagcgacagtcggtagaggcttctgggcaccatactcatcaccagtcagaattcttgcgcgggcccgaaatcgctctgctacgcaagcgtctgcaacaacttcgactgaagaaagcagaacagcagaggcagcaggaactagctgcccatacccagcagcagccatcaacctcagaccaatcttctcacgagggctcatctcaggacccacacgcatccgactcacccagctctgtggtgaacaaacagctgggttctatgtcattagatgaacaacaggataacaacaatgaaaaattgtcccctaaaccaggcaccggcgagccagtgctctcattgcattattcgacagaaggcaccaccacctctaccatcaaattgaatttcacggatgagtggtcctctattgcgagtagctcccggggtattggaagccactgcaaaagcgagggccaggaggaatccttcgtcccgcaaagcagcgtgcagccccccgaaggagacagcgagacgaaagccccggaggagagcagcgaggacgtgaccaaataccaggagggcgtctccgctgaaaaccctgtcgagaaccatatcaatatcacccaatcagataaatttacagccaaacctctggatagcaattcaggcgagcgcaacgacctgaacctcgaccgttcatgcggcgtgcctgaggaatccgcgagctcagagaaggccaaagagccggaaaccagcgaccagacctcaactgaatctgccacaaatgagaacaacaccaaccctgagcctcagtttcaaactgaggcaaccggccctagtgcccatgaagagacctctacccgggattctgcgctgcaggacaccgacgactctgacgacgatccagttctgatacccggagccagataccgtgcagggcccggtgacagattcaacattcgggggacaacaatcggggataggatcatgcgacgatcagccgtggcgcggatccaggagttctttcgaagacgcaaggagaggaaagagatggaggagcttgacaccttgaacatccggcgccccttagtcaagatggtctataagggacaccggaatagccggacaatgatcaaggaagcaaatttttggggcgctaactttgtgatgtccggcagcgattgcggacacattttcatttgggacagacatactgcagaacaccttatgctgcttgaagcagacaatcacgttgtaaactgtctgcagccacatccctttgacccaatcttggcctccagtggaatcgactatgatatcaagatctggagtccattggaggagtcccgaatctttaatcggaaactggcagatgaagtgatcacaagaaatgagctgatgctggaggaaactagaaacactataaccgtccctgcttctttcatgctgcgtatgttggcatccctaaaccacatccgggccgatagacttgaaggtgatcggtctgagggaagcgggcaggaaaatgaaaatgaggatgaagagtag

SEQ ID NO: 19031 - DNA, 1524 bp, Artificial Sequence
  Description of Artificial Sequence: Synthetic coding sequence
atggaggacagcgaggccctgggcttcgagcacatgggcctggacccacggctgctccaggcggtgacagatttgggatggagccggccaacactgatccaggaaaaggctattcctttggcactggaaggcaaagatcttttagccagagcccgaacaggctcagggaagaccgctgcttatgccatcccaatgttgcaactactcctgcacagaaaggcaacaggtcctgtcgtggaacaggctgttcgaggactggtccttgttcctaccaaggagttagcgcgacaggcacagagcatgatccaacaactagccacttattgcgcccgggacgtcagagtggcgaatgtttctgctgccgaagacagtgtaagtcaacgagctgtgttaatggaaaagccggatgtcgtggtgggtacacccagtcgtatcctatctcatctgcaacaggactctcttaagttgagggatagcctagagcttcttgtggtcgatgaggcagatcttttgttttcattcggtttcgaagaagagttgaagagcctgttatgtcacttgccacgaatctatcaggcttttctcatgagcgcaacattcaacgaggacgtgcaggctcttaaggagttgatactgcataatccggtcacactcaaactccaggagtctcagcttcctggcccagatcagctgcagcagtttcaggtagtctgcgagaccgaagaagacaagttcctcctcctgtatgcactgctgaagctatccctgatacggggcaagtctctgctcttcgtgaatacccttgagaggagctatcggctgaggctttttctggagcagttctccatcccaacgtgcgtcctcaatggcgagctgcccttaagatcacgggcgagtgatccggaggccggagtcgcccgcgggatagatttccatcatgtctcagcagtgctgaacttcgacctgccccctacacccgaggcctatattcaccgcgccggacgcaccgctcgagcaaacaatcccggtatcgtgctgacgttcgtgcttccaaccgagcagttccacctgggaaaaatcgaagagctgctcagcggcgagaatcggggtcccattctacttccctaccagttccgtatggaagaaatcgagggattccggtatagatgtcgggacgccatgcgcagcgtgacaaagcaagccatcagggaagctcgattgaaagaaattaaggaggagcttctgcactccgaaaagctcaagacatactttgaggacaaccctagggatcttcagctgctgcggcatgatctacccctacaccccgcagtggtgaagccacatttaggacacgttccagattaccttgtccctcccgcgctgcgggggttagtgagacctcacaaaaaacgcaaaaaactgagcagcagctgcaggaaagccaaaagagccaaatcgcagaaccctctgagatccttcaaacataagggcaaaaaatttcggccgactgccaaaccaagctag

SEQ ID NO: 19032 - DNA, 2391 bp, Artificial Sequence
  Description of Artificial Sequence: Synthetic coding sequence
atggtgctggcccagcggcggcggggcggctgcgagaagctgcgggccggcccccaggctgtgctggcttccggatccggtttctgcgacaacatgctggcagacctcggcctgatcggcacgataggcgaggacgacgaggtgccggtggagcctgaatccgactctggggacgaggaggaagagggccctatcgtgctggggagacgccaaaaagctttaggaaagaatcggtcagctgacttcaatcccgacttcgtgtttaccgagaaagaagggacatacgatggctcatgggctcttgctgacgtcatgagtcagctcaaaaaaaagcgggcggcaactaccctagacgaaaagattgagaaagtgaggaagaaacgtaagactgaggacaaagaggccaaatctgggaaactggagaaagagaaggaggccaaggaggggtctgaacctaaagagcaagaggacttacaggaaaacgacgaggagggtagcgaagatgaggccagcgagacggactatagctccgcagacgagaatattttaacaaaggccgacaccttgaaagtgaaggatagaaaaaaaaagaaaaagaagggccaggaagctgggggattttttgaggacgccagccagtacgatgaaaacttgtcgttccaggatatgaacttatctcgccccttactgaaggccatcactgctatgggcttcaagcaacccactcctatccagaaagcatgtataccggttggcctcctgggcaaggacatctgcgcttgtgctgctaccggaacaggaaaaacagccgcctttgctttgcctgtgctggagagattaatctacaagccaagacaagcccctgtaacacgggttctcgtgctggtccccactcgagagctcggtatccaggtgcatagtgtcacacggcagcttgcgcaattctgtaacatcactacttgcctggccgtgggaggacttgacgtcaaatcacaggaggcggccttaagggcggctccggacattctgattgcaacacctggccgccttattgatcatttacataactgccccagcttccacctgtccagtattgaggtgttaatcctagatgaagctgacaggatgctggatgaatacttcgaagagcaaatgaaagaaataataaggatgtgctctcaccatcggcagacaatgctgttctctgccaccatgaccgacgaggtgaaggacctggccagcgtgagcctgaaaaacccagtccggatcttcgtcaactcaaacaccgatgtcgctccttttctgaggcaggagtttatcagaattaggcctaaccgagaaggcgacagggaggcgatcgttgcagccttattgacacgaacttttactgaccatgtgatgctgttcacccagacaaaaaagcaagctcaccggatgcacattttacttggcctgatgggcctacaggttggcgagttacatgggaacctcagtcaaacccagaggttggaagctcttagaaggttcaaggatgaacagatcgatatccttgtcgctacggatgtggcagccagaggactggacatcgagggagtgaaaactgtgattaacttcacaatgcctaatactatcaaacactatgtgcacagggtcggccggaccgccagggctgggagagccggaagatctgtctcgttggtcggggaggatgagagaaagatgctcaaagagatcgtgaaagcggctaaagcacccgtaaaggcccgtatcctgccccaagacgtgattctgaaattccgggacaaaatcgaaaagatggagaaagatgtgtatgccgtgcttcaactggaggcagaagaaaaagaaatgcagcaatcagaggcccagattaacacggcaaagcgcctcttggaaaaagggaaggaggccgtggtccaggagcctgagcgctcctggtttcagacaaaggaggaacgcaaaaaagagaaaatcgctaaggccctgcaagaatttgatctcgctctgcgtggaaagaagaagaggaagaaattcatgaaagacgcaaagaagaaaggcgagatgacagcagaggaacgaagccagttcgaaatcttaaaggcgcaaatgttcgccgaacggctcgccaagagaaacaggcgggccaagagagcccgcgcaatgcctgaagaggaacctgtgcggggaccagccaagaagcagaagcaggggaagaaaagtgtgttcgacgaagagctgaccaacacctccaaaaaagcgttgaaacagtaccgggccggacccagtttcgaggagcgaaagcaattgggccttccacatcagaggagggggggcaacttcaagagtaagagccggtataagagaaggaaatag

SEQ ID NO: 19033 - DNA, 411 bp, Artificial Sequence
  Description of Artificial Sequence: Synthetic coding sequence
atggtgctggcccagcggcggcggggcggctgcgagaagctgcgggccgggccacaggctgttttggcctctggatccggcttctgcgataacatgctcgccgatctgggcctgatcggcaccatcggagaagatgatgaagttcccgtggagccagaaagcgactctggcgacgaggaggaagaaggccccattgtcttaggtcgacgtcagaaagctctcggtaagaaccgcagcgctgattttaacccagactttgtgttcactgaaaaggaagggacgtatgacggctcctgggccctggctgatgtaatgtctcaattgaagaagaagcgcgccgccaccacactggacgagaagattgagaaggtcagaaagaaaaggaaaaagaagaaaaagaaaaagaagtag

SEQ ID NO: 19034 - DNA, 1758 bp, Artificial Sequence
  Description of Artificial Sequence: Synthetic coding sequence
atggcccccgacctggccagccagcggcacagcgagagcttccccagcgtaaactctcggcctaatgtgattctcccaggtcgagagggccggagggagggtctgccaccaggcggcggaacccgtgggagcctcgtgccaacccgcccagtgcccccttcccccgccccattgggcacaagcccctattcatggtctaggtccggtcctgggcggggcggaggtgcaggatcgagcagggtgccacgcggcgtgcccggacccgcggtgtgcgccccaggttccctattgcatcacgcctccccgacgcagactatggctgccgccgatggttcgttgttcgataacccgcgtaccttctcacggaggcctcctgcccaggccagccggcaggccaaagcaaccaaaagaaagtaccaagctagttcggaagcaccccccgcgaagaggaggaacgaaaccagctttcttcccgccaagaaaaccagcgtcaaggaaacacagaggacctttaagggtaatgctcagaagatgttttctcctaagaagcacagtgtgtcaacctccgaccgaaaccaggaagaacggcaatgtattaagacctctagcctgtttaagaataatccagatattccagaactgcatcggcctgttgttaaacaggtgcaggaaaaagtgttcactagtgccgcctttcacgagctggggctccaccctcatctaatttccacaattaacaccgttcttaagatgtcctcaatgacttctgttcagaagcaaagtattcctgtccttctggagggtagggacgctctggtcagaagccagactggctccggcaagactttagcgtactgcatccctgttgtccaatccctgcaggctatggagtctaaaatccagcggtctgatgggccttacgcattagtgttggtgcccactcgagagctcgcgcttcagagcttcgacaccgtgcaaaaactccttaaacctttcacgtggatcgtccctggcgtattgatgggaggtgaaaagcgtaaatccgaaaaggctaggctgagaaagggcataaacattctgatatctactccagggcggctggtcgatcatattaaatctaccaagaatattcacttctctaggttgcggtggctggtgttcgatgaggctgatcgaattctggatctgggctttgagaaggacattactgtgatcttgaacgccgttaacgctgaatgccagaaacgccagaacgtcctcctgtcagctaccctgacagaaggggtgactaggttagccgacatttcactccatgaccccgtgagcatttccgtgcttgataagagccatgatcagctcaatcctaaggacaaggccgtccaagaagtttgtccccctccagccggcgacaagcttgactcatttgccatccctgagtcattaaaacagcacgtcacagtggtccccagcaaactccgtctggtttgcctggctgcattcatcctccagaaatgtaagtttgaggaggaccagaaaatggtagttttcttctcttcatgtgaattagtggagtttcactattcgctgtttctacaaactcttctgtcttccagcggggctcctgcttccggccagctcccttcagcatctatgcggttgaaattcttacggcttcacggcggaatggaacaagaggagcggacagccgtttttcaggaattctcacactccaggcggggcgtgctgctatgcacttag

SEQ ID NO: 19035 - DNA, 2337 bp, Artificial Sequence
  Description of Artificial Sequence: Synthetic coding sequence
atggcccccgacctggccagccagcggcacagcgagagcttcccctctgtcaacagcaggcctaatgtgattctgccgggtagagaaggaaggagagaagggctgcccccagggggtgggactaggggaagtttggttcccacgagaccagtcccaccaagcccagcccctctgggcacgtccccttactcatggtctcgcagcgggcctggaaggggcggcggcgccggttcaagcagggtgccccgtggcgtgccaggccccgcagtgtgtgcgcctggttccctgctccaccatgcttcccctacccagacgatggctgcagcagacggatcactgttcgataatcctcggacattttctcgtcgtcctcctgcacaggccagtcggcaggcaaaggccaccaagcggaagtaccaagcctcctccgaggccccacccgctaagcggagaaacgagacaagttttctaccagccaaaaagacttcagttaaggaaacgcagaggacctttaaaggtaacgcccagaaaatgttctccccaaaaaaacattctgtgagcacctctgatcggaaccaggaagaaagacagtgtatcaaaacatcatcactttttaagaacaaccccgacatcccggagttgcaccgccccgttgtaaagcaggttcaggaaaaggtattcacgtcggccgcgtttcatgagctgggcctgcacccacatttgatttcaaccattaacacagtcctgaaaatgtcatctatgactagcgtccaaaagcaatcaatcccagttctactggagggacgcgacgcactggtgcggtcacagactggtagtggcaaaactctagcctattgtatccccgtggttcaatccctacaagccatggagtctaaaatccagcgcagcgacggtccttatgcactcgttttggttccaacacgggaactggcactgcaatccttcgatacggtgcaaaaactgctcaaaccatttacttggatagtcccaggtgtactgatggggggtgaaaaacgaaaatcagagaaggcgcgtctgcggaaaggtatcaatatcctaataagcacgcctggccgattggtggaccacattaaatccactaaaaacattcacttcagccgcctgcggtggctggtgtttgacgaggcagatagaatcctggatctgggcttcgagaaggacatcactgtgatccttaatgccgtaaatgcagagtgtcaaaaacgccagaacgtcctgctgagcgcgacattgacggagggggtcacgcgcttggcagacatttcactgcatgaccctgtgtcaatttcagtgctggacaagtcacacgatcaacttaatcctaaggacaaggccgttcaggaagtatgcccgccccctgctggcgacaagctcgatagcttcgcgatccccgagtctctgaagcagcatgtgactgttgttccatccaaactgaggttggtatgcctcgccgcgtttatactgcaaaaatgtaaatttgaggaagatcagaaaatggtggtttttttcagctcttgtgaactcgtcgaatttcactattccctgtttctgcagacgctgctgagctcatccggggcacctgcctcaggccaactcccgtccgcctcaatgcggcttaagttcctccgcctccatggaggtatggagcaggaggagcgcacggccgtatttcaggaattcagccattcccgccgcggtgtgctgctgtgcaccgatgtcgccgcccgcggtctggacctgcctcaagtgacctggatcgtgcaaaatacttccactggcctagaggagcctcccggcctcgccgccatgggcgctgcatgctctttctggttgctgcgccggcagaatatgtcaacgagatggctgttgactaagtcaactctacagtctttcattcaggcgtacgcgacctatccaagagagctcaaacacatatttcacgtccggtctttgcatcttgggcacgttgccaagtctttcggccttagagacgcaccccgtaatctgagtgccctaaccagaaagaagagaaaggcccatgtaaagcggcctgacctgcataagaagacgcaaagcaagcatagcttggccgagatcctcagatctgagtatagcagtggaatggaggcggatattgcgaaagtcaagaaacagaatgcccctggcgagcctgggggcaggccactccagcatagcctgcagccgactccatgctttggacgaggaaaaactctgaaatggcggaaaactcagaaaggtgttcagagagacagcaagacgtcccagaaagtgtag

SEQ ID NO: 19036 - DNA, 2328 bp, Artificial Sequence
  Description of Artificial Sequence: Synthetic coding sequence
atggcccccgacctggccagccagcggcacagcgagagcttcccctctgtaaattctcggccaaacgtgattttgccgggacgagaagggaggcgggagggacttccccctgggggaggcacccgcggctctctcgtgcccacaagacctgtgcctccaagccccgcccctctcgggacaagcccctactcctggagtcggtcgggacctggcagaggaggcggtgcaggttccagccgggtaccgcgcggagttcccggtccagcggtctgtgctccaggctccctgctgcaccacgccagcccaacacagacaatggctgcagcggacggctcgttatttgacaacccaaggacgttttcccggagaccgccagctcaggcatcacgccaggctaaagcaacaaaacggaagtaccaagccagttccgaggcacctcccgcaaagagacgcaacgaaacttccttcctccctgccaagaagacatcagtgaaggagacccagagaacatttaagggaaatgcccagaaaatgttcagccctaaaaaacatagcgtgagcacatcggaccgcaatcaagaagagagacaatgtataaaaacttcatcacttttcaagaacaatcctgacattcccgaattacatcggccggtggtgaagcaggtgcaggagaaggtttttacctccgctgctttccacgagctaggcctgcatcctcacctgatatcgaccattaatactgtcctgaaaatgagcagcatgacctccgtacaaaagcagtctatcccagtgttgctggaaggaagagatgcactcgttcgatctcaaacaggctctggcaaaacgctggcatactgtatcccggtggtgcaatcactccaagctatggaatcaaagatacagcggagtgacggaccgtacgctttagtcctggtgccaactcgggaattggccttgcaatctttcgacacagtgcagaaactgctgaagcccttcacatggattgtgcccggcgtcctgatggggggagaaaagcgtaagtccgagaaagccaggctgagaaaggggatcaatatcctgatcagtacacctggcagactggtggaccacattaaatctaccaagaacattcatttttccagactgcggtggctggtcttcgacgaagccgatagaattctggatctgggattcgaaaaagacataacggtaatcctgaatgcggtgaacgcggaatgccagaaaaggcagaatgtgcttttatccgccactctgacagaaggcgttacacgcctggcagacattagcctgcacgaccccgtatcgatttcagttctggataaatcccacgaccagctgaatcccaaggacaaagccgtgcaggaggtgtgtcccccacctgccggggacaaactggacagttttgcaatacctgagtcactgaaacagcatgtgaccgtggtgccttccaaactgcggctcgtatgcctggccgcctttatattgcagaaatgcaaatttgaggaagatcagaagatggtggtgtttttttcatcctgcgagctggtagaattccactacagcctgttcctgcagactcttctgtcttccagtggagcccccgcctccggccaactccctagtgctagtatgcggctaaagttcttacgcttacatggagggatggaacaggaggagcgcacagccgtgttccaagagttctctcactcaagaaggggggtgttgctctgtacggacgtggctgctcgagggctcgatctcccacaggtaacgtggatagtgcagtacaacgcgccgagctcgcccgcggagtacattcaccggattggcaggaccgctcggataggctgccacggcagtagtttgctcatactggctccatcagaggctgagtatgtaaattccctggcgagccataagattaatgtgagcgagattaaaatggaggacattctgtgtgttctcaccagggacgattgcttcaagggaaagcgctggggcgcccagaagtcgcacgccgtggggcctcaagagatccgggagagagccaccgtgctgcaaaccgtctttgaggactatgtgcattcctcagagagacgtgtgtcatgggctaagaaagtgtggtcactggagactccagtgttgacagcctcgctgcctgcactgttcagcttcagctcagccgttctgcaccccagtttgcgacacctgccacagggtgccgaggctcacctgccgagaccgataccccctccatgggcctgcggtgaagaactccgcacaaaaaggtgtccacaggaaagctag

SEQ ID NO: 19037 - DNA, 2556 bp, Artificial Sequence
  Description of Artificial Sequence: Synthetic coding sequence
atggcccccgacctggccagccagcggcacagcgagagcttcccctctgtgaacagccgtccaaacgtgatattaccagggcgagagggtaggagggaaggcttacctcctggcggcggaaccagaggttctctagttcctactcgccccgtccctccgtccccagctcctctgggtacttctccatacagttggtcacgatccggacccggtaggggaggcggcgcaggatcctcacgggtgcctagaggggtacccggaccagcagtgtgtgcccctggttctctattgcatcatgcgtctcccacccagaccatggctgccgctgatggctctctctttgacaatccacgaacgttttcccgccggccaccagctcaggcctcaaggcaggcgaaggccactaagcggaaatatcaggccagctccgaggccccccctgctaagagacgaaacgaaactagcttcctgccagctaagaagacgtctgtcaaggagacacagcggacttttaaaggaaatgcccaaaaaatgttcagcccaaaaaaacattccgtgtcgacttccgaccgtaaccaagaggagcgtcaatgtatcaaaacttcttccctgtttaaaaacaatcccgacattcctgaactacacagacctgtggtcaaacaggtgcaagaaaaggtatttacttcggccgcctttcacgaactgggccttcatccacacctcatttcaacaataaataccgttcttaaaatgtcatccatgactagcgtgcagaaacaatccatccctgtgctcctcgagggaagagacgccctggtgaggtcccagactggaagcggtaaaacactagcatactgcattccagttgtgcagtccctgcaagccatggaatccaagatacagcgaagcgacgggccgtatgcccttgtgctggtaccgaccagggagctggcccttcagtctttcgatactgtgcagaagctgttgaaacctttcacctggatcgtgcccggagtactcatgggaggagagaaacgaaaaagcgagaaggcaaggctgcgaaagggaatcaacattctgatcagcacaccgggccggttagtggaccacatcaaaagtacaaagaacatacacttcagcaggttgcgctggctcgtatttgatgaagcagataggatcctggatctcgggttcgagaaagacataacagtgatactcaacgcagtgaatgcagagtgccaaaaacggcagaatgtgctcctctctgccaccctcacagagggagttaccagattggcagacattagcctgcacgaccccgtctccattagcgttctggataaatctcacgatcagttgaatccgaaagacaaagccgttcaggaagtttgccccccacccgccggagacaagttagactcatttgccatacctgagagccttaaacagcacgtgaccgtagtcccttctaaactgcgcctggtttgcctggcagcctttatattgcagaaatgcaagtttgaggaggaccagaagatggtggtgttcttttcctcctgcgagctcgttgagttccattactcactatttcttcagactctgctgagctcctctggcgccccagcctcaggtcagctcccttccgccagcatgaggttgaaattcttgagattacacggcgggatggaacaggaagaacggactgcagtgttccaggaattttcccacagccgacggggagtcctgctgtgtaccgacgtcgctgcccggggactggacctaccacaggtgacgtggattgtgcagtacaatgcccccagctcccctgccgaatacatccacaggataggccgcactgcccgtatcgggtgccatggcagctccctgctgatcctggcaccctccgaagctgagtatgtgaactctctagcatctcataagattaatgtaagcgaaatcaagatggaggacattctgtgtgtactgacaagagacgattgtttcaaaggaaaaagatggggcgctcagaaatcccatgccgtgggtcctcaggagattcgggagagggccaccgtactccagacagtctttgaagattacgtgcatagctctgagaggcgcgtaagctgggccaagaaagccctccagtcattcatccaagcttacgccacctatcctagggagctcaagcacatcttccacgtcaggtctctgcaccttggacatgttgccaagagcttcggtcttcgggacgctcctagaaatttatccgctctgacccgcaaaaagagaaaggcacatgttaaacggcctgacctccacaagaagacacaatcgaagcactccctcgccgagatcctgcgttctgagtactcgtcaggaatggaagctgacattgcaaaggtaaaaaaacagaatgctccgggcgagccaggaggcagacctctgcagcattcactgcagcctaccccttgtttcggcaggggaaagacgttgaaatggagaaagacccagaaaggcgtgcagcgcgacagcaagacgagtcagaaagtttag

SEQ ID NO: 19038 - DNA, 2169 bp, Artificial Sequence
  Description of Artificial Sequence: Synthetic coding sequence
atgcaggccaaggccaccaagcggaagtaccaggccagcagcgaggcccctccagccaagaggcggaatgaaaccagtttcctgcctgcaaagaagacatcagtgaaagagactcagcgcacattcaaaggaaatgcccaaaagatgttttcacctaaaaaacattctgtgagtacctctgaccggaaccaggaggagcgacagtgcatcaaaacctcgagcctctttaagaataaccccgatatacctgagctgcaccgtcctgtggttaaacaggtccaggagaaagtctttacgtctgctgctttccacgagttaggcctacacccccatctgatctcgaccattaacaccgtactgaaaatgagtagcatgacatccgtgcaaaaacagtctattccggtgttactggagggcagggatgctcttgtgagatctcaaaccgggtctggcaagacactcgcatattgcattccggtggtccagagcttacaggccatggaatctaaaatccagaggtccgatggtccttatgcactggtgcttgtccctacccgggagcttgccctgcagtcgtttgacacagtgcagaaactcttaaagcccttcacctggattgtgccgggggtactgatgggaggcgaaaagcgtaaatccgaaaaggctcggcttcggaagggcataaacattctgatctccacacctggtcggttggtggaccacatcaaatcaactaagaatattcacttctcccgcttgcggtggctggtttttgatgaggccgacagaatcctggatctcggttttgagaaggatatcacagtgatcctcaacgctgtcaatgcagagtgtcagaaacgtcagaacgtgttgctgtccgcaacactgactgaaggagtgacgcggctggccgacatctctctgcacgaccctgtctctataagcgtgctggacaagtcacacgaccaactgaaccccaaagacaaagccgtccaagaagtctgcccgccacctgcgggggacaagctcgatagcttcgccatcccagagtccctgaagcagcacgtgaccgtggttccatctaagcttcgactcgtgtgcttggccgcctttattctgcaaaaatgtaaattcgaagaggatcagaagatggtggtgtttttctcctcttgcgagctggtggagtttcactactccctattcttgcagactctcctatcctcatcaggggcacctgcaagtggccagctcccgagcgcctctatgaggttaaaattcttacggttgcatggtggcatggaacaggaggaaaggacagctgtttttcaggaattttcccacagccgccgtggggtgctgttgtgcaccgatgtcgccgcaaggggtcttgacctgcctcaggtgacatggatagtccaatataacgccccctcgagtccagcagaatacatccatcgcatcggtagaactgctagaattggctgccatggatcttcactcctgatcctggccccaagcgaagcagaatacgtgaatagtcttgctagtcacaaaataaacgtttccgagattaagatggaggatatcctgtgtgtactgacccgggacgattgctttaaggggaaacggtggggggcccagaagagccacgcagtaggtccccaggagataagagagagagcgacagtcttgcagaccgtcttcgaggattacgtgcacagctccgagcggcgcgtgagttgggccaaaaaagctctccagagctttatccaggcttatgctacttacccaagggaactgaagcatatttttcatgtgaggtccctgcacctggggcatgttgccaagagcttcggtctacgcgacgctccccggaacctgagtgctctcactcgaaaaaagcgcaaagcccatgtaaagcggcctgatctgcacaagaagacacaatccaagcacagcctcgccgaaatattaagatcagaatacagttctgggatggaagcggatattgcgaaagtcaagaagcagaatgcaccgggagagcctggaggaagacccctccagcacagcctgcagcctacaccttgcttcggccgcggaaaaaccctgaagtggagaaagacccaaaaaggggttcagcgggatagtaagacctcccagaaggtctag

SEQ ID NO: 19039 - DNA, 483 bp, Artificial Sequence
  Description of Artificial Sequence: Synthetic coding sequence
atgcggctggaggccggcagcggcgccgtgtggcggggcggcgagctggcacccgctcctagaaaagtaaaggaggggatccggggatgcttcccttggaaacaggcgaaggctacaaagagaaagtatcaagcctctagcgaagccccacctgccaaacgccggaacgagacgtcatttcttcccgctaagaaaacctctgtcaaggagacgcagagaacattcaaaggtaacgcccaaaagatgttcagcccgaagaaacattcagtgagtacttctgatcgaaaccaggaagagcgtcagtgtataaaaacctcgtccctgtttaaaaataatcctgacattccagaactccaccgccctgtagttaaacaggtacaggagaaggtcttcacgtcggccgcattccatgagctcgggctgcatccccatctcatcagcacaatcaacacggtgcttaaaatgtcctccatgacccgctag

SEQ ID NO: 19040 - DNA, 1284 bp, Artificial Sequence
  Description of Artificial Sequence: Synthetic coding sequence
atggccgagcaggacgtggagaacgacctgctggactacgacgaggaagaagagccgcaggccccgcaggaaagcacgcccgcacccccgaagaaggatatcaaggggtcctacgtctctatccactcatcgggttttagggacttcctccttaaaccggagctgctccgcgccatcgtcgactgtggctttgagcacccttccgaggtgcaacatgagtgcattccgcaggcaatattgggcatggatgtgctgtgccaggccaagtcagggatgggcaaaaccgctgtctttgtcctagcaactttgcagcagattgagccggtgaatggacaggtgaccgtcctggtgatgtgtcacacccgagaactggcattccagatctcgaaggagtatgagcgcttctcaaagtatatgcccagtgtgaaagtctccgtgttttttgggggcctgtccatcaaaaaggacgaagaagtgttgaaaaagaattgcccgcacgtcgtagtgggtaccccgggccgaatactggccctcgtgagaaatcggagcttcagcctgaagaacgtcaagcatttcgtgctggatgagtgtgataagatgctggagcagcttgatatgcgtcgggacgtgcaggaaatttttagattaacgcctcatgaaaaacaatgcatgatgttctccgctaccctgagtaaggacattcgacccgtgtgtcggaaatttatgcaggaccccatggaggtcttcgtggacgacgaaaccaagttgacgctgcacgggttgcagcaatactatgtcaagctcaaggatagcgaaaaaaatcgtaagctcttcgacctactagatgtgcttgagttcaaccaggtcatcatctttgtcaaatctgtgcagcgttgtatggccctggcacagcttcttgtggagcagaacttccctgctatagccattcacagagggatggcacaagaggagcgactgagcaggtaccagcagttcaaggatttccagaggcgaatcctggtggcaaccaatctctttgggcgtggcatggatatcgagagggtcaatattgtatttaactatgacatgcccgaagattctgacacttacttacatcgggtagcccgagcaggcaggtttgggactaaaggactcgccatcaccttcgtgtctgacgagaacgacgcaaagatcctcaatgacgtccaggaccggttcgaggtgaacgtggccgagctcccggaagagatcgacatttctacgtatatagaacagtctagatag

SEQ ID NO: 19041 - DNA, 969 bp, Artificial Sequence
  Description of Artificial Sequence: Synthetic coding sequence
atggccgagcaggacgtggagaacgacctgctggactacgacgaggaggaggaacctcaggcacctcaagaaagtacccccgcccctcccaagaaggacatcaagggatcatatgtgtcaatccactcttctggatttagagatttccttctgaagcctgagctgctgcgggccatcgtagactgtggctttgagcaccccagtgaggtgcaacatgaatgtataccccaggccatcttgggaatggatgtgctgtgccaggctaagtctgggatgggcaaaaccgccgttttcgtgttggcgactctccaacagatcgagcctgtcaacggccaggtaaccgtcttagtgatgtgtcacactcgggagctggctttccaaataagtaaagaatatgagcgcttttccaagtacatgcccagcgtgaaggtgtctgtgttcttcggagggctatccattaagaaagatgaggaagtcctgaagaagaattgtcctcacgtggtggtcggcacccctggcaggatactggctcttgttagaaaccggtcatttagtctgaaaaatgtaaagcactttgtgctggacgagtgtgacaagatgctcgagcagcttgatatgcgccgagacgtccaggagattttcagattaactcctcacgaaaaacagtgtatgatgtttagcgccacgctcagcaaggatattaggccagtctgtaggaagttcatgcaggatccgatggaggtcttcgtcgacgacgaaaccaagctgacgctgcacgggctacagcagtactatgtcaagttaaaagatagtgaaaagaatagaaaactgttcgatttgcttgatgtcttagaatttaatcaacctgttactctgtctgcagttcagggttttccggccgccgaccccgggggacaccagagcgtgtggcctggcgacgggcaccgggcaagccaacaccgcctgtag

SEQ ID NO: 19042 - DNA, 1413 bp, Artificial Sequence
  Description of Artificial Sequence: Synthetic coding sequence
atggcctacggcgcccccagccccacctggagcctgagcgtgcggccaaaccgccctaggggaggtctgggaccttttggggaggtccaggtaatcttgttgcccccctcgagttgggactacagcataatggccgagcaagatgtggagaacgacctgctggactacgacgaggaggaggaaccccaggctccgcaagagtcaacccctgccccccccaaaaaagacatcaaaggctcttacgtgtctatacattcctccggattcagggactttctgctgaaaccagaactgctgagggcgattgtcgactgcggattcgaacatcccagcgaagtgcagcatgagtgtattccgcaggcgattctgggcatggacgtgctgtgtcaggccaaatccggaatgggcaaaaccgctgtgtttgtgctggccaccctccagcagattgagcctgtaaatggccaggttactgtcctcgttatgtgccacacccgggagctggcatttcagattagcaaggagtatgagcgcttcagtaagtatatgccatcagtaaaggtgtccgtgtttttcggcggcctgagtatcaaaaaggacgaggaagtactcaagaaaaattgtccccatgtggtggtggggactcctgggcgcatactggcgctggttagaaaccgttctttcagccttaaaaacgtgaaacactttgtgctggatgagtgcgacaagatgcttgaacagctggatatgcgccgcgatgtgcaggagatattccgactcacgcctcacgaaaagcagtgtatgatgtttagcgcaacactctctaaggacatccgccccgtgtgtagaaagttcatgcaggaccctatggaggtgttcgtggacgatgaaacaaagttgacattgcacggcctacaacaatactatgtgaaattgaaagacagtgagaagaacagaaaactgtttgatttgttagacgtgctggagtttaatcaggtgattatcttcgtcaaatccgttcagcggtgtatggctcttgcacaactgctagtggagcaaaacttccccgccatagccatacaccgcggcatggcacaagaggagcggctgtcacgctatcaacagttcaaagactttcagaggcggattctagtcgccacaaatcttttcggacggggcatggatattgagcgtgtgaacatcgtgttcaactacgatatgcccgaggattcggacacatacctgcaccgggttgccagggctgggcggtttgggactaagggcctggcaatcacatttgttagcgacgagaatgacgccaaaatcttgaatgacgtacaggaccggttcgaagtgaacgtggctgagctgcccgaggaaatcgacattagcacatacattgagcagtcccgctag

SEQ ID NO: 19043 - DNA, 804 bp, Artificial Sequence
  Description of Artificial Sequence: Synthetic coding sequence
atggccgagcaggacgtggagaacgacctgctggactacgacgaggaggaggaaccacaagctccgcaggagagcacccctgcccctccgaagaaggacatcaaaggctcttatgtgtctatccactcatcaggattccgtgacttcttattgaagcccgagcttctccgcgcgatcgtagactgtggttttgagcacccctcggaagttcagcacgagtgcataccccaggcaatactggggatggatgtactgtgtcaggctaaatccgggatggggaagacagctgtatttgttctagcgacactccagcagattgaaccagtgaatggccaggtcacagttcttgtcatgtgccacacgcgagaactcgcattccagatttccaaggaatacgaaaggttctccaagtacatgccttccgttaaggtgtccgttttttttggcggcttgtcaataaaaaaggacgaggaagtactcaagaagaattgccctcacgtcgtggtgggaacacctggtaggatcttggctctggtcagaaaccggtccttcagccttaaaaacgtcaaacattttgtcctcgatgagtgcgacaagatgttggagcagttagacatgagaagggatgtccaggaaatcttcagactgacaccacatgaaaagcagtgtatgatgtttagtgccactttaagcaaggatattagaccagtgtgcagaaaattcatgcaggatgtactgtgggaggtctctcacaagggagtcgcacactggaaagtcctcgggcgacgcgacgcgcagcgctag

SEQ ID NO: 19044 - DNA, 3096 bp, Artificial Sequence
  Description of Artificial Sequence: Synthetic coding sequence
atgggccgggagagccggcactaccggaagcggagcgccagccggggaaggtcagggtcccgatctaggtcccgcagcccatcagacaaacgcagcaagcgtggcgatgatcgacggtcccggtctcgcgatagggaccgcaggagggagcgatctagatcccgggacaaacggaggtctcgttccagagatcgtaaaagattgagacggtcgaggtccagggaacgggataggagtagagagcgacggcggtctaggagccgagaccggagaagatctcggagtcggtcaaggggacgccggtcccggagctcctcccctggtaacaaatctaagaaaacagagaaccggagcaggtcaaaagaaaaaacagatggcggggaaagctctaaagagaaaaagaaggataaggacgacaaggaagatgagaaagagaaggacgccggaaacttcgaccagaacaagctggaagaagaaatgcgtaaacgtaaggaaagagtcgagaagtggcgagaggaacagagaaaaaaggccatggaaaatattggcgaactgaagaaagaaatcgaagaaatgaagcagggaaaaaaatggtccctcgaagatgacgacgatgatgaggacgaccctgcagaggccgagaaggagggcaacgagatggaaggggaggagttggatcccctggatgcctatatggaggaggttaaagaagaggttaaaaaatttaatatgaggtcagtcaaaggcgggggtgggaatgaaaaaaaatcaggaccaaccgtcaccaaagtagtcaccgtggtaacaactaagaaagccgtggtggacagcgacaagaaaaagggagagctcatggaaaacgaccaggatgcaatggaatactccagcgaggaggaagaagtcgatctgcagactgctctgacaggataccagaccaagcagcggaaactgctggagccagtcgatcacggcaaaattgagtatgaaccctttagaaagaatttctatgttgaggtgcccgagctcgcaaaaatgagtcaagaggaagtgaatgtgttccgactggaaatggagggaattactgtgaagggcaaggggtgtcctaagcctatcaaaagctgggtgcagtgtggcatctccatgaagatcctcaattcgctgaagaaacacggatatgaaaagccaacgcccatccagacgcaggccatacctgctatcatgagcggcagggaccttatcggaatcgccaagaccggatcagggaaaaccatagccttcctcctgccaatgtttagacacatcatggaccagcgctcgctagaagaaggagaaggaccaatagcagtgataatgaccccaactagagagctggccctgcagattacgaaagaatgcaaaaagttctctaagaccttaggccttcgggtcgtgtgcgtgtacgggggtacagggatctccgagcagatcgctgagctgaaacggggagccgaaattattgtgtgcaccccaggcagaatgatagatatgctggcggctaactctggccgcgtcacaaatctgagaagggtgacctatgtggtgcttgacgaggctgatcggatgttcgacatgggtttcgagccacaagttatgcgcattgtcgacaatgtcaggcccgacagacagactgtgatgtttagtgcgaccttccccagggcaatggaagcccttgcacgccgcatcctctccaaaccaattgaggtgcaagtcggggggcggagtgtagtctgcagcgacgtggagcaacaagtaatcgtcatagaggaggaaaagaaatttctcaaactgcttgagctcctggggcactaccaggagagcggcagcgtgatcatcttcgtggacaaacaggaacacgccgacggactccttaaagaccttatgcgcgcatcatatccttgcatgtcactccacggtgggatagaccagtatgatagggattccattattaacgacttcaaaaacggcacttgtaaactccttgtagccaccagcgtcgccgctagaggtctggacgttaagcatctgattctggttgtcaactactcctgtcctaaccactacgaggactacgtgcacagggccggacgaactggtcgcgctggaaacaaggggtacgcatatacatttatcacagaagaccaggctcgttatgctggggatatcatcaaggctttggaacttagcggaaccgcagttccaccagacctagaaaagctgtggtccgatttcaaggaccagcagaaggccgaagggaaaataatcaaaaagagctccggatttagcggtaagggattcaaattcgacgagacggagcaggctcttgctaatgagaggaaaaagcttcaaaaagcggcgctcggactgcaagactctgacgatgaggatgccgccgtggatattgacgaacagatcgagtctatgttcaatagtaagaagcgcgttaaggacatggccgccccgggaaccagtagtgtacccgcccctactgccggcaacgctgaaaagctcgagatcgccaagcggctggccctgcggatcaacgcccaaaagaatctgggaattgagtcacaggatgtcatgcagcaagcgaccaacgcaattcttaggggcgggacgattttggcccccactgtctcggcgaaaacaattgccgagcagctcgccgagaagataaacgccaagcttaactatgtacccctagagaaacaggaggaggagagacaggatggcggccagaatgagagcttcaaacggtatgaggaggagttggagatcaatgactttcctcagaccgcccggtggaaagttacttctaaggaggcactccagcgcatcagtgagtatagcgaggccgctatcaccatcaggggcacatattttccacctgggaaagagcccaaggaaggggagcggaaaatatatctggccattgagtctgctaatgaactggcagtgcagaaggcaaaggcagaaatcacacgcctcatcaaagaggaacttattaggttacagaactcttaccagccaacaaacaaggggagatataaggtgctgtag

SEQ ID NO: 19045 - DNA, 3099 bp, Artificial Sequence
  Description of Artificial Sequence: Synthetic coding sequence
atgggccgggagagccggcactaccggaagcggagcgccagccgggggaggagtggctctcgctctcgcagccgttcccctagtgataagcgcagtaaaaggggcgatgacagacgcagtcgaagccgcgatcgtgataggaggagagaaagaagtagatcacgggacaagaggcgatctaggtctcgagacaggaagcgattgaggaggagcaggagtagagagcgcgaccggagcagagagcgaagaagatctcgttctagagaccgtcgacggagcagatctcggtcccggggaaggagatcccgcagtagtagtcctggaaacaagtctaagaaaaccgaaaaccgctcccgatctaaagagaaaaccgatggaggcgaatcatccaaggaaaaaaagaaggataaagacgacaaggaggacgagaaagagaaagacgcggggaattttgaccaaaataagctcgaagaggagatgcgaaaacggaaagagagggtcgaaaaatggagagaggaacagcgtaagaaggcgatggagaatattggcgagctgaaaaaggaaatcgaagagatgaagcagggcaagaagtggagtctggaagacgacgacgacgatgaggatgatccagcagaggctgagaaagaggggaacgagatggagggagaggagttggaccccctggatgcctatatggaggaagtgaaggaagaagtaaagaaatttaacatgaggtctgtgaagggcggtggcggtaatgaaaaaaagtcgggcccaaccgtgactaaagtggtcacagtggtgacgactaaaaaagcggtcgttgatagtgataagaaaaaaggggaactcatggaaaacgatcaagacgctatggaatatagcagcgaggaagaagaggttgacctgcagaccgctctgacaggctatcagaccaaacagaggaaacttctcgagcccgtggatcatggaaagatcgagtatgagcctttccgtaaaaatttttacgtggaagtccccgagctcgctaagatgtcgcaggaggaggttaatgttttccgtttggaaatggaaggaattactgttaaggggaaaggctgccctaagcctatcaaatcctgggttcagtgtggcattagcatgaagattctgaacagcctgaagaagcacggctatgagaaacccacgccgatccagacccaggccatccctgccatcatgtcaggacgcgatttgattgggatcgccaagaccggttccggcaagaccatcgcgtttttgctaccaatgtttagacatattatggatcagagatcccttgaagaaggcgaaggaccgatagccgtgatcatgacccccacacgtgagctggcgctgcagattactaaagagtgcaaaaagttttctaaaactctcggcctgagagttgtgtgcgtgtatggcggtaccggcataagcgagcagatcgcagagcttaagagaggtgccgagatcattgtgtgcacgcccggcagaatgatcgatatgctcgccgccaacagcggtcgcgtcaccaacctgagaagagtaacgtacgtagtcctcgatgaggctgatcggatgttcgacatgggttttgagccacaggtgatgagaatcgtcgacaatgtccgcccagatcggcagacagtcatgttctccgctacttttccgagggccatggaggcactggctcggcgtattctctccaaacccatcgaggtacaggttggcggcagaagcgtggtgtgttcagatgtggagcagcaagtaattgtgatcgaggaggagaagaagtttttgaaactcttggagttgctgggacattaccaggagagcggctcagtgattatctttgtggataagcaggaacacgccgatggactacttaaagacctaatgagggcttcatacccctgcatgtcactgcatggaggaatcgatcagtatgatagagactccattatcaatgatttcaaaaatggaacctgcaaactgttggtcgccacttccgtggcagctcgggggctggacgtgaagcacctgatccttgtagtcaattatagctgcccaaatcactatgaggactatgtccatagagctggacgaactgggagagctggaaacaaagggtacgcatacacatttatcaccgaggatcaggccagatacgcaggcgacattataaaggcccttgagctgtccggtaccgctgtacccccagatctggagaagctttggtccgactttaaagatcagcaaaaggctgagggaaagatcattaagaaaagctcgggtttttctgggaagggctttaagtttgatgagaccgagcaagccttggcgaacgaaagaaagaaactccagaaggccgccctggggctgcaagattcagatgacgaagatgcagccgtcgacatcgacgagcaaatcgagtcaatgtttaactcgaaaaagcgtgtgaaagatatggctgcaccaggtactagctccgtccccgccccgaccgcaggtaacgccgagaagctggaaatcgccaagcggctcgcccttcgcatcaacgcccaaaagaacctggggattgaatctcaggtggacgtcatgcaacaagctaccaacgcaattctccgaggaggcaccattcttgcaccaacggtcagcgccaaaaccatcgcagagcagcttgctgagaaaattaatgcaaaactgaactacgtccccctggaaaaacaagaggaggagcgccaggacggggggcagaatgaatcattcaagcggtatgaggaggagcttgaaatcaatgactttcctcagactgcccgatggaaggtcacatccaaggaggccctgcagcgcatttcagagtattctgaagcagccattaccatacgggggacttatttccctcccggaaaagaacctaaggagggggagagaaaaatctacttggcaattgagtcagcgaacgaactcgccgtgcagaaagccaaagctgaaatcacgcgtcttatcaaggaggagcttatccgactgcagaacagttatcagcccacaaacaaaggaaggtataaggtgttatag

SEQ ID NO: 19046 - DNA, 780 bp, Artificial Sequence
  Description of Artificial Sequence: Synthetic coding sequence
atgggccgggagagccggcactaccggaagcggagcgccagccggggtcggagcggcagccggtctagatccaggagccctagcgataaaagaagtaaacgtggggatgacaggcgatccagaagcagggaccgcgatcgtcgcagggaaagatcaagatcccgagacaaaaggaggtcaaggtctagggacaggaagcgtctccgacggagtaggtcacgcgagcgggatcgctccagggagcggaggcggagtcgatcccgcgacagaaggagatcccgatcacggtcaagaggacgtaggagccgatcatcttctcccgggaacaaaagcaagaagacggagaaccgatcacggagcaaggaaaagacagacggcggcgagtcttccaaggagaaaaaaaaagacaaggacgataaggaagacgagaaggagaaggatgcaggcaacttcgaccagaataaactggaggaggaaatgcgaaagcgtaaggagcgcgtcgagaaatggagggaggaacagcggaagaaggcgatggagaatatcggagagcttaagaaagagatcgaagaaatgaagcagggcaaaaagtggtcactggaagatgacgacgacgacgaagatgacccggccgaagctgaaaaggaaggcaacgagatggagggagaagagctcgatccattagacgcctacatggaggaagtgaaggaagaagtgaaaaaattcaacatgcgcagcgtgaaggccgtttccaaaaaaaaaaagaagaagaagaagtag

SEQ ID NO: 19047 - DNA, 1221 bp, Artificial Sequence
  Description of Artificial Sequence: Synthetic coding sequence
atggccgcccccgaggagcacgacagccccaccgaggccagccagccaattgttgaagaggaggagaccaagactttcaaggacctcggcgtaaccgatgtgctgtgtgaggcctgtgatcagcttggctggactaagccgaccaagatccagatcgaggcaatcccactcgcactgcaggggcgcgacatcatcggactggcagagaccggatccggcaagaccggggctttcgccctgcctatcctgaacgccctcctcgagaccccacaaaggctgttcgccctcgtcctcacccccacccgagaactcgctttccagataagcgaacagttcgaggcgctagggtcatcaatcggtgtgcagtcagctgtcatagtggggggcatcgactctatgtctcagagcctggccttggccaagaaaccccatattataattgcaacccccggaagactgatcgatcacctggagaacacgaaaggatttaatttacgggcactcaagtacttggtcatggatgaggctgatcggatcttaaatatggacttcgaaaccgaagtggataagatcctgaaggtgatccctcgcgaccggaaaacatttctatttagtgcgactatgaccaagaaagttcagaaactccagcgggctgcacttaaaaacccagtcaaatgcgctgtgtcaagcaagtaccagacagtggaaaagttgcagcaatattacatatttattccaagtaagttcaaatccaagcgcctgggcagtctcaataagttcaaagccaaggctcgatccatcctgctggcaaccgacgttgcatcaagggggctggatatcccacatgtggacgtcgtggtaaacttcgacattccaacccacagcaaggactacatccacagggttggccgcaccgccagagctgggcggagcggcaaggcaattacgtttgtgacgcagtatgacgttgaactgttccagaggatagagcacctgattggcaaaaagttgcccggcttccctacccaggatgacgaagtcatgatgttgacggagcgggtagcagaggcccagaggtttgctaggatggagctgcgggagcatggagaaaagaagaaacgctctagagaagatgcgggtgataacgatgataccgagggggcaattggggtacgcaacaaggtggcagggggaaaaatgaaaaaacggaaaggaagatag

SEQ ID NO: 19048 - DNA, 1368 bp, Artificial Sequence
  Description of Artificial Sequence: Synthetic coding sequence
atggccgcccccgaggagcacgacagccccaccgaggccagccagcccatcgtcgaggaggaagaaaccaagacttttaaagacctgggggtgaccgacgtgctctgcgaagcttgcgatcagctcggatggacaaagcccaccaagatacagatcgaagctattccactggctctccagggcagagatatcattgggctggccgagactggctcagggaagaccggggctttcgcattgccgatcctcaatgcactcctcgagacaccgcaacgcctgttcgcactagtccttactcccacacgggagttggctttccagatctctgagcagtttgaagcccttggatcaagcattggggtgcagagcgcggttatcgttgggggcatcgacagcatgtcccagtcactcgccttagcaaaaaaacctcatataattatagcaacccctgggcggctgattgatcatctggagaacaccaaggggttcaatctgagggccctcaaatacctggtgatggacgaggctgaccgcatcttgaatatggattttgaaactgaggtggataaaatcctgaaggtgattccccgagaccgtaagaccttcctgttctccgcaacgatgacaaaaaaagtccagaagcttcagagagcagccttgaagaatccagtgaagtgcgccgtgagtagtaagtatcagaccgtggagaagctacaacagtattatatctttatccctagcaagttcaaagacacctatctggtttacatcctgaacgaactcgccggcaacagcttcatgatcttctgcagtacttgcaataacacccaaaggacggcactgctgctgaggaaccttggatttaccgccattcctctgcacggtcagatgtcacagagcaaacggcttggttcgcttaataaattcaaagcaaaagcaaggagtatcctgcttgcaaccgatgtagcgtcccggggacttgacataccacacgtggacgtagtggtgaattttgacattccgacccattcaaaagattacattcaccgggtcgggagaacagccagggctggtcgctctggaaaagccatcaccttcgtgacgcaatatgacgtggagctttttcaaaggatagagcatctgattgggaagaaactcccaggcttccctacgcaggacgatgaggtgatgatgctgacagagcgggtagccgaggcacagaggtttgctagaatggagctgagggagcacggtgaaaaaaaaaagcgctcacgcgaagacgccggggataatgacgatacggagggagcaatcggagtgagaaacaaggttgcaggaggcaagatgaaaaagaggaagggaagatag

SEQ ID NO: 19049 - DNA, 2214 bp, Artificial Sequence
  Description of Artificial Sequence: Synthetic coding sequence
atgcccggcaagctgctgtggggcgacatcatggagctggaggccccactggaggagtcagagagccagaaaaaggagcggcaaaaaagcgataggaggaagagcagacaccattacgactccgatgagaagagtgagacaagagagaacggagtgacagacgatctggatgcccccaaagcaaagaaatcaaagatgaaagagaagctgaacggggatacagaagaagggtttaataggctgagcgacgagttctctaagtcccacaagtctaggcgcaaggatctaccaaatggagacattgacgagtacgaaaaaaagtcaaagagagttagctccctggatacctcaacccacaaatcatccgacaataagctggaagagaccctaactcgtgaacagaaagagggcgctttctccaatttccctataagcgaggaaaccattaaactcctgaagggtagaggagtgacctatcttttcccaatacaggttaagacctttggccctgtgtacgaaggaaaggatctgattgcacaggctagaaccggcacaggcaagacttttagcttcgccattccgctgatcgagagattgcagagaaatcaggagacaataaagaaaagcaggtcccctaaggtgttggtgctcgcccctactagagaacttgctaaccaggtcgcaaaggacttcaaggacatcactaggaaactgagcgtggcttgcttctacgggggcacatcctatcaaagccagatcaatcacataaggaacgggatagacatcctcgtgggcaccccaggacggataaaggaccacctgcagtctggaagactggacctttccaaacttaggcatgtcgtactagacgaggtggaccagatgttggacctcggcttcgcggagcaggtggaggatatcatccacgagtcttataaaactgattcagaagacaacccacagacccttcttttttcagcgacctgcccacagtgggtgtataaagtggcgaagaagtacatgaagagcaggtacgaacaggtggacctggtgggaaaaatgactcagaaggctgcaactacggtggagcacctcgctatacagtgccactggtcccaaaggccggccgtgattggtgatgtgctacaggtgtatagcgggtcggaaggccgagctatcattttctgcgagactaagaaaaacgtgaccgagatggctatgaaccctcatatcaaacagaacgctcagtgcttgcacggtgacatagctcagtcacagcgggagatcactttgaaaggatttcgcgaggggtctttcaaggtattggtggcgactaatgtggctgctcgtgggcttgatatcccagaagtggatttggttatacagtcttctccgccccaggatgtcgaatcctacatccacaggagtggcaggacagggagggctggaaggacaggaatctgcatttgtttttaccagcccagggaaagaggacagctccggtatgtggaacagaaagctggcattacatttaaacgggtcggcgtaccttcaaccatggatctagtgaagtccaaaagtatggacgctatccgtagtctcgcttccgtcagctatgccgcagtggacttctttagacccagcgcacagaggttaatcgaggagaagggagcagtggatgccttggccgccgcgcttgctcacatttcgggggccagctcattcgagccgaggagtctcattacctccgacaaaggtttcgtcaccatgactctggagagcttagaggaaatccaggacgtctcgtgcgcctggaaagaactgaacaggaaactctcgtccaatgccgtgagtcagatcacgagaatgtgtctgctcaagggaaacatgggagtttgctttgatgtgcctacaaccgagtcagagcgattacaagccgagtggcatgacagtgattggattttatcagttcccgctaagttgcccgagatcgaggaatattatgacggaaacacaagctcaaattcacggcagcggagcggttggtcctctggacgatcgggcaggtctggaaggtctggcggccggagcggcggcaggagcggacggcaatctagacagggatcccggagcgggtcacggcaggatggccggaggaggagtggcaatcggaatcgaagcagaagcggcgggcacaagcggtctttcgattag

SEQ ID NO: 19050 - DNA, 2136 bp, Artificial Sequence
  Description of Artificial Sequence: Synthetic coding sequence
atgcccggcaagctgctgtggggcgacatcatggagctggaggcccctctggaagaatcagaatcacagaagaaagagaggcagaaatcagataggaggaagtccagacaccattacgatagtgacgagaagtcagagacacgagaaaatggcgtcacggatgatttagacgccccgaaggccaagaagagcaagatgaaggaaaagcttaatggcgacaccgaagaggggtttaataggctttccgatgagtttagtaagtcccacaaatctcgccgcaaagatctccctaatggtgatatcgacgagtacgaaaagaagtcaaaacgagtaagttcgctagatacttctacacacaaatcgagcgacaacaaactggaagaaacactgacgcgagagcaaaaagagggcgcattcagcaactttccgatctcagaggaaacaatcaaactgctcaagggaaggggcgtaacatacctcttccctatccaagtcaagactttcggacctgtgtatgagggcaaagatttgattgcgcaagccaggacgggtactggaaaaaccttctcctttgcgattccactcatcgagagactgcaaagaaaccaagaaacaatcaagaagagcagatctcccaaagtcctggtgctggcccccacaagggaactcgccaaccaagtcgcaaaagattttaaagatattacccgcaaattgtctgtggcttgcttttacggcggcacatcatatcagagccagatcaatcacatccggaatgggattgatatcctggtggggaccccggggagaatcaaggatcatctccagtcaggccggctcgacttgagcaagctgagacacgtcgtcctcgacgaggtggaccagatgcttgatctcgggtttgccgagcaagtggaggatattatccatgaatcatacaaaactgattcagaagataatccacagactctcctctttagcgccacatgcccgcagtgggtttacaaggtcgcaaaaaagtacatgaaatcccggtacgagcaggtcgaccttgttggcaaaatgacccaaaaggctgccactacagtggaacacttggccatccagtgtcattggagccagcggccggccgtaattggcgacgtgttgcaagtgtactccggcagtgagggaagggcgatcatcttttgcgaaactaagaaaaatgttaccgagatggctatgaacccccacatcaagcaaaatgcccagtgcctacatggagacattgcacagtcccagcgggaaatcaccttgaaggggttccgggaggggtcttttaaggtgctagtcgcgaccaatgttgcagcccggggtttggatatccctgaagttgacctagtgatccagagtagcccacctcaagacgtggagagctacatacaccgctcaggtaggaccggtagggcaggtcgcactggtatatgtatttgtttttatcagccacgggagagaggccagctgaggtacgtggaacaaaaggctggcatcacttttaagagagtgggcgtgccgagcacaatggacttagtgaagtccaaatccatggacgcgataaggtcgcttgcatctgtcagctacgccgccgtggacttctttaggccaagtgctcaaagactgatcgaagaaaagggtgctgtcgatgctcttgcggccgcactagcacacatctcaggcgcttcatccttcgagcctcggtccttgattacttccgataaaggtttcgtcactatgaccctcgaatctctggaagaaattcaagacgtgtcatgtgcatggaaggagctcaaccgaaaactcagtagtaacgccgttagtcagattaccaggatgtgcctgcttaaaggcaacatgggggtatgtttcgacgtgcctactaccgaaagcgagcgcctgcaggcagagtggcatgactccgactggatcctcagtgtgcctgccaaactgcccgagatcgaggagtattatgatggcaatacatcaagcaattcccggcaatcaagacaaggatcgaggtccggaagtaggcaggatgggcgccggaggagcggcaaccgaaacagatctcggagtggcggtcacaaacggagctttgactag

SEQ ID NO: 19051 - DNA, 2001 bp, Artificial Sequence
  Description of Artificial Sequence: Synthetic coding sequence
atggccctgttctacgtggcccggtaccccggccccgacgccgccgcagctgcaggacctgagggagccgaggccggggcacacggtcgcgcccgcgctttactggaacgactccaatctcgggcacgggagcgccagcaacagcgggagcccgctcagactgaggctgccgcaagtaccgagccagccactcggaggaggaggaggccccgaaggcggaggagagttaacgacgccgaaccagggagccctgaagccccccaagggaagagaaggaaagcagacggggaggatgctggcgctgaaagcaatgaggaggcacctggtgaaccctctgccggttcatctgaagaggccccaggcgagcccagcgccggatcttcagaagaggctcccggagaacggtctacgtctgcctccgctgaggccgccccggatggccccgcgctggaagaggcagcaggtccgctggtgccggggctagtgttggggggatttggcaagcggaaggcacctaaagtacagccgttcttgccccgatggctggccgagccaaattgtgtgagaaggaatgtcacagaggacctggttccaatcgaggacatcccagacgttcacccggacctccagaaacagcttagggctcatggtatttcctcctatttcccagtacaggctgccgtgatcccagcactgcttgagtccgccgcctgcggctttctggtggggagagggggatatcggcccagcgatctttgcgtgagtgctcctaccggaagtggcaagactttagctttcgtaatccccgtggtgcaagctttgctgtcaagggtagtttgtcatatccgcgcccttgtggtgctgcccacgaaagaattggcacagcaggtgtctaaggtgtttaacatatacacagacgctacacccctccgcgtctcactcgtaaccgggcagaaatccctggcaaaggaacaggagtctttggtgcagaagaccgccgacggctaccggtgcctcgcggatatcgtagtcgccactcccggccgtctggtcgatcatatagaccagacccctggctttagtctccaacagcttcgctttctgattattgacgaggccgatcgcatgatagacagtatgcatcagagctggttaccgagagttgtagctgccgcattccaatctgaagaccccgccgacccttgcgccctcttacagcgaagacaagcacaggcagtgaccgccgcatctacatgctgcccccaaatgcccctacaaaagctcctcttttccgccacactgactcagaaccctgagaagctacagcagctcggtctccaccagccccggttgttctctacaggtctggctcatagagggctggaggacacagatggggacggcgatagtggaaagtacgctttccctgtggggctgacccaccactacgtgccatgcagtctgtcttctaagccactagtagttctccacttggtgctggaaatggggtttagcagggttctgtgcttcactaactctcgggagaatagccatcggctgtttctgctcgtacaggcatttggaggcgtagacgtggccgaatttagtagccgctacggcccaggccagagacgcatgatccttaagcaattcgagcagggcaagattcagttacttatctctacggatgctacagcccgcggtatagacgtgcagggtgtggagctggtggtgaactatgacgctccacaatacctgcgcacttacgtacatagagttggccgcacggctagagcgggcaagaccgggcaagcttttacattgctgttaaaggtgcaggagcgacgctttctccgcatgctcaccgaggctggggcccctgagctgcagcggcacgagctctcaagcaaattgctgcagcctttggtgcctcggtacgaggaggccctcagccaactcgaggagtctgtcaaggaggagcgaaagcagagggctgcttag

SEQ ID NO: 19052 - DNA, 1896 bp, Artificial Sequence
  Description of Artificial Sequence: Synthetic coding sequence
atgagccactgggcccccgagtggaagcgggccgaggccaacccccgggatctcggggcttcttgggatgtgcggggctctaggggttccggctggagtggaccctttggccaccagggtccccgggccgctgggtcccgcgagccaccactctgctttaaaataaaaaataacatggtcggagttgtcataggctattcagggtcgaagatcaaggatttgcagcattcaactaataccaagatccagatcatcaatggagaatccgaggcgaaggtccggatctttgggaacagggaaatgaaggctaaagccaaagccgcgattgaaaccctgatccgcaagcaggagtcgtataactccgaatcgtctgtagataatgctgcctcacagactcccattggccgcaacctcgggcgaaatgatatcgtcggggaggccgagcctctttcgaactgggacaggattcgcgctgccgtggtagagtgcgagaaaagaaagtgggcggacctccccccagtgaagaaaaacttttatatcgagtccaaggccacatcttgcatgtccgaaatgcaggtgataaactggcgtaaggaaaactttaatatcacctgcgacgacctcaagagcggagagaagcggcttattcctaagcctacttgtagattcaaagatgcttttcagcagtacccagatctgttgaagtccattattcgcgtcgggatcgttaaaccaacacctattcagagccaggcttggccgattatcttacagggcattgatcttattgtcgtcgctcagaccggaacaggaaagactctctcctacctgatgcctggcttcatccatctcgacagccagcctatctcccgtgaacagagaaacgggccagggatgctggttctcacccccaccagggagttggcccttcacgtggaggccgagtgttcaaaatatagctacaagggtctgaagtcgatctgcatttacggtgggcgtaatcggaacgggcagattgaggacatctcgaaaggtgtggacattatcattgctacaccaggaaggcttaacgacttacagatgaacaatagcgtgaatttaaggtcgatcacctatctcgttatcgacgaggcagacaagatgctcgacatggaattcgagccacaaatccgtaaaatcctcctagatgtgagaccagaccgccagaccgtgatgacatccgccacttggcctgacacggttagacaacttgccctcagctacctgaaggaccctatgattgtttatgtaggaaacctaaatctggtggctgtgaataccgttaagcagaacattatcgtcacaaccgagaaagagaaacgagcactgactcaggaattcgtggaaaacatgtctccaaatgacaaagtgattatgtttgtgtctcagaagcacatcgccgatgatctaagttccgacttcaacatccaagggatttcagccgagtccctacacgggaactcggaacagtccgaccaggagagggctgtcgaggatttcaagtcagggaatatcaagattctcattaccaccgacattgtctcacggggactggatttgaacgacgtaacacacgtttataactatgattttccacgaaacatcgacgtctatgtgcatagagtcggctacattgggcggaccgggaaaacgggcacatccgtaactctcataacgcagcgggattcaaagatggcaggagagctaataaaaatactagatcgggccaatcagagcgtgcccgaggacttggtggttatggccgagcagtacaaattgaatcagcagaagcggcacagggagactcggagccggaaacctggtcagaggcgtaaagaattctacttcttgtcttag

SEQ ID NO: 19053 - DNA, 1644 bp, Artificial Sequence
  Description of Artificial Sequence: Synthetic coding sequence
atggaggacagcgaggccctgggcttcgagcacatgggcctggacccccgcctcctgcaggccgtgacagacttaggctggtctcggcctactcttattcaggaaaaggcaattcccctggctctggaggggaaggacttgctggctcgggcccgcacaggctcaggaaaaaccgctgcatacgcaattcctatgctgcagcttctgctccacagaaaagctacaggccctgtggttgagcaggccgtgcggggacttgttctcgtcccgacaaaagagctggctagacaggcacaatctatgatccagcagctcgccacgtattgtgctcgcgatgtgagggtggcaaacgtctcagctgcggaagactcggtttcacagagggcggtgcttatggagaagccagatgtcgtcgtgggtactccatcaaggattctgagccaccttcagcaagacagcctgaaacttcgcgactcccttgagttgctggtcgtagatgaggctgacctgctattctcctttggctttgaagaagaactgaagtcactgctgtgccacttgcccaggatctaccaagcgtttttaatgtcagccacattcaatgaggatgtgcaagctcttaaagaattaatccttcataatccggtgactctgaaactgcaggagtcacaattacctggccccgaccaattgcagcagttccaggtggtgtgcgagaccgaagaggataaattcctgttattgtacgctctcttgaagctcagcctgattagaggaaaaagcctgttgtttgtgaatactctggagcggagctaccgcctgaggctgttcctcgagcagttctccatacctacctgcgtcttgaatggcgagctcccccttcgatcacgctgccatatcatctcccagtttaaccagggcttttacgactgtgtgattgccacggatgctgaagtcctgggtgctcccgtgaagggcaagcgtcgcggaagagggcctaaaggcgacaaggcgtccgaccctgaagcaggtgtagctcggggtattgattttcaccatgtgtctgccgtactcaattttgatctcccgccgacccccgaggcgtacattcacagggcaggcaggacagcgagggcaaacaaccctggcatcgtgctcaccttcgtcctgcctacagagcagtttcatctgggcaagatagaagaattgctgtcaggggaaaaccggggcccaatcctactgccttaccagtttcgcatggaagaaatagagggcttcagatatagatgtcgggatgctatgcggagcgtgacaaagcaggcaattagagaagcacggctaaaagaaattaaggaagaactcctgcactccgaaaaactcaaaacctattttgaggataacccacgcgatctgcagctcttgaggcacgatctgcccctgcatccagcagtagtgaagccccatctcggacacgtacccgattacctggtgccccctgcgctccgggggctggttcgcccacataagaaaaggaaaaagctgagctcttcctgccgaaaggctaagcgggcaaaaagtcagaacccacttaggtccttcaagcataaggggaaaaagttccggcctacagccaagcctagttag

SEQ ID NO: 19054 - DNA, 2112 bp, Artificial Sequence
  Description of Artificial Sequence: Synthetic coding sequence
atggccgcccccgtgggccccgtgaagttctggcggcccggcaccgaggggcccggggtatcgatttccgaagagcggcagtcgctggctgagaacagtggcacaacagtagtgtataacccatacgctgctttgagtatagagcagcagagacaaaaactgccggtattcaagctgcgcaatcacatcctttacctgatagagaattaccaaacggtggtcattgtcggtgagaccggatgcggcaagtcaacgcaaatacctcaatatcttgctgaggccggatggaccgccgaaggcagggtagtgggggttacccaacccagaagagtggctgcggtcacagtagccgggcgggttgctgaggagcggggggcagtactggggcacgaagttgggtactgcatcaggttcgacgattgtactgatcagttagcaacgcggatcaaattcttgacagatggtatgctggtgagagaaatgatggttgatcccctgcttaccaagtactcagttattatgctggacgaggcacatgaacggacactttatacggacatagcaattggcctcctgaaaaagatccaaaaaaagcgaggtgacttacggttgatcgtggcgagtgcaactctcgatgccgacaagttccgggatttttttaatcagaatgagacctcagatccggccagagacacctgcgtcattcttactgtggaggggcgtacctttcccgtggacatattctatttgcagtccccggttcctgattacatcaagtctacagtggaaaccgtggtcaaaatccatcagaccgagggggatggcgatgtcctagctttcctaacagggcaggaggaggtggaaacagtggtatctatgctgatcgagcaagctagagctctggctcggaccggtatgaagcgtcacctcagagtgttaccgatgtacgcaggactccccagcttcgagcagatgaaggttttcgagcgagtttcccggtcagtgaggaaagtcattgtcgccacaaatgtagccgaaacttccatcacaatatcagggatcgtgtatgttattgattgcggcttcgtgaaattgagagcgtacaacccaaggactgctatcgaatgcttagttgtggtgcctgtgtcacaggcgtccgcaaaccagagggccgggcggggcggaagaagccgcagcggcaaatgttaccgcctctatacagaggaggcgttcgataaactgccacagtccactgtgccagagatgcagcgatccaatttggctccggtcattcttcagctgaaggcattagggatcgataacgttcttaggttccacttcatgtcgcccccaccggcccagagcatggtgcaggccctagaacttctgtatgctttgggcgggcttgacaaagactgcaggctgaccgaacctttaggaatgcgcattgccgagttccccctcaatcctatgtttgcaaagatgctgctggagagcggaaacttcggctgcagtcaagaaatcttatcaatcgccgccatgatgcagatccagaacatattcgttgtgcctccgaaccaaaaaagtcatgctattagagttcacaggaagtttgctgtcgaagagggagaccacctgaccatgctgaatatttacgaggccttcataaaacacaataaagactccaagtggtgccaagaacacttccttaactacaagggactcgtacgggccgctacggtgcgggagcagcttaaaaagctcctggtgaagttccaggtcccaaggaagagtagcgagggagaccctgatctcgttctccgttgtattgtgtccgggtttttcgccaacgctgctaggtttcattctactggggcgtacaggacgattcgtgacgaccatgagctgcacatacaccctgcttccgttctttacgccgagaagcccccgcgatgggttatttataacgaggtgattcagacaagtaagtactatatgagggacgtgactgccatcgagagtgcttggcttcttgagctggcaccacacttttatcagcaggggacacatttgagcctcaaggccaaacgggccaaggtgcaggacccctag

SEQ ID NO: 19055 - DNA, 552 bp, Artificial Sequence
  Description of Artificial Sequence: Synthetic coding sequence
atgctgctggagagcggcaacttcggctgcagccaggagatcctgtccatcgcagccatgatgcagatacaaaatatctttgttgtgcctccaaaccagaaaagccatgcccacaacaaggacagtaagtggtgccaagagcacttcctcaattataaaggtctcgtgcgcgctgccacagttcgggagcagctcaaaaaactgcttgttaagttccaggttccccggaaaagttctgagggagatccagatttggtcctgaggtgcatagtctccggcttcttcgcaaatgctgcaagattccattcgacgggggcctatcggaccatccgggacgaccatgaactgcatatccatccggcctcagtgctctatgctgaaaaacccccacgatgggttatctataacgaggtcattcaaacttctaagtactacatgcgcgacgtcactgcaatcgagtccgcttggctgctcgaactggcgcctcacttctatcaacagggaacccatttgtccttaaaagccaaacgggctaaagtccaagatccctag

SEQ ID NO: 19056 - DNA, 2019 bp, Artificial Sequence
  Description of Artificial Sequence: Synthetic coding sequence
atggccgcccccgtgggccccgtgaagttctggcggcccggcaccgaaggaccgggggtgagcatatcagaagaacggcaatcactcgctgagaattctggcactaccgttgtatacaacccttacgcagccttgtcaatagaacagcaaaggcagaagctgcccgtgttcaagtacctggccgaagctggctggaccgctgaagggcgcgttgtcggcgtcactcagcctagacgcgtcgcagccgttacagtggccggccgcgtcgctgaggagaggggggccgtgcttggccacgaagtgggttattgtatcaggtttgatgactgcacagaccagctggccactcggattaagttcctcaccgacggtatgcttgtcagagaaatgatggtggaccctctcttgacgaaatactcggtgattatgcttgacgaggcacatgagcgcaccctgtataccgacatcgcgatcggcctcctgaagaagatacaaaagaaacggggcgatttgcgtttgattgtcgcctccgctacgctcgatgctgacaaatttcgggatttcttcaatcagaacgagacctccgaccccgcaagagacacatgcgtcatcctgacagtggagggtaggaccttcccggtggatatcttttaccttcagagtccagttcctgactatatcaagtcgaccgtggagactgttgtcaaaattcatcaaactgagggggacggggatgtgttagccttcctgacggggcaggaggaggtggaaaccgtcgtgtccatgctcatcgaacaggccagggccttggcccggaccggtatgaaaaggcatttgcgcgttctccccatgtatgccggccttccatctttcgagcagatgaaggtattcgaaagggtaagcaggtctgtgaggaaagtgattgtagcgacaaatgttgccgaaacttctattaccatcagcgggattgtgtacgtgattgactgcgggtttgtgaaactgagggcatacaacccaaggaccgccatcgagtgccttgtcgtggtcccggtgtcacaggcttccgcaaatcagcgggccggccgcggcggccgatcacggtcaggaaagtgttacagattgtacaccgaagaagcattcgacaaactgcctcaaagcactgtgccagagatgcaaagaagcaatcttgctcctgtaattttgcaactgaaagctttgggaatcgacaacgtgttacgtttccacttcatgagtccaccacctgcacagagcatggtacaggccctggagcttttgtatgctctgggcggcctggacaaggactgcagactgacagaaccattggggatgcgaatcgccgagtttccccttaaccctatgtttgcaaaaatgctcctcgagtcaggcaacttcggatgtagccaggagatcctcagcatcgccgcgatgatgcaaatccagaatatcttcgttgtgccacctaaccagaagtcccacgctatccgcgtgcaccggaaatttgctgtggaagaaggagaccacctcactatgctgaatatttatgaggctttcatcaaacacaacaaagattcgaaatggtgtcaagaacacttcctgaattataaaggtttggttagagccgctacagtcagggaacagcttaagaaactgctggtcaaatttcaagtacctaggaagtcatccgagggtgaccctgacctagtgctccgttgcatagtgtccggtttttttgcaaacgctgccagatttcattcaaccggagcttatcggaccattcgcgacgatcacgagctgcatatccatcccgctagcgtactgtacgcagagaaacctccccgatgggttatatacaatgaagtgatccagacttccaagtactacatgagagatgtcaccgctatcgagtcagcttggctcttggagctcgccccccacttttaccagcagggcacacatttgagcctcaaggctaagagggccaaggtgcaggacccctag

SEQ ID NO: 19057 - DNA, 2154 bp, Artificial Sequence
  Description of Artificial Sequence: Synthetic coding sequence
atgaccagccagcccctgcggctggccgaggagtacggccccagccccggggagtcagagctggctgtaaacccttttgatggcctacctttctcatcccgctactatgaactgttaaaacaacggcaggcacttccaatctgggcagctaggtttactttcctggagcagctcgaatcgaaccctaccggagtcgtgttggtcagcggtgagcccgggagcggtaaatctacccagataccgcagtggtgtgctgaattcgctctggccagggggtttcagaaaggtcaggtgaccgtgactcagccttatccgctggcggccaggtctctggccctgcgggtggcggacgagatggacctaacgctggggcacgaagtgggttactccatcccccaggaagactgtaccggccccaatactctcctccggttctgttgggaccgtctgctcttacaggaggttgcctccacaaggggcacgggagcgtggggcgtgctggtgcttgatgaggcacaggaaaggtcagtcgcatccgattccctgcaggggctactgcaggacgccagacttgagaaactgccaggggacctccgcgtggtggtggtaacggatcccgcgcttgagccgaaactgagagccttttgggggaatcctcccatcgttcacatccctcgtgaaccaggggagcggccttcccctatctactgggacacaatcccgccagacagagtggaagccgcctgtcaggctgtgctggagctgtgtcgcaaggaactgcctggtgacgtgctagtctttttacccagcgaggaggagatctccttgtgctgcgaatccttgtctcgggaagtggagagcttgctcctgcaggggctgcccccacgcgtactgccacttcatccagattgtgggcgcgcagtgcaggcggtgtacgaagacatggatgcccgaaaggtggtggtaacacactggttggcggacttctcctttagtctgcccagcatccaacacgtgatcgattccggtctcgaacttcgaagtgtctataatccacggatacgcgctgaatttcaagttctcaggccaatctccaaatgccaggcagaggcaagacgactgcgcgcccgcggctttcccccgggctcctgcctgtgcctttacccaaaaagctttttggagctcgaagcccctccattgccccagcctcgagtgtgcgaggagaacttgagcagcctggtgctgttactgaagaggaggcaaatcgccgagcccggggaatgtcactttctcgaccagcccgctcccgaggcattaatgcaggctctcgaggacctcgactatctggcagccctagacgacgacggcgacttaagtgatctgggagtgatactgtctgagtttcccctggcacccgaacttgcaaaagccttgttggcgtcttgtgagtttgattgcgtagacgaaatgctcacactagccgcgatgcttactgccgctcctggatttactaggccacccctgtcagcggaggaagccgcccttcggcgggccctggagcacactgacggcgaccacagcagtttgatacaggtctacgaagcctttatccagtcaggcgcggacgaagcttggtgtcaagcgcggggcttgaactgggcagccctgtgtcaagcccacaaactcaggggtgagttgctggagctgatgcagagaattgagttgccactgagtttgccagctttcggaagcgagcagaatcgcagggatttacagaaggcccttgtctctgggtatttcctcaaagtagccagagatacagacgggaccggaaactatctcctgttgacccataagcacgtggcccaactgtcctcctattgctgttatcgttctcgacgggccccagcccggccccctccatgggtactctaccataatttcactattagcaaagacaactgtctctctattgtcagtgagatacagccccagatgctggttgagctggcgcccccatatttcctgagtaacctccccccctccgagtctagggatctcctgaatcagctccgtgaaggcatggcggattccaccgcaggctcaaagtccagctccgcacaggaattcagagatccttgtgtgttacaatag

SEQ ID NO: 19058 - DNA, 2154 bp, Artificial Sequence
  Description of Artificial Sequence: Synthetic coding sequence
atgaccagccagcccctgcggctggccgaggagtacggccccagccccggcgaatcagagctggcagtgaacccctttgacggcctgcctttctcttccagatactatgaactgctcaagcagcggcaggccttacccatctgggccgcaaggtttacctttttagagcagctggagtcaaacccaacaggggtcgtgttggtatctggagaacctggatctggtaaatccacccaaatccctcagtggtgcgcagagtttgccctggcccggggtttccagaagggccaggtgactgtcacccagccctaccctctcgcggccaggtcattggcccttagggttgctgacgagatggatttgacactcggccacgaggtgggctattccatcccacaagaggactgtacagggcccaatactttgctccggttttgctgggacaggctcctgctacaggaagtagcatccactcgagggacgggcgcgtggggagtgctggtcttagacgaggcccaggaacgaagcgtcgctagcgattccctgcaagggctgttacaagatgcgagactggagaaactgcctggggacctccgcgtggtcgtagtgactgacccagccctggaaccaaagctgcgcgctttctgggggaatccaccaatagtgcacattcctagagaaccaggcgaacgcccttcgcccatctattgggatacgatacctccagaccgggtggaagctgcctgccaggcagttctggagctgtgtaggaaagaactccccggtgatgtcctcgtgtttctgccaagtgaagaagagataagtctgtgctgcgaaagcctaagcagggaagtagaatccctcctgctgcagggactccctccgcgcgtgctgcccctgcacccagattgtggccgggctgtccaggccgtgtacgaggatatggatgctagaaaagtggttgtgacccattggctggcggactttagcttcagtctcccttcaatacagcatgtcatcgacagcgggctcgagctgcggagcgtttacaaccctcggatcagggcggagttccaggtgctcaggcccatcagcaagtgccaggcagaggcccggcggttaagagctcgaggctttcctccaggttcttgcctctgtttgtaccccaaatcatttttagaattggaagccccacccctgccccagccccgggtgtgcgaggaaaacctgtcctctcttgtgctgctcctgaagcgacgacagatagccgagcccggtgaatgtcatttcctagaccagcccgcacccgaggcactgatgcaggcactggaagatctagactatctcgccgcactggacgacgatggcgacctgtccgatctcggtgtcattctttctgagtttcctttggcaccagaactcgctaaggccctactggcgtcctgcgagttcgactgtgtagatgagatgttgaccctggccgctatgctgacggcagccccaggcttcactagacctcccctcagcgccgaggaggctgcccttagaagagctctcgaacacactgatggggatcatagctccttgatccaggtctacgaagcctttatccagtcaggggctgatgaagcttggtgccaggctcgcggactgaattgggcagcattgtgtcaggcgcacaagttgaggggcgagctgttagagttgatgcaaagaatagagctgcccctgtctctgcctgccttcggatcagagcagaaccgcagagaccttcaaaaggctcttgtgtctgggtattttctcaaggtcgcgagagatacagatgggaccggcaactacttgctgttgacccacaagcacgtggcccagctcagtagctactgctgttaccggtctagaagagcgcccgcccggccgcctccctgggtcctgtatcataactttacaattagcaaggacaactgtctgagcatcgtctccgagatccagccgcagatgctggtcgaactggcccccccatattttctgtcaaacctccctccgtctgagagccgagacttactgaatcagctgagagagggaatggctgattctacagccggatcaaagtcttcaagcgcccaggaattccgcgatccttgcgttctccagtag

SEQ ID NO: 19059 - DNA, 981 bp, Artificial Sequence
  Description of Artificial Sequence: Synthetic coding sequence
atggccctgagcggcagcacccccgccccctgctgggaggaggacgagtgtttagattactacggcatgctgagtcttcacagaatgtttgaagttgtgggggggcaactgacagagtgtgagttggagcttctggccttcttgctagatgaggcccctggcgcagcgggaggcttagcccgagcccgctccggcctggaactgctgctagaactggagcgtaggggccagtgtgacgaaagtaatcttcgactcctgggccagctgcttcgagtgttggctaggcacgatctacttccgcatctggcaagaaaaagaagaagacccgtgtctcctgaaaggtattcatacggcactagttcaagcagcaagcggaccgaagggagttgcagaagacgccgccagtcatcctcgtcagctaacagccagcagggccagtgggaaacaggcagcccgccaactaaaagacagagacggtcccgggggcgccccagcggtggtgcacggcgacgtcgaagaggagcccctgcagccccacaacagcagtcagaacccgccagaccgtcttcggaaggtaaggtaacatgtgacatccgcctcagggttagagctgagtactgtgaacacggacccgctttggaacagggagtggccagtaggcggccccaggcgctggcgagacagctggatgtgtttggacaggctaccgcagtactccggtcacgggatctgggctcggtcgtgtgtgatatcaaattctcagagctttcatacctggacgctttctggggcgattatctgtccggggccttgctgcaggccctcaggggcgtctttttgacagaggcactaagagaggcagtcgggagagaagcagtgcggttgctcgtaagtgtggacgaagcagactatgaggcaggccggaggaggttactgcttatggaggaggagggcggcagacggcctaccgaggccagttag

SEQ ID NO: 19060 - DNA, 981 bp, Artificial Sequence
  Description of Artificial Sequence: Synthetic coding sequence
atggccctgagcggcagcacccccgccccctgctgggaggaggacgagtgcctggattactacgggatgctttctctccatcgcatgtttgaagtggtgggaggtcagctgaccgagtgtgagctggagcttcttgcttttctcctggatgaggctccaggggcagccgggggccttgcccgggctagatctggcctagagttgctgctggagctggagcgaaggggccagtgtgacgagtcaaacttgcgcctgttaggccagctcctcagagtcctggccaggcacgacctattgccacatcttgcgaggaaacgaaggagaccagtatctcctgaacggtacagctacggaacttcatcgtcaagtaagcggaccgagggatcatgcagacgaaggcggcagtcatcttcctccgccaattctcagcaaggccagtgggagaccgggagtcccccaacaaaacgccagcgtcgatcgagggggaggccatccgggggagcgcggcggaggcggagaggagctcccgcggccccacaacagcagagcgaacccgccagaccatcatcagagggtaaagtcacatgtgatatcagattgagagttcgcgccgaatactgtgagcacggacctgccctggagcagggggtggcgagccgtaggcctcaggccttagcgcgacagctcgatgtcttcgggcaggccacagctgttttgaggtccagggacctgggcagtgtagtttgcgacataaaatttagcgaattgagttatctagacgctttttggggagattatttatccggggctttgctgcaggccttgaggggcgtgtttttaaccgaggccttgcgcgaagcagtaggtcgagaggctgtgcgactgcttgtgtcagtagacgaagcagattacgaggccggtaggaggaggttattgcttatggaagaggaaggcggccggagaccaacagaggcctcctag

SEQ ID NO: 19061 - DNA, 1635 bp, Artificial Sequence
  Description of Artificial Sequence: Synthetic coding sequence
atgcgggtggccgtggccggctgctgccacggcgagctggacaagatttacgaaacactcgctctggccgaacgccgggggccaggaccagtcgatttgcttctgtgttgcggcgacttccaggccgttcgaaacgaggccgacctacgatgcatggctgtcccccctaaataccgacatatgcagacattttataggtactatagcggggagaaaaaggcgcccgtcctcactctgttcattggcggaaatcatgaggcctccaatcacctccaagaattgccctatggcgggtgggttgcacccaacatatactatctgggactggccggagtcgtgaagtacaggggcgtgcgaatcggtgggatatcgggtatctttaagtcccacgactaccgcaagggccacttcgaatgccccccttataatagctccacaataagatcaatctaccacgtgaggaatatcgaagtgtacaagctgaagcagttgaagcagcccatcgatatttttctgtctcacgattggccacgatcgatttatcactacggcaataagaagcagctgcttaagaccaaatcattcttccgtcaggaggtggagaataacacacttggaagtccggctgcctcagaattgctggaacatctgaaacctacatactggttctctgctcatctgcacgtgaagttcgccgctctgatgcagcatcaggcaaaggataaaggtcaaactgccagggccaccaaatttcttgctcttgataaatgtctgccccacagagactttctccagatactagaaatcgagcatgacccgtccgcccccgactaccttgagtatgatatcgagtggctgaccattctgcgagccacagatgatctcattaacgtgaccggaaggctgtggaatatgcccgaaaataacggcttacacgctcgatgggactactctgctacagaggaggggatgaaggaggttttggaaaaattgaatcatgatttaaaggtgccctgtaatttttccgtgaccgcagcgtgctatgatcctagcaagccgcagacccagatgcagcttattcacagaattaatccgcagacgactgagttttgtgctcagctgggaatcattgacatcaacgttagactgcaaaagagcaaagaagaacatcacgtgtgcggcgaatacgaggaacaggacgacgtcgaatccaacgatagtggggaagatcaatccgaatacaatactgatacatccgcgctatcttctattaacccagacgaaatcatgttagacgaggaggaagatgaggactcaatcgtgtcagctcactctggcatgaacacaccgtccgtggagccgtcagaccaggcctccgaattcagcgcgtccttttctgatgttcgtatcctgccaggcagcatgatcgtttcaagtgatgatacggtcgattctaccatcgaccgtgagggaaagccaggcgggactgtagaatccggaaatggagaggatctcacaaaggtgcctttaaaaagactcagtgatgagcatgaacctgagcagcggaagaaaatcaaaagacgcaatcaggcaatctatgccgctgtagacgacgatgatgacgacgctgcctag

SEQ ID NO: 19062 - DNA, 933 bp, Artificial Sequence
  Description of Artificial Sequence: Synthetic coding sequence
atgcagcaccaggccaaggacaagggccagaccgcccgggccaccaagttcctcgcactggataaatgcctgcctcaccgggactttttacagatacttgaaatcgaacatgatccgagcgctcccgactacctggagtatgatatagagtggttgacgatcttgcgtgccacagacgatctgatcaatgtaaccggccggctctggaacatgcccgaaaacaacgggctacacgctcggtgggattactccgcaactgaggagggtatgaaggaggttctggaaaagctaaaccacgacctcaaagtgccttgcaacttttccgtcaccgccgcctgctacgatccatccaagccacaaacccaaatgcagttgatccacaggattaacccccagactaccgagttctgtgcccagctcggcattattgatatcaatgttcgacttcaaaagagtaaagaagagcatcatgtatgcggggagtacgaagagcaagacgacgtggagtctaatgactctggagaggaccaaagcgagtacaatacagacacatctgccctcagcagtattaaccctgatgagattatgctggacgaggaggaagacgaggattccatcgtcagcgcccattctgggatgaacactccttcggtcgagccgagcgatcaggctagcgagttcagtgccagcttctctgatgtgcgaattctacctgggtctatgatagtgtccagtgacgacacggtggattctacaattgatcgagaaggcaaacccggcgggacagtagagtccggaaatggcgaagacttgacaaaagtcccactgaaacgcctgagtgatgaacacgagcctgaacagcgtaagaaaatcaaacggagaaatcaggctatttacgcggctgtggatgatgacgacgacgacgccgcttag

SEQ ID NO: 19063 - DNA, 1653 bp, Artificial Sequence
  Description of Artificial Sequence: Synthetic coding sequence
atggaccaccacgtgagcaccatcaagccccggcggatccagaaccagaatgtaatccaccgcttggaaaggagacgcattagctctggcaaggccggtactcactggcaccaggtgagggtgttccaccagaatgtgtttccaaatttcactgtggtaaatgtggagaagcctccatgtttcctcagaaagttcagccccgatggacgctactttatcgctttctcaagcgatcaaacaagcctggagatttacgagtaccaggggtgtcaggcagcagaagacctgctgcagggctatgagggggagatcctcagcaatggaaatgatcaaagatccgtgaatattcggggacggctgttcgaacggttctttgtcttgcttcatatcaccaacgtcgccgccaatggtgaacatctcaacagggagtgcagtctattcacagatgactgcagatgcgtcatcgtcggaagtgctgcttacctacccgatgagcctcaccccccgttcttcgaggtctaccggaattcagagagcgttacaccaaatcccagatctccgctagaggactatagcctgcatatcattgatctgcacaccggcagactgtgcgacactcgcacctttaagtgtgacaaagtagtcttaagccacaaccaaggattatatttgtataaaaacattctggcaatactgagcgtgcagcagcagaccatacacgtttttcaggtgaccccagaaggaacattcatcgatgttaggaccattggccgcttttgctacgaagatgatcttctcaccgtcagcgctgtctttcccgaagtgcagagggattcacagacaggaatggcaaaccctttccgggacccattcattaatagtctcaaacataggctactggtgtatttgtggcggagggccgagcaggacggatccgcaatggccaagcggagattcttccagtactttgatcagctgaggcagctcaggatgtggaaaatgcaactgctggacgagaaccatctgtttataaaatacacaagcgaggatgtcgtgacgctcagagtgacagacccttcgcaggcgagctttttcgtggtctacaatatggttacgaccgaggttatcgcagtttttgaaaatacgagcgacgaacttctggagctgttcgagaatttttgcgacctgttcaggaacgcgaccctacactctgaagttcaattcccgtgttccgcctcaagcaataactttgcccggcagattcagaggagattcaaagacaccatcattaacgcgaagtacggaggccacaccgaggcggtgaggagattactgggccagttgccgattagcgcccagtcctattccggttccccatacctggatctcagcctcttttcttacgatgataagtgggtcagcgtgatggaacgccccaagacttgtggagaccaccctattcgcttctacgccagggattccgggctgcttaagttcgaaattcaagcaggcctgcttggtagacctattaatcatactgtgcgccgcctcgtagcctttacattccacccctttgagccgtttgccatctctgtgcagagaacaaatgccgagtacgtggtgaacttccacatgagacactgctgtacatag

SEQ ID NO: 19064 - DNA, 1686 bp, Artificial Sequence
  Description of Artificial Sequence: Synthetic coding sequence
atggtgggccagatcctgaagcgggacgtgatcatggaccaccacgtcagtaccatcaagcctaggcgcatccaaaatcagaatgtgattcaccgtctagagcggagaaggataagctcagggaaagcagggactcattggcatcaggtccgcgtgtttcatcagaatgtgttccctaatttcacggtagttaatgtggaaaaaccaccttgtttcttacggaaattctcccctgacggacgatacttcattgcatttagctctgatcagacttccctcgagatatatgagtaccaggggtgccaggcggcagaagacctccttcagggctatgagggcgaaatcttgagcaacgggaacgatcagcggtcggttaatattagaggtcgtctgttcgagcgattcttcgttctgctacacattactaacgtggctgcaaacggagagcatttgaaccgagagtgcagcttatttacggacgactgcaggtgcgtgatcgtcgggagcgcggcatacctccccgacgagccgcaccccccattttttgaggtttaccggaattccgaaagcgtgactccaaatccgcgctctccactcgaggattacagccttcacatcatcgacttgcatactggccgattgtgcgacacacggacttttaagtgcgacaaagtcgtcctgtcacacaatcaggggctgtacctgtacaagaacatcctagcgatcctgtctgtgcagcagcagacgatccacgtgttccaggtgacccctgaggggacattcattgatgtgagaactatcgggcgcttttgctacgaggatgacctgttgaccgtgagcgccgtgtttccggaggtacagcgagatagccaaactgggatggcaaaccctttcagggacccatttataaactctctgaaacatcgtttgctggtgtacctgtggcggagagcagagcaagatggtagtgccatggccaagcggcgcttctttcagtattttgatcagttaaggcagcttagaatgtggaaaatgcagctgctggacgagaatcatctatttatcaaatacacatctgaagacgttgtgacattaagagtcaccgacccaagtcaggcatcttttttcgtagtatacaatatggtaacaaccgaagtgatagcggtctttgagaacactagcgatgaactgctggagctgttcgagaatttttgcgatcttttccgaaatgcgactttacattctgaggtgcagttcccttgcagcgcaagttcaaacaatttcgctagacagattcagagacgtttcaaagatacaatcatcaacgctaagtatggcggccacaccgaggcagtccgccgactgctggggcaactgcctatcagtgctcagtcctatagcggctccccctatttggatctgtcattgttcagttacgacgacaaatgggtgtccgtgatggagcggccaaagacgtgtggagaccacccgatcagattttatgcaagagactccggactcttgaagtttgaaattcaagccggtctcctaggtaggccaatcaatcatacagtgcggcgtctggttgctttcacctttcacccctttgaaccgttcgctatctctgtgcagcgtacgaatgccgagtacgtggtgaattttcacatgcgtcactgctgtacctag

SEQ ID NO: 19065 - DNA, 1686 bp, Artificial Sequence
  Description of Artificial Sequence: Synthetic coding sequence
atggtgggccagatcctgaagcgggacgtgatcatggaccaccacgtatctactataaaaccacggagaatccagaatcagaatgtgatccaccgactcgaacgccggagaatttcctctggcaaggccgggacccactggcatcaggtcagagtgttccatcagaatgtcttcccaaatttcaccgtggtcaatgtggagaagccaccatgtttcttgcgcaagttttccccggatggcagatattttattgcttttagcagcgaccagaccagtctagagatctatgagtatcagggttgtcaggccgctgaggaccttttgcaagggtacgaaggcgaaatcttgtcaaacgggaacgatcagcgcagtgtcaacattaggggtcggctctttgaacggttctttgttctcctgcatataaccaatgtcgccgcgaacggagagcatcttaacagggaatgcagcctgtttactgatgactgcaggtgcgtgattgtgggaagcgcagcctatctgccagatgagccccatccgccgttctttgaggtgtacagaaactcagagtctgtcactcctaatcccaggtctcctcttgaggactattcactccacatcatcgatttgcacactgggcgcctatgcgacactcgtacctttaagtgcgataaagtggttctctcccataaccagggactgtatctgtacaagaacatactggcaatcctgtcagtgcaacagcagactatccacgtcttccaggttacaccagagggaaccttcatagatgtgaggaccattgggcgcttttgctacgaggatgatttattgaccgtaagcgccgtgttccctgaagttcagcgagactcacagactggcatggccaatccctttagagatcccttcattaacagcttgaagcatagattgctcgtgtatttgtggcgtcgggctgaacaggatggctcagctatggcaaaaaggaggttttttcagtacttcgaccaactgcgtcagctcagaatgtggaagatgcagttgctagatgaaaatcatctgtttatcaagtacacaagcgaggatgtggtgacccttagggtgactgaccccagccaggcttcattctttgtggtgtataatatggtgaccaccgaagttattgcggttttcgagaacacttccgacgaactgctcgagcttttcgagaacttctgcgacctgtttaggaatgcaacactccatagtgaagtgcagttcccttgctccgcaagctctaataacttcgccagacagattcagaggagattcaaggataccatcatcaatgccaagtacggtgggcataccgaagccgtgcgccgcctcttagggcagctgcctatatccgcacagagctacagcggcagtccgtatcttgacttaagtctgtttagttacgatgataaatgggtaagtgtcatggaaaggcccaagacatgcggtgatcatcctatcagattttacgccagggattccggtcttcttaagtttgaaattcaagcagggctgctgggaaggcctatcaatcacacggtgcgacgcttggtggcatttacatttcatccttttgagccgtttgcaatctcagtgcagcggaccaatgccgagtatgtagtgaactttcatatgaggcactgttgcacgtag

SEQ ID NO: 19066 - DNA, 5592 bp, Artificial Sequence
  Description of Artificial Sequence: Synthetic coding sequence
atgatcgaggacaagggcccccgggtggccgactacttcgtggtggcaggactgactgatgtttctaagccattggaagaggagatccactttaatgacgcctgccacaaagtggccaaaccaaaggaacccatcaccgatgtgtcagtgatcattaagagcctgggcgaggaagtgccgcaggactatatctgcatcgatgtgacaccgaccggcctttccgccgatctcaacaatggtagtctggtaggtccccagatttatctgtgctaccgtagagggagggacaaacctcccttgaccgacttgggcgtactgtatgactggaaagaacgactgaaacagggatgtgagataattcaaagcacaccttatggtagaccggctaatattagtggtagtaccagctcccagagaatctatatcacataccggcgggcctcagagaatatgactcagaatacccttgccgtcaccgatatctgtattataatcccatcaaaaggtgagtcccccccccatactttctgcaaggttgataaaaatctgaacaactcgatgtggggatcagccgtttatctctgctataagaaaagcgtcgctaaaacaaatacagtgtcttacaaagctgggctgatctgcaggtacccgcaggaagattatgaatctttctctctccccgagtcggtgccattgttctgtctgcctatgggcgctaccattgagtgctggccgagcaactccaaataccctctgcctgtgttcagtactttcgtcttgactggcgcgagcgccgaaaaggtttacggagctgccatacagttctacgagccttattccgaggagaacctgacagaaaaacagcgtttactcttgggacttaccagcgccgacggaaaaagtgactcatctaaaactatccacactaacaaatgtatatgtcttttgtctcactggccatttttcgatgctttcagaaagttcttaactttcctctatcgttacagtatctctggtcctcacgtgctgcccatcgagaagcatatcagtcacttcatgcataaggttccgtttcccagtccccagaggcccaggattctagtgcagctgtcccctcatgacaatctgattctctcccagccggttagttctcccctcccgctcagcggaggaaagttctctacactgttgcagaatttgggtcctgagaacgcagtaaccctgttggtttttgccgtgacagagcacaaaattctcatccactctttacgtcccagcgtgctgactagcgtgacagaggcacttgtctccatgatcttcccttttcactggccctgcccttatgtgcccctgtgccccctggccctcgccgatgtgctgagtgccccctgcccatttattgtcggaatagattctcgctactttgacctgtatgatcctccacccgacgtgtcatgcgtggatgttgacaccaacaccattagtcagatcggcgataaaaaaaacgtggcatggaaaatactcccgaagaagccgtgcaaaaacttaatgaatactctcaataatctgcaccagcagctagcaaaactccagcagagaccaagagacgatgggctcatggacctagctattaatgattacgatttcaactcaggcaagcgactccacatgatcgacctcgaaattcaggaagctttcttgttttttatggctagcatcctgaaggggtacaggagctacctccgccccataacacaggccccctccgaaacagcgaccgacgctgcttcactgttcgccctccaggctttcctccgcagccgggaccggtctcaccaaaagttctacaatatgatgaccaagacgcaaatgttcattcggtttattgaggagtgctcttttgtctcagacaaagatgcttccctcgcatttttcgacgactgcgttgacaaggtggacatggataaaagcggtgaggttaggctgattgaactcgatgagtcctttaagtccgaacataccgtttttgtgaccccacctgagattccgcaccttccaaacggggaagaaccacctctgcaatattcatacaatggattccccgtgcttcgcaataacctttttgagaggccagaagggtttctgcaagccaagaagaacaagcttccctctaaatccagctccccaaacagtccgttaccaatgttcagacgaacaaagcaggaaatcaagtccgcccataagatcgccaagcgttattcctccattccccagatgtggtctagatgcttacttagacattgctatggactgtggttcatatgcctacctgcttacgtgaaggtgtgccattcaaaagtcagagctttaaagaccgcttacgacgtccttaagaaaatgcaaagtaagaaaatggatcccccagacgaggtgtgttaccgaattctgatgcaactatgcgggcagtacgatcagccagtgcttgccgtgagggtcttgtttgagatgcagaaagcgggaatcgatcccaatgccattacctatggttactacaataaggctgtgctcgagagtacatggccttcccgcagcaggtccggctacttcctgtggacgaaggttcgcaatgtggtcttgggagtgactcagttcaaaagagccctgaaaaagcacgcccacctttcccaaacgaccttgtccggagggcagtccgaccttggttataattctttgagcaaagacgaggtgcgcagaggcgatacatctaccgaggacattcaggaagaaaaggacaagaaaggtagtgactgtagctcgctctcagaatccgagtctacaaaggggagtgcggactgtctgccaaaactgagttaccagaactcttctagcattgttaggctgacgggcacgagtaacaatagcgcgggcaagatctctggagagtcaatggagtccacacctgaactgttactgatcagtagcctcgaagatacaaacgagacccggaatattcagagccgctgttttcgcaagaggcataagtcagacaacgagactaacctccagcagcaagtagtttggggaaaccgcaacagaaacctgagcggcggggtccttatgggatttatgctgaatagaatcaaccaggaggcgactccaggagatatcgtggagaaactgggggcggatgctaaaatcttaagcaacgtgatctcaaagtcgacacgtccgaataccctggacattggtaaacctcccctacgctctaagagagacagtctggagaaggagtcctccgacgacgacacgccgtttgatggcagcaactatctcgccgacaaggtggatagcccggtgattttcgacctcgaggatctcgatagcgaaaccgacgttagcaaagcaggctgtgttgcaacccagaacccaaagaggattcagcggatgaactccagtttttcagtcaagcctttcgagaaaaccgatgttgccaccggcttcgacccactcagtctattagtcgctgagactgagcaacagcaaaaggaggaggaagaggaggatgaagacgactctaagagcatctccacccccagcgccaggcgcgatctcgccgaagagatagtgatgtacatgaataacatgagctctcccctaactagccgcactccttcgattgacctccaaagagcttgcgatgataaactcaacaagaaaagtcctccactggtcaaggcatgtagaagatcaagccttccccccaattctccaaaacccgtccgtcttaccaagtccaaaagctacaccaaaagtgaggagaagcctcgggacagactgtggagttcaccagctttttctcctacctgccctttccgagaggaatcccaggatacacttacccactcatctcccagttttaatctggataccttattagtcccgaagttagatgtattgcggaatagcatgtttacagccggcaaaggcgtggcagagaaggcctctaaatggtacagcagatttacaatgtacaccacatccagcaaagaccaatcatcggacagaacctccctctcgtcagtcggggctcaagatagtgagagcacctccttgaccgacgaggacgtttgtcacgagctcgagggaccaatctcttcacaggagacaagcgcaacaagtggcactaaaaggattgatctatctcgtatttccctggaaagtagtgcctcgttggagggctcactgtctaaatttgccttaccagggaagtctgaagtcacgtcgtcgttcaacgcctctaataccaacattttccagaactacgcaatggaggtgttgatttccagctgttcccgctgccgcacatgtgattgcttagtccacgacgaggagataatggctggttggacggccgacgatagtaacctgaatactacttgccccttctgcgggaatatcttcttgcccttcctgaacattgaaatacgcgacttaaggcgccccggaagatactttctgaagagttctccttctacagagaatatgcactttccgagcagcatctcatcgcaaacgagacagtcgtgtatctctactagtgcatctggactggacactagcgcattatccgtgcaaggcaactttgatcttaacagtaagtctaagctgcaagaaaatttctgtactcgaagcatccaaatccctgcaaatcggagcaagactgcaatgtcgaaatgcccgatctttccgatggccaggtctatctcgacaagtggcccattggacaaggaagataccggacggcagaaactgattagcactgggtctctgcccgccaccttacagggagctaccgattctctgggcctggaatggcacctaccatcccctgatccggtaaccgtgccgtacctcagcccacttgtcgtttggaaggagctcgagagcctgttggaaaacgaaggcgatcatgccatcactgtcgccgactttgtggatcaccatccaatcgttttctggaaccttgtctggtatttccggaggctggatcttccttctaatctccctggcttgatactgtcctccgaacattgcaacaaatattcaaagattcccagacactgcatgagcgaggattctaagtatgtactcatccaaatgctctgggacaatatgaaactgcaccaggatcccggccagccactttacatactgtggaacgcccacactcagaagtaccctatggtgcatttgctgcagaaatcagataattcttttaatcaggagctgctgaagagcatggttaaatccattaaaatgaatgatgtatacggccccatgtcacagattctggagacactgaataaatgtccacactttaagagacaaaggtcattgtatcgcgagatcctgtttctgagcctggtcgccctggggcgggagaacatagacatcgatgcctttgacaaagaatataaaatggcctacgatcgcctaacaccgagccaggtcaagtcgacacataactgcgatcggccgcccagcacaggtgtcatggagtgcagaaagacgtttggagaaccttatctgtag

SEQ ID NO: 19067 - DNA, 5721 bp, Artificial Sequence
  Description of Artificial Sequence: Synthetic coding sequence
atgatcgaggacaagggcccccgggtggccgactacttcgtggtggccggcctcacggacgtgagtaagcctctggaagaagaaatacacttcaatgacgcgtgccacaaagttgccaaacctaaggagcctatcaccgatgtctccgtgatcataaagtctctgggcgaggaggtgccccaagactacatttgtatcgatgttaccccaaccggattgagcgcggacttgaacaacggcagcttagttggacctcaaatctacctgtgctataggcgcggtagagataagcctcccctgacagacctgggcgtgctctacgattggaaggagaggctcaagcagggctgtgagataatccagtccacgccatatggacggcctgcaaatatttcaggctctacttcctctcagaggatctacatcacctaccgcagagcctccgaaaatatgacccagaacacattggccgttaccgacatttgtattatcatcccgagtaaaggcgagtcccccccccataccttctgtaaggtggataaaaacctgaacaattctatgtggggttctgcagtgtacttgtgttacaagaaaagcgtggccaaaacaaataccgttagttacaaggcaggcctgatttgccgctacccccaggaggactatgaatccttctctctccctgagtccgtccccctattctgcttgccaatgggcgcgaccatagaatgctggccttccaactccaagtatcctctacctgtgttcagcacgttcgttctgaccggcgcctcagcagagaaagtgtacggagcagcgatacagttctatgagccatatagcgaagagaatctgacagagaaacagaggctgctgctgggcctgactagcgctgatggaaaatctgacagttctaaaacaatccatacaaacaaatgtatctgtctccttagtcattggccatttttcgacgctttccgaaagttcttaaccttcctgtaccgctacagcatatccggcccccacgtgctgcctatcgagaagcacatatcccacttcatgcataaagtacctttcccttcgccacaaaggcctcgcatcctggtgcagctgagtccacacgataaccttatcttaagtcagcctgtttcatctccattgcccttatccggcgggaaattctcaaccttactacagaacttgggcccagaaaatgcagtgacacttctagtgttcgcagtaaccgaacacaagatccttattcactcattaagacctagcgttttgacatccgtgaccgaggccctggtgagcatgattttccccttccactggccatgcccatacgtccctctgtgtcctctggccctggccgatgtcctcagcgctccatgcccttttatcgtggggatagatagccgctactttgacttatacgatccaccccccgatgtctcttgcgtggacgttgacacaaatacaatctcccagatcggtgacaaaaagaatgtcgcctggaagattttacccaaaaaaccatgcaagaacctgatgaacaccctgaataacctccatcagcagctagccaaactccagcagaggcctagagacgacggattaatggatctggcgatcaacgactacgacttcaattccggcaagagactgcatatgatcgatctggagatccaggaggcttttctattcttcatggccagcatcctgaaaggatatcgaagctatctgaggcctattacccaggcgccttcagaaaccgctactgatgcagcttctctgttcgctctgcaggcttttctgaggagccgagacaggtcccaccaaaagttttataacatgatgaccaaaacacagatgttcatcagattcattgaagagtgcagctttgtgtctgacaaagacgcaagccttgcttttttcgacgactgtgtggacaaagtcgacatggacaagagtggggaagtgaggctgatcgaactggacgagagtttcaaaagcgagcataccgttttcgtcacccctcccgagattccccacctgcccaacggcgaggaacccccactgcagtactcttacaatgggtttcctgtcttgcgtaacaatctgtttgagcggcccgagggatttcttcaggcgaagaagaataagctgccttccaaaagctccagtcccaactcacctctgcccatgtttcggagaactaagcaggaaattaagtctgcccacaagatcgcgaagcgctatagttccattccacaaatgtggtccaggtgtctgctgcgccattgctatggcctctggttcatctgcttgccggcatacgtaaaggtttgccactcaaaggtcagggctttgaaaaccgcatacgacgtgctgaagaagatgcagtctaaaaaaatggaccctccggatgaggtctgctaccgaattctgatgcagctgtgtggacagtatgatcagcccgtgctggccgtccgcgtactttttgaaatgcagaaagccgggatcgacccaaatgccatcacttacgggtattacaacaaagctgtgctggagtcaacttggccctccagaagtcggagcggatattttctctggaccaaagttcgcaacgtggtgctcggggtgacccagttcaagagagcactcaaaaaacacgcccatctttcacagacaaccttatcagatgggtcagatctggacgcagttagccatgggagtatggactctggacacggtacgcacactgtggagcaagctccttttaatacagggctgattaaagtctatgcaactgacgaccgatcaagcacaggtggacagagtgaccttggctacaattctcttagcaaggatgaagtcaggcgtggtgacacatccactgaggacatccaggaagagaaggataagaagggatcggactgttcctcactatctgaatctgagagcacaaagggttctgccgactgtttgccaaaattgtcttatcaaaatagtagttccattgtgcggcttacaggcactagcaataatagtgctggcaagatctcaggtgaatccatggaatctactcctgagttattactaatctccagccttgaggacacaaacgagacccgaaatatacaatctcggtgttttaggaagcggcataaaagcgataatgaaacgaatcttcagcagcaggtcgtgtggggaaatcgaaatcggaatctatctggcggggttcttatgggcttcatgctcaatagaatcaatcaggaggccaccccgggggatatagtggaaaagttgggcgcggacgctaagattctgtcaaatgtcatcagcaagagcacgagacctaacacactggatatcgggaaaccccctctgaggtccaaacgagattcactggaaaaagagagctccgatgatgatacgccctttgacggcagcaactatctggccgataaggtcgacagcccggtgatttttgatctggaagatcttgacagcgagactgatgtgtctaaggccggctgcgtggccacccaaaatccaaagagaatccagcgcatgaactcttctttctccgtgaaacctttcgagaagactgacgtggccaccggatttgaccccctgtcactgctcgtagccgagacagaacaacagcaaaaggaagaagaagaagaggatgaggatgactccaagtctatctcaaccccttcagcacgacgcgatctagccgaggagatcgttatgtacatgaacaacatgagttctccactaaccagtcgcacaccgtctatcgacttacagcgcgcctgcgacgacaaactgaataaaaagtcgcctccgctcgtcaaagcctgcaggcggtcctctttgccaccgaatagccccaaacctgtgaggctgaccaagtctaagtcatatacaaagtctgaggaaaagccacgggatcgtctgtggtcctccccggctttcagcccgacttgtccgttccgggaggaatcacaggacactctgacccattctagcccaagttttaacctggatacactgttggttcccaagctggatgtgcttagaaacagcatgtttacggctggaaagggagtggctgagaaggcatccaagtggtattccagatttacaatgtacacgacgagtagtaaagatcagagctcggatcgtacctctctcagctccgtcggagcacaggattcggagagcacttccctcacagacgaggatgtgtgtcacgaacttgagggtcccatctctagtcaggagacgtctgctacgtccggcacaaagcggatagacttatcaagaatatccctggagagtagtgcttcactcgaggggtctctgtctaagttcgccttacctggaaagtccgaggtgacaagctcatttaacgcttcaaacaccaacatcttccaaaattatgctatggaggtattgatctctagttgcagccgttgtagaacatgcgactgccttgttcacgacgaggagattatggcagggtggacagcagacgattcaaacttgaatacaacctgcccattttgtggtaacatctttttaccgttcctcaatatcgaaattcgtgatctccgcaggcctggccgatattttctgaaaagcagtcccagcaccgaaaatatgcatttcccaagctccatttcctcgcagacaaggcagtcttgcatttccacctccgcttcaggactcgatacctctgctctctccgtgcaaggcaactttgatcttaatagtaagagcaaactccaggagaatttttgtactcgctctatacaaattcctgccaatcgatcgaagaccgccatgtcgaaatgccccatctttcccatggccaggtctataagcacatccgggcctctggataaggaggatacagggagacagaagctgatctctacagggtcacttccagccacgctgcagggcgcaactgactccctgggcttggagtggcacctgccatcccctgatcctgttactgtgccctacctgtctccactcgttgtgtggaaagaattggaatctctcctggagaatgaaggggatcacgccatcacagtcgcagatttcgtggatcaccatcctatcgtcttttggaatctggtgtggtattttcgcaggttagatcttcctagcaaccttcccggtcttatactgagcagcgaacactgtaataagtattccaaaatcccgcgacactgtatgtccgaggacagtaaatacgtgctgatacagatgctgtgggacaatatgaaactccatcaggatcctggacagccactgtatattctttggaacgcacacacacagaagtatccaatggtacatttactgcagaagagcgataacagctttaaccaagaactcctgaagtccatggtgaaatctattaagatgaatgacgtctatggaccgatgtcacagatcctggagactctgaacaagtgcccacactttaagcgacaacggtcattatacagggaaatcctgtttcttagtctcgtggccctgggacgggaaaacattgacatcgacgcatttgacaaggaatataagatggcttacgataggctgacaccatcacaggttaaaagcacacacaattgtgacaggccaccgtcaacaggggttatggaatgccgaaagacattcggagagccctatttgtag

SEQ ID NO: 19068 - DNA, 102 bp, Artificial Sequence
  Description of Artificial Sequence: Synthetic coding sequence
atcatcaagtacctgctgctgtacagcttcctgtgcgtgctgatcaagtgccaggactcctttaagatctattgctttccatgttatcccttttataactag

SEQ ID NO: 19069 - DNA, 990 bp, Artificial Sequence
  Description of Artificial Sequence: Synthetic coding sequence
atgggcgccaccggcgacgccgagcagccccggggccccagcggcgcagaaaggggcggcctcgagcttggggacgccggtgccgccgggcaactcgtgctgactaacccttggaatatcatgatcaaacaccgccaggtgcagcgcagagggcgacgctctcagatgaccacctctttcactgatcctgcaatttctatggacttactcagagccgttctacagcccagcattaatgaagagattcagacagtgttcaataaatatatgaagtttttccagaaggcggccctcaatgtgcgcgataatgtgggggaggaggtggacgccgagcagttgattcaggaggcctgtaggtcctgcttagagcaagctaagttgttattctctgacggcgagaaagttatccctaggcttacccacgagctgccgggaatcaaacggggccggcaggctgaggaggaatgcgcccaccgaggatcacccctccccaagaagcgcaaaggccggcctcccgggcatatcttgtcctctgaccgggcagccgccggcatggtgtggaaacccaagtcatgtgagccaatacggagagagggaccaaagtgggatcccgcgcggctgaatgaaagtaccacattcgttcttgggagcagagccaacaaagctttggggatgggcgggacccggggccgcatttacattaaacatccacacctgttcaaatatgccgccgatccgcaggataaacactggttagccgagcaacaccatatgagagctactggcggaaaaatggcatacctgttgatagaagaggacattcgtgacctcgcagctagcgatgactatcgcggctgtctggacctcaaactagaagaactgaaatctttcgtcttgccctcttggatggtcgagaagatgcgtaagtatatggagaccctacgaaccgaaaatgagcatagggccgtggaggcccctcctcaaacctag

SEQ ID NO: 19070 - DNA, 2271 bp, Artificial Sequence
  Description of Artificial Sequence: Synthetic coding sequence
atggtggtgacccggagcgcccgggccaaggccagcatccaggccgcatccgcagagtcaagcggccagaagtcgttcgccgctaacggcatccaggcgcatccagagagctccactgggtccgacgcccgtaccaccgcagagtcccagacgaccggcaagcagagcttaatacccagaacccccaaagcaagaaagcggaaaagccggaccaccggaagtctccctaagggcacagaaccatctacagatggggagacgtccgaagccgaaagcaattactctgtgtctgagcaccatgatactattctgcgcgtcacaaggcgccgacagattctcatagcttgtagtcccgtgagcagtgtgcgaaaaaaacctaaagtgacccccacaaaagagagctacacagaggaaattgttagcgaagcagagtctcacgtgtccggcatttctcgcatagtactgccaacggaaaagacaacgggcgccagaaggtccaaagccaaaagtctcactgacccatcacaagaaagccataccgaggcgatcagtgacgcggagacctctagttccgacatctccttctccggaatcgcgacccggagaacaaggtcaatgcagaggaaactgaaggcacaaactgagaaaaaagattccaagattgttcctggcaacgaaaagcagatagtcgggaccccagtcaatagcgaggactccgacacgcggcagacttctcatctgcaagcgcgatctctgtctgaaatcaacaaaccgaacttttataacaatgattttgacgacgacttttcccatcgttcatctgagaatatcctgacagtacacgagcaggccaatgtagagtctctgaaagaaactaagcaaaattgtaaggatcttgacgaggatgccaatggaattacagatgagggaaaggagatcaacgaaaagtccagccagttgaagaatctctcagaactgcaagacacttccctacagcagttggtgagtcaacgccatagcaccccccagaataagaacgccgtgtccgtccatagcaatctgaacagtgaagccgtgatgaaatcgctcacccagacgtttgccacagtggaagtcggacggtggaacaacaataagaagtcacctattaaggcctctgacctcacgaaattcggcgactgtggcgggtccgacgacgaggaggaaagcactgtgatcagcgtctcagaagatatgaactccgagggcaatgtagatttcgaatgtgatactaagctttatacatccgccccaaatacctcccaggggaaggataatagcgttcttctggttttgtccagcgacgagtcacaacaatccgaaaattctgagaacgaagaggacacactatgctttgtggaaaacagcggacagagagaatccctttctggggacaccgggtcactgagttgcgataacgccctctttgttatcgatacaactcccgggatgagcgcggataaaaacttttatctggaagaagaagacaaggcatccgaggtggccatagaggaggaaaaagaagaggaagaggacgagaagtcagaggaggactcttccgaccacgacgaaaatgaggacgaatttagcgacgaggaggacttcctgaactccaccaaagccaaattactgaaattaacatcttcttctatcgatccggggctctccatcaagcagctcggcggcctgtacataaatttcaacgccgacaagttgcaatcaaataaacgcacactgacgcagattaaggagaaaaagaaaaacgaactcctgcagaaagccgtgatcactcccgactttgaaaaaaaccattgcgtaccaccttatagcgagagtaagtatcaactccaaaaaaagcggcgcaaggaacgacagaagacagcaggggatggatggttcggaatgaaggcacctgaaatgaccaatgagttaaaaaatgacctaaaagctctgaaaatgagggcctcaatggatcctaagcgattctacaagaagaacgaccgtgacgggttccccaagtacttccagatcggcactattgtagacaatcctgccgatttttaccacagccgaattccaaaaaagcagcgcaaacgaaccatagttgaggagctgcttgccgacagtgaattcaggagatataatcggcggaaatattccgagattatggcggagaaagccgccaatgcagcaggcaagaagttccgaaagaagaaaaaatttcgcaactag

SEQ ID NO: 19071 - DNA, 1020 bp, Artificial Sequence
  Description of Artificial Sequence: Synthetic coding sequence
atgctgcccagcgccgtggccgcccacgccggcgcctactgggacgttgtagctagctccgcactcctcaacctgccagccgctcctggattcgggaatttgggaaagtcctttctcatcgaaaacctcctgagagtaggaggcgcaccaacacctcgtcttcagccacccgcgccgcacgatcccgcaactgcgctggctaccgctggagcccagctccgcccactgcctgctagcccggtgcccctaaaactctgtcccgccgccgagcaggtgtctcctgccggagctccctatggcacgaggtgggcgtttcaagtgctcagccccagtgctgactcagcgcgcctgccagggcgagcaccaggggatcgtgactgtacttttcagccaagcgccccagctccctccaagccctttttgctgtccaccccgcccttctattctgcgtgctgtggcgggtcatgtcgtcgaccagcctcaagcaccgctttccctcgggaagagagtatgctgcctctccttacccaggacagcaactccaaagcacgaagagggattctgagacgggcggtgttttccgaggaccagaggaaagcacttgagaaaatgtttcagaagcaaaagtatatctccaagaccgaccgaaagaagcttgcgatcaatcttgggttaaaggagagccaagttaagatctggttccagaatcgacgcatgaaatggcggaactcaaaagagaaggaggtgctgagcaaccgctgtatccaggaagtaggcctgcaagaggacccgctttcccgtagtgccctgggctttcctagcccttgtccgtccatctgggacgtaccacagcagcacagttctcctaggtggcgagagaactcaccggagccctccgagagactgattcaggagagctccggagctcctccccctgaagccaacagtctccagggcgccctctatctgtgcagtgaggaagaggccggatctaagggggtgctgactggggctgtctag

SEQ ID NO: 19072 - DNA, 1134 bp, Artificial Sequence
  Description of Artificial Sequence: Synthetic coding sequence
atgcagcactacggcgtgaacggctacagcctgcacgccatgaactccctgagcgcaatgtataatctgcatcagcaggccgctcagcaggctcagcatgcccctgactatcgcccttccgtgcatgcgctgacactggccgagcggctggccgacatcatcttggaggccaggtacgggagccagcatagaaagcagaggcgctcaaggacagcgtttaccgcccaacagctggaggcactggaaaagacatttcaaaagacacactaccctgatgtcgtgatgagagagcgtttggccatgtgcacaaatcttcccgaagcgagggtacaggtctggttcaaaaaccgtcgtgctaaatttcggaagaagcagcggtcactccagaaggagcaactccaaaagcagaaggaagctgaggggtcacacggcgagggaaaggctgaggcccccactcccgatacccagctcgacacagagcagccccctcgacttcctggatccgacccacccgcagaactccatctctccctgtccgagcaatctgcatctgagtctgctcccgaggatcagccagatagggaggaagacccacgtgcaggggctgaagatccaaaagcagagaagtcacccggcgctgacagtaagggccttgggtgtaagagggggtcacccaaggccgattcccctggctcactaactattactccggtggcacctggcggtggtttgttgggtcctagtcactcatatagctctagccctctctcgctgttcagacttcaggagcagtttcgacaacacatggcggctaccaacaatctcgttcactattctagcttcgaagtgggaggaccagcccccgctgctgcagccgcggcagcggccgttccctatctgggtgtgaacatggcccctctgggtagtttacattgccagagttattatcaaagtctctcagccgccgccgccgcccaccagggcgtgtggggaagccctcttctccccgctcccccagcaggcctggccccagccagtgctacactgaatagcaagacaacctccatcgaaaacctcagactgagagccaaacagcatgccgcctcactcggcctggataccctacctaattag

SEQ ID NO: 19073 - DNA, 1149 bp, Artificial Sequence
  Description of Artificial Sequence: Synthetic coding sequence
atgcagcactacggcgtgaacggctacagcctgcacgccatgaactccttatcagcgatgtacaaccttcatcagcaggcagcgcaacaggcgcagcatgccccagattatcgacctagcgtgcatgccctcactctggccgagagactggctggttgcaccttccaggatatcattttggaggcccgttatggttcccaacatcgtaaacagcggagatctcgaacagccttcacagcccagcagttggaggctctggagaagacctttcagaagacccactatcctgatgttgtcatgcgtgaacgcttggccatgtgtaccaaccttccagaagctcgagtacaggtgtggtttaagaataggcgggcgaaatttcgaaagaaacaaagaagcttacagaaagaacagctgcagaagcaaaaagaagccgaaggttcccatggcgagggcaaggccgaagcacctacacctgacactcagctcgatactgagcaacctccaagattgccaggctcggaccctcccgctgagctgcacctcagcctttctgagcaatccgcatcggagtctgcaccagaggaccaaccagatcgcgaggaggaccccagggcaggagcggaagaccccaaagctgaaaagtctccaggggcggattccaaaggactgggatgcaaaagaggctccccaaaagctgactctccgggtagtctcaccatcacacctgtggcccccggtggggggttgctgggaccaagccatagctactctagctctcctcttagtctgtttcgattgcaggagcagttccgtcagcatatggccgccacaaacaacctggtgcactactcgtcctttgaggtcggagggcccgcccccgctgcagcagcggctgcagctgcagtaccatatctcggtgtaaatatggcccccctcggatccctgcactgccagtcttattaccagtctctgtctgctgcagccgcagcccatcagggcgtgtgggggagtcccctgctccctgcccctcctgccggcctggcccctgcctccgccacattaaactccaaaactacctcgattgaaaacctacggctaagggcaaaacagcacgcagcctctctgggcctggatacccttccaaattag

SEQ ID NO: 19074 - DNA, 1431 bp, Artificial Sequence
  Description of Artificial Sequence: Synthetic coding sequence
atggagacccccggcgccagcgccagcagcctgctgctgcccgccgctagccgcccacccagaaagcgcgaagctggggaggcgggagccgccacttccaagcagagggtgttagacgaggaggagtatatcgaaggactgcagacagtgatccagagagactttttcccagacgttgagaagctccaggctcagaaggagtacttagaagccgaggagaacggggatctggagcgcatgcggcagattgcaatcaagttcgggagcgcacttggtaaaatgagtagagagccccccccgccgtatgttactcctgctacgtttgagacccctgaagtgcatgctggcaccggcgtcgtgggtaataagccccggccacgtggccggggccttgaggatggagaggctggcgaagaggaggagaaagaacccctacccagcctcgacgttttcttaagtagatacacgtcggaggataacgctagcttccaggagatcatggaggtcgctaaggagcgctccagagcccgccacgcatggttgtaccaagccgaagaagaatttgagaaacggcagaaggataacttggaactgccgtctgcagaacatcaggcaattgagagttcccaagcatcggtcgagacatggaagtataaagcaaaaaactcgctcatgtactatcccgagggcgttcctgacgaggagcagctgtttaagaaacctagacaagtggtgcacaagaacactcggttcttacgggacccgttttcccaagcactgagccgttgccagttacagcaagccgccgccttaaatgcccagcacaaacagggaaaggtagggccagacggcaaagaattgatcccccaggagagcccacgagttggcggattcggatttgtggctaccccttctccggctccaggggtaaacgagtcaccaatgatgacatggggtgaagtggagaacacacctctacgggtagaaggtagtgagacaccgtatgtggatcggacaccaggaccagcattcaagatcttggagcctggacggagagaacgtctggggcttaagatggcaaatgaagcagccgccaagaatagggccaagaagcaggaggcactgaggcgcgtgactgagaacctagcctcgctgactcccaaagggttatcccctgcaatgagccccgccttacagaggcttgtgtcgaggactgcttcgaaatataccgaccgcgcactcagagctagttacacccctagccctgctcgcagcacccaccttaaaacgcctgcttctggactgcagacacccaccagcactcccgcacccggtagtgctacacggactcccctcacacaagaccccgcctccataactgacaacctgcttcagctcccggcaagacggaaggcttctgatttcttctag

SEQ ID NO: 19075 - DNA, 747 bp, Artificial Sequence
  Description of Artificial Sequence: Synthetic coding sequence
tgatgcagcacctggagcttcctggcccccctgccccagcagttccatttgaaaattctattccttccactcaccccactaaggcttctgctgctgtctgcccaggtgctgattgtcgtgccatttcgggaagcagcccttcgcgtcgtgcagttattcatttccctgctcgagggcgattctaagaaaaaaatcattgtgtcgaataagaaacgctttcaaggagagtacgggtctgatccggaggagcgtccccccaacctgaaaaggcccgaggactacgaggccgttttcgtcgggaatatcgacgatcacttcagaatcggagtggcaatcctgcagcgcagcatccgcctctacgccccattttattctagcgatatcctgattgccagcccattgggccttaggacgattataggcggcgagggagaaaagaagagggacttcgatttcctaagttctatcgagctgttgatcattgatcaagccgatatttacctgatgcaaaattgggaacacgtgctccatctgatgaatcatatgaatctgttgcccctggactctcatggtgtcgatttttcccgcgtgcgaatgtggagcctgaataactggtccaaatattaccgccagactctgttgtttggggcactgcaggacgcccagatcaactctgtttttaacaagtattgcgtgaacatgcagggacaggtgggctctcgactggtgagcagcgtcagctcatag

SEQ ID NO: 19076 - DNA, 2271 bp, Artificial Sequence
  Description of Artificial Sequence: Synthetic coding sequence
atgggcaagcggggcagccggagccagagccagctgctgaacaccctaactaagaagcagaagaagcatctccgtgacttcggggaggagcatccgttctacgaccgagtctcgcgcaaggaggcaaagccgcagatttgtcaattatctgaatctagtgactcttctgatagcgagagcgactctgagtccgaacctcagcaagtttcgggttaccatcgactcctggctacattaaagaatgtgagcgaagaggaagaggaagacgaggaggaagaagaggaggaggactctatagtggatgatgccgagatgaacgacgaggacggtggctcagacgtatctgtcgaggaggagatggcggcagaaagtacagagtctcccgagaatgtggccttatccgcagaccccgaggggaaagaagatggagaagaacccccggggacgtcacaaaccagccccgaagagttcactgacgctaaacatgaatccttattttcactggaaactaattttctggaggaggaaagtggcgataattcctccctcaaagcctcccaggacccgtttctgcagcacgtgaataaggaattaaaagagaaagcaatacaagccgtcgctactaacccaaagaccacccacgaactcaagtggcctatactcggacagctcttctttagttctaaatttcagaagctagagacgttcaagccaccaaaagatatcgacctgaagtcgcttcacctgcagaaaccactagaatccacctggactaaaactaacagtcagtttctgtccggccctcagaagtcctcttccccattcactcctctgcagaaggaattgtttctgatcatgaatagctatagggacctgttctacccagagcgtacagcgcttaagaatggagaagagattagacacgtgtactgcttgcacgtgatcaaccatatcttaaaagcgaatgcgcaagtccttggtaataacagcaggcggaggtcccaaaagttcggtgttggagacgacgacgactttcgtgatcagggactgacacgcccaaaagtcctgattgttgtgccatttagagaggctgccttgcgagtggtccagctttttatatctctgcttgagggcgactcaaaaaaaaagatcatagtgagtaacaaaaaaagattccagggtgaatacggctcggatcccgaggagaggccacccaatctgaaaaggccggaagactacgaagcggtgttcgtagggaatatagatgatcactttcgaatcggcgttgccatcctgcagaggtccattagattatatgcgccattttactcatcggatattcttatcgcctctcctctgggccttcgcaccatcatcgggggcgagggcgagaagaaaagagacttcgatttcctatccagcatcgaactgttgatcatcgatcaggccgacatctatctgatgcaaaactgggaacacgtcctccacttgatgaaccatatgaacctgcttccgttagatagtcatggcgtggacttcagtcgcgtgcggatgtggagcctgaacaattggagtaaatactatcggcagactctcttgttcggagccttgcaggacgcgcagattaatagtgtttttaataagtactgcgtcaatatgcaggggcaggttgccgtaaggaatgtgcctatgacagggagcatcagtcatgttctagtgcagctgccccatgtctttcagcgcatggaagctgagaacctggcctcagtgattgatgcccgctttaatttttttgtgaacaaaatactgccgcagtatagagacgccgtgatgagccatacactgatttacatcccgtcttactttgattttgtcagactgaggaattatttcaaaaaggaagagctcaacttcacccatatttgtgaatatacccagaagtctggagtgtccagggcccggcacttttttctgcagggagagaagcagttcctgctatttacagagaggtttcacttctataaacgttatacgatcaaagggattcgcaacctaatcttctatgagctgcctacctatccccatttctactcagaaatctgcaatatgttgcgcgcgactaatcgcggcgaagaagcaacttggacgtgcaccgtgctttactcaaaatatgacgcccaacgccttgccgccgttgtcggagtggagcgtgctgcccagatgcttcaatcaaacaaaaacgttcatcttttcattaccggcgaaaagtag

SEQ ID NO: 19077 - DNA, 942 bp, Artificial Sequence
  Description of Artificial Sequence: Synthetic coding sequence
atgcccaaggtgaagagcggcgccatcggccggcggcggggccggcaggaacaaaggcgcgaactcaaatccgcaggcggcctgatgttcaataccggcattggccagcacattctgaaaaatccattgatcattaattccataatagataaagccgcactgcggcctacagacgtggtactggaagttggacctggcactggaaatatgactgtgaaactcttggaaaaggccaaaaaggtggttgcatgtgagctcgatcccagactagtggccgagctgcacaaacgagtccaaggtaccccagtggcatccaaattgcaggtactggtgggcgatgtactgaaaactgatctgccttttttcgacacgtgcgttgcaaatctcccataccagatatcctctcccttcgtcttcaagctgttactgcataggccgttttttcgttgtgccattctcatgttccagagggagtttgcactgcggctcgtggctaaacctggcgataaattatactgccgcctgagcattaacacacagttattagctcgcgtggaccacctgatgaaggtaggcaagaacaattttcggcccccacctaaagtcgagtcatccgtagtcagaatagagcctaagaacccaccaccaccgatcaattttcaagagtgggatggattggtgcgtataacttttgtccgaaagaataaaacgttgtctgccgcttttaagagctccgcggtgcagcagcttctggaaaagaattaccgcatacactgttccgtgcataatatcatcatcccagaagatttctccatcgccgataagatccaacagattctgacctccactggcttctctgacaagagggccaggagcatggacatagatgatttcatcagactgttgcatggttttaatgccgaaggtatacatttctcctag

SEQ ID NO: 19078 - DNA, 4719 bp, Artificial Sequence
  Description of Artificial Sequence: Synthetic coding sequence
atggccgaccggggctgccccctggaggccgcccccctgcccgccgaagtcagggaaagcttagcagagttagaacttgagctatcagagggcgatattacgcagaaaggctacgagaagaagcgggcaaaactgcttgcaagatacattcctctcattcagggcattgacccctcgctccaggctgaaaatagaatccccgggccctctcagaccactgccgcagcccctaagcagcaaaaatctaggccaaccgcatcccgcgatgagcggttcaggtccgatgtgcacactgaagccgtccaggcggccctggctaagtacaaggaacgcaaaatgcctatgcccagcaaacgtcggagtgtgttagtgcactcgtccgtagaaacatacacacccccagacaccagcagtgcatccgaggacgaagggtctctgaggagaccggggagactcacctccaccccgctgcagagccactcctcagtagaaccttggctggatcgggtaatacaaggaagctccacctctagctcggcctcttccacgtcttcacacccaggcgggaggccaactactgcccctagcgctgctgccacccccggggcagccgccacaacagcacttgcggggctggaagcccacactcatatagccgacctgcacagcgctcctcccgacgtgacaacagggctggttgaacattcttactttgaacggccccaagtcgcctcagtgcgcagtgtcccgcgcggttgcagcgggtcgatgctggagaccgccgatggagtaccggtgaacagcagagtgtcttccaaaattcagcaattactcaatactctgaagagacccaaaaggccaccattgaaagagtttttcgtggacgacttcgaggaactccttgaggttcagcagcctgacccaaatcaaccaaaacctgaggggtcggaaacctcagttctgagaggagagccactgacagctggagttccacgccctccatcccttctggccaccctgcaaagatggggaacaacacaaccaaagtccccatgtttaaccgcattagataccaccggcaaagcagtgtatacactgacttatggcaaactgtggtctaggtctctgaagttggcctacactctactgaacaagctcaccagcaagaatgaacccctgctcaaacccggtgatagggtcgccctcgtattccctaacagcgaccccgttatgttcatggttgcattttacggctgcctgcttgctgagctggttcccgtgcccatcgaagtgcctctcacccggaaggacgccgggagccagcaggtcggtttcttgcttggtagttgtggggtgttcctggctcttaccactgatgcatgtcaaaagggcctgcctaaggcccagacgggcgaggtggccgcattcaaaggctggccgcctttgtcctggctggtgattgatggcaagcatttagccaagccacctaaggactggcacccactggctcaggatacaggaactggcacagcctacatcgagtacaaaacaagcaaggaggggagcaccgtgggagttaccgtctcccacgcatctctattggcccagtgccgggctctcactcaggcttgcggttactcggaggccgagacccttacgaacgtgctagattttaaacgggacgcaggcctttggcacggggtcttaacgagtgttatgaatagaatgcacgtcgtaagcgtgccctatgcgcttatgaaggccaaccccctcagctggatacagaaagtctgcttctataaagcaagggccgcattggtgaagagccgcgatatgcattggagcctattggctcagagagggcagcgtgatgtctctttgtccagcctgcggatgttgatcgtagccgacggagccaatccgtggtccatttcttcatgtgatgcctttctgaacgtgttccagtcccgcggcctgagaccagaagttatctgcccttgtgcgagttcacccgaagcactgaccgtggcaatccgaagaccccccgaccttggaggaccccctccgcggaaagccgttttaagtatgaatggtctgtcttatggagtaatacgcgtggacactgaggagaaattgtcagttcttacagtgcaagacgttgggcaggttatgcccggggccaatgtctgcgtggtgaaattagagggtacaccatacttgtgtaaaacagacgaagtcggagaaatatgcgtcagttcatccgccaccggcactgcctactatggtctgctcggtattacgaaaaacgtgtttgaggccgtgccggtgacgacaggaggagcccccatcttcgaccggccctttacccggacgggtctgctgggatttatcggccctgataaccttgtcttcatagtgggtaaactggacggcttgatggtcactggcgttagaaggcataacgccgatgatgtggtcgcgactgcacttgccgttgaaccaatgaagttcgtctatcgtggacgcatcgccgtcttctcagtcacggtcctccacgacgaccggatagtgctggtcgcagagcagcggccggatgcgagcgaggaggacagcttccagtggatgagcagggtgttacaggctatcgattccatccatcaggttggcgtgtattgcctggccttggtgcctgcaaacaccttacctaaagctcccctaggagggatacacatctcagagaccaagcagcgctttctggagggcaccctgcacccctgcaacgtcctcatgtgcccacacacatgcgttacaaacctgccgaagcccaggcagaagcaacccgaggtgggtcctgctagcatgatcgtagggaatcttgtggccggcaagaggatagcccaggcctcaggaagagaacttgctcacttagaggatagcgaccaggccagaaaatttctctttctcgcagacgtcctgcagtggcgggcccacactactcccgatcatcctctctttctgctgctcaacgccaaggggaccgtgacaagcacagccacttgcgtccagctgcacaagcgggcagaacgcgttgcggccgctcttatggagaaagggagactgagcgttggagaccacgtggccctcgtctatccccccggcgtcgatctcattgccgcgttctatggctgtctgtattgcggttgtgtccccgtaactgtgaggccacctcacccgcagaacctcggtaccactctgcctactgtgaaaatgatagtcgaggttagcaagtccgcatgcgtactcacaacacaggcagtgacccgactgctgcgtagtaaagaggctgccgctgctgtggatattcgcacatggccaaccatccttgacaccgatgatatccccaaaaagaaaatagcctcagttttccgtccccccagccctgatgtattagcgtaccttgactttagtgtttccactaccggaattctggcaggggtcaaaatgtctcatgcagccactagtgcgctgtgcaggagcataaagctgcagtgtgaattgtatccatcccgacagatagctatctgcctcgatccctattgtggcttaggctttgctttgtggtgcttgtgcagcgtgtatagcgggcatcagagtgtacttgtccctcctctggaactagagagcaacgtgtctctctggctgtccgccgtctcccagtacaaggcgcgcgtgacattttgttcatactccgtaatggagatgtgcaccaaagggctcggcgcccagacgggagtgctgcgtatgaagggagtgaacctcagttgcgttcgaacatgtatggtggtggccgaggagaggccgcggatcgcattgacccagagctttagcaagctgtttaaggatctgggtctacccgcaagggctgtgagtacaactttcggatgccgcgtgaacgttgccatttgtctgcagggcaccgccggccctgatcctacaacagtgtatgtggatatgagagccctgcggcatgaccgagtccggctcgtggagcgtgggtcgccacatagcctccccctgatggaatccgggaaaatcctgccaggggtaaaagtgattattgcccacaccgagacaaaaggccccttgggtgatagccacctgggggagatatgggtctctagtccacacaacgccaccggttactacactgtctatggggaagaggctctccacgccgaccatttcagtgccagactttcatttggcgatacacaaaccatttgggctcgcactggttatctaggctttctcagacgcaccgaactgaccgatgcctccggtggtcgccacgacgctctgtatgttgttggaagcttggacgagacccttgaactgagaggcatgaggtaccatcccatcgacatcgaaacttccgtgatccgcgcccacagatctattgccgagtgcgccgtgtttacctggaccaatctgctggtggtggtggtagaactggacggcctcgagcaagacgccctggatctcgtggctctcgtcacaaacgtcgttctggaagaacactacctcgtagtgggcgtggtagtgatcgtggatccgggggtgatccccataaattcaagaggggaaaagcaacggatgcatctgcgagatggcttcctcgcagatcaactggaccccatctacgtcgcctataacatgtag

SEQ ID NO: 19079 - DNA, 2394 bp, Artificial Sequence
  Description of Artificial Sequence: Synthetic coding sequence
atggccgaccggggctgccccctggaggccgcccccctgcccgccgaggtacgtgaatccttggccgagttggagctcgaactgtcagagggggacataacacagaagggttacgagaagaaacgggccaaattgcttgccaggtacattcccctgatccaaggcatcgaccccagtctccaggcggagaatcgtataccaggcccttcgcagacgaccgcggccgcacctaagcaacagaagtcgcgccccacggctagcagggatgaaaggtttcgctcagacgttcacacagaagctgtacaggcagctcttgcaaagtacaaagagcgaaaaatgccaatgccaagcaaacgacggagcgtactggtacattccagcgtggagacgtacaccccaccagacacttctagtgctagtgaggatgaaggttctctccgacgtcccggccggctgaccagcacgccgctgcagtctcatagtagtgttgaaccatggctggacagagtgatccagggcagctccactagctcctcagcaagctctactagctcccatcctggcgggaggccgactaccgccccaagcgctgccgcaaccccgggcgccgcagccacaaccgctctggctggtctcgaggcccacacccacattggagttcctgtcaactcaagagtgtcatctaaaatccagcagctgctgaatacgctcaagcgacccaagcgacccccccttaaagagtttttcgtggacgacttcgaggagctgctggaggtccagcagcccgaccccaatcagcccaaacctgagggatcggaaaccagcgttttgaggggagaaccactgacggccggcgtgcccagaccaccaagcctcctggccactctgcagaggtggggaaccactcaaccgaagagtccctgtttaaccgcccttgatacaacaggcaaagccgtgtacaccctcacctacgggaaattgtggtctcgctcgcttaaactcgcctataccctcctcaataaattgacaagtaaaaacgagcctctcctgaaacctggcgaccgagtggctctcgtgtttcccaattctgacccagtaatgtttatggtcgccttctacggatgcttattagccgagctagtccccgtcccgattgaagtgcccctgactcggaaggatgctggctctcaacaggtgggtttcctgcttgggtcttgcggcgtgtttctagcactcacaacagatgcatgccaaaagggcctgccgaaagctcagaccggagaagtggctgcctttaaaggatggccgccattaagctggctggtcatcgatgggaaacacctggcgaagcccccaaaggattggcaccctttggctcaggacactggcactgggacagcgtacatcgaatacaagaccagcaaggaaggctcaacagttggtgttaccgttagccacgcttctctgctggcccagtgtagggcattgacccaggcatgcggctactccgaggccgaaactctcacaaatgtcctggattttaaacgggatgctggcctctggcacggagtcctcacatccgtgatgaacagaatgcacgtggtgagcgtcccttacgccctcatgaaggctaatcccctgtcttggatccaaaaggtgtgcttctataaagctcgggcagctctggtaaagtctcgagatatgcattggtccctgcttgcccagagagggcagagagatgtttcattgtcatcactaaggatgctgatcgtggcagatggagcgaatccatggagcattagtagctgcgacgcctttctgaacgtgtttcagtcacggggtctgagaccagaggttatatgtccatgtgcttcttcgcctgaggctctgacagttgccatcagacggcctcccgatctgggagggcccccccctcggaaggctgtgctgtctatgaacggcctatcttatggagttatccgcgtggacacagaggaaaaattgtcggtcctcactgtccaggacgtgggacaggtcatgccgggtgccaatgtttgcgtggtgaagcttgagggtactccctacctgtgcaagactgacgaagtaggggaaatatgtgtatccagcagcgccaccggcacggcttactacgggctgctcgggatcaccaagaatgtgtttgaagccgtgcctgtgacaactgggggcgctcctatcttcgacaggccattcacccggacaggcctgcttggattcatcgggcccgacaatctggtcttcatcgtgggcaaactcgacgggttgatggtaacgggggttcggcgacataacgcagatgacgtggtagctacagccctggctgtggaacctatgaagtttgtctaccgcggatag

SEQ ID NO: 19080 - DNA, 4704 bp, Artificial Sequence
  Description of Artificial Sequence: Synthetic coding sequence
atggccgaccggggctgccccctggaggccgcccccctgcccgccgaagtgcgagagtcccttgctgagctggaactcgagctgtcggaaggcgacattacccagaaggggtacgagaagaagagggctaaactgctcgcgcggtatatcccactgatccagggaatagatccctccttacaagcagaaaaccggatcccagggccctcacaaacgacggccgcagctcctaagcagcaaaagtcccgcccgaccgcatcccgagacgaaaggtttcgcagcgacgtgcatactgaagccgtccaggctgcactcgctaagtacaaagagaggaagatgccaatgccaagcaagaggcgttcagtgctggtgcattcatccgtggagacctacacccctcctgacacttcttcagcttcggaagacgagggaagccttaggagaccgggcagactgacctccacccccttgcagtcgcactcatccgtcgagccttggctggatcgggtgattcagggttccagtacaagttctagtgcttctagtacctctagccaccctggagggcggcctaccaccgctccttccgccgccgcaacgcccggtgcagccgccaccactgccctcgcggggctggaggcacatacccatatcgacttgcatagcgcgccacccgacgtgaccacaggactcgttgagcatagctatttcgaaaggccacaggtcgccagtgttcggtctgtcccgcggggatgttccggttccatgttggagacagccgatggagtccctgtcaactcaagagtatcaagcaagatacagcaactgctgaacacactgaagcggcccaagagaccacctctcaaggaattctttgtagatgactttgaggaattactagaagaccccaaccagcccaagcccgagggatccgagacttccgttctgaggggcgagccccttaccgccggcgtccctcgccccccaagccttctggcaaccctgcagcgctggggtaccacacaacctaagtctccatgtctgacggccctcgacacaacaggcaaagcggtgtacaccctgacgtatggaaagttgtggtccagatccttgaagctggcttataccctgttgaataagctgacttctaaaaacgagcccctcttaaagcccggggaccgagtcgcgctggtctttcccaattcggatcccgtgatgttcatggtggccttttatggatgcttgctggctgaactcgttccagtccctattgaagtccccctgaccaggaaagatgctggttcccagcaggttgggttccttttgggaagttgtggcgtctttcttgctttgacgacagacgcatgtcaaaaggggctccccaaggcgcagactggtgaggttgcagcttttaagggatggcctccgctcagctggttagtgatcgacgggaagcaccttgctaaacctcccaaggactggcacccactagcacaggataccggtactggcaccgcttacatcgaatataagacgagtaaagagggctcgacagtgggtgtgaccgtcagccacgcttcgctgctggcccagtgcagagctctgacacaggcctgcggctatagtgaggcggaaacccttaccaatgttctggattttaagagggatgcagggctctggcacggagtcctgacatccgtcatgaacagaatgcacgttgtgagcgtgccgtacgccttgatgaaggctaacccgctgtcttggatacagaaagtatgtttttacaaagctagggctgcattggttaaatcgcgcgacatgcattggtctctgctggctcagaggggacaaagggacgtttcactatcttcactcagaatgcttatagtggcagatggggcgaatccctggtctatcagctcttgcgatgcattcctgaatgttttccagagcagagggctccgccccgaagtgatttgtccatgtgccagtagtcctgaggcacttaccgttgccatccgccgcccaccagatctgggcggaccacctccacgcaaagccgtcctgagtatgaacggactgtcatatggcgtgatccgggttgacacggaggaaaagttatccgtgctcacagtgcaagacgtaggccaggtaatgccgggtgctaacgtgtgcgttgttaagctggagggcaccccctacctctgtaagactgatgaggtgggggagatctgtgtgagctcgagtgccacaggcacagcgtattacgggttactgggcatcaccaagaacgtcttcgaagctgtacccgtgaccacgggcggagcacctatattcgaccgcccatttacccgcacaggtttgctggggtttatcggccctgataatttggtgttcattgtgggtaaactggacggattgatggtcactggagtgcgccgacacaacgcagacgacgtggtcgcaaccgccctggccgttgagcctatgaagttcgtgtaccgcggccggatcgctgtgttttccgtaacagtgctgcacgacgatcgcattgtcttggtcgccgagcagcggcccgacgccagtgaggaagattcattccagtggatgtcaagagttcttcaggctatcgattctatccaccaggtgggggtttactgcctagctctggtacccgccaacaccctgcccaaggcacccttggggggtatccacatcagtgagaccaaacaaaggtttctcgaaggaacactccacccttgtaacgtactgatgtgcccacatacttgtgttactaacctcccgaagccaagacaaaagcagccagaggtgggccctgccagcatgatagtcggaaacttggttgctgggaaacgtatcgcacaagctagtggacgggagcttgcccatctcgaagactcagaccaggctcggaagttcctgtttctcgccgatgttttacagtggagagcccatacaacaccagaccatccgctttttttgcttttgaatgccaaaggaactgtaacgagcactgccacatgcgttcagctgcataaacgcgcggaacgtgtggcagctgctttgatggaaaagggccggctgtcagtcggcgatcacgtcgcacttgtttatcctccgggcgtcgacctgatcgcagcattctatgggtgtctgtattgcggctgtgtgcctgtcacagtaagacctcctcacccacagaatttaggcacaaccctgcccactgttaaaatgatcgtcgaagtgtcaaaaagcgcctgcgtgctcactacccaggctgtgactaggctgctgcggtccaaagaggccgctgccgccgtggatattcgaacctggccgaccatactggataccgacgacatacctaagaaaaagatagcaagcgtgttccggcccccctctcctgacgtcctcgcctacttggatttcagtgtatcgacaacggggatcttagctggagttaaaatgagccacgctgcaacttccgccttgtgtagatccatcaaactccagtgcgaactgtatccgagccgacagattgcaatctgtcttgacccttactgcggcctgggattcgcgttgtggtgcctgtgctccgtttactcaggccaccagtccgtcctcgtaccccctctggagctagagagtaacgtttccctctggctgtcggcagtgtctcaatacaaagcccgcgtcaccttctgctcgtattccgtgatggaaatgtgcaccaagggcctcggcgcccagaccggagtcctccgcatgaaaggtgtgaatctctcttgcgttcgcacctgcatggtggtggctgaggagagacctaggatcgctctgacacagagtttctccaaacttttcaaggacctgggcttgccagcccgagctgtttcaactaccttcggatgtcgcgtgaacgtggccatctgcctacagggaactgctggacccgatcctacaaccgtttacgtggacatgagagccctgaggcatgatcgggttcgtctagttgagagagggagccctcattcgttgcctttgatggagtctggaaagatactgccaggggtaaaggttatcatagcccacacagaaaccaaaggacccctaggtgatagtcacctgggcgagatctgggtgtcatcgccccacaacgccacaggttattatacagtttatggcgaggaagcattgcatgctgaccatttttcggcccgcctgagctttggcgacacccagactatctgggcgagaacggggtacctgggctttcttcgtcgcaccgaattgacagacgcctcaggtggaaggcatgatgccctttacgttgtaggatctcttgatgaaacgctggagcttcgaggaatgaggtaccaccctatcgatattgagacctctgtaatccgagcccacaggtccatcgcagaatgtgccgtttttacttggactaaccttctggtcgtagtagtggagctggatggactggaacaggacgctctcgacctcgtggccctcgtgacaaatgtcgtgctggaagaacactatctagtcgtgggcgttgtggtgatcgtcgacccaggggtgatcccgattaattcgcggggcgaaaagcagcgaatgcatttaagagacgggttccttgcagatcagctagatccaatttatgtggcttataacatgtag

SEQ ID NO: 19081 - DNA, 4716 bp, Artificial Sequence
  Description of Artificial Sequence: Synthetic coding sequence
atggccgaccggggctgccccctggaggccgcccccctgcccgccgaggttcgggagtcattagctgaactcgaactggagctctctgagggggacattactcaaaagggctatgagaaaaagcgtgccaagctgcttgcgcggtatatccccctgatccagggcatcgacccctctctccaggcagagaaccggattcctggccccagccaaaccactgccgccgcacctaagcaacagaagagtagacctaccgcttcgagggacgaaagatttcgctctgacgttcatactgaagctgtccaggccgctctggcaaaatacaaggaacgtaagatgccgatgccttctaagagaaggtccgtcctggttcactcgtctgtggaaacatatacgcctcctgacacctcttctgcatccgaggacgaggggagtctcaggagacccggtagacttacatctaccccactgcaaagtcactcctcggtggaaccctggctggatagggttattcagggctccagcacctcttcatccgcttcctcaacatcctctcatccgggcggaagacctactaccgcgccaagtgctgccgcaacacccggggcggccgcaacgacagccctggcaggcctggaggcgcacacacacatagaccttcactcggctcctcccgacgtgactactgggctggttgagcactcctacttcgaaagaccacaggtagcatccgtgaggagcgtgcctcgtggctgcagcggctctatgcttgaaactgcagacggtgtgcctgtcaacagtcgggtttctagcaaaatccaacaattgctgaatacactcaaaaggccaaagcgccctccactgaaggagtttttcgtggacgactttgaagagctcttagaggttcagcagcctgatcctaaccagccgaagcctgagggctcagagacctcagtccttcgtggggaaccgttaactgcaggggtgcccaggcccccaagcttgctggccaccttgcagcgctggggaactacgcaacccaagagtccgtgtctcaccgcgctcgacacaacaggcaaagcagtgtacaccctgacctatggaaaattgtggtccaggtcgctgaaactggcttacactctcctgaataagctgacgtctaaaaacgagcctttgctcaagcctggcgatagagttgcgctggtgttccctaactccgaccccgtcatgttcatggtcgcattctacggctgtctgctggccgaactggtacctgtccctattgaagttccactcaccagaaaggacgctggaagtcagcaggtgggatttctgttgggtagttgcggcgtctttctggcactcacgaccgatgcatgccagaaaggactccccaaggcccaaacgggcgaagttgcagctttcaagggatggcctcctctgagctggctggtgattgacggaaagcatcttgctaagcccccgaaggactggcaccctctggcccaggataccggtaccgggactgcatacattgagtacaaaaccagtaaagaaggctctacagtgggtgtaactgtaagccacgcttcactattggcgcaatgcagagcgctgacccaggcttgcggatactctgaggcagagacactgaccaatgtactggattttaagcgggatgctgggctttggcatggtgtcctcacctctgtgatgaaccggatgcacgtggtgtccgtgccttatgccctgatgaaggctaaccccctaagctggatccagaaggtgtgtttctacaaggctagagctgctttagttaaaagtcgggatatgcactggtctttgctagctcaacgtgggcagcgagacgtgagcctcagttcattacgcatgctgattgtggccgatggagcaaacccctggagtatcagtagctgcgacgctttcttgaatgtattccagtcccgcgggctgcggcccgaggtgatatgtccatgcgcctcatctcctgaagctctcactgttgccattcgccggccaccagacttgggcggccctccgccacgcaaggctgtgttgtcaatgaacgggcttagctacggagtcataagagttgacactgaagaaaaattaagcgttctgactgtgcaagacgttggtcaggtgatgccaggagctaatgtgtgtgtcgtaaaacttgaaggcacgccttatctgtgtaagaccgacgaggtcggcgagatttgcgtatcatcatctgcaacaggcaccgcgtattatggcctgctggggattacgaagaacgtctttgaagccgttcccgtgaccactgggggtgcgcctatctttgatcgaccttttacccgcacaggccttttggggttcattgggccagataatctggtctttatcgtgggcaaactggatggcctgatggtcaccggcgtgcgcaggcacaacgcggacgacgtggtcgctaccgctctagctgttgaacccatgaagtttgtttaccggggtagaatcgcagtattctctgtgaccgtgttacacgatgatcggatcgtcctagtagctgagcagcgtcctgatgctagcgaagaagatagcttccagtggatgtcaagagttttgcaggcaattgactccatccaccaggtgggcgtatactgcctggccctggtgcccgcaaatacactgcccaaagcaccattaggcgggattcatatcagcgagactaaacaacgctttctggaggggacccttcacccttgcaacgtgctcatgtgccctcacacctgcgtgactaacctccccaaaccacgccaaaagcaacccgaggtgggccctgctagcatgatagttggaaatcttgttgccgggaaaaggatcgcacaagcctctggtagggagcttgcacacctggaggatagcgatcaggctcggaaattcctctttcttgcagatgtgctgcagtggcgcgcccacacaactccagaccaccctctgttccttctgttaaacgccaaaggcactgtgacatccacagccacttgcgttcaattgcataagagagctgaacgcgtggctgctgctcttatggagaagggaagactcagcgttggggatcacgtagctcttgtctatccacctggggtcgacctgattgcagcattctacggctgtctgtattgtgggtgtgtgccagtgacagtcagaccccctcatccccagaatcttggaaccactctgcccactgttaaaatgatcgtggaagtttccaagtccgcctgtgtccttaccacgcaagccgtgacgcgcctgttgcgctcaaaggaggcagccgcagctgtggacatccgcacctggcctactatcctggatactgacgatattccaaaaaagaagattgccagtgtcttccgacccccaagtccagatgtgctcgcttacctagatttttcagtttctaccaccgggatcctggcaggcgtgaagatgtcccatgccgccacgtctgccctgtgcaggtccataaaactacagtgcgagctgtatccatctcgtcagatcgccatctgtctggacccatactgtgggttaggtttcgcgctgtggtgtctctgtagcgtttacagcggccatcaaagcgtcctggtcccccccctggaactcgagtcaaatgtgtcgttatggttgtccgctgtatctcagtacaaagcgcgcgttacattttgttcttactcagtgatggagatgtgcacaaaagggttaggcgcccaaactggggtgttaagaatgaaaggcgtcaacctgtcgtgcgtgagaacatgcatggttgtggcagaagaacggcccaggattgcacttacacagagttttagcaagctgttcaaggatctggggctgccagcccgggcagtaagcaccacttttggatgtcgtgtaaacgtcgcaatatgcctgcaaggaactgcaggacctgatcctacaaccgtttacgtggacatgcgagccctgcgtcacgatcgcgtccgccttgtcgagcgcggttccccccactcccttcccctgatggagagcggtaagattctgcctggagtgaaggtgattatagcccacactgaaacaaaagggcccctgggggattcgcaccttggcgagatctgggtatcaagcccacataatgcaacaggatactacactgtgtatggagaagaagctctacatgccgaccacttcagtgcacgactaagttttggagacactcagactatctgggcccgaacaggatacctcggcttcctaaggagaactgagctcaccgacgcatccggtggcaggcacgatgcattgtatgtcgtgggttcactggacgagaccctggaattacggggaatgcggtatcatccaattgatatagagactagtgtaatcagagcacatcggtccattgcagagtgcgctgtgttcacatggacgaatctgctcgtggtggtcgtggaactggacgggctggaacaggacgctttggatctggtcgcacttgtgactaacgttgtgctcgaagagcactatttggtggtcggtgtagttgtcatcgtggatcccggtgtgataccgataaatagcagaggtgagaaacaacggatgcacctaagagatggtttcttggcggaccagttggacccaatctacgtcgcgtacaacatgtag

SEQ ID NO: 19082 - DNA, 3333 bp, Artificial Sequence
  Description of Artificial Sequence: Synthetic coding sequence
atggccgaccggggctgccccctggaggccgcccccctgcccgccgaggtgcgggagtctctagctgagctggagttggaactatcagaggacgtgcacactgaggccgtgcaggcggcactggctaagtacaaagaaaggaaaatgcctatgcccagtaaaaggcgtagcgttttagtccacagctctgtcgagacttatactcccccagacacctcttccgctagcgaggacgaaggaagtttacggcgacccggccggttgacttccactcccctgcagtcccattctagtgtagagccttggcttgatagggtcatccaaggatcgtcaaccagttcctctgcttccagcactagctcccatcctggtggcagaccaacaacagccccgtcagccgcagccacgcccggtgctgctgccaccactgccctggccgggctggaagcccacactcacatagacctgcacagtgctccacctgatgtgactacagggttggtagaacactcctactttgagaggcctcaagttgccagcgttcggagcgttccgcgaggttgttcgggcagcatgcttgaaacagccgatggcgtgccagtgaatagtcgcgtgagctccaagattcagcaactcctgaataccctgaagaggccaaaacggccacccctcaaggagttcttcgtggacgattttgaggagttgctggaagtacagcagcctgacccaaaccagccaaaaccagagggatcagaaacctccgttttgcggggcgagcccctgacagccggtgtgcctaggcctccttctctgctcgccactctacaacggtgggggacaacacagccgaagtctccctgcctcactgcactcgacaccaccggaaaagcagtttacacccttacgtatggtaagctatggagtcggagcttgaaattagcatacacactcctgaataaactaaccagcaagaatgagcccctcctgaaacctggagatcgggtggcgctcgtgttccctaactctgatcctgtgatgttcatggtggctttttatggatgccttctggcggaattggtgccagtccctatcgaggtgcctctgaccaggaaagacgcaggtagccagcaagttggcttcctactggggtcttgtggcgtcttcctcgcactaacaaccgatgcatgtcaaaaaggcttacccaaagcacaaacaggagaggttgccgcatttaaaggttggcctcctctatcatggctggttatcgacggtaagcaccttgcaaagccccccaaagactggcaccccctggcacaggatactggaacgggaacagcatacattgaatataaaacttccaaagagggctcaacagtgggtgtgaccgtctcccatgccagcctactcgcgcagtgcagggccctgacacaagcctgtggctatagcgaagctgagactttaactaatgtgctggacttcaagcgggatgcagggctctggcacggcgtgcttacatcggtgatgaacagaatgcatgtggtgtcggtcccatatgcactgatgaaagcaaacccattgagctggatacaaaaggtgtgcttctacaaagcaagggctgctctggtcaaatctagagatatgcactggtcattgctggcccagagaggacaacgcgacgtgtccctatcgtctcttcgtatgttgatcgttgccgacggagccaacccctggtctatctcgtcctgcgatgcctttctgaacgtgttccaatctagaggcttgcgtccggaggtgatctgtccttgtgcatccagcccggaagctcttaccgtcgctatccggcggccaccagacctgggtggccccccacctagaaaagctgtactatctatgaacggcctgtcctacggcgtgatcagggttgatacagaagagaagctgtcggtgctgactgtgcaggacgttggacaggtgatgcccggcgcaaatgtctgcgtggtgaagctagagggcaccccttatctctgcaaaaccgacgaggtcggagaaatctgtgtctcatcaagtgccacaggcacagcctattacggtctcttggggattacgaaaaacgtattcgaggccgtgcccgttaccacaggtggagctcccattttcgaccgccctttcacccgtacaggtctgctgggcttcatcggaccggacaacctggtgttcattgtgggaaagctggacggattaatggtgacaggcgtgagacgccacaacgccgatgacgtagtggctaccgcactggccgtggagcccatgaaatttgtttatcggggtaggatcgctgtgttcagtgttaccgtgctgcacgacgaccgaatcgttctggttgccgagcagagaccagatgcttcggaggaggactcgtttcagtggatgagccgtgtcctgcaagccattgattcgattcaccaggtcggagtatattgtttggctctggttcctgctaacaccttgcccaaggcacctcttggcggaatccatatatcagagaccaagcaacggtttttagaaggaacactgcacccgtgtaatgtcctaatgtgtccccacacatgtgtgactaatctgcccaagcctcgacagaaacagcctgaagtcggtcctgccagtatgatagtggggaacctggtggccgggaagcgcatcgcccaggcatctggcagggaacttgcacaccttgaggattcggatcaggcccggaagtttctttttttagcagatgttctgcagtggcgggctcacactacacctgaccacccactctttctactccttaatgcgaaaggcacagtgacttctactgccacctgcgtccagctgcacaaacgggctgaaagagttgctgctgccctcatggaaaagggcaggctatctgttggtgatcatgtggccctcgtgtaccctccgggtgtggatctgatcgctgccttttacggatgcctgtactgtggctgtgtacctgttacagtaaggcccccacacccacaaaacctgggcacgactctgccgactgtcaagatgatcgtggaagtgtccaagtccgcctgtgtgctcaccactcaggccgtcacacggctgttacggtctaaagaggccgccgccgccgtggacatccgcacatggcccactattctagacaccgacgatatcccaaaaaaaaaaatagcctctgttttccgtccaccatctcccgatgtgttggcctacctcgacttcagcgtatccaccacgggcattctcgcgggagtgaaagcgggcagggggggttcacggctgtag

SEQ ID NO: 19083 - DNA, 2526 bp, Artificial Sequence
  Description of Artificial Sequence: Synthetic coding sequence
atggccgaccggggctgccccctggaggccgcccccctgcccgccgaagtgagggagagtcttgctgagctcgaacttgaactgtctgagggagatattacacaaaaggggtatgagaaaaagcgagccaaactactcgcccggtatatcccactaattcaggggatcgatccaagtcttcaggctgaaaacagaattccaggtccatctcagacaactgctgcagccccaaaacagcaaaagagccggccaacggcatcaagggacgagcggttccgcagtgacgtccacacggaagctgtccaggcagcactggcgaaatacaaagagaggaagatgccaatgcccagcaaaaggcgttctgtgttagttcattcaagcgtggaaacctacacgccaccagacactagctctgcttctgaggacgaggggtctcttaggagacccgggcgactgacatctaccccactacaatctcatagttccgtcgaaccttggctagatagggtgatccaaggtagcagcacgagctcctcagcttcaagtactagttcccacccaggagggcgtccaacaaccgctcccagtgctgctgccaccccaggagccgcggccaccactgcattggccgggttggaggcacatacacacattgaccttcactccgccccacctgacgtcacgaccggcctagtcgaacatagctattttgaacgaccccaggtggccagcgtgagaagtgttccccgaggctgtagcggtagtatgctggagacagctgacggggttcccgtcaactcccgtgtaagctcgaagatacaacaactgctgaacaccctgaaaagaccaaagagacccccgctgaaagaatttttcgtagatgattttgaagagctgcttgaagtgcagcagccagaccccaaccagcccaaacctgaggggtctgagactagcgtgctcaggggagagcctctgaccgccggagtcccccgcccccctagcctgcttgccactcttcagcggtggggtactacccagccaaaatcgccgtgtttgactgcattagacacaactggaaaagctgtgtacactctgacatatggaaaattgtggtcacgtagtttgaagctcgcttatacattgctgaataagcttacatctaagaatgagccattgctcaaaccaggagacagagtcgcgttggtttttcccaacagcgatccggtaatgtttatggtggccttctatggttgcctgttggccgaacttgtacctgtgcctattgaggtgccattgactcgtaaagacgctgggtcccaacaagttggctttctgcttgggagctgcggagtgttcttggccttgaccactgacgcatgtcagaagggcctgcccaaagcccaaactggagaggtagccgctttcaagggctggccacctctgagctggctagtgatcgacgggaagcacctcgcaaagccccccaaggattggcacccgttggcccaggataccggcacaggaacggcgtacatcgaatataagaccagcaaagaagggtcaacagtgggcgtgaccgtttctcacgcatctctgctagcccagtgcagagccttgacacaggcctgcggctacagcgaagctgaaacactgacaaatgtgttggacttcaagcgcgacgccggcctgtggcacggagtgctcacctccgtcatgaacaggatgcacgttgtatctgtaccttacgccctaatgaaagctaacccactgtcttggatccagaaagtgtgtttctacaaggcacgcgctgcactcgtgaagtccagagatatgcactggtctctcctggcgcagcgcggacagcgggatgtatctttgagctcattgagaatgttgattgtggccgacggagctaatccctggagtatcagcagctgtgacgcgtttctcaatgtttttcaaagtcgtggcttgcgcccagaagtgatctgcccatgcgcttcatcaccagaggcactcacagttgctatccgcaggcccccagacctgggcggtccacccccacggaaggcagtgctctccatgaacggtctgtcctacggcgttattcgagtggataccgaagaaaagctatccgtactaaccgtacaggacgttgggcaagtgatgcccggggcaaacgtgtgcgtcgttaaactcgagggaaccccgtacctttgcaaaacggatgaggttggcgaaatctgcgttagtagctccgcaactggcacagcctattatggtctgctgggtataacgaagaacgtgttcgaagccgtgcccgtaaccacgggcggagccccaattttcgaccggcctttcactcgcacgggactgctcggcttcatagggcctgacaatctggtgttcatcgtggggaaactggacggacttatggtcacaggcgtacgccgccataatgctgacgacgtggtagccaccgcgttggctgtcgaaccaatgaagtttgtgtatagaggccggtag

SEQ ID NO: 19084 - DNA, 2670 bp, Artificial Sequence
  Description of Artificial Sequence: Synthetic coding sequence
atggccgaccggggctgccccctggaggccgcccccctgcccgccgaagtccgtgagtccctcgcggaactcgaattagaactgtcggagggtgatataacccaaaagggttacgaaaagaagcgagccaaactgcttgcacgctacattcctctaatacaggggatcgatccctccttgcaagcagagaacaggatccccggccctagtcagactacagcagcggcccccaaacagcagaagagccgcccgaccgcttccagagacgagcgattccggtccgacgtccatactgaggcggtacaggctgcactcgcaaagtacaaggagcgcaaaatgcccatgccttcaaaacggcggagtgtgctagtgcattcgtccgtagaaacttatacccctcccgatacatcatcggctagcgaagacgaagggtctttacgaagacccggacgactgacttcaacccccttgcagagtcatagtagtgtcgaaccatggttggatagggttatccagggatccagtactagctcatcagcaagctcaacatcttcccaccccggagggcggcccacaactgcgccttctgccgctgcaacccccggcgctgctgctacaactgctctggccgggttggaggcacatacacatatcgatctccactcggctcccccggatgttactactgggctggtggagcactcctatttcgagcggccacaggtcgcttccgtgcgcagtgtaccccgaggatgcagtggcagcatgctggagacagccgatggcgtgccagtgaattctagggtttcttcgaagatacaacagcttctgaacactctgaagcgccctaagcgaccaccgcttaaggaattttttgtcgacgactttgaagaacttctggaggtccaacagcctgatcctaaccagccaaaaccagagggaagtgaaaccagcgtgctgagaggagaacctctgacagctggcgtccctagaccgccctccctgctcgctacgttgcagagatgggggactacacaacctaaaagtccctgcctgaccgccttagacaccaccggaaaggccgtctacacgctgacttacggtaagttgtggagtcgcagcctgaaattggcctacacgttgcttaataaactaacttccaagaatgaaccactgttgaaacccggcgatcgggtagccctcgtttttcctaattcggaccctgtcatgtttatggtggctttctatggatgtcttctcgcagaactggtcccggtccctatagaggtgccactcacccggaaggatgcaggctcccaacaggttggattcttactgggctcttgtggggtgtttctcgctctgaccaccgatgcgtgccagaagggcctgcccaaggcacagacgggtgaggtggccgccttcaaaggctggccaccattgtcctggctggtgatcgacggcaagcacctggcaaaaccacccaaagactggcaccccctggcacaggataccggcacaggaactgcctatattgagtataaaactagtaaagaaggatccactgtaggcgtaaccgtgtcacatgcttccctcttggcccagtgtcgtgcgcttacccaagcgtgtggatacagtgaggctgagaccttgactaacgtgctcgactttaaacgcgatgccggactctggcatggcgtcctgaccagcgttatgaacaggatgcacgtcgtgtcagtgccatacgccctgatgaaggccaatcctttgtcctggatacaaaaagtatgcttctacaaagcaagagctgccttagtgaagtctcgagatatgcactggtccctcctcgcacagcgcggacagcgcgacgttagtctgagttccttaaggatgctgatagtggctgatggcgctaacccctggagtatttcttcttgcgacgcctttctcaatgtgttccagagcaggggcctgagacctgaagtcatctgtccatgcgctagtagccccgaggctctgacagtagcaattcgacgaccccctgatctggggggacccccgcctcgcaaggccgtactgtcaatgaatggcttgtcatacggtgttatcagggttgacaccgaagaaaagttgagtgtccttacagtgcaggatgtcggccaggtgatgcccggagctaatgtgtgtgtggtcaagctggaggggaccccctatctgtgtaagactgatgaggtcggagagatatgtgtctcgtccagcgctaccggaactgcttactatggcctattgggtataactaaaaacgtgtttgaagcagtgcccgtgactaccggaggggctcctatcttcgaccgcccctttacacggaccgggctgcttggatttataggaccagacaacctcgtgttcatcgtgggcaagcttgatggcctgatggttacgggcgtgagacggcacaacgctgacgatgtagtggcgaccgcacttgctgtggagcctatgaagttcgtgtaccgcggccgaattgcggtgtttagtgtgacagtcctgcacgacgatagaatcgttctggtggctgagcagcggccggacgcctccgaggaagactcatttcagtggatgtctcgcgtactccaggtgggagcacccgcccgcccgatggtacggtag

SEQ ID NO: 19085 - DNA, 2397 bp, Artificial Sequence
  Description of Artificial Sequence: Synthetic coding sequence
atggccgaccggggctgccccctggaggccgcccccctgcccgccgaggttcgcgaaagcttagccgagctggaactcgaactgagcgagggcgacattactcagaagggctatgagaagaaacgcgcaaaacttctcgccaggtatattccccttatccaagggattgatccctcactacaagccgagaatagaattcccggcccaagtcagactacggccgccgctcctaaacaacagaaatccagacccacagcaagtcgcgacgaacgctttagatccgatgtccataccgaggccgtccaggccgccctcgccaaatacaaagagcgcaaaatgccaatgccttctaaacggcggtctgttctggtgcactcctcagtcgaaacttataccccccccgacaccagttccgcctctgaggatgaggggagtctgcggcggcctgggcgtttgacatcaactccattgcagagtcactctagtgtcgagccctggctggaccgcgtgatccagggctcgtcaacgagttcaagtgcttcatcaacatctagtcaccctggcggaaggcccaccaccgctcccagtgccgccgcgacccccggtgcagccgcaaccactgccctggccgggttggaggcccacacccatatcggagtgcccgtcaactccagagtcagctctaaaatccagcagttactcaacactctcaaacgcccaaagaggccccccttgaaagagttttttgttgatgactttgaggaattgctggaagtgcagcagcctgaccctaatcagccaaaaccggaggggagtgagacctctgtgctccggggcgaaccattgactgcaggggtcccccggccaccaagcctcctggccacgctgcagagatggggaacaactcagcccaagtctccgtgcctgacagccttagatactacagggaaagccgtgtatactcttacatatgggaagctgtggagccgctccctcaagctggcctacactctgctcaacaaactgacaagtaagaacgagccactcctgaagcccggtgacagggttgcgttggtgttccccaattctgacccggtcatgttcatggtggccttctacggttgtctgttggctgaactggttccagtgcctatcgaagtgcctctgacacgcaaggacgcggggtcccagcaggtggggtttctgttgggctcatgtggagtcttcctcgcactgacgaccgacgcatgccagaaagggcttcccaaagcacagacgggggaagtcgcagcctttaagggctggccaccgctctcctggcttgtgatagacggaaagcacctggctaaaccacctaaggactggcatccccttgcccaggacacagggaccggaaccgcctacatcgagtacaagacaagcaaggagggctccacggtcggcgtaaccgtttcccacgctagcttgctcgcccaatgtcgagcccttacccaggcatgtgggtactccgaagccgagacgcttacaaatgtcttggatttcaagagagatgctggcctatggcacggcgttctgacttcagtcatgaataggatgcatgtcgtgtctgtaccatatgccttgatgaaggctaacccactatcttggatacagaaagtctgcttctacaaggccagagccgcccttgttaagtcacgcgacatgcactggtctctgctggcccagagaggacaaagagatgtctcactttccagcctccgaatgctgattgtggcagacggggccaacccctggagtatctctagttgtgacgcctttttaaatgtgtttcagagtcgcggactgcgccctgaagtgatctgcccctgcgccagtagtcccgaggccctgaccgttgctatcaggcgcccgcctgacctcggtggtcccccaccaaggaaggctgttctgtcgatgaacggattatcctacggagtgatccgggtggataccgaagagaagctctcagttctgacagttcaggacgtcggccaagtaatgcctggcgccaacgtctgcgtggtcaagcttgagggtaccccatacctgtgcaaaactgacgaggttggcgagatttgcgtgagcagctccgcgacaggcactgcctactacggactgcttggcatcacgaaaaacgtattcgaagctgtgcctgtaaccacgggaggcgcccccatcttcgatcggccctttactcgcactgggctgttggggttcatcggacctgataacctcgttttcattgtggggaagctcgacggcctgatggtgaccggagtaaggcgacataacgccgatgatgtcgttgcaactgctttagcagtcgagccaatgaagtttgtttataggggtcggtag

SEQ ID NO: 19086 - DNA, 1515 bp, Artificial Sequence
  Description of Artificial Sequence: Synthetic coding sequence
atggagcggagccagtgcggcagccgggaccggggcgtgagcggccgacctcacctggcgccaggattggtggtagctgcgccccctccaccgtcacctgctttgccagtcccatccggaatgcaggtcccccccgcattccttaggcccccatctctgtttctcagggcagcagccgccgcggcagccgcagctgcagccacttccggatcaggcggctgccccccagccccaggactggagagtggcgtcggggccgttggctgtggataccccaggaccccaaaatgtgcacgatgccgtaaccacggcgtggtcagcgctcttaaaggccacaaaagattttgcagatggagagactgtgcttgtgctaaatgtaccctgatcgccgagcgccagcgggtgatggctgctcaagtcgcactacggcgacagcaggctcaggaagaaagcgaggcccgcggcctacagcgcttgctgtgctcaggactcagttggcctcctggcggaagggcctctggaggcggcggccgggcagagaacccccagtcaactggcgggccggccgccggcgccgccctcggcctaggtgcactgcggcaagcaagcggttcggcaacaccagccttcgaagtgttccagcaggactatcccgaggaaaaacaggaacagaaagagtcaaaatgtgagagttgtcagaacggccaagaggaactgatatctaaatctcatcagttatatttagggagctccagcaggagcaatggcgtcatcggtaaacaaagcattggcagctcaatcagcgaatactccaacaagccagatagtattctctccccacatccaggggaacagagcggaggggaggagagccccagatccttgtcctctagcgaccttgaatcgggtaacgaatcagagtgggttaaagatttaactgcaactaaggcatctctacccacggtatccagccgcccacgagatccgttagacatattgacaaagatttttccgaactacaggcgcagtaggctggagggcatactgcggttttgtaaaggcgacgtggtgcaggctatcgagcaagtcttgaacggcaaggaacacaagcctgacaaccgaaatctagccaacagtgaagagctggagaatacagccttccagagagcttcgtccttcagtcttgccggcataggatttggcacacttgggaataaatcagccttcagtccattgcagacaacttctgcctcctatggaggcgactcatccctctacggcgtgaacccaagagtggggatttcccccctgcgcctggcctactcttccgcaggcagggggctttcaggattcatgtctccatatttaacacccggtctggtccccactcttccttttaggccagcactagattatgcttttagcgggatgatccgcgacagctcctatttaagtagcaaggattctataacatgtggccggctgtattttagacccaaccaggataatccgtag

SEQ ID NO: 19087 - DNA, 1629 bp, Artificial Sequence
  Description of Artificial Sequence: Synthetic coding sequence
atggagctgcggagcgagctgcccagcgtgcccggcgccgccaccgcagccgctgctaccgctacaggaccccccgtagcatcggtggcctccgtagctgctgcagcggccgctgctgcctctctgccggtgtccgtcgcaggaggactccttcggggcccacctctgctgctgcgtgccgctgaaaaatatcctcgcacaccaaagtgcgcacgatgccgcaaccacggcgtggtttccgccctgaaaggccacaagcggtactgccgttggaaggactgcctgtgcgccaagtgcactctgattgctgagaggcagcgcgtgatggcagcacaggttgctctgagaagacagcaggcccaagaggaaaatgaagccagggagctgcaactgctgtatgggactgccgaaggcttggctttggccgctgctaacggaatcataccccctcggcctgcatacgaggtctttggttcggtgtgcgcggcagacggcgggggaccaggagcaggggcaccagcaggaactggagggggggctgccggtgccggaggtagtgaagcaaaactgcagaagttcgacctctttcctaagactttactgcaggcggggaggccaggttctccgctgcctccccccgtaaaacctcttagccccgacggagctgatagcggacccggaacatctagccccgaggtgcgcccaggatccgggtctgagaacggggatggagagagcttctccggttcccccttagctcgagcatctaaggaagccgggggttcctgtccagggagcgccgggcccggagggggcggagaagaggactcgcctgggtccgcgtcgcccctcgggagtgagtccggcagcgaagctgataaggaagaaggcgaggctgctcctgcacccggcctgggcgggggttcgggtccgcgtcagaggactcccttagacatcctcacaagggtgtttcccggtcacagacggggcgtgctggagctcgtactgcagggatgtggaggggatgtggttcaggctatcgagcaggtccttaatcatcacagaggggggctggctgctggtttaggtcccgcagctcctccagacaaggccgccgtcggcgcagctgccgcagccgatgacgcttggccatcgagggtagacgcagccgcagccgccgctgccgctgccggagggcctggattgcccgcgccgctgcaggccggtccggctgcccccccccaccatcggccactgctggccggagccatggcacccggtgccctggggtccctgtcatcacggtctgccttctctccactgcagcctaacgctagccactttggagcggacgccggcgcttacccactcggggctccactcgggctatcgcctcttcgtctggcttacagtgccgcagctgcccattcacggggtttggcttttatggccccctactccacagcggggctggtgcccacccttgggttcagaccaccaatggactacgctttctcagacttgatgagagaccgcagcgcggccgcggctgccgccgtacataaggagccaacttacggcggtggcctatacggacctatggtgaatggagcccccgagaagcaatag

SEQ ID NO: 19088 - DNA, 1629 bp, Artificial Sequence
  Description of Artificial Sequence: Synthetic coding sequence
atggagctgcggagcgagctgcccagcgtgcccggcgccgccaccgctgccgccgccaccgctacagggccgcctgtcgcctcagtggcctccgtagccgccgctgccgccgccgctgcgagcctgcccgtcagcgtcgccggaggcctgcttcgcggcccacccctgctgctcagggcagccgagaagtatccgcgcacgcctaagtgcgcccgatgtaggaatcatggggttgtatcagccctgaaaggacacaaacgctactgcagatggaaggattgcctctgtgccaagtgcacattgatcgctgagaggcagcgtgttatggctgcgcaggtcgctctgagacgtcagcaagcccaggaagagaacgaggccagagaattgcagctcctctacggaaccgccgaaggcctggcgctcgctgcagccaatggcataatacctccgagacctgcctatgaagtctttgggtccgtatgcgcagcagacggaggtggaccaggagcgggagctccggcaggaacaggaggaggcgccgccggtgccggcgggagtgaggctaagttgcagaaattcgatctttttcccaagacattgcttcaggccgggaggcccggcagtcccctgcccccgccagtcaagcctctctcccctgatggcgccgatagcgggccagggacttcatctcctgaggtgcggccaggttcgggatctgagaacggggatggtgagagtttttcaggttctcccctggccagagcatcaaaggaggcagggggctcctgcccaggctcggcgggcccaggggggggcggagaagaggattcacctggtagcgcctctccactagggtccgaatcaggaagtgaagctgataaagaggagggagaagccgccccagcacctggactgggcggcggaagtggcccccgacagagaaccccgctggacattctcactagggtctttcccgggcatcgccggggcgttctcgaactggtactgcagggctgcggtggagacgtagtccaagctatcgagcaggtgctgaaccaccacagggggggactggccgctgggctgggccctgccgcccccccagataaggctgccgtcggcgccgctgccgccgccgatgacgcctggccaagcagagttgacgcggcagctgccgctgcggcagccgccggcggccctggtttacctgccccgctacaagctggtcccgccgccccaccacaccataggccccttcttgcaggagcgatggctcccggggctctcgggtcactcagcagccgcagtgccttttctcccctgcaaccgaatgcctcccatttcggcgccgacgccggtgcctatccattgggcgcaccgcttggcctgtcaccgctccggctcgcttacagcgcagctgcagcgcattccagaggcctggcctttatggccccctactccactgctggcttagtgcccactttgggattcaggccccctatggattacgcattctctgatctaatgagggaccgatctgccgccgcagcagctgctgtacacaaagagcccacatatggcgggggtctgtacggaccgatggtgaatggcgcacctgagaagcagtag

SEQ ID NO: 19089 - DNA, 1029 bp, Artificial Sequence
  Description of Artificial Sequence: Synthetic coding sequence
atggccgacaagatggtgcggacccccaagtgcagccggtgccggaatcatggttttctggttccagttaaaggacacgcaggcaaatgccgctggaagcagtgcttgtgtgaaaagtgttatctcatctcagaaaggcagaaaataatggccgcccagaaggtgctcaagacacaggcagccgaggaggagcaggaagcggccctctgtgcccaaggaccaaaacaggcatcaggtgctgcggctgctgcaccagctcctgtccccgtgcctgcagcgtccctgcgccccctctcccccggtaccccatctggcgacgcggatccgggaccggagggtcgcgccgccgcctgtttcttcgagcaacctccacgtggtcgaaatcccgggccacgagctctccaacccgtgctcggcggacgatcccacgttgaaccttcagagcgggctgccgtggcaatgccctccttagctggaccacccttcggcgccgaggctgcagggtccggctatcctggcccccttgacctgagacggcccatgagaacagtgcctggcccactcttcaccgattttgtaagacccctaaatatcaaccctgaccgagcacttggccccgagtatccaggcggctcctctatgcatccttactgcccattccccttagggtacttggatgcaccacccggcgtcccactacagcagggatttcggcatgtctccaggagccagtatcagggcggcgggctcgtgtcagaacccggcggagattttcagccatcttactatctcccgccgccccctccgcctcttccacccttgccccctctccccccacagccccagttcctgcctccaggatatctgagtgcccttcacttcctaccaccccctcctccccctccccctccctcttcctttagcctgaccgtgctgtttgataccgacaaggagaacactgatgatcaggacgccgaagtgctgtccggagagccctcccagccttcatctcaggagcagagtgattag

SEQ ID NO: 19090 - DNA, 432 bp, Artificial Sequence
  Description of Artificial Sequence: Synthetic coding sequence
atgcccagcctggccggcccccccttcggcgccgaggccgccggcagcgggtacccaggccccctggacctcaggaggccaatgcggactgtccctgggcctctgtttactgattttgtacgtcccttgaatattaacccagatagggctttgggccctgaataccccgggggcagctctatgcatccctactgtccttttcccctgggctacctagatgcccccccaggcgtgcctctccaacaagggttccggcatgtgagccgttcacaatatcaaggaggaggactggtctcagagcccggcggcgatttccaacctagctattatcttccccctccaccgccccctcttccgcccctaccacccctgcctccacctgctacggcaaccacaacctcgattatcttcctaaccgaccggcccgtatag

SEQ ID NO: 19091 - DNA, 1104 bp, Artificial Sequence
  Description of Artificial Sequence: Synthetic coding sequence
atggagcccagcgacatgcccgccggctaccactgccccctggactccgccccttgggacgaaacccgagacccccaaagcactgaacttatcccccggagagctatctccagatctcccacctgtgccagatgtaggaaccatggcgtgactgctcacctgaagggtcataagcgtctatgcttgtttcaggcatgcgaatgccataagtgcgttttgatcctggagaggcggcgcgtgatggctgcccaggtcgcattgaggcgacaacaagaggcccagcttaagaagcatctcatgcggcgaggcgaggcctcaccgaaagcacccaaccacttcaggaagggtacgactcagccccaggtccctagtggcaaggagaacatcgcaccacaacctcaaacaccgcacggagccgtcctgcttgcacctaccccccctgggaaaaatagctgcgggccactccttctgagtcatccaccagaggcctccccgctgagttggacccctgtgcctcccggcccatgggtgcctggacactggctacccccaggattctccatgccaccccccgtggtatgtcggttgctataccaggagcctgccgtgtccctaccaccgttccccggctttgaccctggcacatcattgcaactgccaactcatgggccattcacgacttgcccgggcagtcaccccgtgctgacagcaccgttaagcggcgagccccaaggcccaccgtcacagcctcgtacccactcaactcttattctgcagccttgcggaacgcccgatcctctgcaattgcaaccccaggcgagcggggctagttgtctggccaggactagcggcccgtccgagtggcagctgcagcaagaggccgccgaagcattggttggattgaaagatagctcacaggcgcctcgcgttacccctagcgtgccaccaaatcctgcatggatttcgctgttgcatccttgtggtccaccagcacctgcaggcggcagaggctttcagccagtgggcccttgtctacgcccaagccccgctccttctgtcgctctgcacatcggcagacttggatctatcagccttttatcctag

SEQ ID NO: 19092 - DNA, 1404 bp, Artificial Sequence
  Description of Artificial Sequence: Synthetic coding sequence
atggccaccggcgccgacgtgcgggacatcctggagctgggcggcccagaaggagacgccgcatccggcaccatttccaagaaggacattatcaaccccgacaagaagaagtctaaaaaatcaagcgagacattgacattcaaaagacccgagggcatgcatcgtgaagtatacgccctcctgtattccgacaagaaggacgcaccacctttactgccatccgacactggtcaaggctatcggacagtcaaagccaagctaggctccaagaaggtacggccatggaaatggatgccttttaccaaccccgcccgcaaagatggggccatgtttttccactggcgcagggcagccgaagaaggcaaggattacccattcgcacgcttcaataaaactgtccaggtccccgtttactccgagcaggagtaccagctgtacttgcatgacgatgcgtggaccaaagccgagactgaccacttattcgatctgtcccggaggttcgatctgagattcgttgtgattcacgaccgttacgaccaccagcagtttaaaaagagatcagtggaggatcttaaggagaggtattatcacatctgcgcaaagctagccaacgtacgtgctgtcccggggacggacctgaagatacccgtcttcgatgctggtcatgagcggaggagaaaagaacagctggaacgcttatataaccggactcctgagcaggtggccgaggaggaatacctgctgcaggagctccggaaaatcgaagctcggaaaaaggagagagaaaagagatctcaagacttacagaaactaattaccgccgcggacacaaccgccgagcagcggcgcacggaaagaaaagccccaaagaagaaactgccacaaaagaaggaagctgagaagccagcagtgccagagactgcgggaatcaaatttcccgattttaagagtgccggagtcacccttcgaagtcagcgtatgaaactgcctagctccgtgggtcagaaaaagataaaggcgcttgagcagatgctactcgaactgggagtcgagctgagccccacaccaacggaggaactggtccatatgttcaatgagctgaggtctgatctcgtgctgctttacgaactaaaacaggcctgtgcaaattgtgaatacgagttgcagatgctgaggcataggcacgaagccctggctagggccggcgtactgggtggtcccgcgaccccggcctcaggtcccggacctgcgtctgctgagccagccgttaccgaaccagggcttggccctgaccctaaggacaccattattgatgttgtcggcgcccctctgacacctaattctcgaaagcggagagagagcgccagttccagtagctctgtgaaaaaagctaaaaagccctag

SEQ ID NO: 19093 - DNA, 1404 bp, Artificial Sequence
  Description of Artificial Sequence: Synthetic coding sequence
atggccaccggcgccgacgtgcgggacatcctggagctgggcggcccggagggggacgctgcctccggtactattagtaaaaaagatatcatcaacccggacaaaaagaaatctaaaaagtcttccgaaacactgacgtttaagcgccccgaagggatgcatcgggaggtctacgctctgctgtattcagataagaaagatgctcccccgcttttaccaagcgacactggccagggctataggaccgtcaaggctaaattgggctcaaaaaaagtgcgcccctggaagtggatgccctttactaaccccgcgagaaaagatggcgccatgttttttcattggagacgggccgccgaagagggcaaagattatccttttgccagatttaataagacagtgcaggtgccggtctattccgagcaggaatatcagctgtaccttcacgatgacgcctggacaaaggccgagactgaccatctgttcgacctgagccgcagatttgatctccgcttcgttgtgattcacgatcgttatgatcaccagcagttcaagaaacggtctgtggaagacctgaaggagaggtactatcacatctgtgcgaaactggccaatgtgagggcagtgcctggcaccgatttgaaaattcctgtgttcgatgccggtcacgagcggagacgcaaggagcagctcgagcggctgtataatcgcacccccgaacaggtcgcggaagaagagtacctgctgcaagaactccggaagattgaagcgcgtaagaaggaacgggagaaaaggtcccaggatctccagaagcttattactgctgctgataccaccgcggagcaacgcaggaccgagcggaaggcccccaagaaaaaattaccccaaaaaaaagaagcagaaaagcccgccgtgcccgaaactgcagggatcaagttccctgactttaaatcagcgggtgtaacactgcgttcccaacggatgaagctgccttcctctgtaggtcagaagaagatcaaggcgctggagcagatgctgctcgaactcggcgtggagctgagtcctaccccgaccgaggagcttgtgcacatgtttaatgaactgcgcagtgatttggttctcctctacgagttgaaacaggcctgtgccaactgcgaatacgagttacagatgctgcgtcacaggcacgaggctctcgcaagagccggtgtgttgggcggtcccgccacaccagcctcaggtccagggccagcatctgctgaacccgctgtgactgaacccggactggggccggaccccaaagacacaatcatagatgtggtcggagcccccctgacccccaactctcggaaacgacgggagtctgctagttcgagcagcagcgtcaagaaggccaagaaaccttag

SEQ ID NO: 19094 - DNA, 858 bp, Artificial Sequence
  Description of Artificial Sequence: Synthetic coding sequence
atggccaccggcgccgacgtgcgggacatcctggagctgggcggccctgaaggagacgcggcctctggtacaatatctaagaaggacatcatcaacccagacaagaaaaaaagcaagaaaagctccgaaaccctgaccttcaaaagacctgagggcatgcacagagaagtgtacgcactcttgtattccgataagaacaagggttcttgcctccttagcaggatgcaggaagacctcaagtcctttgcacctggacacgacttcctggccataggggatgctcctccgctcttgcccagcgacactggacagggttatagaacagtaaaggcgaaactgggatcaaagaaggtgcggccctggaagtggatgccttttactaatccagctcggaaggatggcgctatgttctttcattggcgcagagccgctgaagagggtaaagattacccctttgccagattcaataagacggtgcaagttcctgtttactctgaacaggaatatcagttgtacctgcacgatgatgcgtggacaaaagcagaaactgatcatctgttcgacctgagtaggaggttcgatctgagattcgttgtgattcacgaccggtatgatcaccagcaattcaaaaagcggagtgttgaagatctcaaagagcgatattaccacatctgcgctaagctggctaatgtgagagccgtgcctgggactgacctgaagatccctgtcttcgatgccggtcatgagcgacgccgcaaagagcaactcgagagactgtacaaccggacccctgagcaggtcgcggaagaggagtacctgctacaggaactgcgaaaaattgaagctcggaagaagtag

SEQ ID NO: 19095 - DNA, 1404 bp, Artificial Sequence
  Description of Artificial Sequence: Synthetic coding sequence
atggccaccggcgccgacgtgcgggacatcctggagctgggcggccccgaaggcgatgccgcctccgggactatctctaagaaggacattattaaccctgataaaaagaaatctaagaagtcatcggaaacactcactttcaagcgacctgaaggtatgcatcgcgaggtgtatgctttactgtatagcgataagaaggacgcgcccccacttctgccctcggatactggacaaggttacagaaccgtaaaagctaagctcgggtcaaagaaggtcagaccgtggaagtggatgcctttcactaaccctgctaggaaagacggggcgatgttttttcactggaggagagctgcagaggaggggaaagattatccgtttgccagattcaacaagactgtccaggtgccggtgtactcggagcaggagtatcagttatatctccacgacgacgcttggactaaggccgaaactgatcacctctttgatttaagccgccgattcgacctgaggttcgtggtcattcatgatcggtatgaccatcagcagttcaagaaacgatcagtggaagacctcaaggagcgctactatcacatttgtgccaaacttgcgaacgttcgcgcggttccaggaacggatttaaagattcctgtattcgacgcaggccacgagaggaggagaaaggaacaattggaaagactctataaccggactccagagcaggttgccgaggaggagtatttgctgcaagagcttcgcaaaattgaggccaggaagaaagagagagagaagagatcccaagacctgcagaaactaatcacagcagccgacacaacagccgaacaaaggcgcactgagagaaaggcccccaagaaaaaactcccacagaaaaaagaggctgaaaagccagctgtacctgagacagccgggattaaatttccagattttaagagcgccggcgtcactctgaggtctcaaagaatgaagctgccgtcttctgtggggcaaaaaaagattaaggcccttgagcaaatgctgctggagcttggtgtcgaactgagtcctactcccaccgaggagctggtgcatatgtttaacgagctgagatctgacttagttctgctctatgaactgaagcaggcgtgcgctaactgcgaatacgagttacagatgcttaggcaccgccatgaagccctggcccgagctggagttttaggcggcccagctacaccggcgagcgggccgggcccagcatcagccgagcctgcagtgaccgagccaggcttagggcctgatccaaaagacacgatcattgacgtggtcggcgccccactgaccccaaacagtcggaagagacgggaatccgcctccagcagcagttcagtgaagaaagctaaaaagccctag

SEQ ID NO: 19096 - DNA, 399 bp, Artificial Sequence
  Description of Artificial Sequence: Synthetic coding sequence
atcatcaaccccgacaagaagaagagcaagaagagcagcgagaccctgacgtttaagcgcccagagggtatgcatagggaggtgtacgcccttctgtactccgacaagaaggatgccccgccgcttctgccatcagacacaggacagggttaccggactgttaaggccaagttaggcagcaagaaagtgcgcccctggaaatggatgcctttcactaatcctgcccgcaaggatggtgcaatgtttttccattggaggcgagccgccgaggagggcaaggactatcctttcgcccgttttaacaaggagtatcaactctacctgcatgacgatgcatggactaaagccgagaccgaccacctgtttgatctgtcccgccgatttgacctgcggttctag

SEQ ID NO: 19097 - DNA, 456 bp, Artificial Sequence
  Description of Artificial Sequence: Synthetic coding sequence
atggccaccggcgccgacgtgcgggacatcctggagctgggcggcccagaaggcgatgcggcctcagggacaatcagcaagaaggacataatcaaccccgataagaagaagtcaaagaaatctagcgaaacgctcaccttcaagcggccagagggaatgcaccgggaggtgtacgcattattatacagcgataagaacaagggcagttgcttgctgtcaaggatgcaggaagatctcaagtctttcgcccccggccacgactttttggcgatcggtgacgcccctccactcctgccttccgatacaggacaggggtaccgaaccgtcaaagctaaactgggatcaaaaaaagtgcggccctggaaatggatgcctttcaccaatccagcacgcaaggacggagcgatgttctttcactggagaagagccgcagaggagggcaaagactacccgtag

SEQ ID NO: 19098 - DNA, 858 bp, Artificial Sequence
  Description of Artificial Sequence: Synthetic coding sequence
atggccaccggcgccgacgtgcgggacatcctggagctgggcggccccgaaggggatgctgcctcagggactatcagcaagaaggatataatcaaccctgacaaaaagaagtccaaaaagtccagcgagacactgacctttaaaagacctgagggaatgcatcgagaagtgtatgctctactttactccgacaaaaacaagggctcatgcctactcagtaggatgcaggaggatctgaaaagctttgcaccgggtcatgactttctcgccatcggggatgcgccacccctcctgccttcggataccggccaggggtataggaccgtaaaagcaaaattggggtctaagaaggtgagaccctggaaatggatgcccttcacaaatccagcccgaaaggatggcgccatgttcttccactggagacgagctgcggaggaagggaaagattacccttttgcccgcttcaataaaaccgtgcaagtgcccgtgtactctgagcaggaatatcaactttacctgcatgacgacgcatggactaaggctgagactgatcacctgttcgatctcagtcggcgtttcgatctgaggtttgtggttattcatgatcggtatgatcatcagcagtttaagaaacgcagtgtggaagacctcaaagagcgctattatcatatctgtgcgaaactggctaacgttagagccgtgcccggaacggatctgaagatcccagtgttcgatgcggggcatgaaaggcggcggaaagagcagctggaacgactgtacaaccgaacgccggagcaggttgctgaggaggaatatctgcttcaggagctacgtaaaatcgaggcgagaaagaagtag

SEQ ID NO: 19099 - DNA, 714 bp, Artificial Sequence
  Description of Artificial Sequence: Synthetic coding sequence
atggccaccggcgccgacgtgcgggacatcctggagctgggcggcccagaaggtgacgctgcgagtgggaccatttctaagaaggacattatcaaccctgataaaaaaaaatccaaaaagtcttctgagaccctgaccttcaagcgccccgagggtatgcacagggaagtctacgcgttattgtactcagacaaaaaagatgcaccacccttactcccctctgacaccgggcagggatacagaaccgtaaaggctaagttggggtctaaaaaggttcgaccatggaagtggatgccctttaccaatccagctcggaaggacggggccatgtttttccattggagaagagctgcagaggaaggcaaggattacccttttgcgcgctttaacaaaacagtgcaggtgcctgtgtactctgagcaggagtatcagctgtacttacacgatgacgcctggacaaaggccgagacagaccacctgtttgacctgtcccgtagatttgacctccggttcgttgtcattcatgaccggtacgaccaccagcagttcaaaaagaggtccgttgaagatctgaaggaacgctactaccatatttgtgccaaactggcaaacgtgcgcgcagtcccgggtaccgatttaaaaatacccgtttttgacgccgggcacgaacgccgccgcaaggagcagttagagaggctttacaatcgcacttag

SEQ ID NO: 19100 - DNA, 909 bp, Artificial Sequence
  Description of Artificial Sequence: Synthetic coding sequence
atggccaccggcgccgacgtgcgggacatcctggagctgggcggcccagagggtgacgccgcctcagggacgatttcaaagaaggatataatcaaccctgacaagaaaaaaagtaagaagagtagcgagacccttactttcaagcgccctgagggcatgcacagagaagtctatgccctgttgtatagcgacaaaaaggacgcaccgcctctacttcccagcgataccggtcagggatatcgtacagtcaaggcaaagctaggcagtaaaaaggtgagaccatggaaatggatgccatttactaaccctgctcgcaaggacggggctatgttctttcactggcgcagggccgcagaggaaggtaaggattaccccttcgcccgctttaataagacagtgcaggtgcccgtgtattccgaacaggagtatcagttatacctacacgatgacgcctggaccaaagcggaaacagatcacctgttcgacctctctcggagattcgacctgcggttcgttgtgatccacgaccgctatgatcaccaacagttcaagaagcggtccgtggaagatctgaaagagaggtactatcacatttgcgctaagctggcaaatgtcagagccgtacccgggacagacctgaaaatccccgtgtttgacgcgggccacgagagacgccgaaaagaacaactcgaacggctatacaatagaactccagagcaggttgccgaggaagaatatctgctgcaagaactgaggaaaatcgaagccagaaaaaaagagagggagaagcgatcacaggatcttcagaaactgatcactgccgctgataccacagcagagcaacgtcggaccgagcgtaaagctcccaagaaaaaactacctcaaaaaaaggaagcagagaaaccctag

SEQ ID NO: 19101 - DNA, 762 bp, Artificial Sequence
  Description of Artificial Sequence: Synthetic coding sequence
atggccgccagcggcgagagcggcaccagcggcggcggcggcagcacagaagaggctttcatgactttctattcagaggtgaagcaaatcgagaaacgggatagcgttctgacgtcgaagaatcagatagaaaggctgacccggccaggaagttcttacttcaacctgaaccccttcgaggtgctccagattgaccctgaagtgaccgacgaggagattaagaagcggttccggcagctgtctatcctcgtgcatcctgataaaaatcaggatgatgcagatcgagcccagaaagctttcgaggccgtcgataaggcgtataagctgctgctggatcaggagcagaaaaagcgggccttggatgttatccaggctgggaaggagtacgtggaacacacagtcaaggagcgcaaaaagcagcttaaaaaagaaggaaaaccgacgattgtcgaagaagatgatccagaactcttcaaacaggccgtctacaaacagaccatgaagctgttcgcagagctcgaaatcaaaagaaaagagagggaggcaaaggagatgcacgaaaggaaaaggcaaagagaggaggagatagaagcacaagaaaaggcaaagcgggagcgtgagtggcagaagaatttcgaggaatcgcgcgacggcagagtagattcatggaggaatttccaagctaacacaaagggcaaaaaagagaagaaaaatcgtacgtttctcagaccacccaaagtcaaaatggagcaacgagagtag

SEQ ID NO: 19102 - DNA, 1458 bp, Artificial Sequence
  Description of Artificial Sequence: Synthetic coding sequence
atgaagggctggagcctgcccgcctgcggccccctgcagggccggctggctgggtggctggcagtgcgagctggcttactcgcagcacccgccgcggtgcatagccctgccgaggtccacggtagccctccagccagtctctgcccgaggccatccgtcaaattccgcccaggattgactgccatggcccttcccacaccatccgactcaacgcttcccgctgaggcccgtgggcgcggacggaggagaagactggtgtggacaccatcacagtcagaggcactgagggcctgtttcgagaggaatccttatcccggcatcgccactcgagagaggctggcccaggctattggcatacctgagcctcgcgtccagatttggttccagaacgaacgaagtcggcagcttcggcagcacaggagggaaagtagaccctggccggggcgcaggggtccacctgagggaagacgcaaacgcacagcggtcacaggcagccagacagccctgttgctcagagcattcgaaaaagataggttccctggcattgccgctagggaagagttagccagagaaaccggactgccggaaagccgcatccagatttggttccagaatagacgcgcccgccatcctggtcagggtgggagagcccccgcccaggccggtggcctatgctccgctgcacccggcggtgggcaccccgccccttcatgggtggcttttgcacacacaggagcttggggcacgggattacccgcaccccatgttccatgcgcacctggcgcactgccacagggagcgtttgtgtcacaggctgcccgcgccgcacccgccctgcagccctcacaagccgcgccagcagaaggtgtcagccagcctgcccccgcgcggggggactttgcctatgccgccccagctccgccagacggtgcactcagtcatccccaggccccgcgatggccgcctcacccagggaaatcaagagaagatcgcgatccccagagagatggactacctggcccttgcgcggtagctcagcctggccccgcccaggcaggcccccaaggtcagggagttttggcgccgccgacctcacaggggtccccctggtggggctggggccggggaccacaggtcgcaggcgccgcttgggagccacaggccggagccgccccccccccacagcccgccccccccgatgctagtgcctccgctcggcagggccagatgcaaggcattcctgctcccagtcaggctctgcaagagccggcgccttggtccgctctgccctgcgggctgttgctggacgagcttttggcatctcctgagtttttacaacaggcacagccattattggaaacagaggcaccaggagagcttgaggcctccgaagaagcagcctctttggaggcccccttaagtgaggaagaatacagagcactactggaggaactgtag

SEQ ID NO: 19103 - DNA, 1275 bp, Artificial Sequence
  Description of Artificial Sequence: Synthetic coding sequence
atggccctgcccacccccagcgacagcaccctgcccgccgaggccagaggacgtggacgcagacgtagactggtatggacccctagtcagtcagaggcgttaagggcttgcttcgagcgcaatccgtaccctggtatcgctacccgagaacgccttgcccaggctatcggcatcccagagcctcgagtgcaaatttggttccaaaatgagcgcagccgtcagctacgtcagcatagaagggagtctaggccttggcccggtagacgcgggcctccagaggggaggagaaagaggactgcggtaactggctcccagactgccctcttactcagggccttcgagaaagaccgtttcccaggaatcgccgcacgggaagagttagccagggagacggggcttcccgagtccaggatacagatctggtttcagaacagacgagctcgccatcctgggcaggggggtagggctccagcccaagccgggggcctgtgttccgcagcaccgggcggcgggcatcccgccccaagttgggtcgcatttgcccacacaggcgcatgggggactggattacctgctccgcatgtgccatgcgcgcccggggccttgccacaaggggcattcgtgtcccaggccgctagggctgcccccgcactgcaacctagtcaagctgctcctgctgaaggggtttcgcagcctgcccctgccaggggagatttcgcttacgcagctcctgcccctcccgatggcgccttaagtcaccctcaggcgccgcgctggccccctcatccaggcaaaagcagagaggatcgcgatccccagcgcgatgggctgcctgggccctgtgcagtggcccagcccggacctgcccaagcaggcccgcaggggcagggcgttctggctcccccgactagtcagggctcgccatggtggggctgggggaggggcccccaggttgcaggtgctgcatgggagcctcaggccggagccgccccacccccacagcccgcacctcccgatgcctcagcgtctgctcggcaggggcaaatgcagggaatccctgcgccctcccaggcgctacaggagcctgccccttggtctgcgctgccctgtgggctcctgctggatgagctgcttgcgtcccccgaatttctccagcaggctcaaccccttctggagacggaggcaccaggtgaattggaggcctctgaggaagccgcaagtctcgaagcgcctttgtccgaagaagagtatagagccttactggaggaactctag

SEQ ID NO: 19104 - DNA, 1458 bp, Artificial Sequence
  Description of Artificial Sequence: Synthetic coding sequence
atgaagggctggagcctgcccgcctgcggccccctgcagggccggctagccgggtggctggccgtaagggccggtctgctcgctgctccagcggctgtccacagtcctgcggaggtccacggaagcccacctgccagcctgtgtccccggccgagtgtgaagtttcgcccagggttgactgccatggccttacctacgccatccgattctacactccccgcagaagcgcgcggtaggggtcggcgcaggaggctggtgtggacaccatctcagtccgaagccctgcgtgcttgctttgaaagaaacccttatcctggaattgctacaagggaacggctagcgcaggccatcggcattccggaaccccgcgtccaaatctggttccagaacgagcgaagcaggcagctgcggcagcaccgccgagagagtcgcccctggcctggacggaggggtccaccggaagggagacgaaagagaactgcagtcactgggtcccagacagccctcttacttcgggcatttgaaaaggacagattccccggcatcgctgctcgagaggagctcgcccgggagaccgggttgccagaaagccgcatacagatatggtttcagaatcgtcgcgcgaggcaccccgggcagggtgggagggcgccagcccaagccgggggactttgttccgccgcgccaggcggcggccacccagcaccatcttgggtggctttcgcacatacaggcgcatggggaaccggtctgccagctccccatgttccttgtgcccccggcgccctgccgcagggtgctttcgtgtcacaggcagctagagccgcgcccgctctgcaaccatcccaggctgcacctgctgaaggcgtgtcacaaccggccccagcaagaggagatttcgcatacgccgcacccgctccgcctgacggggctctctcccacccccaggccccccgttggccacctcaccccggtaaaagccgggaggaccgggatccacagcgagatggactgccagggccttgcgctgtcgcacagccgggaccggcccaagccggaccgcaggggcagggcgtgctcgcaccccccacctctcagggcagcccctggtggggatggggacgagggccacaagtggccggtgccgcctgggagccccaagccggggctgccccaccgccacagcctgcaccccctgacgcaagcgcatccgctcggcagggccaaatgcagggcattccagcacccagccaggctctacaagaacccgccccttggtcggccctcccctgcggtctacttctggacgagctgctggcctctcctgaattcctgcaacaggcacagcccctgctggagaccgaggctccaggagaactggaggccagcgaggaggctgcatccctcgaggcacctctctctgaagaggagtaccgcgccctgctcgaggagctgtag

SEQ ID NO: 19105 - DNA, 1275 bp, Artificial Sequence
  Description of Artificial Sequence: Synthetic coding sequence
atggccctgcccacccccagcgacagcaccctgcccgccgaggccagaggacggggcagacggcgccggctggtctggacccctagtcagtctgaggcattacgggcgtgctttgagagaaatccataccccggaatcgcgacccgagagcgtctcgcacaggcgatcgggattccagagcccagggttcagatttggtttcagaatgaacgaagtaggcagctccgccaacacagacgcgagtctcggccttggcctggtaggagaggtcctcccgaaggccgccgtaagcgcacagcagtgaccggttcacagacggccttgttgctcagagcttttgagaaggatcgttttccgggtatagcagccagggaggagcttgctcgagaaacgggtttaccggagtcgagaatacaaatctggtttcagaacaggagagccagacacccaggacagggtgggagagcaccagcccaggccggaggactctgttcagccgctcctggaggtgggcacccagccccctcctgggtcgccttcgcccacaccggagcctggggaacaggcttaccggctccacatgtcccttgcgcacccggagcattgccacagggggctttcgtgtcacaagccgccagggccgctcccgcactgcaaccttcacaggcggcacccgctgaaggtgtgtctcagccagccccggcgaggggcgattttgcttatgcggcaccggctccacccgacggtgcgctgtctcaccctcaagcgccacgttggccacctcatcctggcaaaagtcgcgaagatagggatcctcaacgtgatgggctccctggaccttgtgccgtggcccagccaggccccgctcaggctggaccacaaggtcagggggtgctggcccctcccacttctcaaggaagtccatggtggggttggggccgcgggccacaggtggcgggcgctgcctgggagccccaagccggagcagcaccccctccacagcccgcccccccagacgcttctgcatccgcaagacagggtcagatgcagggtatcccagccccatctcaggcccttcaagagccagccccttggagcgctctgccctgtgggttactcctggatgagctgctggctagtcccgagttcctgcagcaggcccagcctcttctggaaaccgaagcccctggggaactcgaggccagtgaggaggcagcctcactggaggctcccctcagtgaagaggagtatcgagctctcctggaagaactgtag

SEQ ID NO: 19106 - DNA, 1452 bp, Artificial Sequence
  Description of Artificial Sequence: Synthetic coding sequence
atgaagggctggagcctgcccgcctgcggccccctgcagggccggctcgcaggctggttagccgtgcgcgcagggttattagcagcccccgccgcggtgcattcacctgctgaggtgcacggctcccctcccgcttccctgtgtcctcgaccttctgtgaaattccggccgggactcactgccatggccctgccaaccccttctgactcaacactgcccgcggaggcccggggcaggggcaggcggcggagacttgtgtggaccccttcccagagcgaggcactaagagcatgttttgaacgaaacccgtaccccgggatcgctacaagggagagactggcacaggctatcgggatcccagaacctcgggtccagatctggtttcagaacgagcggtctcgccaattgcggcaacaccgccgggaatcccgcccctggccaggaaggcgcggccccccagaaggcagaaggaagcgtacagcggtcactggatcacagaccgccctgctgcttagggcatttgagaaagaccgctttccaggcatcgctgcgcgagaggagctggctcgcgagactggacttccggagagcagaatccagatctggtttcagaatcgccgcgcaaggcaccccgggcaaggcggccgcgccccagcacaggcaggcggactctgctcagctgcgcccggagggggacatcctgctccaagctgggtggcattcgcgcacaccggggcctggggaaccggtctccccgcaccgcacgttccctgcgcaccaggcgcactgcctcagggagccttcgtatcccaggcagcgcgcgccgcccccgcccttcagcctagccaggctgctcctgcagagggtgtgagccaaccagcccccgccaggggggacttcgcctatgccgctccagctcctccggacggtgcgttaagtcatccacaggcacctcgctggccaccacatcctggaaagagtagagaggaccgcgatccacagcgagacggactcccaggcccatgtgcggtcgcccagcccgggcctgcccaggccggtccccaagggcagggtgtgctcgccccgcccacatctcaggggtctccatggtgggggtggggaaggggcccacaggtcgccggggccgcttgggagccccaggcaggtgaagccccacccccccagcctgctccccctgacgcctctgccaggcagggacagatgcagggcattcctgctcccagccaagccctccaggagcctgccccgtggagcgcactcccttgtgggttgctgttagacgaattactcgctagtcctgaattcctacagcaagcacaacccttgctggagactgaggcccccggtgaactcgaggcgtcagaagaggcggcaagtctcgaagcacctctgtccgaagaagagtatcgtgccctcttggaggagctctag

SEQ ID NO: 19107 - DNA, 1269 bp, Artificial Sequence
  Description of Artificial Sequence: Synthetic coding sequence
atggccctgcccacccccagcgacagcaccctgcccgccgaggcccgcggaagagggaggcgtaggcgtctggtgtggacgccgtcccagagcgaagcactgcgcgcctgctttgagagaaacccctacccaggcatcgcgacccgcgaacgattagcacaggccatcggcatccctgagcctcgagtacagatctggttccaaaatgagcgatctcgacagttgcgacaacacagaagagaatctcgcccctggcccggtcgacgaggaccccccgaaggaagacgcaagcggacggctgtgacgggatctcagacagcattgctgttacgtgctttcgagaaagacaggttccctggtatcgcggctcgtgaggagttagctagggaaacaggcctccctgaaagtagaatacagatttggttccagaatagacgcgcgcgacaccccggccaggggggccgtgccccggcccaggcaggagggctatgtagcgccgcccccggggggggacaccccgctccgtcttgggtcgcctttgcccacacgggcgcctgggggacgggtctgcctgcaccacacgtaccatgcgctcccggcgcactgcctcaaggggcctttgtctcccaagctgctagagcggctccagcattgcagccatctcaggcagcgcctgctgaaggcgttagccagcctgctcccgccagaggggattttgcttatgcggcccctgcgccaccagatggggctctcagtcatccacaggcaccgagatggcctccgcatcccggaaagagtagagaagatagggatccgcagcgagacggccttcccggcccgtgcgcagtcgcccaaccaggtcccgcgcaggcaggcccacaagggcaaggcgtgctggctccccccacttcacagggctctccttggtggggatgggggcgcggacctcaggttgccggggccgcttgggagcctcaggccggcgaggctccaccccctcagccagccccgcccgatgcatccgctcggcagggccagatgcagggaattccagctcctagccaggctctccaggagcctgctccttggtccgccctaccatgcggactcttgctagatgaactactggccagcccagagttcctgcaacaggcacagcctctattggaaactgaagcaccaggagaactagaggcctctgaagaggccgcatccctggaggcgcctctttccgaggaagagtatagggccttgttggaggagctatag

SEQ ID NO: 19108 - DNA, 1458 bp, Artificial Sequence
  Description of Artificial Sequence: Synthetic coding sequence
atgaagggctggagcctgcccgcctgcggccccctgcagggccggctcgcaggctggcttgcagttagagcgggtcttctagcagcgcccgccgctgtccatagcccagccgaggtgcatggatcaccccccgccagcttgtgtccccgccccagtgtgaagtttagaccagggctgaccgctatggccctaccaacaccgtccgactccaccttgccagccgaagcacggggccggggccggcggcggaggttagtatggacaccgagtcagagtgaagcacttcgagcctgtttcgaaagaaacccctacccaggcatcgctacgagagagcggctcgcgcaggcgatcggaattccagagccccgagtgcagatatggtttcagaacgagaggtcgaggcagctgagacagcacaggcgtgagtcccggccgtggccaggcagacggggccccccagaaggcagacggaagcgtacagccgtcaccgggagccaaaccgcactgctgctgcgcgccttcgagaaggaccgctttccagggattgcagccagggaagaacttgcgagggaaacaggtttgcccgagagtaggattcagatctggtttcagaacagacgggcgaggcatcccgggcagggggggagggcacccgcacaggctggcggattgtgcagcgcagctcccggtggcgggcacccagcgccctcctgggtggccttcgctcacaccggtgcttggggcacggggttgccggccccacacgtaccatgcgctccaggggccttgccccagggcgcattcgtgagccaagcagctcgagcagcccccgcactccagccttctcaggccgctcccgcagagggcgtctcccaacctgcccctgcccggggggactttgcctacgccgcccctgctcctcccgacggtgctctctctcatccccaagcaccacggtggccaccccaccccgggaagtccagagaagacagagaccctcagcgggacggcctccctggaccttgtgccgtcgctcagccaggcccagcacaggcaggccctcaaggccaaggggtgctggctcctccaacaagtcagggatccccttggtggggatggggtagggggccacaggtcgcaggggcagcctgggaacctcaggcaggagccgccccccccccgcagccagctcccccggacgccagtgcttctgcaaggcagggccagatgcaggggataccagcgccttcgcaggctctccaggagcccgcaccatggagcgccctaccatgcgggctgctgcttgacgagctgctagcctcacctgagtttctgcagcaggcacagcccctgctggaaaccgaagcacccggagagctcgaggcctctgaagaggccgcctctctggaggcgccgctatccgaggaggagtacagggctctcctggaggagttgtag

SEQ ID NO: 19109 - DNA, 1275 bp, Artificial Sequence
  Description of Artificial Sequence: Synthetic coding sequence
atggccctgcccacccccagcgacagcaccctgcccgccgaggcccgagggcgcggacgaaggcggagattagtttggactccctctcagagcgaagctctccgcgcatgctttgagcggaatccctacccgggcatcgccacccgtgaacggctcgcccaggccattgggatccctgaacctagagtgcagatctggttccagaacgagagaagccgccagttgcgtcagcacagaagagagtctcgtccatggcctggtaggagagggcccccagaaggccggcggaagcgaactgccgtaacaggctcacagacagccctgttgctacgggcattcgaaaaagataggttccccgggatcgccgcacgtgaggagctggcccgggagactgggttgccagagtcccgcattcagatttggttccagaaccggcgtgcccggcatcccggtcagggcggccgcgcccccgctcaggctgggggattgtgcagcgcggctccaggcggaggacacccggcaccgtcttgggtggcttttgcgcacacgggtgcttggggcacaggtcttccagccccccatgttccttgcgcaccgggcgcccttccacaaggcgcattcgtgagccaagccgcgagggccgcaccagctctgcagccttcccaggccgcaccagcagaaggcgtgagccagccggcccctgcccgcggggattttgcctatgctgctcccgcaccccctgacggggccctgtctcatccacaggcgccccgctggccccctcacccaggaaaatcacgggaagatagggatccccagagggacggccttccgggaccttgtgccgtagcccagccagggccagcccaggccggaccgcaggggcagggagtcctggccccaccgacctctcaggggagcccatggtgggggtggggaagaggacctcaggtggccggtgccgcctgggaaccacaggctggtgcagctccaccaccccaacctgcaccccccgacgcaagcgctagtgccaggcaggggcagatgcagggcattcctgcaccgagtcaagcactgcaggagccagctccctggtccgcactgccgtgcggcctgcttttggacgagctactagcgtctcctgaattcctacaacaggcccaacccctgttggagactgaagcacctggagagctggaagccagcgaggaggctgcctcactggaggcacccttgtcagaggaggaatatcgtgctcttctcgaagagctgtag

SEQ ID NO: 19110 - DNA, 1275 bp, Artificial Sequence
  Description of Artificial Sequence: Synthetic coding sequence
atggccctgcccacccccagcgacagcaccctgcccgccgaggccaggggaaggggccggcggaggcggctggtgtggactccctctcagtcagaagcgcttcgtgcatgttttgagcgcaatccgtatcccggtatcgctacccgggagagactagcccaggccatcggtatacctgagccaagggtgcaaatctggttccaaaacgaaagatctcggcagcttcgccaacacaggcgggagtcacgcccctggcccggcaggcgtgggccgcccgagggtcggagaaaaaggaccgccgttacaggcagccagacggccttactgttacgtgcgtttgaaaaggacaggtttcctggtatcgctgctcgggaagagctggctcgggaaacgggcctccctgaatcacgcattcagatctggtttcagaataggagagccagacatcccgggcagggagggcgggccccagctcaggctggtggtctgtgcagtgctgcccctggaggcgggcaccctgcaccctcttgggtagctttcgcccatacaggcgcatggggaaccgggttacccgcaccgcatgtgccatgcgcacctggtgccctgccacagggcgccttcgtctctcaggcggcacgcgccgctcctgcgctgcagccaagtcaggccgcacctgctgagggcgtgtcccagcctgcccccgccagaggcgacttcgcttatgccgctccagcccccccagatggcgctctgtcgcacccccaggcccctcgatggcctcctcaccccggaaaatctcgcgaggaccgcgatccccaacgagacgggttgcccggcccctgcgccgtcgcccagcccggccccgctcaggcaggtccccagggacagggggtgttggccccacccaccagccagggctctccctggtggggctggggccgcggacctcaagtcgctggagccgcgtgggagcctcaagcgggtgccgcgccacctcctcagccagctcctcctgacgcaagcgcttccgctcggcagggccagatgcaggggattcccgctccatcccaagcgctgcaggaaccggccccctggagcgctctgccatgtggcttgttgttggatgagctgctggcttcaccagagttcctgcagcaagctcagcccctgctagaaactgaggccccgggggaactggaagcctccgaagaggctgcttcactcgaggccccactttcagaagaggagtaccgtgcattgttagaagagctttag

SEQ ID NO: 19111 - DNA, 1458 bp, Artificial Sequence
  Description of Artificial Sequence: Synthetic coding sequence
atgaagggctggagcctgcccgcctgcggccccctgcagggccggctcgccggctggctagcagtgcgcgccggtctcttagctgctccagcagcagtccattcccccgccgaggttcatgggtcgccgcccgcctccctgtgcccacggccatctgtgaagttccggccaggcctgacagccatggcattgccaaccccctcggattctactttacccgcagaagcccgaggtcgtggcagacgtcgtcgacttgtctggaccccttcgcaatctgaggccctgcgcgcctgcttcgaacggaatccctatccgggcatcgcgacaagggagagattggcgcaggccatcggaattcctgagccgcgcgtgcagatttggttccagaatgagagatccaggcagctacggcagcacaggagggagtctaggccgtggcctggccgccgcggccccccggaagggcgaaggaaacggaccgcagtcactgggtcccaaactgccttactgttgcgggcattcgagaaggaccgctttccaggaattgccgctagagaagaactggcccgcgagaccggacttcccgagtcgcggattcagatctggttccaaaatcgtcgggctcgccatcctgggcagggcggcagggcgcctgctcaagccggagggctgtgctccgccgctccggggggtggccaccccgcgccatcctgggtcgccttcgcgcacactggcgcctggggtacgggactcccagccccccacgtcccgtgtgctccgggtgctctgccacaaggcgctttcgtgtctcaggcagctcgcgccgcacctgccctccagccttcacaggccgctcctgcggagggcgtcagccagccagcccccgcccgtggtgattttgcctatgccgctcctgccccacccgacggtgccctgagccacccccaggcgccccgttggccgccccatcccggtaagagcagggaagaccgggatccacaaagagatggcctgcccggaccatgcgctgtggcccagccaggccctgcccaggcaggaccacagggtcaaggtgtcctcgccccacccacaagccagggcagcccatggtggggatggggccgcggacctcaagtggctggcgccgcctgggagccgcaggccggagccgcacctcccccgcagcccgccccccccgatgcctccgcctctgctcgccaaggccagatgcagggcattcccgcccctagtcaggccttacaagagcctgctccttggtcagcactcccatgcggtctgcttctcgatgagcttctggcctcccctgagttcctgcagcaggctcagccactcctggaaaccgaggctccaggagaattggaggctagtgaggaggctgcgagtctagaggcacctcttagcgaggaggagtaccgcgccctcctggaagaactatag

SEQ ID NO: 19112 - DNA, 1458 bp, Artificial Sequence
  Description of Artificial Sequence: Synthetic coding sequence
atgaagggctggagcctgcccgcctgcggccccctgcagggccggctcgctggttggcttgcggtcagggcaggcctgctggctgcccccgccgccgtccatagcccagctgaagtccacgggtccccacccgcttccctgtgccccagaccaagtgtgaagttcagacctgggctaacagcaatggctctgcccacaccaagcgatagcacattgccagccgaggcaaggggtaggggtcggcggagacgcctggtctggacaccctctcagagtgaagcattgcgggcgtgctttgaaaggaatccctaccccgggatcgctacacgtgagagactcgcccaagccatcggcatacctgaacctcgcgtgcaaatctggttccagaatgagcggagtagacagttaaggcagcacaggcgcgagtcaaggccatggccgggcaggcggggacctcctgaaggcaggcgcaaacggactgcagtgactggtagccagacagccctacttttaagggcattcgaaaaagaccggttcccaggtatcgctgccagagaagagcttgccagggaaactggactgccagaaagcaggatacagatctggtttcaaaatcggagagctagacacccagggcagggcggtagagctccagcccaagcgggaggcctctgtagcgccgcgccaggtgggggtcaccccgcaccaagctgggtagcattcgcccacactggagcttggggcaccggccttccggccccacatgtaccttgcgcacctggagctcttcctcagggcgccttcgtttctcaggcagcccgcgcagcgcccgcactgcagccttctcaggccgctcctgctgaaggagttagtcaacccgcacctgccagaggtgattttgcatacgctgctcccgctccccctgacggggcattgtcccatcctcaggcgcctcgctggcccccccacccaggaaagtcacgggaagacagagacccccagagagacgggctgccagggccttgcgcagtcgcccagcctggccccgcacaagcaggtccccaggggcagggagtgctcgccccccccacttctcagggtagcccatggtgggggtggggacgtgggcctcaggtagccggcgctgcatgggaaccccaggccggggctgctcccccccctcagcccgcacctcccgacgcttccgcttccgcacggcagggccagatgcaagggatcccagccccaagccaggcacttcaggaaccagcgccgtggagtgcactgccttgtgggctgctgctcgacgagctgcttgcctcaccagagtttctccagcaagcgcagcctctgctggagacagaagccccaggggagctggaagcttcagaggaggcagcatccctggaggctccgctttcagaagaggagtatcgagcccttcttgaagagctgtag

SEQ ID NO: 19113 - DNA, 1275 bp, Artificial Sequence
  Description of Artificial Sequence: Synthetic coding sequence
atggccctgcccacccccagcgacagcaccctgcccgccgaggccaggggaagaggacggagaagacgcttggtctggacaccgtcccagagcgaggctctgcgcgcttgtttcgaaagaaatccttaccccggaatcgccacgcgggagcgccttgcacaggcgattgggattcctgaacctagagtacagatctggttccagaacgagagaagccgccagctgcgccaacatagaagagaaagtagaccttggccaggccgccggggacctcccgagggcagaaggaaacgcaccgcagtcaccgggtcccaaaccgcactgctgctgcgggcttttgagaaggatcgtttcccagggatcgcggctcgggaggaactggcacgcgaaaccggcctgcctgagtctagaatccagatctggttccagaaccgcagagctcggcacccagggcagggtggaagagcacccgcccaagccgggggcctctgctccgccgctcctggtggcggccatccagcgccttcttgggtggcattcgctcacacaggcgcatggggcaccgggctcccagccccacatgtcccatgcgcaccgggggccctgcctcagggagcatttgtctcgcaggctgcccgggccgcccccgcattgcagccatcacaggctgcacccgccgagggcgtgagtcagcccgctcccgctaggggtgacttcgcatatgccgcccctgcccctcccgatggggccctctcacatccacaagcccctaggtggccaccacaccctggaaaatccagagaggacagagacccacagcgggacggactcccagggccatgcgctgttgcccagccaggccctgcccaggccggccctcagggccagggcgtgcttgcgcctcctacctcacagggcagcccgtggtggggatggggtcggggacctcaggtagcaggggccgcatgggagccccaggcaggggctgccccccctccccaaccagcccctcccgacgcatccgccagcgcacgccaagggcaaatgcagggaatccccgcgccctctcaggccttgcaggagcccgccccctggtctgctctgccatgcggcctactcctggacgaactcctggcctctcccgaattcttgcagcaggcacaacccctcctggaaacagaggcaccaggtgaactcgaagcatcagaggaagccgccagtctggaggcaccattatcggaagaagagtatcgagccctcctggaagaactatag

SEQ ID NO: 19114 - DNA, 1275 bp, Artificial Sequence
  Description of Artificial Sequence: Synthetic coding sequence
atggccctgcccacccccagcgacagcaccctgcccgccgaggcccgtggacggggccgccggcggaggctggtttggaccccaagccagtccgaagctctcagggcctgctttgaacgaaatccttatcccgggatcgccaccagggaacggctggcccaggcaattggtatccccgagcctcgggtccagatttggtttcagaacgaacggagtcgacagctcaggcagcaccgtagggaatcgagaccttggcctggaaggcgagggccccccgaggggaggagaaaaaggaccgcggtgacagggagccagactgcattgttattacgcgcctttgaaaaggacagatttcctgggatagcagcccgggaagagcttgctcgtgagactggcctgccagagtcacggatccagatatggttccagaaccggcgcgcacggcaccccgggcaggggggccgagcgcccgcgcaggcgggagggctatgttccgccgccccagggggggggcaccctgcaccctcgtgggtcgccttcgctcacactggagcatggggcacgggcctgcccgcccctcacgtgccgtgtgcgcctggggctctgccccagggagccttcgtgagccaggctgctcgtgccgccccagccttacaaccatctcaggccgcccctgcagagggcgtgtctcagcctgcaccagccagaggcgattttgcttacgccgctcctgctccacccgacggtgcgctcagtcatccacaggcaccgaggtggcctccccacccaggaaaaagccgcgaagatcgcgacccacaacgcgatggcctgcccggaccttgcgccgttgcccagcccggccctgcccaggcagggccgcagggccagggggtgttggcgccccctacatctcaaggctcgccatggtgggggtggggcaggggcccccaggtcgctggagccgcatgggaaccccaggcgggagccgccccgcccccccagcctgcacccccggatgcttccgcctcagcccggcagggccagatgcagggcatacccgccccgtcccaagccctccaggagcctgccccttggtctgcccttccgtgcgggctgttacttgacgagcttctagcgtctcccgagtttctgcagcaggcccagccattattagagacggaagcgcctggcgagttggaggcatcagaggaggcggcgtcccttgaagcacctctgagcgaagaagagtatagagctctattggaggaactgtag

SEQ ID NO: 19115 - DNA, 1419 bp, Artificial Sequence
  Description of Artificial Sequence: Synthetic coding sequence
atgaacggctacggcagcccctacctgtacatgggcggccccgtgtctcagcctccccgggctccccttcagcgcactcctaagtgcgcccggtgcagaaatcatggagtgctgtcctggctgaaaggccacaaacgatattgcagatttaaagattgtacctgcgaaaaatgcattctcatcatcgagagacagagagtaatggctgcccaagtggccttgcggcgccagcaggcaaatgaaagtctcgagtcgctgattcccgattcacttagggccctacctggtcccccgccacccggcgatgcagtagccgcacctcagccacccccggccagccagccctcccaaccccagcctcctcgccccgctgcagagctcgctgccgctgccgccctgcgatggactgccgaaccccagccaggggcactgcaggctcagctggctaagcccgacctcaccgaagagaggctgggagacggcaaaagtgctgacaacaccgaggtctttagtgataaggatacggaccagcgcagcagccccgacgtcgctaaaagcaagggatgcttcacacccgagtcacctgaaattgtcagcgtcgaggagggaggatatgcggtccaaaaaaatggtgggaaccctgagagccggcccgactcccccaaatgtcatgctgagcagaatcacctgctgatcgaggggccctcagggacagtcagtcttccattcagcctcaaagccaaccggccacccctggaagtcctgaaaaaaatattccccaatcagaagcccactgtattggaactgattctaaaggggtgtggcggagatctcgttagtgcagttgaggtactgctgagctctcggtctagcgtgacaggagcagaaaggacaagtgcagaacctgaaagcttggcgcttccttcaaacgggcatatcttcgagcatacactgagcagctatccaatttcttcaagtaagtggagcgttggcagtgctttccgggtgccagacacccttaggttctcagctgattccagcaatgttgttccgtcccccctggctgggcccttgcagcccccttttccccagcccccacgctatcctctgatgttgcgaaatacattagcaagatctcagagcagcccctttctacccaacgacgtgacactatggaatactatgacactgcagcagcagtatcaattgcggagccagtacgtgtccccgttcccttcaaactccacctctgtgtttcggagttcacctgtgctaccagcccgtgccacagaagacccacggatcagcattcccgacgacggttgccctttcgtgtctaaacagtccatatatacagaagacgactacgatgagcgctcagactctagtgactcccggacccttaatacgtcctcttag

SEQ ID NO: 19116 - DNA, 339 bp, Artificial Sequence
  Description of Artificial Sequence: Synthetic coding sequence
atgcacacccggaagcggctgacccagctgttctgcttccccgaccttacagaagagagactgggcgatggtaaatctgccgacaataccgaggttttcagtgataaagacactgatcagagatcatctcccgacgttgccaagagcaaaggctgcttcacccctgaaagccccgaaatcgtctctgtggaggagggtgggtacgctgtgcagaagaatggaggcaacccggagagccgtcctgactctcctaaatgccacgctgaacagaatcaccttctgatagaaggaccgtcaggcaccgtgagccttcctttttctctaaaggcgaataggtag

SEQ ID NO: 19117 - DNA, 1701 bp, Artificial Sequence
  Description of Artificial Sequence: Synthetic coding sequence
atggccctgagcgtgcccggctacagccccggcttccggaagccccctgaggttgtacggctgcgtcgcaaaagagcgcgctctagaggtgcagccgccagcccgccccgggaactgaccgagccagccgccaggcgcgccgcgctggtcgccgggctgccattgcgaccatttcccgctgctgggggtagaggtggtggctcaggcggtgggcctgccgctgcccgcagaaatcctttcgcccggttagacaatcgcccacgggtcgcagctgaaccaccagatggacctgctcgggaacagccggaggcccccgtcccttttctcgactctaaccaggagaacgatctgctctgggaggagaagttccccgaacgcacgactgtgaccgaactgccacaaacttcccatgttagcttctcagagcctgatattcccagttctaagagcaccgaactgccggtagactggtctattaagacgagactgctttttacatcttcccagccattcacatgggctgaccatttaaaggcacaggaagaagctcagggacttgtgcagcactgtagggcaacagaggtaactctgcccaagagcatacaggatccaaagctcagctcagaattgaggtgcacatttcaacagagcttaatctactggctgcaccccgccctgtcctggctgcccctgtttccacggataggcgctgacagaaagatggccggaaagacttcaccttggtctaacgacgcgaccctgcagcatgtcttaatgagtgattggtctgtgtctttcacttcgctgtacaatttgctcaagacaaagctgtgcccttacttttacgtttgtacataccagtttacagtactgtttcgcgccgcaggcctggctggctctgacctcattacagccttgatttcaccaacaacccgcgggctgagggaggccatgcgaaacgaaggcatcgagtttagtctcccattaatcaaggagtccggccataagaaggaaactgcctcaggaacatctcttggttatggggaggaacaggccatctcagatgaggacgaggaggagtcgttctcatggttagaagagatgggcgtgcaggataagattaaaaagcccgacatcttaagcatcaagttgcggaaagaaaagcatgaggtgcagatggaccatcgccccgaatcagtggtgctggttaagggcattaacaccttcaccctattgaactttctgatcaacagcaagtcccttgttgccacctcggggccccaagccggcttgccgccaaccctcctctctcccgtggccttcagaggggccacgatgcaaatgcttaaggcgcgctccgtcaatgtgaaaacccaggctctctcgggataccgagatcagttcagtttagaaatcacggggcctatcatgccgcattccctccactccctgacgatgctcctcaagtcctctcagtccggaagtttttccgccgtcctgtaccctcatgagcctacggcagtattcaatatctgcctacagatggataaggtcctggacatggaggtggtgcacaaagagttaactaactgcggcctgcatccaaacaccctggaacagctgagccagataccgctcttaggcaaatcaagtctcagaaacgtagtgctcagagactacatctataattggcgtagttag

SEQ ID NO: 19118 - DNA, 618 bp, Artificial Sequence
  Description of Artificial Sequence: Synthetic coding sequence
atgcccagcaagaagaagaagtacaacgcccggttcccccccgcccgcattaagaaaatcatgcaaactgatgaagagatcgggaaggtagcggcagccgtgcccgtaatcatctcccgggccctcgagctattcctggagtccctgcttaaaaaggcgtgccaggtgacccaatccaggaatgcgaaaacgatgacgacctcacacttgaaacagtgcatcgaactggaacaacagtttgacttcctaaaggacctcgttgcctccgtccccgatatgcagggcgacggggaggataatcacatggacggcgataaaggcgcccggcgcggtcggaagcccggatcgggggggagaaaaaacggagggatggggactaagagtaaggataagaagctcagcgggacggactccgagcaggaggacgagtccgaagacaccgacaccgatggcgaggaggagacaagtcagccacccccacaggcgtctcatccgtcagcacacttccagagtcctccaactccttttctgccattcgcttccacactccctctccccccagcccccccaggccccagcgcacccgacgaggaggacgaagaagactatgactcatag

SEQ ID NO: 19119 - DNA, 750 bp, Artificial Sequence
  Description of Artificial Sequence: Synthetic coding sequence
atgaaccccagccccagcaagatccggatcaacctggaggacaacgtacagtatgtcagtatgaggaaggctctcaaggttaagagaccacgctttgacgtgtctctcgtctacttgacacgcaagtttatggatctggtacgctccgctcctggaggcatcctggatttgaataaagtcgccaccaaactcggtgtcaggaaacgccgggtgtacgatatcaccaacgtgctcgacggcatcgatttggtggagaaaaagtcgaagaaccatatcaggtggatcggcagtgacttgagcaacttcggcgccgtcccccagcagaagaagctccaggaagagctatcagacctgtcagcaatggaggacgctttggatgaactaatcaaagattgtgcgcaacaacttttcgagctgactgatgataaggaaaacgaacgtctagcatacgtcacttaccaagatattcacagtatccaggcgttccacgaacaaatcgtgatcgcagtaaaagctcccgctgagacacggctcgatgtgcccgccccgcgggaggactctatcactgttcacatcaggtcgacaaacggccctattgatgtatacctgtgcgaagtggagcagggacagacctctaataagaggtccgaaggggtgggaaccagcagcagcgagtctacacaccctgaggggcctgaggaggaagaaaacccgcaacagagtgaggaactgttggaggtctcaaattag

SEQ ID NO: 19120 - DNA, 402 bp, Artificial Sequence
  Description of Artificial Sequence: Synthetic coding sequence
atgagccagcagcggcccgcccggaagctgcccagcctgctgctggaccccacagaagagacggtgagaaggcggtgccgggacccgattaacgtagagggccttctgccttcaaagattcgcattaacctggaagacaacgtgcagtacgtgagcatgagaaaagcactaaaggtgaagagacctcggtttgacgttagtctggtttacctcacccgaaagtttatggacctggtgcgctcagctcctggcggcattttggacctgaacaaggtggccactaagctgggcgtcaggaaaaggcgggtatacgacattactaacgtcctggatggcattgaccttgtggagaagaagagcaaaaaccatattcgctggatgacactgtcccagtgcacgtag

SEQ ID NO: 19121 - DNA, 846 bp, Artificial Sequence
  Description of Artificial Sequence: Synthetic coding sequence
atgagccagcagcggcccgcccggaagctgcccagcctgctgctggacccaacagaggagaccgtccgtcgaaggtgtagggatcctatcaatgttgaggggctgctcccctctaaaatcaggatcaacctggaggacaacgttcaatacgtgtccatgagaaaggctctgaaagtcaaaagaccacgttttgacgtgtcactggtttatctcaccagaaagtttatggatcttgtgcggtccgcaccaggcgggatcctggacctaaacaaggtggcaacaaagctgggggtcagaaagaggagggtctatgacataactaacgtcctggacgggatcgacctggtggagaagaaatctaagaatcacattaggtggatcgggagcgacctatctaatttcggtgccgtcccccaacagaagaagctgcaggaggaactgtctgatcttagcgcaatggaagatgcccttgacgagctgattaaagactgcgctcagcagctcttcgaattgaccgacgataaggagaatgagaggctcgcgtatgtgacttaccaggacatccactcgatccaggcctttcacgaacagatcgttattgccgtgaaagcacctgccgagactcggctggacgtgcccgccccccgggaggactccattacagtgcatataagatccactaatggacctatcgatgtgtacctctgtgaggtcgaacagggccagacctctaacaagagaagcgagggagtaggcactagcagctcggaaagcacccaccctgaggggccggaagaggaggagaatcctcagcaatctgaagaactactggaagtatccaattag

SEQ ID NO: 19122 - DNA, 621 bp, Artificial Sequence
  Description of Artificial Sequence: Synthetic coding sequence
atggacctggtgcggagcgcccccggcggcatcctggacctgaacaaggttgctactaagctcggcgtccgtaaacggcgtgtgtatgacattactaatgtattagatgggatcgacctggttgagaagaagtcaaagaatcatatccgctggatcggcagcgatctgagtaacttcggcgccgtgcctcagcagaagaagctgcaggaggaactttcagatcttagcgccatggaggatgctcttgatgaattgattaaagactgcgcacagcagctgtttgagcttactgatgacaaggaaaacgaaagacttgcctatgtgacttatcaggacattcactcaatacaggcgttccacgagcagattgtgattgctgtcaaggccccggctgagacacgcttggacgtcccggcccccagagaggactccatcacagttcacatcagatctactaacggtccaattgacgtgtacttatgtgaggtcgagcagggacagacaagtaacaagcgaagcgagggtgtggggactagtagctctgagagtacacaccccgaaggacccgaggaagaagagaatccacagcagtctgaggagctcttggaggtctccaactag

SEQ ID NO: 19123 - DNA, 621 bp, Artificial Sequence
  Description of Artificial Sequence: Synthetic coding sequence
atggacctggtgcggagcgcccccggcggcatcctggacctgaacaaggttgctacgaagctgggagtcaggaagaggagagtgtacgacatcactaacgtcctggacggcattgacttagtggagaagaagtcgaagaatcatattaggtggattggatctgatctgagtaatttcggcgctgtgcctcaacagaagaagctacaagaagagttgagcgatctgtccgccatggaagatgctctggacgaattaattaaggattgtgcacaacaattgtttgagctcaccgatgacaaggaaaacgagaggctcgcctatgtcacatatcaggacattcattctatccaggctttccacgagcagattgtcatcgcggtcaaagcgccagctgagacgaggctggatgtaccagccccacgcgaggatagcataacagtgcatatacggtccacaaacggcccaatagatgtctatctttgcgaggtggagcaggggcagacctctaacaaacggagcgagggagttggtacctcatcgagcgagtccacccaccccgaagggcccgaagaagaagagaatcctcagcaatccgaagagcttctcgaggtgagcaactag

SEQ ID NO: 19124 - DNA, 1860 bp, Artificial Sequence
  Description of Artificial Sequence: Synthetic coding sequence
atggccgccgtggtgcagcagaacgacctggtgttcgagttcgcctctaacgtcatggaggacgaacgacagctgggcgatcctgcaatattccccgcagttattgtggagcatgtacccggtgccgacattctcaacagctacgcagggttggcatgcgtggaggagcctaacgatatgattactgagtcttcattagatgtggctgaagaagaaattattgatgatgatgacgatgacattacactgacagtggaagcttcatgccatgatggggacgaaactatcgagaccattgaggcagccgaggctctgttaaatatggacagtcccggacctatgctcgatgaaaagaggatcaataacaatatcttctcctctcctgaggatgatatggtggttgcgccagtcacccacgtatctgtcacgctggacggcattccagaagtgatggaaactcagcaggtgcaggagaaatatgcagatagccctggagcttcctcccctgaacaacccaagagaaaaaaagggagaaagaccaagccccctcggcctgatagcccagcgacaactccaaatattagcgtaaagaagaaaaacaaggatggaaaaggcaatacgatatacctgtgggagttcctcctcgcccttctacaggataaggccacctgccctaagtacataaaatggactcagcgcgaaaaaggaatctttaagctcgtcgatagcaaagccgttagtagactctggggaaagcacaaaaacaagcccgacatgaattatgaaactatgggacgagccctgcgctactattatcaaagagggattcttgctaaggtcgaaggacagcgacttgtgtaccagtttaaggagatgccaaaggatctcatttatattaatgacgaggatcctagcagctccatcgagtctagcgaccccagtctatcaagttctgcgacgagtaacagaaaccagactagcagatctcgagtgagcagttctcctggggtaaagggcggggctacaactgtccttaagccgggcaactctaaggccgcgaagcccaaggatcccgttgaggtagcacagccgagtgaggtactgcgaaccgtccagcccacccagtctccttatcccacacagctctttcgaaccgtccacgtggtccaaccagtacaagcagtgcctgagggcgaggccgctaggacctccactatgcaggacgaaacattgaactcatccgtgcagagcattcggactatccaggcccccacacaggtccccgtcgttgtgagcccccgtaaccagcagctgcacactgttacgcttcagactgtgccactgactaccgtgatagcttcaactgatccgtcagcggggaccggctctcagaagtttatactgcaggcgataccaagttcccagccaatgacagtgctcaaagagaacgttatgctccagtcacaaaaagctggaagtcctccttcaattgttttaggtccagcacaggtgcagcaggtgcttactagtaatgtgcaaactatttgcaacggcacagtgtccgttgccagctccccctcattttctgctaccgcgcccgtggtcaccttttcacctaggagctcacagttagtcgcacatccgccaggaaccgtcatcaccagcgtgatcaaaacccaggaaactaagaccctgacgcaggaggttgaaaaaaaggagtcggaagaccatctgaaggagaacaccgagaaaactgaacagcagcctcagccttatgtcatggtcgtctcctcctccaatggcttcacatcccaagtggcaatgaagcaaaatgagctgctggaacccaatagcttctag

SEQ ID NO: 19125 - DNA, 1086 bp, Artificial Sequence
  Description of Artificial Sequence: Synthetic coding sequence
atgaactacgagaccatgggccgggccctgcggtactactaccagaggggcattctcgccaaggtcgagggccagcggttggtataccagttcaaggagatgccaaaggatctgatttatatcaacgatgaggacccctccagtagtattgagagctccgacccatcactaagcagctctgccaccagtaaccgcaatcagacatccaggagccgagtgtcctctagccccggagtgaagggtggcgccaccacggtcctgaaacctggtaacagtaaagctgccaaacccaaagaccccgttgaagtggcccaaccttcagaagtcctgcgcacagtgcagccaactcaatctccctatccaacccagcttttcaggaccgttcatgttgtgcaaccagtacaggctgtgcccgagggcgaagcggcacggactagcacgatgcaggacgagacgcttaatagttccgtgcagtctattcgcacaatccaggcacccacgcaagtgcctgtagtcgtctcacctcgcaaccagcagttacacacggtaacactccagactgtcccactaactacggttatcgcctctactgatccctctgccggcactggctcgcagaaattcatcctgcaggctatacccagcagtcaacccatgacagtcctgaaagaaaatgtcatgctgcagagtcagaaagctgggtctccaccatctatcgtgctgggccctgcacaggtccagcaagtgttgaccagcaatgtgcaaaccatttgcaatggcacagtttcagtggcctcctctccctcattctccgctactgcccccgtggtgactttctcccctcgcagcagtcagctcgtagcccatccaccaggcaccgtgattacaagtgtaatcaaaacacaagaaacaaagacgctgactcaggaagttgagaaaaaagagtccgaggatcacctcaaggaaaatacagaaaaaacagagcagcagccgcagccatatgtgatggtggtgtcgagttctaatgggtttacttcccaggtagctatgaagcagaacgaactgcttgagcctaattccttctag

SEQ ID NO: 19126 - DNA, 75 bp, Artificial Sequence
  Description of Artificial Sequence: Synthetic coding sequence
atggccgccgtggtgcagcagaacgacctggtgttcgagttcgccagcaacgtgatggaagacgaacgacagtag

SEQ ID NO: 19127 - DNA, 1788 bp, Artificial Sequence
  Description of Artificial Sequence: Synthetic coding sequence
atggccgccgtggtgcagcagaacgacctggtgttcgagttcgcctcaaatgtcatggaggacgagcggcagctcggtgatccggcgatctttcccgccgtgattgtggaacacgtgccaggtgccgacatcctgaactcctacgccgggctggcttgcgtggaagagcctaatgacatgataaccgagagctcgttagatgtcgcggaagaggaaattattgatgacgatgacgacgacattactcttaccgtggaggcgagctgtcatgacggagatgaaactatagagactattgaggccgccgaggccctgttaaacatggactcaccaggaccaatgctggatgagaagaggataaatggcatcccggaggtgatggaaacccagcaagttcaagagaagtacgcagacagtccaggagcctcgtctccagagcaacctaagcggaagaaaggcaggaagaccaaacccccccgccccgattcaccggccaccacccccaacatttcagtcaaaaaaaagaacaaggatggtaagggcaacaccatttatctgtgggaattcctgttggcactcctgcaggacaaggccacttgccccaagtacatcaagtggacccagcgtgagaagggcatctttaagcttgtcgattctaaggcagttagcaggctctgggggaagcataagaacaaacccgacatgaattacgagaccatgggtcgagcactccgttattactaccagcgcggtatcttagcaaaggttgaaggccagagactagtataccagttcaaggaaatgcctaaggatctcatctacatcaatgacgaagatccctcctcctcaatcgaatcatcagatccaagcctgtccagctcagccacgtcgaacaggaaccagacatctcggtcacgtgtgagctccagtcccggagtgaagggtggtgctacaactgtgctcaagcccggcaattctaaggctgccaagcccaaagatccagtggaggtcgcccagccttctgaggtcctgagaacagtgcagcctacccagtcaccttacccgacgcagctgtttcgaacagtgcatgtggtgcaacccgtgcaggccgttcccgaaggagaagccgctcgcacctccacaatgcaagatgagaccctgaactcgagcgtacaaagtataaggaccatccaggcacctacgcaagtcccggtggtagtctcaccgagaaaccagcaactgcataccgtgaccttgcagactgttcccctcaccactgtcatagcaagcaccgacccctctgccggaactgggtcacagaaattcattcttcaggccattccatccagccaacccatgacagtactgaaggaaaatgtgatgctgcagagccagaaagcaggcagtccaccatctattgttcttggacccgcccaagtccaacaggtcttaacatctaatgttcagacaatttgcaatggaactgtttcagttgcttcatcaccttcattcagcgcaaccgctcctgttgtgactttcagccctcgttctagtcagctggtggctcacccacccggcacagtgatcacttccgttatcaaaacccaagagacaaaaactctgacacaggaagtggagaaaaaggagagtgaggatcacttaaaagaaaacacggagaaaaccgaacagcaaccacaaccgtatgtcatggttgtgtcttcaagtaacggtttcacaagccaggtcgctatgaagcagaacgagctgctcgagcctaattcattttag

SEQ ID NO: 19128 - DNA, 1776 bp, Artificial Sequence
  Description of Artificial Sequence: Synthetic coding sequence
atgttcggcatccaggagagcatccagcggagcggcagcagcatgaaagaggagccactaggtagcggcatgaacgcagtcaggacatggatgcagggagctggcgtgttagacgctaacactgctgctcagtcaggtgtgggactggcaagagcccacttcgagaaacaacctccctccaatctacggaaaagcaacttctttcacttcgtcctggctctctatgaccgacagggacagcccgtcgagattgaaagaaccgcgtttgtgggcttcgtcgaaaaagaaaaagaggcaaatagcgaaaagacaaacaacggcatacattacagactgcagctgctgtactctaatggcattcgaaccgagcaagacttctatgtccgcctcatcgactccatgacaaagcaggcgatcgtgtatgagggacaggataaaaatcctgagatgtgccgagtcctcctcacacatgaaatcatgtgcagtagatgctgtgataagaagtcatgtggcaatagaaacgagacaccttcggaccctgtcatcattgatcgctttttcttaaagtttttcctcaagtgcaatcagaactgcctgaagaacgcgggaaatccccgcgatatgcgccggttccaggttgtcgtctctacgacagtgaacgtcgatggtcacgtgctagcagtgtcggataacatgtttgtgcataacaactctaaacacggaaggagagccagacggctggacccaagtgagggcactccaagttacctcgaacatgctacgccatgtataaaggcgattagtccgtctgaagggtggacaacaggcggagcaacagtcataattattggcgacaatttcttcgatggtctccaggttatctttggtacgatgttagtatggagtgaactgataactccccacgctatccgggtgcagactccacctcgccatattcccggggtcgttgaggtgacgttgtcttacaaaagtaagcagttctgcaagggcacgcccggccgatttatatatacggctttaaacgagcccacaattgactacggatttcagcggctgcagaaggtaattcctagacaccccggcgacccagaaagactgccgaaagaggtcatactgaagagggcagctgaccttgtggaagcactgtacgggatgccgcataataaccaagagataattctcaagcgggctgccgacattgctgaggctctttactctgtgccccggaatcataaccagctgccagccctggccaacacgtcggtgcacgccgggatgatgggcgttaattccttctctggtcagctggctgtcaatgtctccgaagcttctcaggccacgaaccagggattcacccgcaattcaagcagcgtttcacctcatggttatgttccttccactaccccccaacagactaattacaacagtgtaaccacctctatgaacggatacggttctgccgccatgtctaatctgggcgggtcacctacatttctgaacggttcagccgcaaacagcccctacgcgatcgttcccagcagtccaaccatggcatcttccactagcttgccatctaattgctcatctagttctggaattttctctttttcccccgccaatatggtgagtgccgtcaagcagaagtccgcctttgcccccgtggtgaggcctcagacttccccacccccaacatgcacatccacaaacgggaactcccttcaggccatatctgggatgatcgtgcccccaatgtag

SEQ ID NO: 19129 - DNA, 1776 bp, Artificial Sequence
  Description of Artificial Sequence: Synthetic coding sequence
atgttcggcatccaggagagcatccagcggagcggcagcagcatgaaagaagaaccactgggatccggaatgaatgcagttcgaacctggatgcagggcgccggcgtcctcgatgccaatacggctgctcaatccggggtgggtttggcgagggctcacttcgagaagcaacctcctagtaatcttagaaagtctaattttttccactttgtattggcgttatacgaccgtcagggacaacccgtcgaaatcgaacgtaccgctttcgtgggattcgtcgaaaaagagaaagaggcaaactcagagaaaacaaacaatgggattcactatcgcctccagttactttacagtaatggtattcgaaccgaacaggacttctatgtgcgcctcatcgactctatgacaaaacaggccatcgtctatgaggggcaggacaaaaaccccgaaatgtgccgcgtgttactcacgcacgaaattatgtgcagcaggtgttgcgacaagaaaagttgtggtaaccgtaatgaaacgccaagcgaccccgtaatcattgaccgctttttcctcaagttcttcctgaagtgcaaccagaattgcctgaaaaacgcagggaatcccagggatatgagaagatttcaggtcgtggtatccaccactgtgaacgttgacgggcatgtgctggccgtatcggacaacatgttcgtgcataataattccaagcatggtcgcagagctcgcaggctagatcccagcgaagggacgccttcctatctcgaacacgctactccatgcatcaaggcaataagcccgagtgaagggtggaccacgggtggggctacagtgattatcatcggtgacaacttcttcgatggcctacaggtgatcttcgggacgatgctggtctggtcggagcttataacgcctcacgccattcgcgtccagacgcccccaaggcatatccccggggtggtggaggttactctgagctacaagagcaagcagttttgcaaggggacaccaggacgcttcatctatacagccctgaacgaaccaaccatagactacggattccaacggctgcagaaagtgatacccaggcacccgggagacccagagaggttgcctaaggaggttatccttaagcgcgcagcagatcttgtcgaagccctgtatgggatgccccacaacaaccaggagataattctcaagcgcgctgcagacatcgcggaagctctttactccgtgcccaggaaccacaatcagctccccgcactggccaacaccagtgtccacgccggcatgatgggagtgaatagcttcagcggccagctcgctgtgaatgtctccgaggcttcccaggccaccaaccagggcttcacacgaaacagttcctctgtcagtccccacggctacgtacctagtacaacaccacagcaaaccaactacaactccgtgacaacaagcatgaatggctacggaagcgccgccatgagcaatctgggagggagtccaacttttctgaacggcagcgccgcaaactctccctacgccatagtaccctcttctccgactatggcttcatctaccagcctcccctcaaattgttcctctagctccgggatattttcattttcacctgccaatatggtatcagcagtgaagcagaagagcgcgtttgcccctgtggttcgccctcagacgtcacctccccctacatgcaccagtacaaatggaaattctttgcaggccatcagtggtatgatcgtgcccccgatgtag

SEQ ID NO: 19130 - DNA, 1683 bp, Artificial Sequence
  Description of Artificial Sequence: Synthetic coding sequence
atgttcggcatccaggagagcatccagcggagcggcagcagcatgaaagaggagcctctgggtagcgggatgaacgctgttcgaacgtggatgcaaggtgcaggcgtgcttgatgccaacaccgccgcccagtctggagtggggctggcccgggctcatttcgagaagcagcctcctagcaatcttaggaaaagcaacttctttcactttgtcctggctctatatgaccggcaggggcagccagtagaaatcgaaaggacagccttcgtgggattcgtagaaaaggagaaggaagctaacagcgagaagactaataatgggatacactacaggctacagctcctgtactcaaacggaatacggaccgagcaggatttctatgtgcgtctgatcgactccatgacaaaacaggccatagtgtacgaggggcaggacaagaaccccgaaatgtgccgagtacttttaactcacgagataatgtgcaggttctttttgaagttcttcttaaaatgtaaccagaattgtctgaaaaatgctgggaaccctagagacatgaggaggtttcaagtcgtggtttccacgaccgttaatgtcgacggccacgtactagcagtctccgacaatatgttcgtgcacaacaactcaaaacacgggagacgcgcccggagacttgaccccagtgaagctacaccctgcataaaggctatatccccctcagagggatggactacaggcggggcaactgtcatcattataggagataatttcttcgacggcctccaggtgatcttcggcactatgctggtgtggagtgagctgatcaccccccacgccatcagggtccagacccctcctaggcatatccccggagtggtagaggttacactcagctataaatctaagcagttttgcaagggaacaccagggaggtttatatacacagctctgaacgaaccaacaatagactacgggttccagcgccttcagaaggtgatcccccgtcaccctggggatcccgaacggctgcccaaggaagtcattctcaaacgggccgcggatctggtcgaggccctgtacgggatgccccacaataatcaggagatcatcctgaaacgtgccgcggacatcgccgaggcgttgtatagcgtgcctcggaatcacaaccagctacccgccctggcaaataccagcgttcacgctggcatgatgggagtaaacagcttttctggtcagcttgccgtcaacgtcagcgaagcgagccaggctaccaatcaggggttcactcgtaattccagttctgtcagtccccacggatatgtgccctcaactactcctcaacagacaaattacaatagcgttactaccagcatgaacggctacggttctgccgctatgtctaacctgggaggctcacctacttttctcaacgggtctgccgcaaattccccgtatgctattgtgccttcctcccctactatggccagtagtacttcattgccgagcaattgctcatcctcctcaggcatttttagtttctctccagccaatatggtgagcgctgtgaagcagaagtccgcattcgctcccgtggttcgtccacagaccagtcccccgccgacctgtacaagtactaatggaaactccctgcaggccatcagcggtatgatcgtccccccgatgtag

SEQ ID NO: 19131 - DNA, 4506 bp, Artificial Sequence
  Description of Artificial Sequence: Synthetic coding sequence
atgtgcaagatggccatcatccccgactggctgcggagccacccccacactaggaagtttacccactcacgccctcattccagtccgtgtagggtgtacagccgaaatggatctcctaacaagttccggtcgagctccacgacagccgttgcgaatccgacactctcttccctcgatgtcaagaggattctgtttcaaaaaataactgaccgcggtgacgagctgcagaaagcctttcagctactggatactgggcagaatctgacggtttccaagagtgagctgcggaggatcatcacagacttcttgatgcctctgacaagggagcaattccaggacgtcctggcgcagattcccttgtctactagcgggaccgtgccctatctggccttcctgtcccgcttcggcggtattgatctgtacatcaatggcatcaaacgcgggggcgggaacgaaatgaattgctgtaggactttgagggagttagagatccaggtaggcgagaaggtgtttaagaacattaagacagtaatgaaggccttcgagctcatcgacgtcaacaaaacaggactggttagaccccaggaactacgtagagtgctggagaccttttgtatgaagctgcgcgatgaggaatacgagaaattctctaaacattataacattcacaaagacactgcagtcgactataatgtgtttcttaaaaacctgtcaatcaataatgacctgaatctgagatattgtatgggcaaccaggaggtctcactggagaatcagcaggccaagaattcaaaaaaggagcgccttctcggttcggcctctagtgaggacatctggcgtaattattcattagacgagatagagagaaacttttgcctccagctgtctaagtcatacgagaaagtagaaaaggcgctcagcgctggcgacccatgcaaaggcggatatgtgagctttaactacctcaaaattgtcctcgacaccttcgtgtaccagatccctaggagaatctttattcagctgatgaaaaggtttggcttgaaagccaccacaaagataaattggaagcagttccttacgagcttccacgaaccgcagggtctgcaggtgagcagcaaggggcctcttaccaaaagaaattccatcaactctaggaacgagagccacaaagagaacatcattactaagctctttcggcataccgaagatcatagcgccagtctaaagaaggcccttcttataattaatactaagcccgacggtcctataacaagggaggaatttcgctatatccttaactgcatggctgtgaagttgtccgacagcgagttcaaggagctgatgcagatgttggacccaggcgacacgggcgtggtgaacacctcaatgttcatcgatctgattgaagagaactgcagaatgcgtaaaacgtcaccttgtacagacgcaaagacaccatttttgctggcctgggattccgtggaagaaatcgtgcacgacacaatcacacggaatctgcaggctttctacaacatgctaagatcctacgatttgggcgataccggccggatcggcaggaacaatttcaaaaagataatgcacgtgttttgtccgttcttgacaaacgctcactttatcaaactgtgcagcaaaattcaggacattggatctggcaggatcttgtacaaaaagcttctggcgtgcattgggattgacgggccaccaacagtgagtccagtcctagtcccaaaggatcaactgctttccgagcacctgcaaaaagacgaacagcagcagccagacctgtcagagagaactaaactgaccgaagacaaaaccacgttaaccaagaagatgaccaccgaagaggtcattgagaagttcaagaaatgcatacagcagcaggacccggcgttcaagaagcgattcttggactttagtaaggagcccaatggaaaaattaatgtccacgacttcaaaaaagtcctggaggatacaggcatgcccatggacgacgaccagtacgccttgttgactacaaagatcggattcgaaaaagaagggatgagctatctagacttcgcggccggatttgaggacccccccatgcgcggccctgagaccaccccgccccagccacctacacctagtaaatcttacgtgaatagtcattttatcactgctgaagaatgtctgaaactgttccctcgcagactgaaggaaagctttagggacccttactccgcctttttcaagacagacgctgatagggatggtatcatcaacatgcatgatctacaccgcctcctgctgcacctgcttctgaaccttaaagatgatgagtttgagcgctttctggggctcctgggtctgcggctctctgtgaccctcaactttagggagtttcaaaacttgtgtgaaaaacgcccctggcgcaccgatgaggctccccaacggctgatccgcccaaaacagaaggtggccgacagtgaactcgcatgcgagcaagcccaccaatatcttgtcaccaaggccaagaaccggtggtcagacttaagcaaaaacttcctggagacagataatgaagggaatgggatactgagacgcagagacatcaagaacgcactgtacggatttgacatccccctcactcctcgcgaattcgaaaagctctgggcacgctatgatacagaaggaaaagggcacataacctaccaggaatttcttcagaaattgggcattaactacagtccagccgtgcaccggccttgcgctgaggattacttcaatttcatgggtcacttcaccaagcctcagcagttgcaggaggaaatgaaggaacttcaacaaagcacagaaaaggcagtggccgctcgagataagctgatggaccgacatcaagacatcagtaaggcctttacgaaaaccgaccaaagcaagaccaactacattagcatctgcaagatgcaggaggtgttggaagagtgcggctgctcactgactgaaggcgaactcacccacctgctaaattcatggggcgtgtcacgccacgacaatgcaatcaactatcttgactttcttcgcgctgtagaaaattctaaatctactggggcccaaccgaaggagaaggaggaatccatgcccataaattttgccaccctcaaccctcaagaggcagtaagaaaaatccaagaagttgtagaatcttctcagctggccctgtccactgccttttccgcactcgataaagaagacactgggttcgtcaaggcaacagaattcgggcaggttctgaaggacttctgttacaaactcactgacaatcagtaccactacttccttaggaaactgcggattcacctgaccccatacattaattggaaatactttctgcagaacttcagttgcttcctggaggagaccgccgatgaatgggctgagaaaatgccaaagggacccccacctacctcccccaaggccaccgctgaccgagatatcctggcccgtctccacaaggcagtaacttcccattatcatgctattactcaggaatttgagaattttgacactatgaagactaatacaatttcccgcgaagaatttcgcgccatttgtaacagacgagtgcagattttaacagacgaacaattcgatcgcctgtggaacgagatgcctgtgaacgccaaaggaagactaaagtaccctgacttcctgtctcgcttcagttctgagactgcagccacgcctatggcgactggagactccgcggtcgcgcagcggggcagtagtgtgcctgatgtttctgagggaactagatcagccctgagcctgcccacccaagagcttcgccccggtagcaagagtcagtcacacccatgtacgcccgcaagtactactgtcattcccgggacacctccccttcagaattgcgacccaatagaatcacggctccgcaaaagaatccagggctgttggcgccagctgctgaaggagtgcaaggagaaggatgtggctagacagggggacattaatgcatccgactttctggccttggtcgagaaatttaacctggacatcagtaaagaagagtgccagcagctcattattaaatatgatctcaagtctaacggaaaattcgcttattgtgacttcattcagtcttgcgtgcttctcttaaaagccaaggagagttcgctcatgcacagaatgaagatccagaacgcccataaaatgaaggaggccggggcagagactccttccttctatagcgccctgcttaggatccagcctaagatcgtccattgctggcgcccaatgcgccgcacatttaagagctacgacgaagccggaactggcctgctgagtgtggccgacttccgaacagtcctgcgtcagtattccattaatctttctgaggaggaattttttcacattcttgaatactacgataagactctgagctccaagatctcctacaatgactttttgagagcgttcttgcagtag

SEQ ID NO: 19132 - DNA, 732 bp, Artificial Sequence
  Description of Artificial Sequence: Synthetic coding sequence
atggtgccccagatcagcagcgacctgctgcagatccccctgagcacctctggcaccgtgccatacctggcgtttttaagcaggttcggaggcatagacttgtatataaacggcatcaagaggggtggcggtaatgagatgaattgttgccggaccctgcgagagctggagatccaagtcggtgagaaggtgtttaagaatatcaagactgtgatgaaggcgtttgaactgatcgatgtcaataaaactggcctggtgcgccctcaagagctcagaagggtgctcgagacgttttgcatgaaactcagagatgaggagtatgaaaagttcagcaaacattataacattcataaggacactgccgtcgattataacgtgttcttaaaaaatctttcgatcaataacgacctgaatctaagatactgcatgggaaaccaggaggtctcactggagaaccaacaagccaaaaacagtaaaaaggagcgcctgctaggcagcgcgtcatctgaggacatctggcgtaattactccttggatgagatcgaacggaatttttgtctgcagctgtcaaaaagctatgagaaggtggagaaggccctgtctgcaggcgacccgtgtaagggagggtatgtttcctttaactacctgaaaattgtattggacactttcgtttaccagatccctagacgcatctttatccaattaatgaaaaggaacccaatggataggtag

SEQ ID NO: 19133 - DNA, 4050 bp, Artificial Sequence
  Description of Artificial Sequence: Synthetic coding sequence
atgaactgctgccggaccctgcgggagctggagatccaggtgggcgaaaaggtgtttaagaatatcaagaccgtgatgaaggcctttgagctgatcgacgttaacaagacaggactggtccgcccccaggagctccgtcgcgtgcttgagacgttctgtatgaaactgagggatgaggagtatgagaagtttagtaagcactacaatattcacaaggataccgcagtagactataacgttttcttgaaaaaccttagcattaataacgacttgaacttacggtactgcatgggcaatcaggaagtgagcctagagaaccagcaggctaagaactccaaaaaagagaggctgttgggatcagcttccagtgaagatatttggaggaattattcactggacgaaatcgagcgcaacttctgtctgcagctgagtaagtcttacgagaaggtggagaaagctttgtcagctggcgatccctgcaaaggtgggtacgtatcctttaattacctaaaaattgtgctagatactttcgtgtatcagatccccaggcggatatttatccaactcatgaaaagattcggactgaaggcgaccaccaagattaactggaagcaattcctgacgtcgttccacgaaccccagggactccaggtatccagtaagggaccgctgactaagaggaattccattaatagtcgcaatgagagccacaaagaaaatatcattacaaagctattcaggcatacagaagaccattctgcctcattgaaaaaagcgctgcttatcatcaacacgaagcccgatgggcccatcactcgcgaggagtttaggtacatcctgaactgtatggcagttaagctctctgactcggagttcaaggagctaatgcagatgctagatccaggtgataccggagttgtaaataccagcatgtttatcgatcttattgaggagaattgcaggatgcggaagacatcaccatgcactgatgccaagactccgttccttctggcctgggactctgtggaggaaatagtacacgatactataacccgcaatctgcaggccttttacaatatgctgaggagctacgacttgggcgatacaggaaggattggccgtaacaattttaagaagattatgcatgttttttgtcccttcttaactaatgcacactttattaaactgtgttcaaaaattcaggacatcggaagtggcagaatcctctacaaaaagctacttgcctgtattgggatagacggtcctccgacagtgtctcccgtgctcgtaccaaaggatcagcttctctctgagcaccttcagaaagacgaacaacagcagccagacttgagcgagcggaccaagctaaccgaagacaagaccaccttgaccaaaaaaatgacaaccgaagaggttatcgagaagtttaagaaatgtatacaacagcaagaccccgccttcaaaaaacggttcttggacttttccaaagagcctaatggaaagatcaatgtccatgacttcaaaaaagtacttgaagacactggaatgccgatggatgacgatcagtatgctttattgaccaccaagataggctttgagaaagagggtatgagctatctggactttgccgcagggttcgaggatcctcctatgcgaggtcctgagacaacccccccccaacccccgacccctagcaaatcgtacgttaattcccacttcattaccgccgaggaatgtttaaagctcttcccaagacgactaaaggagtctttcagggacccctacagcgcttttttcaaaaccgacgcagacagggatgggataattaatatgcacgatttgcaccgcctgctgctccatctattgctaaacctcaaagacgatgaatttgaaagattccttggcctgctgggccttcgtctgtcagtgacactgaactttcgcgagtttcagaatctttgcgagaaacgtccctggaggacagatgaggccccccagaggctgatcagacctaaacagaaagtcgctgattctgagctggcatgcgagcaggcacatcagtatctcgtgaccaaggcaaaaaaccggtggagcgacctgtccaagaattttctggaaacggacaatgagggaaacggcattctgcgtaggcgtgacatcaaaaacgccttgtacggattcgacattcctctcactcctcgggaatttgagaagctgtgggcaagatatgatactgagggaaagggccatattacataccaggagtttctgcagaagttgggtataaattatagccccgctgttcacaggccctgtgcagaggactacttcaattttatgggtcattttacaaaaccccagcaactgcaagaagagatgaaagaactgcaacaatcgactgaaaaggcagtagccgccagggacaagcttatggacagacaccaggacatctcaaaagcatttaccaagactgatcagtctaagaccaattacatctcaatctgtaaaatgcaggaagttctggaggaatgtggatgttctctgactgaaggagagctaacgcaccttctcaattcctggggggtgagcagacacgacaacgcaatcaactacctggacttcttacgggcggtcgagaacagcaaatcgacaggcgcacagccaaaagagaaggaggaatctatgcctataaactttgccaccctaaacccccaggaggctgttagaaagatacaggaagtcgtggagtcttcacagctggcattgtcaactgctttctctgctctggataaggaagacacaggttttgtgaaggctacagaattcggtcaggtcttgaaagatttctgttataagttaaccgataaccagtaccattactttttgcggaagctccggatccatctcactccatatattaattggaagtacttcctccagaacttcagctgcttcctggaagaaaccgccgacgagtgggccgagaaaatgccaaagggtcctccacctacctcccccaaagctaccgcagatcgtgacattctcgcacgtctacataaagcagttaccagccattatcacgccataacgcaagaattcgaaaacttcgacactatgaagactaatacgataagccgtgaagaatttagggcaatctgcaaccggcgggtccagatattaaccgatgaacagttcgatagactgtggaacgaaatgcccgtcaacgcaaagggacgcctgaaataccctgacttcctgagcagattctccagcgagacggctgccacacccatggccacaggggactccgcggtggctcagcgaggcagctccgtgcctgacgtttctgagggcaccaggtcggcgctatctctgcctacccaggagttgcggcccggatccaaaagccagtcgcatccctgtacaccagctagtaccaccgtgatccccggaactcctcccttacaaaactgcgaccctatagagagccgtctgagaaagcgtatacaaggttgctggagacagctcctcaaggagtgcaaggagaaagatgtcgcccggcaaggggacatcaatgcttcagatttcctggctctggtggagaaatttaacttggacatttccaaggaagaatgccagcagttaattattaaatatgacttgaagtcaaacggcaaattcgcgtattgtgactttatccagtcttgcgtcctgctactgaaggcgaaagagtcttcacttatgcatcgaatgaaaatacagaatgctcataagatgaaggaggccggcgcggaaactcccagcttctatagcgccctcttaaggatccaacccaagattgtgcattgttggagacccatgcgacgaaccttcaagtcgtatgacgaagcggggaccgggttactgtccgtcgcagatttccgcacagtcctgagacagtactccattaatctgtccgaggaggagttctttcatatcctcgagtactacgacaaaacactgtctagcaagattagttataacgacttcttgcgcgccttcttgcagtag

SEQ ID NO: 19134 - DNA, 783 bp, Artificial Sequence
  Description of Artificial Sequence: Synthetic coding sequence
atgaacagcgccgccggcttcagccacctggaccggcgggagcgggtgttgaagctgggcgagagttttgagaaacagcctaggtgtgcatttcataccgtccggtatgatttcaaacccgcatccatagacacgtcttctgaagggtacttggaagtgggagaaggcgagcaggtgaccataactctacccaatattgagggttccacaccaccagtgaccgtattcaagggaagtaagaagccttacctgaaggaatgcattttgatcatcaatcacgatactggtgaatgtagactcgaaaaactgtctagtaacattacagtgaagaaaacacgcgtcgagggctcctctaagattcagtatagaaaggagcaacagcagcagcagatgtggaattctgcccggacacccaacttggtgaagcatagcccatcagaagacaagatgtctcctgcttcacccatcgatgacatcgaaagggagcttaaagcagaggcaagcctgatggaccagatgtcctcatgcgattcctctagcgactccaagtcctcgtcgtcgagttcttcagaggacagcagttcagatagcgaggacgaggactgcaaatccagcactagtgacacgggtaattgtgtctccggtcaccccaccatgacacagtacaggatacccgatatagatgcttcccacaacagattccgcgataatagcggattgctgatgaacactctgagaaatgatctacagctaagtgaatccggtagtgacagcgacgattag

SEQ ID NO: 19135 - DNA, 792 bp, Artificial Sequence
  Description of Artificial Sequence: Synthetic coding sequence
atgaacagcgccgccggcttcagccacctggaccggcgggagcgggtgctgaaactcggggaaagcttcgagaagcagccacgctgcgctttccatactgtgaggtacgactttaaacccgctagcatagacacctcaagcgagggctatctggaagtgggcgaaggcgagcaagtgacaattaccctgcctaatattgaagggtccacccccccagtgactgtcttcaagggatcaaaaaaaccttatctgaaagagtgcattctgatcatcaaccatgacaccggagagtgccgtcttgagaaattgagttctaatataaccgtgaaaaagaccagagtcgagggctcctcaaagatccagtatcggaaggaacagcaacagcagcagatgtggaattcagctaggactcccaacttggtcaagcactcgccatctgaagacaagatgtcccccgctagtccaattgatgatatagagcgtgagttgaaggccgaggcaagcctgatggaccagatgagttcctgtgattcttcgtcggactccaagagttcctcatcttcttcatctgaggacagtagcagcgatagcgaagacgaagactgtaaaagcagcacttcggacaccggcaattgcgtgagcggacatcccactatgactcaataccgaatccccgatatcgacgcatctcataaccggtttcgcgacaattccggtcttcttatgaacactcttaacaacctttcctctcactcatttagtagtctctacgaccctctgttaagtcactag

SEQ ID NO: 19136 - DNA, 252 bp, Artificial Sequence
  Description of Artificial Sequence: Synthetic coding sequence
atgggccggcggaagagcaagcggaagcccccccccaagaagaagatgaccggaaccctcgagactcagttcacgtgccctttttgcaaccacgagaagagttgcgacgtgaaaatggaccgtgctagaaatacaggggttatttcttgcactgtctgcttagaagagttccagactcctattacatatttatccgaacccgtggacgtgtacagcgactggattgatgcgtgtgaagctgcaaaccagtag

SEQ ID NO: 19137 - DNA, 306 bp, Artificial Sequence
  Description of Artificial Sequence: Synthetic coding sequence
atggtggtgagcaagatgaacaaggacgcccagatgcgggccgccatcaatcagaagctgatcgagaccggagagagggagcggttgaaggaattattgcgtgccaagttgatcgagtgcggctggaaagaccagctgaaagctcactgtaaggaagtgatcaaagaaaaaggactcgagcatgtcaccgtcgatgatctcgttgccgagattactccaaaaggaagggcactcgttccagatagcgtaaaaaaggagcttttgcagcgtatccgtacatttctggcacaacatgcctctctctag

SEQ ID NO: 19138 - DNA, 291 bp, Artificial Sequence
  Description of Artificial Sequence: Synthetic coding sequence
atgaacaaggacgcccagatgcgggccgccatcaaccagaagctgattgagacaggagaacgtgagaggctaaaagagttgctccgagctaagctgatcgaatgtggttggaaggaccagctcaaagcacactgtaaagaggttataaaagagaagggactcgaacatgtgacagtggatgatttggttgcggagatcacaccgaaaggccgggcacttgtgccagactccgtgaagaaggagctgctccagcgcatcaggactttcctcgcacagcatgcctctctgtag

SEQ ID NO: 19139 - DNA, 486 bp, Artificial Sequence
  Description of Artificial Sequence: Synthetic coding sequence
atggccgagcccaccggcctgctggagatgagcgagctgcccggcgatagtagcgtcccccaggtgggaacagccagtggcgtgtcggacgtcctgaggggagccgtaggcggtggggtgcgggtgcaggaagctagagaaggccctgtcgccgaggctgcccggtcaatggctcggatgccaggtccggtgcccggacccattccatcaagcgtgcctggacttgccagtgctcccgatccccaccaacagttggctttccttgaaataaacagacagctcctcttccgcgaatacctggatggaagttctatgatccccgttaggcttcttcgagactttgaagagcggcgtcgcttgtttgtggaaggctgcaaagcacgggaggcagccttcgatgcggacccgccacagatggacttcgccgccgtggccttcacagtcgcactcactgcttccgaagcccttagtcccctggccgattag

SEQ ID NO: 19140 - DNA, 2556 bp, Artificial Sequence
  Description of Artificial Sequence: Synthetic coding sequence
atgagcagcaagcaggagatcatgagcgaccagcggttccggcgggtggctaaggatccccgcttctgggagatgcctgagaaagatcgaaaagtgaaaatagacaagaggttccgagccatgtttcatgacaagaaattcaagctaaactatgcagtggacaagcgcggccgtccaatctcacacagtaccacagaggacctaaagcggttctacgatctgtcggattccgattcaaatctgagcggcgaggattccaaagccctgagccaaaagaagataaaaaagaagaaaactcagacgaagaaggaaatcgattctaagaatctggttgagaaaaaaaaggaaactaaaaaagctaatcacaaggggtccgaaaataaaacggacctcgacaatagcatcgggataaaaaagatgaagacatcctgcaagtttaaaatagatagcaacattagccctaaaaaagactcaaaggagtttacacagaagaacaagaaggagaagaaaaacatcgtccagcacacaaccgatagttcgctagaggagaagcagaggaccttagatagtgggacgagcgagattgtaaagagtccacggatcgagtgctccaagaccagacgggagatgcagagcgtggtccaactaattatgacccgggacagcgatggatatgaaaatagtaccgacggcgagatgtgtgataaggatgcactcgaggaggacagtgaatctgtctctgagatcggaagcgacgaggaatcagaaaacgagattacatcagtggggagagccagcggcgatgatgatggtagcgaagacgatgaagaggaggacgaagacgaggaggaggatgaggatgaagattccgaggacgatgataaatcagactctgggcccgacctggcacgaggtaaagggaacatcgagacctcctcagaggatgaagacgacactgccgacctcttccctgaggagagcgggtttgagcacgcctggcgggagctggataaggatgccccgcgggccgatgagatcactaggcggctcgcggtgtgtaatatggattgggacaggcttaaggcaaaagatcttctggccctgtttaactcctttaagcctaaaggcggcgtaattttctcagtcaagatctatccttcagaattcggcaaagagcggatgaaggaggaacaggtacaggggccagtagaattactgagcatcccagaggacgcacctgagaaggactggactagtagagaaaaactccgggactatcagtttaagagacttaaatattactacgctgtagtggattgtgatagtcccgaaaccgcctctaaaatttatgaagactgcgacggccttgagttcgagagctcatgttcttttatcgatctccgtttcatacccgacgatattacattcgatgatgaaccaaaagatgttgcctccgaggttaaccttactgcgtacaaaccaaaatattttacaagcgcagctatgggaacatccaccgttgaaattacctgggatgagacagatcatgagcggatcactatgctcaatagaaaattcaaaaaggaagagctgctggatatggattttcaagcgtatttggccagctcaagcgaggacgaggaagagattgaggaggaactgcagggcgatgatggcgttaacgtggaggaggacggtaaaactaaaaaatcacagaaggatgacgaagaacagattgctaaataccgtcaactgctgcaggtgatccaagagaaggagaagaagggcaaagaaaatgatatggagatggagatcaagtgggtgccagggctgaaggaaagtgctgaagagatggtcaagaacaagcttgaggggaaggataagctgaccccctgggaacagtttttagaaaagaagaaggagaaaaagcgtctcaagcgaaaacagaaagctttggcagaggaagcgagcgaggaagaactgccaagtgatgtggatctcaatgatccatatttcgctgaggaggtgaaacaaatcggcatcaacaaaaagagtgtgaagtctgcaaaggatggcacatcccccgaggaggaaatcgagattgaacggcagaaagctgaaatggcactgttgatgatggatgaagacgaggattctaagaagcatttcaactacaacaaaattgtggagcaccagaatttgagcaaaaagaagaagaaacagctcatgaaaaaaaaggaactgatcgaggatgatttcgaggtgaatgttaacgatgcgaggtttcaggcaatgtacacaagccatctctttaatctcgaccctagcgatccaaattttaaaaagaccaaggccatggagaagatcttagaggaaaaagccaggcagcgcgaaagaaaagaacaggagctgacacaggctatcaagaaaaaagaatccgagatagagaaggagtctcagcggaagtccatcgatcctgcactcagtatgcttattaaaagtattaagactaagaccgagcaattccaagcccgcaagaagcagaaagtgaagtag

SEQ ID NO: 19141 - DNA, 333 bp, Artificial Sequence
  Description of Artificial Sequence: Synthetic coding sequence
atgagcagcaagcaggagatcatgagcgaccagcggttccggcgggtcgccaaggaccccaggttttgggagatgcccgagaaggatcggaaggtaaaaatcgataaaagatttagagccatgttccatgacaaaaaattcaagttgaattatgcagtcgataaaaggggtcgccccatcagccacagcactactgaagacctgaagcgtttttatgatctatccgattccgacagcaacttatctggagaagatagtaaggctctctcccagaaaaagatcaagaagaaaaagacccaaaccaagaagaaaaaaaagaaaaaaaagaaatag

SEQ ID NO: 19142 - DNA, 1086 bp, Artificial Sequence
  Description of Artificial Sequence: Synthetic coding sequence
atgcactgcagctgcctggccgagggcatccccgccaaccccggcaattggatatccgggctggctttcccagattgggcctacaaggctgagagctcaccaggatccagacaaattcagctttggcactttattctggaactgctgcagaaggaggagttccggcacgtgattgcttggcagcagggagaatacggcgagtttgtcattaaagatcctgacgaagtggcccgcctgtggggcaggcgcaaatgcaaaccacagatgaactacgataaactatcacgtgcgttgcgctactattacaacaagaggattctacacaagacaaagggcaagcggtttacctacaagtttaactttagcaaactcatcgtcgtaaactatcccctgtgggaggtgcgtgctcctccaagcccccatctgctcttaggggcccctgctctttgtaggccagcgctggtgccggtgggcgtgcaaagcgaactgttgcactcaatgctgttcgcacaccaggcgatggtggaacagctaaccggacaacagacaccgcggggcccaccagaaacctctggcgacaagaaaggctctagcagttccgtttaccgtctgggctcagcgcctggcccctgtaggttgggcctttgctgtcatttgggctccgtccagggcgagctgccaggggtggcaagcttcaccccccctctccctccccccttaccaagcaattggacatgcctgagcggcccttttctacctcctcttccatccgagcagcagctgcctggcgcatttaagccagacatactgcttcctggacccagatcactgccgggtgcctggcattttcccggacttcctttactggctggcctgggacaaggagcgggcgagagactgtggttgttgtccctcagacccgaagggctggaggtaaagcccgcgccaatgatggaggctaagggaggcctggatccacgggaggtcttttgtccggagacgcgcaggctgaaaacaggagaggagtcactgacttctcccaacctggagaacctgaaggccgtgtggcctctcgatccgccctag

SEQ ID NO: 19143 - DNA, 498 bp, Artificial Sequence
  Description of Artificial Sequence: Synthetic coding sequence
atgagccaggccaccaagcggaagcacgtggtgaaggaggtgctgggggaacatattgtccccagtgatcaacagcagattgtgagagtgctccggactccgggaaataatctgcatgaagtggaaactgcacaagggcagcgtttcctggtgtctatgccctcaaaatatagaaaaaacatttggatcaagagaggagacttcctcattgtggacccaatcgaggaaggcgaaaaggtgaaagcagagatcagttttgtgctgtgcaaggatcacgtgcgctcattgcagaaggaaggattctggcctgaagccttctctgaggtggcagagaagcataacaaccggaatagacagacacagcctgagctgcccgcggagccacagcttagcggcgaagaaagttccagcgaagatgacagtgatttgtttgtgaacaccaataggcgccagtaccacgaaagcgaagaagaaagcgaggaggaagaggccgcttag

SEQ ID NO: 19144 - DNA, 498 bp, Artificial Sequence
  Description of Artificial Sequence: Synthetic coding sequence
atgagccaggccaccaagcggaagcacgtggtgaaggaggtgctgggggaacacatcgtcccttctgatcaacagcagattgtgagggttctgcgcaccccaggaaataacctgcacgaagtggaaacagcgcagggacagagattcctggtgtccatgccaagtaagtaccgtaaaaatatttggattaagcgaggagacttcctgatagtggatccaatcgaggaaggagagaaggttaaggctgagatatcttttgtgctgtgcaaagatcacgtcaggtccctgcagaaggaaggcttttggcctgaggcgtttagcgaggtggccgaaaagcataataatcgcaacaggcagacccagcctgaactccccgctgaacctcaacttagtggcgaagagtcctcctctgaggacgacagcgatctcttcgttaacaccaacaggagacagtaccacgagtccgaagaggagtctgaagaggaagaggccgcatag

SEQ ID NO: 19145 - DNA, 237 bp, Artificial Sequence
  Description of Artificial Sequence: Synthetic coding sequence
atgagccaggccaccaagcggaagcacgtggtgaaggaggtgctgggtgaacatatcgtaccttcagatcaacaacaaatcgtacgggtactgagaactcccggcaacaacttgcacgaggtggagacagcacagggccaacgcttccttgtgtccatgccgagcaagtaccgaaaaaacatttggataaagcggggggacttcctcattgtggaccccatcgaggagggggaatag

SEQ ID NO: 19146 - DNA, 498 bp, Artificial Sequence
  Description of Artificial Sequence: Synthetic coding sequence
atgagccaggccaccaagcggaagcacgtggtgaaggaggtgctgggggaacacattgttccctctgatcagcaacaaatcgttcgagtgttgcgaacccccggcaataacttgcacgaggttgaaactgctcaggggcaaagatttctggtttccatgccaagcaagtacagaaagaacatctggatcaagaggggggacttcctcattgtggaccccatagaagaaggcgagaaggtgaaggctgagatctcttttgtcctatgtaaggaccacgtccggtcactgcagaaagagggtttttggcctgaggccttctcagaagttgctgaaaaacacaacaaccgcaatcgccagactcagcccgaactccctgctgagccccagctgtctggagaggagtctagcagcgaggacgatagcgacttgttcgtcaacactaaccgcaggcagtaccacgagtcagaggaagagagcgaggaggaagaggccgcatag

SEQ ID NO: 19147 - DNA, 441 bp, Artificial Sequence
  Description of Artificial Sequence: Synthetic coding sequence
atgagccaggccaccaagcggaagcacgtggtgaaggaggtgctgggggaacacattgttcctagcgaccagcagcagatcgtgagagtgctgaggacccccggaaataacctgcacgaggtggagactgctcagggacagaggttcctggtaagcatgcctagtaaataccggaaaaacatatggataaagcgcggagacttcctaatagttgatcctatcgaggagggggaaaaagtaaaagcagagatctccttcgtgctgtgtaaggatcacgttcgcagcctacagaaggagggattttggccagaggcctttagcgaagtcgcagagaaacacaacaatcgcaacagacagacccagcccgagttgccagccgagccacagttgtctggcgaagaaagcagtagtgaggacgacagcgacctgttcgtgaattag

SEQ ID NO: 19148 - DNA, 345 bp, Artificial Sequence
  Description of Artificial Sequence: Synthetic coding sequence
atgagccaggccaccaagcggaagcacgtggtgaaggaggtgctgggagagcacattgttccctctgatcaacagcagattgtcagagtcctccggacaccagggaataatctgcatgaagttgagacagcccagggccaaagattccttgtctccatgccttcaaagtatcgtaagaatatctggattaagcgtggagacttcctgatcgtggatcccattgaggaaggggaaaaagtgaaagcagagatctcctttgttttgtgcaaagaccatgtaaggagtcttcagaaggagggcttttggccagaagctttttccgaagtggccgagaaacacaattag

SEQ ID NO: 19149 - DNA, 342 bp, Artificial Sequence
  Description of Artificial Sequence: Synthetic coding sequence
atgagccaggccaccaagcggaagcacgtggtgaaggaggtgctgggagaacacatcgtcccctcagaccaacaacagatcgtgcgggtcttaaggacgcctggtaataatttgcatgaagttgaaaccgctcaggggcagaggttcttagtgtctatgccttcaaaataccggaagaacatatggataaaaagaggagacttccttatcgttgacccaatcgaagagggagaaaaggtcaaagctgagatctcattcgtcctatgcaaggatcacgttcggtccctgcagaaagaaggcttctggcccgaggcgttcagtgaggtggcagaaaagcattag

SEQ ID NO: 19150 - DNA, 498 bp, Artificial Sequence
  Description of Artificial Sequence: Synthetic coding sequence
atgagccaggccaccaagcggaagcacgtggtgaaggaggtgctgggggaacatatcgtgcctagtgaccagcagcagatcgtgagggtgttgagaacaccgggcaacaatctgcatgaggtggagactgcacagggtcaaagattcttagtttcaatgccaagcaaataccgtaaaaatatctggattaagaggggagattttcttatcgttgatccaattgaagaaggcgagaaggtcaaagccgagatctcctttgttctgtgcaaggaccatgtgaggagtttgcagaaagagggattttggcccgaggccttcagcgaagtcgcagagaagcacaacaataggaacaggcagacgcagcctgagctaccagcagagccacagctgagtggtgaggagtctagcagcgaggatgactctgacctgtttgttaatactaatcggaggcagtaccatgagtcagaggaagaatctgaggaggaggaggctgcttag

SEQ ID NO: 19151 - DNA, 1230 bp, Artificial Sequence
  Description of Artificial Sequence: Synthetic coding sequence
atggagggcgagagcaccagcgccgtgctgagcggcttcgtgctgggagcactggctttccagcatctaaacacggactctgacactgagggattcttactgggtgaagtcaagggagaagctaaaaactccatcactgattcccaaatggacgatgtggaggtagtttataccatagatatacaaaagtatattccatgctaccagctgttttcattttataactcttcaggtgaggtgaatgagcaggcccttaagaagattctttccaacgtgaagaagaatgtcgtgggttggtataagtttcgaagacacagtgatcagatcatgaccttccgggagcggctgttgcacaaaaatcttcaggagcacttctccaaccaggacctcgtcttcctgcttctgactccttcaatcataactgagtcctgctctactcaccgtctggagcactccctctataagccgcagaagggcctgtttcaccgggttccgttggtggtggccaatctcggcatgagtgagcagttaggatataagaccgtatccggtagttgcatgagcacgggcttctctcgcgctgttcagactcactctagtaaattcttcgaagaggatggcagcctgaaggaggttcacaaaataaacgagatgtacgcctcgctccaggaagagctcaagtctatctgtaagaaagtggaggatagtgaacaggcggtagacaagctggtcaaggatgttaatcgattgaagagagagatcgaaaaaagacggggagctcaaatacaggcggcccgtgagaaaaacatccaaaaagatccccaggaaaatatcttcctatgtcaggccctgagaactttttttcctaattctgagtttctccatagctgtgtgatgagcctaaaaaaccggcacgtgagtaagtcatcttgcaattataatcatcacctagatgtggtggacaacctgactctgatggtggaacacacagatattcctgaagcgtcacccgcttccaccccgcagataatcaagcacaaagccttggatctggacgaccggtggcagttcaagagatccagactgttagatactcaggacaaaaggagtaaggccgataccggctcctcaaaccaggacaaggcaagcaagatgtcatctcctgagaccgacgaagagattgaaaagatgaaaggcttcggtgagtactccagaagtcctactttttag

SEQ ID NO: 19152 - DNA, 1083 bp, Artificial Sequence
  Description of Artificial Sequence: Synthetic coding sequence
atggacgacgtggaggtggtgtacaccatcgacatccagaagtacatcccgtgttatcagctgttctcattttacaattcctcgggggaagtcaacgaacaggccctgaaaaagatccttagtaacgttaaaaagaacgtcgtaggatggtacaagtttaggcggcacagtgatcaaattatgaccttcagagagcggctgctgcacaaaaacctacaagaacacttcagtaaccaggatctggtctttttgcttcttactccatccattatcaccgagagttgttctacccaccgactggagcattccctgtataagccacagaaggggctttttcaccgggttccccttgtagtggcaaatctcggcatgtcagaacagcttggctataagactgtgagcggaagctgcatgtcaacggggttttcacgagccgtccagacacatagtagcaaattttttgaagaagatggatcacttaaagaagtgcacaagattaatgagatgtacgcgagccttcaggaagagctgaagtccatctgtaagaaagtggaggatagcgagcaagccgtcgacaagttagtgaaggatgttaacaggctcaaacgagaaattgaaaagcggcgaggtgcacagatacaggctgctagagaaaagaatattcaaaaggatccccaggaaaatatctttctctgtcaggctttacgaaccttcttccctaactctgaattcctgcacagctgtgtcatgagtcttaagaataggcacgtctcgaaatcatcttgcaattataatcatcaccttgacgtggtggacaacttaacgctgatggtggagcataccgacataccagaggcttccccagcttccaccccccagattattaagcacaaagctttggacttggacgacaggtggcaatttaagagaagcaggctgctggacacacaggacaaaagaagcaaagcagatactggaagttctaaccaagataaagcatctaaaatgagttcaccagagaccgacgaggaaattgagaagatgaaagggtttggcgaatatagcagatcgcctacgttttag

SEQ ID NO: 19153 - DNA, 333 bp, Artificial Sequence
  Description of Artificial Sequence: Synthetic coding sequence
atggacgacgtggaggtggtgtacaccatcgacatccagaagtacatcccttgctaccagctgtttagtttttacaactcgagcggtgaggtgaatgaacaagccctgaagaaaatcctcagcaatgtgaaaaaaaatgtcgtggggtggtacaagttcaggcgccactcggatcagatcatgacttttagagagcgcttactccacaagaatctgcaggaacacttcagtaatcaggacttagtgttcttacttttgacaccttcgattattacagagtcatgctccacccaccgcctggagcactccctatacaaaccacaaaagggctag

SEQ ID NO: 19154 - DNA, 1338 bp, Artificial Sequence
  Description of Artificial Sequence: Synthetic coding sequence
atgagcgagctgaccaaggagctgatggagctggtgtggggcaccaaatcttcgccgggcctaagtgacacaatcttttgtagatggacacagggcttcgtattttcagagagtgagggatctgccttggaacagtttgagggtgggccatgcgctgtgatagcgcccgtgcaggcattcttgctgaagaagctcctgttcagtagcgaaaaaagttcctggcgcgactgctccgaggaagaacagaaagagttactttgtcacacgctgtgcgatatactcgagtctgcatgttgtgaccattccggtagttattgccttgtttcctggttaaggggcaaaacgaccgaagagacagcgagcatcagtggctcacctgcagagtcttcgtgccaagttgaacattcttccgcccttgcggtcgaagaactaggcttcgaaaggttccacgccctaattcagaaacggagttttaggtcactcccggagttgaaggatgcagttctggatcaatactccatgtggggcaataaattcggggttctccttttcctgtattctgtgcttcttactaaaggcatcgaaaatattaaaaacgaaatcgaagacgccagcgagcctttgattgacccggtgtacggacacggtagtcagtccctgatcaacctcctgttgactggacatgctgtgagtaacgtgtgggacggagatcgcgaatgctcaggtatgaagctcctggggattcatgagcaggccgccgtcggctttctcactttaatggaagccctgagatactgcaaagtcggctcttacctcaagtcgccaaagttccccatatggattgtagggtctgagacacatctgaccgtattttttgccaaagatatggccctggtggcaccggaggccccctccgagcaagcccggcgagtgtttcagacatacgaccccgaagacaatgggtttatcccagactccctgctggaagatgtcatgaaagcactggatttagtcagcgatcccgagtatattaacctgatgaaaaacaaactggatcctgaaggtctaggaattatcctcctgggaccttttttgcaggagttcttccctgaccaggggtccagcgggccagagagcttcaccgtctatcattacaacgggctcaaacagagtaactacaatgagaaagtgatgtatgtggagggtacggctgttgtcatggggttcgaggatccaatgctccagaccgatgacacacctataaagcgctgtttgcagacaaagtggccctacatcgaattactttggacaacagataggtctccgagcttaaactag

SEQ ID NO: 19155 - DNA, 453 bp, Artificial Sequence
  Description of Artificial Sequence: Synthetic coding sequence
atggccctggtggcccccgaggcccccagcgagcaggcccggcgggtttttcagacctacgatccggaagacaatggatttattccagacagcttattggaggatgtgatgaaggcactggacctggtttccgacccagagtacataaatttgatgaagaacaaattagaccctgagggtctcggaatcatactcctcggcccctttcttcaggaattcttccctgaccagggatcttctgggccggagtctttcacggtgtatcactacaacggtctcaaacagagtaattacaatgagaaggtgatgtacgtggagggtaccgcagtcgtcatggggtttgaggatcccatgctgcagacagacgacacgcctatcaagcgctgcctgcagaccaaatggccatatattgagttgctatggacaacagatcggagtccatctttaaattag

SEQ ID NO: 19156 - DNA, 453 bp, Artificial Sequence
  Description of Artificial Sequence: Synthetic coding sequence
atggccctggtggcccccgaggcccccagcgagcaggcccggcgggtgtttcagacatatgatcccgaggataacggtttcatccctgacagcttgcttgaagacgtgatgaaagctctcgatctggtgagtgacccagagtacatcaacttaatgaagaataagctggacccagagggcctaggaataatcctactcggtccgtttctccaagaattctttccagaccaggggtcctccgggcccgagagctttaccgtttatcattacaatggcctgaaacagtctaattataacgagaaagttatgtacgtggagggtaccgccgtagtcatgggcttcgaggatcctatgctccagacagatgacacaccaattaagaggtgcctccagaccaagtggccatacatcgaactgctctggaccaccgatagaagtccctcgttaaattag

SEQ ID NO: 19157 - DNA, 549 bp, Artificial Sequence
  Description of Artificial Sequence: Synthetic coding sequence
ctgcccgagctgaaggacgccgtgctggaccagtacagcatgtggggcaacaagttcggggttctgttatttctctattccgtccttctgactaagggcatcgagaatataaagaacgagatcgaggatgcaagcgaacctctgatcgaccctgtttatggccatgggtcacaaagcttaatcaatcttcttctcactgggcacgccgtaagcaacgtctgggatggtgacagggagtgcagcggaatgaagcttctgggaattcacgagcaggccgccgtaggtttcctgacgctcatggaggctctccgctactgcaaagtgggttcttacctcaagagtcccaaattcccaatttggatcgttggatctgagactcatctcacagtctttttcgccaaggacatggctcttgtcgccccagaggctccatcagagcaggcccgtcgcgtgttccagacctatgatcccgaagataatgggttcatccccgacagtctcctggaggacgttatgaaagcactggacttggtaagcgacccagaatag

SEQ ID NO: 19158 - DNA, 495 bp, Artificial Sequence
  Description of Artificial Sequence: Synthetic coding sequence
atgaagcggttccccgccaagaagcggagcttccggagcctgcccgagctcaaggacgccgtcctggaccaatactctatgtgggggaataaattcggcgtacttctatttctttattccgtgctcttgacgaaagggatagaaaacatcaaaaatgaaatagaggatgcctccgagccgttgatcgatccagtgtacggccacggatcccagagcctcattaatctcctgttaactggacatgcagtgagtaatgtctgggatggggaccgagagtgttccgggatgaaattgctcggtattcacgaacaagccgctgtgggcttccttactctcatggaggcactgaggtattgcaaggtgggtagttacctcaaaagccccaaattccccatttggattgtgggatccgagacacatctgacagtgttcttcgcaaaagacatggctcttgtagctcctgaagctccttctgagcaggcaagacgtgtctag

SEQ ID NO: 19159 - DNA, 765 bp, Artificial Sequence
  Description of Artificial Sequence: Synthetic coding sequence
atggacggcggcgacgacggcaacctgatcatcaagaagcggttcgtctccgaggcagagttggacgagcgcaggaaaagaagacaggaagaatgggaaaaagtccgcaaacctgaggatcccgaggagtgtcctgaggaagtctacgatccaaggtccctttatgaaagactacaggagcagaaagatagaaaacaacaggaatacgaagagcaattcaaattcaagaatatggtgagaggacttgacgaggatgagaccaacttcttggacgaggtgtccaggcagcaggagttgatcgaaaaacagcgcagagaagaggagctgaaagagctgaaggaataccgaaacaatctaaagaaagtaggaatttcccaggaaaacaagaaagaagtcgagaaaaagctcactgtaaaacccatcgaaacaaaaaataagttcagtcaggcgaaattgctcgctggggccgttaaacataagtcctctgaatctggaaactccgttaagcggttgaaaccggatcctgaacctgacgataaaaatcaagagccgtcctcatgtaaatcccttggtaatacgtccctctcaggaccctctattcattgtccatctgcggctgtatgcatcgggattctccccggtctcggcgcttattccggatcatccgatagcgagagttcttccgactcagaaggcacaatcaatgcgacaggcaaaatcgtcagcagtatctttcgcaccaacaccttcctcgaggccccatag

SEQ ID NO: 19160 - DNA, 765 bp, Artificial Sequence
  Description of Artificial Sequence: Synthetic coding sequence
atggacggcggcgacgacggcaacctgatcatcaagaagcggttcgtgtccgaggctgaactggatgagcgcagaaaaaggcggcaggaagagtgggaaaaggtccgtaaaccagaagaccctgaagaatgtcctgaggaggtgtatgatccaagatcactgtacgagaggctgcaggaacaaaaggacagaaagcagcaggagtatgaggaacagtttaagtttaaaaatatggtaaggggtctggacgaggacgaaactaacttccttgacgaggtttctcgacagcaggaacttattgaaaagcagaggagagaagaagaactgaaggagctgaaggaatatagaaacaacctgaagaaagtcgggatcagccaggaaaacaaaaaagaagtcgagaagaaactcacagtaaaacccattgaaaccaagaacaagttctctcaagcgaagctgctggccggcgctgtcaagcacaagtcatctgaaagcgggaactccgtgaagaggctcaagccggacccagagcccgacgacaaaaaccaggagccgagctcctgcaagagtttgggcaatacatcactgtccggcccaagtattcactgtccgagcgccgcggtgtgcatcgggatcctgcctggtctgggcgcttactctggctcatccgacagtgagagctcttccgacagtgaaggcacaatcaacgccactgggaagattgtcagctccatcttcagaacaaatacatttctcgaggccccgtag

SEQ ID NO: 19161 - DNA, 246 bp, Artificial Sequence
  Description of Artificial Sequence: Synthetic coding sequence
atggacggcggcgacgacggcaacctgatcatcaagaagcggttcgtctccgaggcggaactagatgaaaggcggaaaaggagacaggaagaatgggagaaagtacgcaaacccgaggaccctgaggaatgtccagaggaagtgtacgatccacggagcctttacgagagactgcaggagcagaaggaccggaaacagcaagagtatgaggaacaatttaagttttctaaacaattcgatccttag

SEQ ID NO: 19162 - DNA, 1617 bp, Artificial Sequence
  Description of Artificial Sequence: Synthetic coding sequence
atgcggcacgtgcaggccgagcccagccccagcagcgagcccgaggccggacctagtcagccccccgtacgccagggggctctccagggtggtctgctgatggggtactcccccgccggtggcgccacatcacccggagtctatcaggtgagcatttttagcccccctgccgggacgtctgaaccacaccgggcacttaagagacaggcacctagcaccgagggcccacgagagctgaaaagaggcccagggcttggtgcccgggaggggctacccccggaagagccttctaccgtgggtttgttggggcctgagggccccggcctcggactaggtgtggcgtctcagcacttttcgcacagaggattgtgtgtcgtggaacagcgatcaagtgtgactagttcctggacatcgggcgcttggtcccctccatgtcctccaagcaatgcaagctgcaacaccctccacacacgcgactgggcgtctcctgaccccggcggacaggggtcactgggcgaatcgccgggccctgccccaccaggacagctacatactcttgataccgatcttcactcattagcccagataggggggaaaagcccggttgctggcgtgggcaacggaggcagtctgtggcctcgggagtctccaggaacagctaacggtcactcgcccgaacataccccacccgggcctgggccacccggtccttgtcccacgaagcgccgcctcttgcccgccggcgaagcccccgacgtctcatccgaagaggaaggacccgcacctagaaggcgacgtggcagtctgggtcacccaaccgccgccaacagttctgacgccaaagcaacaccattttggtctcatttgctccccgggcccaaggagccggtcctagatccgacggactgtggccctatgggtcgccgactgaagggagctagaagactgaagttatctccgttgcgttcattacgaaagggccctggccttttatcccctccttctgctagcccagtcccaactccagcagtcagcaggactcttcttggcaatttcgaagaatccctcctccgtgggagatttgcccctagtggccacattgaagggttcacagctgagattggggcttccgggagctactgcccacagcatgtgaccctgcccgtcaccgtgaccttctttgatgtgtccgaacagaacgccccagcacccttcctcggtatagttgacctgaacccactggggagaaagggatattctgtaccaaaggtgggcacagttcaggtgaccttgtttaaccctaaccaaactgttgtcaagatgtttctggtcacatttgactttagcgacatgcccgccgcccatatgacttttttaaggcaccgcctcttcctcgtccccgtgggtgaggagggaaacgctaacccaacacacaggttgctgtgctatcttttacacctgcgttttagaagcagccggagcggaaggctaagcctacacggagatattcgacttctgttctcacggcgtagtctggagttggatacaggactcccttacgagctccaggcggtgaccgaagcccctcataatcccagatactctccccttccctag

SEQ ID NO: 19163 - DNA, 1329 bp, Artificial Sequence
  Description of Artificial Sequence: Synthetic coding sequence
atgcggcacgtgcaggccgagcccagccccagcagcgagcccgaggccggtccgagccaacctccggtccggcagggggccctccagggcggcctgttgatggggtattcacctgcaggcggggcaacctcgcccggggtgtaccaagtgtctattttctcaccgcctgccggaacctcagagcctcacagggctcttaagagacaagcccctagtactgaagggcccagagagctgaaacgcggccccgggctgggcgccagggaaggcttgccacccgaagaaccctcaaccgttggactgctcggaccagagggccccggactgggtctgggggtggctagccagcatttctcacatagaggtctttgtgtcgtggaacagcgaagctctgttacatcaagctggacctccggcgcctggtctccaccttgcccaccttcaaacgcgagctgcaatactctgcacacgagagattgggcatcacctgacccagggggccagggatctctgggggagtctccaggccccgccccacctggccagcttcataccctcgacaccgatctgcattcactggctcagatcggcgggaagagcccagtggcaggcgtcggcaatggtgggtccttgtggcccagagagagtccaggtaccgccaatggacattcacccgagcacaccccccctggacccggcccccctgggccttgccccacgaaacgaaggttgctgccagctggagaagcgcctgatgtgtcaagcgaggaggaaggccccgcacctaggagaaggcgcgggtccctaggccatcctaccgccgcgaacagctcagacgccaaggctaccccgttctggtcacacctgttacccggccctaaagagcctgtgctggaccccaccgattgtggacccatggggagacgcttaaagggagctcgcagactgaagctcagccccttgaggtccctgcgtaagggacccggactgctctccccgccatccgcgtctcccgttccaacacctgccgtaagccggaccctcctcggcaatttcgaagagtctctgctgcggggccggtttgcgcccagcggtcacattgaaggcttcactgctgagataggagcgagtggctcatattgcccacaacatgtcactctcccagtcacggtgacctttttcgatgtctcagagcagaatgcccctgctcctttccttggcattgtggatctgaatcctctgggacggaaggggtattctgtgcccaaggtaggaaccgtgcaggttacactgtttaatcccaatccatttacgtccccaacgctctag

SEQ ID NO: 19164 - DNA, 1617 bp, Artificial Sequence
  Description of Artificial Sequence: Synthetic coding sequence
atgcggcacgtgcaggccgagcccagccccagcagcgagcccgaggctggcccaagccaaccaccggtgcgccaaggcgcgcttcagggcggcctcttaatggggtacagccccgccggtggagcaacaagtcccggcgtctaccaggtgagcatattcagccccccagccggcacgtcagaacctcaccgcgctcttaaaaggcaggccccttctaccgaaggcccacgtgagttaaagcgcggccctggcctgggcgctcgtgaagggctccccccggaggagccttcaacagtgggcctgctgggaccagagggccccggactggggctgggcgttgcatctcaacatttttcacacagaggcctatgtgtggtggagcaacggagttcggttacctcttcatggaccagtggagcatggtcccctccgtgcccaccctctaacgccagctgcaataccttgcacacccgagattgggcttctccggacccaggtggtcaaggatcattaggggagtcacctgggcccgccccacccgggcaactgcacaccctcgacacagacttgcattccttggctcagatcggcggcaagtcacccgttgctggggtcggcaatggaggctcactctggcctcgcgaaagccctggcactgccaacggtcacagccccgagcacacccctccggggcccggaccgcctggcccttgcccaactaagcgccgattactaccggccggggaggcaccagacgtgagttccgaggaagaggggccagctcccagaagacgaaggggaagcctcggccaccctactgcagctaatagtagcgacgcaaaagctaccccattctggtcacacttgctgcctggccctaaagagcccgtgctggaccccaccgactgcggtcccatgggccgcaggctgaagggagcccgacgcttgaaactgtcacccctaagatccctgcggaagggacctgggttactttccccacccagcgcttcacccgtgccgactcccgccgtgtcgagaactctcctgggaaatttcgaggagtcgcttctgagagggcgtttcgctccctcgggccacatagaagggttcaccgctgagatcggagcatctggtagctactgcccccaacatgtcacgcttcccgtgaccgtgacgttctttgacgtcagcgaacaaaacgcacctgctccttttttgggaattgtggatctgaatccactggggcggaagggatacagcgttcccaaagtaggtaccgttcaggttacgctctttaatccaaatcagactgttgtgaaaatgttcctggtcacattcgacttttccgacatgcctgctgctcatatgaccttcctgaggcatcggctcttcctcgtaccggttggtgaagagggaaacgcaaatcccacacaccgacttctgtgctacttattgcatctgaggtttcgcagcagtaggagcggacgtctgtccctgcatggtgatattagactgctcttttcccgacgtagcctggagttagacacagggctgccatatgagctgcaggcagttaccgaagccccgcataatccccggtacagtccgttgccctag

SEQ ID NO: 19165 - DNA, 1617 bp, Artificial Sequence
  Description of Artificial Sequence: Synthetic coding sequence
atgcggcacgtgcaggccgagcccagccccagcagcgagcccgaggccgggccctctcagccccccgtccgccagggtgcgctgcaggggggcttgctcatgggctactcacccgccgggggagcaacaagtcctggtgtgtaccaggtgagtatcttttcaccgcctgcaggcacaagcgaacctcaccgtgctctgaaacgtcaggctcctagcacagagggtcccagggagctgaagagagggcccggcctaggagctcgggagggtctgcctcccgaggagccgtccaccgtcggcttgctgggccctgaaggacctgggctgggactgggtgtggcttcgcaacatttctcacatcgggggctatgtgtggtggagcagcggtcttccgtgaccagcagctggacgtcaggagcgtggtccccaccatgccctcccagcaacgccagctgtaacaccttgcacacccgagactgggcatctcccgatcctggtgggcagggttccttgggcgaatcaccaggccccgcacctcctggacagctgcacacgctggacaccgatttgcacagtctggcccagatcggagggaagtccccggtcgccggtgtgggtaatggcggcagcctgtggccgcgcgaatctcctggcaccgctaatggccactcccccgagcacacacccccagggcccggccccccggggccctgcccaacaaagcggcgcctgcttccagctggcgaggctcccgacgtgagttcggaagaggaaggccccgcccccagaaggaggcgagggtctttgggccaccctactgctgcaaattcctccgacgccaaagcaacaccattttggagtcacctgctgcccggcccaaaggagcctgtgctggaccccactgattgcggacccatggggcggcgccttaagggcgcccgcagactcaaactgtcgcccttgagatcactgagaaagggccccgggttgctgagccccccctctgcgagccctgtccctacccccgctgtatctaggacactgctgggtaactttgaggaaagtctgttacgcggcagattcgctccaagcggccacattgaagggttcactgctgagatcggcgcgtcaggcagctattgtccccagcatgtgactctccctgtcaccgtgacctttttcgacgttagtgagcagaacgctcccgcccctttcctggggatcgtcgacttgaatcccctgggcagaaaaggatactcagtacctaaggtggggacagtccaggtcactctttttaacccaaatcagacagtcgtgaagatgttcctggtgactttcgatttctccgacatgcctgccgcccatatgacattcctgaggcacaggttgttcctggttccagtcggggaagaaggcaacgcaaaccccacgcatagactactgtgttatctcctgcacctgagattccgctcatctagatctggcagattgtctctgcatggtgatatcagactcctgttttcgcgaagaagtctcgagctggacacggggctgccgtatgagcttcaagctgtcacggaggcccctcacaatccacgatacagtccactcccctag

SEQ ID NO: 19166 - DNA, 702 bp, Artificial Sequence
  Description of Artificial Sequence: Synthetic coding sequence
atgggccggcggctgaagggcgcccggcggctgaagctgagcccccttaggagccttagaaaggggcctggcttactgtcgccaccatccgcatctcccgtgcccactcccgctgtatcaaggacactcctgggaaattttgaagagtctcttcttcggggccggttcgccccgtctggtcacattgaaggattcaccgctgaaatcggcgcctctggctcttactgtcctcagcacgtgacgctgcctgtaacagtcacattcttcgacgtgtccgagcagaatgcacccgcaccattcctgggcatagtggacctgaaccctctgggcagaaaaggctattcagtgcctaaggtcggtacagtccaggtgaccctgtttaaccctaatcagactgttgttaaaatgttcctggtgactttcgacttttccgatatgccggctgcccatatgacatttcttaggcaccggctgtttctcgtaccggttggggaggagggtaacgccaatcctactcaccgactcctgtgctatctcctccatctgcgcttcaggtcgagccgatctgggcggctgagtctccatggcgacattcgccttcttttcagcaggcgctctctggagctggacaccggcctgccttacgaactgcaggccgtcaccgaagctcctcataatcccagatactctccccttccctag

SEQ ID NO: 19167 - DNA, 339 bp, Artificial Sequence
  Description of Artificial Sequence: Synthetic coding sequence
atggaggcctacgagcaggtgcagaagggccccctgaagctgaagggggtggcggagttgggtgtgacaaagcgcaagaaaaagaaaaaagacaaagataaggccaagttactggaggccatggggacttctaaaaaaaatgaggaggagaagcggcggggcctggacaaacgtacgcccgctcaggccgccttcgagaagatgcaagagaagcggcaaatggaaaggattctgaagaaggccagtaagacccataaacagagggtggaagacttcaatcgccacctggacactctgactgagcactacgatatacccaaagtaagctggactaaatag

SEQ ID NO: 19168 - DNA, 639 bp, Artificial Sequence
  Description of Artificial Sequence: Synthetic coding sequence
atggagcccgccgtgggcggccccggccccctgatcgtgaacaacaaacagccacagcccccaccgccaccacccccagccgccgctcagccaccacccggagccccaagagctgccgccggtctgctgcctggcggcaaagccagggagtttaacagaaatcagcgaaaggactccgaggggtacagtgagtctccagaccttgagttcgaatacgccgatactgacaagtgggccgctgagttatccgagctgtattcctacacagaggggcctgagtttctcatgaatcgaaaatgtttcgaggaagatttcagaatccacgtcacagataaaaagtggacagaacttgataccaatcagcataggacccacgcaatgcgactgcttgacggcctggaagtgaccgctcgcgagaagcggctgaaagtggctagggccattctctacgtggcacaagggaccttcggcgaatgcagtagcgaggccgaggtgcagagttggatgagatataacatctttcttctgctcgaagttggaactttcaatgccctggtagagctcctcaatatggagatagaacactgctgtgtgagacccgccgtttccgccttggctggcggccaagcgcaggattag

SEQ ID NO: 19169 - DNA, 2514 bp, Artificial Sequence
  Description of Artificial Sequence: Synthetic coding sequence
atggagcccgccgtgggcggccccggccccctgatcgtgaacaacaaacagcctcagcccccgcccccacctccccccgcagctgctcagccgccacctggggcacccagggccgcagccggtctcctgcccggtggcaaggctagggagtttaaccgcaaccagcgtaaggacagcgaagggtattccgagtcgccagatctggagtttgagtatgccgataccgacaagtgggccgctgagttgtccgagctctactcgtacacagagggccctgagttccttatgaatcgcaagtgttttgaagaagactttcgcattcatgtcaccgacaagaagtggaccgagctagatactaaccagcatagaacccacgctatgcgccttctggacgggcttgaggtgaccgcacgcgaaaagagattgaaagtggcgcgtgctatcttgtatgtggcacagggcaccttcggcgaatgctccagtgaggcggaggttcaaagttggatgcgatataatatattcctgctactggaggtgggcacttttaatgcccttgtggagttgctcaacatggagatcgacaactccgccgcttgctcttcagcagttagaaaaccagctataagccttgcggactctacggacttgagagtactgctgaacatcatgtaccttattgtcgagacggtacatcaggaatgcgagggagacaaagccgaatggcgtaccatgcgccagacgttcagagccgagttgggctcacccctgtacaataatgaaccattcgcaatcatgttatttgggatggttaccaagttttgtagcggccatgcaccccacttccccatgaagaaggtactgcttttattgtggaagaccgtgttgtgcactctgggcggcttcgaggaactccagtccatgaaggcggagaagcgctccatcctgggactgcctccactgccagaggactcgatcaaggtgatccgcaacatgcgtgcagcaagtcctcctgcatcagcctccgaccttattgagcagcagcagaagcgaggccgccgggaacataaggctctcattaaacaagacaacctggacgcattcaatgaacgggacccttacaaagctgatgattcccgagaggaggaggaggaaaatgatgacgacaattcgctggagggcgaaaccttccccctggagagggacgaggtgatgcctcccccactccagcacccacaaacagacaggttaacgtgtcctaagggactgccatgggcccctaaggtcagggaaaaagacatagagatgttcctggagtcatctcggtccaaattcattggctatacacttggctcagacaccaatacagtggtggggctgcctagacctattcacgagtccattaagaccctcaaacagcataagtacacgtccattgcagaggtacaggcacaaatggaggaggaatatctgcggtctcccctgtctggcggcgaggaggaggtggaacaggtccctgccgaaaccttatatcagggattactccccagccttccccagtacatgattgctctgttaaagattctcctggcggcagctccgacctccaaagcgaagacagactccattaacatcttagcggatgtgcttccagaggagatgccaaccacggtcctccagtccatgaagcttggagtagatgtgaaccgacataaagaagtcatagtgaaggccatatcagcggtattacttctactgctgaaacactttaaactaaatcatgtttaccaattcgaatatatggctcagcacctggtctttgccaattgtatccctctgatcctgaaattttttaaccagaatataatgtcctatatcacagctaagaatagcatatccgtgttggattatccacattgcgtcgtccacgaactgcctgaactcaccgctgaatccttggaggctggcgattctaaccagttttgctggaggaacctgttctcctgcatcaacctcctaagaatactaaataagctgacaaaatggaagcacagcagaaccatgatgctagtggtttttaaatccgccccaattttaaagcgcgctctgaaagtaaaacaagccatgatgcaactctacgttttgaaactgctcaaggtacagacaaaatatctgggacggcagtggaggaaaagcaacatgaaaaccatgagtgctatctatcagaaagtccgccacaggctgaatgatgactgggcttatggaaatgacctcgacgccaggccctgggactttcaggcagaagagtgcgcccttcgggccaacatcgagcggttcaacgcccgccgctatgatcgcgctcactccaatcccgactttctgccagtggataactgccttcagtcagtccttggccaacgtgttgatttacctgaggacttccagatgaattacgatctgtggttagagcgcgaggtgttttcaaaacccatttcctgggaggaactgctgcaatag

SEQ ID NO: 19170 - DNA, 2229 bp, Artificial Sequence
  Description of Artificial Sequence: Synthetic coding sequence
atgaaccggaagtgcttcgaggaggacttccggatccacgtgaccgataaaaagtggactgaactggacacaaatcagcaccggactcatgcaatgcgtctcctcgatggactggaagtgacagctagagagaagcggctgaaggttgcccgggccatcctttacgtggcacagggcacctttggtgaatgtagttcggaggctgaagtgcagtcttggatgaggtataacatcttcctgctgttagaggtcggaaccttcaatgccttagtcgaactactgaatatggagattgacaattccgccgcctgttcatccgctgtgcggaagccagctatatccctggccgatagcaccgacctcagagtactactcaacataatgtatctgattgtggagactgtacatcaggagtgtgaaggagacaaggctgaatggcgaacaatgcggcagacttttagggcagaactgggcagccctttgtacaataatgagcctttcgccatcatgctcttcgggatggtgaccaaattctgttccggacacgccccccatttcccgatgaagaaagtgctgcttctattgtggaaaactgtgttgtgtacactcggcggcttcgaagagctgcagtccatgaaggctgagaaacggtctatcctcggcctgccgcccctgccagaggactccatcaaggtgattcgaaatatgagggctgcttcccctcccgcgtccgcttccgacctgattgagcagcagcaaaagcgggggaggagggagcacaaagctctgatcaagcaggataacttggacgctttcaatgaaagagatccctacaaggctgatgacagtcgcgaggaggaggaggaaaatgacgatgacaattcactggagggtgagacctttccgctcgagagagacgaggtaatgcctccaccacttcaacatcctcaaacagatagactcacttgccccaaaggattgccttgggctcccaaggtacgagagaaagacattgagatgtttcttgagtcttctagaagcaaattcataggatacacactgggatccgataccaatacagtggtcggactgccgcgcccaattcacgaatctatcaagacactcaagcagcacaaatacacaagtatcgcagaagtgcaggcacagatggaagaggagtatttgcgctcccctttgtccggcggggaggaggaagtagaacaagttcctgcagagacgctgtaccaagggctcttgcccagtctgccccaatacatgatcgctcttctgaaaatccttctggccgctgctcccaccagtaaagcaaagactgacagtatcaatatcctggcagacgtgctgcccgaagagatgcctacaacagtgcttcaatctatgaaattgggcgtggacgtaaaccgccataaggaggtcatagtcaaggcaatctcagccgtcctcttattacttctcaaacactttaagctcaatcatgtttaccagtttgaatatatggctcagcacctcgtgtttgccaactgcattcctctgattctaaaattttttaaccagaacatcatgagctatatcacagcaaaaaactctattagcgtccttgactacccccactgcgtagtgcatgagctgccggaactgaccgccgagagtctggaggcgggagacagcaatcaattctgttggcgaaatctgttctcttgtatcaatctcctccgaatcctgaacaaactaacgaaatggaagcactccagaactatgatgttggtggtatttaaaagcgcaccgatcctgaagagagctctcaaagtaaagcaggccatgatgcagctatacgttttgaaacttctgaaagtacagaccaaatatctgggtcgacagtggcggaagtcgaatatgaagacaatgagcgcgatataccagaaggtgcggcatagacttaatgatgattgggcttacggaaatgatttggatgctcgcccatgggatttccaggcagaggaatgcgccctgcgtgcgaacatagagaggttcaatgctcgccgctacgaccgggcgcatagcaatcctgatttcctacccgtggataactgtcttcagtccgttctgggccagagggttgacctgcctgaggactttcagatgaactacgatctctggctggaacgcgaggtgttctctaaaccaatttcatgggaagaattactccagtag

SEQ ID NO: 19171 - DNA, 783 bp, Artificial Sequence
  Description of Artificial Sequence: Synthetic coding sequence
atgaagagcaacatcgacaagaagttcagcgcccactacgacgccgtcgaggccgagctcaagagctctaccgtgggcctggtcactttaaatgacatgaaggccaaacaagaggcactggttaaggaaagagaaaagcagttggccaaaaaggaacagtccaaggagttgcaaatgaagctggagaaactgcgcgagaaggaacgcaaaaaggaggcaaaacgtaagatctcttcacttagtttcactctggaggaagaggaggagggtggcgaggaggaagaggaggccgctatgtacgaagaggaaatggaacgcgaggagatcactaccaagaaaagaaagttaggcaagaaccctgacgttgatacatctttccttcccgatagggatcgcgaggaagaggagaacagactgcgggaagaattgagacaggagtgggaggccaagcaggaaaaaataaagtctgaggagatcgagatcaccttctcctactgggacggatcgggccataggcggactgtcaaaatgagaaaaggaaataccatgcagcagtttctgcagaaagcactggaaatcctgcggaaagatttctctgagttgaggtctgccggtgttgagcagctgatgtacataaaggaggaccttattattccccatcaccattcattttacgattttatcgtaacaaaagcaagaggcaaaagcggaccactgtttaattttgatgtacatgatgacgtgaggctactatccgacgctaccgtggagaaggatgagtag

SEQ ID NO: 19172 - DNA, 1020 bp, Artificial Sequence
  Description of Artificial Sequence: Synthetic coding sequence
atggcccagtacaagggcgccgccagcgaggccggccgggccatgcatctgatgaagaagcgggaaaaacagagggaacaaatggagcagatgaagcagagaatcgctgaggagaatatcatgaagtccaacatcgacaagaagttcagtgcgcactatgatgcagttgaggcggagctgaagagttccactgttggcctcgtcactctgaatgacatgaaggcgaaacaggaagccttagttaaggagagagaaaagcaattggccaagaaagaacagtccaaagaactccagatgaagttagaaaagttgagggaaaaggagcgcaagaaagaagccaaacgaaaaataagttcactctcgttcaccctcgaggaagaggaagaggggggcgaggaggaggaggaggcagcgatgtacgaggaggagatggagcgggaagagatcacaacaaaaaaaaggaagctaggaaaaaaccctgacgtcgacaccagtttcctacccgatcgagatcgggaggaagaggagaaccggctaagggaggagttgcgacaggaatgggaagcgaagcaggaaaagatcaagtcagaggagatcgaaattaccttctcctattgggatggctccggccatagaaggaccgttaaaatgagaaaaggaaatactatgcagcagtttctgcaaaaagccctagagatccttcgtaaggattttagtgagttacggagtgctggggtagagcagctaatgtacattaaagaggatttgattattcctcaccaccatagtttttacgatttcatagtaactaaagcaagaggcaaaagtggtcccctgtttaattttgacgtacatgatgacgtgaggctgctgtctgatgccaccgtagagaaggacgaatcacatgcaggcaaggttgtcctgaggagctggtatgagaaaaacaaacatatcttcccagctagccgatgggagccatatgatcctgagaagaaatgggacaagtatacgatcaggtag

SEQ ID NO: 19173 - DNA, 1197 bp, Artificial Sequence
  Description of Artificial Sequence: Synthetic coding sequence
atggtgaccctgatcaccgagaagctgcagagccagagcctggacgacctcacatgtaaagctgaggccggcccactacagtactctgcagaaacccttaacaagtccggccgcctttttcccctggaactgaatgaccagagcccatggaaggttttttctggaggtcccccagtcagaagccaggccgccaccgggcctgacttttctttcctgccggggctgtccgctgcagctcacactatgggcctgcagtggcaaccccagagccctcgcccaggcgccggcctcggggctgcctccacagttgatcctagcgagagcaccggcagcagcaccgcgcctccaactaaacggcactgtagatctctcagtgagcccgaggaactcgttcggtgccgcagcccttggagaccgggttctagtaaagtttggactcccgtgtcaaaacgcaggtgcgattccggaggatctgcaacccgtcagggctcccccggtgctgtgctgcctagaagcgctgtctggtctaccgggccgacatcgcccgcaacacccaggccatcaagcgccagcggaggctttgtcgattctagtgaggggtctgccggctcaggtccactttggtgcagcgccgagtcttgtctcccctcaacacgtcggaggccatccctctcccaggaaagactcgccggcgccgggactccactgccatgggcatccagcagtccaacatctacccccgcgctgggaggccggaggggcctcctgcggtgcagatctcagccctgtgtgctgtcggggaaacggtcccgccggaaacgcagacgcgaggaagacgccagatggacccgcccatctctagattttctgaagatgactcagactcttaagaactcaaaatcgctctgctcactgaactatgaagatgacgatgaagatgatacccctgtgaaaaccgtgctctcgtcaccctgcgacagccgggggttacccggtataactatgccaggctgttcacaaaggggacttaggacatcccctgttcatcccaacctgtgggcctccagagaatctgttacatccgatggcagcaggcggagtagtggcgaccccagagacggcgactcagtgggagaggaaggtgtgtttccgcgggccaggtgggagctggatcttgaacaaatcgaaaataactag

SEQ ID NO: 19174 - DNA, 1197 bp, Artificial Sequence
  Description of Artificial Sequence: Synthetic coding sequence
atggtgaccctgatcaccgagaagctgcagagccagagcctggacgacctgacgtgtaaagcggaggcggggccactacagtactctgccgaaacattgaacaaatccgggagactttttcctctggagttgaatgaccagtcaccatggaaggtattttccggcggacccccggtgaggagtcaagcagctacaggtcctgacttctccttcctaccaggcctgagcgccgcagcgcatactatgggcctccagtggcagccacagagtcctcggccgggggccggactgggtgccgcttcaaccgtggaccctagcgaaagcaccggcagctcaaccgccccacccacaaagagacattgtaggtccctcagcgagcccgaagagttggtgcgctgtcgctccccctggcgcccagggtcgtctaaggtctggacaccagtatctaagcggcggtgtgactctggaggatccgcaacaaggcaggggtccccgggggctgtccttccacggagcgctgtatggagtacagggcctacttccccggctacccctcggcccagtagcgcctcaggaggcttcgttgactcaagtgagggatccgctggctcaggacctctgtggtgttccgccgaatcttgcctgccatctacgagacgccggccttccctgtcccaagaaagacttgccggtgccggaacaccccttccctgggcatcctcctcaccgacctctacgccagccttggggggccgacgaggcctcctaaggtgccggtcacagccctgcgttctgtctgggaagaggtcccggaggaagcgtagaagggaggaggatgcccggtggactaggcccagcctggatttcctgaagatgacccagactctgaaaaattccaagtccctctgctccttgaattatgaagatgacgacgaggacgatacacctgtgaaaacagtgctgtcttccccttgcgacagcagaggattgccaggtattacaatgcccggttgttcccagcggggcctcaggacgagccccgtgcacccaaatctgtgggcatctagagaatccgtgacatcagacggttccagacgatcatccggagatcccagagacggggattctgttggcgaagagggggtgttccctagggctcgctgggagttggatctcgaacagattgaaaataactag

SEQ ID NO: 19175 - DNA, 327 bp, Artificial Sequence
  Description of Artificial Sequence: Synthetic coding sequence
atggtgaccctgatcaccgagaagctgcagagccagagcctggacgatctgacatgcaaagcagaggccgggcctcttcaatacagcgccgagactttgaacaagagcggtagattgttcccccttgagctcaatgatcagagtccttggaaggttttctctggggggccccccgtgaggtcacaggctgccacaggacctgatttcagcttcttgccaggcctgtcagctgcagcccacactatgggattacagtggcaaccgcagtcaccgaggccaggggcaggactgggagcagccagtacggtggacccaagcgagtcttag

SEQ ID NO: 19176 - DNA, 1197 bp, Artificial Sequence
  Description of Artificial Sequence: Synthetic coding sequence
atggtgaccctgatcaccgagaagctgcagagccagagcctggacgatctgacctgcaaggccgaggccggaccccttcagtattccgccgagacattgaacaagtctggacggctatttccacttgaactcaacgaccagtcaccttggaaagtgtttagcgggggccctcctgtccggtctcaggcagccacgggccccgacttttctttcctaccggggctgtcggctgccgcgcacaccatggggctccagtggcagccccagtctccgagacccggtgctggccttggggcggcctcaaccgtcgatccatcagagtcgacaggttcttctacggccccacccaccaagcgtcactgtaggtcactgtcagagcccgaagagctcgttcgttgcaggtctccatggcgtcctggttctagcaaggtctggacacctgtctcaaagcgtcggtgtgactccggcggaagcgccacaagacagggttctccgggcgctgtgctgccacgctctgctgtgtggagcaccgggccgaccagccctgccacccccagacctagctccgcttcaggtgggtttgttgattcctcagagggcagtgccgggtccgggcctttatggtgctcagccgaatcttgtctaccttcgacccggcgacgcccatccctgtctcaagagagactcgccggggcaggcacacccttgccatgggctagcagtagccccacatccacccctgccctaggcgggcgtcggggacttctaaggtgtcgttctcagccctgtgtcctaagtggaaagaggagtcgccgcaagcgccggcgagaggaggatgcccgatggactaggccaagcctagattttctgaagatgacccagaccctcaaaaatagcaaatccctctgttcgctcaactatgaagacgatgatgaggacgatacaccagttaagaccgtgctgtccagcccttgtgactctagaggtttaccagggatcacaatgcccggttgctcccagcgtggcttgcgaacatctcccgtccatcctaacctctgggcatccagggagtcggtcacctccgatggatcccgccgtagctcaggcgacccaagggatggcgatagtgtaggcgaggaaggcgtttttcctcgcgctaggtgggagctagacctggaacaaatcgagaacaactag

SEQ ID NO: 19177 - DNA, 717 bp, Artificial Sequence
  Description of Artificial Sequence: Synthetic coding sequence
atggccagccggtggcagaacatgggcaccagcgtgcggcggcggagcctccagcatcaggagcagttggaggattctaaggagctgcagcctgtcgtatcacatcaggagacttcggttggggccctggggtcgctgtgtagacagtttcagagacgcctacctctccgcgctgtgaatcttaacctgagagctgggccttcgtggaaaaggctcgaaacgcccgagcccggacaacaaggactgcaggctgctgcgcgaagcgccaagagtgccttgggcgctgtcagtcaacgcatacaggaatcatgtcagtccggcacgaaatggttagtggagacacaggtcaaggccaggcgccggaagagaggcgcacagaaaggatctggttctcccacccactcactgagccagaagtctacccggctcagtggagcggctcctgcacattctgccgccgatccctgggagaaggagcaccatagattgagtgtgcgcatggggtcccatgcccatcctctgcgtcgtagcagacgcgaggccgcgttcagatctccctactcaagtactgagccactgtgtagtccttcagagtccgattccgaccttgaacccgtaggggctggcatccagcatctccagaagctatcacaggaattagatgaggccattatggcagaggaatccggtgatattgtctctctgattcacgactag

SEQ ID NO: 19178 - DNA, 747 bp, Artificial Sequence
  Description of Artificial Sequence: Synthetic coding sequence
atggccagccggtggcagaacatgggcaccagcgtgcggcggcggtccctgcagcaccaagaacaactggaagacagcaaggagttgcagccagtcgtgtcacatcaggagactagcgtcggagctctggggtcgctgtgtaggcaattccaaaggcggttgcctcttcgagcggtcaacctcaatctgcgggcaggtccctcttggaaaaggctggaaacccctgagcctggccagcagggattgcaggccgccgccagatctgctaagagcgccctcggcgcggtctctcaacggatccaggagtcctgtcaatctggcacgaagtggctggtagagacgcaggttaaagcaaggcgccgaaagaggggagcgcagaagggaagcgggagtccgacccactctctgtcccagaaatctactcgcctcagtggcgcagcccccgcgcacagcgccgccgacccttgggaaaaggagcaccacagactcagtgttcggatgggatcgcacgcccaccctctgagacgatccaggcgagaggccgcattccgcagtccatattcaagtacagaacccctgtgctcgccctctgagtcagatagcgatctggagccagtgggggccggaatccagcatttgcagaagctgagtcaggagctggatgaggccattatggccgaggagcgcaagcaggcgctttccgatcgtcaaggattcatcctaaaagacgtctacgcatccccctag

SEQ ID NO: 19179 - DNA, 717 bp, Artificial Sequence
  Description of Artificial Sequence: Synthetic coding sequence
atggccagccggtggcagaacatgggcaccagcgtgcggcggcggtccctgcagcaccaggaacagctggaggattctaaggaactacagcccgttgtgtcgcatcaggagactagtgtgggagccctagggtcactgtgtagacagttccagaggcgtcttccactacgggccgtgaacctgaacctgagagccggcccaagttggaagcgactcgagactcctgaacccggtcaacaggggctccaggccgccgccagaagcgctaagtcggccctaggagcagtatcccagagaatacaggagagctgccagtctgggacaaaatggctggtggagacccaggtcaaggcccgtcgacggaagcggggagcacagaagggatccggaagccccactcatagcctgagtcaaaagtctacccggttatcaggagctgctcccgcacactccgcggctgatccctgggaaaaagaacatcatagattgtcagtgcgtatgggctcccatgcccatccgttacgacggagcagaagagaggcagctttccgcagtccatactctagcactgagcctctgtgctccccctcagaaagcgactcagacttagagcccgttggcgccggtatccagcatctgcaaaagctgtcacaggagttggacgaggctattatggctgaagagtccggcgacattgtaagccttatccacgattag

SEQ ID NO: 19180 - DNA, 1818 bp, Artificial Sequence
  Description of Artificial Sequence: Synthetic coding sequence
atgagcaacgagagctgcctgccctactacaccgcccacagctacagttcgatgtctgcctttaaaacctccatgggcgatctgcagcgccaactgtataatcggggggaatacaacattttcaagtatgcgccaatgtttgaaagtaacttcattcaaattaacaaaaagggggaagtgatagacgtccataaccgggtgcgtatggtgactgttggaatcgtttgcaccagtcctatcctccctctaccagacgtcatggtactggcccaacctacgaagatctgcgagcagcacgtgcggtggggccgtttcgcaaaaggacggggacggcgacctgtgaagacccttgaactcacacgactgctgcccctcaagttcgtgaagatcagcatccacgatcatgaaaagcaacaattgagactgaaactggccacgggaaggaccttttacttgcagctttgtccatcctcagatacacgtgaggaccttttctgctactgggaaaaattggtgtatctgctgcggccccccgttgagtcgtattgctccaccccaaccttgttaagcggagatgccccaccagaggataataagtctctggtggccgccgaacttcatcgggagggcgatcagagtgagacaggactatataaaccttgtgacgtctctgcagctactagctctgcttatgcggggggtgaaggcatccagcacgcgtctcatggcactgccagcgccgcaagcccttcgacatctacccctggggcagcagagggaggcgcagcccgaacagctggtggaatggctgtggccggaaccgccaccggacctagaacagacgtcgccattgccggggccgcaatgtccccagccactggggccatgtccattgccaccacgaagtcagccggccctggccaggtgacaaccgccctcgccggtgctgctataaaaaaccccggagaaaatgagtccagcaagtctatggcgggggctgcgaatatctcctctgaggggatcagtctggccctcgtcggggccgcttctacttctctggagggcacaagcacctctatggcgggggcagcttcactctcccaggatagttccttaagcgctgccttcgcaggatcgatcactacgtccaagtgtgctgctgagcggactgaaggcccggccgttggcccccttataagcaccctccagtcagagggttacatgtctgagcgtgatggtagccagaaagtcagtcagccgtccgcagaagtatggaatgagaacaaggaacggcgggagaaaaaggaccggcacccttcccgaaagtcctctcatcacagaaaagcgggcgagtcccataggagacgcgcaggagataagaaccaaaaagcaagctctcatcgtagcgcctccgggcacaagaacactcgcgatgacaagaaggagaagggctactctaatgtgcgtggaaagcgtcatgggtcttcccggaagtctagcacgcatagctcaactaagaaagagtcacggaccacgcaggaattgggcaagaaccagtcagcatcctctacaggcgctctgcagaagaaggcctcgaagattagtagcttcctacgctcactcagagcaactcctgggtccaagacacgcgtgaccagtcacgacagggaagtggatattgtcgccaaaatggtggaaaaacaaaatattgaagctaaggttgaaaaagcccagggcgggcaagagctggagatgatttctggcacgatgacaagcgagaaaacggaaatgatagtgttcgaaaccaagtctatctag

SEQ ID NO: 19181 - DNA, 3054 bp, Artificial Sequence
  Description of Artificial Sequence: Synthetic coding sequence
atgatgagcgagggcaagccccccgacaagaagcggccccggcggagtctctccatatcaaagaataaaaagaaggcatctaacagtataatctcctgtttcaacaatgccccaccggccaaattagcatgccctgtgtgttctaaaatggttcctagatatgatcttaatcgccacctcgacgagatgtgcgccaataatgatttcgtccaggtggaccctggccaggttgggctgatcaactcaaatgttagcatggtcgatcttacttccgtgaccctggaagatgtgactccaaagaagtccccccccccgaaaaccaacctgactcctggccagtccgatagcgccaaaagagaagtgaagcaaaagatctctccttacttcaaaagtaacgacgtggtttgcaaaaaccaggacgagctcaggaaccggtctgtcaaggtgatttgcctgggatctctggccagcaaactgagtcggaagtacgtgaaagccaagaagagcatcgacaaggatgaagaattcgctggttcctcccctcagtctagtaaaagcaccgtggtcaaatctctgatcgataactcctccgaaatagaggacgaagaccaaatcctcgaaaattcttctcagaaagagaatgtcttcaaatgtgactccttgaaggaggaatgtattcccgaacatatggtgcgaggttccaaaattatggaagctgaatcgcagaaagctactcgagagtgcgagaagtccgctttaactcctggtttcagcgataatgccataatgcttttttcccctgactttacgctgcggaatacgcttaagagtacaagtgaagactcacttgtcaagcaagagtgtattaaagaggtggtagagaaacgcgaagcttgccactgtgaggaggtgaagatgactgtggcatccgaggctaagatacagttaagtgactctgaagcgaaaagtcacagtagtgctgatgatgccagtgcatggagcaacatacaggaggccccactgcaggacgactcttgcctgaacaacgacatcccacatagtataccactcgaacagggatctagctgtaacggacccggccaaactacaggccacccgtattatctccgctcgttccttgtcgtgttgaagacggtgctggagaacgaagatgacatgcttctgtttgatgaacaggagaagggtatcgttaccaagttctatcagctgagtgctactggccaaaaattatatgtgcgcctgttccagcgtaaactaagctggatcaaaatgacaaagctcgagtacgaagagatcgcgttggatctgaccccagtgatcgaggaactaaccaacgcaggcttcctgcagactgagtcggagctgcaggagctgagtgaggttctggaactcctttccgccccagagctgaaaagcttggctaaaacattccatctggtgaatcccaatggtcagaaacagcagctcgtcgatgcctttttaaaattagcaaagcagaggtccgtgtgtacctggggcaagaataaacctggaattggagccgtgatccttaagcgcgctaaggcactggcaggccagtctgtgaggatttgtaaaggtccacgtgctgtgttcagtcgcattctcctgcttttttccctaaccgactccatggaggacgaggatgctgcttgcggcggccaggggcaactaagcacggtgcttctcgtaaacttaggcaggatggaattcccatcctacactatcaatagaaagactcacatttttcaagatcgtgacgacctgattaggtatgccgccgctacccatatgctgtctgatatctcctctgctatggctaacggcaactgggaggaagccaaagagctcgctcagtgcgccaagcgagattggaataggcttaagaaccacccgtccctgaggtgtcatgaagaccttcctctgttcctgagatgcttcacagtgggatggatatacactcgcatccttagccggtttgtggagattctgcagagactacatatgtatgaggaagccgtgagagagctcgagagcctgctgtcacaacggatctattgccccgacagcaggggacgctggtgggaccgcctcgcgcttaaccttcaccagcatctgaaacggctggaaccaaccattaaatgcatcacagagggtcttgcagaccccgaggttcgcaccgggcaccggcttagtctgtaccaacgggccgtccgccttcgagagtctccttcctgtaagaagtttaaacacctcttccagcagttgccagaaatggctgtgcaggacgtgaaacacgtaaccatcactggaaggctgtgtcctcagcgggggatgtgcaaatctgtgttcgttatggaggcaggagaggctgctgatcctaccacagtcctttgcagcgtagaggagctcgccctagctcactaccggagaagcggatttgaccagggcatccacggtgaagggagtacattctcaactctttacggcctgctgctatgggatattatcttcatggatgggattcctgatgtgtttcgaaacgcctgccaggctttcccactcgatctctgcaccgatagcttttttaccagcagacgccccgctctggaggcaagactgcagctgatccacgatgctccggaggaatccttacgggcttgggtggccgccacttggcacgaacaggaagggcgggtagcgagtctggtgtcatgggaccggttcacctccctgcagcaggctcaagacctggtttcatgtctagggggccccgtgctgtccggcgtgtgccggcatcttgccgccgatttcaggcactgcagaggggggctgcctgatttggtggtctggaattctcagagtcggcattttaaactagtcgaagtaaagggaccgaatgatcggctttcccacaagcagatgatctggctagctgagctccagaagctgggtgctgaggttgaagtgtgtcacgtggtcgccgtgggagccaaaagccagagtctcagttag

SEQ ID NO: 19182 - DNA, 1602 bp, Artificial Sequence
  Description of Artificial Sequence: Synthetic coding sequence
atgatgagcgagggcaagccccccgacaagaagcggccccggcggagccttagtatttccaaaaataagaagaaagcctccaattccatcatatcctgtttcaacaacgcaccgccagccaaattggcatgcccagtgtgtagcaaaatggtgcctcggtatgatctgaatcggcacctagacgagatgtgcgctaataacgactttgtgcaagtagaccccggacaagtgggactcatcaattccaacgtctccatggtggatctcacaagtgtgacgctagaagatgtaacgcctaaaaagtccccgccacctaagaccaacttgacaccaggacagagcgactccgccaaacgggaagtaaagcagaaaattagtccttactttaaaagcaatgatgtggtctgtaaaaatcaggacgaattaaggaaccgcagtgtgaaagtcatttgcctgggaagcctggctagcaaactctctcgcaaatatgttaaagcgaagaaatcaatagacaaagatgaggaattcgcagggtcatctccacaatcctcaaagagcacagtcgtcaaaagcttaattgataactcgtcggaaattgaggatgaagatcagattttggagaatagttcacagaaagaaaatgtcttcaaatgcgacagcctgaaagaggaatgcattccagagcatatggtgcggggtagtaaaatcatggaggccgagtcccaaaaagcaacccgggagtgtgagaagtcagccctgacgcctgggttctccgacaatgccattatgttgttctcacctgacttcaccctccgaaataccttgaaatccacgagtgaagattctctcgtcaagcaagaatgtattaaagaggtggtagagaagagagaagcatgtcactgcgaggaagtcaaaatgactgttgcctctgaggccaagatccaactcagcgacagtgaagcaaagtcccactcttccgccgatgacgccagtgcatggtcgaatatacaagaggccccacttcaggatgactcgtgcctgaataatgatattccgcatagtataccactcgaacagggctcgtcctgtaacgggcctggccagacaaccgggcatccctattatctaagatcctttttggtggtcctgaagactgttctcgagaacgaggacgatatgctgctttttgatgaacaggagaaaggcattgtaaccaagttctaccagctctcagcaactggacaaaaactgtacgtgagactctttcaacgcaagctgtcatggattaagatgacaaagctggaatacgaagagatcgcactcgacttgactcccgtcattgaggagctgacaaatgctggctttttacaaacagaatctgaattgcaggagttgtctgaggttttggaattgcttagcgcaccagaactgaaaagcctcgcaaagacatttcatttagtgaatcctaacggccagaagcaacagttggtggatgctttcttaaagctggcaaagcagcgctcagtctgtacatggggtaaaaacaaaccaggaattggcgcagtcattcttaagcgcttctgttggctgcttcttcaatag

SEQ ID NO: 19183 - DNA, 1719 bp, Artificial Sequence
  Description of Artificial Sequence: Synthetic coding sequence
atggccgagctggtgcagggccagagcgcccccgtgggcatgaaggcagagggatttgtggacgccttgcaccgggtaaggcagatcgcggcgaagattgatagtataccccatctcaacaattccaccccactggtagacccttctgtttacggatacggggttcaaaagcgccctcttgatgatggtgtagggaaccagctaggagccttagtgcaccagagaaccgtgattaccgaagagttcaaagttcccgataagatggtcgggttcattattgggcgaggcggcgagcaaatcagtcggattcaagctgaatccggttgcaaaattcaaattgccagtgagtccagtgggatcccggaacgcccgtgcgttcttactggaacccccgaaagtatagaacaggctaaacgattgctcggccaaattgtggatcggtgccgaaacggacccgggtttcataacgacattgactccaattcaacaatacaggagattttgattccggccagtaaagtgggactagtcatcgggcggggtggtgagacaatcaagcagctacaggagcgaactggggttaaaatggtgatgatccaggatggccctctccccaccggtgctgacaagcccctcagaatcacaggggatgcttttaaggtgcaacaggcccgggaaatggtattggagattattcgcgaaaaggaccaggcagacttccggggtgtccggggagactttaactcccgaatgggcggaggaagtatcgaggtatctgtgccgcgtttcgcagtgggaatcgtgatcgggaggaacggcgaaatgatcaagaagatccagaatgacgccggcgtcagaatccaattcaaaccagatgatggtatttccccagaaagagccgctcaggtcatggggcctccagaccgttgtcagcacgcagctcatatcataagtgaactcattctaacagcccaggaaagagatggcttcggaggactggctgctgcgcggggccgaggtcgtgggaggggtgactggtcggtgggagctcccggtggcgttcaggaaattacttatacagtgccagccgataagtgtggactggtcattgggaaaggaggcgaaaacatcaaatccataaatcagcagagtggcgcccacgtggagctgcagaggaatccccctcctaatagtgatccaaacctgcgtcggtttaccatccgtggagtacctcagcaaattgaggttgctcggcagctcatagacgagaaagtgggcggtaccaacctgggagcgccaggcgctttcggccagtcgccatttagtcagcctccggctccacctcatcagaacaccttcccaccccgctccagcggctgcttcccgaacatggccgcaaaggttaacggaaatccacattcaacgcctgtctctgggccacccgccttcctgacacaggggtggggcagcacctaccaggcctggcagcagccaacccagcaggtcccatcccagcaaagtcagcctcagtcatctcagcctaactacagtaaagcttgggaagattactataagaagcagtcccatgccgctagcgcagcaccacaggccagcagtcctccagactacacgatggcctgggctgagtactatcgacagcaggttgcattttatgggcaaacactgggacaggcccaggcccactcgcaggaacagtag

SEQ ID NO: 19184 - DNA, 927 bp, Artificial Sequence
  Description of Artificial Sequence: Synthetic coding sequence
atgaaggccgagggcttcgtggacgccctgcaccgggtgcggcagattgccgctaaaatcgacagcattcctcaccttaacaattctacccctctcgtcgacccttccgtgtatggttatggggtgcaaaagagaccactggatgatggagttggaaaccaactgggagcactggtgcaccagcggactgttattaccgaagagttcaaggtcccagacaaaatggtcggatttataatcggtcgagggggggaacagattagccggattcaagccgagtccggctgtaagattcagattgccagtgaatccagcggaattcctgagagaccttgcgtgctgaccggaacgcctgaatcaattgagcaggctaaacggctgttgggccagatagttgaccgctgccgaaacggcccaggtttccacaatgatatcgattctaattccaccatccaggagatactgattccagcctccaaagttggtctggtcattggccggggaggtgaaacaatcaaacagctgcaggagagaactggtgttaaaatggttatgatacaggacggtcccttaccaaccggagcggacaagcctctcagaatcaccggcgatgccttcaaggttcagcaagcaagggaaatggtgctggagataattagggagaaggaccaggcagactttcgaggggtgagaggggatttcaatagtagaatgggaggtggatctatcgaggtgagcgttcccaggttcgcagtgggtatcgtgattggacgcaatggggaaatgattaagaaaattcagaatgacgccggtgtccggatacagtttaagcctgacgacggcattagcccagaatactacaggcagcaggttgccttttatgggcagaccctcggtcaggctcaggcacactcccaggatgagtag

SEQ ID NO: 19185 - DNA, 786 bp, Artificial Sequence
  Description of Artificial Sequence: Synthetic coding sequence
atgccccccatcggcaaccagctgggcgccctggtgcaccagcggaccgtgatcacggaagaattcaaagttccagacaagatggtcggtttcattatcggacgcggaggcgagcagatttccagaattcaggccgagtctggatgcaagattcagattgcctccgagtcatctggtattccagagcgcccttgtgtcttgactggaacccctgaaagcattgaacaggcaaagagactccttggccagatcgtcgaccgatgtagaaatggacccggtttccataatgatattgattctaatagcactatacaggaaattctgatcccagcatccaaagtaggactagtcattggtaggggcggggaaacgatcaaacagctgcaggagaggaccggagtgaagatggtcatgattcaggatggcccactacccactggcgccgataaacccttacgcataacgggcgacgctttcaaggtgcagcaggcgagagagatggtgctggagattattcgcgagaaggatcaagccgacttccgcggagtccggggcgatttcaacagtcggatgggggggggcagcattgaggtgtccgtgcctcgcttcgcagttgggatcgtgattggtaggaacggtgaaatgattaaaaagattcaaaacgatgcgggggtgcgcatacagtttaagccagacgacgggatctcccctgagtactatcgtcagcaggtggcattttacggacagacccttggacaggctcaggctcattctcaggaacaatag

SEQ ID NO: 19186 - DNA, 597 bp, Artificial Sequence
  Description of Artificial Sequence: Synthetic coding sequence
atgggcaagcagaagaagacccggaagtacgccaccatgaagcggatgctgtcattgcgagaccagcggctaaaagagaaagacagactgaaaccaaaaaagaaggagaaaaaggatccttccgccctgaaggaaagggaggtgccccaacatccgtcctgtctctttttccagtacaatacgcaacttgggccgccctaccacatcctggtggataccaatttcatcaatttctccatcaaagcaaaactcgacctggtacagtcgatgatggattgcttatatgcaaaatgcattccctgtatcaccgattgtgtaatggccgaaatcgaaaagttggggcaaaaataccgcgtggctctgcgcattgcgaaggatccccggtttgaaaggcttccatgtactcacaagggaacctacgctgacgactgccttgttcaaagggtgacacagcataaatgctacatcgtcgcgaccgtggatcgggatttaaaaagaaggattcgtaaaatccccggagtaccaattatgtacatcagtaaccaccgctataatattgaacgaatgccggacgattatggggctcctcgtttctag

SEQ ID NO: 19187 - DNA, 501 bp, Artificial Sequence
  Description of Artificial Sequence: Synthetic coding sequence
atggccgcctaccccgagagctgcgtggacaccaccgtgctggacttcgttgcagacctttccctggcttccccacgccggcccctactgtgcgactttgccccaggagtgtccctcggcgatccggcactggctctacgggaggggcggccgagacgcatggcccggttcgaagagggggaccctgaggaagaagagtgcgaagtcgatcagggcgatggcgaggaggaggaggaggaggaaagggggcgaggagtctctctgctgggcagacccaaacgaaagcgcgtgatcacgtacgcccagaggcaggctgctaatataagggaacggaagaggatgtttaacttaaacgaagccttcgaccagctgcgccgtaaagtgcctacattcgcctatgagaaaagactctcccgcattgaaactctcagattggccatcgtgtacatctctttcatgaccgaacttctggaatcatgcgaaaagaaagaatctggctag

SEQ ID NO: 19188 - DNA, 2280 bp, Artificial Sequence
  Description of Artificial Sequence: Synthetic coding sequence
atgatcagcagcaccagcgtgtacggcctgaagatgcagtggacccccgaacatgcccaatggcccgagcagcacttcgatattactagcacaactaggagccctgcgcacaaggttgaggcgtaccgggggcacttacagcggacctatcagtatgcatgggccaacgacgacatcagcgccctcacagcgtcaaacctccttaaaaagtatgctgaaaagtactctggtatcctcgagggccctgtggacagaccagtgctttccaactacagtgacacaccatccggcctggtcaatgggcgaaagaacgagtctgaaccgtggcaaccttcgctaaattcggaagcagtgtatccgatgaattgcgtcccagacgtcatcactgcctccaaagcaggtgtgtccagtgccctgccaccagccgatgtcagtgcttctattggttcatctcctggagtggcctctaaccttacggagcccagctactctagttctacttgcggctcgcacactgtgcccagccttcacgccggcctaccgtcacaagaatacgccccaggatataatggctcttacctgcatagtacctatagctctcaacccgcacctgccctcccaagtcctcacccttcgccgctgcactcgtctgggctgttgcagcctcctccccctccacccccacctcctgccctggtgccaggatataatggcaccagtaatctttcttcatacagctatccatcggcaagctacccgcctcagacagcggtcggtagcggctactctcccgggggcgccccaccacctcccagtgcataccttccatccggtatccctgcccccacacccctccctccaacaacagttccaggctacacctatcagggccacgggttaactccaattgctccctccgcactgaccaacagtagtgcaagctccctgaagcggaaagctttctacatggcaggccaaggagatatggatagctcctatgggaattactcttacgggcagcagcggagtacccagtcccccatgtaccgcatgccagacaattcaatctctaacacgaatcgaggcaacggcttcgatcgtagcgcggaaacctctagcttagcattcaagccaacaaaacagctgatgtcttcagagcagcaacgaaagttctcatcgcagtcatctcgcgcccttactcctccctcttactctacggccaaaaattcgctcggaagccgcagttctgagtccttcggtaagtatacaagcccggtgatgagtgagcacggtgatgagcacaggcagcttctgagccaccctatgcagggtccaggtttgagagccgcaacaagctccaaccactctgtggacgaacagctcaaaaatactgatacccatctgattgacctggtgacaaacgagatcattactcagggcccccccgttgattggaatgacattgcgggcctggaccttgtgaaggcagtgataaaagaggaagtgttgtggcccgtcctgcgctctgatgcattctcggggctgaccgccctgccgcgtagcatcctcttgttcggtccccgaggcactggcaagacacttctcggtcgctgcatcgccagtcagcttggcgctaccttctttaaaatcgctggttccggacttgttgccaaatggctcggtgaggcggagaagattattcatgcatcctttctcgtggctaggtgccggcagccaagcgtgatcttcgtgtccgatatagacatgctcttatcttcacaggtgaacgaggaacactcccctgtctcacggatgaggacagaatttcttatgcagcttgacaccgtgctgaccagcgcagaggaccagatcgtagtaatttgcgctacgtcaaagcctgaagaaatagacgagagcctacgccgatatttcatgaagcgcttactcatccctctccccgactctactgcacggcaccagataatcgtacagctcttgtcccagcacaattactgtctaaacgataaggaatttgccctcttggtgcagcggacagagggattttcgggtttggatgtggcacacctctgccaggaagctgtcgtgggacctctgcacgcaatgccagccacagatctaagtgctattatgcccagccagcttcggccagtgacttatcaggatttcgagaatgccttctgcaaaatccagccgagtatcagccagaaggaactcgacatgtatgtagagtggaataagatgtttggctgcagccagtag

SEQ ID NO: 19189 - DNA, 1050 bp, Artificial Sequence
  Description of Artificial Sequence: Synthetic coding sequence
atggagaccccccccgtgaacaccatcggcgagaaggacaccagccagccccagcaagaatgggagaaaaatctgagggagaacctcgattctgttatccagattcgccagcaaccacgcgatccaccaaccgagactttggaactcgaagtgtcccctgaccccgccagccagatcctcgagcacacacagggagctgagaaactggtggccgaactggagggagattcacacaagtcacacggcagcacctcacaaatgcccgaagcactccaggccagcgacctttggtactgccctgatggcagctttgtaaagaagattgttatccgtgggcacggcttggacaagcctaagttaggatcttgttgccgtgtgcttgctctggggttcccctttggctcaggtccccctgaaggatggacagagctgaccatgggtgttgggccgtggagagaggaaacttggggcgagctcatagaaaagtgcctggaaagcatgtgccagggagaggaagcagagctgcagctccccggccactctggaccaccggtgcggctcaccttggcctcattcacccagggcagagactcctgggagctggagacctccgaaaaagaagcccttgctcgcgaagaacgtgctaggggcactgagttgttcagggccggtaatcccgagggagctgctagatgctacggccgggctcttcgcctattacttactcttccaccaccgggaccacccgagcgcactgttctccacgctaatctcgctgcatgtcaattgctactgggtcagccccaactggcagcacaatcttgcgatcgagtgctagaacgcgagccaggccatttgaaggcgctgtacagaagaggcgtggctcaggccgccctgggaaacctcgagaaggcaacagccgatctgaagaaagtgcttgcaatagacccgaagaaccgcgcggctcaagaagaactgggtaaagtggtcattcagggcaagaaccaggacgccggactggcccaaggacttcgcaaaatgtttggctag

SEQ ID NO: 19190 - DNA, 1050 bp, Artificial Sequence
  Description of Artificial Sequence: Synthetic coding sequence
atggagaccccccccgtgaacaccatcggcgagaaggacaccagccagccacaacaggaatgggagaagaatctcagggagaaccttgatagcgtaattcaaattcgacagcagcctcgggacccccctaccgaaaccctcgagcttgaggtgtcccccgatccagcatcacagatcttagaacacacacagggtgcagagaagctggttgctgagctggagggcgactcacataagtctcatggaagcacttcccaaatgcctgaggctcttcaggcttctgacctctggtattgtcccgacggctcttttgtgaagaagatcgtgatacggggccacggactcgacaaaccaaagctgggatcttgttgccgagttttagcgttgggttttcccttcggcagcggacccccagaaggatggaccgagctgaccatgggagtgggtccctggagggaggagacgtggggagagttgatcgagaaatgcctggagtccatgtgccagggggaggaggccgagctccagttgcccggacattccggaccccctgtacgcctcaccctcgcttccttcactcaaggacgtgatagttgggaactagaaacctctgagaaggaggctctcgcccgggaggagcgtgcacgaggaacggagttgttcagggctgggaatccagaaggagcggcccggtgctacggccgggcgcttcggctcttgctcacactgcctcctcctggaccccccgagaggaccgtgttacatgcgaacctcgcagcgtgtcaactgctgctaggccagccacaactagctgcacaatcatgtgatcgcgttcttgagcgcgaacccggacatcttaaagctctctatagaaggggggtagcacaagcggcgctgggaaacctcgagaaggccaccgcagacctgaaaaaggtcctggcaattgacccaaagaatcgcgctgcccaagaggagctgggaaaagtcgtgatccagggcaagaatcaggacgctgggctggcacaaggattgaggaaaatgttcggctag

SEQ ID NO: 19191 - DNA, 1050 bp, Artificial Sequence
  Description of Artificial Sequence: Synthetic coding sequence
atggagaccccccccgtgaacaccatcggcgagaaggacaccagccaacctcagcaagaatgggaaaaaaacctgcgtgagaacttggacagcgtcatacagataagacagcaacctagagacccacccactgagaccctcgaactcgaggtctccccggacccagcctcacagattttggaacatacgcagggagcagagaagctggtagctgagctggagggagacagccataagagtcacggctctacaagccaaatgcctgaagccttgcaagctagcgatctgtggtactgtcccgatggatcctttgtgaagaagatcgtgattcgggggcacggcttagacaagcctaaactggggtcctgttgtcgtgtgctcgccttgggctttcccttcgggtctggcccccctgagggatggaccgaattaacaatgggcgtaggcccctggcgagaggaaacttggggggagctgatagaaaaatgcctggagagcatgtgtcagggagaggaagcggaattgcaactgcccggacattcagggcctccggtgcgtctaacattagccagtttcacccaagggcgtgattcttgggagttggagaccagtgaaaaggaagccttagcccgggaagaaagggctagaggaacagagctgttccgggccggcaacccagagggagctgcccgctgctacggccgcgctctaaggttgttgctcacgctacctcctccaggaccacctgaacggaccgtgctccacgccaatctagccgcttgccagctgcttctcggccagcctcagcttgcagcccagtcttgcgaccgggttctggagagagaacctggtcatctcaaagccctgtatcgtaggggtgtggcccaggccgccctcggcaatctggagaaagcaaccgcggacctgaagaaggtcctcgccatcgaccccaagaatcgcgccgcgcaggaggagttgggcaaggtggtgattcagggcaaaaaccaggatgctggtttggcacaggggctccgtaaaatgtttggttag

SEQ ID NO: 19192 - DNA, 2151 bp, Artificial Sequence
  Description of Artificial Sequence: Synthetic coding sequence
atgcccctgcccgagcccagcgagcaggagggcgagagcgtgaaggccggccaagagccttcccctaagccagggactgatgttatccccgccgccccacggaagcctcgggagttctccaagttagtgctgctaaccgccagcgatcaggacgaagatggtgtgggatccaaaccccaggaagtgcattgtgtgttgtcactcgagatggctggcccagcgaccctagcttccacactccagatcctgccagttgaggagcagggcggagtggtacagccagccctggaaatgcccgagcagaagtgctcaaagctagacgccgcagctccacagagcctggaatttcttagaactccattcgggggtaggctgcttgtgctggagagttttctatataaacaagagaaggccgtgggagacaaggtgtactggaaatgccgtcaacacgcagagcttggctgcaggggcagggcaataaccagagggttgcgcgctaccgtcatgagagggcattgtcatgcaccagacgagcaggggttggaggcccgcagacaaagggagaagctaccctcgctcgcccttcccgagggtctgggtgaaccgcagggcccggagggtcccggaggcagagttgaagaacccttagagggcgtcggcccatggcagtgccctgaagagccagagcccacccccggactcgttctaagtaagcctgcattggaagaagaagaagctccacgggccctcagcctcctgtcattacctcccaagaaaagatccatcctcgggctcggtcaggccaggcccctggagtttcttcgtacctgctacggagggagctttctggtccacgagagttttctgtataagcgcgaaaaggctgttggggataaagtttattggacctgccgcgatcacgcattgcacgggtgccgatcccgtgccatcacacagggccagagggtcactgtgatgaggggacattgtcatcagcccgatatggaaggactagaagcaagacgccagcaggagaaagcagtggagacgctgcaggccgggcaggatgggcctggatctcaagtagataccttgctgaggggcgtcgattctctgctctacagaaggggaccggggccccttaccttaacacgtccaagaccacgcaagagggctaaggtcgaggaccaggaacttccaactcagcccgaagccccagacgagcaccaggatatggacgcggaccccgggggacctgagttcttgaaaaccccactgggcggatccttcttggtgtatgaatcgtttctgtatcgtcgagaaaaggctgccggcgagaaggtctactggacctgcagagatcaggctcgcatgggctgcaggtcccgcgctattacccagggtagaagggtgacggttatgagaggtcattgccacccccctgatcttggaggattggaagccctgcgccagagggagaaacgccccaacaccgcacaacgagggagtccagggggacctgaatttctcaagacccctcttggcggaagttttctggtatatgaatctttcctttatcgcagggaaaaagccgccggcgaaaaagtgtactggacctgtcgggaccaggcccggatgggttgccgttcacgagcgatcacccagggaaggcgggtgatggtgatgcggcggcactgtcacccacctgacctaggggggctggaagcccttcgacagcgggaacacttccctaatctcgcccagtgggatagcccagaccccctgcgcccattggagtttctccggacatcattaggaggaagattcctcgtgcacgagagtttcctctataggaaagagaaagcagctggcgagaaggtctattggatgtgtcgtgaccaagccaggttggggtgccggtctcgggccatcacccaaggccaccgcattatggtgatgaggtctcactgccatcagcctgacctggctggtttagaggctctgcggcagcgagagagactgcctacaacagctcagcaagaagaccctgaaaagattcaggtgcagctgtgctttaaaacctgtagccctgaatcccaacaaatctacggtgatatcaaagacgtgcgtttagatggagaatcccagtag

SEQ ID NO: 19193 - DNA, 987 bp, Artificial Sequence
  Description of Artificial Sequence: Synthetic coding sequence
atgccccaggccaccagcccccccctgtggcccctgagcctgcacggtggcaagggtatcctgtgggcacgacactcccatccccccggcccaccttcgcatcacatccaggactccggccgctgtagcctgccccttcctcagtctccaggagtgaccccacttcccgcgaggctgagtggggctaccccactcagcccgattcgcctgctgtctagcttcgtcccaagagggccaagggtgatccccctgaccaatcaagctaggcggaccctgcatgccagcctggggggatgctggggcagaacctcggacgccgccgacactgcttcattaaaggcgtggcaagggggcccggagtttcttaagacccccttgggtggcagtttcctcgtctatgagagcttcttgtaccggagggaaaaggccgccggcgagaaagtttattggacctgccgagaccaggctaggatgggatgtagaagccgcgcaataacgcagggcagacgagtaatggtgatgcggcgccattgccaccctcccgaccttgggggactggaagctctccgacaacgtgaacactttccgaacctggcccagtgggatagccccgacccactacggcccctggaatttttacgaacatctctgggcggaagatttctggtgcacgagtcttttctgtaccggaaagaaaaggctgccggagagaaggtatactggatgtgccgggatcaggcccggctgggatgcaggtcccgcgccattacccagggacaccgcatcatggttatgcgctcgcattgtcaccagcccgatcttgctggtctggaggccctcagacaacgggagcgactcccaacaaccgcccaacaggaagaccctgagaaaattcaggtgcaactgtgcttcaagacctgcagcccagaaagccagcagatctacggcgacatcaaggacgtacgacttgatggagagtcccaatag

SEQ ID NO: 19194 - DNA, 2298 bp, Artificial Sequence
  Description of Artificial Sequence: Synthetic coding sequence
atgcccctgcccgagcccagcgagcaggagggcgagagcgtgaaggctggccaggagccaagcccaaaacccgggaccgacgtgattcctgctgccccccgaaagccgagggagtttagcaagttggtgctgctaactgccagcgatcaggacgaagatggagtgggtagcaagccccaggaagttcactgcgtcctctcactggaaatggcagggccagccacactggccagtactctgcagatccttcctgtcgaagaacagggcggcgtagtccagccagctctggagatgcccgaacagaaatgttccaaactggatgccgccgccccccagtcattggaattcctgaggacacccttcggaggaagattgcttgtgcttgagagttttctctacaaacaagaaaaagcagtaggggataaagtctattggaaatgtcgccaacacgcagagcttgggtgtagggggagggccatcaccagggggctgagggcaactgtgatgcgcggccactgccatgccccagatgagcaaggcttggaggccaggagacagagagaaaagttaccatctttagccctgccagagggactgggcgaaccgcagggaccggaagggcctggtggtcgcgtggaagagcctctggagggggtcggcccatggcagtgtcccgaggaacccgagccaacacccgggttagtgctgagcaagccagcccttgaggaggaagaagcaccccgcgcactgtcattgctgagcttgccacccaaaaaacgaagcattcttggcctcggccaggccagaccactggaattcctgagaacatgctacggggggagctttcttgtgcacgaatccttcttgtataagcgtgaaaaggccgtcggagataaagtgtactggacctgccgtgaccacgctctgcatggctgccggagtagagctatcacccagggacagcgcgtgactgttatgcgcggccactgtcatcagccagacatggagggattggaggctaggcgccagcaagaaaaggccgttgaaacattacaggcaggccaggacgggccaggctcccaggtagatacgctgcttagaggcgtggacagcctgctctaccggcgtggccctggccccctaacgctgaccagacccaggccccgtaaacgtgccaaagtggaagaccaggagcttcccacacagcctgaagccccggatgaacatcaggatatggatgctgacccagggggccccgaattcctcaaaaccccgctgggcgggtcctttctggtatacgagtcttttctctaccggcgggagaaggccgctggggagaaggtgtactggacttgcagggaccaggcaaggatggggtgcaggagccgcgcgattactcagggacgtagggtaaccgttatgagaggccattgccacccaccagacctcggcggcctcgaggcgttgcggcagcgggagaagagacctaacaccgcgcagcgaggttctccaggagctggactgtctttccagtggctcttccgaatcctgcagttgctagggcatgcgcctgtcctgctctgccccagtggttcgagctgtcttcccagtttgccggctccccatggcccttgcccagccttgtctatccccctggaaggaggtccggagttcctcaagacacccctgggcgggtcttttctggtgtacgagtccttcctgtaccgccgcgagaaagccgcaggcgagaaggtatactggacttgtcgagatcaagctcggatgggatgcaggtctcgggccattacccaaggccgtcgcgtgatggtgatgcgtcggcattgtcaccctccagacctgggcgggttggaggccctgagacaacgagaacatttccccaatctagcacagtgggacagccccgatcccctgagacctttggaatttctgcggactagtctcggaggccggttcctggttcacgagagctttctgtacagaaaagagaaggctgccggcgagaaagtgtactggatgtgtcgcgatcaggcccgtctggggtgccggtcccgggctatcacccaaggccaccggatcatggtcatgagaagtcactgccatcagccggacttagccggacttgaagctttacgccaacgtgaacgccttccaaccacggcccagcaggaagacccagaaaagattcaagtgcagttatgctttaagacttgctctcctgagtcccagcaaatctatggcgacatcaaagatgtcagattagatggcgagtcccaatag

SEQ ID NO: 19195 - DNA, 2148 bp, Artificial Sequence
  Description of Artificial Sequence: Synthetic coding sequence
atgcccctgcccgagcccagcgagcaggagggcgagagcgtgaaggccggccaggagccgagccctaaacccggaactgacgttattccagcggcccctcgaaaaccacgcgagttctctaaactcgtgcttctgactgctagtgaccaagatgaagatggcgttggctcaaagcctcaggaagtacactgcgtgctcagtctggaaatggccggaccagccacccttgctagtacgcttcagatcctacccgtggaggaacaaggtggtgtggttcagcccgcgctggaaatgcccgagcaaaagtgttctaaactagatgccgcaccacaaagcctggagttcctgcgcacaccctttggcggacgcctcctggttctggagagttttctctacaaacaagagaaagcagtgggcgataaagtgtactggaagtgtagacagcacgccgaactgggctgcaggggccgcgccataacacggggcctgcgggcgacagtgatgcggggccattgtcatgcccccgatgaacaaggcttggaggcgaggcgccagagggagaaattgccctcactggcgctgcccgagggactgggcgagccccaaggaccagaagggcccggcgggagagtggaggagccattggaaggagtcggaccctggcagtgtcccgaggaacccgaaccgactcctggcctggtactgtctaagcccgccctggaggaggaggaggcacctcgggctctgtccctcctgagtctccccccgaaaaaaaggtctatactcgggcttggccaggcccggcctcttgagttcctaaggacatgctatggaggtagtttccttgtacacgagtcatttctttacaaaagagaaaaagccgtgggcgacaaggtgtattggacttgcagagatcatgccttgcacggctgtcggagtcgcgcaatcacccagggacagagggttaccgttatgaggggacattgtcatcaacccgacatggagggcttggaggcccgtaggcaacaggaaaaggccgtggagactctgcaagccgggcaggacgggcccggttctcaggttgacacactccttcgcggtgtcgattccctcttgtaccgaaggggacctggcccactcaccctaacccgtccgcgcccgagaaagcgcgccaaagttgaagatcaggagctccccactcagcctgaagcccccgatgagcaccaggacatggatgccgacccaggcggacccgagttcttgaagaccccccttggtggctcatttcttgtttatgagagtttcttgtacaggagagaaaaagcggccggtgagaaggtgtattggacctgcagagaccaggccaggatgggctgtcggagccgtgccattacccaggggaggcgcgtgaccgttatgagaggacattgccaccctcccgacctgggaggcttggaggcgcttaggcagagagaaaaaagacctaacaccgcacagagaggaagtccggggggcccggagtttctcaaaacccctctgggggggtcattccttgtttatgagagttttctgtatagaagagagaaggccgctggtgaaaaggtctactggacatgccgagaccaggctcgcatgggctgcagaagcagagcaatcacacagggaaggcgagttatggtgatgcgacgacactgccatcctcctgacctcggaggccttgaagctcttcgtcagcgagagcactttccaaacctggcacagtgggattcccccgatccgcttagacctttggaatttttgagaacttcactgggcgggaggttcctggttcacgaatcgttcctttaccggaaagagaaggcagcaggtgagaaggtgtattggatgtgccgtgatcaggctcgccttggttgcagaagtcgcgcaataacacagggacatagaattatggttatgcggagtcattgtcatcagccagacctggctggtctcgaggctttacgccagcgagaacggttgccaaccactgcgcagcaggaggatcccgaaaagatccaggtgcagctgtgcttcaagacctgctctcctgaaagccagcagatttatggcgatataaaagatgtgcgcctggacggcgagagtcagtag

SEQ ID NO: 19196 - DNA, 978 bp, Artificial Sequence
  Description of Artificial Sequence: Synthetic coding sequence
atgccccggcccggccggaacacctacagcgaccagaagcccccctattcttacatatccttaactgccatggcaattcagagttctccagaaaagatgcttcctctctcagagatctacaagttcatcatggataggttcccttattatagagagaacactcagcgatggcagaacagcctgaggcataacctatccttcaatgactgctttatcaagatacctagaaggccagaccagcccgggaagggatctttctgggccctgcacccttcatgcggcgacatgttcgagaacggatcatttctgcggcgccggaaaaggtttaaagtcttgaagtctgaccatcttgcacctagtaaaccggccgacgctgctcagtatctccaacaacaagccaaactgcgactttctgccctcgccgctagcggcacccatttgccacagatgcccgccgccgcttataacctggggggggttgcgcaaccatccggatttaaacatccgttcgctatagaaaatataatcgcacgagagtataagatgccaggcggcctggccttcagtgcaatgcagcctgtgcccgcagcttaccctttgcctaaccaactcactaccatgggttccagccttggtactgggtggccccatgtgtacggaagcgccggtatgattgacagcgccacacccatctcaatggcgtccggcgattacagtgcttatggggtgcctctgaagcctctctgccatgcagccggccaaacgttacccgctatcccagttcccattaaacctacccccgcagccgttccagccctgcccgcgctgcctgctcccatacctaccctgctttcgaattctccgccctcactttctcccacatcaagccaaaccgctacatcccagtcctcgccagccacaccctcggagacactcacaagtcctgccagcgctctccactctgtcgcggtgcactag

SEQ ID NO: 19197 - DNA, 1299 bp, Artificial Sequence
  Description of Artificial Sequence: Synthetic coding sequence
atgccccggcccggcaagagcagctacagcgaccagaagcccccctatagctatatctcacttaccgctatggctatccagcactctgcggaaaaaatgttgcctttgtcagatatttataaattcattatggagcggttcccttactatcgagagcacactcaacgttggcagaactcactgcggcataatcttagcttcaacgattgcttcatcaagattccccggagaccggatcagcccgggaaagggtctttctgggcgctgcaccctgattgcggagatatgttcgaaaacggcagtttccttcgaagacgcaaaaggttcaaagtgttaagagctgaccatacacatcttcacgccggatcaaccaaatcggcccccggtgcaggaccagggggtcacttacacccgcatcaccatcaccacccgcaccatcaccaccatcaccatgcagccgcacatcatcatcatcatcaccacccaccccagcccccgcctcccccccctccacctcctcctcacatggtccattatttccatcagcagccgcccactgctcctcaacctcccccgcacctaccctctcagcctccacagcagcccccccagcagtcccaacctcagcagcctagccatccagggaaaatgcaagaggccgccgccgtcgccgccgccgctgccgcagctgcagccgctgctgttggaagcgtgggacggttgagccaattcccaccctatggtttagggagtgcggcggccgccgccgccgctgccgcggcttccacatcagggttcaaacacccgtttgccattgagaacattataggaagagattacaaaggggtgctacaggctggaggactgcccctcgcctccgttatgcaccatctcggctatcccgtgccaggccagctgggtaacgttgtgtccagcgtatggccccacgtaggagtgatggacagcgtggctgctgccgccgccgccgccgccgccgctggcgtgccagtcggcccggaatacggtgcgttcggcgttcccgttaagagcctgtgccactccgcctcacagtccctgccagccatgcccgtgcctattaagccgacacccgccctcccaccagtgagcgcactgcagcctggtcttactgtccccgctgcatcccagcaaccacccgccccttctactgtgtgcagcgccgcggccgcctctccggtagcctccctgctcgaaccaactgcccctacaagcgcggaaagcaaaggtggaagcctccattcagtactggtgcacagttag

SEQ ID NO: 19198 - DNA, 1251 bp, Artificial Sequence
  Description of Artificial Sequence: Synthetic coding sequence
atgaacctgccccgggccgagcggccccggagcaccccccagcggtccttgcgcgatagcgatggggaggatggtaaaattgatgtactcggggaggaagaggacgaagacgaggtcgaggacgaggaagaggaagcccggcagcagttcctggagcaaagtctgcagcccggattacaggttgcccgctggggaggggtggccctgccccgggaacacattgagggagggggcgggcctagtgacccttctgagttcggcaccaagtttcgcgctcctccgcgttctgccgcggcctccgaggatgcccgacagcccgccaagcctccttatagctacatagccctgattactatggctatcttgcagaaccctcataagaggctgactctcagtggcatctgtgcatttatttctggacgctttccctattatagacggaagttccccgcttggcaaaattctatccgacataacctatctttgaatgactgtttcgtcaagatcccaagagaacccggccatcccggcaagggcaactactggtcattggatcccgcgagccaggatatgtttgataatggctcgttcctcagaaggcggaaacgattcaaaaggcaccagctcacacctggagcccacttgccacaccctttcccattgcctgctgcccacgcagcacttcataatccccatccaggccctcttctgggcgctccagcccctccgcaaccggtaccaggtgcctaccccaacaccgctcccggccgcagaccttatgctcttctgcatccccatcctctgagatatctgctgctgagtgcacgagtctatgccggggcgcccaagaaagcggaaggcgctgacctggcaacccctgcaccattcccttgctgttcaccacacctagtgttgagcctgggacgacgagcaagagtctggcgccggcatagagaggccgacgcctctctgagtgcccttagggtcctctgtaagggatcaggagagagagtgcagggtctgcgcagggtttgtccaagaccccgaggtgccacagcaacatgttcctcagaccatcaggcgtgttgcataccaaaacccctgccattgtgttgcaagtgtccccctcccctgcttctgggacaattttgtagtaacagttcctcgatccggaggaccgctcctactgctgcactccccccccgagccaggtgctgggcaggtacctgccgccctcgaaggcgatgttag

SEQ ID NO: 19199 - DNA, 1251 bp, Artificial Sequence
  Description of Artificial Sequence: Synthetic coding sequence
atgaacctgccccgggccgagcggccccggagcaccccccagcggtcactgagggatagtgacggagaggatggaaagatcgatgtactgggcgaagaggaagacgaggatgaagtagaggacgaggaggaagaggcccggcagcagttcctggaacagtccctacagcccggtttgcaggtagctaggtggggcggcgtggcactgccccgggaacacatcgagggaggtggtggtccatctgacccctcggaatttgggaccaaatttcgcgcaccgcccaggtccgccgcagctagtgaggatgctagacagcccgctaagccaccttactcctatatcgccctgatcacaatggccattttgcaaaaccctcataagcgactcacactgtcggggatttgcgcctttatctccggacgttttccttattatcggaggaaattcccagcatggcaaaactctattcgacataatctcagtcttaacgactgcttcgtgaaaatccctcgcgagccaggacatccaggcaaaggaaattattggagccttgatcctgctagccaagacatgtttgacaacggcagtttcctgcggaggaggaagagattcaaacgccatcaactgactcctggggcacaccttccacacccttttccgctgcccgcagcgcacgcagctctgcataacccacaccccggaccccttctcggcgccccagccccccctcagcctgtcccaggagcctaccccaataccgcgccagggcggtgcccgtatgctctgctgcacccccaccctcttagatatttgctacttagcgcccctgtgtacgctggggcccccaagaaggcagagggtgctgacctggccacccctgccccctttccctgctgcagtccacacctcgtgctgtctctcggaaggagggctcgagtgtggcgccgccaccgagaagctgacgcctccctttctgccttaagagtcctgtgtaaggggagcggtgagagggtccagggtctgagaagagtgtgccccaggcccagaggagccactgccacttgttcttcagatcatcaagcctgctgcatacccaaacccctcccactttgttgcaaatgccctcctcctttgctcttgggtcagttttgctcaaacagcagttcaatccgccgcacagccccgactgccgcattgccccctcgggcgcgctgttgggcagggacgtgtagaccacggcggaggtgttag

SEQ ID NO: 19200 - DNA, 1254 bp, Artificial Sequence
  Description of Artificial Sequence: Synthetic coding sequence
atgaacctgccccgggccgagcggctgcggagcaccccccagcggagcctcagggacagtgacggggaggacggcaagatagatgtcctcggagaagaagaggatgaggacgaagttgaagatgaggaggaggcagcttcacagcagttcctggaacagtcattgcagcccggactgcaagttgcccgctggggtggagttgccctccctagggagcatattgagggcggcggtggccccagcgaccctagcgagtttggcacaaagttccgggctcctcctaggagtgctgctgcatccgaggatgctcgccagccggcaaaaccaccgtactcttacatcgctctgatcacgatggcaatcttacagaatcctcacaagcgcctcacgttatcaggaatttgtgctttcatctcgggcagattcccctattatagaaggaagttccctgcttggcagaactccatccggcataacctctccttgaacgattgcttcgtcaagatacctcgcgagcccggacatccaggtaagggcaactattggagcctcgatccagcctctcaagacatgtttgacaatggtagctttcttagacgcagaaaacgattcaaacggcaccaactgactcctggcgcgcacctgccacaccccttccccctaccggcagcccacgccgcactgcataacccgcaccccggtccactcctaggagcacccgccccaccacagcctgtgccgggggcgtatcctaacacagcgcctggccgtaggccatacgcgctgctacacccgcaccccctgcggtacctcctcctgtcggcgccagtgtacgccggggccccgaaaaaggcggaaggggctgcactcgccacaccagccccatttccatgctgctctcctcatcttgtcctgtcgctgggacggagggcaagagtctggaggcgacaccgcgaagctgacgcatccctgtccgcccttcgcgtgctgtgtaaaggaagtggcgagcgggtccagggtctgcgacgggtctgtccgagacctaggggcgcaaccgctacttgctcctcagaccatcaagcctgctgcatcccgcgccctctgccattgtgttgcaaatgtccacccccacccttgttgggccagttttgctccaacagctcctctatccgacgccgaacagcacccacagccgcacttccccctagagcgcggtgctgggccggcacatgccgaccgaggagaccctgctag

SEQ ID NO: 19201 - DNA, 1140 bp, Artificial Sequence
  Description of Artificial Sequence: Synthetic coding sequence
atgagcagcgcccccgagaagcagcagcccccccacggcggcggcggagggggaggagggggaggcggtgctgcgatggatcctgcgagcagcggcccaagcaaagctaagaaaacaaatgcaggcatacgccgtcccgagaaacccccatactcatatattgctctcattgtcatggccatccagtcctcaccgaccaaacgattaaccctgagcgaaatttaccaatttctacagtcccggttccccttcttccgcggatcttaccaagggtggaaaaattcagtgcggcataacctgagcctgaatgaatgttttattaagcttcccaagggtttaggcaggcctggaaaagggcactattggaccatcgacccggcgagcgagtttatgttcgaggagggctcctttcggcggcggccgcgcggctttagacggaagtgccaagcactgaagccaatgtattctatgatgaatggcctgggcttcaatcatctcccagacacttacggatttcagggctctgctggaggtctgagttgccccccgaactccctggctcttgagggaggcttagggatgatgaacggccacctccccggaaatgtagacggaatggcacttcccagccattccgtgccacaccttccaagcaatggagggcactcctatatgggcggctgcggcggagcggcagccggggagtaccctcatcatgattcatcagtgcctgccagccctttattaccaaccggtgctggcggagtgatggagccccatgctgtgtattccgggagtgctgccgcatggccgcctagcgcttccgccgcgctcaacagcggcgcgtcctatatcaagcagcagccgttatccccctgcaatcctgccgctaaccctctctccgggtctctgtccacccactcccttgaacaaccttatttgcaccagaacagccacaatgcacccgcagagctgcaggggatcccacggtatcacagccaatccccgagtatgtgtgacaggaaggagttcgtcttctcttttaacgccatggcttcatcatcaatgcactctgcgggcggcggaagttattaccaccagcaagtcacctatcaggacattaagccttgcgtgatgtag

SEQ ID NO: 19202 - DNA, 765 bp, Artificial Sequence
  Description of Artificial Sequence: Synthetic coding sequence
cccgccctgcccagcaccctgccccaccggcccgcccccagcacccgccctggaccctgcccacgctgcctaccatccaggatgggcccctgctccggttcccgcctcggtcccccggaggcagagtctccaagtcaaccccccaaaagacgcaagaagagatacttgaggcacgacaagcctccatacacgtatctcgcaatgattgccctcgtgatccaggccgccccaagtcggcgcctgaagcttgctcagattattagacaagtacaggcggtgtttccattcttcagggaggactatgagggctggaaagactctatccggcacaatctcagttctaacagatgctttcgtaaggtccctaaggacccagcgaagccccaggccaagggtaacttttgggctgtggacgtttcccttattcccgcagaagccctgcgtctgcagaacacagcgttgtgtcgcagatggcagaacggcggcgcccggggtgctttcgcaaaagatctgggaccctatgtactccatggccgcccctatcgcccgcccagcccaccccctcccccaagtgaggggttttccattaaaagcctcctgggtggatccggcgagggcgccccatggcccggactggctcctcagtcatcacctgtccccgcaggaactgggaattccggtgaggaggctgtaccaacgcctcctccaccatcaggcgggagctgtccccctcctacttgcctgtcaactctgcctatgtggtag

SEQ ID NO: 19203 - DNA, 1098 bp, Artificial Sequence
  Description of Artificial Sequence: Synthetic coding sequence
atgggcccctgcagcggcagccggctgggcccccccgaggccgagtcaccttcccagccacctaagcgccgtaagaagcgctatctgagacatgataaacccccttacacatatttggccatgattgcactggtaattcaagccgccccatccagaaggctgaagctcgcccagattatccgccaagtccaggccgtatttcctttcttcagagaggattacgagggttggaaggacagtatcagacacaatctctcaagtaaccgctgcttcagaaaggtccccaaagatccagctaaaccacaggccaagggaaatttctgggcggtcgacgtgagtctgattcccgccgaagccttacgcctgcaaaacacagccctctgtaggaggtggcagaatggaggtgctcgcggcgctttcgccaaggaccttggcccgtatgtgctgcacgggcgaccctatcgtcccccatcacctccaccgcccccgtctgaaggattttcaattaagagtttgttgggcggaagcggggaaggagccccctggcccggccttgcccctcagagctctccagtgcccgcaggcaccgggaactctggagaggaggccgtcccgacaccaccactccccagcagcgagcgcccactgtggcctctatgtcctctccccggtcccactcgagtggaaggagagactgtgcagggcggagcaataggacccagtacgctgtcacccgaaccaagggcttggccactacatctcttacaggggacggcagttcccggaggccggagtagcggagggcaccgtgcaagcctatggggacagctccccacttcgtacctcccgatttatacgccaaatgtggtgatgcctctggccccaccaccaacatcctgtccgcagtgtccaagtacttcaccagcatactggggcgtggcacccgaaaccaggggaccaccaggactattgtgtgatctcgatgcattgttccagggggtaccacctaataagtctatctacgacgtttgggtcagtcatccacgggacctggccgcgcctgggccaggctggctgctgtcttggtgttcactttag

SEQ ID NO: 19204 - DNA, 957 bp, Artificial Sequence
  Description of Artificial Sequence: Synthetic coding sequence
atggccacctactgcgacgacctgggccccagcagcgccccccccggacaggcacaggctaccgcacaccccccagggtacgaaccaggagatctcggtgcagtcggaggagggccacttctgtgggtcaatgcgccagctctgagccctaagagttacgcatccggacccggccccgcgcccccatacgccgctccgagttacggtgctccaggccccctgctgggcgcaccagggggcctcgcgggcgccgatctggcctggcttagtttgtccgggcagcaggaactgttacgcctggtgaggcctccctatagctactccgccctgatcgcaatggcgatccagagtgcaccattacggaagcttacgttgagccagatctaccagtacgtggccggcaatttccctttttacaaaaggagtaaagccggctggcagaatagcataaggcacaacctttccttgaatgattgcttcaaaaaggtgccaagggatgaagacgatcccggcaaggggaattactggactttggatccgaactgcgagaaaatgttcgataacgggaatttccgcaggaagcgtaagcgccgggcagaggcttcagcagccgttcgttcgggggccaggagtgtggggggggcagaagccccagctctcgagccacccagcgcagcttgtctggatctccaggccagtcccagtccgtccgctccagaggctgctacttgttttagcggttttgcctccgccatgagcgccctcgcaggtggtctgggaacttttcccggcggcctcgccggagatttcagttttgggcggcgacctcccaccgtcgctacacatgcccctcagacactcaaccctagcccaggattcgccccagggcaccagaccgccgcagctggtttcaggctgtctcacttgctttatagccgggagggaaccgaagtgtag

SEQ ID NO: 19205 - DNA, 1725 bp, Artificial Sequence
  Description of Artificial Sequence: Synthetic coding sequence
atggccagcgacctggagagcagcctgaccagcatcgactggctgccccagcttaccctgagggctactatagaaaagttaggcagcgccagccaggccggaccgccaggctcaagtaggaagtgcagccctgggagtccaaccgacccaaacgcaacgctaagcaaagatgaagccgccgtacaccaggatggtaaacctcgttattcctatgcgaccctaataacatacgcgattaacagtagtcctgcgaagaagatgaccttgtccgagatttatagatggatatgtgacaattttccatactacaaaaatgccgggatcgggtggaaaaacagcatcaggcataaccttagcctcaataagtgcttcagaaaggtgccccggcccagagacgatccaggtaagggaagctattggactattgatacttgtcccgatattagtcgcaaacgtcgtcatcctccagatgacgacctcagccaggacagccccgaacaggaggcctcgaaatctcctcgaggtggtgttgccggatcaggcgaagcatctttgccccccgagggaaaccctcagatgagcctccaaagccccaccagtatcgccagctactcccagggcactggaagcgtggacggaggcgctgtggctgcaggggccagcggcagggaatccgctgagggccctcctcccctgtataacactaaccacgattttaaattttcgtattcagagatcaatttccaagacctttcatggtctttcaggaatttatacaagtccatgctggaaaagagtagttcttcctcccagcatggttttagtagtcttctgggcgacatccctccctccaataattactatatgtaccagcagcagcagccccccccaccacagcagcaacagcaacaacaacagccgccacagcctccgcctcagcagagccagccgcagcagcagcaagcccctgcccaggggccgtctgccgtcggcggtgccccgcccctccatactccttctacagacggctgcaccccccctggcggcaaacaagcgggagccgaaggatacggccctccccccgttatggcgatgcacccacctcccctccagcatggcggttaccacccccaccagcaccaccctcacagccaccccgcccagcaaccccccccgcctcaacctcaggcccaaggtcaggcgccgatcaataacactggctttgccttcccttccgattggtgtagcaatattgactcattaaaagaatcatttaaaatggtgaatcggctcaactggagttccatagagcagagccagttctcagaactgatggaatcattgcgccaggctgagcaaaagaattggacgttggatcaacatcacattgccaatctgtgcgatagccttaatcatttcctcacccaaacgggccatgtgccaccccaaggagggacccatagacctcccgctccggctcggatcgctgactcctgcgccctgacatcagggaagcaggagagcgctatgtcacaggtgaacagctatggccacccacaagcgccgcacctgtaccccgggccttcccctatgtatcccatcccgacccaagatagcgcgggatacaaccgccctgctcatcatatggtgccaaggccatcagtgcctccacccggggctaacgaggagatacccgacgacttcgactgggacctgattacatag

SEQ ID NO: 19206 - DNA, 1581 bp, Artificial Sequence
  Description of Artificial Sequence: Synthetic coding sequence
atggccagcgacctggagagcagcctgaccagcatcgactggctgccacagctgactcttcgagccaccattgagaaacttggcagcgcaagccaggccgggcccccaggttcaagtaggaagtgttctcccggaagccctaccgacccaaatgctactttatctaaagatgaggctgctgtccatcaggatggaaaaccaaggtactcgtatgctacactgattacatatgctattaattctagtcccgccaaaaagatgaccctgagtgagatctaccgatggatatgtgataacttcccatattataagaacgccggaatcggatggaagaattccatcagacacaacttaagcctgaacaaatgctttcggaaggtgccccgcccacgtgacgatcccggcaagggaagctattggactatcgatacatgcccggacatcagcaggaagcggcggcaccctccagacgatgacctctcacaggactccccggagcaggaagcctccaaatccccccgcggtggcgtcgcgggctctggcgaggcttctctccctccagagggcaaccctcaaatgagtctgcagtcccctacaagcattgccagttactcccagggaacgggctctgtcgatgggggagcagttgcagccggggcatctgggagagagagcgcggaaggcccccctcccctgtataacactaatcatgacttcaagttttcatactccgagatcaactttcaggatctatcttggagctttcgtaatctgtacaagtctatgctagaaaagagctccagctcgagtcagcacggtttcagcagcctcttgggtgacataccaccctccaacaattactacatgtatcagcagcagcaacccccccctcctcaacagcagcagcagcaacagcagccccctcagcccccaccccagcagtcccaaccccaacagcagcaggcaccggctcaggggcctagcgccgtagggggtgctccgccactgcacaccccctccacagacggctgcacccctccgggaggaaaacaagctggcgcagaaggatacgggccccccccagtgatggccatgcacccaccaccactgcagcacggtggctaccacccccaccagcatcacccccattcccacccagctcaacaacctccaccccctcaaccccaagcccaaggacaggcaccaataaacaacactggtttcgcgttcccctctgattggtgcagtaatatcgacagtctcaaggaatctttcaaaatggtgaatcgattaaactggtcctccatcgaacagagccagtttagtgagctaatggagtccctgagacaggctgaacagaagaactggaccctggatcaacaccacattgccaatttgtgcgacagtctgaatcattttctcactcaaacaggtcacgttccccctcagggcggcacccacaggcccccggcccctgcgcgtatcgccgacagttgtgcccttacaagtggtaagcaggaatccgccatgtctcaagggacggcccccagccaactcccatggcgctggagactgtgttag

SEQ ID NO: 19207 - DNA, 1869 bp, Artificial Sequence
  Description of Artificial Sequence: Synthetic coding sequence
atgggcctgtacggccaggcctgccccagcgtgaccagcctgcggatgacatctgagctggaatcttcgctgacaagtatggactggcttccacaactcactatgcgggctgccatacaaaaaagcgatgccactcagaacgctcatgggaccggaatatctaaaaaaaatgcgctgctggatccaaatactactctggatcaagaagaagtccagcaacataaagatggcaagccaccatactcctacgcctctctgatcacctttgctataaactcctctcccaagaaaaagatgacgctaagcgagatctatcagtggatctgtgacaatttcccatattatagagaagcaggaagtggatggaagaattcaattaggcacaatctttcacttaacaaatgtttcctcaaagtgccccggtctaaagatgaccccggaaaaggcagttactgggcaatagataccaatccaaaggaagatgtcctccctacccgccctaagaagcgcgctcggagtgtggaacgagctagtactccttactctatcgattcagatagcctgggcatggagtgcatcatctccggaagtgcttcacctactctggcgatcaatactgtgaccaataaggtcaccctgtacaacaccgatcaggatgggagtgacagtccccgttcatctcttaacaattccctctccgaccaaagcctcgcttctgtgaacctcaactcagtagggtcagtacactcctatactccggtgacatcccacccagagtccgtcagccaatccctcacaccacagcagcagccccagtataatttgcccgaacgagataagcagcttcttttttcggaatacaattttgaagatctgagcgcgtctttccgaagtctgtataaatctgtctttgaacagtccttaagtcaacaaggcctgatgaacatcccctctgaaagcagtcaacagagccacaccagttgcacctatcagcactcaccctctagcacggtctccacgcatccacacagcaaccaatcatccctttccaactcccacggaagcggcttgaataccacaggaagtaattctgttgctcaggtgagtctctcccacccacaaatgcatacccagccatcacctcaccccccacacaggccacacggcctacctcagcacccgcaacgatccccacatcccgcccctcatccgcagcagcactcccagttacagagcccacatccgcaacacccaagcccccatcagcacatccagcatcatcctaaccatcagcatcagaccctcacccatcaggctcccccacctccacagcaagtctcatgcaatagcggagtctccaatgattggtacgctaccttagacatgctcaaagagtcttgtaggatagcttctagcgtaaactggagtgatgtcgacctctcgcaattccagggactgatggagtcaatgcgccaggccgacctgaagaattggagccttgaccaggttcagtttgctgacctgtgttcctcccttaatcagttctttactcaaaccggactgatccattctcaatcaaacgttcagcagaacgtttgtcatggtgccatgcaccccactaagcccagccagcatatcgggactgggaatctgtatattgattcccgccaaaatcttcctccctctgttatgccccctccaggctaccctcatatcccgcaggccctgtcaacccctggtacaacaatggctggtcaccatagggcaatgaatcagcagcacatgatgccaagccaggccttccagatgagacggtcattgcctcctgacgacatccaggacgattttgattgggacagcatcgtttag

SEQ ID NO: 19208 - DNA, 1767 bp, Artificial Sequence
  Description of Artificial Sequence: Synthetic coding sequence
atgggcctgtacggccaggcctgccccagcgtgaccagcctgcggatgacctccgagctggagagcagcctgacctccatggattggctcccacagttgaccatgcgggccgctattcagaagtccgacgcaacccagaatgcccacggcaccggtattagcaagaaaaatgctctgttagacccaaataccaccctcgaccaagaggaagtgcagcagcacaaagacggaaaacccccctactcatacgccagcctgatcacatttgccatcaactcaagtcccaagaagaagatgacactgagcgaaatctaccagtggatttgtgacaatttcccttattatagggaagctggttctggttggaagaatagcataagacataacctttctctaaataagtgttttcttaaggtgccacgcagcaaggatgaccctggcaagggctcttattgggccatagataccaacccaaaagaagatgtgctacccacccgacctaagaaaagagcaagatccgtggaacgcgtgacgctgtataatactgatcaagacggcagcgacagtcccaggtcctcgctgaacaactcactctctgaccagtctctagcatctgtcaacctcaacagcgttggcagcgtgcatagctacactccagtgacgagccatccggaaagtgtatcccagtctcttacacctcaacagcagccacagtacaatctgcccgaaagggacaagcagctgctgttttccgagtacaactttgaagatttgtcggcttctttccgctctctgtataaatcagttttcgagcagtctctttctcagcagggactgatgaatatccctagcgagagcagccagcagagtcacacttcatgtacataccagcactcaccttcttctaccgtgagcacgcatccacacagtaaccagtcatcattatccaacagccacgggagcgggctcaatacaacagggagcaattcagtggctcaggtgtcactgagtcatccacagatgcacacccagccaagcccccaccccccgcaccgcccccacgggctgccccagcacccccagaggagtcctcacccggcaccgcatccccagcagcactctcagctgcaaagtcctcatcctcagcatccatctccccaccagcacatccagcatcaccccaaccatcagcatcagactctgacccatcaagcacctccaccaccccaacaagtctcatgtaactctggagtaagtaacgactggtacgctaccctggacatgctgaaagagtcctgccggatcgcctcatccgtcaattggagcgatgtggacctcagtcagttccaaggcttaatggagtccatgagacaagccgacctcaagaactggtctctagatcaggtccagttcgccgatttatgttcttcccttaatcagttctttacccaaacaggcctgattcactcccagtctaacgttcagcagaatgtgtgccatggggccatgcatcccaccaagccgagtcaacatataggaacaggaaacctttacatcgactcgcggcagaatctccctccctctgtcatgccgccccccggatacccacacatcccccaggcccttagcacccccggaaccaccatggccggccaccatagagcaatgaaccagcagcatatgatgccctctcaggcatttcagatgaggcggagcctgcctcccgacgatatccaggacgacttcgactgggactctatcgtttag

SEQ ID NO: 19209 - DNA, 411 bp, Artificial Sequence
  Description of Artificial Sequence: Synthetic coding sequence
atggagagcatgcggcaggccgacctgaagaactggagcctggaccaggtgcagtttgccgacctgtgctcaagtctgaaccagtttttcacacagacggggttgatccacagccaaagtaacgttcagcagaacgtctgccacggcgctatgcatcccacaaagccttctcagcatattggcactggtaacctttatattgattcccgccaaaacctccccccaagtgtgatgcctcccccaggctatccccatatcccacaggctctgtctacaccgggtactacaatggctgggcaccaccgagcgatgaatcagcaacacatgatgccctcacaggcatttcagatgcgccgctctctgccgccggacgacattcaggacgactttgactgggattctatagtctag

SEQ ID NO: 19210 - DNA, 1869 bp, Artificial Sequence
  Description of Artificial Sequence: Synthetic coding sequence
atgggcctgtacggccaggcctgccccagcgtgaccagcctgcggatgaccagtgagctggagagctccctaacatccatggactggctgccacaactaaccatgcgcgccgccattcaaaagtctgatgctacccagaatgcccacgggactgggatttcaaagaagaatgctctgctggaccctaatactaccctggatcaggaggaggtgcagcagcacaaggacggcaagcccccgtattcgtatgccagcctgataaccttcgcaattaactcatcccctaagaagaagatgactttaagtgagatttatcagtggatatgtgacaacttcccttactatagggaagctggttccggctggaaaaactccattcgccataacctgtccttaaataaatgtttcctgaaagtgcctaggtctaaggacgaccctggaaagggcagttactgggcaatcgataccaaccctaaggaggatgtgttgcctacccgtccaaagaaacgagcgcgatctgttgagcgggcatctaccccctattctattgactccgattctctgggaatggagtgcattatcagtggatctgcttcgccaacgctggcgatcaacactgtgactaataaggtgaccctctacaatactgatcaggacgggagcgacagtccacggtcaagcctcaataactcccttagcgatcagtccctggcatcagtgaatctcaattcagtgggctccgttcatagctataccccggtgacttctcacccagagtcagtgtcgcagagcctgacccctcagcaacaacctcaatataatcttcctgaaagagacaagcaattgctgttcagtgagtataatttcgaagacctttctgcgagtttcaggtccctgtacaaatctgtgtttgagcagtctctgtctcagcaaggcttgatgaatattccgtccgaaagctcccagcagagtcacaccagctgcacttatcagcacagcccgtcttccactgtctccacgcacccgcacagcaaccagtcgagtctgtccaattctcatggctcgggtctcaatactacggggagtaattctgtggctcaggtatctctctcacacccccaaatgcacacacaaccgagccctcacccacctcaccgcccacacgggctcccgcagcacccccagcgctcaccccaccctgctcctcatccacagcaacactctcagctgcagtctccccacccacagcacccaagcccacaccagcacattcaacatcacccaaatcaccaacaccagaccttgacacatcaggctccaccaccgccccaacaggtgtcatgcaatagcggggtttccaatgattggtacgcaacgctcgatatgcttaaagagtcctgcaggatcgcctctagcgttaactggagtgacgtcgacctgtctcagttccagggtctcatggaaagcatgcggcaggcggacctgaagaactggagccttgatcaggtgcaatttgctgacctgtgcagtagcctgaatcaatttttcacccagaccgggctcattcactctcaatccaatgttcagcagaatgtttgccatggcgctatgcatcctacgaagccttcccagcacataggaaccggaaacttatatatcgactcacgccagaacctgcccccctctgtcatgccacccccagggtatccacatattccccaggccttgagcacgccaggcaccactatggcaggccaccatagggctatgaatcagcagcatatgatgccaagccaggcgttccaaatgaggaggtccctgcctcctgatgatatccaggacgatttcgattgggactccatcgtatag

SEQ ID NO: 19211 - DNA, 1869 bp, Artificial Sequence
  Description of Artificial Sequence: Synthetic coding sequence
atgggcctgtacggccaggcctgccccagcgtgaccagcctgcggatgaccagtgagctggagagctctttaacttccatggactggcttccacagctgactatgcgggcggccatccagaagagcgacgctacccagaatgcccacgggaccggcattagcaagaagaatgccctacttgacccgaacacaacacttgatcaggaggaagtccagcagcataaggatggcaaacctccctacagctatgctagtctgatcactttcgccattaacagtagtccgaaaaaaaaaatgacactttcggaaatctatcagtggatctgcgacaattttccctattacagagaagccggttccggttggaagaacagcattagacataacctgagtcttaataagtgcttcctgaaggtgccaagaagtaaggatgaccctggaaaggggtcttactgggctatcgacacaaacccaaaggaagacgttctgccgacacgtcctaaaaaaagggcccggagcgttgagcgggcatccacaccctacagcatcgactccgattcactcggcatggagtgtatcatctccggaagcgccagtcctacccttgcgattaacacagttaccaataaagttacgctgtataatacagaccaagacggttctgactcccctcggtcctccctaaacaactccctttccgaccagtccctggcgtctgtgaacctgaacagcgttggtagtgttcactcctacacccccgttacatcccatccagagagcgtgtcacaaagcctcaccccgcaacagcagcctcaatacaatctccctgagcgcgacaagcagctgctgttctcagagtacaatttcgaagacttgagtgcttccttcagaagcctgtacaaatccgtgttcgaacagtcgctatcacagcagggactgatgaatatccctagcgagtccagccagcagagccataccagctgcacataccagcactccccctctagcaccgtatccacacacccgcattcgaaccagagcagcctatccaacagtcatgggtcagggctcaacaccacaggatcaaacagtgtggcccaggtgtccttatcccatccacagatgcacacccagccctcccctcatcctccccaccgacctcacggactgcctcagcacccccaacggtcccctcaccctgccccgcatcctcaacagcacagtcaactgcagtcaccccatccccagcacccctctccacatcaacacatccagcaccatcccaaccatcagcatcagactctcactcaccaggcccctccacctccccagcaagtgtcgtgcaatagcggcgtcagtaacgactggtatgccactttggacatgctcaaggagtcttgtagaatcgcgtcctcagttaactggagtgacgttgatctctctcagtttcagggcttaatggaatctatgcggcaagccgacctaaagaactggtctctagatcaggtgcagtttgctgatctgtgtagtagcctgaaccaatttttcactcagactgggctaattcactcccagtctaacgtacagcagaatgtgtgtcatggcgctatgcatcccaccaaaccatcacagcatatcggaacaggcaacttgtacatcgacagcaggcagaacctgcccccgtcagtcatgccgccgccggggtatccacacatccctcaagctctgagcactcctggcaccacaatggccggccatcacagagctatgaaccagcagcacatgatgccctcccaagcttttcagatgagaaggtcactcccccccgatgatattcaggatgacttcgattgggattccattgtgtag

SEQ ID NO: 19212 - DNA, 264 bp, Artificial Sequence
  Description of Artificial Sequence: Synthetic coding sequence
atggagtgcatcatcagcggcagcgccagccccaccctggccatcaacaccgtgaccaacaaagtgactctgtataacacagatcaggacggcagcgactctccacgctcctctttgaataattctttatctgaccagtcactggccagtgtcaatctcaatagtgtcgggagcgtgcattcatatacccctgtcaccagtcacccagagtctgtttcccagagtctcaccccccagcaacagccacagtataatctaccttag

SEQ ID NO: 19213 - DNA, 1149 bp, Artificial Sequence
  Description of Artificial Sequence: Synthetic coding sequence
atgggcctgtacggccaggcctgccccagcgtgaccagcctgcggatgacttctgagctggaatcctcacttacaagcatggattggctcccccagctgactatgagggcagctatccagaagagcgacgccactcagaatgcccacggcactggtatctctaaaaagaacgcgctgctcgatcctaacactacacttgatcaggaagaagtgcagcaacataaggacggtaagcctccatattcttacgccagcttaattacattcgcgattaatagctctccaaagaagaaaatgactctgagtgaaatctaccagtggatctgcgacaactttccctattaccgggaagctggcagtggctggaaaaactctattcgtcataacctgtctctgaacaaatgctttctgaaagtgcctcgatcgaaagacgatcctggcaagggcagctattgggctatagacaccaaccccaaagaggacgtcctccccactaggcccaagaagagggcgaggagtgtggagcgagtgaccctctacaacacggaccaagacggcagtgattcccccagatctagcttgaacaattctctatctgatcaatccctggcatccgtgaatctgaatagtgttggttctgtgcattcctatactcctgtcaccagccacccagagtctgtatcccagtctcttactccgcagcagcaaccccagtataatcttccagaacgagataagcagctccttttctccgaatacaatttcgaggacctgagcgccagtttcagaagtctgtacaaaagcgtttttgaacaaagcctgtcacaacagggactgatgaacattccctctgaaagcagtcagcagtctcatactagctgtacttaccagcacagcccgagtagcaccgtgagcacccatccccacagcaaccagtcctcgctatcaaactcgcacgggagtggtcttaacacgactgggagcaattctgtggcccaagtgagcttgtcgcatccacagatgcacacgcagccgtctccgcaccccccccatcggccccacggtctcccccagcacccgcagcgtagtccacaccctgctcctcacccacagcaacactctcagctccagtcaccccacccccagtag

SEQ ID NO: 19214 - DNA, 378 bp, Artificial Sequence
  Description of Artificial Sequence: Synthetic coding sequence
gccacccagaacgcccacggcaccggcatcagcaagaagaacgccctgctggatccgaacaccacacttgaccaggaagaagtccagcagcacaaggatggtaaaccaccatactcgtacgccagtcttattacttttgcaattaattccagtcccaagaaaaagatgaccttaagcgagatttatcagtggatctgcgacaatttcccctactacagagaagccgggtcgggctggaagaacagcatcaggcacaaccttagcctcaacaagtgtttcctcaaggtcccgaggagtaaggatgatcccggaaaggtcggctttatctttctcaagcagctgaatagctcagtgtgccacctgagctgcctgaattag

SEQ ID NO: 19215 - DNA, 1869 bp, Artificial Sequence
  Description of Artificial Sequence: Synthetic coding sequence
atgggcctgtacggccaggcctgccccagcgtgaccagcctgcggatgacctctgagttggagtcatctctcactagtatggattggctaccacagcttacgatgcgggcagccatccagaaaagcgacgcaacccagaacgctcacgggactggaatctctaaaaaaaatgcattgttagaccctaacaccacgcttgaccaagaagaagtccagcagcataaagatggaaaacccccttatagctatgcctctctaattacatttgcgattaactcatctcctaagaagaagatgacactctctgagatataccagtggatttgtgacaattttccctattatagagaagccgggtccgggtggaaaaactccatccgccacaaccttagtttgaacaaatgctttctaaaagtaccgagatcaaaggatgacccggggaaaggcagttattgggccatagatactaaccccaaggaggacgtgctccccacgcggccaaagaagcgagcccggtcggtggagcgtgctagtacaccatattctattgattctgattcgctcgggatggagtgcatcatctcaggatcagcgtcacctacacttgctatcaacacagttaccaacaaggtgaccctctataatactgatcaggacgggagcgacagcccccgaagtagcctgaataactcactgagcgaccagagccttgcctctgtcaaccttaactctgtaggaagtgtccactcctacaccccagtgacttcacaccctgagtccgtttcacagagtttgaccccccaacaacagcctcagtacaacctgcccgagcgcgacaaacagctgcttttttctgagtataacttcgaggacttgagcgcgtcattccggtctctctataagtccgtcttcgagcaatcactctcccagcagggcctgatgaacatccctagtgagagttcccaacagtcacacacatcatgtacataccagcacagcccaagctcaacagtgagcactcacccacattccaatcaatcatctttgtcaaactctcacggttctggcctcaacaccacaggctcgaatagtgtggcacaggtgagcttgtcgcacccacaaatgcatacacaaccttcgccccacccaccccacaggccccacggtctccctcagcatccccagcgatcgccccatccagcaccacacccacaacagcattcccagctgcagtcaccccacccccagcatcctagcccacaccagcatattcagcaccaccccaaccatcagcaccagaccttaacacaccaggcgcccccgcctccacagcaagtatcatgtaacagcggagtgtcgaatgactggtatgccacactagacatgctcaaggagtcgtgcaggatcgcttcatccgttaactggtccgatgttgatctgtctcagttccagggtctcatggagagtatgaggcaggcggatctgaaaaattggtctctcgaccaggtccagttcgcagacttatgctcttcattgaatcaatttttcacacaaacaggcttaatacattcacagtccaatgtacaacagaatgtgtgccacggcgccatgcaccctacaaaacctagccagcacataggcacaggtaatctgtacatcgattcgagacagaatctccctccgagcgtgatgcctcccccaggatacccacacatcccccaggccctcagcacccccgggacgaccatggctggacatcacagggccatgaatcagcagcatatgatgccttctcaggccttccagatgcgtagatccttgcccccggacgacatccaggacgacttcgactgggattctatcgtgtag

SEQ ID NO: 19216 - DNA, 1023 bp, Artificial Sequence
  Description of Artificial Sequence: Synthetic coding sequence
atgatgtgccaccccctggaccagctggccacccggacccagaagaagtctgctacctctaaaccaccatactcttttagtctgttaatctacatggccatagaacattcacccaataagtgcttgcccgtgaaggagatctattcatggattctcgatcattttccttattttgcaaccgcgcccacaggttggaagaacagcgttaggcataacctcagcctcaacaaatgttttcagaaggttgagcgtagccatgggaaggtaaatggtaaaggatcattatggtgcgtcgatcccgagtacaagcctaatctgatccaggctttgaagaaacagccgttttcatctgcctcatcgcagaatggatccctgagtccacattatcttagctcggtgatcaaacagaatcaggtacggaatctaaaggagtcggacattgatgccgctgcggcaatgatgctgttgaacacttcaatcgaacagggtatcttagaatgcgagaaacctctgccactgaagaccgctctgcaaaagaagcgctcttatgggaatgccttccatcatccgtcggccgttcggctgcaggagtcagacagcctcgcgacatctattgatcccaaggaggatcacaattattctgccagctccatggctgctcagcgctgcgccagcaggagcagtgtctcctcactgagcagtgtagatgaagtttatgagttcatccccaaaaactctcatgttggctcagacggatcagaagggttccactccgaagaagacactgatgttgactacgaggacgacccactgggtgactctggctacgccagccagccctgtgctaagatcagtgagaaaggacagtcagggaagaaaatgcggaagcaaacttgtcaggaaatcgacgaagaattgaaggaggccgccggctctctgctccacctggccggcatccgcacgtgcctcggctctcttatttccaccgcgaagacccagaatcagaaacagcgaaaaaagtag

SEQ ID NO: 19217 - DNA, 1296 bp, Artificial Sequence
  Description of Artificial Sequence: Synthetic coding sequence
atgggccccgtgatcggcatgacccccgacaagcgggccgagacccctggcgcagaaaagattgccggtctgtctcagatttataagatgggcagccttcctgaggccgtggatgccgccaggccaaaggctaccctggtggatagtgagtctgcagatgacgaactgactaatctgaattggctacatgagagtaccaacctcttgacaaatttcagcctcggatccgaggggttgcctattgtaagtcccctttatgatatagagggtgatgacgtgccctcatttggcccagcttgttatcagaatcccgagaaaaagtcggcaaccagcaagccaccctacagcttcagcttgctgatttatatggctatcgagcactccccaaataagtgcctgccggtaaaggaaatctattcatggatactggaccacttcccttatttcgccactgcccccactggctggaaaaacagcgttagacacaacctgtccctgaacaaatgcttccagaaggtcgaacggtcgcacggcaaggtaaacggtaagggaagtttgtggtgcgtggaccccgagtataagccaaaccttatccaggctttaaaaaagcaaccgtttagttctgcctcctcccaaaatggctcactctcaccccactatttaagcagtgtcatcaagcagaaccaagtgcgaaatctgaaggaatcagacatcgacgctgccgccgccatgatgctattgaataccagtatagagcagggcattctggagtgtgaaaaacccctgccattgaaaacagcgcttcagaagaagcgcagctacggaaacgcgttccaccatccttcggccgtgaggctacaggagtcggactcattggcaaccagtatcgacccaaaagaagatcacaattatagtgcttcttccatggctgcacagcgctgtgcatccagatcaagcgtatcatccctctcctctgtggacgaggtatatgagtttattcccaaaaactcgcacgtgggttccgatggcagcgaggggtttcattccgaagaagacacagatgtggactatgaggacgatccactcggcgactctggctacgccagtcaaccctgtgccaagatctcggagaagggtcaatccgggaaaaaaatgcgtaaacagacctgtcaggaaattgacgaggagttgaaggaagcagctggctcacttctgcaccttgccggcattagaacctgtctgggatccctgatcagcaccgccaaaacccagaaccaaaaacaaaggaagaagtag

SEQ ID NO: 19218 - DNA, 741 bp, Artificial Sequence
  Description of Artificial Sequence: Synthetic coding sequence
atgggccccgtgatcggcatgacccccgacaagcgggccgagaccccaggagccgagaaaattgctggtttatcccaaatctacaagatgggatccctgccagaggcagtggatgctgccagaccgaaggctacgctggtggattctgaatcagcagatgacgaactcacaaatctgaactggctgcacgaaagtactaacctgctcacaaactttagcctcggcagcgaaggactccctatcgtatcaccgctttacgacatcgagggagacgacgtaccgtcattcgggcctgcatgttaccagaaccctgaaaagaagagtgcaacatctaagcctccatattctttcagccttttaatctatatggcaatcgaacactctcccaataagtgcctgccggtcaaggagatatacagctggattctcgatcatttcccttatttcgccaccgctcccacaggatggaagaactcagtgcgccataacctgtctcttaacaaatgtttccagaaagtagagcgttcacacggcaaggtcaacggcaaggggtcactttggtgcgttgatccagaatataagccaaacctcatccaggccttgaagaagcagcctttttcatctgcttcttcgcagaacgggagtctgtctccccattacctcagctccgttatcaaacagaaccaggtccgaaacctgaaggaaagtgacatcgacgctgctgctgccatgatgttatag

SEQ ID NO: 19219 - DNA, 879 bp, Artificial Sequence
  Description of Artificial Sequence: Synthetic coding sequence
atgggcaacgagctgttcctggccttcaccaccagccacctgcccctggcggagcagaagctggcacgatacaagttgcgtatcgtcaaaccaccaaagctccctctggagaaaaaacccaatccagacaaggacggccctgattatgaacctaatctctggatgtgggtgaaccccaacattgtatatccacctggcaagttggaggtcagtggccgtcgtaaacgagaagacctgactagcaccctgcccagtagccagcctccccagaaagaagaggacgcctcctgttctgaagcggccggggtggaatccctgtcccaatcttcttcgaagcgctccccccctcgcaagagatttgcttttagcccaagcacgtgggaattgaccgaggaggaggaggccgaggatcaggaggattcgtccagtatggcactgccaagcccacacaaaagggcccctctgcaatcacggcgattgcggcaggccagctcccaggcagggaggctgtggagcagacctcctctaaattactttcacctaattgccttagccctgcgaaatagcagcccatgcggcctcaacgtgcagcaaatctattccttcactcgaaaacattttccattctttcgaacagcaccagaaggttggaaaaatacagttcggcacaatctgtgcttcagggattcttttgagaaagttcctgtaagcatgcaaggaggagcttcaaccaggccacggtcatgtctgtggaagctgacagaggagggtcatagacgcttcgccgaggaggctcgcgctctggcctctactaggctggaaagcattcagcagtgcatgtcgcagccagatgtgatgccttttctgttcgatttgtag

SEQ ID NO: 19220 - DNA, 936 bp, Artificial Sequence
  Description of Artificial Sequence: Synthetic coding sequence
atggacctgaagctgaaggactgcgagttctggtacagcctgcacggacaggtgcccgggctcctcgactgggatatgagaaatgaactgttcctgccctgcacaacagaccaatgctctctggctgagcagatcctagccaaataccgtgtgggcgtcatgaagcctccagagatgccccagaaacggcgcccttcacccgacggcgatggtcctccatgcgagccgaatttatggatgtgggtggatccaaacattctatgtccccttggaagtcaagaggcccccaagccatcaggcaaagaagatctgacaaacatcagcccgtttccccagccaccccagaaagacgagggatcaaattgttctgaggacaaggtggtggagagtctaccctcttcctcttccgagcagtcacccctgcagaaacagggcatccatagccccagtgatttcgagttgacggaggaggaggccgaggagcctgacgacaactctctgcagagccccgagatgaagtgttaccagtcgcagaagctttggcagattaataaccaggagaagtcatggcagaggccaccactcaactgtagccatctgatcgctctcgccctgcgaaataacccccattgtgggctctcagttcaggaaatctataactttacccgtcaacatttcccgttcttctggactgcccccgacggatggaaatctacaatccactacaatttatgctttctggatagcttcgaaaaggtccctgactctctgaaggacgaggataacgctcggccacgtagttgcctctggaagttaacaaaagagggacacagacggttctgggaagagactcgggtcctggctttcgcacagcgggaacggattcaggagtgcatgagtcaacccgagctgctgactagtctgttcgacctgtag

SEQ ID NO: 19221 - DNA, 993 bp, Artificial Sequence
  Description of Artificial Sequence: Synthetic coding sequence
atgcagcagcagcccctgcccggccccggcgcccccaccaccgagccaactaaaccaccctattcttacattgcactaattgcaatggccatacaatcttcacccggccagcgagcaactctgtccgggatctatcgttacatcatgggtaggttcgctttctaccgacataatagacccgggtggcagaacagcataaggcataatcttagcctgaacgagtgcttcgtaaaagttcctcgggacgatagaaagcctggaaagggctcttactggacactagatcctgattgtcatgacatgttcgagcacgggagctttctgcgcagacgcagacgctttaccaggcagaccggggccgagggcactaggggccctgccaaagcccggcgaggacccttgagggcaacaagccaggatccaggggtcccaaacgccaccaccggaagacagtgttccttccctcctgaactcccggatcctaagggcttgagttttggagggctggtgggcgcgatgccagcctccatgtgtccggcaacaacagacggtcggcccaggcccccaatggagccgaaggaaatcagtacccccaaaccggcttgccctggggagctgccagtggctacaagcagctccagttgccctgcattcggattcccagcaggtttttccgaggcggagagttttaataaggccccaaccccagttctttccccagagagtgggatcggatcctcctaccagtgccgcctgcaggcccttaacttctgtatgggagccgaccccgggttggaacacttgttggcttccgcagcaccgagtcctgccccgccaacacctcctgggtcccttcgcgcccctctgcccttaccaactgatcataaggaaccatgggtcgctggaggcttccctgttcaaggtggctctggatatccgctgggtctgactccatgtctatacaggaccccagggatgtttttttttgagtag

SEQ ID NO: 19222 - DNA, 957 bp, Artificial Sequence
  Description of Artificial Sequence: Synthetic coding sequence
atgaaccggttcggcacccggctggtgggcgccaccgccaccagctctccccccccgaaggcccgctctaacgagaatctggataaaatcgatatgagcctggacgatatcatcaagctgaataggaaggaggggaagaagcagaattttccacgtctgaatagaagattattgcaacagtcaggggcccagcagtttcggatgagggtgcggtggggaatccaacagaattcaggcttcggaaaaacatcactgaacagacgagggcgagtaatgcctggaaaaagacgacccaatggtgtcatcactggactcgccgcacggaagactaccggcatccgaaaggggatatctcctatgaaccgtccacccctaagcgacaaaaacatagagcaatatttccctgttttaaagaggaaggctaatctgctgcgacaaaatgagggtcagcgcaagccagtggccgtgctcaagaggccatctcagttgtccaggaagaacaacattccagcaaacttcacaagatctggtaataagcttaatcatcagaaggacacccggcaagccacatttttgttccgacgcgggctgaaggtgcaggcccaactgaacaccgagcagctgctggacgatgtagtggccaaacggacccggcagtggagaacttcaaccacaaatggaggaatcctgacagtatctattgacaaccctggagcagtacagtgtcccgttactcagaagccgcgcctgaccaggaccgcggtgcccagcttcctgacaaagagggaacagagtgacgttaaaaaggtgcccaaaggggtcccgctacaatttgatattaattctgtgggcaagcagactggtatgacgctaaatgagagattcggcattctgaaggaacagagagcaacgctcacctataacaaggggggctcgaggttcgtcactgtcggatag

SEQ ID NO: 19223 - DNA, 684 bp, Artificial Sequence
  Description of Artificial Sequence: Synthetic coding sequence
atgcccggcaagcggcggcccaacggcgtgatcaccggcctggccgcaagaaaaaccacaggcatacggaagggcatcagccctatgaacaggccgcctctgtccgataaaaatatcgagcagtactttcccgtgttgaagaggaaggctaacctgcttcgacagaacgagggacaaagaaagccagttgcagtgctgaaacgcccatcccagttgtcgaggaaaaataacatccctgcgaacttcacccgctccgggaacaaattgaaccatcagaaggacacgagacaagctacctttctgttcagacgaggcctgaaggtccaggcccagctcaatacggagcagcttcttgatgacgtggttgctaagcggactcgtcaatggagaacctcgaccactaacggcgggatcctgaccgtatcgatcgacaacccaggcgccgttcagtgccccgtaacccaaaagcccaggctgaccaggacggccgtgcccagctttcttactaagagggagcagagcgacgtaaagaaggtgcctaagggagtcccgctacaatttgacatcaacagcgttggcaagcagaccggtatgacactgaatgagaggtttggtattctgaaggaacagcgagccacacttacttacaataagggtggatcacgtttcgttactgttggctag

SEQ ID NO: 19224 - DNA, 879 bp, Artificial Sequence
  Description of Artificial Sequence: Synthetic coding sequence
atggagcccagcgtgatcatgggcaacgacatcatcaagctgaaccgcaaagagggcaagaagcagaacttcccgcggcttaaccgtagactgctgcagcagtccggggctcaacagttcaggatgagggtacgctgggggattcagcagaacagtggtttcggcaaaacaagcctgaataggcggggcagggttatgcctgggaagagaagacccaacggcgtgattaccggactcgcagctaggaaaacaacaggcatacgcaaagggatcagccctatgaatagaccaccactgtctgacaaaaatatcgagcagtatttcccagtgctgaaacgaaaggctaacttgctgagacagaatgaaggccagagaaagcccgtcgctgtcctcaagaggccctcacagctctctagaaagaacaatatccctgccaatttcacacggagcggcaacaaactgaatcaccaaaaagataccagacaggccaccttcctgtttcgacgtggactgaaagtgcaggcccagctgaatacagaacaattattagacgacgtggtcgctaagcgcacacgtcaatggaggacttctaccaccaatggcggaattctaaccgtcagtatagataacccaggcgccgtgcagtgcccagtgacacaaaagcctagactgactaggactgccgtgccctccttccttactaaaagagagcagtctgacgtgaagaaagtcccgaaaggagtgcctttgcagtttgacattaactcagtgggaaaacaaacaggtatgaccctcaacgagaggttcggcatattgaaggagcaaagggctacgttgacctataacaaagggggctccagatttgtgacagtgggatag

SEQ ID NO: 19225 - DNA, 837 bp, Artificial Sequence
  Description of Artificial Sequence: Synthetic coding sequence
atgggcaagggcaacgaggaccccgacctgcactgcagcagcatccagtgctcaacagatcagccgcccttccagcaaatctcattcaccgagaaggggagcgatgagaagaagccatttaaggaaaagggcaagaccgccttctcgcacagcagcgaaaagcatattcagcgtcagggttcagagcccaatcctaacaaggaaaattccgaggagacgaagctgaaggcaggcaactctacagcaggttcagaacccgagtcctcctcatacagagagaactgtaggaaacgcaagatgagctccaaggatagctgtcaggacacagctggaaattgccccgagaaagaatgctctctctccctgaacaaaaagtcgcgctctagcacgccagtccataattccgagatacaggagacctgtgatgctcaccatcgtggccggtcaagggcttgtaccggtcggtctaaaagacatcggagcagggcactgggagtccagaccccgagcatcaggaaaagcctagtcaccagcgtgcgagccatgtccgaggcagtctatcaagacctggcgcaggtgtgggctcaacaaattcactcacctcttacatgcgagcaacttactctattaaccagacttaggggaccgttgtgcgcccaggtgcaaaccttgtatagcatggccacccaggccgcatacgtcttccctgccgaaagctggctggtccccgccactctgccgggacctggcgagagcgccctggacagggaagcccacccttttcctggtcaagagattaccgagaccgtgtccgggagcgacgaggcgaaactgtag

SEQ ID NO: 19226 - DNA, 840 bp, Artificial Sequence
  Description of Artificial Sequence: Synthetic coding sequence
atgggcaagggcaacgaggaccccgacctgcactgcagcagcatccagtgtagcacagaccagccacctttccagcagatatcgttcaccgagaagggaagcgatgagaagaagccattcaaggagaaaggaaagacggcatttagccatagttcagagaagcacatccagcggcaggccggttcagaaccgaaccccaacaaagagaacagtgaggagaccaaactgaaggccggcaacagtactgccggatctgagcccgagtcctcctcctacagggaaaactgtcgaaaacgcaaaatgtctagcaaagattcctgccaggatacagcaggcaactgtccagaaaaggaatgttccttgtcactcaacaaaaagagcaggagctccaccccagtccacaactcagagatccaagagacttgcgatgctcaccataggggccggagcagggcctgcaccggccgttccaaacgacaccgatcccgtgcattgggggtccagaccccgagtattaggaagtccctcgtgacctccgtgcgtgcaatgagcgaggccgtttaccaggacctggctcaagtgtgggcgcagcagattcattctcccttaacttgcgagcagctgactctcctgacaaggctgaggggtccactgtgtgcccaggttcaaacactgtacagcatggcaacccaggcagcttacgtcttccccgcagaaagctggctggtgcccgcaactttgcctggaccgggggaatctgcgttggaccgcgaggcacatccatttccaggacaggaaatcaccgagaccgtctctggatctgacgaagccaagctgtag

SEQ ID NO: 19227 - DNA, 2544 bp, Artificial Sequence
  Description of Artificial Sequence: Synthetic coding sequence
atgggcaagaagggcaaggtgggcaagagccggcgggacaagttctatcaccttgcaaaagagaccggatacaggtctagatcagccttcaaactgatccagctgaatagacgcttccaattcttgcagaaggctcgagcccttctggacttgtgtgctgcgccagggggttggttgcaggtggcggcaaagttcatgccggtcagctccctgatcgtcggcgttgaccttgttccaatcaagcctctccccaacgtggtaacgctacagcaggatatcacgactgaacgctgtcgccaggccctgaggaaagagctgaaaacttggaaggtggatgtggttctgaacgacggcgccccaaacgtgggggcctcctgggtgcatgatgcttacagtcaagctcatttgaccctcatggctctgagactggcatgcgatttcttagccagaggcggctcctttatcacaaaagtgttcagaagcagagattatcagccgctcctttggatttttcagcagctgtttagacgggtccaagctacaaaaccacaggcttccagacatgagagcgccgaaatctttgtagtctgccaaggatttcttgcaccggacaaggtggactctaagttttttgaccctaagttcgcgtttaaggaagttgaggttcaagcgaagacagttacggaactagtcactaagaaaaaaccaaaagccgaaggatacgcggagggggacctcactctgtaccatcgcacctcggtgacagattttctaagggccgctaaccccgttgactttctgtccaaagcctccgaaatcatggttgacgatgaggaactggctcagcacccggctaccaccgaggatatccgggtgtgttgtcaggacattcgcgttctcggtagaaaggaactgaggtcactcctcaattggaggaccaagcttagaagatatgtcgccaagaaactgaaagagcaagccaaggcgctcgatatcagcctgtcttctggagaggaagacgaaggcgacgaagaagatagcacggctgggacaacaaagcagccctctaaagaggaagaagaagaggaagaggaagagcaactgaaccagacattagcagaaatgaaggcacaagaggtcgctgaacttaaaagaaaaaagaaaaagctcctgagagagcaacgaaaacaaagggaacgtgtcgaactaaagatggatttgcccggtgtttctatagcagatgagggagagactggcatgttttccctgtcaactatacgcggccaccaacttctggaagaagtgacacaaggggatatgagcgcggccgatacattcctgtctgacctgccaagagatgacatttatgtgtcggacgtggaagacgatggcgatgacacatccctggattccgacttggatcccgaggagctagccggcgtgcgagggcatcaaggtctccgcgatcagaaacgtatgaggctgaccgaggtgcaggacgacaaggaggaggaggaagaagagaaccctttactagtccccctggaggaaaaggcggtgctgcaggaggaacaggctaacctgtggtttagtaaaggaagcttcgcaggtatagaagatgacgccgatgaggccttagagatctcacaagcacagctactctttgaaaaccgacgcaaaggtcgccagcaacagcaaaagcagcaacttccccaaactcctccttcatgtttgaagacggagatcatgagccccctctatcaagatgaggctccaaaaggcacagaggccagcagcggtactgaggctgctaccgggctagaaggcgaggaaaaggacggtatatcggactccgattcctcaaccagttcagaggaagaggagtcatgggagcccttgaggggcaagaagaggtccaggggtcccaaatcagacgatgacgggtttgagattgtgccaattgaggaccctgcaaaacaccggatcttggaccctgaaggactggccctgggggccgtcattgcgagctctaaaaaggccaaaagagacttgatcgacaattcatttaatagatacacttttaatgaggatgagggcgagctgcccgagtggttcgtccaggaggaaaaacagcatcggatcaggcaattgccggtgggcaagaaagaggtcgagcattatcgaaagcggtggcgcgaaataaatgctaggccaattaaaaaagtggccgaggctaaagcacgaaaaaagaggagaatgttgaaacggctggagcagactaggaaaaaggccgaagcggtggtgaacacggtggatattagtgagcgcgagaaggtggcacagctaagatctctgtataagaaggctgggctgggcaaggagaagcggcatgtgacctacgttgttgctaaaaagggcgtcgggcgcaaagtacggcgccccgctggcgtgcgggggcatttcaaggtggtagattcacgaatgaagaaggaccaacgggctcaacagagaaaggagcaaaagaaaaaacacaaacgcaagtag

SEQ ID NO: 19228 - DNA, 1431 bp, Artificial Sequence
  Description of Artificial Sequence: Synthetic coding sequence
atggccgacagcaaggagggcgtgctgcccctgaccgccgccagcacagcgccaatcagcttcggtttcacacgaacctccgccaggcgccgtctggctgacagcggcgacggcgccggcccctccccggaggagaaggacttcctgaaaacagtggagggtcgcgaattgcaatcagtgaagccacaagaagcccccaaggagctcgtaataccgcttatccagaacggccaccggaggcagcctcccgcgagaccaccagggcccagcactgataccggcgccctggcagatggcgtggtcagccaagccgtcaaagagctgattgcggagagtaaaaaaagtctggaggagcgcgagaacgcaggggtggaccctactctggcaattcccatgatccaaaaaggatgtacacctagtggcgagggagcggattcagaaccacgcgctgaaaccgtccctgaggaggctaattacgaagccgtccctgtggaggcctatggtctggcaatgctgcgcggaatgggatggaagcctggagagggcattgggcgaacctttaatcaagtcgttaagcctcgcgtgaacagcctccggccaaaaggcctgggcttaggcgccaacttgaccgaagctcaggcactgacgcccacaggcccaagtaggatgccccgtccagatgaagaacaggagaaggacaaagaggaccagccacagggtttggtgccaggaggggcagtcgtggttctttctggacctcaccggggattgtacggaaaggtggagggcctggatcctgataacgtccgggctatggtgagactggccgttggctcccgtgtcgtgacggtgtctgaatactaccttcggcctgttagccagcaggaatttgacaaaaataccctggatttaaggcaacagaacggcaccgcgagcagccgcaaaaccctatggaatcaggagctgtatatccagcaagataattcggaaagaaaaagaaaacatcttcctgatcggcaggacgggccagcagcaaagagtgagaaggcagctcccaggtctcagcactggctacaccgcgatttacgagtgcgatttgttgataatatgtataagggcggacagtactacaataccaagatgatcattgaggacgtgctgtcaccagacacatgtgtatgccggactgacgagggtagggtcctggaggggctccgggaggatatgttggagactttggtaccaaaagcagagggtgatagggtgatggtggtcctgggaccgcagactggcagggtgggccacctgctcagccgcgaccgagccagatctcgggctcttgtgcagttacctcgggaaaaccaggtcgttgagctgcattatgatgccatttgccaatatatggggccatctgatacggacgacgattag

SEQ ID NO: 19229 - DNA, 2796 bp, Artificial Sequence
  Description of Artificial Sequence: Synthetic coding sequence
atggccgcccgggacagcgacagcgaggaggacctggtgagctacggcactggactcgaaccgctcgaagagggggagagacccaaaaaacccattccattgcaggaccagactgttagggacgagaaaggccggtacaaaaggttccacggtgcatttagtgggggcttttcagctggttacttcaacacagttggctctaaagaggggtggacgccgtcaacttttgtgtcgtcaagacagaatcgcgcagacaagtcagtcttgggcccagaggatttcatggatgaggaggatctgtccgagttcggcattgccccaaaagctatcgtgaccacggatgacttcgcatccaagacaaaagaccgcatccgggaaaaagcgcggcaactggcagcagccaccgcccctattcccggagctacactcctggatgacttgatcacccctgccaagctttcagtgggcttcgagcttctccgaaaaatgggatggaaggagggtcagggggtgggcccaagagttaagcgcaggcctaggaggcagaaaccagatcctggagtgaaaatttatggctgcgctctccctcctggtagttctgagggcagcgaaggagaagacgatgactatcttccagataatgtgacttttgcgcctaaggacgtgaccccagtagatttcacccccaaggacaacgtgcacgggctcgcatacaaagggctggatccacaccaagctcttttcggtaccagcggtgaacattttaacctgttcagcggggggtctgaacgtgccggtgatttaggagaaattgggctcaataaagggagaaagcttggtatcagcggccaggcattcggagttggggccttggaggaggaagatgatgacatttatgcaactgagacactgagcaagtacgatacggtgttaaaagatgaggagcctggagatggtctttatggctggactgccccccgccagtacaaaaatcaaaaggagagcgaaaaggacctcagatatgtgggcaaaatcctggatgggttctcccttgcttccaagccgttgagctcaaagaaaatttaccctccgcccgagttgccacgcgattatagacccgtgcactatttccgacccatggtggcggccacttccgaaaacagccacctgctgcaggttctatctgaatcagccggaaaagccacccctgatcctggcacacactccaaacatcagctaaacgcctctaagcgtgccgagttgcttggcgaaacccccatccagggcagtgctacatctgtgctggaatttctcagtcagaaagacaaagagagaataaaagaaatgaagcaagcaacagaccttaaggctgcacagctcaaggctcgaagcctggctcagaatgctcagtcctctcgagcacagctatcacccgctgcagccgccggccactgttcttggaatatggccttaggcggcggaactgcaacgctcaaggcctccaactttaagcccttcgccaaagatcccgaaaagcagaagcgctatgacgagtttttggtccatatgaagcaggggcaaaaggatgccctcgaaaggtgcctcgatccaagtatgactgaatgggagcgaggccgggaacgggatgagttcgctcgggctgctctcctctatgccagctcgcattcaacccttagcagccgatttacccacgctaaagaagaggacgatagtgaccaagtggaggtgccacgggaccaagaaaatgacgtgggcgataaacagtctgcagtcaaaatgaagatgtttggcaaacttaccagagacacatttgagtggcaccccgataagctgctctgcaaaagatttaacgtgcccgacccttatcccgatagcaccctggtgggccttccacgagtgaagcgtgataaatatagcgtcttcaatttcttgaccttgccggagacagcttcactaccaactactcaagcttctagtgagaaagtaagtcagcaccgtggacctgacaaatctagaaaaccctctcggtgggataccagtaagcacgaaaagaaggaggacagtatatcggaatttctcagcctcgcccggtcgaaagctgaacctccaaaacagcagtcatctccactggtcaataaggaggaggaacacgcacccgaactttcagccaaccagacagtgaataaggatgtggacgcccaggctgagggggagggttcgcggccaagcatggaccttttccgggcgatttttgcgtcatccagcgacgagaagagcagctccagcgaggatgaacagggggacagtgaagatgatcaggcaggcagcggggaggccaatttccagagctctcaggacaccgatcttggggaaacatcttcagtcgcccatgctctggtcccagcgccacaggagccacccccaagtttccccatacagaaaatgcagatcgatgaacgagaggagttcgggcccagactgccgccagttttttgccctaacgcgcgacaaaccctcgaagtgcctcagaaggagaagcataagaagaacaaagacaaacacaaggccaaaaaagagcatcgcaggaagaaagaaaagaaaaaaaagcacagaaagcataaacacaaaggcaaacagaaaaacaagaaaccggagaaatcgagtagcagtgaatcctcagattcatctgactcccagtccgacgaggaaaccgcagacgtctcccctcaggagctcctgagacgcctcaagagtttgcccttgagaaggcagtag

SEQ ID NO: 19230 - DNA, 984 bp, Artificial Sequence
  Description of Artificial Sequence: Synthetic coding sequence
atgcccgccctgctggagcggcccaagctgagcaacgccatggcccgcgctctacacagacacatcatgatggagcgcgaacgtaagaggcaagaagaagaagaggtggataagatgatggagcagaaaatgaaagaggaacaggaacgccggaagaagaaagagatggaagagcgtatgagcctggaggagactaaggaacaaattctcaagctggaagagaagcttctggccctgcaggaagagaagcaccagctgttcctgcagttgaaaaaagtgctgcacgaggaggaaaagagacgccggaaagaacaatctgacctgactacactcacctcagctgcatatcagcagagccttactgtccacacaggaacccatttactttctatgcagggcagccctggaggacataatagacctgggacacttatggccgccgatcgggccaaacagatgtttggcccacaggtcctgaccacaaggcattatgtggggtcagccgctgcctttgctggcacacccgaacacgggcagttccaaggcagccccgggggtgcgtacggaactgctcagccgcccccacactatggcccgacacagccggcctactcaccatctcagcaactgcgagcgcccagtgcctttcctgcagtgcagtatctgagtcagccccagcctcagccctatgcggtacacggacatttccaacctacgcagacaggcttcctccagcccggcggcgcactgtccttgcaaaagcaaatggaacatgccaaccagcaaaccgggtttagcgatagtagctcacttcgccctatgcacccccaagctttgcaccccgccccaggcctacttgcttctcctcagttgcccgtgcagatgcagccagcgggaaaaagcggtttcgccgcaaccagccaacccggtcccaggttgccatttatacagcactcacagaatccccgcttctatcacaaatag

SEQ ID NO: 19231 - DNA, 984 bp, Artificial Sequence
  Description of Artificial Sequence: Synthetic coding sequence
atgcccgccctgctggagcggcccaagctgagcaacgccatggcccgtgccctgcatcggcacatcatgatggagcgtgaaagaaagcgacaggaggaagaagaggtggacaagatgatggagcagaaaatgaaggaggagcaggagcgtagaaaaaaaaaggaaatggaggagcgcatgtctttagaagaaactaaagaacaaattctgaagctagaagaaaagctactcgctctgcaggaggagaagcaccaactcttcctccagttaaaaaaggtcttgcatgaggaagaaaaaaggcgacggaaagagcaatctgacctgacaaccctgacttctgcagcataccaacaatcactgaccgtccacaccggtacacacctattaagcatgcagggcagcccaggtggccacaataggccagggacgctgatggccgcagatcgagctaagcagatgttcggcccccaggtgctgaccactagacattatgtgggaagcgccgctgcttttgctggcacaccagaacatggacagttccagggatctcctggaggggcttatggcactgcccagcctcctcctcactatggccctactcagcccgcctactctccaagccagcagcttagagccccgtctgcctttcctgccgttcaatacctgtcccagccacagccacagccttacgcagttcacggacacttccagccaacccaaacgggtttcctacagcctggtggcgcgctttccttgcagaagcagatggagcatgccaatcagcaaactggattcagcgattcatcaagtctacgacctatgcacccacaagccttacacccagcgccaggccttctagcttcaccccaattacccgtccagatgcaacctgccgggaagagcgggtttgctgcaacaagccagccaggccccaggttgccctttattcagcatagccagaaccctcgcttctaccataagtag

SEQ ID NO: 19232 - DNA, 984 bp, Artificial Sequence
  Description of Artificial Sequence: Synthetic coding sequence
atgcccgccctgctggagcggcccaagctgagcaacgccatggcccgagctctgcatcgccacattatgatggaacgcgaacgaaagcgccaggaggaagaagaagtcgacaaaatgatggagcagaagatgaaggaagagcaggaaagacggaagaaaaaagaaatggaagagcgtatgagccttgaagagacgaaggagcagatcctgaagctcgaggaaaaactcctcgctctgcaggaggaaaaacaccagctgttccttcagctgaagaaggttcttcacgaagaagaaaagaggagacgcaaggagcagtctgacctgacaacacttacctcagctgcttaccagcagagccttacagtacacacgggcacacatctcctcagtatgcagggaagtcctggaggacataataggcccggcacactcatggcagcagaccgcgctaaacaaatgtttggcccccaggtcctgaccacccgacactacgtcggctctgctgccgccttcgcagggacacccgaacatggccaatttcagggctcccccggaggtgcatatggaacagcacagccacccccccactacggaccgacccagcctgcctactccccttcccagcagctcagagcgccaagtgcattccccgcagttcagtacttgagccagccacaacctcagccttacgcagtccacggccattttcagccgacccagaccggcttcctgcagcctgggggcgccctgtctctgcagaaacaaatggaacatgctaaccaacaaacaggattctccgactctagtagcctcagacccatgcacccccaagccctgcatcctgcgcctggcctgctggcttctcctcagctgcctgtccagatgcagcccgccgggaaatccggctttgctgccacttcacagcctgggccccgattaccttttatccagcattcccaaaacccgaggttctaccataaatag

SEQ ID NO: 19233 - DNA, 912 bp, Artificial Sequence
  Description of Artificial Sequence: Synthetic coding sequence
atgcccgccctgctggagcggcccaagctgagcaacgccatggcccgggcgcttcacagacacatcatgatggagagggaaaggaaaaggcaggaggaggaggaggtggacaagatgatggaacagaaaatgaaagaggagcaagagagaaggaagaagaaggaaatggaagagaggatgagtctggaggagactaaggagcagatcctgaagctcgaggaaaagcttctagctttacaagaggagaagcaccaactatttctccaactcaaaaaggtcctgcacgaggaggagaaacgtcgccgtaaagagcagagcgatctgactacactgacgtccgcagcttaccagcaaagcctcacagtgcatacaggaactcatctgttgtcaatgcaggggtctccggggggccataatagacccggaaccttaatggccgcggatagggctaagcaaatgtttggtcctcaggtgcttactactcggcattacgtagggtctgccgccgccttcgccggaaccccagaacacgggcagttccagggatcaccgggaggggcatacgggaccgcgcagcctccaccgcactacgggcctacccagcctgcatattccccaagccaacagctccgcgcccctagtgcctttcccgccgtccagtatctgtcacagcctcagccccagccctacgcagtccatggccacttccagcccacccaaacaggcttcctgcagccagggggggcccttagcctgcagaagcagatggaacatgcaaatcagcagactggttttagcgattctagctccttgaggccgatgcaccctcaagcccttcacccagcacccggcttgctggcctctcctcagctacctgttcagatgcagcctgcgggaaagactgccccttag

SEQ ID NO: 19234 - DNA, 1986 bp, Artificial Sequence
  Description of Artificial Sequence: Synthetic coding sequence
atgagcaagcggctgcggagcagcgaggtgtgcgccgactgcagcgggcccgatccaagctgggcctccgttaaccgcggtactttcctctgtgatgagtgctgttcagtgcaccgatccctggggaggcacatatcccaggtgaggcatcttaagcacacgccatggccaccaacactcctgcagatggtcgaaactctctacaacaatggggccaatagtatctgggaacacagcttgttagatcctgcttcaattatgtcaggccgtagaaaggccaacccacaagataaggttcatcctaataaagccgagtttatcagggctaaataccagatgctggcgtttgtgcataggcttccatgccgagacgatgacagcgttacagcaaaggatctttccaagcaactacattcctccgtccggaccggcaatttggagacatgtctgagactcctgtctcttggggcgcaagccaacttctttcaccctgagaaggggaatactccactgcatgtggcaagtaaggccggacagatcctgcaggccgagctgctcgctgtgtacggtgccgaccctgggactcaggattcgtccgggaagaccccagtcgactatgctcgtcaggggggccatcacgaactggcagagcgactcgtcgagattcaatacgaactcactgatcggctggctttttacctctgcggccgtaaaccggaccacaaaaacggtcagcactttatcattcctcagatggcagactcaagcctggacttatccgagttggctaaggctgccaagaagaaactgcaatccctgtcgaaccaccttttcgaagaactggcgatggatgtatacgatgaggtagaccggagagagaccgacgctgtgtggctggccacacagaatcacagcgcactggtaacggagaccaccgttgtcccttttctgccggtaaaccctgagtatagttctacccgcaaccagggtagacagaaactcgcccgcttcaacgcacacgagttcgcgacccttgtcattgacattctgtctgatgctaaacgcaggcagcagggctcctcgttgagcggtagtaaggacaatgtcgagctgatactgaaaacaattaacaatcagcacagtgtggaatcgcaagataacgatcaacccgactacgattcggtggcctccgatgaggacacagacttggagaccaccgcctcaaagacgaatcgccaaaagtctttggattcagatctgtccgatgggcccgtaaccgtacaggagttcatggaggtgaaaaacgccttggtcgctagtgaagctaagattcagcagctgatgaaaatcggccgttctgctcttgtaacaagctcatcctccctgccctcttttccctcaacactgtcgtggtctcgcgacgagtccgctcgtagggcctctcgcttggagaagcagaattcgacacctgaatctgactatgataacaccccgaatgatatggagccggatgggatgggcagtagtagaaagggaagacagcgcagtatggtgtggcccggggacggactggtgccagacaccgctgaaccccatgtggcaccgagccctactctcccatcgacagaggatgtgattcgaaagaccgaacagataacgaaaaatatccaggaactgctgagagcagctcaggagaacaaacacgactcttacattccatgttccgagcgcatccacgtggctgtcaccgaaatggctgccctcttccccaaaaaacctaagtccgacatggtccggacaagcctgcggctcttgacttcatccgcttaccggctgcagtctgagtgtaaaaagaccctgcccggcgacccagggagcccgactgacgttcagttagtgacacaacaggtaatccagtgcgcatacgacatcgccaaagccgcaaaacaactggttacgatcacaactaaggaaaataataactag

SEQ ID NO: 19235 - DNA, 1950 bp, Artificial Sequence
  Description of Artificial Sequence: Synthetic coding sequence
atgagcaagcggctgcggagcagcgaggtgtgcgccgactgcagcggtcctgatcctagttgggctagcgttaatcgcggaacatttctgtgcgacgaatgctgcagcgttcatagatctctgggcaggcacatatcccaagtccggcacctcaaacacacaccttggccgcctaccctgctgcaaatggtcgagacactttataacaacggcgccaacagcatttgggaacactccctcctagacccagccagtatcatgagcggacgaagaaaagctaacccccaggataaggttcaccctaataaggccgagttcattagggcgaaatatcaaatgttggcgtttgtgcaccgcctgccctgtcgggacgatgatagcgtgaccgcaaaggatctatccaagcaactccacagcagtgttcgaacaggtaacctcgaaacctgccttcgcttgctgagtctcggggcacaggctaatttcttccaccctgaaaaggggaatacccccctacatgtggcctcgaaagccgggcagatcctccaggctgagctgttagccgtgtatggcgcagatccaggaacacaagattcaagcggaaagactcccgtggattacgccaggcaaggcggtcaccacgaactggctgaaagactggtcgaaatccagtatgaactgacggataggctggccttctatctttgcgggagaaagcccgatcataagaacgggcaacacttcatcatcccacagatggctgacagtagccttgatctctcggagctggcgaaagctgccaagaagaaactccagtctttgagtaatcatctcttcgaggaactggccatggacgtatatgacgaggtggatcgcagggagaccgacgcagtttggctagctacacagaatcactctgctcttgtaactgagacaaccgttgtaccatttctccctgtaaatcccgaatactctagcacacggaatcaaggccaaccaaagaaaagcctggacagcgacctctccgacggccccgttaccgttcaggagtttatggaagtgaagaatgctctggtagccagcgaagcaaagatccagcaactgatgaaagtgaataataatctttccgatgagctgcggattatgcaaaaaaaactgcagacacttcagagcgaaaattctaaccttaggaaacaggcgacaacgaacgtgtatcaagtgcagactggcagcgaatacacagatacttctaaccattcttctctgaagagacgaccctccgccagggggtctaggccaatgagtatgtacgagacagggtccggacagaagccatacctcccgatgggggaagcctcccggcccgaagaatcccgcatgcgactgcagcctttccctgctcacgcgagtagactggaaaagcagaattctacccctgagagcgactatgataatacaccaaacgacatggaacctgatggaatgggatccagtcgcaagggccggcaaaggtcgatggtgtggcctggcgatggcctggtgcctgacactgccgagcctcatgtggcaccctcacccactctcccgagcactgaggacgtaatcaggaaaaccgaacagattacaaagaatatccaggagctgctccgggccgcccaggagaataagcatgattcctacatcccatgctcagagcggatccacgtagccgtgacagagatggcagctctttttccaaaaaagccgaaaagcgacatggtaagaaccagccttaggctgctgacatcgtcagcttatcgcctgcagtccgaatgtaagaagacactccccggggaccctggatcacccaccgacgtacagctagtcacccagcaggtcatccagtgcgcgtacgacatagccaaagctgccaagcagcttgtgacaattactaccaaagagaataataactag

SEQ ID NO: 19236 - DNA, 2046 bp, Artificial Sequence
  Description of Artificial Sequence: Synthetic coding sequence
atgagcaagcggctgcggagcagcgaggtgtgcgccgactgcagcggccctgatccttcttgggcctctgtcaatcgcggcacattcctgtgtgatgagtgttgctcagtgcaccgctcgctgggcagacatataagccaggtcaggcacctgaagcacactccctggccccccactctcctccagatggtcgaaacattgtacaacaacggtgccaacagtatttgggagcactcccttctggaccccgcctctataatgagcggtcggcgcaaggccaatccccaggacaaagtgcatcccaacaaagcagagtttatcagggctaaataccagatgctggccttcgtgcacaggctcccttgccgagatgatgacagcgtgaccgcaaaggacttaagcaagcaactgcattcatccgttagaaccggaaacctcgagacttgcctccggctgctctccctgggcgctcaggctaactttttccacccagagaagggcaacacccctctgcacgtcgccagtaaggcaggacagattctccaggcagagttactggctgtgtacggagcggaccctggtacacaggattcatctgggaaaactccggtggactatgcaagacaaggcggccatcacgaattggccgaaaggctggtggaaatccagtatgaactcacagaccgcctcgctttttacctctgtggacgcaaaccggaccacaagaacggccagcacttcattatcccccagatggccgacagaaggtcttctctggacctgagtgagcttgccaaggcagcaaagaaaaaactgcaatccctgtccaatcacctgttcgaggaactcgccatggacgtgtacgatgaagtggacagacgggagacagacgccgtctggctcgccactcaaaatcactcagccctggtcacagagaccacagtggtacccttcttgcctgtcaacccggaatattcctctaccagaaatcaggggcgccagaagttagcaaggttcaatgcccatgagttcgctaccttagtgattgacatcttgagcgacgcaaaacggcgtcagcaaggttcctccctttcaggaagcaaagataatgtggagttgattctaaaaactatcaataatcagcatagcgtcgaatcacaggacaatgaccaacccgattatgactcagtcgcaagcgacgaagataccgacttggaaacgaccgcttcaaagacaaaccgccaaaaactgcagaccctgcaatctgagaactcaaacctgaggaaacaagctaccaccaatgtttatcaggtacagaccggctctgagtacactgacacaagcaaccactcttccttaaagagacgccccagtgcaagaggaagcagaccaatgagcatgtacgaaacgggtagcgggcaaaagccatatctgccaatgggtgaggcctcccgccccgaagagagcagaatgcgattgcaaccattcccagctcatgcatcaaggctcgagaagcagaattccacccccgaaagcgattatgacaacacccccaacgacatggagcctgatggaatgggctctagcaggaagggtcggcagagatccatggtgtggccaggggatggtctggtgcccgataccgccgagccccacgtagctccctcccctacactgccctctactgaggacgtgatccgcaaaactgagcagatcacaaagaacatccaagagttgttgagagctgctcaggagaacaaacacgactcctacattccctgttccgaaagaatccacgtggccgtaactgaaatggctgctctgtttcccaaaaaacctaaatctgatatggtaagaaccagtctgaggctgctgacctctagtgcatatcgacttcaaagcgagtgcaagaaaactttacctggagatcccggcagtcccactgacgtgcagctagtcacacagcaggtgattcagtgtgcttacgacattgctaaggccgccaaacagcttgttactattaccaccaaagagaataataactag

SEQ ID NO: 19237 - DNA, 2280 bp, Artificial Sequence
  Description of Artificial Sequence: Synthetic coding sequence
atgagcaagcggctgcggagcagcgaggtgtgcgccgactgcagcggccccgacccgtcttgggcttcagtcaatagggggacgttcctctgcgacgagtgctgctccgtgcatagaagtctgggccgccatatatcccaggtgcgccatctgaagcacacaccttggcctccaacactgctgcaaatggtcgaaacactctacaataatggcgccaattctatctgggaacattccctgctcgaccccgcttctattatgtcaggccgcaggaaggctaacccacaggataaggtgcatcccaataaagctgaatttatacgggcaaagtaccagatgctcgccttcgtgcaccggcttccttgccgtgacgacgactccgttactgccaaagacttgagtaaacagctgcattcatctgtgaggaccggaaaccttgagacctgccttcgactgctaagtcttggtgcacaggccaacttttttcatcctgagaaaggaaacacgcccctgcatgtcgccagcaaagcaggtcagattctccaggctgaactgttggcggtttatggagccgatcctgggactcaggatagctccggaaaaactcctgtcgattacgcgcgtcaagggggacatcatgagcttgcggaacggctggtggaaatccagtatgagctgacagaccgactggccttctacctgtgtggacgcaagcccgatcataaaaacggacaacattttattattccccagatggccgatagctcactggacctgtccgagcttgcgaaggctgccaagaagaagctacagtccctttctaaccacttgtttgaggaattagccatggacgtgtacgatgaggtcgacaggagagaaacggacgctgtctggctcgccacacagaaccatagcgcgctggtgaccgaaaccacagttgtgccctttctccctgtcaacccagaatactccagcactagaaaccagggacggcagaagctggcgagatttaatgcgcacgagttcgccaccctcgtgattgacattctatctgatgccaagagacgacagcagggttccagtctgtccgggagcaaagataacgttgaactgattttgaaaaccatcaacaaccagcactctgtggaaagccaggacaatgaccaacctgactatgatagtgtagcttctgacgaggataccgacctggagacaacggcaagtaagactaaccggcagaagagcctcgacagcgatctcagcgacgggcccgttaccgtgcaagagtttatggaggtgaagaacgccctggtagcctccgaggcgaagatccagcagttgatgaaggtcaacaataatttaagtgacgagctgagaattatgcagaagaagttacagaccctgcagagcgagaacagcaatctccggaaacaggcaactacaaatgtataccaggtccaaaccggttccgaatatactgatacctctaaccactcctctctgaaaagaaggccatctgcacgggggtcacggcctatgagtatgtacgaaacaggatccgggcagaaaccctatctacccatgggggaggcaagcaggccagaagaatcccgtatgcgcctccagccttttcccgcacacattggtagatctgcgctggtcacttcctcaagttctttgccctcttttccaagcacattgagctggagtagagacgagtccgcgcgccgcgcctcccgtcttgagaaacagaactctaccccagagtctgactatgacaacacacccaacgacatggagccagacggtatgggttcttctcggaaaggcagacagaggtcgatggtatggcccggagatgggttggttccagatacagccgagccgcatgtggcccccagccctactctgccaagtaccgaggatgtaataaggaagacggagcaaatcaccaagaatattcaggaactgctcagagctgcccaggaaaataagcatgattcctatatcccgtgttctgagcggattcacgtagccgtgactgagatggccgctctctttcctaagaagcctaagagcgatatggtgcggacaagcctgcgcttgctgacatcctctgcatatagactgcagtcagaatgtaagaagactcttccgggtgaccctgggtcaccgactgacgtgcagctcgtgacccagcaggtcatccagtgtgcgtacgacatcgcaaaagcagccaaacaacttgtcaccataacaacaaaagagaacaacaattag

SEQ ID NO: 19238 - DNA, 1941 bp, Artificial Sequence
  Description of Artificial Sequence: Synthetic coding sequence
atgagcaagcggctgcggagcagcgaggtgtgcgccgactgcagcggaccagatccaagctgggccagtgtcaatagagggacctttctgtgcgatgaatgttgttcagtgcatcgtagtcttggacgccatatctcccaggtaaggcatttgaaacacaccccatggcccccaacactgctacagatggtcgaaacactctataataacggtgctaactctatctgggagcactccctcctggaccctgctagcattatgtctgggcgccgcaaggccaacccccaggataaggttcacccaaacaaggccgagtttattagggcgaaatatcagatgctggcgtttgtgcaccgccttccttgccgcgacgatgactcagtcacagccaaagacctgtctaagcagcttcatagctccgtgaggacaggaaatttagaaacttgcctcaggctgctttcactcggcgcccaggcgaacttttttcaccccgagaaaggcaacacccccttacacgtagccagtaaggcaggtcagattctgcaggcagagctattagctgtctacggagccgacccagggacccaggacagctccggtaaaactccggtcgactatgccagacaaggcggacatcatgaacttgcagaacggctagtggaaatacagtacgagctgaccgacaggttagctttctacctgtgcgggcgaaagccagaccacaagaatggtcaacacttcatcataccgcaaatggcagactctagccttgacttatctgaactggctaaggctgctaagaagaaactgcagtctctgtcaaatcatctgttcgaagagctggcaatggatgtctatgacgaagtggaccggagagaaaccgacgcagtctggctcgcgacccagaatcactccgcactcgtcacagagaccaccgtggtgccctttctcccagttaatcccgagtattcatctacaagaaatcagggtcgccaaaagctcgcccgctttaacgcccacgagttcgctactctcgtcattgacatcttatcagacgccaaacgtagacaacagggatcctccctgtctggctccaaagacaatgtggagctgattctaaagacgataaacaatcagcactccgtggaatcacaggacaacgaccaacctgactatgacagtgttgcaagtgatgaagacactgaccttgagaccacggccagcaagaccaatagacagaaatcattagacagcgatctatcagatgggcccgtgacagttcaggaatttatggaggtgaagaacgcactggtggcaagcgaagccaagatccaacagcttatgaaagtaaacaacaacctctctgatgaactgaggatcatgcaaaaaaaagcttcacggctggaaaaacagaattcaactccagagtccgattacgataatactcccaatgacatggaaccggatgggatgggatcgagtcggaaaggtaggcagcggtcaatggtgtggcctggtgacggcctggtgccagatacggccgagccgcacgtcgctccttcccccaccctgccgagtacagaagacgtgattcgcaagacggaacagatcaccaagaacattcaggagcttctccgggcagcacaggaaaacaaacacgactcttatatcccgtgcagcgagcggatccacgtcgctgttaccgagatggctgctctgtttcccaaaaaacctaaaagtgacatggtgcggactagcctgcggttgctgacaagttctgcttacaggttgcaatccgagtgtaagaagactctcccaggtgatcccggctctccaaccgatgtgcaactggtgacgcagcaggtgattcaatgcgcttacgatattgccaaagctgctaagcagctggtaactatcaccactaaggagaataataactag

SEQ ID NO: 19239 - DNA, 2130 bp, Artificial Sequence
  Description of Artificial Sequence: Synthetic coding sequence
atgagcaagcggctgcggagcagcgaggtgtgcgccgactgcagcgggccagacccaagctgggccagtgtgaatcgtgggactttcctttgcgacgaatgctgctccgtgcacaggtctctgggaagacatatttcacaggtgcgtcacctgaaacataccccctggccacccactttgctgcagatggtcgagaccctgtacaacaacggcgctaattccatatgggaacattcactgttagacccagccagcattatgtctgggcgtcgcaaagccaatccacaagataaggtgcatccaaacaaggccgaattcataagggctaagtaccagatgttggcctttgtccacagacttccatgccgtgatgacgatagcgtgactgccaaggatctctctaagcagctccactcgagtgtgcgcacagggaacttagagacatgcctaaggctgttaagcctgggagcacaggctaacttctttcaccccgagaaaggcaacactcccctacacgtagcatccaaagccgggcagatcctacaggccgagctgctggcggtctatggggcggatccaggcactcaggactccagcggcaagacgcctgttgactatgcccgccagggcggacatcatgaactcgcagagcgtctggttgaaatccaatatgaacttaccgatcgccttgctttctacctgtgcgggaggaagccagaccacaagaatggccagcatttcatcattcctcagatggccgactcaagtctggacttgagcgagttagctaaggctgctaaaaagaaactgcagagtctatcaaatcacctgtttgaagaattggccatggatgtttatgacgaagtggaccgcagagaaaccgatgctgtgtggttagccacacagaatcacagtgcactcgttaccgaaacgaccgttgtgccttttctacctgtgaatccagaatactccagcacacgcaaccagggaaggcaaaagctggccagattcaacgcacatgaattcgcgaccctggtaatcgacatactcagcgacgccaaaaggcgtcagcaaggaagctcactttccgggtctaaagacaatgtggagttgattctcaagaccatcaataatcagcacagcgtggagagccaggataacgatcagccggactatgacagcgtcgctagtgacgaagatactgatttggagacaaccgcctctaagaccaatagacagaagttacagacccttcaaagcgagaactctaaccttcgcaagcaagccactactaacgtgtaccaggttcagactggcagcgagtacactgacacgtcgaaccactctagcctgaaaagacggccaagcgctagaggatcacgccctatgtccatgtatgaaaccgggagtggccagaagccatacctgcccatgggcgaggcgtccagacctgaggaatcccggatgcgcctgcagcccttcccagcacacattggaaggtcggctctggtgacttctagtagttcactcccatccttcccctccaccctttcctggtccagggacgaaagtgctcgccgggccagccgcctggagaaacagaacagcacccccgaaagcgattatgataacacgcctaacgatatggaacccgatggcatggggtccagtcggaagggtagacaacgatctatggtatggccgggtgacggtctcgttcccgataccgctgaaccacacgttgcaccttctccaactttgcccagcactgaggacgtcatccgcaaaacagagcaaattaccaagaatatccaggaattgcttcgagctgctcaggaaaacaaacatgacagttacattccctgtagcgagcgcattcatgtcgccgttacagagatggcagcactgtttcctaaaaagcctaagtccgatatggtaaggacatccctgcgcctgttgacttcctctgcctacagacttcagtccgaatgcaaaaagacacttcctggcgatccagggtcccccaccgatgttcaacttgtgacccagcaagtcatccagtgcgcttacgacattgccaaagcagccaagcagctggtaacaatcaccacaaaagaaaataataactag

SEQ ID NO: 19240 - DNA, 2190 bp, Artificial Sequence
  Description of Artificial Sequence: Synthetic coding sequence
atgagcaagcggctgcggagcagcgaggtgtgcgccgactgcagcgggccagaccctagctgggcgtcagtaaatcgcggaacttttctgtgcgacgagtgttgctctgtgcaccggtctctcggacggcacatctcccaagtccgccacctgaaacacactccatggcctcccactctccttcagatggttgagaccctgtacaacaacggagcaaattcgatctgggaacacagtctactggacccagcttctataatgagcggccgtcggaaagccaatccgcaggacaaagtgcaccccaataaggctgagtttattcgggctaagtatcagatgctggccttcgtgcacagactgccatgtcgcgatgacgactctgtcaccgcaaaagatctgtctaagcaactccattccagcgtgagaaccggcaatctcgagacttgtttacgcctgttgtctctcggggctcaggctaactttttccatccagagaaaggcaacacgcccctgcatgtggcatctaaggccggacagatcctccaggccgaacttctcgctgtgtacggtgcagaccctggcacccaggattcctccggcaagactccggtcgattatgcaaggcaaggcggacatcatgaacttgctgaaagacttgtcgaaatacagtatgaactaaccgatcggttagccttctatctgtgtggccgtaagcctgatcataaaaacgggcagcactttatcatcccccagatggctgacagttctctcgacctgtctgaactggcaaaggcggccaagaaaaaactgcagagtcttagtaaccacttgtttgaggagctggctatggacgtgtatgacgaggtcgacagaagagagacagacgctgtgtggctagcaacacagaaccactccgccctggtcacggagactactgttgtgccttttctccctgtaaaccctgaatattcatccacgaggaaccaggggcgacagaaactggcaaggtttaatgctcacgaatttgccaccctagtaatcgacatactgagcgacgccaaacgacgccagcagggctcctccctgtccgggtcaaaggataacgtggaactgattctgaagaccataaacaatcagcattcagtagagtcccaagacaacgaccaaccagattacgattccgtcgcatccgacgaggacaccgacctagagaccacggcttctaaaaccaaccgccagaagtccttggacagtgatttgagtgatggtcccgtcacagtgcaggaatttatggaagtgaagaacgctctggtcgcaagtgaggccaagatccagcagttgatgaaggtcaataataacctgtcagatgagttaagaatcatgcaaaagaagctgcagacacttcagagcgaaaactccaatttgcggaaacaagccactaccaatgtataccaggtgcaaacgggcagcgagtataccgatacgtcaaatcattcatccttaaaacgacgaccgtctgccaggggctcaagacctatgagcatgtacgagacagggagcgggcaaaagccctatctgcctatgggcgaagcctcaagacctgaagagtctcgcatgagattacagccctttcctgcccacgccagccgcttagagaaacagaacagcactcctgagtcagactacgacaacacaccgaatgatatggaaccagatgggatgggcagtagtcggaaaggccgccaacgctctatggtatggcccggggacggtctggtgcccgatactgccgagccacatgtcgctcctagccccaccctcccaagcaccgaagacgtaatcaggaaaaccgagcaaatcactaagaatatccaggagctccttcgggccgctcaagaaaataaacatgacagttatatcccttgttctgaaagaatccatgtggcggtgacagaaatggctgccctttttcccaaaaaaccaaagagtgacatggtgaggacatcactgcgccttctgacctcctccgcctacaggctgcagtcagaatgtaaaaagaccctgcctggtgatcctggctcccccaccgatgtgcagctcgtgacacaacaggtgatacagtgtgcttatgacattgcgaaagccgcgaagcaattggtgaccattacgactaaggaaaacaataactag

SEQ ID NO: 19241 - DNA, 2046 bp, Artificial Sequence
  Description of Artificial Sequence: Synthetic coding sequence
atgagcaagcggctgcggagcagcgaggtgtgcgccgactgcagcggtcccgatccatcatgggcatccgtcaatcgcggcacttttctgtgtgatgagtgctgcagcgtacatagatccctcggaaggcacatttctcaagtacggcatctcaaacacactccgtggccaccaactttgctccagatggtcgagactttgtacaacaatggcgcaaatagcatctgggaacactcccttttggatcccgcatccatcatgtcaggaagaaggaaggctaatccccaagataaagtgcatcctaacaaagccgaatttatacgggcaaaatatcagatgctcgcgttcgtgcatcggttgccttgtcgcgacgatgatagtgtgacagccaaggatttgtctaagcagctacacagttcagtgcggacgggaaatcttgagacatgtctgcgactactgagcctaggagcgcaggccaactttttccatccagaaaagggaaataccccactgcatgtggcgagcaaagctgggcagatactgcaggccgaacttctcgcagtgtatggagctgacccaggcacccaggactcgtctggaaagaccccggtcgactacgcacgtcagggcggccaccatgagttggccgaaaggctggtagaaatccagtacgaattaacagataggctggctttttacctctgcggaaggaagcccgatcacaaaaacgggcagcactttatcataccccagatggccgatcggagactgagtctggatctaagcgagctggcaaaggctgccaaaaagaagctgcagagcctgtctaaccacctgttcgaagagctggcgatggatgtgtacgatgaggtggatcgccgagaaacggacgccgtgtggctggcaacacagaatcacagtgccttggtcacagagacaactgtggtccctttcctacccgtgaaccctgagtactcaagtacccgcaatcagggacggcaaaagcttgctcggttcaatgctcatgagttcgccaccctggttattgacatcctgtccgacgccaagcgcaggcaacaggggagcagcctctctggatccaaagataatgtggaattgatccttaagaccattaataatcagcatagtgttgagtcccaggacaacgaccaaccggactacgatagtgtggcaagtgacgaagacacggacttagaaactactgcttccaaaaccaaccgccagaaactgcagacacttcagtctgagaactctaacctgcgcaagcaggcaaccaccaacgtgtatcaggtgcagaccggctccgagtacaccgacactagcaatcattcttctctgaagaggcggccgtcggcaaggggaagtagacccatgtctatgtacgaaaccggttccggccaaaaaccttatctgccaatgggtgaggcctcacgtccagaagagtctcgaatgcggttgcaaccattccccgctcacgcctcccgtctcgagaagcagaattccacacccgaatctgattatgacaacacccctaacgacatggagccagacggaatggggtcgagtcgaaaaggacgtcagcgcagcatggtatggcctggagacgggctagttccagacacagccgagccacacgttgccccatccccaacactgccctccacagaggacgttatcagaaaaacagagcagatcacaaaaaacattcaggagttgctcagggccgcacaggaaaataaacacgacagctatatcccctgcagcgaaagaatacacgttgccgtgacggaaatggcagccttatttccgaagaaacccaagtccgacatggttcgcaccagtctgcgccttttgacatcctccgcctatagactgcagtcagagtgtaaaaaaactcttccaggagatccaggctctcctacggatgtccagctcgtgacacagcaagtgattcagtgcgcctacgatattgccaaggcggctaagcagctagtcacaattaccactaaggagaataacaattag

SEQ ID NO: 19242 - DNA, 1806 bp, Artificial Sequence
  Description of Artificial Sequence: Synthetic coding sequence
atggtggagaccctgtacaacaacggcgccaacagcatctgggagcatagcctcctggatccggcttccatcatgtcagggagacgtaaggcaaatcctcaagataaagtgcatcccaataaagccgaattcattagggcaaagtatcagatgcttgccttcgtccatcgactgccctgccgggacgatgattctgtgaccgcaaaagacctttccaaacagctgcactcaagcgtgcgaacgggaaatctggaaacttgtctgaggctgctcagcctgggggcacaggcaaacttctttcaccctgagaaaggcaatactcccctccacgtcgctagtaaagctggacaaattctgcaggctgaacttctggccgtgtatggggcggacccaggaacgcaggactcatctggaaaaacgccggtcgattacgctcggcaaggaggccatcacgagctggcagaacgcctggtggagatccagtacgaacttaccgacagactagcattttacctatgtggccgcaagcccgatcataaaaatgggcaacacttcataattccacagatggccgattctagtctggacctatccgagctcgccaaagcagccaagaagaagctgcagagcctctcaaaccacctgtttgaagaactggccatggacgtctacgacgaggtggaccgacgcgagacggacgcagtttggctggctacacagaaccattctgcgctggttaccgaaaccaccgttgtgcctttcctgcccgtgaatccagagtactcttcaaccagaaaccagggacggcaaaaattagcaaggtttaatgcccacgagttcgcaaccctagtgatcgacatcctttcagacgcaaaacggaggcagcagggctcaagcttgtctggcagcaaagacaatgtggagttgatattgaagacgataaacaaccagcactccgttgaaagccaggataacgatcagcccgactacgactctgtcgcttccgacgaggacaccgatctggagacaaccgccagcaaaacaaaccgtcagaaatcactggactctgaccttagcgacggacctgtgaccgtccaagagtttatggaggtaaaaaacgctttggtagcttccgaggcgaagattcaacaactgatgaaggtcaacaacaacctctcagacgaattgcggatcatgcagaaaaagctgcagactctgcaaagtgagaacagcaacctgcggaagcaggcaactactaacgtgtatcaggtccaaacgggcagcgaatatacagatactagcaaccactcaagtctcaagaggaggccgagcgctcggggttctagacccatgtcgatgtacgaaaccgggagcgggcagaagccctacctgccaatgggagaggcctctcgccccgaggagagccgcatgagactccagccttttccggcacacgccagccggctagagaagcagaatagtacaccggagtctgactacgataatactcccaacgacatggagcccgatgggatggggagttctcgaaagggcaggcagcgctcaatggtgtggcccggcgacggcctagtcccagatactgccgagccacatgtggccccatcacctacactgcctagtacggaggacgtcatccgaaagacggaacagataacaaagaacattcaagaactgctgagggctgctcaggagaacaagcacgactcttacattccctgctcagagcggattcacgtcgcagtgaccgagatggctgccctatttcccaaggagacccaggtatag

SEQ ID NO: 19243 - DNA, 1416 bp, Artificial Sequence
  Description of Artificial Sequence: Synthetic coding sequence
atgagcaagcggctgcggagcagcgaggtgtgcgccgactgcagcggtcctgaccccagttgggctagcgttaatagggggacattcctctgtgacgaatgttgctccgtgcaccgtagccttggccgccacatttcacaggtccgacatttaaaacacacaccttggcccccgacacttctgcagatggtagagaccctgtacaacaatggcgctaattctatctgggagcatagtttgctggaccccgcttctattatgtcaggtagaagaaaggctaacccgcaagataaagttcatcctaataaagccgagttcatacgggccaagtatcagatgcttgcttttgtccacagattgccttgccgggacgacgatagcgtaacagccaaggacctgagcaagcagctccacagcagtgttaggaccggaaatctagaaacgtgtctgcgtctgttaagtctgggggcccaggccaattttttccatcccgaaaaggggaacacaccactccacgtagcctcaaaggcagggcagatcttacaggctgagcttctagcggtctatggtgccgacccaggaacccaggattcctctgggaaaactcctgtcgattatgcgcgtcaggggggccaccacgaacttgcagaaaggctcgtggagatacagtatgagctaacagacagacttgctttctacctttgcggccggaagccagatcacaagaacggccagcactttatcattccacagatggcagattcttctcttgatctgtccgagctagcgaaagcagctaagaagaaattgcagtctctgtccaaccacctgttcgaggagctggccatggacgtttacgatgaagttgaccgtagggagactgacgcagtctggctggccacccagaatcactcggccttggttacagagacaacagtagttccgtttttgcccgtgaatccagagtactccagcacacggaaccagggcaggcagaaactggctcgcttcaacgcccatgagttcgctaccctggtgatcgacatcctgagcgatgctaagaggcggcagcaaggtagctccctttccggctcgaaggataacgtcgagctgatcttaaagactattaacaatcagcactccgtggaatcccaggacaacgatcaacctgattacgactccgtcgcctctgacgaagatacagacctggagacgactgcttccaagacaaatcgacagaaaagtctggactcagaccttagtgatggccccgttaccgtccaggagttcatggaagttaagaacgctctggtggcctccgaagccaaaatacagcagctcatgaaagttaataataatctgtctgatgaacttagaataatgcagaagaaacttctgggcaaggatgctaactag

SEQ ID NO: 19244 - DNA, 1896 bp, Artificial Sequence
  Description of Artificial Sequence: Synthetic coding sequence
atgagcaagcggctgcggagcagcgaggtgtgcgccgactgcagcgggcccgacccctcatgggcatctgtcaacaggggaacattcctgtgcgacgagtgttgttcagtgcaccgatcactaggaagacacatatctcaggtgaggcatctgaagcacacaccttggcccccgacacttttgcagatggtggaaacgctctacaacaacggtgcaaatagtatttgggaacattccctattggacccggcctcaataatgtcaggaaggcggaaagcaaatccccaggataaagtgcaccctaacaaagccgagttcattcgggccaaatatcagatgctggctttcgttcaccggttgccctgccgcgacgatgactctgtcacagccaaagacctttctaaacagctccactcctctgtccggaccggtaaccttgagacctgcctgagactgctaagcctgggcgctcaggctaacttttttcatccagagaaaggaaatacccctctacacgttgcatctaaggcaggccagattctgcaggctgaacttctggcggtgtatggcgctgaccccggaacacaggattctagcggtaaaactcctgtggactacgcccgccaaggtggccaccacgagctggctgaaaggctggttgagatccagtacgaactaacagaccgactcgctttttatctgtgtggtcggaaacctgatcacaaaaacggacaacactttattatcccacagatggccgactcttcgctagacctgagcgaacttgcaaaggctgccaaaaaaaagctgcagtcgctgtccaaccatctgttcgaagagttggccatggatgtatacgacgaggtggatcggcgcgaaacagatgcggtctggctggcaacgcagaaccattccgccctcgtcacagagacgacagtcgtgccatttcttcccgtgaatccagaatactcatccacaaggaaccaaggccgccagaagctggcccgctttaatgcgcatgagtttgctacactggtgatcgatattctgagtgatgctaagcgccgccagcagggatcttctctgtcaggctccaaggataacgtggagctgattctcaagactattaacaaccaacatagcgtcgaatcccaggacaatgaccagccggactacgactctgtcgctagcgatgaggacacggatctcgaaacgacagcctccaagacaaaccggcagaaaagcctcgattccgacctgtctgatgggcctgtcacagtgcaggaatttatggaggtaaagaacgcactagtggcctctgaagctaagattcagcagctaatgaaggcaagtcgcttagagaaacagaattcaacccccgagagtgactacgacaacaccccaaacgacatggaaccagacggaatgggaagcagccggaagggccgccagcggtctatggtgtggccgggggacggcttagtgccagacacagcggagccgcatgtcgctccttctcccacactgccaagcactgaggatgtgatacgtaagaccgagcaaattaccaaaaatattcaggaattgttgcgcgccgcccaggaaaacaaacacgacagttacattccgtgttctgagagaattcacgtagctgtaacggagatggcagctttgtttccaaaaaaaccgaagtctgatatggtgaggacctctctccggctccttacatctagtgcatatcgcttgcagagtgagtgcaaaaaaacactcccaggcgatccgggcagcccgacagacgtgcagttggtgacacagcaagttatccagtgcgcttacgatatcgctaaagctgccaagcagctggttaccataacaacaaaagagaataacaattag

SEQ ID NO: 19245 - DNA, 1233 bp, Artificial Sequence
  Description of Artificial Sequence: Synthetic coding sequence
atgagcctggtggacctgggcaagcggctgctggaggccgcccggaaagggcaggatgacgaggtgagaaccctgatggctaacggggcccctttcactacggactggcttggcacatctcccctgcatctagctgcccagtatggacattactcgaccgccgaggtgcttctcagggccggcgtaagccgggacgcgcggactaaagtcgaccggacccccttacacatggctgctgccgatggccatgcccacattgtcgagctgctagtgcgcaacggagcggatgtaaatgcaaaagacatgttgaagatgaccgccctgcactgggcgactgaacgccaccatagggatgttgttgaacttcttatcaaatatggcgccgatgtgcacgcctttagtaagttcgacaagtctgcctttgacattgctctggagaaaaacaatgccgagattcttgtgattcttcaggaggccatgcagaatcaggtgaacgtcaacccagagcgcgccaacccagtgaccgatccggtcagcatggccgcaccgtttattttcacctctggcgaggtcgtgaacctggcgagtctgatttcgagcacaaacaccaagacaacatccgcgaacactgaagagatcatcgagggaaattcggtggatagcagcatccagcaggtgatgggcagcggtgggcaaagagtgattaccatcgtcacagacggagtcccactgggtaacatccagaccagtatcccgaccggaggaatcggtcaaccctttattgtaacagtgcaggatggtcagcaggtgctgaccgtgccggccggtaaggtggccgaagagaccgttatcaaggaagaagaggaagaaaagttacccttgacgaagaagccccgcatcggagaaaaaactaattcagtcgaagaaagcaaagaggggaacgagagagagctgctgcaacagcagcttcaggaagcgaataggagagcacaggaatatcgccatcaactcctgaagaaggagcaggaagccgagcagtatcggcttaagttggaagccatagcgcggcaacagccaaacggcgttgacttcaccatggtggaggaggtggccgaagttgatgccgtcgtagtgaccgagggagagctggaagagcgagaaaccaaagttaccgggtccgctgggacgaccgagccccacaccagagtttcaatggccaccgtgagctcgtag

SEQ ID NO: 19246 - DNA, 1233 bp, Artificial Sequence
  Description of Artificial Sequence: Synthetic coding sequence
atgagcctggtggacctgggcaagcggctgctggaggccgcccggaagggccaggatgacgaggtccggacgctcatggcaaatggagctccttttaccacggattggctgggtacaagccccctccacctagccgcccagtatgggcattactctacagccgaagtgctccttagggcaggagtgagccgtgacgcacgcactaaggtcgatcgaactccgctgcacatggctgctgctgacggacacgcccacattgtggaattgctggtgagaaacggtgctgatgtcaacgccaaagacatgctgaagatgacagccctacactgggcgaccgagcgacaccatcgggatgtggtggaactactgattaaatacggcgccgatgtgcatgccttctccaaattcgataagtccgctttcgatattgccctcgagaagaacaacgcagagatcttggtgattctgcaggaagcaatgcagaaccaggtgaacgtcaaccctgaacgagcaaatccggtgactgaccccgtctccatggcagctccattcatctttacttctggtgaggtggtcaatctggcgtctctcatttcaagtacaaataccaagaccacgtccgcaaacactgaagaaatcatagagggaaattccgtggactcctccattcagcaggttatgggcagtgggggccaacgcgttattactattgtcactgacggggttccattgggcaacatacagacatccattcctactggaggcattggacagcccttcattgtgacagttcaggacggccagcaggtgctgacagtgccggcaggcaaagtcgccgaggagacggttataaaggaagaagaggaagagaaactgccactgactaaaaagccacgaatcggcgaaaagactaactcagtggaagagtcaaaggaaggaaacgaacgcgagctactgcagcagcagctgcaggaggcaaatcgtcgcgctcaggagtaccggcaccagctgctgaagaaggagcaggaagccgagcagtatcgcctgaagctggaagccatagcaagacaacagccgaatggggtggatttcactatggtggaggaagtcgccgaggtggacgctgtggtggtgaccgaaggtgagctcgaggaaagggagacaaaggtgactgggtccgcaggtacaacagaaccccacacccgggtgtccatggcaacagtctcttcctag

SEQ ID NO: 19247 - DNA, 1347 bp, Artificial Sequence
  Description of Artificial Sequence: Synthetic coding sequence
atgagcctggtggacctgggcaagcggctgctggaggccgcccggaaaggccaagacgacgaagtgcggaccctgatggccaatggtgcgcccttcaccacagactggctgggcacttcccctctgcatctcgctgctcagtacggccactatagtacagctgaagttctgcttagagctggcgtgtcaagggacgcccgtactaaggtcgatcgtacaccgctgcacatggcagcagctgacgggcacgctcacatcgttgagttgttggtacgcaacggggcagatgtgaacgccaaagacatgctgaagatgaccgccttacattgggccactgagaggcatcacagggacgtagttgagctgctgattaagtacggggctgacgtccatgccttttctaagtttgacaagagtgcctttgacattgccctagaaaagaataacgcagagatcctcgtgatactgcaggaagcaatgcagaaccaggtgaatgtgaacccagagcgcgcgaaccccgtgaccgaccccgtgtccatggcagcaccatttatctttacctctggcgaagtggttaatcttgcctccctgattagctccaccaacaccaaaactacatcaggcgaccctcacgcatccaccgtgcagttttccaacagtacaacaagcgtgctcgccaccctggccgctttggctgaagcatccgtgcccctttccaattcccaccgtgcgactgccaatacagaagaaattatcgagggcaacagtgttgacagtagcatacagcaggtgatgggatcaggggggcagagggttatcactatcgtgacagatggagtacccctgggaaatattcagacttccattccaaccggcggcatcggccaacctttcatcgtgaccgtacaagacggacaacaggttctcacggtgccagccggaaaagtggcggaagaaaccgtgatcaaggaggaagaggaagagaagctgcctctgacgaagaaaccccggataggcgagaagactaactcagttgaagagtccaaggaaggaaacgagcgcgagctgctacagcagcaattgcaggaggccaatcgtcgcgctcaggaataccggcatcagctgcttaagaaagagcaggaagccgaacaatatcggctcaagctcgaggccatcgctcgacagcaacctaacggggttgacttcaccatggtcgaggaggtcgcagaggtggatgccgtggtcgttaccgagggagaattagaggaaagagaaaccaaagtgaccggttcagccggtactacggagccacatactcgcgtgagtatggccactgtgtcaagttag

SEQ ID NO: 19248 - DNA, 1188 bp, Artificial Sequence
  Description of Artificial Sequence: Synthetic coding sequence
atgagcctggtggacctgggcaagcggctgctggaggccgcccggaagggacaggacgatgaagtgagaactctaatggctaacggcgcacctttcaccacggactggttttcaaaacttagggtgtcctgcggatacataggggacaactgtaagttgggcacctcccctctgcatcttgcagcacagtatggacactattccaccgcagaggttctgttgagggccggggtctctagggacgcacgcacaaaagtcgatcgcactcctctgcacatggccgccgccgatgggcacgctcatatcgtcgaactgctggttcgaaacggtgccgatgtcaatgctaaggacatgctgaagatgaccgctctgcactgggctactgaacgtcaccatagggatgtggtagaactcctgataaaatatggggccgatgtgcacgcgttttccaaattcgacaagtccgcatttgacatcgcccttgagaaaaacaacgccgagatcctggtgatcttgcaggaggccatgcagaaccaggtgaacgtgaaccccgaacgggccaacccggtgactgaccctgtttccatggccgcaccattcatttttactagtggtgaggtagtgaacctggcaagccttatttcatctaccaatactaagacaacgtccggcgaccctcatgcatccactgtgcagttctcaaatagcacaacttccgtactagcaaccctggccgccctagctgaggccagtgtccccctgagtaatagccatcgtgccacagccaacaccgaggagacagtaattaaggaggaggaagaagaaaaacttccactgaccaaaaaacctaggatcggcgaaaaaacgaactcggtcgaggaaagcaaagagggcaatgagcgcgaacttctccagcagcagctccaagaggcaaatcggagagcccaggagtacagacatcagctcctcaaaaaagagcaggaggccgaacagtacagacttaaactcgaagcgatcgctagacaacagccgaacggtgtagacttcacaatggtcgaggaggtggccgaagtggacgctgtcgtcgttaccgaaggcgaattagaagagcgggagactaaggtcactggtagtgccggcacaactgagccacacacacgcgttagcatggcaaccgtatccagttag

SEQ ID NO: 19249 - DNA, 1827 bp, Artificial Sequence
  Description of Artificial Sequence: Synthetic coding sequence
atgaccgaggaggcctgccggacccggagccagaagcgggccctggagcgagaccccaccgaggatgatgtggagtctaaaaagataaagatggaaagagggctgttagcttcagacttgaacactgacggcgatatgcgagtcacaccagaaccaggcgccgggccaacccaaggcttgctgcgggccacagaggccaccgctatggccatgggtcgtggcgaaggcctggtgggagatggccctgtggacatgcgtacctcccactctgacatgaagtcagaacgccggcctccctcacctgacgtgatagttctgtctgacaatgagcagccctcctcaccaagggtcaacggactcacaacggtcgccctgaaagagacctccaccgaagcattgatgaagagctccccggaggagagagagcgcatgatcaagcagctcaaggaagaactgagactggaggaagcaaagctggtgcttctgaaaaaactgcggcagtctcagatacagaaggaggccaccgctcaaaaaccaaccggttccgtagggtcaactgtgaccacacctccgccactggtgcgcggaacacaaaatataccagccggcaaaccatccttgcagacatcttcagcaaggatgcccggctctgtgatacccccccctttggtgagagggggccaacaggcctcttcaaagctggggccccaagcctcgtcgcaagtcgtgatgcctcctttggttcgaggtgcgcagcagatccacagcattaggcaacatagcagtacgggccccccccctctgctcctcgccccccgagcctccgtgcctagtgtgcagatacaggggcagagaattatccagcagggcctgatccgagtggcaaacgtgcccaacacatctctcctcgtgaacattccacagcccacccccgccagcttgaaagggactaccgctaccagcgctcaggctaactcaactcctacctccgtggcgtccgttgtcaccagtgccgaatctccggcaagtcgacaggccgccgctaagttagctttgcgcaaacagctggagaaaacattgctcgagatacctccaccaaaacctccagcacctgaaatgaactttctgcctagtgccgccaataacgaatttatttatttggttggcttggaggaagtggtacaaaacctgctcgaaacacaaggccggatgtctgcagccactgttctgtctagggagccatacatgtgcgctcagtgtaaaaccgactttacttgtcggtggcgggaagagaagagcggtgctataatgtgcgagaactgcatgactacaaaccagaagaaagctctcaaggtggagcacacatcgcgtctgaaagcggcattcgttaaagcgttgcaacaggaacaggaaatcgagcagaggctcctgcagcaaggcacagcgccagcacaggctaaggccgagccgaccgccgctccccaccccgttctcaaacaagcatcatctcagctgagtcgtggatcagctactacacccaggggggtcttgcacacattctctcccagtcccaagctgcaaaactccgcctctgccacagccctagtctcccgaactggtaggcacagtgagcggaccgtgagcgcaggtaaaggtagcgcaaccagtaactggaaaaagactccgcttagtacaggaggcactctggctttcgtgtccccctccctggcagtccataaatcatcttccgcagtggatagacagagagagtacctcctagacatgatcccaccaagaagcattcctcaaagcgctacatggaaatag

SEQ ID NO: 19250 - DNA, 1902 bp, Artificial Sequence
  Description of Artificial Sequence: Synthetic coding sequence
atgaccgaggaggcctgccggacccggagccagaagcgggccctggagcgggacccaaccgaagacgacgtagagtctaaaaaaataaagatggaaagaggcctcctagcttctgatctcaacactgatggagacatgcgtgtcacacctgagccgggtgctggtcccactcagggcctgctacgggcgactgaggccaccgccatggccatggggcgcggtgaaggcctagtgggggacggacctgtggatatgcgtacatctcactccgacatgaaatccgaaaggcgacctccttccccagatgtgattgtgctcagcgataatgaacaaccttcatccccccgcgtgaacgggttgactacggtcgctctgaaggagacaagtacagaagcactcatgaagagcagccctgaggaacgcgaacgaatgataaaacaactgaaggaagagcttcgcttagaagaagccaaattggttttattgaagaagctgcggcagagccagatccagaaggaggctactgcccaaaaacccaccgggtcagttgggtctacagtcaccacccccccccccctcgtgaggggcactcagaacatcccagctggaaagccaagcctgcagacgtccagtgcgcgtatgcctggttccgtaatccctccacctctggttcgcggagggcagcaggccagcagtaaactgggacctcaggcttcctcccaggtcgtgatgcccccactcgttcgaggagcccagcagattcatagtattcgtcagcattcaagcacaggtccccctcctctgctactggcccctagagccagtgtaccctctgtccagatccagggtcagagaataatccagcaggggctgatccgggtggccaatgtacctaacaccagtctccttgtcaacataccccaacctacccccgctagtttaaagggtacgacggcaacctcagcacaggcgaacagcacccctacttctgtggcgagcgttgtgacatccgccgagagcccggcatccagacaagctgctgcaaaactggcactgcggaagcagctcgaaaagacgctgctggagatcccaccgccaaaaccgcccgccccggaaatgaacttcttgcctagcgccgcgaataatgagttcatctacttagtagggctggaggaagttgtgcaaaacttactggaaacgcagggccggatgagcgcggccaccgtgctgtctagagagccctatatgtgtgctcaatgtaagaccgattttacctgcagatggagggaggagaagtctggagctattatgtgtgaaaactgtatgaccacaaaccagaagaaagccctgaaggttgaacatacatctaggctaaaggctgcattcgtgaaagccctgcagcaggaacaggagattgagcagaggctccttcaacaggggaccgctccggcgcaggccaaggccgaacccactgctgctcctcatcctgtgcttaaacaggtgattaaaccaaggcgaaaactcgcctttcgttcaggagaggcaagagactggagtaacggagctgttctccaagcctccagccaattgtctcgggggagcgcgactacccctcggggtgttcttcacaccttctcgccctcccctaagttgcagaatagtgcgagtgccacggctctcgtgtcaaggaccggacggcatagtgagaggaccgtgagcgcagggaaggggagtgcaacttctaattggaaaaaaacgccgctgtcaacgggagggactctcgcattcgtgtctccctctcttgcagtgcacaagagtagcagcgctgtggaccgccagcgcgagtatctgcttgacatgattcctccccgtagtatcccgcagagtgccacttggaaatag

SEQ ID NO: 19251 - DNA, 1902 bp, Artificial Sequence
  Description of Artificial Sequence: Synthetic coding sequence
atgaccgaggaggcctgccggacccggagccagaagcgggccctggagcgagatcccaccgaagacgacgtcgagtcaaaaaagataaaaatggagaggggtttgctcgcctctgacttaaacacagacggcgacatgagggtcacgcccgagcctggagccggacccacgcaaggcttactgcgtgccaccgaagcaacagctatggcgatgggtaggggcgagggactggtgggggatggtcccgttgacatgagaacctcacacagtgatatgaagtcagagagacggccacctagccctgatgtgatagtcctatcagacaacgaacagcccagctcccctagagttaatggccttacaaccgtagccctgaaggagacaagcactgaggccctgatgaagagctcgcctgaagagagagagcgcatgattaaacagctgaaggaagaattgcgcttggaagaggccaaactcgtgctgttaaaaaaactgaggcagtctcaaattcagaaggaggccacagcacagaagcctacaggcagcgtgggttctacagtaaccacacctcctcccctggtacgaggcactcaaaatattccagcagggaaaccatcattgcagacatcatctgctcgaatgcctggctcagtgattccgcctccgttggtgcggggcgggcaacaggcctcttctaagctggggccccaagcctccagtcaggtcgtcatgccaccgttggtgcgcggtgcacagcagatccactcaatccgccagcactcatcaaccgggcccccgccactcttactagcgccccgagcctccgtgcctagcgtgcagattcagggccaaaggattatccagcaaggcctcattcgggtggctaatgtcccgaataccagcctgttagtgaacataccacagcccactcccgcatctctaaaaggcacaaccgccacttccgcccaggccaattccactccaaccagcgtggcgagtgttgtgaccagtgcagagtccccagctagccggcaggctgccgccaaacttgctctgcgaaagcagctcgagaaaacactgctggagatccccccccctaaaccccccgctcccgaaatgaattttcttccttcggccgccaacaatgagttcatctacctggtcggcctggaggaagtggtccagaaccttctcgaaacacaggggaggatgagtgcagctaccgtgctctcacgggagccatatatgtgtgctcaatgtaagacggatttcacatgcaggtggagggaggagaagtcaggggccattatgtgcgagaactgtatgacaacaaatcagaaaaaggcactgaaggtagagcacactagccggctcaaggcagctttcgtgaaggccctgcagcaagagcaggagattgaacagaggctcctgcagcaggggacagcccctgcacaggccaaggccgagcccactgccgcccctcaccccgttctgaaacaggtgataaaacctagaaggaaattggcatttcgcagcggcgaggctagagactggagtaacggagctgtcctgcaggcaagcagccagctctctagggggtctgcgaccactcctcgaggcgtgctgcatacattctctccatccccaaaactgcaaaactctgcttccgctaccgcgcttgtgtcccggactggtaggcacagcgaacgcaccgtatccgcagggaagggatccgcgacctcaaactggaagaagacccctctgagcaccggcggcaccctggccttcgtgtccccgtcgctggccgtccataaatcaagctcagccgtggacagacagcgggagtatttactggacatgatccctccaaggagtatccctcagtccgccacctggaaatag

SEQ ID NO: 19252 - DNA, 534 bp, Artificial Sequence
  Description of Artificial Sequence: Synthetic coding sequence
atgaccgaggaggcctgccggacccggagccagaagcgggccctggagcgggatccaacagaggacgacgtcgaatctaagaaaattaaaatggaacgcggactgttggctagtgacttaaataccgacggcgatatgcgggtgacccctgagcccggagccggacctacccaaggcttattgagagccactgaggcgactgcaatggcaatgggtcgcggggagggtttggttggggacggccccgttgatatgcggacttcccattcggatatgaagagcgaaagacgaccgcctagccctgatgtgattgtgcttagtgacaatgagcaacctagttccccccgagttaacgggctcacaacagtcgctctgaaagaaaccagtacagaggctttgatgaagtcatcccctgaagagcgggaacggatgatcaaacaactgaaggaggagttacggttggaggaagcaaagctggtgcttctgaaaaagcttcggcagtcccagatccagaaggaggcaactgcacagtag

SEQ ID NO: 19253 - DNA, 381 bp, Artificial Sequence
  Description of Artificial Sequence: Synthetic coding sequence
atgaccgaggaggcctgccggacccggagccagaagcgggccctggaacgagatcccactgaagacgacgttgagtcaaagaaaataaagatggagagaggcctgttagcctccgatctgaacacagacggcgatatgagagttaccccagaaccaggcgccggaccgactcagggactcctgagagccacagaggccactgctatggccatggggcgaggtgagggtctggtgggtgacggccccgtggacatgcgtactagtcattcagacatgaaatcggagagacggccaccttccccggacgtgattgtgctgtctgacaatgagcagccttctagcccacgggtcaatggcctcaccaccgtggctctgaagtag

SEQ ID NO: 19254 - DNA, 1311 bp, Artificial Sequence
  Description of Artificial Sequence: Synthetic coding sequence
atgatcaagcagctgaaggaggagctgcggctggaggaggccaagctggtcctgctcaaaaagcttcgtcagagccagattcagaaagaagcgacagctcagaaaacttcgagtgcacggatgcctgggagcgtgatcccgccgccactggttcggggtggacaacaagcctcctccaagctcggcccccaggcaagctctcaggtcgtcatgccccctttggtgagaggcgctcagcagatccactcgatacgccagcatagctcaacaggtccccccccacttcttctggcaccgagagcctccgtaccttccgtgcagatacagggacagcgaattattcaacagggcttgattcgggtggcgaatgtgcctaataccagtcttcttgttaatataccccaacctaccccagcctctctgaaaggaacaactgccacatccgcacaagccaattccacccccactagtgtggcaagtgttgttaccagtgctgagtccccagccagccggcaggcagccgcaaagctcgctttgcgcaagcagttagaaaaaacactgcttgagatacccccaccaaagccccccgcacccgagatgaattttttaccaagcgctgcgaacaatgagtttatttatctggtgggtttagaggaggtcgttcagaaccttcttgagacgcaagctggacgaatgagcgcagctacggtcctgtcccgtgaaccttacatgtgtgcacagtgtaaaaccgacttcacctgtagatggcgggaagagaagtctggcgctatcatgtgtgaaaattgcatgactaccaatcaaaaaaaagcattgaaggtcgaacacaccagccgcttgaaagctgcctttgttaaggcacttcagcaggagcaagagatcgaacagcggctgttgcagcagggcacagctccagcccaggccaaagccgagccaactgcagcacctcatccggtactaaaacaggcttcaagccagctgtcccggggctctgcaacaacacctcgcggggttctccacacttttagcccgtcccctaagctgcaaaattcggccagcgctaccgcactcgtctcccgaaccggcagacacagcgaacgtacagtttctgctggaaagggatccgctaccagcaattggaaaaagactccactgtctaccggcggaacattggccttcgtctctccctcactggcagtgcataagtcctcctctgctgttgaccgtcagagggaatatctgttggatatgatccccccccgctccataccacagtccgccacttggaaatag

SEQ ID NO: 19255 - DNA, 420 bp, Artificial Sequence
  Description of Artificial Sequence: Synthetic coding sequence
atgaccgaggaggcctgccggacccggagccagaagcgggccctggagcgagaccccaccgaagatgacgtggaaagtaaaaaaattaagatggagcgggggctccttgccagcgacctgaacacagatggtgacatgagagttaccccagaacctggcgccggacctacccagggcctgctgcgagcaaccgaagcaactgccatggcaatgggccgcggggagggcttagtgggcgatggtcccgtggatatgaggacaagtcattctgacatgaagagtgaacggcggccaccttctccagacgttatcgttctgagcgataacgagcaaccttcatcccctagggtgaatggactgactaccgttgcccttaaggaaacctctaccgaggctctcatgaaatccagccccgagtag

SEQ ID NO: 19256 - DNA, 282 bp, Artificial Sequence
  Description of Artificial Sequence: Synthetic coding sequence
atgaccgaggaggcctgccggacccggagccagaagcgggccctggagcgcgacccaaccgaagatgatgtcgaatctaaaaaaatcaagatggaaagggggctgcttgctagcgatctcaacaccgatggcgacatgcgggtcacccctgagcccggcgctggccctacccaaggtctacttagagcgactgaagcaactgcgatggccatgggacgaggggagggtctggtgggggacggcccggtcgacatgcgcaccagtcattctgacatgaagtag

SEQ ID NO: 19257 - DNA, 57 bp, Artificial Sequence
  Description of Artificial Sequence: Synthetic coding sequence
atgagcctgtggccctggcccaccggccggaccagcaccccctaccctgaggcctag

SEQ ID NO: 19258 - DNA, 507 bp, Artificial Sequence
  Description of Artificial Sequence: Synthetic coding sequence
atgaccgaggaggcctgccggacccggagccagaagcgggccctggaacgcgatccaaccgaagacgacgtggagtctaaaaaaatcaagatggaacgcggcctgttggcatcagacctgaataccgatggcgatatgagagtcacacccgaacccggcgccggtcccacccaggggcttctgcgggccacagaggccacagccatggcaatgggacggggagaaggacttgttggggacgggccggtagacatgagaaccagccatagcgacatgaaatcagaaagacgtccgcccagccctgacgtcattgtgttgtcggataacgagcaaccgtctagccctcgggttaatgggctcaccactgtggcattgaaagaaacatcaacagaggcacttatgaaaagtagccccgaggagagggaaagaatgatcaagcagttaaaggaggagctgcgacttgaggaggccaaactggtgctgctgaagaagttgcgccaatcatag

SEQ ID NO: 19259 - DNA, 789 bp, Artificial Sequence
  Description of Artificial Sequence: Synthetic coding sequence
atgaacttcctgcccagcgccgccaacaacgagttcatctacctggtgggccttgaggaggttgtgcagaatctgctggaaactcaagccggaaggatgagcgcggcaacagtcttgtccagggaaccgtacatgtgcgcacagtgtaagaccgacttcacatgcagatggcgtgaggagaagagtggggccatcatgtgcgaaaactgcatgacaacaaatcagaaaaaagccctgaaggtcgagcacacctcccgcctgaaggccgcctttgtcaaagccttacagcaagagcaggagatcgaacagagacttctgcaacaggggacagccccggctcaggctaaagcggagccaaccgccgctcctcatccagttctgaagcaggtgatcaagccccggcgaaagctggcttttaggtcaggggaggctagagattggtctaacggcgcagtccttcaggcatcctcccaactgtcccgaggttctgccactacccctcggggcgtgctgcacacattttccccttcccctaagcttcagaatagcgccagcgccaccgctctggtgagtcgtaccggccggcattctgagcgcacagttagtgctggcaagggctctgcgacttcaaattggaaaaaaacccccctgagcaccggaggcacgcttgcctttgtgagtccctctctagcggttcacaagtcatctagtgcagtagaccgccagcgggaatatctccttgacatgattccacctcgaagcatcccgcagtcggccacctggaagtag

SEQ ID NO: 19260 - DNA, 1782 bp, Artificial Sequence
  Description of Artificial Sequence: Synthetic coding sequence
atggaccggatgaccgaggacgccctgcggctgaacctgctgaagagaagtctagatcctgctgacgaacgagatgatgtccttgccaagagactgaagatggaggggcacgaagccatggaacgcctgaaaatgttagcactgctcaaacgcaaagatttagctaacttagaggtgccccatgaactgcccactaagcaggatggttccggcgttaagggctacgaagaaaaactgaatgggaacctgcggccccacggggataacagaactgctgggagacccggaaaagagaacattaatgacgagcccgtcgatatgagcgctaggagatccgagccagagcgcggccgccttacccctagtccagacatcattgtactctcagacaacgaagcatcatcaccaagaagtagctcacgtatggaagaaagacttaaggcagccaacctggagatgttcaaagggaaaggaattgaagaacgacaacagctcatcaagcagctgcgggatgagctgaggctcgaggaagcacggttagtgctcctgaaaaagctaaggcagtcccagcttcagaaagaaaacgtcgtacagaaaacccccgttgtccagaacgccgcttcgatagtccaacctagcccggcgcacgtcgggcagcagggattatctaagcttccaagcaggcccggggctcagggagtggagccacagaatctgagaacgctccaaggccattcagtgattagatccgccacgaatacaactcttcctcacatgctgatgagtcagagagtgatagcacccaacccggctcaactgcaaggacaaaggggccctcccaagccgggcttagtgaggacaacaacaccaaatatgaaccccgcgattaactaccaaccccaaagctccagttcagttccatgtcaaaggacaacctcgagcgcaatctacatgaatttagcgtctcacattcagcctggaactgtcaatagggtttcctctccactcccaagtccatccgccatgaccgatgctgctaactcacaagccgctgccaaactggctcttcgaaagcaattagagaaaactttgctggagatcccccccccaaaaccacctgctccactgctgcacttcctcccgtcagccgccaattctgagttcatctatatggtcggcctggaggaagtggtgcaatcagtgatcgactcccaggggaagtcttgcgcaagtctattgagagtggagccatttgtgtgcgcccaatgcagaactgatttcacccctcattggaaacaggaaaaaaatggcaaaatcctgtgtgagcaatgcatgactagcaaccagaaaaaagctctgaaagctgaacacaccaaccgcttgaagaacgcttttgtgaaagcgctgcagcaggaacaggaaatcgaacagagactacagcagcaggccgcattgtctccaacaaccgcaccagccgtgtcatcggttagcaagcaggagacaattatgagacaccacacgctaaggcaggccccccagccacagtccagtcttcaaagaggaatcccgacaagtgccagaagcatgctgagcaattttgctcaagcgccgcaattatctgtgccaggcgggctgctgggtatgccaggagttaacatagcttacctcaatactgggattggagggcacaaagggccatctctcgctgatcggcagcgggagtacctacttgatatgattccgccacggtcgatttcccagtctatcagcgggcagaagtag

SEQ ID NO: 19261 - DNA, 1425 bp, Artificial Sequence
  Description of Artificial Sequence: Synthetic coding sequence
atggcccagcacgacttcgtgcccgcctggctgaacttcagcaccccacagtcagccaagtctcctactgccactttcgagaagcatggcgagcatctccctcgaggtgagggtagattcggggtaagccgccggcgtcataactcatccgatgggttcttcaataacgggccgttaagaacagccggagacagctggcatcagccgtccctgttcagacacgattcagtcgactctggagttagtaagggagcttatgcaggcatcaccggaaacccgtcgggctggcactctagctcccggggacatgatgggatgtcccagcgatcaggggggggtacgggaaaccatagacactggaacggctcatttcatagccggaagggctgtgcgtttcaggagaaaccccccatggaaatcagagaggagaagaaagaagataaggtagagaaactgcagttcgaggaggaggatttcccttcactgaaccctgaggctggcaagcagcatcagccctgtcggccgatcggtactccctccggagtctgggagaatccaccatctgcaaaacagccttccaagatgttggtgattaagaaggtgagtaaagaagacccggccgccgctttcagcgcagcattcacgagccctggttcacatcatgctaatggaaacaagctgtcaagtgtggtgcctagtgtttacaaaaacttggtcccaaaacccgtcccccccccaagtaagcctaacgcgtggaaggccaaccgcatggagcacaagagtgggtcactgtcttccagtagggagtctgcatttaccagcccaatttcagtgactaaacccgttgtgctggccagcggagccgccctgagctcacccaaggagagtccatccagtactaccccacctattgagatctcatcaagtagattaaccaagctgacgcggaggacaactgatcgcaaatccgaattccttaaaacactgaaggatgaccgcaacggcgacttctctgaaaaccgagattgcgacaagcttgaggatctcgaggataattctacacctgagccgaaggagaatggcgaggagggctgtcatcagaacgggctcgccttacccgttgtcgaagagggtgaagtcctctcccactcccttgaggctgagcatcgcctcctgaaggcgatggggtggcaggagtatccggaaaacgacgaaaattgcctgcccttgactgaggacgagctgaaggagtttcatatgaagaccgagcagctccgtaggaatggtttcgggaagaatggtttcttgcagtccaggtcgtcatctctgttctccccttggcggtctacatgtaaagccgagttcgaggattccgacaccgagacatcctccagcgagacaagtgatgacgatgcatggaagtag

SEQ ID NO: 19262 - DNA, 1425 bp, Artificial Sequence
  Description of Artificial Sequence: Synthetic coding sequence
atggcccagcacgacttcgtgcccgcctggctgaacttcagcaccccccagtctgcgaaaagccctaccgccacattcgagaagcacggagaacatctgccgagaggcgaagggaggtttggggtgagccgaaggagacacaattctagcgatggcttcttcaacaacggcccgctcagaactgccggagatagctggcatcagcctagtttgtttcgccacgacagtgtcgattcaggggtgtcgaaaggggcgtacgcaggaatcacgggaaacccttctggatggcatagtagctctagggggcatgatggcatgtcccagcgctctgggggaggaacaggtaatcaccgacattggaatggatcctttcattcccgcaaggggtgcgcattccaggaaaagcctcctatggaaataagggaagagaagaaggaggacaaagtcgagaaactccagtttgaagaggaggacttcccatctctgaacccggaagccgggaagcaacatcagccctgccgacccatcggcacaccatcaggcgtgtgggagaaccccccttcagctaaacagccttctaagatgctggttattaagaaggtgtcaaaggaggaccctgccgccgccttttccgcggccttcacatcacctggatctcatcacgccaatggtaataaattaagctctgtggtcccatcagtttacaaaaacctggtgccgaagcctgtccccccaccaagtaagccaaacgcatggaaggcgaaccgtatggagcacaagtccggttcgttgagctccagtcgcgaaagcgccttcacatcacctatctccgttaccaaacccgtggttctagcctctggggccgcattgtcgtcgccaaaagagagcccctcctccacaactcccccaattgaaataagctctagtcgtttgactaaactgacccggcggactaccgacaggaaatccgagtttctgaagacattaaaagatgataggaatggcgactttagcgaaaacagagattgcgataagctcgaggatttggaggacaactcaactcctgagccgaaagagaacggagaggagggctgccatcagaacgggctggccttgcccgtggtggaagagggagaggttctcagccattctctggaagccgagcaccggttactgaaagccatgggctggcaggaataccctgagaacgacgagaattgcctgcccctgactgaggacgaactcaaggaattccacatgaagaccgaacagttgagacgaaatggctttgggaagaatggattcctgcagagccgcagcagcagtctgttcagcccttggcggagtacatgcaaggcagagttcgaggattccgacactgagacaagctcctctgaaacctcagatgatgacgcctggaagtag

SEQ ID NO: 19263 - DNA, 2448 bp, Artificial Sequence
  Description of Artificial Sequence: Synthetic coding sequence
atgttccggaaggcccggcgggtgaacgtgcggaagcggaacgacagtgaggaggaggagagagagagagatgaagagcaggagccaccacccctgctccctccgccgggcactggcgaggaggccggacccggcggcggcgatagagctcctggaggagagtcattgcttgggcctggcccttccccgccaagtgctcttacacccgggctcggcgctgaagccggtgggggattccctggcggagccgaaccgggaaatggcttaaaaccacgcaaacgacctagggaaaataaggaggttccaagggccagcttactgtccttccaggatgaagaagaggagaatgaggaggtctttaaggttaaaaaaagcagttacagtaagaagatcgtgaagctcctcaagaaagaatacaaggaggaccttgaaaagagtaaaatcaaaaccgaacttaacagcagtgccgagtcggagcagccactggataaaactggacacgtaaaagacactaaccaggaagacggtgtcattatctcagaacatggcgaagatgagatggatatggaatcggaaaaggaggaagagaaacccaagacaggtggagcattcagcaacgccttgtctagtttgaatgtccttcgccccggcgagatccccgacgctgcatttattcatgccgcacgaaagaaacgccagatggcacgagagttgggcgactttactcctcacgataatgaacccggtaagggtcggctggtcagggaggatgaaaacgacgcctctgacgatgaggatgacgacgaaaaacggagaatcgtgttctctgtcaaggaaaagagtcagcggcagaaaatcgcagaggagatcggaattgagggatcagacgacgacgctctggttactggtgagcaggacgaagagctcagccgatgggaacaggagcagatccgtaaaggcataaacataccccaggtccaggctagccaacccgctgaagtgaatatgtattaccaaaacacgtatcagacaatgccctatggctcatcctacggaattccttactcttacaccgcgtatggctcaagcgatgccaagtctcagaagaccgacaatacagtcccctttaagacccccagcaatgagatgaccccagtaacaattgatctcgttaagaagcagctgaaggatagacttgacagtatgaaggaactccataaaactaaccggcaacagcacgaaaagcaccttcagagtcgcgtcgatagcacaagagctattgaaagacttgaaggatcaagcggtggaattggtgagagatataagtttctgcaagagatgcgcggctatgtacaggatctgctcgaatgcttcagtgagaaggtccccttgatcaacgagctggaaagtgctatccatcagctatacaaacagcgcgcttcgcgtctggtccagcgaaggcaggatgacataaaggatgaatccagcgagttttctagccactcgaacaaggctcttatggcccccaatctggacagctttggacgtgacagggccctgtatcaagagcacgctaagagacggatagcagaaagagaagctaggagaacacgccgccgtcaggcccgagaacaaactgggaagatggctgatcacttagaggggcttagttccgacgacgaggagacctcaacagatattaccaattttaacctcgagaaggataggatttctaaagaaagcggtaaagtgttcgaggacgtgttggagagcttttactctatagactgtatcaaaagccagtttgaggcttggcggagcaagtactatacctcttacaaggatgcctacatcgggctctgccttcccaaattgtttaatcccttgattaggttacagcttctgacctggacaccattggaggctaaatgtcgagattttgaaaacatgctgtggttcgagtcgctcctgttctatgggtgcgaggagagagagcaggaaaaggatgatgtcgacgtcgctcttcttcctaccatcgtcgagaaggttatcctcccgaaactcacggtgatcgccgagaacatgtgggacccattttccaccacgcaaacgtcgcggatggtgggtatcacattaaagctgattaatgggtacccctctgtggttaatgccgagaataagaacacccaggtgtacctaaaggctcttttgctgaggatgcgacgcacactagacgatgacgtgttcatgcctctttaccccaagaacgtgctggagaataaaaacagtggaccctatctgttttttcagcgccagttctggtcatccgttaaagtcatcaaacccccgtttcagcgcggcagctgtcctattccccggaggaaggagtgttgcagtgaacggcctagaaggatctggacggatcgcccctgtgttgtcttcagctag

SEQ ID NO: 19264 - DNA, 2754 bp, Artificial Sequence
  Description of Artificial Sequence: Synthetic coding sequence
atgttccggaaggcccggcgggtgaacgtgcggaagcggaacgacagcgaagaggaagagagagagagagatgaggaacaggagccacctcctttgctgccacctcccggtaccggcgaggaagccgggcccggcggcggggaccgtgccccggggggtgagtcacttttggggcctggcccctcccccccctctgctctgactccaggtcttggagccgaggcaggaggtggtttccctggtggggccgaacctggcaacggacttaaacctcgcaagcggcccagagagaacaaagaggttccccgcgcatctcttctgagcttccaagatgaagaagaagaaaatgaggaagtgtttaaagtaaagaaatcatcatattctaagaaaattgtgaagctgctgaagaaagaatataaagaggatctggagaagtctaaaataaagactgagttgaactctagtgccgagtccgagcagccactggacaaaaccggccacgttaaagacaccaaccaagaggacggagttataatcagtgagcatggggaggacgaaatggatatggaaagcgagaaggaggaggagaagcctaagactgggggggcattttccaatgccctgtcttcactgaatgtgctccgccccggcgagatccctgacgcggcatttatccacgcagcacgcaagaagcgtcagatggcccgggaactcggcgatttcacaccccacgataacgagcccggcaagggacgactcgttagagaagacgaaaatgacgcatccgatgatgaagacgacgacgagaaacgccgtatcgttttcagcgtgaaggagaagagccaaagacagaagattgctgaggaaattgggattgaaggcagcgacgacgacgcactcgtcactggcgagcaagatgaggagttgtctagatgggagcaggaacaaatcagaaagggaattaatatcccccaagtgcaggcatctcaacctgctgaggtcaacatgtactatcagaatacctatcaaaccatgccatacggcagctcctacggaatcccgtattcatacactgcttacggctctagcgatgcgaagagccaaaagactgacaacaccgtaccttttaagacaccctccaacgagatgactcccgtcactatcgacctcgttaagaagcagttgaaggataggctggatagcatgaaagagctgcacaagacgaatagacaacagcatgagaaacacttacagtcgcgcgtggattctactagagcaatcgagagattggagggcagctccggagggataggtgagcggtataagttcctgcaggaaatgagaggctacgtacaggacctcctcgaatgtttttcggaaaaagtccctctgatcaatgaactggagtccgccatccaccagctctataaacagcgcgcttccaggctggtgcagcggaggcaagacgacataaaagatgagtcctccgagttctcctcacattccaataaggctctaatggctccgaatctcgatagctttggacgcgatcgggcactgtaccaagagcatgccaaacgcaggatcgcagaacgggaagcccgtaggacccgccggcgtcaggccagggagcagacgggcaaaatggctgaccacctggagggcctttcttcagacgatgaggagaccagtaccgatatcaccaacttcaaccttgaaaaggatcgaatatcaaaagaatccggcaaagtctttgaggatgtgctggagtcattctacagtatagactgtataaagtctcaattcgaggcctggcggagcaagtattacacctcgtacaaagacgcgtacatcggactctgtctgcctaaactgttcaaccctttgattagacttcagctccttacgtggacacccttagaagccaagtgtcgagactttgaaaacatgctttggttcgaatcgctgttattttatgggtgtgaagaacgcgagcaagagaaggacgacgtggacgtggcactcttgcctaccattgtggagaaagtcatcctccccaagctgacagtcatcgcggagaatatgtgggatccatttagtacaacgcagacttcacgcatggtgggcatcaccctcaaactgatcaatggttatccctcagtcgtaaatgcagagaacaaaaacactcaagtgtatttaaaagcactgctcctgaggatgcgcaggaccctggatgacgacgtgttcatgccactgtacccaaagaacgttttagagaacaaaaattcaggaccttatctgttttttcaacggcagttttggagctcagtgaagctacttgggaatttcctacaatggtacggaatatttagcaacaaaacactgcaggaattgagtattgatggcctactgaataggtatattcttatggcctttcagaacagtgaatatggtgatgattccatcaagaaggctcagaatgtgattaactgttttcccaagcagtggttcatgaacctgaaaggtgagaggaccattagccagcttgaaaatttctgtcggtacctcgttcatctcgccgatactatttataggaactcaataggatgtagcgacgtagaaaaacggaatgctagggagaacattaagcaaatcgtgaaacttctggcgtcagtcagagctctagaccacgcgatgtccgtggcaagtgaccataatgtcaaagagttcaagtccctcattgagggaaaatag

SEQ ID NO: 19265 - DNA, 2346 bp, Artificial Sequence
  Description of Artificial Sequence: Synthetic coding sequence
atggcccaccggcccaagcggaccttccggcagcgggccgccgactcttcagattcagatggtgccgaggaatctcccgctgaaccgggggccccccgggagctcccggtgccagggtcggcggaagaagaaccgcctagcggcggcgggcgggcacaagtcgctggactgccacatcgtgtgcgcggacctagagggcgtggccgcgtctgggcctcctctcggcgagccaccaaggctgccccgcgggcagacgagggcagcgagtctaggacccttgacgtaagcacagacgaggaagataaaatccaccactctagcgaatctaaggacgatcaaggtttgtcttcagacagtagctccagcttgggcgaaaaagagttaagttcaaccgtcaaaatccctgacgcagcctttatacaggccgcccgccgcaagagggagttggctagagcacaggatgattatatctcgctggacgtgcaacatacatcttcgatctcagggatgaaaagagaatctgaggacgatcctgaatccgagcctgatgatcatgaaaaaaggatccccttcaccttgagacctcagacgctgagacaaaggatggctgaagaatccatctcacgtaacgaggaaacctcagaggaatcccaggaagatgagaagcaggacacctgggagcaacagcaaatgaggaaggctgtgaagatcattgaggaaagagatattgacctgtcgtgcggtaatggttccagcaaagtgaaaaaatttgatacaagcatctctttcccacccgtaaatttagagatcattaagaagcagctgaatacccgcctcactctcctgcaggagacacataggtcacatcttcgggagtacgagaagtatgtccaggatgtcaaatccagcaaaagcaccatccagaatctagagtcctcttccaatcaggcattgaactgtaaattctataagtcgatgaagatttatgttgagaaccttatcgactgcctgaacgaaaaaatcatcaatatccaggagatcgagagtagcatgcacgcactacttctgaagcaggccatgacttttatgaaacgacggcaggacgaactgaagcacgaaagcacgtatctgcagcaactctctagaaaggatgagacatcaactagcgggaacttttcagtcgacgagaagacccaatggattcttgaagagattgagtcaagaagaactaagaggcggcaagcacgggtgctctcaggcaactgtaatcaccaggaaggaacgtcctctgatgatgagctcccttccgccgagatgatcgacttccagaagtcccaaggcgatatactccaaaaacagaaaaaggtgttcgaagaggttcaggacgacttctgcaatatacagaatatcttgctgaagttccagcaatggagggaaaagtttcctgacagttactacgaagcattcatcagcctgtgtatacctaaactgctgaatcctctcattagggtgcaactgattgactggaatcctctcaaactggagagtaccgggctgaaagagatgccatggtttaagtcagtggaggagtttatggattcatcggtggaggacagtaaaaaagagtcttctagcgacaagaaggtgctgagcgccatcattaacaaaactattattcccaggctgaccgattttgtggaattcctgtgggacccattaagcacttcccaaactaccagcctgatcacccactgccgcgtgattttggaggaacacagcacttgcgagaacgaagtatctaagtctcgacaggatctcctgaaatctatcgtctctcgaatgaaaaaggctgtggaagatgatgtgttcatcccgctatatcccaagtcagccgttgaaaataaaacaagcccgcacagcaagtttcaggaaaggcagttttggtctgggcttaagctatttcgcaacattttactctggaatggactcttaactgacgacactctccaagaattgggtttaggaaagctgctaaaccgttacttgataattgcactgctgaatgcgactcccggtcccgatgtggtcaagaaatgtaaccaggtagcagcctgcctgccagaaaaatggttcgagaatagcgcaatgaggacttcaattccacaattagaaaactttatacagttcctcttgcagtctgctcacaagctcagtcgatcggaatttagagatgaggtagaagagattatcctgattctggtgaagatcaaggctctcaatcaggctgagtcattcattggagagcatcatctggatcacctgaagagtctcatcaaggaagattag

SEQ ID NO: 19266 - DNA, 2232 bp, Artificial Sequence
  Description of Artificial Sequence: Synthetic coding sequence
atggcccaccggcccaagcggaccttccggcagcgggccgccgactcttctgattcggatggtgcagaagagagtcctgcagagccgggagcccctcgagagctgcccgtacccgggagtgccgaagaggaacccccctcaggtggcggcagagctcaggtagcaggactgccacatcgagttcgcggtcctcgcggtaggggcagagtgtgggcatcaagccgacgagctacaaaggctgccccccgagcggacgagggttcagagtcaagaacactggatgtcagtacagatgaggaggacaaaatccaccactccagcgaatccaaggatgatcagggcctgtcatctgattcatcatcttccctgggcgagaaagagctctccagcaccgtcaagatccccgatgctgccttcattcaggccgctaggagaaaaagagaactggctagagctcaggatgactacatctcactggacgtgcagcatacctcatcaataagcgtctccaggaacgaagagacatctgaagagtcgcaggaggacgagaaacaagacacttgggagcaacagcagatgaggaaagcagtgaagatcattgaggaacgtgatattgacctgtcttgtggaaacggcagtagtaaggtgaagaagtttgatacgagcattagcttcccacctgtgaatctcgaaatcatcaaaaaacagttgaacacgaggctgaccttactgcaagagacccacaggagccatctccgagaatacgagaaatacgtccaggatgtgaagagttcaaaatccacaatccagaacctggagtcaagcagcaatcaggccctcaattgtaagttctacaaaagcatgaagatatatgtggaaaacctgattgattgcttgaatgagaaaatcatcaatatccaggagatcgagagcagtatgcacgctctgctgctcaagcaggctatgacatttatgaagagacgacaggacgaacttaaacatgaatcaacatacctccagcagctgtcccggaaggacgagacctcaacctcggggaatttctctgtggatgagaagacccaatggattctggaagagatcgagtcacgtcgaaccaagcggcgccaggctcgggtgctgtcaggcaattgcaaccaccaagaaggaacgtcatcagacgacgagcttccaagcgctgagatgattgactttcaaaagtcacaaggcgatatcctgcagaaacaaaagaaggtctttgaagaagtgcaagacgatttctgcaacatccaaaacatactgttgaaattccagcagtggcgagaaaagttccccgatagctactacgaagccttcataagcctttgcattcctaagctgcttaatccattaatccgggtgcaactcatcgactggaacccactgaaactggagagtaccggtctcaaggagatgccctggtttaaaagtgtggaagagtttatggactccagcgtcgaggattctaaaaaggaatcctcctctgataagaaggtactcagcgccatcattaacaaaactatcattcctagactgactgattttgtcgagttcctgtgggaccctttgagcaccagccagacaactagcttgataacacattgcagagttatattagaagagcattccacgtgcgagaatgaggtcagcaaatctaggcaggatttgctaaagtctattgtttcaaggatgaagaaggcagttgaagatgacgttttcatcccactttaccctaagtccgctgtagagaacaaaacttcaccacactctaagttccaggagagacaattttggtccggcctgaaactcttccgtaacatcctactgtggaatggactcctaacggacgatacactccaagagctagggctggggaagttgctcaacagatatctgatcattgcactgctgaacgccacacctgggcctgatgtggtgaagaagtgtaaccaagtggcagcttgtctgccagaaaaatggtttgagaattctgctatgcgcaccagtatcccgcagctcgagaatttcattcagttcctcctgcagtccgcccacaaactgagtcggagtgaatttagggatgaagtggaggagattatcctgattttggttaagatcaaagccctgaaccaagctgaatctttcattggtgaacatcatttggaccacctcaaatcacttattaaagaggattag

SEQ ID NO: 19267 - DNA, 765 bp, Artificial Sequence
  Description of Artificial Sequence: Synthetic coding sequence
atggcccaccggcccaagcggaccttccggcagcgggccgccgactcaagtgattcagacggggccgaggagagtccagccgaacccggggctcccagggagctgccagttcctggatctgcagaggaggaacctccttcagggggcggacgggctcaggtcgccgggctgccgcatagagttcgtggtccacgcggccggggacgagtctgggcaagtagccggcgcgcaactaaagccgctcctagagccgatgaagggagcgaatccagaacgctcgatgtcagcactgacgaagaagacaaaatccatcactcttctgagagcaaagacgatcagggcctctctagtgatagctctagttccttgggggaaaaggaactttcctctaccgttaaaattcccgatgcggcctttattcaggctgctaggcgcaagcgagagctggccagggcacaagacgattacatttcgctcgacgtccaacatactagcagtatttccggcatgaagcgtgagagcgaggatgatccggagagcgagccggacgaccatgaaaaacggatcccattcacactgcgcccgcagaccctacgccagagaatggcagaagagtctatctcccgcaatgaagagacttccgaagagtctcaagaggacgaaaagcaggatacatgggaacagcaacaaatgcgcaaggctgtcaaaattattgaaataaatattaccactgggaatagccctttgacccccgagggcgtttag

SEQ ID NO: 19268 - DNA, 504 bp, Artificial Sequence
  Description of Artificial Sequence: Synthetic coding sequence
atgagcgagtggatgaagaagggccccctggagtggcaggactacatttacaaagaggtgcgcgtgactgcctccgaaaaaaacgagtataagggttgggtactgacgaccgatcctgtgtctgccaacatcgtgttggttaactttctggaagacgggtctatgtccgtgactggaattatgggccatgcagtgcaaactgtggagaccatgaatgagggcgatcaccgtgttagggaaaagctgatgcatctttttacttctggcgattgtaaggcctactcgccagaagatctagaagaacggaagaacagcttaaagaaatggcttgaaaaaaatcacataccaataactgagcagggagatgctccccggacattgtgtgtggccggggtcttgaccatcgacccgccatatggccccgaaaactgcagttccagtaacgaaatcattctttcccgagtacaagaccttattgaggggcaccttaccgcatctcagtag

SEQ ID NO: 19269 - DNA, 336 bp, Artificial Sequence
  Description of Artificial Sequence: Synthetic coding sequence
atgagcgagtggatgaagaagggccccctggagtggcaggactacatttataaggaggtgagggtaaccgcctccgaaaagaacgaatacaagggttgggtgctgaccacggacccggttagtgccaaagtcctgctgtcgccacgcctggaatgctctggagagatttcagcactgtgtaatctgcatttggcagggtctagtgacagccctgcgctggcctcccgcgtcgccggcaccaccgggatttgccaccatgtttggctgatcttcgtttttttcgtggagaccggtctgcgccacgttgctcagtactgcccttgcgagctcccatag

SEQ ID NO: 19270 - DNA, 330 bp, Artificial Sequence
  Description of Artificial Sequence: Synthetic coding sequence
atggcctaccagctgtaccggaacaccaccctgggcaacagcctgcaagagtctttagacgagctcattcagtctcagcagattacaccccagctggctctccaggttctgttacaatttgataaagccattaatgccgcactcgcccagcgagttaggaatagagtcaacttccgtgggagtctgaacacatataggttctgtgacaatgtctggacctttgtcctcaacgacgtggaattccgggaagtcactgaactgatcaaggttgataaggtgaaaatcgttgcatgtgatggcaagaatacaggctcaaatacaacggaatag

SEQ ID NO: 19271 - DNA, 330 bp, Artificial Sequence
  Description of Artificial Sequence: Synthetic coding sequence
atggcctaccagctgtaccggaacaccaccctgggcaacagcctgcaggagagcctcgacgaacttattcagtcccagcaaattactcctcagctggccctgcaggtgcttttacagtttgataaggctattaacgcagcattagctcaacgggtaagaaaccgggtgaattttcgagggagtctgaatacataccggttctgtgacaacgtctggacctttgtcttgaatgacgttgagtttagggaggtgacagaacttatcaaggtcgacaaagtaaagattgtggcatgtgacggaaagaacacagggagcaacaccaccgagtag

SEQ ID NO: 19272 - DNA, 330 bp, Artificial Sequence
  Description of Artificial Sequence: Synthetic coding sequence
atggcctaccagctgtaccggaacaccaccctgggcaacagcctgcaggaatccctggatgagttaattcagtcacagcagatcactcctcagctggctctccaggtcttgctgcagttcgataaagctatcaatgctgcactggctcaacgggtgcgcaacagagtgaactttaggggcagtctcaatacatatcgcttttgtgacaatgtatggacgttcgtgttaaatgatgtcgaattccgcgaagtgaccgaacttatcaaagttgacaaggtgaagatcgtagcttgcgacggaaagaacaccggaagcaatacgacagagtag

SEQ ID NO: 19273 - DNA, 1320 bp, Artificial Sequence
  Description of Artificial Sequence: Synthetic coding sequence
atggccgaccccgacgtgctgaccgaggtgcccgccgccctgaagaggctcgcaaagtatgtgattcggggtttttatgggatcgagcacgcactggcgcttgacatactgattcggaatagttgcgtcaaggaagaggacatgttggagctattgaagttcgatcgaaagcagctgaggagcgttttaaataatctgaagggcgataaattcattaaatgtcgcatgcgcgtggagacagctgctgatggcaaaaccactcgacataactattacttcatcaactatcgaactctagttaatgttgtcaaatacaaacttgaccatatgcggcgcaggattgagaccgacgagagagacagcacaaatcgagcgagttttaagtgccccgtgtgcagctccacttttactgacctggaggccaatcagctcttcgaccctatgacagggacctttaggtgcacattttgtcacaccgaggttgaagaggatgagagtgcaatgcctaagaaagatgcacgcaccctgcttgcccgcttcaatgagcagatcgaacctatttatgctctgctccgtgagacagaggacgtgaacctcgcatatgagattctcgaaccagagcctactgaaatccctgccttgaagcagtcaaaagaccacgctgcgactaccgcaggggcagcttccctcgcaggaggccatcatagggaagcatgggcgaccaaagggccttcctatgaagatctttatactcagaatgtagtaattaatatggacgatcaggaggatctgcaccgggcttcactggaggggaagtctgcgaaagaacgcccaatttggttacgagagtcgactgtgcagggcgcctacgggtcagaggatatgaaggaaggcggaatcgacatggacgccttccaggaacgggaggaaggccacgcagggcccgatgacaacgaggaggttatgagagcattgctgatccacgagaagaaaacaagctccgccatggccggcagcgtcggggctgcagcccccgtcaccgcagctaacggctctgacagcgagagcgagacaagcgagagtgatgacgacagtccaccccgtccggccgccgtggcagtgcataagagggaagaagacgaagaggaggacgatgagttcgaggaggtcgccgatgaccccatcgtaatggtagccggtcggccgtttagctactccgaggtgagccagcggcctgagctggtggcccaaatgacccccgaggaaaaagaagcttacattgcaatgggtcagaggatgtttgaagatctgttcgaatag

SEQ ID NO: 19274 - DNA, 150 bp, Artificial Sequence
  Description of Artificial Sequence: Synthetic coding sequence
atggccgaccccgacgtgctgaccgaggtgcccgccgccctgaagcggctggccaagtacgtgattcggggcttttacggcatcgaacatgcccttgctctcgatatactcattagaaattcttgcgtgaaggaggaagatatgctgtag

SEQ ID NO: 19275 - DNA, 369 bp, Artificial Sequence
  Description of Artificial Sequence: Synthetic coding sequence
atggccgaccccgacgtgctgaccgaggtgcccgccgccctgaagcgtctggccaagtatgtcattagaggcttctatggcatagaacacgctctcgcactcgacatcctgatccggaatagttgcgtcaaggaggaagatatgttagaactattaaagttcgaccgcaaacagctgaggtcagtcttgaacaatctaaagggagataaattcatcaaatgtagaatgagggtcgaaaccgcagcagacggcaaaacaacaaggcataattactacttcatcaattataggacactcgtgaacgtagtcaaatacaagctggaccacatgcgtcgcagaatcgagacagacgagcgggacagtacctag

SEQ ID NO: 19276 - DNA, 1188 bp, Artificial Sequence
  Description of Artificial Sequence: Synthetic coding sequence
atggacgaggagcccgagcggaccaagcggtgggagggcggctacgagagaacgtgggaaatactgaaggaggacgaaagtggaagcctcaaagccacgatcgaggacatcctctttaaagctaagagaaagcgagtgttcgagcaccacggccaggtccggctcggcatgatgcggcacttgtacgtcgtcgtggacggcagtcggacgatggaggatcaagacctgaagcctaaccgcttgacatgtacattgaaactgttagaatattttgtggaagagtactttgaccagaatccaatcagccagattgggattattgtgaccaagtccaagagagccgaaaagctgaccgaattgtcagggaatccccgcaagcacattactagcctaaaagaggccgtcgatatgacttgccacggggagccaagtctgtacaactcactgagtatggccatgcagaccctgaagcatatgcctgggcacacctcccgagaggtgctgataatcttttctagtttaaccacttgcgacccctccaacatttacgacctgattaaaaccttaaaggctgctaagatccgggtctccgtcatcggcttgagcgccgaggttcgcgtctgtaccgtactcgcccgtgaaactggcggcacctatcacgtcatcctcgatgagagccactacaaggaactgttaacccaccacctcagcccccctcctgctagttcaagttccgagtgtagtctcatcagaatgggattccctcagcatactatcgccagcctctccgaccaggacgccaagccctccttcagtatggcgcacctcgatgggaataccgaacctgggctcaccttgggcgggtatttctgtccacaatgcagggctaaatattgtgagttacctgtggagtgcaagatctgcggtctaaccttggtgagcgcgcctcacctggctcgcagctaccaccatctgtttcctctggacgccttccaggagattcccctggaagaatataatggggagcggttttgctatggatgccagggagaactaaaagatcaacacgtgtatgtttgcgctgtctgtcaaaatgttttctgtgtcgattgcgatgtatttgtacacgactcactccactgttgtccaggctgtattcataagatcccagctccctcaggggtgtag

SEQ ID NO: 19277 - DNA, 1017 bp, Artificial Sequence
  Description of Artificial Sequence: Synthetic coding sequence
atgcggcacctgtacgtggtggtggacggcagccggaccatggaggatcaggatttgaaacctaacaggctgacatgcaccctgaaacttctggagtattttgtggaggagtattttgaccagaatccgatctcccagatcggcataattgtaaccaaatcaaaacgcgccgaaaagcttactgagttgagcggaaatcctcgaaaacacatcactagtttaaaggaagctgtggacatgacatgccacggggagccaagcctgtataactcactgtccatggctatgcagactctgaaacatatgccaggacacacttcacgggaagttttgatcatcttcagctctcttacgacctgcgatccgagcaacatttacgacttgattaagactctcaaagcggccaagatccgggtgtccgtaataggcctgtctgcagaggtgagagtgtgtaccgtgctcgccagagagacgggggggacatatcacgtgatcttggatgaaagccactacaaagaactgctaacacaccacctatcacctcctccagcttcctctagctctgaatgctccctgatccgtatgggatttccgcagcacacaatcgctagcctcagcgatcaggacgctaagccttcattcagtatggcccatcttgacggcaacaccgagccaggtttgacattaggcgggtacttttgtccccaatgcagggccaagtattgtgagcttccagttgagtgcaagatttgcggactaaccctcgtttccgcgcctcatctcgcccggtcttaccaccatttgtttcccctcgacgcctttcaggagatccccctcgaggaatacaatggcgagagattctgctacggttgtcagggggaattaaaggatcagcacgtgtacgtctgtgcagtttgccagaatgtcttttgcgtcgactgcgatgtttttgttcatgattcactgcattgctgtcccggatgcattcataaaattccggcgccttcaggcgtgtag

SEQ ID NO: 19278 - DNA, 1188 bp, Artificial Sequence
  Description of Artificial Sequence: Synthetic coding sequence
atggacgaggagcccgagcggaccaagcggtgggagggcggctacgagcgcacatgggagattctgaaggaggacgaatcaggctcactgaaggctactattgaagacattctgtttaaagctaagcgtaagagagtattcgaacatcacggtcaggtccgtctgggaatgatgcgccatctctatgtggtcgtggatggtagtcggacaatggaggatcaagacttgaagccaaacagactgacatgcacattgaaattgctcgagtacttcgtggaggagtacttcgatcagaatcctatttctcagatcggaatcatcgtgacaaagtccaaaagggcggaaaaattaacggagctctcagggaatccgagaaagcacatcacttcattaaaagaggccgttgatatgacctgtcatggcgaaccgtctctttataactcactgagcatggccatgcagactctgaaacacatgcccgggcacacgagtagggaggtgttgattattttctctagccttacaacctgcgatcccagtaatatctacgatctgattaagaccttaaaggctgccaagatccgggtgagtgtcatcggcctctcagccgaggtgcgtgtgtgtacagtgttagcacgcgagaccggggggacctaccacgttatcttagacgagagccactacaaagagctcctaactcaccacttgtcaccaccacccgcaagcagttcttcagagtgctccctcatacgcatgggatttccccagcacacaatcgcctcactatcagatcaggatgctaagccctccttttcaatggcccatcttgacggcaacacggagcccgggcttactctggggggctatttttgcccccagtgccgggcaaagtattgcgaacttcccgtcgaatgcaagatatgcggcctgactctggtgtcagcgcctcacctggcccgaagttatcaccatttatttcccttagacgccttccaggaaatcccgttagaagagtacaatggggagaggttctgctatggatgccagggggagttaaaagaccagcacgtctacgtgtgcgctgtgtgccagaatgtcttctgcgtcgactgcgacgtgttcgtccacgacagcctgcactgctgtccgggctgtatacataaaatcccggccccctccggcgtttag

SEQ ID NO: 19279 - DNA, 606 bp, Artificial Sequence
  Description of Artificial Sequence: Synthetic coding sequence
atgaccgagaaggcccccgagccccacgtggaggaggacgacgacgatgagttagattcgaaactcaattataagcccccccctcagaaatctttgaaagagctgcaggagatggataaagatgatgagagcctgatcaaatataaaaaaacactcttaggtgatgggcccgtggttacggaccctaaggctcccaatgtggttgtgaccagattaacacttgtctgtgagagcgccccaggcccgatcacgatggatctcaccggtgatctggaggctctgaagaaggagaccatcgtcctcaaggagggtagcgagtacagagtcaaaattcatttcaaggtaaatcgcgacatcgtgtccggtctgaagtatgtgcagcacacttatcgcaccggagtgaaggttgataaggccacattcatggtcggctcttatggcccacgccctgaagagtacgaattcctaacccccgtggaggaggccccgaagggcatgcttgcaaggggaacctaccataacaaaagcttcttcaccgatgatgacaagcaagatcacctgagttgggagtggaacctgagcattaaaaaggaatggaccgagtag

SEQ ID NO: 19280 - DNA, 777 bp, Artificial Sequence
  Description of Artificial Sequence: Synthetic coding sequence
atgaaccggagcaacaagctggccgtgatcgccagccacatccaggagtccaggtttctgtacccgggaaaaaacggccggttgggggacttcttcggggatcccgggaaccccccagagttcaatccttcagggtctaaggatgggaagtacgaactgcttacttcagccaacgaggtcattgtggaagaaattaaagacttaatgaccaaatctgacatcaaggggcagcatacagaaacgctactcgctggaagcctggctaaagccctgtgctatatccatcgcatgaacaaagaggttaaagataaccaagagatgaagtcaagaattctggtgataaaggccgcggaggactctgcgctacagtacatgaatttcatgaatgtgatctttgcggcacagaaacaaaatatcctgattgacgcctgtgtcctagactcggacagtggactactgcagcaggcctgtgacatcactgggggcctgtatcttaaagttccacagatgcccagcctgctgcagtacttgctgtgggtctttctgcccgaccaagaccaaaggtcgcaattgatcttaccgccgccagtgcatgtggattatcgggccgcctgtttttgccatcgaaacttgatcgagatcggatatgtctgctccgtttgcctgtcgatcttttgtaacttcagtcccatttgcaccacatgcgaaaccgccttcaagataagtctgcctcctgtgcttaaagctaaaaaaaaaaagttaaaagtttcagcctag

SEQ ID NO: 19281 - DNA, 927 bp, Artificial Sequence
  Description of Artificial Sequence: Synthetic coding sequence
atggtgagcgacgaggacgagctgaacctgctggtgatcgtggtggacgcaaaccctatctggtggggtaaacaggccttgaaagaaagccagttcacgttgtctaagtgtattgacgcagtgatggtactgggcaactcgcatctatttatgaatagaagtaacaagcttgccgtgatcgcatctcacattcaagagtcacgcttcctttacccgggcaagaatggcagacttggggacttttttggagatcctggaaatccccctgaatttaatccctccggcagcaaggacggtaagtatgaactgctgacatccgcaaacgaggtgatcgttgaggaaattaaggacctgatgacaaagagtgacatcaaagggcaacatacagagactctgcttgccggaagtctggcgaaggcattatgctatattcaccggatgaataaggaggtgaaagacaaccaggaaatgaaaagccgcatcttggtcattaaagctgcagaggactcagcccttcagtacatgaactttatgaacgttatattcgccgctcagaaacagaatattttaatcgatgcctgcgtcctggattcagatagtggtttgttgcagcaagcgtgtgacattactggtggactctacctgaaggtacctcagatgcctagtctgcttcaatacctcctgtgggttttcttacctgatcaggaccagaggagccagcttatcttgcctccccctgttcatgtagactatcgcgcagcctgcttttgccatcggaatcttatcgagatagggtacgtgtgttccgtgtgcttgagcatattttgcaacttctccccaatttgcactacgtgcgaaactgcgtttaaaatctcactccctcctgtgcttaaggctaagaagaagaagctaaaggtgtctgcctag

SEQ ID NO: 19282 - DNA, 6330 bp, Artificial Sequence
  Description of Artificial Sequence: Synthetic coding sequence
atggacgccctggagagcctgctggacgaggtggccctggagggccttgacggcttgtgtctgcctgctctgtggagtcgcttggaaacacgagttcctccttttccactgccgcttgagccctgcacccaggagttcctctggagggccctggcaacacatccgggaattagcttctacgaggagcctcgtgagagacccgacttgcagctccaggataggtatgaagagattgatctggagaccgggatcctcgaatcccgcagggatcccgtcgcactggaggatgtgtatcccatccacatgatccttgaaaacaaagacggcatccagggtagctgtagatacttcaaggaaaggaagaacattactaacgacattcgaactaagtccctgcagccccgctgtacgatggtcgaggcctttgatcgatggggcaaaaaactcatcattgtggcaagccaggcgatgagatacagggccctaattggccaggaaggagacccagatcttaaattaccagatttctcctattgtatcctggagcgccttgggcggagcagatggcaaggagaattgcagagagacttacacaccaccgcttttaaggttgacgcggggaagctgcattatcaccgtaaaatcctcaataagaacggactgattactatgcaatcccacgtgatccgcctgcctacgggagcccagcagcattctatccttctactccttaacaggttccacgttgataggcggagcaaatacgatattcttatggaaaagctgagcgtgatgttatccactagaaccaatcacattgaaactttaggcaaattaagagaagagcttggtctgtgcgaacgcacttttaagcggctttaccagtatatgcttaatgcgggattggcaaaggtggtgagtctgcgcctacaggaaatccaccccgagtgcggtccttgtaagactaagaagggcactgacgttatggtgcggtgtttgaagcttctcaaggagtttaagaggaacgaccacgatgatgatgaggatgaagaagttatctccaaaactgtgccgcccgtagacatagtgttcgaaagggatatgctgactcagacatacgacctgatcgaaagacgcgggaccaaaggcattagccaggcagagatcagggtcgcaatgaacgtgggaaagctcgaagccaggatgttgtgtagactgttacagcgttttaaggtggtgaagggctttatggaggacgagggaaggcagcgcaccaccaaatatatctcatgcgtgtttgccgaggagtcagacctcagccgacagtaccaaagagaaaaggcacggtccgaactgttgactacagtcagtcttgccagtatgcaggaagagtctctgcttccggagggggaagatacgtttctaagcgaaagcgactcagaggaggagcgctcttcctccaaaaggcgtggtcgaggttcgcaaaaggacactcgtgctagcgctaacctcaggcctaaaacacagccacaccatagtactccgacaaagggcggttggaaagttgtcaatctccacccactgaaaaagcagccacccagtttcccaggtgccgcagaagagagagcttgtcagtctctggcttcgagggattccttgttggacacctcgtccgttagtgagcccaacgtgtcctttgtctcacattgtgctgactcaaattccggcgacatcgccgtcattgaagaagtgagaatggagaaccctaaagaaagcagttccagcctcaaaacggggagacatagttccggtcaagataagccgcatgaaacttacaggctgctgaagaggcgcaatctaatcatagaggctgtgacaaatttgcgtctcatcgagagtctgttcaccatccaaaaaatgattatggatcaggagaagcaggagggtgtgagcaccaagtgttgcaagaaaagcatagttcggctagttaggaatctttccgaggaggggttgctaagactttatcgaaccacagtcatccaagacgggataaaaaagaaggtggatctggtggtacatccatcgatggaccagaacgaccccttggttcgctccgcgattgagcaggtcagattccgcatctcaaatagctcgaccgcaaacagagtgaagacctctcagccacccgtccctcagggagaggcagaagaggactcgcagggaaaggaaggcccgtccggatcaggtgattcacagctctctgcatcgtcgcggtctgagtctggtcgcatgaagaagtcagacaataagatgggcattacaccgttgaggaactatcatcctattgtagtgcctggactgggtcggtcgctgggctttctgccgaaaatgcctcggctgcgggtggttcacatgttcttgtggtatctgatctatggccacccagcctccaacaccgttgagaagccctcatttatttccgaacgtcgcactattaagcaggagagcggacgggctggtgtacgtccctctagcagcgggtccgcctgggaagcttgttctgaggcccctagcaaaggctcacaagacggtgtcacctgggaagccgaggtggaattagcgaccgaaacagtctacgttgacgatgcctcttggatgcggtacattccgcccattccggtgcatcgtgattttgggtttggatgggccctcgtctctgacatcttgctgtgccttccgctcagcatttttatccagatcgtccaggtaagctacaaagttgacaatttagaggagttcctcaatgaccctctgaaaaaacatacgttgattcggttcctgccaaggcctattcgacaacagctactgtataagcggcgctacatttttagtgtggtggagaacctgcagaggctctgttatatgggattgctgcagtttggacccacagagaaatttcaggacaaagaccaggtttttattttcttgaaaaagaatgctgtgatcgtggacacaaccatctgtgacccccactataatctggccagatcctcacgtccttttgaaaggcgcctttatgtgttgaactctatgcaggatgtggaaaactattggtttgacctgcagtgcgtttgtctgaacacaccactgggggtagtcaggtgccccagagtgcggaaaaacagctccaccgatcagggctccgacgaagagggctcactgcagaaagagcaagagtccgcaatggataaacataatctggagcgcaagtgcgccatgcttgagtacacaactggaagtcgtgaggtagttgacgaaggcctgatccctggagacggcctcggcgctgccggcctcgactcatccttttacggacatctgaaaagaaactggatctggacctcttacatcatcaatcaggccaagaaggagaacacagctgcggaaaacggccttactgtacggttacagacgtttttaagcaaacggcctatgccgttgtctgcccggggaaactcccggttgaatatctggggcgaggccagggtcgggtcagagctctgcgcgggctgggaggagcaattcgaagtagaccgggaaccttccctcgaccgaaatagaagagtgcggggaggaaagagccagaagcgtaaaagattgaagaaagatcctggtaagaagatcaaaaggaaaaagaaaggggaatttcctggggagaagtctaagaggctgagataccacgacgaggctgaccagagcgctttacagcgtatgacgagactccgggtgacatggtccatgcaggaggatggacttctagtgctgtgtaggattgcttcgaacgtcttaaacacgaaagtgaaaggaccattcgtgacctggcaggtggtccgagacatattgcacgcaacctttgaagagtccttagacaagacttcccattcagtaggccgcagagccaggtatattgtgaagaacccccaggcctacctcaactacaaagtgtgcttagcggaagtatatcaggataaggctctggtgggcgacttcatgaatcgcagaggtgactatgatgaccctaaagtctgcgcgaacgagtttaaagagtttgtcgagaagctgaaagagaagtttagctccgccctgcgtaactccaacttagagatccctgacacactccaggaactgttcgctcgctatagagtgttagctattggtgatgagaaagaccagacaagaaaagaagacgaactgaactcagttgatgatattcactttctggttttacaaaatctcatccagtcaactctagccctctcagactcccagatgaagtcctaccagtctttccagacattccgtctgtaccgcgaatacaaagaccatgtcttggtgaaggccttcatggagtgccagaaacggtccttggtgaaccgacggcgtgtcaatcacactctgggtccaaagaaaaatagggctcttccctttgtacctatgtcttaccaattgtcccagacttattaccgcatcttcacctggcgctttccatcaactatctgtacagagtcattccagttcctggaccgcatgagggccgcggggaagctggaccaaccagatagattctcgttcaaggaccaggataacaacgagcccacgaatgacatggtggccttcagcctcgacgggcccggcggtaactgtgttgcagtcttaacactcttcagcctcggcctgatctctgtggacgtgcgtattcctgaacagattatcgtggttgactcatccatggtcgagaatgaggtgatcaagtcgctggggaaagacggtagcctggaggatgacgaagatgaggaggatgatcttgacgagggcgtgggcgggaaaagaagatcgatggaggtcaagcctgctcaggccagccacactaactatctgctgatgagaggatactattctcctggcattgtgtccacgcggaacttgaaccccaacgatagcatcgtggtaaacagttgccagatgaagttccagctgaggtgtactccagtcccagctcgcctccgacccgcagccgcgcccctcgaagagctcacaatgggcacgtcttgccttcctgacacttttaccaaattgattaacccccaggagaatacctgcagcttggaggagtttgtcctgcagcttgaacttagcggctattccccggaggacttaacagctgcattggagatattggaggcaattattgccacaggatgctttggcatcgacaaagaagagctgcggcgtcggttcagcgccttagagaaagctggaggaggcagaacgcggacctttgcggattgcattcaggctctcctggaacagcaccaggttttagaggttgggggcaataccgccagactagtggcaatgggctcagcctggccttggctcttacactccgtgcgtctgaaggatcgagaggatgctgatatacagcgcgaagatccccaggctagaccgctggaaggctctagcagcgaagactcgccccctgagggacaggcccccccaagccattctcctcggggtaccaagcgtcgcgccagctgggcatccgaaaatggtgaaaccgacgccgaaggaacccaaatgacccctgcaaagcgccctgctttacaggactctaatctcgccccaagtctgggacctggggctgaagacggagctgaggcccaggccccctctcccccgccggcactggaagatacagctgcagcaggggcggcacaagaggatcaggagggagtgggggagttttcaagcccaggtcaagaacagctctcggggcaggcgcagcctcctgaggggtcagaagatcctagaggctttactgagtcattcggcgcggctaacatctcccaggcagcacgggagagggattgtgagtcagtctgcttcataggtcgcccttggagagtggtggacggacatctgaatttgccagtgtgcaagggtatgatggaggccatgctgtaccacatcatgaccaggccaggcattccagaaagcagtctgctccgccactaccagggggtgttacagccagtggcagtcctagaactgctacagggccttgaaagtctgggatgcatccgtaaaagatggttaaggaagccccggcccgtatctctgttcagcacaccagtagtggaagaggtagaagtgcccagtagcctcgatgaaagtccaatggcattttacgagcccactttggattgtaccctcaggctgggaagggtcttcccacatgaggtgaattggaacaaatggatccatctgtag

SEQ ID NO: 19283 - DNA, 5064 bp, Artificial Sequence
  Description of Artificial Sequence: Synthetic coding sequence
atggacgccctggagagcctgctggacgaggtggccctggagggcctggacggcctctgtctgccagccctgtggtcccgcctggagacgagagtgccgccgtttcctttgccgctcgaaccctgcacccaagaattcttgtggcgcgccctcgcgacccaccccgggatttccttttacgaagagcccagggagcgccctgacctgcagttgcaggatcgctacgaggagatcgacctagaaactggtatcctggaatcgcggcgcgaccccgtggcccttgaggatgtctacccaattcatatgattctggagaataaggatggtattcagggctcctgtaggtacttcaaggaaagaaagaacattacgaatgacattcgaactaagagcctgcaacccagatgtacaatggtggaggctttcgacagatggggtaagaaactgattatctgccttcccggtcatgccgtccaggggttagacaggcctggaggggggagccgtccggaggccgccaggctactccttctgcatccaggtacagcccgtcctgttcaacagggagaactgcagcgcgacctgcacacgacggcattcaaagtggatgccggaaaactgcactaccaccgcaagatcctaaataaaaacggcctgatcacaatgcaatctcatgtgattcggttgcctactggcgcacagcagcactcgatcctcttgctgctgaacaggttccacgtagatcgaagaagcaagtacgacatactgatggaaaagctgtccgtgatgctgagtaccagaactaaccatatcgagacattgggcaagctgcgggaagagctggggctttgcgaacggacgtttaagcggttgtatcaatatatgctgaacgccggattggcaaaggtcgtcagcctgcgactgcaggagattcatcccgaatgtggaccttgcaaaaccaagaaggggactgatgttatggttcgatgtttaaaacttctcaaggaattcaagaggaacgaccacgatgacgatgaggatgaggaggtgatttcgaaaacagttccaccagtagatattgtgttcgagcgggacatgctcacgcagacctacgacctgatagagcgccgaggaactaaagggatctcacaggccgagatcagggttgctatgaatgtgggaaaactggaagccaggatgttgtgccgactgctccagagatttaaggtggtgaagggcttcatggaagacgagggacggcaacggactaccaaatatatatcctgtgtgttcgctgaagagagtgacctgtcccggcaataccaacgggagaaagctcgttccgaactgctcaccacggtgagcctggcctctatgcaggaagagtctcttcttccagaaggcgaggataccttcctgtctgagagtgatagcgaggaagaacggagttctagcaagaggcgcggcagggggagccaaaaagacacccgggcaagcgccaacctgcgtcccaagactcagccccaccactcaaccccaacgaagggcggatggaaggtggtgaatcttcaccccttgaagaagcagcccccaagctttcctggggctgccgaggagcgcgcgtgccagtcactcgcatcacgggactcactactggacacctcatccgtgagtgagcctaacgtgtcttttgtatcacactgtgctgatagcaacagtggtgatatcgccgtcattgaggaagtgcgtatggaaaaccccaaggaatctagctccagcctcaagaccggtcggcattcctctggtcaggataagccccatgagacatacaggctgctcaagagaaggaacctgattattgaggctgtgaccaatttacgcctgatagaaagcctcttcacaattcagaagatgatcatggatcaggaaaaacaggagggagtttccactaagtgttgtaagaagtccatagtgcgactcgtgagaaacctctctgaggagggtcttctgagactatataggacgacagttatacaggatggaatcaaaaagaaagtagatctggtggtacatcctagtatggaccagaacgaccccttggtgaggagcgccatcgagcaggtccgttttcgtataagcaactcaagcaccgccaacagagtaaaaacgtctcagccccccgtgcctcagggagaggccgaggaggattcgcaggggaaagaaggcccatcggggagcggagatagtcagctctctgcttcttcgagatcagagtctggacgaatgaaaaagagcgacaataaaatgggaatcactcctctgcgaaactatcatccaatcgtggttccaggcttgggacgaagcctcggctttttgccgaaaatgccccgattgcgcgtcgtgcacatgttcctgtggtacctgatctatggtcatccggctagcaataccgtcgaaaagccaagttttatatccgaacgacgtacaatcaagcaagagtctgggagggctggggtcaggcctagctcaagtggctctgcctgggaagcatgtagcgaggcacctagtaaggggtcccaagatggggtcacctgggaggcagaggtggaacttgccacagagactgtgtatgtggacgatgcctcttggatgcgctacatccctccaatcccagtgcacagggattttggctttggatgggccttggtatcagacatcctgctgtgtctgcctctgtcaattttcatacagatcgtgcaggtctcatataaggtagacaacctggaggagttcctgaacgaccctttgaaaaagcatacactcatccgctttctgcctcgccccattaggcagcagctactttataagcgccgctacatcttcagcgtcgtcgagaatttacaacgactttgttatatgggattgttacagttcgggccaacagagaagttccaagacaaggaccaggtgttcattttcctgaagaagaatgcggtcatcgtggatactacgatatgcgacccacactacaacctcgcacggtcttctagacccttcgaacgccggttgtatgtgctgaactctatgcaagacgtggagaactattggtttgaccttcagtgcgtctgcctgaatactcccctgggtgtggtccggtgccccagagtccgaaaaaatagctctactgatcaaggatcggacgaggaaggaagcctgcagaaagagcaagagagcgctatggataagcataacctggaacgaaagtgtgctatgcttgaatatacaacagggagtcgtgaagttgtggacgaaggtttgatcccgggcgacggtctaggggccggctcgatcccagctagcaccgacacctcctctgccacaggaagtggcccagcgacatcttccacaagacccaaacggagaacgcttccccagcgtatggacaccgtgcgccttcagacatttctttctaagcggcccatgcctttgagcgccagaggcaacagcagactaaacatctggggggaggcccgcgtagggagcgaactgtgtgccggctgggaggaacagttcgaggtcgatagggaacccagcctcgatcggaaccgcagggttcgcggtggcaagtctcagaagcggaagaggcttaagaaagacccagggaaaaagattaaaagaaaaaagaaaggggaatttccaggggagaagtctaaaaggctccggtaccacgacgaggccgaccagtctgctctgcagcgcatgaccagattgcgtgtgacgtggagtatgcaggaggacgggctgctggtgctgtgccggatcgcttctaacgtgctcaacaccaaggtgaaggggcctttcgtgacttggcaggtagtgcgggatattctgcatgccacgtttgaggagtccctggataaaacaagccacagcgtgggtagacgggctaggtacattgtgaagaaccctcaagcctacctgaattacaaggtttgtctcgctgaggtataccaagacaaagcacttgtgggcgactttatgaaccgaagaggagattacgatgatcctaaggtatgcgctaatgagttcaaagaatttgttgaaaaattgaaggaaaaattctcatcagcattgcgcaactccaatctggaaattcctgatacccttcaggaattgttcgcacgttatcgcgtgctcgctataggcgatgagaaagatcagacccggaaggaggatgagctgaacagcgtagacgacatccactttctggttctccagaacctaattcaaagcactctggcactctctgatagtcaaatgaaaagttatcagtcatttcaaaccttccgtctgtacagggaatataaagatcatgtattggtgaaggcttttatggaatgccaaaagagatccctggtcaataggaggcgtgtcaatcacaccctcggtcccaagaagaaccgcgctctcccgtttgttcccatgtcttatcaactgtctcaaacctactatagaatcttcacttggcgttttccatccaccatatgtactgagagttttcagtttctggaccggatgagagccgcaggtaaactggatcagcccgaccggttcagctttaaggatcaggacaacaacgagccgactaacgacatggtggccttcagcttggatggcccagggggcaactgtgttgccgtcctgacactgttttccctgggccttatctcagttgacgtacgaattccggagcagattatcgttgtcgattccagtatggtggaaaacgaggttatcaaaagcctcggcaaggatggatctctcgaagatgacgaagacgaggaagacgatttagacgagggcgtcggtgggaagcggcggagcatggaggtcaaacctgcacaggcctcgcacacaaactatctgctcatgcggggttattattcgcctggcattgtaagcacccggaatctgaatccaaacgacagcattgtggtgaactcctgtcaaatgaaattccagctgagatgcacacccgtgccagctaggctgaggcctgcttag

SEQ ID NO: 19284 - DNA, 2736 bp, Artificial Sequence
  Description of Artificial Sequence: Synthetic coding sequence
atggacacctgcggcgtgggctacgtggccctgggcgaggccggcccggttgggaacatgaccgtggttgactcccctgggcaagaagtgcttaaccagcttgacgtgaaaacctctagcgagatgaccagcgccgaagctagtgtggaaatgtcgctgcccactcctcttcccggcttcgaagactctccggaccaaaggcggctgccccccgaacaggagagtttgtcacggctcgagcagccagacctctcctctgagatgagcaaggtgtctaaaccccgggcaagtaaacccggcaggaaaagaggtggccgaaccagaaaggggccaaagcggccacagcagcccaatccaccttccgcaccactggtcccgggtctgttagaccaatctaatccattgtctaccccgatgcctaaaaagagaggcagaaaatctaaagccgagctcctcctgctaaagctttctaaggatctcgataggcctgagtcgcagagccctaagagaccacccgaagacttcgagacccccagcggggaacgtccaagacggcgcgcagcccaagtcgctctgctctacctgcaggagctggcggaagaactcagtacagcactgcctgctcctgtcagctgtcccgagggacccaaagtttcctcccccactaaacccaagaaaatcagacagcccgcagcctgtcccggcggcgaagaggtggacggcgctccaagggacgaggattttttcctccaggttgaagccgaggacgtggaagaatcagagggccctagcgagtcctcttccgagccggagcctgtagtaccgaggtcaaccccaagaggcagtaccagcgggaaacagaagccgcactgcaggggtatggctcctaacgggctgcccaaccatattatggcgcccgtttggaagtgtctgcacttaacaaaggactttcgagagcaaaagcacagctactgggaattcgccgaatggattccactcgcttggaaatggcacctgctgagcgaattggaggcagctccctatctacctcaggaagaaaaaagtcccctgtttagtgtgcagcgcgaaggcttgcctgaagacggtacattatataggataaacagattcagttctatcaccgcccaccccgagaggtgggacgtgtctttcttcacaggaggacctctgtgggccctggattggtgccctgtgcccgaaggtgcaggtgctagccagtacgtcgctctctttagttcaccagacatgaatgaaacccaccctctgagtcaactgcattctgggcccgggttgttgcagttatggggtttaggtacgctacagcaggagagctgccctggcaatcgggctcacttcgtgtacggcatcgcttgcgacaatggttgcatctgggatttaaaattctgcccgagcggcgcctgggaactcccgggcaccccacgcaaggcccctctgctcccgagacttggacttttagccttagcctgcagcgatggaaaggtgctgctcttctccctccctcatccggaggctctgctggcccagcagcctccagacgccgtaaagcctgccatctacaaggtacagtgcgtcgccaccttgcaggtcggctctatgcaggccaccgatccatccgagtgcggacagtgcctgagcctagcctggatgcctacccggccccaccagcatcttgccgctggatattataacggaatggtagtgttctggaacctgcctactaattccccgctgcaacggatacgattgtccgacggttcgttgaaactctatccttttcagtgcttcctggcccatgatcaggcggttcgaaccctacagtggtgcaaagctaacagtcactttctggtgtcagccggctctgaccgtaagattaaattctgggatctccggaggccttacgaacccattaactcaattaagaggttcctcagtacggagctggcatggctgcttccctataacggcgtcaccgtcgcgcaagacaactgctacgcatcctatggactgtgcggcatccactatatagatgcaggctatttaggtttcaaggcatatttcaccgctcctcgaaaggggacggtatggagtttgagcgggagcgactggcttggtacaatcgccgccggagatatttccggagagcttattgcagctatcctgcccgatatggcattaaatccaatcaatgtgaagcgtccagtggagagacgttttcccatttacaaagcagatcttataccctatcaagacagccctgaaggccctgaccactcgtcagcttcctcaggcgtgcctaatccaccaaaagcacgcacttacactgagaccgtgaaccaccattacctgttgttccaggataccgacttgggttcattccacgacctcctgagacgggaacccatgctccggatgcaggaaggagaagggcattcacagctgtgtctggaccgcctgcagcttgaggcgattcacaaggtccgtttttctcccaacctggacagttatggctggctcgtcagtggcggtcagtccggcttagtcagaatccattttgttcgtggcctggcctctcctttgggccatcgaatgcaactggagtctcgtgcccactttaacgcgatgtttcaacctagtagccctacccggcggccaggcttctctcccacatcccataggctgctgcccacaccctag

SEQ ID NO: 19285 - DNA, 2736 bp, Artificial Sequence
  Description of Artificial Sequence: Synthetic coding sequence
atggacacctgcggcgtgggctacgtggccctgggcgaggccggccctgtgggcaatatgaccgtagttgacagccctggtcaggaagtgctgaaccagctcgatgttaaaacttctagcgagatgacttctgccgaggcttctgtcgaaatgtcactgccaacacccctgcctggttttgaggattctccagaccagcgtcgcttgcctccagagcaagagagtctgtctcgcctagaacagcctgatctgtcctcagagatgagcaaggtgtctaagcccagagcatcaaagcctgggaggaagaggggaggtcgtacacgtaaaggaccaaagcgacctcagcagcccaaccctccttctgccccgctcgtccccggcctcctggatcaatcaaaccctctgtccactcccatgccaaaaaagagggggcgtaagtccaaagccgagctgctcctgcttaagctgagcaaagatttggacaggcccgagtcccagagcccaaagcgacctcctgaggacttcgagacccccagcggagaacgtcctcggcgccgtgcggctcaggtggctctcctatacctacaggagctggccgaggaacttagcacagctctgccagcaccagtgtcatgtcccgagggacccaaggtgagctctcctacaaaaccaaagaagatccgacagccagcggcttgccctgggggtgaggaagtggacggcgctcccagggacgaggacttttttctgcaggtcgaagcagaagacgttgaagaatcagagggaccctccgaatctagttcggagcccgaacccgtagttccaagaagtacacctaggggttcaaccagtggcaaacagaagccacattgtcgcggaatggcacctaacggcctgcctaaccatataatggcacccgtgtggaaatgtttgcacctgacaaaagactttcgcgagcaaaaacactcctactgggagttcgctgaatggatcccgctggcgtggaaatggcaccttctgagcgaacttgaggccgccccatacctgcctcaggaggaaaaatctccactgttctcagtacagagggaaggccttccagaagatgggaccctgtatcgcatcaaccgcttctcgtctattaccgcccatcccgagaggtgggacgtgtctttcttcaccgggggccctctgtgggcactcgattggtgccctgtgcctgaaggggctggggcctctcaatatgtggcactcttctccagccctgacatgaacgaaacccatcccctcagccagctgcacagcggaccaggtttactgcaattatggggacttggtacattacagcaagagtcatgcccaggtaaccgcgctcatttcgtctatggcattgcctgtgataacggctgtatctgggaccttaagttctgcccctccggggcttgggaactcccaggtacacccaggaaggccccactgttgcctcgcttaggtctgctcgcccttgcatgctcagacggcaaggtgttgctgttctccctccctcaccctgaagctctactggcacagcagccaccagatgccgtgaagcccgcgatctacaaggtgcagtgcgtggcgacactacaggtcgggtcaatgcaggctacagatccatccgagtgcggtcagtgtctgtccctggcttggatgccaacacgccctcaccagcatctggcagctggatactacaacgggatggtggttttttggaatcttccaacgaattctcctttacagcggatcaggctgagtgacgggtctctcaaactgtaccccttccagtgctttttagcgcatgaccaggccgtgcgcacccttcagtggtgtaaagccaatagccacttcttggtgagcgcaggaagtgatcggaagatcaaattctgggatcttaggagaccatacgagccgatcaattcaataaagaggttcctgagcaccgagctcgcgtggctgctgccttacaacggagtaactgtggcacaggacaactgttacgcctcctatgggttgtgcgggatccattacattgacgctggatatctcggatttaaagcctattttacggcccctaggaaaggcactgtgtggtcgctatcgggcagtgattggctcggcaccatcgctgctggggatatctcaggagagctaatcgccgctatcttaccagacatggccctcaatcctattaatgtgaagagaccagtcgagcgccgcttccccatttataaggcagatttgattccttaccaagatagccctgagggccctgaccactcaagcgcttcttccggagtgccaaatccccctaaggcccggacatacactgagacagtgaaccaccattacctgctcttccaagatacagacttgggatccttccatgacttgctccggcgggagcccatgctcaggatgcaggagggcgagggtcattctcagctgtgcctcgataggctccagctagaagccatacataaagttcggttctccccaaatctggattcctatgggtggctggttagtggtggccagagtgggctggtgcgtatccattttgtaaggggcttggctagccccttgggtcataggatgcagttggaatcgagagcccatttcaacgcaatgtttcagcccagttcccccacccggcggccaggattttcccctaccagtcatcggcttttgcccacgccgtag

SEQ ID NO: 19286 - DNA, 225 bp, Artificial Sequence
  Description of Artificial Sequence: Synthetic coding sequence
atggacacctgcggcgtgggctacgtggccctgggcgaggccggccctgtggggaacatgacagtcgtggacagccctggacaggaagtgttgaatcaattggacgtcaagacatcgagtgagatgaccagtgcagaagcatctgtagagatgtccttaccaacaccactacccggcttcgaggacagcccagatcagaggcggctcccaccagaacaggaatag

SEQ ID NO: 19287 - DNA, 408 bp, Artificial Sequence
  Description of Artificial Sequence: Synthetic coding sequence
atggacacctgcggcgtgggctacgtggccctgggcgaggccggcccggtgggcaacatgaccgtggtggactctcccggtcaagaagtgctcaatcagctggacgtgaagacttcatctgagatgacctcagccgaagcaagcgtcgagatgtcgttgcctactcctctccctggattcgaggacagccccgaccagcgaagactgccacccgagcaagaatcgcttagcagactggagcagcctgatctgtccagtgaaatgtcaaaggtttctaagccaagggccagcaagcctggtcgaaaacgggggggtcggacacgcaagggacccaaaagaccccagcagcctaatccaccatcggcacctctcgtgccagggcttctggaccagagcaaccccttgtag

SEQ ID NO: 19288 - DNA, 2661 bp, Artificial Sequence
  Description of Artificial Sequence: Synthetic coding sequence
atgagcggcttcagccccgagctgatcgactacctggagggcaagatcagctttgaagaattcgaacgccgcagggaagagcgcaagacaagagaaaaaaaaagtcttcaagagaaaggaaaactgtccgccgaagagaacccagatgactccgaggtcccaagttctagcggcatcaacagcaccaagtctcaggataaggacgtgaacgagggtgagacgtctgacggcgtgcgcaaatctgtccacaaagtgtttgcatccatgctcggcgaaaacgaagatgacgaagaagaggaggaggaggaggaggaggaagaagaggaagaggagacccccgaacagcctactgccggagatgtcttcgtcttagagatggtgcttaatcgagagaccaagaaaatgatgaaggagaagagacctcgtagcaagcttcctcgcgcactgagggggctaatgggcgaagcgaatattcggttcgccagaggcgagagagaggaggcaatcctgatgtgcatggaaatcatcagacaggcccctttggcgtatgaacctttttctaccttagccatgatttatgaggatcagggcgatatggagaagtcactacaattcgagcttattgccgcacacctgaaccctagtgatacagaggaatgggtgcggctggctgagatgtctctggagcaggataatatcaaacaggcaatattttgctacactaaggctctgaagtacgaacctactaatgttcgctatctgtgggagaggtcttcactctacgagcaaatgggagatcacaaaatggcaatggacggctataggagaattctcaacctgctgtcgcccagtgacggcgagaggtttatgcagcttgcaagagatatggccaaatcttattatgaggctaatgatgtaacatctgcaattaacattatagacgaggccttctctaaacaccagggactagtcagtatggaggatgtgaacattgctgctgaactgtacatctccaataaacaatatgataaagcattggagattattacggactttagtggtatcgtactggaaaaaaagacttcagaggaaggcacgtccgaagagaataaggcccccgagaacgtgacttgcacaattccagacggggttcccatcgacatcaccgtaaagttgatggtgtgccttgtgcatctgaacatcctagaacctctcaaccctttgctgactactctggtcgagcaaaatccagaggacatgggagacctgtatctggacgtggccgaagccttcctggatgtaggggagtataactcagccctgcccctgctgtctgccctcgtgtgctccgagagatacaacctggcagtggtctggctccggcatgccgagtgtctgaaagctctgggctatatggagcgggcagccgagtcatatggaaaagtggtagaccttgctcccctgcatctggacgctcggattagtctctccacgctgcagcagcagcttggccagcccgagaaagctctggaggctcttgaacccatgtacgaccccgacactcttgcgcaggacgctaacgcagcccagcaggagctgaaacttttgctgcaccgaagcactctgctcttctctcaaggtaagatgtatggatatgtggacaccctattgacaatgctggccatgttgctgaaagttgctatgaatcgagcgcaagtgtgtctgattagctcgagcaagagtggcgaacggcacctgtatcttattaaagttagtagagacaaaataagcgacagcaatgaccaagaatccgctaattgcgacgccaaggctatcttcgcagtgttaactagcgttctgacaaaggacgattggtggaacctgctgctgaaagccatttactccctgtgcgacctgtcaagatttcaggaagccgaactgctggtcgactctagccttgaatattacagcttttatgatgatcgtcagaaacgaaaggaactcgagtatttcggactatccgctgcgatcctagataagaatttccgtaaagcctataactacatccgaattatggtcatggagaacgtcaataagccgcagttgtggaatatcttcaatcaggtgaccatgcactcacaggacgtacgacaccatcgattctgtctgagactgatgctgaaaaacccagagaaccatgctctgtgtgtgctgaacggccataacgcctttgtatcaggaagctttaaacacgctcttggacaatacgtgcaggccttccggacacatcctgacgagccgttatattcgttctgcatcggtttgaccttcatccacatggcctcccagaaatatgttttgcgcagacatgccctcatcgtgcagggcttctcctttttgaaccgctacctgtccctgagaggaccctgtcaggagagtttctataacctgggaagagggctccatcagttgggccttatccacctagcaattcattattatcagaaggcactggaactgccacccctggtggttgagggaattgaactcgatcaactggatcttcgtcgtgacattgcttataacctctctctaatatatcaatcttcagggaacaccggcatggctcagacattgctttatacatactgctctatatag

SEQ ID NO: 19289 - DNA, 1242 bp, Artificial Sequence
  Description of Artificial Sequence: Synthetic coding sequence
atgagcggcttcagccccgagctgatcgactacctggagggcaagatttcctttgaggaattcgaaagacgacgcgaggaacgtaagacacgcgagaagaaatcactccaggagaaagggaagctcagtgccgaagagaatcctgatgactctgaggtgccatcttccagtggtattaattccaccaaaagtcaggataaagacgtaaatgagggcgaaacctccgacggcgtcagaaaatctgtgcacaaagtctttgcatctatgctcggcgaaaacgaggacgatgaggaagaggaggaggaggaggaggaagaagaggaagaggaggagacaccagaacagcctaccgccggagacgtctttgtcctcgagatggttcttaatcgagaaacaaaaaaaatgatgaaggaaaagagaccccggtccaagctgcctcgcgcccttagggggttaatgggcgaggcaaatatcagattcgcaaggggcgaaagagaggaggcaattctaatgtgcatggaaattatccgccaggcgcccctggcatacgagccttttagtacgcttgctatgatatacgaggaccagggggatatggagaagtcccttcaatttgagttaatcgcagctcacctgaatccctctgacactgaagagtgggtgcgcctagcagagatgagcctcgaacaggataatatcaagcaggccattttctgttacacaaaagccctgaagtatgagcctaccaacgtgcggtacctgtgggagcgctcctcattgtacgagcagatgggcgatcataaaatggccatggatggctatagacggatcttgaacctgctgtctccttctgatggggaaagattcatgcagctggctcgggacatggccaagtcctactatgaggctaacgacgttacgtcagctatcaatattatcgatgaggctttttccaagcaccagggtctggtttctatggaagatgtgaatatcgccgctgaattgtacattagcaacaaacagtacgacaaggctctcgaaatcatcactgacttctcaggtattgtgttggaaaaaaagacaagcgaagaagggacatccgaggagaataaggcaccagaaaacgtgacatgtaccatccctgacggggtgcctatcgatatcacagtgaagctgatggtgtgcctggttcacttaaacattctggaaccgctaaatgtctgtaacaagatttgtacctag

SEQ ID NO: 19290 - DNA, 2469 bp, Artificial Sequence
  Description of Artificial Sequence: Synthetic coding sequence
atgaacaccgccgaccaggcccgggtgggccccgccgacgacggccccgccccttccggggaagaggagggcgaggggggcggggaggccggtggcaaagaacccgcagccgacgcagcgcctggccccagtgccgcctttcgcttgatggtgaccagaagggagcctgctgttaaattacagtacgccgtgtcagggcttgagccgctcgcctggtcggaagatcaccgtgtgtcagtgtccaccgcccggtctatcgcagtcttggagttaatttgcgacgtgcacaatcctggacaggacttggtcattcaccggacgtcggttcccgcccccctgaacagctgtttactcaaggttggatcaaaaacagaggttgctgagtgtaaggagaaattcgctgcttccaaggaccctactgtatcacagacatttatgttggatcgggtgttcaaccctgaaggcaaagccctgccccccatgcgcggtttcaaatacaccagttggagccccatggggtgtgatgcaaacggacgctgcctcctagcagcacttactatggataatagactcacgatccaggctaatctgaacaggctgcagtgggtccagctggttgatcttactgaaatatatggagaaagactatacgagacatcctatcgccttagcaagaatgaagcgccggaagggaatctaggggacttcgccgaattccagaggcgccatagcatgcagacacccgtgagaatggaatggagcggcatttgcactacccagcaggtcaagcataataacgagtgccgggacgttgggagtgtcctgctggccgtcctgttcgagaatggcaacatagccgtgtggcagtttcagctgccctttgtaggtaaagaatcaatttcctcttgcaacacaattgaaagcgggattaccagtcccagcgtgctcttctggtgggagtatgagcacaataataggaaaatgtcagggctgatagtcggcagcgcattcggacccattaagattcttccggttaacttgaaggccgtaaagggatattttacactaagacagcctgtcatcctgtggaaagaaatggatcagctcccggtacattcgatcaagtgcgtccccctgtaccatccctatcagaagtgcagctgctctctggtggtggcagctcgaggtagttacgtgttttggtgtttactgctcatttctaaagccggtcttaatgtgcataactcgcacgtcactgggttgcattcgctgcctatcgtttccatgacagccgataagcagaatggcacagtgtacacctgctcttctgatggtaaagttcgccagttgatccctatctttacagacgtagccctgaaatttgagcatcagctcatcaagttgagcgatgtcttcgggtcggtccgcacccatggcatcgccgtatccccgtgtggcgcctacctggccataatcactactgagggcatgatcaacggtcttcaccccgtcaacaagaattaccaagtgcaatttgtcaccctcaaaaccttcgaagaagccgcggctcagttgctagagtcttcagtgcaaaatttatttaaacaagtcgacctcattgatctagtgagatggaagatcctcaaagacaaacacattccgcagttcttgcaggaggctcttgaaaaaaaaattgagtcgagtggcgtgacctatttttggaggttcaaactattcttgttgaggatcctgtaccagagtatgcagaagactccctccgaggccttatggaagccgacccatgaagacagcaaaattctgctcgtggactcacccggtatggggaacgccgacgatgagcagcaggaggaagggactagctccaagcaggttgtaaagcaaggtctgcaggagcggtcaaaggagggagacgtggaagagcccacggatgattctctgcccacaactggggatgcagggggcagggaaccaatggaagagaagttactggagatccaaggaaaaattgaagctgttgagatgcacctgaccagagagcatatgaagcgcgtactaggcgaagtgtacctgcacacctggattaccgaaaataccagtatccccacacggggcctgtgcaattttctgatgtccgatgaagagtacgacgatcgtactgccagggtcctgattgggcatatcagcaagaaaatgaacaagcagacctttcctgagcactgctcgctgtgtaaggaaatcctaccctttacagacagaaaacaagccgtgtgcagtaatggacacatttggctgcgatgctttctcacatatcaatcctgccaatccttaatctaccggagatgtcttctccatgattccatcgctaggcaccccgcccccgaagaccccgattggattaaacgattgctccagtcgccctgccctttttgcgactcacctgtcttctag

SEQ ID NO: 19291 - DNA, 1374 bp, Artificial Sequence
  Description of Artificial Sequence: Synthetic coding sequence
atggccgccgaggccgccgacctgggcctgggcgccgccgtgcccgttgaattacgcagagaacggcgcatggtctgtgtggaatatccaggggttgtgagagacgtagccaaaatgttgcctaccctcggtggagaagaaggagtctcaagaatctatgccgacccgacaaagaggctggaactctatttccgcccaaaagatccttactgtcaccctgtttgcgcaaacaggttctctacaagctcattgctcttgagaattagaaagcgaaccagacggcaaaagggcgtgctgggaactgaggcccacagcgaagtgacctttgacatggaaattctgggaataatctcgacaatctacaagttccagggcatgtcagatttccagtatttggccgtccacacagaagcgggggggaagcatactagtatgtatgacaaggtactaatgctccggccagagaaggaagccttctttcatcaagagctcccattgtatattcctccgcccatcttctcacgcctagacgctccagtggattacttttatagacccgaaacccagcatagagagggatataacaaccctcctatcagcggcgagaatttaattgggctgtcccgggcccgccgcccccacaatgcaattttcgttaacttcgaggatgaagaagttcccaaacacctttggatcagattcggctatgaccctcgcaagaaccctgacgctaaaatctatcaggtgctggatttcaggatcagatgtggaatgaagcacggatacgcgccttcagatctgccagtaaaggccaaaagaagcacgtacaattactcgctgcccattacagttaagaaaacgtcctctcaattagtcacaatgcatgatttaaaacagggcttggggcctagcggaacatcaggagccaggaaacccgcgtccagcaaatataagctgaaggtgagtctacaaacactgagggacagtgtctatatcttccgtgaaggggccctacccccgtaccgccagatgttctatcaactttgcgacctgaacgttgaggaactacagaaaatcattcatcgaaacgatggagctgagaacagctgcactgagcgtgacggatggtgtctgccaaaaacaagcgacgagcttcgggataccatgtctctaatgatcagacagacaattaggtctaagaggcctgctctgttcagtagtagcgccaaggccgatggggggaaggagcagctaacatacgagtccggcgaagacgaggaagacgaggaggaggaggaggaagaggaggaggactttaaaccatctgatggcagcgaaaatgagatggagaccgagatcctcgattacgtttag

SEQ ID NO: 19292 - DNA, 834 bp, Artificial Sequence
  Description of Artificial Sequence: Synthetic coding sequence
atgctgcggcccgagaaggaggccttcttccaccaggagctgcccctgtatataccaccccctattttctctcgccttgacgcccccgttgactacttttaccgccccgagacacaacaccgagagggatataacaacccgcctatcagcggggagaatctgatcggtttatcaagagcccgacgacctcacaatgctattttcgtcaactttgaggacgaggaggtgcccaaacaacctctggaggctgccgcccagacctggcgacgggtgtgcacgaaccccgtggaccggaaggtggaagaagaactgagaaaattgtttgacattcgcccaatttggtcaaggaacgctgtaaaggcaaacatatctgtccaccctgacaaactgaaggtactgctgcctttcatcgcatactacatgattactggaccatggcggtctttgtggatccggttcggctacgatcccagaaagaatccggatgccaagatctaccaggtgctggactttagaatcagatgtggaatgaagcacggatatgcgccatccgacctgcctgtcaaagccaaacgcagcacatataactattccctacctattacagttaagaaaacttcctcacagctggtgacaatgcatgatctgaagcagggattaggacctagcggtacctcaggtgcccggaagccggcatcaagcaagtataaattaaaggtgtctctgcaaacaacatccggggaggaagtggtaacctccctgagagaggtgtggcatcagcagttgcatgttgtggtactactcgagcccttcggctcgttgggcccccattag

SEQ ID NO: 19293 - DNA, 1239 bp, Artificial Sequence
  Description of Artificial Sequence: Synthetic coding sequence
atgagcgacttccagtacctggccgtgcacaccgaggccggcggcaaacatacttccatgtacgataaagttttaatgcttagacctgagaaggaagcctttttccaccaggagttgccgctctacatcccccctccgattttttcccggctggacgcgcccgtggattacttttacagaccagagacacaacaccgagagggctataacaatccacctatctctggagagaacctgattgggctgtcccgagcccgcagaccccataatgccattttcgttaactttgaggacgaggaggtgccgaagcagcctcttgaagctgccgctcagacgtggcgcagagtgtgtacgaaccctgtggacagaaaggtggaggaagagctgcgtaaactcttcgatattaggcctatctggagccgaaacgcggtcaaggccaacataagtgttcatcccgacaaattaaaagtgctactgcctttcattgcatactacatgattacgggtccctggcgctccttgtggattaggtttggctatgaccctagaaaaaatcctgacgcaaagatctatcaggtattagacttcagaattcggtgtggaatgaagcacggctatgcacctagcgatctgcctgtgaaggcaaaaaggagtacgtacaactatagcctcccaattacggttaagaagacctcatcccaacttgtgaccatgcatgacctgaagcagggcctcggaccgtcaggaactagcggagcccgaaaacctgccagcagcaaatataaactcaaggtaagtctgcagaccctgcgagttagaacacgtgtacagagcccccgcgccgtctgtgtgggagacatatggcgccggggtggggacaaaagtcaggggagcttggctcccgccgccgcgtgtggttgtccttcccgggctctgtgggagcccggccccccccttagccacgttactacccctggtatgataggtatcggacacacccaggaggatcgggccagagctggccatgtgggttgttcctgtggaagaagcctgactggttcccggttccgtcagtgtggctgccctgcaggcgtgggtggcttccaatcttgctctcacatccaagctccagccagccggtcgaccgcactcggagaagcagagaaaggcgcctcaagaactgtcgagagcccagccgagggagttggagggagggacgagtgctcaagggacggctag

SEQ ID NO: 19294 - DNA, 1560 bp, Artificial Sequence
  Description of Artificial Sequence: Synthetic coding sequence
atggccgccgaggccgccgacctgggcctgggcgccgccgtgcccgtggagcttcgacgggagcgaagaatggtgtgcgtagagtatcccggtgttgtgcgcgacgttgcgaagatgctacccacccttggaggcgaggaaggggtgagcaggatctatgctgatcccactaaaagactcgagctctatttcaggcctaaagacccctactgccaccccgtatgcgcaaacagattttctacaagcagccttctcctgcgcattcgtaagcgcactcgacgacagaagggcgttctgggaactgaggctcacagtgaagtgacatttgacatggagatcctggggatcattagcacaatttataagttccagggcatgagcgattttcaatatctggctgtgcataccgaagctggcggcaagcacacctcaatgtacgataaggtcctgatgctccgtcctgaaaaggaggcgttcttccatcaggagctccctttgtatatacctccacccatctttagtagactcgatgcgcccgtcgattatttctatcggccagagacacaacaccgggaaggctataataatcctccaataagcggagagaaccttatcggtctttctagggctaggcgtcctcataatgcaatcttcgtgaatttcgaggatgaggaagtgcccaaacagccccttgaggcagctgctcaaacctggagacgggtttgtacaaaccccgtggatagaaaggttgaggaagagctccgcaaattatttgacatccgaccgatctggtccaggaacgctgttaaggcgaatatcagcgtccatccggacaaactgaaggttctgcttcccttcattgcctactatatgatcacaggcccttggcgcagtttgtggataaggttcgggtacgatcctcgcaagaaccctgacgctaaaatctaccaggtgctcgactttagaatcaggtgcggaatgaagcacgggtatgccccttctgacttacccgtgaaagcgaaaagaagtacatacaactactcactccccattacggtgaaaaaaacctcctcccaactggtcacaatgcatgatctgaagcagggcctcggaccaagtgggactagtggggcaaggaagcccgccagctcgaagtataagcttaaggattccgtgtatatcttcagggagggggccttgccgccctatcgacagatgttttatcagctgtgcgacctgaacgtggaagagcttcagaagatcattcaccgcaatgacggcgctgagaacagctgtactgagcgtgatggatggtgtttgccaaaaaccagcgacgaactgagagatactatgtctctcatgatccggcaaactattcggtctaagcgtcccgctctgttttcatcaagtgcgaaggcagatggcgggaaggagcagttaacgtatgaatctggggaagacgaagaagatgaagaagaagaggaagaagaggaggaggatttcaagccgtctgacggctccgaaaacgaaatggaaaccgaaattctggactatgtttag

SEQ ID NO: 19295 - DNA, 1533 bp, Artificial Sequence
  Description of Artificial Sequence: Synthetic coding sequence
atggccgccgaggccgccgacctgggcctgggcgccgccgtgcccgtggagttgaggagagagcggcgcatggtttgtgtcgaatatccaggcgtagtacgcgatgtcgctaagatgttacctacgctcggcggcgaagagggagtctccagaatctatgcagacccacccaaggacccttattgccacccagtgtgtgcgaataggttttcgacgtcgtctctcttgttacggattcgcaaacgaacacgaaggcagaaaggcgtcctgggcactgaagcgcacagcgaagtgaccttcgacatggagatcttgggcattatatctacaatctacaaattccagggaatgagcgactttcagtatttggccgtgcatacagaggccgggggtaagcacactagcatgtacgacaaggttctcatgctccggcctgagaaggaagccttcttccaccaggagttgccactttacattccaccccccatcttttcaaggctcgacgcaccggtcgattacttttataggcccgaaacgcaacatcgggagggttacaataatccccccatcagtggtgagaatttgatcgggttatccagagcccggaggccacacaacgcaattttcgtgaacttcgaggacgaggaagttcccaagcaaccattagaagccgcagctcagacttggcgcagagtgtgtacgaatccagtggaccggaaagtggaagaggaactgcgcaaactattcgatatacggccaatctggtctcggaacgctgtgaaggctaacatttcggtgcatcctgataagttgaaggttctgttgccctttattgcatactacatgatcacggggccttggcgttcgctgtggatccgatttggatatgatccgagaaaaaatccagacgccaaaatttaccaagtattggacttccggatcagatgcggtatgaagcatggttacgctccctccgatctaccagtgaaagcaaagaggtcaacctacaattattctctgcccataactgttaagaagacaagctcccagttagtgacaatgcatgatctgaagcagggcctgggcccctccggcacgtcaggagcccgcaaacctgcttctagcaagtacaagctgaaagattccgtctacatcttccgagaaggggctctgcctccatatcgccagatgttctaccagctctgtgacctcaatgtcgaggagctgcagaagatcatacacagaaatgatggtgccgaaaactcatgcaccgagagggatggttggtgtctacctaagactagtgacgaacttcgtgataccatgtcgctgatgatccgacagactatcagaagtaaacgcccagccctcttcagcagtagcgcgaaggcggatggagggaaagaacagctgacgtacgagtctggcgaggacgaggaggacgaggaggaagaagaggaggaagaagaagatttcaagccaagcgacgggtcagaaaacgagatggaaacagaaatcctcgattacgtctag

SEQ ID NO: 19296 - DNA, 1581 bp, Artificial Sequence
  Description of Artificial Sequence: Synthetic coding sequence
atggccgccgaggccgccgacctgggcctgggcgccgccgtgcccgttgagttacgccgcgagaggcggatggtgtgcgtcgaataccccggggttgtgcgggatgtggctaaaatgctccccacactcgggggagaagagggtgtttctcgtatctacgctgaccccacaaagaggctggagctgtacttcaggccaaaagatccctattgccaccctgtgtgcgcgaacagattctctacatctagcctcctcctacggatccgcaagagaacacggcgacaaaagggggtgcttggaactgaggcgcattctgaagtcactttcgatatggagatcctgggtattatttcaacaatctataaatttcaggggatgagcgacttccagtatctagctgtgcacaccgaggcaggggggaaacacactagtatgtacgataaggttctcatgcttcggcccgagaaggaggcattctttcatcaagagcttcccctttacatccctcctcctatttttagccggctcgacgcgcccgtggattacttctataggcccgagacacagcaccgagagggatataataacccgcccatttcaggtgagaacctgataggtctttctagagcgagacgcccgcacaacgctatcttcgtgaactttgaagacgaggaagtgccgaaacaaccactggaagctgctgctcagacatggagacgagtttgcaccaatccagttgacagaaaagttgaagaggaactaagaaagctgtttgatatccgcccaatatggagcaggaatgccgtcaaagccaacattagtgtgcatcctgataaactgaaagtgctcttaccattcatagcctattacatgatcacagggccctggagatccctgtggatccgctttggttacgacccgaggaagaatccagacgctaagatttaccaagtgttggattttcggatccgttgtggcatgaagcacggctacgcccctagcgacctgcctgtcaaggctaagcgttctacctacaactattctctgccaataacagtgaagaaaacatcctcgcagctggtaacaatgcacgatctcaagcagggcctcgggccttcaggaactagcggtgctagaaaaccagcctcatccaagtacaaactgaaggtatccttacagacactgagggacagcgtgtatatctttcgggagggagcccttcccccctatcggcagatgttctaccagctgtgtgatctcaacgtcgaggagttgcagaagatcattcacaggaatgatggggcagagaactcctgtacagagcgagacggctggtgcttgcccaaaacttctgacgagctgcgggacaccatgtcactgatgattagacagacaatccggtcaaaacgccccgccctcttttctagcagcgcaaaagctgatggcggcaaggaacaattgacatatgaatccggagaggacgaagaggacgaggaggaggaggaggaggaagaagaagacttcaagccatcagacggctcagaaaatgagatggagacagagatccttgactacgtatag

SEQ ID NO: 19297 - DNA, 597 bp, Artificial Sequence
  Description of Artificial Sequence: Synthetic coding sequence
tgacccctggaggccgccgcccagacctggcggcgggtgtgcaccaatccggtcgatcgtaaagtagaagaagagctgcgaaaattgtttgacattcgaccgatctggtctcgcaatgccgtgaaagctaatataagcgtccatcccgacaaactcaaggtcttactccccttcatagcatattatatgattaccggaccctggagaagcctctggattaggttcggatacgatcctcggaaaaaccccgacgcaaaaatatatcaggtgcttgacttccgaattcgctgtggaatgaagcacgggtatgcaccgtcagacctcccagtcaaggccaaacgcagtacttacaattacagcctgccaataacagtgaagaagacatcctcgcagttagtcaccatgcacgatctcaaacaaggtttagggccctccggaacatctggcgcacgaaagccggcttccagtaagtacaagctcaaggtttctctgcaaaccagtggtgaagaagtggttacgtctctccgggaagtctggcaccagcaactgcatgtcgtcgtgctgctcgagccctttggttctttggggccgcactag

SEQ ID NO: 19298 - DNA, 273 bp, Artificial Sequence
  Description of Artificial Sequence: Synthetic coding sequence
tgaatccggtgcggcatgaagcacggctacgcccccagcgacctgcccgtaaaggccaaacgcagcacttacaactatagcctcccgattacggtgaagaagacctcatcgcagttagtgacaatgcacgatctcaagcagggcctggggccttctggcacaagcggagcacgcaagccagcgtcatctaaatataagctgaaggtaggtgcaccagggggccaggaatggcgcggtggccttccctcatggggtagggccccttgtggttag

SEQ ID NO: 19299 - DNA, 675 bp, Artificial Sequence
  Description of Artificial Sequence: Synthetic coding sequence
atgagcgacttccagtacctggccgtgcacaccgaggccggcggcaaacacacctcgatgtacgataaggtcctgatgttgagacccgaaaaagaagcttttttccatcaggaactgcctctctacatccccccgccaatctttagtcgacttgacgcgccagtagactatttctataggcccgagacacagcatcgagaagggtataataatccaccaatttccggtgagaatctcatcggtctttccagggcccgccgcccacataacgcgatcttcgtgaatttcgaggatgaagaggtccccaagcagcctcttgaagccgctgcacagacatggagacgcgtgtgtacaaatcccgtcgatcgtaaagtggaggaggaactgcgcaaactatttgacattaggccaatctggagcaggaacgctgtgaaggcgaacattagcgtacacccagacaagctcaaggtactactgccctttatcgcttactatatgatcaccggcccctggaggagcttatggatacggtttggctacgatcctcgcaagaaccccgatgctaagatttatcaagtgctcgatttccgcattaggtgcggaatgaaacatggatacgcaccatctgatttaccagtcaaggccaaaaggagcacatacaattactcactttag

SEQ ID NO: 19300 - DNA, 735 bp, Artificial Sequence
  Description of Artificial Sequence: Synthetic coding sequence
atgacccgggccatctacgccgaccccaccaagcggctggagctgtactttcgtcctaaggatccctactgccacccagtgtgtgcaaataggttcagtacctcaagcctcctcctgcggatcaggaagagaacacgtagacaaaaaggtgtcttgggcactgaggcacattctgaagttactttcgacatggaaattcttggaattatttcaacaatctacaagtttcagggtatgtcagacttccagtatctcgctgttcatactgaagccggcgggaagcacacctcaatgtatgataaagttttaatgctccgaccagaaaaggaggccttttttcatcaggagctccccctgtatattccccccccaatttttagcaggctggacgctcctgtagactacttctatcgccccgagacgcagcacagggaaggatataacaaccccccaatcagtggcgaaaatctcattgggctcagtcgggccaggagaccacacaacgctattttcgtcaactttgaagatgaagaggtgccaaagcaacctcttgaagctgccgcacagacgtggcggcgcgtatgcacaaatcccgtggaccgaaaagtcgaggaagagctcagaaaattattcgacattcgcccaatctggtcaagaaacgccgtgaaagctaacataagcgttcaccccgacaaattgaaggtgttgctcccatttattgcctactatatgtag

SEQ ID NO: 19301 - DNA, 1548 bp, Artificial Sequence
  Description of Artificial Sequence: Synthetic coding sequence
atgggcagcctgagcagccgggtgctgcggcagccccggcccgcccttgctcagcaagctcagggagcccgcgccggcggctctgcaagacgccccgacaccggagatgacgccgcaggtcacgggttttgctactgtgctggctctcacaagcgaaagaggtctagtggctccttctgttactgccatcctgacagtgaaaccgacgaggatgaggaggagggagacgagcaacagagattgctgaacacccccaggagaaaaaagctcaagtccacctcaaagtatatataccaaacactgtttctgaacggcgagaacagcgacatcaaaatctgcgcccttggggaagagtggtcactccacaagatctacctatgtcaatctggctattttagttcaatgttcagtgggagctggaaggaaagctctatgaacatcatagagctggagatccccgatcaaaacattgacgtggaagccctccaagtggcgttcggctccctgtaccgcgacgatgtgctcattaagccttctagagtggtggcgatattagccgctgcttgcctattgcaactggatggactcatccagcagtgtggcgagacgatgaaggagacggtaaacgtgaagacggtatgcggatactacacctcggctggcacctacggactagatagtgtcaaaaagaaatgtctggaatggctgttgaacaatttgatgacccatcagaacgttgagctcttcaaggagctgtcaatcaatgttatgaaacagttaattggatcaagcaacttatttgtaatgcaggtcgagatggatatttacaccgccctcaaaaagtggatgttcttacagttggtacccagctggaacggatccttgaaacagctcctgacagagacagatgtgtggttctccaaacagcggaaagatttcgagggcatggccttcctagagacggagcaggggaagccctttgtgtccgtcttccgacacctgcggcttcaatatattatttcagatctggcctccgccagaattattgagcaggacgcggtagtgccaagcgagtggttatcgtccgtttataaacagcaatggttcgccatgttgcgcgctgagcaggactccgaggtcgggcctcaggagataaacaaggaggagctcgagggcaacagcatgaggtgcgggaggaagctggctaaagacggggagtactgttggcgctggacagggttcaatttcggattcgatcttctggttacatacacgaaccgctacatcatttttaagcggaatacactgaatcaaccatgttccggctccgtgtctctgcaaccccggcgaagcattgcctttcggttaaggctggccagctttgactcatcgggaaaactcatctgtagccgcacaacggggtatcaaatcctgaccctagagaaagaccaggaacaagttgtgatgaacctagacagcaggttactgatcttccccctttacatttgttgtaattttctgtacattagtcccgagaagaaaaattag

SEQ ID NO: 19302 - DNA, 1311 bp, Artificial Sequence
  Description of Artificial Sequence: Synthetic coding sequence
atggagcccgacgacttcgacagcgaggacaaggagatcctgagctgggatattaacgacgtgaagctacctcaaaacgtgaagaagaccgactggtttcaagaatggcctgacagttacgcaaaacacatttatagctccgaggataaaaatgcccagcgccacttaagctcatgggccatgcgaaataccaacaaccacaactcccgcatcctaaagaagtcatgtctcggcgtggtagtgtgcggcagggactgtctggcagaggagggaaggaaaatctacctcaggccagctatttgcgacaaggcgagacagaaacagcagagaaaacgttgccctaactgcgatggacccctcaaactcattccttgccgcggtcacggcggcttccctgtcaccaatttctggagacatgatgggagattcatttttttccagagtaaaggagagcatgaccatcccaaacccgaaacaaagctcgaggcagaggcccggcgggccatgaagaaggtgaatactgcccctagctcagtgagtctcagtctaaagggatctactgagacccgtagcctgcccggtgagacacagagtcaggggagtttacccctaacttggtcttttcaagaaggagtgcagctgcccgggtcctacagcgggcatctgatcgccaacactccccagcagaatagtcttaatgattgcttcagcttcagcaaatcatatggcctggggggtatcacggacctaactgaccaaacctcgactgtggacccaatgaagctatatgagaaaagaaagctctcctcctcgcggacatattcttctggagatcttcttccccctagtgccagcggggtgtactccgatcatggtgacctgcaggcttggtcaaagaatgccgccctgggaagaaaccacctcgcagataactgttacagcaactatccattccctctgacaagttggccgtgctctttcagcccttcacagaactcgagtgagccattctaccaacaactgcctctggaacccccagccgcaaagacaggatgtcctccgctctggccaaatcccgcaggtaatctctacgaagagaaagtgcacgtggatttcaactcatatgtgcagtcacctgcataccactcccctcaggaggacccattcttattcacatatgctagccaccctcatcagcaatacagtctgccttcaaagtcctctaaatgggatttcgaggaagagatgacctaccttggattggaccattgcaacaacgatatgctgctgaatctgtgtccactgaggtag

SEQ ID NO: 19303 - DNA, 1521 bp, Artificial Sequence
  Description of Artificial Sequence: Synthetic coding sequence
atgcccgccgccgccgtgcaggaggccgtgggcgtgtgcagctacggaatgcagctctcctgggacatcaacgatccccagatgcctcaggagctcgccttgtttgatcagttcagagagtggccggacgggtacgtgcggtttatttattcgtctgatgaaaaaaaggcccagcgacatctgagcggctgggctatgaggaacaccaataatcacaatgggcatatccttaagaagtcttgtctcggtgtggtggtctgcacacaggcttgtaccctccctgatggatccagactgcagttacgaccggctatatgtgacaaggcgcgccttaagcagcagaaaaaggcctgcccaaactgccatagtgcactggagctgattccgtgccgtggtcatagcggctacccagtgacgaatttttggaggctggacggcaatgccatcttctttcaggccaagggcgtacacgaccatccccggccagagtcgaagtctgagacagaggcccgccgctcagccatcaagcgccagatggcatctttctaccagccacaaaaaaagcgcattagagagagcgaagccgaagagaaccaagatagttccgggcacttctccaacattccaccactggaaaatcctgaggattttgatatcgttactgaaacatcctttcctattccaggccagccttgccctagcttcccaaagagcgacgtctacaaagctacttgcgacttggcaactttccaaggagacaaaatgcctccttttcagaaatattcttcgcccagaatctacttaccccgacccccttgttcatacgaattggctaatcccggctataccaactccagtccttatccgacgctgtataaagacagtacctccatacccaacgataccgactgggttcacctgaataccctccagtgtaacgtgaatagctattcctcttacgagcggtcgtttgatttcactaacaagcagcatgggtggaaaccggcgctgggcaagcctagtttggttgagcggactaatcacggtcagttccaagcaatggctacaaggccctactataatcctgagctaccatgtcgttacctgaccacgccccccccaggtgccccggccctgcagacagtaataaccactaccaccaaggtgtcataccaggcctatcagcctcctgcaatgaaatactccgacagtgtgcgggaagtcaagagcctctccagttgcaactatgccccagaagacacaggtatgtctgtctaccctgagccctggggccctcccgtcacagtcacacgcgcggcctccccgtctggcccgccacctatgaagatcgcaggggactgccgcgccatcaggcctacagtggccatacctcacgagcccgtaagctccaggacagacgaggctgagacctgggacgtgtgtctctcaggccttggcagtgcggtctcatacagtgatcgggtgggcccatttttcacgtataataacgaggacttctag

SEQ ID NO: 19304 - DNA, 1863 bp, Artificial Sequence
  Description of Artificial Sequence: Synthetic coding sequence
atggccgaggcccggaccagcctgagcgcccactgccggggccccctggctaccggcctgcaccctgacttagaccttcccggcaggagccttgccacgccagctccctcgtgctacctgcttggctcggaaccttcctcaggcctcggcctccaacctgagacccatttacctgagggatccctgaaacggtgctgtgtactgggactgccccccacaagtccagcatccagctccccttgcgcctcatcagacgtcacctccatcatccgcagctctcagacctcactcgtgacatgcgtaaatgggctgcggagccctcccctaactggagatctgggaggaccaagcaaacgtgcacgccctgggcccgcctctactgacagccatgaaggatcactgcaactcgaggcctgcagaaaagcaagcttcctcaaacaagaacctgcagacgagttttccgaattgtttgggccccaccaacagggcctcccccctccctatcccctgtcgcagctccccccgggaccctcactcgggggactcggattagggttggctggacgtgttgtggccgggagacaggcctgtaggtgggtggattgttgtgccgcatacgaacagcaagaggaacttgtacggcacatcgagaaatcccacatcgatcagagaaagggcgaagactttacctgtttttgggccgggtgcgtgcgcaggtacaagcccttcaatgcccgttacaaacttcttatccatatgagagtgcatagtggcgaaaagcctaacaagtgcatgttcgaggggtgtagcaaggccttttcacggctggagaatctgaaaattcacttgagaagtcacacaggagagaagccctacctgtgccagcacccgggttgccagaaagccttctcaaattcatcggatcgggccaaacatcagcggacccatttggatactaaaccttatgcctgtcagatacccgggtgctccaagcgctataccgatccaagtagtctcaggaagcatgtcaaagcccactcagctaaagaacagcaagtacggaaaaagctgcacgctggccccgacacagaagcagatgtgctgaccgagtgtttagttctgcagcagctgcatacttcaacgcagctggccgcctcagatgggaagggcgggtgtgggttggggcaggaactgctgccaggcgtgtaccctggtagtatcactccacataatggcctggcatcaggtcttcttcctcccgcccatgatgtccctagtcggcatcaccctctcgacgcaacaacatcaagccaccaccatctgtcacctctgccaatggccgagtcaaccagagatggactgggacctgggttgctttctcccatagtctcacctcttaaggggctggggcctccccctttaccacctagctcacaatcccattcaccaggcggccagcctttccctactctcccatctaaaccatcctatccgccctttcagtcgccccccccgcccccgctcccctcacctcagggttatcagggcagcttccatagcattcaatcatgttttccttatggagactgctatagaatggcagaacctgccgccggaggtgatggcctggttggagagactcatggatttaatccgctgagacctaatggttaccactctctttctacccctctgccggctaccgggtacgaagcactagcagaggcatcctgtcccaccgcgctgccccaacagcctagcgaagacgtcgtgagctcgggtcccgaagactgcggttttttccctaacggcgccttcgatcattgcttgggccacatcccaagcatctatacagatacctag

SEQ ID NO: 19305 - DNA, 1662 bp, Artificial Sequence
  Description of Artificial Sequence: Synthetic coding sequence
atggccgccgtgagcctgcggctgggcgacctggtgtggggcaagttgggcaggtatccaccctggcctggcaagatcgtcaatccccccaaggatcttaagaaaccgagaggcaagaaatgtttcttcgtcaagttcttcggtaccgaggaccatgcctggatcaaggttgagcagctcaaaccatatcacgcacataaggaggagatgatcaagattaataaaggcaagcggtttcagcaagctgtagatgccgttgaggaattcctgcgcagggccaaagggaaggatcagacgagcagtcataattcctctgacgacaagaaccgccgtaactcctctgaagaaagatccaggccgaactccggagacgagaaacgtaagctgtccctgagtgaggggaaagttaagaaaaacatgggagaaggtaagaagagagtgtcctccggaagctccgagcggggctcaaagagccccctgaaaagggcgcaagaacagtccccacgcaaacgggggcggcctcctaaggacgaaaaggacctaacaatccctgaaagcagcaccgtgaagggaatgatggcaggcccaatggcggcctttaagtggcagccaacagcctctgaacctgtcaaagacgccgatccccactttcatcacttcctgctcagtcagactgagaagccagccgtatgttaccaggcaatcaccaagaagctaaagatttgcgaggaggagacaggcagtacatcaattcaggctgctgacagcaccgccgttaatggctccataaccccaacagacaagaagatcggctttctgggcctggggcttatgggatccggcatcgtaagcaacttattaaagatgggccacactgtcacggtctggaacagaacagctgaaaagtgcgatctctttatccaggaaggagcgaggctcggtcgaacgccagctgaagtggtctctacctgtgatataacatttgcatgcgtctccgatccaaaagctgccaaggacctggtattagggccatccggcgtcctgcaggggattcgtcctggcaaatgttatgtggacatgagcaccgtggacgcggacaccgtcactgaactggcacaggtgattgtgtcacgcgggggccgcttccttgaagccccggtgagcgggaatcagcagctaagcaacgacggtatgcttgtgattctagccgccggggatagagggctatacgaggattgctcgtcatgtttccaggccatgggtaagacctccttcttccttggagaagttggtaacgcagccaaaatgatgctgatagtcaacatggtccagggatccttcatggccacaatcgccgaagggctgacactcgctcacgtcaccgggcagtctcagcagaccctcctggacatcctgaatcaaggccagctagcctctattttcctggatcagaaatgccaaaacatcctgcaggggaacttcaagccggacttctatctcaagtatatccagaaggacttgagactcgccatcgcactgggcgacgccgtcaaccaccccacccctatggcagctgccgccaacgaggtgtacaaacgggccaaggctctggaccagtctgataatgacatgtctgcagtgtatcgtgcgtacattcattag

SEQ ID NO: 19306 - DNA, 1611 bp, Artificial Sequence
  Description of Artificial Sequence: Synthetic coding sequence
atggccgccgtgagcctgcggctgggcgacctggtgtggggcaagttgggccggtatccaccttggcctggaaaaatcgtaaacccacctaaggatctgaaaaagccacgtggaaaaaaatgcttctttgtaaagttcttcggtacggaagatcatgcatggataaaggtagagcaactcaagccatatcatgcacataaagaagaaatgataaaaatcaacaaaggcaagaggtttcagcaggctgttgacgctgtggaggaatttcttcggagggcgaagggaaaggatcagacctcttcccataacagctccgatgataaaaaccgccggaactctagcgaagagcgctcccgacccaacagtggagatgagaagaggaagttatcactcagtgaaggcaaggttaaaaagaacatgggggagggcaagaagagagtgtcatccggctctagtgagagagggtcaaagtctcccctgaaaagagctcaggaacagagcccaaggaagcgaggaaggccgcctaaggatgaaaaggatctgactatcccagagtcatctactgtgaaaggaatgatggctggacccatggctgctttcaagtggcaacctaccgcaagcgagccagtcaaggacgccgacccccacttccaccacttcctgctgagtcaaactgaaaaggagacaggatccacgagcatccaggcagccgacagtactgccgttaatggatctatcacaccgactgacaagaaaatcgggttcctgggtctagggctgatggggtcagggatcgtcagcaatctccttaagatgggacatactgtgactgtttggaacagaaccgctgaaaaatgcgatttattcattcaggagggtgctaggctcggcaggactcccgccgaggtggtgtccacctgcgacataacctttgcctgtgtcagcgacccaaaggccgcaaaggacctggtactaggtccgagcggcgttctgcaggggattcgacccggcaagtgctacgtggacatgtctacggtcgacgccgacacagttactgaattggcgcaagtcatcgtgtctaggggaggccggttcttagaagccccggtgagcggaaaccagcagctcagcaatgacggaatgcttgtgattttagccgctggagatagggggctttacgaggactgttcctcatgcttccaagcaatgggaaagaccagttttttcctgggggaggtcggcaatgccgccaaaatgatgctgatcgtcaacatggtgcagggcagttttatggctacgattgcagagggactcactttagcgcatgtcaccggccagtcccagcaaacactcttagatattctgaaccagggacagctggcctctattttcctcgatcaaaaatgtcagaacattctgcagggaaattttaaacccgatttttacctgaaatatattcagaaggatctccgactggctatcgcacttggtgacgccgtcaatcaccccactccgatggccgccgcagcaaacgaggtgtacaagagggccaaagctctcgatcagtcagataacgacatgtcggctgtctaccgcgcatatatccactag

SEQ ID NO: 19307 - DNA, 1419 bp, Artificial Sequence
  Description of Artificial Sequence: Synthetic coding sequence
atggccgccgtgagcctgcggctgggcgacctggtgtggggcaagctcggacgttaccctccctggcccggtaagattgtgaatcctcctaaggatctcaagaaaccgcggggaaagaaatgcttttttgtgaaattctttggcacggaggaccacgcttggatcaaagtggagcagcttaaaccctatcatgcacacaaagaagaaatgattaaaattaataaggggaagcggtttcagcaggctgtagatgctgtcgaagagttcttgcgtcgggcaaagggcaaagatcaagacctgaccattcccgaaagctcaacagtcaagggtatgatggcgggccctatggcagccttcaaatggcagccaacagcaagcgaaccggtcaaggatgccgacccccacttccatcactttctgctgagccagactgagaagcccgcggtgtgttaccaggccattacaaaaaaactgaaaatttgcgaagaggaaactgggtccacctccatccaagcagctgactccacagccgtgaatggctcaattactcccactgataaaaaaatcgggtttcttggcttggggctcatgggatccgggatcgtcagcaacttgcttaaaatggggcacacggtcacggtctggaatcgcacggccgagaaatgcgacctgttcatccaggagggggctcgactgggcaggacacctgcggaggtagtctctacatgtgatatcacattcgcttgcgtgtcagatcccaaagcggctaaagacctagtgctggggccatccggcgtcctgcaggggatccgccctggtaagtgctacgtcgatatgtcaacggtggatgccgatactgtgacagagctggcgcaggtgattgtgtctcggggagggcgcttccttgaagcgcctgtcagcggaaaccagcaattaagcaacgacggcatgctggtcattttagctgccggggataggggattgtacgaggattgctcctcctgttttcaggcaatgggtaagacctcattcttcctgggagaggtgggcaatgccgccaagatgatgttgattgtcaatatggtccaggggagcttcatggccactattgctgaaggcttaacgctggcccatgtaacagggcagtcccagcaaaccttgctggacatcctcaaccaaggccagctggcatctatattcctggaccagaagtgtcagaacatactccaaggaaacttcaaacctgatttctatctcaagtacatacagaaggaccttcgactagccatcgcactgggggacgcggttaaccatccaacccccatggccgcggccgccaacgaggtgtataagcgggctaaggcacttgatcaaagcgataacgatatgtctgcagtataccgcgcctatatccattag

SEQ ID NO: 19308 - DNA, 6723 bp, Artificial Sequence
  Description of Artificial Sequence: Synthetic coding sequence
atgctgccctgcaagaagcggcggaccaccgtgaccgagagcctgcagcataagggcaaccaggaggaaaataacgtagatctagagagcgctgtgaagccagagtcagaccaggtcaaggatctcagctctgtgtctctttcctgggatccatcacatggcagggtcgctggttttgaagtgcagagtttgcaggatgctggaaatcagctcggcatggaagacacctcactgagctcaggtatgctgacccaaaatacaaacgtcccaattctcgaaggggttgacgtcgccatttcccaggggatcacactcccgagcctggaaagcttccacccactcaatatccacatcggcaaaggcaagttgcacgcaacgggctctaaaagaggaaagaaaatgacgctgcggccagggccagtgacccaggaggataggtgtgaccacttgactcttaaggaacctttttcaggggagccgagtgaggaggtgaaagaagagggtggcaagcctcagatgaatagtgagggggagattccctccctaccatctggttctcagtcagccaaaccagtctcccagccacgcaaatcaacacagcctgatgtatgcgcctctcctcaggaaaagcccctcaggaccctcttccaccagcctgaagaagagatcgaagacggcggattatttatccccatggaggagcaggacaatgaagagtctgagaagagaagaaaaaaaaagaagggtacaaaacgcaaacgggatggtcgggggcaggaaggcactctcgcctatgatctcaagctcgacgatatgttggatcgaacgctggaggacggggcaaaacagcacaacctcaccgccgttaatgtccggaacattctgcatgaggtcattacaaatgagcacgtagtggccatgatgaaggcggcgatatcggaaacggaagacatgcctatgttcgagcctaagatgacccggagcaaactgaaggaggtggtcgagaaaggagtggttatccctacctggaatatcagtccaatcaagaaagctaatgagattaaaccccctcagtttgtcgacattcacctcgaagaagacgactcatccgatgaagagtatcaacctgacgacgaagaagaggacgaaacagccgaagagagcctgctggaatctgatgtggaatctactgcatccagcccccgaggggctaagaagtcgcgcttgaggcagtccagtgaaatgacagaaactgacgaagaaagcggcattttgtctgaggccgagaaagtcaccactcccgctatcagacacataagcgctgaggtagtgcctatgggacctcccccgccaccaaagcccaagcagacccgcgattccaccttcatggagaagctacatgcagtggacgaggaactcgctagctccccagtttgtatggacagcttccaaccaatggacgattccctgattgctttccggacacgctcaaaaatgcccttgaaggacgtgccactgggccagttggaggcagaactgcaggccccggatattacaccggatatgtatgacccaaatacagccgacgacgaagactggaagatgtggttaggaggactgatgaatgatgatgtgggaaacgaggacgaggcggacgacgatgatgatcccgagtataattttctggaggacctggatgagcccgacaccgaagattttcggaccgacagagcggtcagaattactaagaaggaagtaaatgagttgatggaggagctgttcgagacattccaagatgaaatgggcttcagtaatatggaggatgacggtcctgaagaggaagagtgcgtggccgagccacgccctaattttaacacgccccaagccttaagattcgaggagcctctcgcaaacctgctgaacgaacagcaccgcacagtgaaagagttgttcgaacagctgaaaatgaaaaagtcctcagcaaagcaattgcaggaggtcgaaaaagtgaagcctcagtcagaaaaagtgcaccagaccctcattcttgaccccgcacagaggaaacggttgcaacagcagatgcagcagcacgtccaactactaacgcagatccatcttctggccacatgcaatccaaatctgaaccctgaggcaacaacaacccgcatcttcttgaaagagctggggacgtttgcacagagctctatcgcgttacaccatcagtataacccaaaatttcagaccctgttccagccatgtaatctgatgggggcaatgcaactgatagaagacttctccacgcatgtgtccatcgattgctctcctcacaagaccgtgaagaagaccgccaacgaatttccttgtctgcccaagcaagtcgcatggatcctggccacttcaaaagtgttcatgtatcccgagctgctgccagtgtgttccttgaaggcgaagaaccctcaggacaagatcgtgtttaccaaggctgaggacaatcttctggctctcggtctgaaacatttcgagggtactgaatttcccaacccattgatcagtaagtacctgctgacatgcaaaacggctcatcagctgactgtccgaatcaaaaatttaaatatgaacagagctcccgataatatcatcaagttctacaagaaaaccaaacagttacctgtcttaggaaaatgctgcgaggaaattcaaccacatcagtggaaaccgccgatcgagagagaagagcatcggctgcctttttggcttaaagcaagtctgccatcaatccaggaagagcttcgacatatggcagacggtgccagggaggtaggcaacatgaccgggacaaccgagataaattcggatcgatctttggagaaagacaatctggagctaggcagtgagtcgcgctaccccctgctacttcctaaaggtgtggtactcaagttgaaacccgtagcgaccagatttccgagaaaggcctggagacaaaaacgctcaagtgtccttaagccgctgctaatccagccgagcccgtctctccaaccaagtttcaaccccggaaagactcctgcacggagtacccacagtgaggctcccccaagtaagatggttttaagaattccccacccaatacagccagctactgttcttcagacagtgccaggtgtgccaccactgggggtgtcgggaggggaatccttcgagagtcctgcagcccttcctgccgtgccccctgaggccagaaccagcttcccgctgtctgagtctcagactctgctgtcctcagctccagtgcccaaggtcatgctaccgtcccttgcgccatccaagtttcgaaaaccttacgtgcggcgcaggccgagcaagcgacgcggcgtgaaagcaagcccgtgcatgaagcccgctcctgtcatacaccaccccgcctcggtcatctttacagtgccagccactacagtgaaaattgtatcacttggaggcggctgcaatatgatccagccggttaacgccgccgtcgcacaatcacctcagaccattccaatcacaaccttgctcgttaatcctactagcttcccttgcccccttaatcaatctcttgtcgcttcttccgtttcgcccttgattgtgagcgggaactccgtgaatttaccaattcctagcactcccgaggacaaggcgcacgtgaatgtcgacatcgcttgtgccgtagccgatggagaaaatgccttccagggcctggaacccaaactggagccgcaagagctcagccctttaagtgctacggtctttcccaaagtggagcatagtcccggcccccccctggctgatgctgagtgccaggagggtctcagcgaaaatagtgcttgcaggtggacggtcgtgaagacagaagaaggaagacaggcgctggaaccactcccacaggggattcaggagagcctgaacaatccaacccctggagatctagaggaaatcgtgaagatggaacccgaggaagctcgagaagaaatctcaggctcccctgagcgcgatatctgcgatgacattaaggtcgagcatgccgtagagctggatactggagcaccttcagaggagctgtcatccgcaggcgaggttaccaagcagactgtgctccagaaggaagaggaacgatcccagccaacgaaaacgccatccagctcccaggaacctcccgacgagggtacaagcggcaccgacgtgaataaggggagtagcaagaatgccctttcctctatggatccagaggtcagactgtcctcccccccaggtaaaccagaagactcctctagtgttgatgggcaatctgtgggaacgcccgtcggacccgagaccgggggtgaaaagaatggcccagaagaggaggaggaggaggattttgacgacctgactcaggatgaggaggatgagatgtcctctgcctccgaggagagtgtactatctgtgcccgagctgcaggaaaccatggaaaagctgacttggctggcgtctgagcgtaggatgtctcaagagggggagagcgaggaggaaaactcacaggaggagaactccgagccggaagaggaggaggaggaagaggccgagggaatggaaagtcttcagaaggaggacgaaatgacagacgaggccgtgggcgactccgccgagaagccacctacatttgcttctcctgagaccgcccccgaggtggagacctctagaacaccacctggggagtctataaaggcagcgggaaagggccgcaataaccatagggcacgtaacaagagaggaagcagagcacgcgcctcgaaggatacctctaagctgctgttactttacgatgaggacatattggaacgggacccattgagagagcaaaaagacttggcgtttgctcaagcctacctgacgcgagtgagagaagcgctgcaacacatccctggaaagtacgaagattttctgcaggtgatttatgagttcgagtccagcacccaacgacggaccgccgttgacctctataaatccttgcagatcctgttgcaggactggcctcagctcttaaaagacttcgcagcatttctattaccagagcaggctcttgcttgtggtttgttcgaggagcagcaggcgtttgagaaaagtcgtaagttcctccgccaactggaaatctgcttcgcggagaatccttcccaccatcagaagataataaaggtgctgcaggggtgcgcggactgtctgccacaggaaattaccgagctgaagacccagatgtggcagctactgaagggacacgatcatctgcaggatgagtttagtatcttctttgaccatctcagaccagccgcaagtagaatgggggacttcgaagagatcaattggaccgaggaaaaggagtatgaattcgacggtttcgaggaggtggctctgcctgatgtagaagaggaagaggagcctcccaagataccaaccgcctctaagaataagcggaagaaagagataggtgtgcagaaccacgataaggagaccgagtggcctgatggggccaaagattgcgcatgctcctgtcatgagggggggcctgattccaagctcaagaagagtaagcggagaagctgcagtcactgcagtagcaaggtttgtgattccaaatcctataagagtaaggagccccatgagctggtgggctcatctccccaccgagaagcctcaccgatgcccggagccaaggaggctgggcagggaaaggatatgatggaggaagaggctcccgaagaacgggaatcaacagaggcgacccagtctcgtactgtcagaactacgagaaagggcgagatgcccgtgtcgggattggcggttggtagcacactgccctcacctcgggaggttacagtgaccgaacgtctcctgctcgacggacccccgcctcactccccggagaccccacagtttccccccacgaccggcgcggttttgtacacggttaagcggaatcaagtgggccccgaggtgcgcagttgtccaaaggcttccccccgactccaaaaagagagggagggtcaaaaagctgttagtgaaagcgaagccttgatgctggtttgggatgccagcgaaacagaaaagctgcccggcacagtcgagccaccagcttcattcctaagccctgtgagctctaaaacgcgggatgccggccgccgccacgtgagtgggaaacccgatactcaggagagatggttaccatcttccagagcccgtgttaagacccgagataggacttgccctgttcacgagtcaccttctggcattgatacaagcgagacatcaccaaaagcccctcggggagggctggcgaaggatagcgggacgcaggccaaagggcccgagggcgaacaacaacccaaagccgcagaggccaccgtgtgcgccaataattcaaaagtgagtagcacaggtgaaaaagtcgtcttatggacacgcgaggccgatcgcgtgatcttgactatgtgccaggagcaaggggcccagccacagacattcaatatcatttctcagcaattggggaacaagactccggccgaggtgagtcatagatttcgggagcttatgcagcttttccacactgcctgcgaggcttctagtgaagacgaggacgatgcaacctctacaagtaatgcagatcagctgtccgaccacggtgacctcctgtccgaagaagaactggacgaatag

SEQ ID NO: 19309 - DNA, 4590 bp, Artificial Sequence
  Description of Artificial Sequence: Synthetic coding sequence
atgctgccctgcaagaagcggcggaccaccgtgaccgagagcctgcagcataagggaaatcaggaagaaaataatgtggatctggagtcagccgttaagcccgaatccgaccaggtaaaggacttatctagtgtatctctgtcctgggatccatcacacggccgggtggctggctttgaggtgcagtccttacaggacgccggaaatcaactgggaatggaggatacttccctgtcctctgggatgctcacccagaatactaacgtgcctattctagagggagtggatgtggccatctctcagggcattacgctgccttcattggaatctttccaccctctgaatatccatatcggaaagggtaaactccatgccacggggtcaaagcgcggcaaaaaaatgacattgcgccctggaccggtcacacaagaggaccggtgtgatcatcttacactcaaggagccattcagtggagaaccctccgaggaggtgaaagaagagggcggaaagccccaaatgaacagtgagggagaaatcccatcactgccctctgggagccaatccgctaaaccagtgagccaaccgcggaagagtactcagcctgatgtctgcgcgtcaccacaggagaagcccctgcggacactgttccaccaaccagaggaagagatcgaagacggtggcctgttcattccgatggaggagcaggacaatgaagagtcggagaagaggcgcaaaaagaaaaaggggaccaagaggaaacgggatggcaggggacaggagggaacacttgcttacgacctgaaacttgacgatatgctcgaccgcaccctggaggacggtgccaaacagcataatcttactgcagtcaacgttcggaatattctccatgaggtgatcaccaatgagcacgtggtggctatgatgaaagccgccatctctgagaccgaggacatgccaatgttcgaacccaaaatgaccagatctaagcttaaagaggttgtcgaaaagggagtcgtgattccaacttggaacatatctcctattaagaaggctaatgagatcaagcctccgcagtttgttgacattcacctggaggaagatgactcttccgatgaagagtatcagcctgacgacgaagaggaggacgagaccgccgaggaatcattattagaatcagacgtggagagcaccgcgagctctccacggggggctaagaagagtcgactgcgccaaagctctgaaatgaccgagactgacgaggagtccggaattctgtctgaggccgaaaaagttaccacacccgccattagacacatcagtgctgaagttgttcccatggggccacccccaccaccaaaacctaagcagactcgcgactctacattcatggaaaagctacacgcagtggatgaggagttggcaagttccccagtgtgtatggattctttccaaccaatggacgatagcctgatcgccttcagaacacgatcgaagatgcctctgaaagatgttcctctgggtcagctggaagccgaactgcaggccccagacattactccagacatgtacgatcccaacaccgccgacgacgaagattggaagatgtggctggggggactgatgaatgatgacgttggtaacgaagatgaagccgatgatgatgacgatcctgaatacaattttctggaggacctggatgaaccggacacggaagatttccggacagacagggctgtgagaattaccaagaaggaggtcaatgagcttatggaagaactgttcgagaccttccaggacgagatgggcttctccaatatggaggatgacggtccagaagaagaggagtgcgtcgccgagcctcgccctaatttcaataccccacaagctctgagattcgaagagcctctggctaatttactcaatgaacagcataggaccgtcaaggagcttttcgaacagctgaaaatgaagaaatcctccgcaaagcagctgcaggaggtcgaaaaggtgaagccccagagtgagaaggttcaccaaacgcttatcctcgatcccgcgcagaggaagagactgcagcagcaaatgcagcagcacgttcagctcctaacgcagattcacctgctggcaacatgcaacccaaacttgaaccccgaggccaccaccaccaggattttcctgaaggagcttggtacctttgctcagtcgtcaatcgccctccatcaccagtacaaccctaagtttcagacactgttccagccatgtaatctgatgggcgctatgcagctgattgaagatttctctactcatgtgagtatagattgcagcccacataagaccgtgaagaaaactgctaacgagtttccttgtctgccaaagcaagtggcctggatactcgccacttcgaaggtcttcatgtatcccgagctgttaccagtttgcagccttaaagctaaaaaccctcaggataaaattgtgttcacaaaagccgaggacaacctgttggccttggggttaaagcacttcgagggcacggaatttcctaaccctctgatttctaagtacctgctgacctgcaagactgctcatcagctcactgtgcggatcaagaatctgaatatgaacagggcccccgacaatattataaagttttacaaaaagactaagcagctgcccgtgttgggaaagtgctgcgaggagatccagccccaccaatggaagccaccaattgaacgagaggaacatcgcctgcccttctggctgaaggcgagcctgccctctatccaagaggagctgcgccacatggctgatggggcacgtgaggttggtaacatgacagggaccaccgagataaattctgatcgtagcctagagaaggacaacctggagttaggatctgagagccgttatccactgctgctgcccaaaggggtggtgttaaagttgaagcccgtggcaacacgctttccaagaaaagcatggcgccagaagcgaagctccgtcttgaagcccttgttaatccaaccctctccttcactccagccaagcttcaatcctggcaagaccccggccagatccacacacagtgaagcccctcctagtaaaatggttttgcggattccccaccccatccaacctgcaacggttctgcagacggtgcctggcgtaccacctctcggcgtgtccgggggcgaaagcttcgagtcaccggccgcccttccggcggttcccccggaggctcgcaccagtttcccgctctccgagtcccagacactcttaagttctgcgcccgtacctaaggtgatgctgccaagcctggccccatctaagttcagaaagccttacgtgagaaggaggccatcaaagagacggggtgtgaaagcctctccctgtatgaaacctgcaccggtaattcatcatccagctagtgttatctttactgtacccgccaccacggtgaaaatcgtttcacttggaggaggatgcaatatgatccagcctgtcaacgctgcagtggcgcaatctcctcagacgattccaattacaactctcctggtaaatcctacatcttttccatgtccgttaaaccagtctctggtggcaagctccgtcagcccgctgatagtgagtggcaatagtgtcaacctgcctatcccttctacaccagaggacaaggcccacgttaatgtcgacattgcatgcgccgttgccgacggcgagaatgccttccagggattggaacctaagcttgagccccaggaactgtctcccctttcagctactgtgtttcctaaggtggaacacagtccagggccacctctcgccgacgctgaatgccaggaagggctctccgaaaactctgcctgcaggtggactgtggtgaaaacagaagaggggaggcaagctttagaaccattacctcaaggtatccaggagtctctcaacaatcctaccccaggggatctggaggaaattgtaaagatggagcccgaggaggcccgtgaggagatttctggatctcctgaacgggacatctgtgacgacatcaaggtggagcacgcagtggagttagacactggtgctccttctgaagagttgagtagcgctggggaggtgaccaaacagacagtgctgcagaaagaggaggagcgtagccaacccactaaaaccccatcttctagccaagagccaccggatgagggtacaagtgggactgacgtcaacaaggggtcttcgaagaatgctctaagcagcatggatcccgaggtgcgactgtcctcaccgcctggaaaacccgaagattcatcatctgtcgatggacagtccgttggcacgccagtgggtcccgagaccggcggtgaaaaaaatgggcccgaagaggaagaagaggaggatttcgatgatctaacacaagacgaggaagacgagatgtcatctgctagcgaggagtcagttctttccgtgccagaactgcaggtgagggctggtgagtacagccaagtattcagaggcctgtcaaacatgtaccaccttctgatctgccatctgttggcgtgttgtacaatggactcacctaagatcatttgcatctag

SEQ ID NO: 19310 - DNA, 726 bp, Artificial Sequence
  Description of Artificial Sequence: Synthetic coding sequence
atgtacgaccccaacaccgccgacgacgaggactggaagatgtggctgggcggcctgatgaacgatgacgttggtaacgaagatgaagccgatgacgacgacgacccggaatataatttcttagaagatctcgatgagccagacacggaggacttccggacagacagggcagttcggatcactaaaaaggaagtaaacgagttgatggaggagttatttgagacctttcaagacgagatgggatttagcaatatggaggacgacggccctgaggaggaggagtgtgtggcagaaccgcgaccaaacttcaatacaccacaggctctgaggtttgaggaacctctggccaatctgttgaatgaacagcatcgcaccgtcaaagaattgttcgaacagttgaagatgaagaagagctcagccaagcagctgcaggaggtggagaaagtgaaaccacagagcgagaaagtccaccagaccctgattctggaccccgcacagcgcaagaggctacagcagcagatgcagcagaaagagcttgggacattcgcccagtctagcatcgctctacatcaccagtataatccgaaatttcagaccctgttccaaccttgcaatctgatgggagccatgcagttaatcgaggactttagcactcatgttagtattgactgctcccctcacaaaacagtaaagaagaccggaagacgccagatgtgccagctctag

SEQ ID NO: 19311 - DNA, 6726 bp, Artificial Sequence
  Description of Artificial Sequence: Synthetic coding sequence
atgctgccctgcaagaagcggcggaccaccgtgaccgagagcctgcagcacaaagggaaccaagaagagaacaatgtcgacttggaaagtgcagtaaagcccgagtcagatcaggtgaaggatctcagtagcgtgagcctcagctgggacccctctcatgggcgggtggctggctttgaggtgcaaagcctccaggacgctggaaatcaactagggatggaagataccagcctctccagcgggatgttgacccagaacacaaacgtgccaatactggagggcgttgacgtggccatcagtcagggaattaccctgccatccctcgagtcattccaccccctcaatatacacattggcaaggggaagctgcatgctaccggttcaaagagaggcaagaagatgacacttaggcctggccctgtgactcaagaagatcggtgcgaccacctgacactgaaggagccatttagcggagaacccagtgaagaggtgaaagaggagggggggaagcctcagatgaattccgaaggggaaatcccttcactgcctagcggatcccagtcagcaaaacccgtttcccaacccaggaagtctacccaacctgacgtgtgcgcatcgccacaggaaaaaccactgaggactctgttccaccagcccgaagaggagattgaagatggaggcttatttatcccgatggaggagcaggataacgaggaatccgagaagagacgcaagaagaagaaagggactaaaagaaagcgcgacggtagaggacaagagggtacccttgcatatgacttaaaactggatgatatgttggatcgcactttggaggatggggcaaaacaacacaatcttaccgccgtgaatgtgagaaacatactgcacgaagttatcacgaacgaacacgttgtagccatgatgaaggccgctatttccgaaacagaggatatgcccatgtttgaacccaagatgacccgaagcaaactgaaggaggtggtggaaaagggagtcgtgatccccacctggaatatcagccctatcaaaaaggcaaacgaaattaagcctccacaattcgttgatattcatctggaggaggacgactcttctgatgaggagtaccagccagatgacgaagaggaggacgaaacagccgaagagtctctgctggaatccgatgtggaatccacagcctcctctcctaggggagctaagaaatcaagactcaggcagtcttccgagatgaccgaaacagacgaggaatcgggaattttgagcgaggcagagaaagtgacgactcccgccattcgacacatctccgctgaggttgtacccatgggaccgccaccccctccgaagccaaaacagaccagggactctaccttcatggagaaactgcacgcagtagacgaggaacttgcttccagccctgtctgtatggattctttccagcctatggacgatagtttgattgctttcaggacaagaagtaagatgccgcttaaagacgtgccactgggccagctggaggccgaactacaggcgcctgatattaccccagacatgtatgatcctaacacagcagacgatgaggactggaaaatgtggttgggtgggcttatgaacgatgatgtgggaaatgaggacgaggccgatgacgatgatgatccggagtacaacttccttgaagatctggacgaacctgacactgaggattttagaacggaccgggctgtgaggatcactaaaaaggaagtcaacgagctcatggaggaactttttgagacatttcaggacgagatgggcttttcgaatatggaggatgacggcccagaagaagaggagtgcgtggccgaaccgcgtcctaatttcaatactccgcaggctctgcggtttgaggaaccgcttgccaatcttcttaacgaacaacacaggaccgttaaggaattattcgagcagctgaaaatgaagaaaagcagtgcgaaacagttgcaggaggtcgagaaagtcaagcctcagtccgagaaggtgcaccagactctcatcctcgaccctgcccagagaaagcgcttacagcaacaaatgcagcagcatgttcagcttctgactcagatccatttacttgctacctgtaaccctaatttaaatcctgaggccacgaccacaaggatattcctgaaggagttaggcacgttcgcccagagtagcattgccctccatcatcaatacaatccgaaatttcagacattattccagccttgcaatctcatgggtgcaatgcagctaatcgaggatttttccactcatgtaagcattgactgctccccacataagacagttaaaaagaccgccaacgaattcccttgtttaccaaagcaggtcgcgtggatactggcaactagtaaggtatttatgtaccccgaactccttccagtgtgcagcctgaaagccaagaatccccaggacaagatagtattcaccaaagcagaggacaacctgctggctctggggcttaagcatttcgaggggaccgaattccctaacccattaatctctaagtacctgcttacatgcaagaccgcccaccaactcaccgtacgcattaaaaatttgaatatgaacagggcccccgataacatcattaagttctataaaaaaacgaagcaactcccggtgctggggaaatgttgtgaagaaatacagccacaccagtggaagccacctatcgaaagggaagagcataggttaccattctggctcaaagcttctctgccgtccattcaggaggagctgagacacatggccgacggcgccagggaggtaggcaacatgaccggtacaacagaaattaatagtgaccgcagcctagagaaagataatctggaactcggctccgaatctaggtatcctctcctgctccccaaaggtgtggtgctgaagcttaaacctgtggccacacggtttcctaggaaggcctggcggcagaagagatccagtgtgcttaagccgctattaatacagccatcccccagtctccagccaagtttcaatccggggaagacacccgcgcgctctacgcacagcgaggcacctccgtctaaaatggtcctccgcattcctcaccctatccagcctgccacagtcctgcaaacggtgcctggcgtaccccctctcggcgtgtccggcggggagagcttcgaaagcccggccgcccttcctgcagtgccgcccgaagcacgtacatccttcccactgagcgaatctcagactttgctgagctcagcccccgtgcctaaggtcatgcttcctagcctcgccccctcgaaatttaggaagccatacgtgaggcgacgcccatcgaaacgcagaggtgtgaaggcatctccttgtatgaagcccgcccctgtgatccaccatccagcttcagttattttcaccgttccagcaaccacagtgaaaatagtgtcattgggtggaggatgtaacatgatacagcccgttaacgcggccgtcgcacagagccctcagacaattcccatcaccaccttacttgtgaaccctacatctttcccatgtccattaaaccagagcctcgtggctagctcagtgagccctttgattgtcagcgggaactcagtcaacctcccaatccccagtacaccagaggacaaagcccatgtgaatgtggacatcgcctgtgctgtggcagatggtgagaatgctttccagggcctggagcctaagctggagcctcaagagttgagccctctaagcgctacagtgttcccaaaggtggagcacagccccggccctcctttggccgatgccgagtgccaagaggggctgagcgagaatagcgcctgcaggtggaccgtggtcaagaccgaggagggacgacaggctctcgaacctttgccccaaggcattcaggagtccttgaacaacccaacacccggcgacctggaagaaattgtcaagatggagcctgaagaggctcgtgaggagatctccgggagccctgagagggatatttgcgacgatatcaaagtagagcatgcagtggaactcgacacgggcgctccatcagaggaattgagctccgctggggaggtgactaagcagactgtgctccagaaggaagaggagcgctcccaacccactaagactcctagttcgtcccaagaaccaccggacgagggaacatcaggcaccgacgtcaacaaggggagtagtaagaacgccctgtcaagcatggaccctgaggtaaggctgagtagtccacccggcaagcctgaagacagctctagtgtcgacgggcaatcagtgggaactccagtggggcccgaaacaggaggggaaaagaacggccccgaagaagaggaggaggaagacttcgatgacttgactcaggatgaagaagatgaaatgagtagcgcctctgaggagtccgtgctgtctgtccccgaactccaggagacaatggaaaagctgacctggctggcttccgagagaagaatgagtcaggagggtgagagtgaggaagaaaacagccaagaggagaattccgagcctgaggaggaggaagaagaggaggcagaagggatggaatccctacaaaaagaagacgaaatgacggacgaggcagtcggagactcggccgagaaaccccctaccttcgcctcaccggagacagctcccgaggtcgagaccagccgtacacctcccggggagtcaattaaggccgcaggaaagggaagaaataaccacagagccaggaacaaaaggggaagtcgcgcccgggcatccaaggacaccagtaagctgctactgctctacgacgaggacatcttagagagagatcctttgcgtgaacagaaggacctggcgtttgcacaagcctatcttacaagggtccgcgaagcactgcagcatattccagggaaatacgaagacttcctgcaggttatctacgagtttgaatctagcacccagcgacggaccgccgtggatctctacaagtctcttcagattctgctacaggactggccccagttgctcaaagacttcgcagcttttcttcttcctgaacaggccctggcctgcggcctgtttgaagagcagcaggcgtttgagaagtcacgcaagtttcttcgtcagctcgaaatttgcttcgccgaaaacccatcacatcaccagaagataattaaggtgctccaagggtgtgccgactgtctgccacaggaaataacagaactaaagacccagatgtggcagctgctgaaggggcacgaccacctgcaggatgagttctctattttctttgatcacctgagaccagcagccagccgtatgggggacttcgaagaaatcaactggacagaagaaaaagagtatgagtttgacgggtttgaggaggtggcattgcctgacgtggaagaggaagaagaacctcctaagattccgacggcaagtaaaaataagaggaagaaggaaattggcgtgcagaaccatgacaaagagaccgaatggccagacggagcaaaagattgtgcatgcagttgccatgaaggggggcccgacagtaagctcaagaagtctaagagacggagttgcagccactgctccagcaaggtgtgcgattctaagagctacaagtcgaaggaaccccacgaactggtgggaagttctccccatcgggaagcttctcctatgccgggagctaaagaagctggccaggggaaagacatgatggaggaggaagcccccgaagaacgagaatccactgaagccacccagtctcgcacagtgaggaccacgcggaaaggagagatgcctgtttccgcaggacttgcggtgggatctacgctgccttccccaagggaggtgaccgtgacagaacggttgctgttagacgggccaccaccgcactcccccgagaccccacagtttccccccacaaccggggcagtgctctacacagtgaagagaaaccaggtgggtcccgaagttagaagttgccccaaggctagtccacgcctccaaaaggaacgggaaggacagaaggccgtgtccgagtccgaagcactcatgctggtatgggatgcaagcgaaacagaaaaattaccaggaactgttgagccacccgcttcttttttaagccctgtgtcctctaaaacacgcgacgctggccggaggcacgtttctgggaagcccgacacgcaggagaggtggctgccatctagccgagcacgcgtgaagacccgtgacagaacttgtccagttcatgagtcaccctccgggatcgatactagtgagacctcacccaaggctccacgaggggggttggcaaaagactccggaactcaggcaaagggcccagagggtgaacaacagcctaaagcggccgaagcaacagtctgcgccaataattctaaggtgtcttctacaggtgagaaagtcgtgctctggacgagagaggccgacagggttattctcaccatgtgccaggagcagggcgcccaaccacagacatttaacatcatctctcaacaattaggcaataagactcctgctgaggtgtctcacaggtttagagaactgatgcagttattccacaccgcctgtgaggcctcatccgaggacgaagatgacgctactagtacaagtaatgcagaccagcttagcgaccacggtgatttactctccgaggaggaactcgatgagtag

SEQ ID NO: 19312 - DNA, 6723 bp, Artificial Sequence
  Description of Artificial Sequence: Synthetic coding sequence
atgctgccctgcaagaagcggcggaccaccgtgaccgagagcctgcagcataagggtaatcaggaggaaaacaatgtggacttagagtccgccgtcaagccagaatcagatcaggtgaaggacctgtcttccgtgagtctaagctgggaccccagccacggccgggtcgcagggtttgaagtgcagtctctgcaggatgccggcaatcagttgggtatggaagacacgagcctgtcctcaggaatgcttactcagaacaccaatgtgcctatcctcgagggtgtcgacgttgctatctcccaaggaatcaccctgccctctttagagtccttccatcccctgaacattcacataggaaaaggcaagctgcacgcaactggttccaaacggggaaaaaagatgacactgcgacctggtcctgttactcaggaggatcgctgtgatcatctcaccctgaaagaacccttttcaggggaaccttctgaggaagtgaaagaagagggaggaaagccgcagatgaattcagaaggggaaataccatcccttcctagcggcagccagtccgcaaagcccgtttcccagcccagaaagagcactcagcccgatgtgtgcgcctcaccccaggagaagccactgagaacgctgttccaccaacccgaagaggagatcgaagatggaggcctctttataccgatggaagaacaggacaacgaggagtcagagaagcgcagaaaaaagaagaaggggacaaagcgcaaaagggatggaaggggacaggagggtaccctggcgtacgacctgaaactcgacgatatgcttgacaggaccttagaggacggggcaaaacagcacaatctgaccgccgtgaatgtgcggaacatcctgcatgaggtcataaccaacgaacacgtggtcgcaatgatgaaagccgccattagcgaaaccgaggacatgcccatgttcgagcctaaaatgactagatccaagctgaaggaagtggtggaaaaaggtgtggtgatccccacctggaacatctcaccaatcaaaaaggccaatgagatcaaaccgccccagttcgtcgacattcacctcgaggaggatgactcttctgacgaggaatatcagccagacgacgaggaagaagacgagaccgccgaagagtcccttctggagtcagacgttgaaagtacagcatcatctcctaggggtgccaagaagtcccgcctgcggcagtcatccgaaatgaccgaaaccgatgaggaatctggaattctgtcagaggcggaaaaggtgactaccccggcgatccgtcacataagcgctgaggtagtgcctatgggcccaccccctccacccaaacccaagcagacacgtgactccaccttcatggagaagctgcatgccgttgatgaggaacttgccagttctcccgtgtgcatggatagttttcaacccatggacgactccctcattgcgtttagaactcgatccaagatgcccctgaaggacgtgcccttgggccagttagaagccgagttacaagccccagatatcacacctgatatgtacgatcctaacaccgccgacgacgaggactggaagatgtggctaggaggactcatgaacgacgatgttggaaatgaagatgaggctgatgatgacgatgatcccgagtataattttcttgaggaccttgatgagccagacactgaagacttccgcactgacagggctgttcgcataacaaaaaaagaggtgaatgagctaatggaagagttattcgagacctttcaagatgagatggggttttccaacatggaggacgatgggccagaagaagaggaatgcgtggctgagccaagaccaaactttaacactcctcaagctctgcgattcgaagagcctcttgccaacctgctgaacgaacaacaccgtactgttaaggagctgtttgagcagctgaagatgaagaagtcgtcagcgaaacagctgcaggaggtggaaaaggtcaagcctcaaagtgagaaggttcaccaaaccctaattctggaccctgctcagcgtaaacgccttcaacaacagatgcagcagcacgtgcagctgctgacacagatacacctgcttgctacttgtaaccccaacctgaatccagaggcaactacaactaggatctttctcaaagagctgggcacgtttgcccagtctagtatcgccctgcaccaccagtacaaccccaagttccagacactcttccagccgtgcaatctgatgggagctatgcaattaatagaagatttctctacccacgtgagtattgactgcagccctcataagaccgttaaaaagacagccaatgaattcccatgcctgcccaagcaggtggcttggattctggctacctcaaaggtgtttatgtacccagaacttctacccgtatgtagtcttaaggcgaagaacccacaggataagatcgtctttaccaaagccgaagataacctcctcgccctgggcttgaagcatttcgaagggacagaatttccaaatcctctgataagcaaatatctcctcacttgtaagactgcccaccagctaactgtgcgaattaagaatttaaatatgaaccgggccccagataatattatcaagttctacaagaagacaaaacagctgcctgtcctgggcaagtgctgcgaggaaatccaaccccaccagtggaaaccacccattgaaagggaggagcaccgtttgcctttttggctgaaggctagccttccctctatccaagaagagctgcgccatatggctgatggcgcccgtgaagtgggcaacatgacaggaacgaccgaaataaacagtgatcggagcttagagaaagataacctcgaactgggatccgaatcaaggtaccccttgttgcttcccaagggggtggtcctgaagctgaaacccgtggcaaccaggttccctcggaaagcatggcgccagaagcgaagctctgtgttgaagcctcttctgatccagcccagtccatctttacagccaagtttcaaccctgggaaaacgcctgcacgctccacacatagtgaagccccaccaagtaagatggtcttgaggatacctcaccccattcagcctgctactgtgttgcagaccgtaccaggagtgcctccgttgggagtatcagggggcgagtccttcgaatcacctgctgcacttcctgctgtgcctcctgaggcgcgcacctcttttccactgtccgagtctcagaccttattatcatccgcccctgtgcccaaagtgatgttaccgagtctcgcgccaagcaagttcagaaagccttatgtgaggagacgtccgtctaaacgtagaggagtgaaagcttcaccttgtatgaagcccgcacccgtgattcaccaccccgcttcagtcatatttaccgtccccgccactaccgtcaagatcgtgtctctcggtggggggtgcaatatgattcagcccgtgaacgctgccgtggcacagtcaccacagaccattcctataacaactctccttgttaatcctacgagctttccctgccccctgaatcagtcactggtggcctccagtgtaagccccctgatcgtgtctgggaactccgtgaacctgcctatcccctcgacccccgaggacaaggctcatgtaaatgtggatatcgcgtgcgctgtcgccgacggggagaatgcgtttcaggggttggagcctaagttggagcctcaagagctctctcccctgtccgccaccgtgtttcccaaagtggagcattcccctggcccacctctcgccgatgccgaatgccaggaaggcctctccgaaaatagtgcctgccggtggaccgtggtaaaaaccgaggagggtagacaggcacttgagcccctgccacaaggcattcaggagagtctgaataaccctacccccggtgacttggaggagattgtaaaaatggagcccgaggaagcccgcgaagaaattagcggttcacccgaacgggatatttgcgacgacattaaagtggaacatgccgtggagctggacactggagccccctccgaggaactatcgtcggccggagaggtgaccaaacagacggtgctgcagaaagaagaggaaaggtcacagcccaccaagaccccttccagcagccaagagccaccagatgaaggcaccagcggcaccgatgttaacaaggggagctccaagaacgccctgagctccatggaccccgaagtcagactgtcttccccccccggtaaacccgaggacagctccagcgtggatggacagagtgtagggacccctgtaggacctgaaactgggggggaaaaaaacggtccagaagaagaagaggaggaggattttgatgacctgacacaggacgaggaggacgaaatgagctcagccagcgaggagtccgtgctgtcagtgcccgagctccaggagacgatggaaaagctcacatggttggcaagcgagcggagaatgtctcaggaaggcgaatcagaggaggaaaattctcaagaggagaattctgagccagaagaagaagaggaagaggaagcagagggtatggaatctctgcagaaagaggacgaaatgacagacgaggcggtgggcgattctgccgagaagccacccaccttcgctagcccagagacagcccctgaggtagagacgtccagaactcctcccggcgagagtataaaggcagccggcaagggcagaaataatcaccgcgcccggaacaaacggggatcccgggcccgggcttccaaggatacctcaaaactgcttcttttatacgatgaggacatcctggaacgggatcctctgcgggaacaaaaagatcttgcatttgcccaggcctatctcacacgcgtgagggaagctctgcaacatattccagggaagtatgaggattttctacaagtcatctacgagttcgagagctcgacccagagacggactgcagtcgacctgtataagagcctgcagatcctgctgcaggactggcctcagctgctgaaagattttgctgccttcctcctccctgaacaagccttagcttgtgggctgttcgaggagcaacaggcatttgaaaaaagcagaaagtttctccgccaactggagatttgtttcgctgaaaatcccagtcatcaccagaagatcataaaggtccttcaggggtgcgccgattgccttccccaggaaattacagagctcaagacccagatgtggcaactccttaagggacacgatcacctgcaagacgagttcagcatctttttcgaccacctgcgccctgccgcctcaaggatgggcgatttcgaggaaataaattggacagaggaaaaggaatatgagtttgacgggttcgaggaggtcgctcttcctgatgtcgaagaggaggaggagccgccaaagattccaactgcttcaaagaacaagcgtaagaaagagataggggtgcagaatcacgataaagagaccgagtggcctgatggcgctaaagattgcgcttgtagctgccatgagggaggacctgacagcaaactgaaaaagtccaaaagacgcagctgcagccactgtagtagcaaggtctgtgattcaaagtcatataagtccaaagagcctcacgaactcgtgggctcatcccctcaccgcgaagcgagtcccatgccgggagccaaggaggccgggcagggtaaggacatgatggaggaggaggctcccgaagagcgcgaatctactgaagccacgcaatctcgcaccgtccgcaccaccagaaagggggagatgcctgtgtccggacttgccgtgggctctaccttacctagccctagagaggtgaccgttacagagaggcttctgttggatgggcccccgcctcatagccctgagaccccacagtttcccccgaccacaggcgcagtgctttatactgttaagcgaaaccaagtgggacccgaggtgcgcagctgtcctaaggcctcaccaagactgcagaaagaacgtgaaggacagaaggcagtcagcgagtccgaagcattgatgctggtgtgggacgcgtcagaaactgaaaaacttcctggaactgtggaaccacccgcctcctttttgtcaccagtaagctccaaaacacgagacgctggcagaagacatgtcagcggaaaacccgatactcaggaaagatggctcccttcaagcagagccagagtgaaaaccagagacaggacttgccctgtgcatgagtcaccctccgggatcgatacgagtgagactagccccaaggcaccgcgcgggggactggcgaaggacagcgggacacaagcaaaaggcccagagggtgagcagcagccaaaagccgcagaggccaccgtgtgcgccaacaatagcaaagtgtccagtaccggcgagaaagtagtgttgtggacccgagaagccgacagggtgatcctcaccatgtgtcaggagcaaggcgcccagccccaaacctttaacatcatcagccagcagttgggcaataaaaccccggccgaggtatcccatcgcttccgcgaattaatgcagctgtttcatacagcatgtgaggcgagctcagaggatgaagatgatgcaactagtacttctaacgccgatcaactgagcgatcatggagacctgctatctgaagaggaattggatgagtag

SEQ ID NO: 19313 - DNA, 2913 bp, Artificial Sequence
  Description of Artificial Sequence: Synthetic coding sequence
atgctgccctgcaagaagcggcggaccaccgtgaccgagagcctgcagcacaaaggaaatcaagaagaaaacaacgtggatctcgagagcgctgtgaaacccgagagcgaccaggtgaaagatctttcaagcgtatccctctcatgggacccctcccacgggagggtcgcaggcttcgaagtgcagtcactgcaggatgccgggaatcaactcggcatggaggatacgtcactgtcttcgggcatgctgacccagaacacaaatgttccaatactcgaaggtgtggatgtggctataagccagggaattactctcccgagcctggagtcctttcaccctctgaatatacatataggcaaagggaagctgcatgctacagggtctaaacgtggaaagaagatgaccctaagacctgggcccgtgactcaagaagaccgatgcgaccaccttacccttaaggaacctttttcaggcgagcccagtgaagaagtcaaggaggaaggaggtaagccacagatgaacagtgagggggagatccccagccttccttccggatctcagtcagctaaacccgtcagccagccgcggaagtccacccaaccagacgtatgcgcaagtcctcaggagaagccactgagaactctgttccatcagcccgaagaggagatcgaagacggaggcctctttattcctatggaggaacaggacaacgaagaaagtgaaaaaaggcgcaagaagaaaaaaggcacaaaacggaaaagggacgggcgcggacaggagggtaccctggcctacgacctgaagctggacgatatgctagacagaaccctcgaggatggcgccaaacagcataatttgaccgccgtgaacgtgcggaatatcctccacgaggtgatcacaaatgagcatgttgttgcaatgatgaaggccgctatttccgagaccgaggacatgccaatgttcgagccaaagatgacacgttccaagctcaaggaggttgttgagaagggtgtggtgatcccgacttggaacatctcccctatcaaaaaggccaacgagataaaaccaccacaattcgttgacatccaccttgaagaagatgattcgtctgacgaggaataccagccagacgatgaagaggaagatgaaaccgcagaggaatcgttgctcgagtccgatgtggaatccacagcctccagcccacggggggcaaagaagtcccggctcagacaatcctcagagatgacagagaccgacgaagagtccggaattctgagtgaggctgagaaggtgaccactccagctattcggcacatctcagcagaggtagtgcccatggggccgccacccccaccgaagcccaaacagacccgagactcaaccttcatggaaaagctacacgccgtcgatgaggaacttgcctctagtcccgtgtgcatggactcttttcagcccatggatgacagcctgatagccttcagaacccggagcaaaatgccactcaaggacgttccgctgggacagttggaagccgaactccaagctcccgatatcaccccagatatgtacgatcctaacacagccgatgatgaggattggaaaatgtggctgggaggcctcatgaatgatgacgtcggcaacgaagacgaggcagacgatgacgacgatcctgaatataactttcttgaggatctagacgaacccgatacggaagactttaggactgaccgggcagtcaggattaccaaaaaggaggttaacgagcttatggaagaacttttcgagacctttcaggacgagatgggattctcaaacatggaggatgacggacccgaggaggaggagtgcgtcgccgagcccagaccaaactttaacactcctcaggcacttcgatttgaagagccactagcaaatctactcaacgaacaacataggaccgtgaaggaactgttcgagcagcttaagatgaaaaagtcaagcgccaagcagcttcaggaggtggaaaaggtcaaaccacagtccgagaaggttcaccaaacactcatactggaccctgctcagcgaaagcggctgcagcaacaaatgcaacagcatgtgcagttacttacccaaattcatctgctggccacttgtaacccgaatttgaatcctgaggcaacaactactaggatttttctgaaagagcttggtactttcgcgcagagttcaatcgcactgcatcaccaatacaaccccaaatttcagacgctatttcagccatgtaacctgatgggtgccatgcagctgatcgaagattttagtacacacgtgtctattgactgttccccacacaagacagtaaaaaaaacagccaacgagttcccgtgcctgcccaagcaggtcgcctggatccttgccacaagtaaagtttttatgtatcccgagttgcttccagtctgcagcctcaaagcaaagaatccacaggataagattgtcttcacaaaagcggaggataacctccttgcacttgggcttaagcatttcgaaggcaccgaattccccaacccgctgatatccaagtacctgctaacatgcaaaactgcccatcaactcaccgtcaggataaagaatctgaacatgaaccgggcccccgataacatcatcaagttctataaaaagacaaagcagctcccagtgcttggaaagtgttgtgaggagatccagccacaccaatggaagcctccaatcgaacgggaggagcacagactgcccttctggctgaaggcgagtcttcccagtatccaggaggaactgagacatatggcggacggtgcccggcagagctaccgcagaaagaggagaggtgttagtcagttgaaaccactgcatctgctcaaatcccccctgatgaaagagccacaaggtcagatgtag

SEQ ID NO: 19314 - DNA, 618 bp, Artificial Sequence
  Description of Artificial Sequence: Synthetic coding sequence
atggccgccgccgccggcggcgccgccagccggcggggcgccggccgtccttgtccatttagcatcgagcacattctctccagcctgcctgagagaagtctgccggcccgcgccgcttgcccaccccagccagctgggagacagtcgccagctaaacccgaggagcctggagccccagaggctgccccatgcgcctgctgctgctgttgtggccccagagcagcgccatgcgggcccccagaagctgccgcaggcctgggggccagattggcttggcccctgaggctcggtcccgcggtgcccttgagcttaggggctcccgccggcggctccggcgctctgcctggcgcagtagggcccggctcccagcggcgcactcgccgccaccggacaattttctctgaggagcaactgcaggcactggaagcacttttcgtgcaaaaccagtaccctgatgtgagtacgcgggagcgactggccgggagaatacgccttcgtgaggaaagagtcgaagtatggttcaaaaaccgaagggcaaagtggcggcatcaaaaacgcgcctcagcatcagctcgcttgctccccggtgtcaaaaaatcccccaagggatcttgttag

SEQ ID NO: 19315 - DNA, 1824 bp, Artificial Sequence
  Description of Artificial Sequence: Synthetic coding sequence
atgtggatgaacagcatcctgcccatcttcctgttccggagcgtgaggctgttaaaaaatgatccagtgaacctccagaagtttagctatacctccgaagatgaggcttggaagacatatctagagaaccctttaactgcagccacaaaagccatgatgagagtcaatggcgatgacgactcagtagccgccctgagcttcttgtacgattattacatgggccctaaggagaagaggatcctttcttcctcaacagggggaaggaatgatcaagggaaacgctactatcacggcatggagtatgagacagatctgacacctctggaatcacctactcatctgatgaaattcctgactgaaaacgtgtctggcacccctgagtaccctgacctgcttaaaaaaaacaacctgatgtctctcgagggagccctcccaacccctggaaaggcagcaccactgcccgccggtccctcaaagttggaggctgggagcgtagattcgtatctcctccctaccaccgacatgtacgataatggctccctcaactcactgttcgaatctatccacggcgtgccccccactcagcgctggcagcccgactcaactttcaaagacgaccctcaggagagcatgctgtttcccgatattctgaaaacttcccccgagcccccgtgccccgaggactacccaagcctgaagagcgatttcgagtacacacttggcagcccaaaagctatccacatcaaaagtggcgaatcacccatggcctatctgaataaggggcaattctaccctgtcactctccgcacacccgccggcggaaagggcctggcgctgagctcgaacaaggtcaaaagtgtggtaatggtggtgttcgataacgagaaggtgcctgtagagcagctgagattctggaagcattggcattcccggcagccaaccgcaaagcagagagtgatcgatgtggctgattgtaaggagaactttaacactgttgagcacatagaagaggtggcctacaatgcgctgagttttgtgtggaatgtgaatgaggaggcaaaggttttcataggagtcaactgcttgtcgacggacttttccagccaaaagggcgtgaagggcgttccactcaacctccagatcgacacatacgactgtggtcttggtacagagcggctagtgcaccgggcagtttgtcagataaagatcttctgcgacaagggagctgagaggaagatgagagatgacgagaggaaacagttcaggcgcaaagtcaaatgccctgattccagcaattctggagtcaaaggttgtcttctatccggtttcagaggcaacgagacaacatatctgcgcccagagacggatctggagactccacctgtgttattcatcccaaatgtgcatttcagcagtctgcagcgctccggtggggccgccccgagtgccgggccatcaagttctaacaggctgcctctgaagcggacctgttcccccttcacagaggaattcgagccactgcccagtaagcaagctaaggagggagatcttcagcgcgtgttgttatacgtgagacgcgagaccgaggaggtctttgacgcgctcatgctcaagactcccgatttgaaggggctgaggaatgccatctctgagaagtatggttttccagaagagaatatctataaagtgtacaagaaatgtaagagagggattctggtgaatatggacaataacataatccagcactactcaaatcacgtggccttcctcctggacatgggagagctggacggaaagattcaaatcatactgaaagaactttag

SEQ ID NO: 19316 - DNA, 1530 bp, Artificial Sequence
  Description of Artificial Sequence: Synthetic coding sequence
atggagtacgagaccgacctgacccccctggagagccccacccaccttatgaagttcttgaccgagaacgtgtcgggcactcccgaatacccagatttgctcaagaagaacaacctaatgtccctcgagggagcactacctacacccggcaaggccgctcctttgccagccggaccatctaagttggaagcaggttccgttgactcatacctcctgccaacaactgatatgtatgacaacggatccctcaactccctgtttgagagcatccatggcgtaccaccgacacagcgctggcaaccggactccacttttaaagacgatccacaagagtcaatgctctttcctgacatccttaagacatctcccgagccgccctgccctgaggactacccaagcttgaagagtgatttcgagtataccttgggcagtcccaaggcaattcacattaagtctggagagtcccctatggcttatctcaataaaggccaattctatcctgtaaccctcaggactcccgctggcggaaagggcctggcgctcagcagtaacaaggtgaaatcggtcgtcatggtcgtcttcgataacgagaaggtgcccgtcgaacagttgcgcttttggaaacattggcatagtagacagcccactgcaaaacagcgagtgatcgacgtggcggattgtaaagagaactttaacacagtggagcatatcgaagaggtggcatacaacgccctctctttcgtttggaacgtgaacgaggaagccaaagtgtttatcggtgtgaactgcctgtctactgactttagtagccaaaaaggggtaaaaggcgtgccactgaatttgcaaatagacacctacgactgcggtctgggtacagagaggcttgtccatcgggccgtgtgtcagattaagatcttttgtgacaagggagctgagcgtaaaatgcgggacgacgaaagaaagcagtttcggcggaaggtcaagtgtcccgacagctctaattccggggtgaagggttgtctcctctctggatttcgcggcaatgaaactacctacctgagaccagagacagacttggagacccctcccgtcctattcatccctaacgttcacttttcgtctctgcagcgctctgggggtgctgccccatccgctgggccgtcatcctctaaccgcctgcctcttaaacgcacttgcagcccttttacagaagaattcgagccactgcctagtaagcaggccaaagaaggcgacctgcagcgagttctgctgtacgtgagaagagagaccgaagaagtatttgacgctttgatgctgaagacacccgacctcaaggggctgcggaatgccatatctgagaagtatgggttcccggaagaaaatatttacaaggtctacaagaaatgcaagcggggaatcctcgtcaacatggataataatataattcagcactatagtaaccacgttgcttttttgctcgatatgggagaactcgacggaaagattcagatcatactgaaggagctgtag

SEQ ID NO: 19317 - DNA, 1881 bp, Artificial Sequence
  Description of Artificial Sequence: Synthetic coding sequence
atgagcaacgagctggacttccggagcgtgcggctgctgaagaacgaccctgtaaacctgcagaagttcagctacacaagcgaagacgaagcatggaaaacctatctggagaatcccttgaccgccgctacaaaagccatgatgcgggtcaacggagatgacgatagcgtcgcagccctcagctttctgtatgattactatatgggcccaaaagagaaacgtatcctctccagttctaccgggggacgcaacgaccaggggaaacgatattatcatggtatggagtacgagactgacctgacccccttggaatccccaacccatcttatgaaattcctcacagagaatgtgtccggtaccccagagtatccagacttgctgaaaaagaataaccttatgtctttggagggagcactccctacccccggaaaggcggccccgctgccagctggtccaagcaaactggaagctggaagtgtggatagctatctgcttcctactaccgacatgtacgacaatgggtccctgaattctctttttgaatctatccatggcgtgccacccacccagagatggcagccagatagcactttcaaagacgaccctcaggagtccatgctgtttccggacatcctcaaaacttcccctgaaccaccatgtcccgaagattatccgagcctcaaaagcgactttgaatacaccctcggaagccccaaggcaatccatatcaagtccggcgagtctcccatggcctatcttaataagggccagttctatcccgtcaccctcaggacacctgctgggggcaagggcctggctttgtcatccaataaggtcaagtcagtggtgatggtggtgttcgacaacgaaaaggttcccgtggagcagctaaggttctggaagcactggcattcgaggcagccgaccgccaaacaaagggtcattgacgtggccgattgcaaggagaattttaacaccgttgagcatattgaggaagtggcatataatgccctgagttttgtttggaacgtgaacgaagaggccaaggtttttataggggttaattgtctttctaccgatttttcctcacagaagggcgtgaagggcgtgcctctcaatctgcagatcgatacttatgattgtgggttaggaaccgaacggttggtccacagagctgtgtgccagattaaaattttttgtgataagggcgccgagagaaaaatgcgtgacgatgagagaaagcagtttagacggaaagtaaagtgccctgattcctcaaatagcggagttaaaggatgtctgttgagtggcttccgtggaaatgaaaccacatacctcagaccagagactgatcttgaaaccccgcccgtgctgtttatccctaatgtccactttagttctctgcagagatctggtggagcagctccaagcgcgggtccaagcagttctaacagattaccactcaaacggacctgttcaccattcaccgaagagttcgagccactcccttcaaagcaggccaaggagggagacctccagcgggtgctcctgtatgtccggcgggagactgaagaggtgttcgatgctcttatgcttaaaacaccagacttgaaaggcctgcgtaatgctatctctgagaagtacggatttcccgaagagaatatatacaaggtctacaagaaatgtaagcgcggcgaaactagcttgctgcacccaaggctttctaggcacccccctcccgactgtttggaatgcagccaccctgttactcaagttagaaacatgggatttggagacgggttttggagacagagggatctcgactcaaatccatcccccactaccgtgaacagcctacactttactgttaacagcgagtag

SEQ ID NO: 19318 - DNA, 1671 bp, Artificial Sequence
  Description of Artificial Sequence: Synthetic coding sequence
atgatgcgggtgaacggcgacgacgacagcgtggccgccctgagctttctgtatgactattatatgggccccaaggagaaacgtattctgagtagcagtactggcggacgcaacgatcagggcaaaagatactaccatggcatggaatacgaaactgatctcacccccctcgaatcacctacacatttaatgaaattcctgactgaaaacgtgtccggtaccccagagtaccctgatctgctaaagaagaacaatttgatgagcctcgagggcgccctgcccaccccaggcaaggccgctcccttgcctgccggcccgtccaaactggaggcaggatccgtcgacagctaccttcttcctacaaccgatatgtatgacaacggctcgctgaattccctgttcgaatctatccatggagtgccgcccactcagagatggcaaccagattcaacttttaaagatgatcctcaagaatctatgcttttcccagatatactaaagacaagccctgaaccaccctgtccagaggattacccatccctgaagtcggactttgaatataccctgggctcccccaaggcgattcacattaaaagtggggaaagccccatggcctacctcaataagggacagttctatccggtgacactccggacacctgcaggcggtaagggtcttgccctctcttccaataaagtgaagagcgttgttatggtcgtatttgacaacgaaaaagtgcctgtggagcagcttcggttttggaaacactggcactctcggcagccaacagctaaacagagagtgattgatgttgccgactgcaaagaaaattttaataccgtagaacatatagaggaagtggcctacaacgccctctcttttgtgtggaatgtaaacgaggaggctaaagtcttcataggagtgaactgtctgtcgacggatttctccagccaaaagggcgtgaagggggtgcccctgaatttgcagatcgacacttatgattgcggactgggaaccgaaaggctggtgcatagagctgtttgtcagattaagatcttctgtgataagggggcagaacgaaaaatgagagatgatgagagaaagcagttcaggcggaaggtgaaatgccccgatagctcaaattccggtgttaaggggtgtttgctctcaggcttccgcggcaatgaaactacctatctacgtcccgaaacagacctggaaacccccccagtactgtttattcccaatgtccacttcagttctctgcagcgcagcgggggcgccgccccaagtgcaggtcctagctcctcaaacaggctccccctgaagcggacctgtagcccttttacagaagagtttgaaccgctgccatcaaagcaggcgaaggaaggcgatctgcagagagtgctgttatacgtcaggagggaaaccgaggaagtattcgatgcactgatgctgaagacacctgacctgaaggggctgagaaatgccataagcgagaagtacgggtttcccgaggagaacatctacaaggtgtacaaaaagtgcaaacgaggaattctggttaacatggacaacaacatcatacaacactacagtaaccacgtcgcattccttcttgatatgggggagctcgatggaaagattcagatcattctgaaagagttgtag

SEQ ID NO: 19319 - DNA, 1809 bp, Artificial Sequence
  Description of Artificial Sequence: Synthetic coding sequence
atgagcaacgagctggacttccggagcgtgcggctgctgaagaacgacccagtgaaccttcagaagttttcatatacaagtgaggacgaggcctggaagacttatctggagaaccccctcacagccgccacaaaggctatgatgagggttaacggcgacgacgactcggtggccgcgctgtcgttcctatacgactactatatgggccccaaggaaaagcggatcctcagctccagtactggtggacgtaatgatcagggtaagagatactaccatggtatggagtatgagactgacctaacccccttagaatccccaacccatttgatgaaattcttaaccgagaacgtgagtggcacccctgagtatcctgatttgctaaaaaaaaacaatctaatgtccctggaaggcgcccttccaacaccagggaaagcagcgccccttcctgccgggcctagtaaattggaagctgggagtgtggattcttacctgttgccaaccacggacatgtatgacaatggtagtcttaatagcctatttgagtccatccatggcgtccctccaacacaacggtggcagcctgactcaacatttaaagatgacccacaggaatccatgctgtttcccgacattctcaaaacctctcccgagccaccttgtcccgaagattacccatccttgaagagcgatttcgagtatacgctgggcagccccaaagccatccatatcaagtccggcgagtctcccatggcttacctcaataaaggccagttctatcctgttaccctccgtactccagcaggtggcaagggcctggcacttagttccaacaaagtcaaatcggtcgttatggtggtgtttgacaacgagaaagtgccagtggaacagctgcgcttctggaaacattggcactcgcgccagcccactgccaagcagcgtgtaatagatgtggctgattgtaaagagaactttaatacagttgagcacatcgaggaagttgcatataatgccctgagcttcgtttggaacgttaacgaggaggcgaaggtgttcatcggtgtcaattgtctgagcactgacttcagcagtcagaagggagtcaaaggtgtcccactcaacctccagatcgatacttacgattgcggactcggaacggaacgactggtacatagggcggtgtgtcagatcaagatcttttgcgacaagggcgccgagcgaaagatgagggatgatgagaggaaacagttccggcgcaaggttaaatgccctgactcatctaactcgggggtgaaggggtgcctgctatccggattccgaggaaatgagactacatatctgagaccagaaaccgacttggagacgccgcccgtcctcttcatcccaaacgttcatttttcttccctccaacgctccggaggtgccgcccccagcgctggtccctcatcctcaaatcgcctccctcttaagcgcacctgttctccatttaccgaagagttcgagccacttccttcaaaacaggctaaagagggggacctgcagcgtgttttgctgtacgtgcgcagagagacagaggaagtcttcgatgctctgatgctaaagacacctgacctgaagggtttgaggaatgcaatttcggagaaatacggctttccggaggagaatatttacaaggtgtacaaaaagtgcaaacggggaattctggtgaatatggacaacaacattatccagcactactcaaatcacgtggctttcttgctggatatgggtgagctggatggcaagatccagatcatcttaaaggaactgtag

SEQ ID NO: 19320 - DNA, 795 bp, Artificial Sequence
  Description of Artificial Sequence: Synthetic coding sequence
atgccccggagcttcctggtggacagcctggtgctgcgggaggccggggagaaaaaagctcccgaggggtctccgccacccctgttcccatacgccgtgccaccaccccatgcccttcacggtttatccccgggggcttgtcacgctcgcaaggccgggctgttatgcgtttgccctttatgtgtgaccgctagccagctgcacggaccacctggcccccccgccctccctctgctcaaggcctccttcccccctttcggctcccaatattgccacgccccccttggccggcagcactctgcggtgtctccgggagtggcacacggtccggccgccgctgcagctgccgctgcgctatatcagactagctatcccctgcccgaccccaggcagtttcattgcatttctgtggattcttcctccaatcagcttccatccagtaaaaggatgagaaccgcctttactagcacccagctgcttgaactggaaagggaattcgcatccaatatgtacctgtctcggctgcgcagaattgagatcgctacatacctcaatctttcagaaaaacaggtgaaaatttggttccagaatcgccgtgtcaagcacaaaaaagagggaaagggcagcaaccaccggggtgggggaggggggggagcaggggggggcggatcagcgcctcaggggtgcaagtgcgcttccctctccagtgccaagtgttcagaggatgacgatgagcttccaatgtcgccaagttccagtggtaaagacgaccgcgacctgactgtgactccttag

SEQ ID NO: 19321 - DNA, 915 bp, Artificial Sequence
  Description of Artificial Sequence: Synthetic coding sequence
atgagccggagcttctacgtggacagcctgatcatcaaggacacctcaaggcctgcaccctcccttcctgagccgcaccccgggcccgatttctttatccctctgggcatgccccctcccctagttatgtccgtgagtgggcccggctgccctagtaggaagagcggggcattttgtgtttgccccctgtgtgtaaccagtcacttacacagttcacggggatctgttggagctggaagcggcggagccggcgccggcgtaacaggcgcaggcggtagcggagtggcaggagctgcaggcgctcttccactgctcaaaggccagttcagtagcgctcccggcgatgcccaattctgcccacgggttaaccacgcccaccaccaccaccaccctccccagcatcatcaccaccaccatcagccccagcagcccggatcagccgccgcggctgccgcagccgcagcggccgccgccgctgctgcagctctgggccacccccaacatcatgcccccgtgtgtaccgccactacttacaatgtggctgatcccagaagatttcattgtttgactatgggtggatccgacgcatcgcaggtaccaaatgggaaacgaatgaggacggcgttcacctcaacacaacttttagagctcgagcgggagttctcatctaatatgtatctcagccgcctccggaggatcgagatagccacatacctgaacctgtcagagaagcaagtcaagatctggtttcagaacaggagagtgaaacataaaaaggaagggaaggggactcaacggaacagccatgcaggctgcaaatgtgttggctcccaggttcactacgcccgttcagaagacgaagatagcctgagtcccgcttcggcgaacgatgacaaagaaattagccccctctag

SEQ ID NO: 19322 - DNA, 2850 bp, Artificial Sequence
  Description of Artificial Sequence: Synthetic coding sequence
atggcccaggtggccgtgagcaccctgcccgtggaggaggagagcagcagcgaaacgcgcatggtggttaccttcctggtcagcgctctagaatccatgtgcaaggaactcgctaaaagcaaggccgaagtggcgtgcatcgcggtgtatgagacagatgtgttcgtggtcgggaccgagcgcggttgtgcttttgtgaacgctcggactgattttcagaaagactttgccaaatactgcgtggcagaagggttatgtgaagtgaagcccccttgccctgtgaacgggatgcaggtgcatagcggcgaaacggagatcctgcgcaaagccgtcgaggattatttctgcttttgctacggcaaagctcttggcactactgtcatggtgccagtgccttacgagaaaatgcttcgtgatcagagcgctgtggtcgttcagggcctgccggagggcgtggcttttcagcatccggaaaactatgaccttgccaccctgaaatggattcttgaaaacaaggcgggcataagctttatcatcaatcgacccttcctcggcccagagtcacagttagggggtccaggcatggtgacagacgctgagcgctctattgtgagcccctcagaaagttgcggtcctattaacgtcaagacagagcccatggaagattctgggatctccctgaaggcagaggccgtctccgtgaagaaagagagtgaggaccctaactactaccagtataacatgcaggggtcccatccttcctcgacgtcgaacgaagtgatcgagatggagctacctatggaagattcaaccccacttgttccctcagaagaacctaacgaggacccagaggcagaggtgaagatcgaaggcaatacaaactcatcttcggtgacgaactcagccgcaggcgtggaggacctcaacatcgtacaggtgaccgtgccagataacgaaaaggagcggctgagctccattgagaagattaaacagctccgagagcaagttaatgatctgttctctcggaaattcggagaagccataggcgtcgatttccctgttaaggttccgtacaggaagataacgttcaaccccggatgcgtggtaattgacggcatgccacctggagtggtgttcaaggcacccgggtatctagagattagttcaatgcggaggatcctcgaagctgcagagtttattaaattcacagttatacgtccactgcctgggttagagctgagcaatgtgggaaaaaggaagatagaccaggaaggcagggtgttccaggaaaagtgggagcgggcatatttcttcgtagaggtgcaaaacattcctacctgcctgatttgtaagcagagtatgagcgtttcaaaagaatacaatctgcggcggcattatcaaactaaccattcaaaacactacgaccagtacatggagcgcatgcgcgacgagaagctgcacgaactcaagaaggggctgcggaaatacctattggggttgtctgatactgagtgtcctgaacagaaacaggtgtttgcccatccttcccctacgcagaaatcccccgtccagcccgtcgaggatctggccgggaacttgtgggagaaacttcgggaaaaaattcgctcattcgtcgcttattcgatcgcgatcgatgagattactgatattaacaatacaacccagttggcgatatttataagaggcgtagacgaaaattttgacgtgtctgaggaactgctggacactgtgccgatgacaggaaccaaatctggcaatgaaatattttcacgggtagagaagtctctgaaaaaattttgtatcgattggagcaaacttgtgagcgtggcatcaactggaacacccgcaatggtggacgcaaataatggcctggtgaccaagctgaagtcccgtgtggcaaccttttgcaaaggcgcggagcttaagagcatttgttgtattatccatcccgagtccctgtgcgctcaaaagttaaaaatggatcacgttatggacgtggtcgttaagtcagtaaattggatctgctctcgtggcttgaatcatagcgagtttaccaccctcttgtacgaactggacagccaatacggcagtttgctgtattacacagaaatcaaatggctgtcccggggcctggtgctgaagcgattttttgagagtctcgaagaaatcgactctttcatgagttcacgaggaaagcccttgcctcagttgtcgtcgatagactggatcagggatctcgcctttctagtggacatgaccatgcatctgaacgcgctcaacatcagtctccagggtcactcacagatcgtcacccagatgtatgaccttattcgggcctttcttgctaagctgtgcttatgggaaactcacctgacacggaacaacttagcccacttccccacgctgaagttagcctctcgaaatgaatcggacggattgaattatatcccaaaaatcgccgagctaaagactgagttccagaagcgtctctccgactttaagctctacgaatcagaactgaccctcttcagctcacccttctctacgaaaatcgacagcgtccatgaagagctacagatggaagtgatcgatctacagtgcaatactgtgctcaaaaccaaatacgacaaagtgggaataccggaattctacaagtacttgtggggctcttaccccaaatataaacatcattgtgccaagatactgtcaatgttcggtagtacatacatctgtgagcaattattctctattatgaagctgtccaaaaccaaatactgctcacagttgaaagacagtcaatgggacagcgtgctacacatcgctacatag

SEQ ID NO: 19323 - DNA, 1491 bp, Artificial Sequence
  Description of Artificial Sequence: Synthetic coding sequence
atgagcgtgagcaaggagtacaacctgcggcggcactaccagaccaaccatagtaaacattacgatcagtatatggaacgcatgagagatgagaaactgcatgagttgaaaaagggtctaagaaagtaccttttagggctctccgacaccgagtgtcccgaacagaagcaggtattcgcgcacccatcaccaacacaaaagtccccagtccagcctgtggaggacttagctggcaatctgtgggagaagctgcgcgaaaaaatacgctcgttcgtcgcctacagcattgccatcgatgaaataaccgacattaataatacgacgcagctggccatttttattcgaggagtggacgagaacttcgacgtcagcgaagaactccttgacaccgtccctatgaccgggaccaaaagtggaaacgagatctttagcagggttgagaagagtctaaaaaaattttgtatagattggagcaagctcgtgtctgtggcctcaactggcaccccagccatggttgacgctaacaacgggttagtcaccaaactgaagtcccgcgtggcaacattctgcaagggggctgagctgaagagtatttgttgtataattcaccctgagagcctttgcgctcagaaacttaaaatggatcacgttatggatgtggtggtcaaaagcgttaactggatctgctcccgggggctcaatcactctgagtttaccactctgctgtacgaactggattctcagtacgggtcactgctttactataccgagattaaatggttaagtcgaggattggtcctgaagaggttcttcgagtctctcgaagaaatcgattcattcatgagctcccggggaaagccactgccccagctgtcctctatcgactggattcgggacctcgcctttctcgtggatatgactatgcatctcaacgccctgaacatttccttacaaggccacagtcaaatcgttactcagatgtatgatctaatccgcgccttcctggccaagctgtgtctgtgggagactcatctcacccgcaacaatcttgcccacttccccacccttaaactggcctccagaaatgagtcagacgggctgaattacattccgaagatcgcagagcttaagacagagttccagaagaggctgagcgacttcaagctctacgaaagtgagctcacactattttcatccccattttcaacgaaaatcgacagcgttcatgaggagctgcagatggaggtcatagacctacagtgtaacacagttctgaaaacaaagtatgataaggtcggaattcctgagttctataagtacctgtggggctcctaccctaagtataaacaccattgcgccaaaattcttagtatgttcggaagtacctacatctgtgaacagctgtttagcatcatgaagctcagcaagacaaagtactgcagccagcttaaggattcacagtgggattcggtactgcatatagctacctag

SEQ ID NO: 19324 - DNA, 681 bp, Artificial Sequence
  Description of Artificial Sequence: Synthetic coding sequence
atggcccaggtggccgtgagcaccctgcccgtggaggaggagagcagctccgaaacaaggatggtcgttaccttcctggtgtctgccctcgagtctatgtgcaaggaactggcaaaatctaaagccgaggtcgcatgtattgccgtgtacgagactgacgtctttgtcgttggaacggagaggggctgtgcttttgtgaacgctcgcaccgactttcagaaggattttgctaaatactgtgtcgccgaggggctatgtgaagtgaaaccgccgtgcccagtcaatgggatgcaagtccattcaggtgagaccgaaatacttaggaaggccgtagaggactatttctgtttctgttacggcaaggctcttgggacaaccgtaatggtgccagttccgtacgagaagatgctgcgggaccagagtgctgtggtggtacagggactgcctgagggggtagcatttcagcatcctgaaaattatgacctggccacgctcaaatggatcctcgagaataaggccggaatatcttttataattaataggccatttctgggaccggaatctcagctaggcggaccagggatggtgaccgatgccgagcggagtatcgtgtcgccaagtgagagacactttacagagtcaaggagctgtttaagtcaggagcggattagacgcagttag

SEQ ID NO: 19325 - DNA, 2850 bp, Artificial Sequence
  Description of Artificial Sequence: Synthetic coding sequence
atggcccaggtggccgtgagcaccctgcccgtggaggaggagagcagctccgaaactcggatggtggtgaccttccttgtttcagctttggagagtatgtgcaaagaactggctaaatcaaaagccgaggtcgcctgcatcgctgtgtacgaaactgacgtatttgtggtcggtaccgagaggggctgtgcatttgtgaatgctagaaccgacttccagaaggattttgcaaagtactgcgtggccgaaggcctctgcgaggtcaaacccccctgtcccgtcaatgggatgcaggttcacagtggggagacagagattttgcggaaggccgttgaggattatttttgcttttgttatggcaaggcgttaggcaccacagtgatggtgcctgtgccttatgaaaaaatgctacgtgatcagagcgcagtggttgtgcagggcttaccggagggcgtggctttccaacatcctgagaactatgatttagcaaccttaaagtggattcttgaaaacaaggctggaatcagtttcattatcaacagacccttcctcggtcctgaatcccagctcggggggcctgggatggtcacagatgctgagagatctatagtgtctccttcagaaagttgtggtcctatcaatgtcaagacggaaccgatggaggactcaggcatatccctgaaggccgaagcagtaagcgtcaagaaagagagtgaggaccctaattattaccagtataatatgcaggggagtcacccttccagtacatccaatgaggtgatcgagatggaactccctatggaagattcaacgcccctggtaccctccgaggagcctaacgaagaccccgaggcagaggttaagattgaaggaaacacaaattcctccagcgtcacaaacagcgcagcaggcgtagaggacctgaatattgtacaggtcacagtgcccgataacgagaaggagcgactcagcagcattgagaaaattaaacagctgagggaacaggtgaacgacctgttctctagaaaattcggcgaggctattggggttgacttccccgtcaaggtgccataccgcaaaattaccttcaatcccggctgcgtggtaattgatggcatgccgcctggggtggtcttcaaagctccagggtacctcgaaatatctagcatgaggcgcatcctagaggctgctgagtttatcaaattcaccgtgatcaggcctctcccaggccttgagctttccaatgttggaaagaggaagattgaccaggagggccgcgtatttcaggagaagtgggagcgcgcatacttcttcgtcgaggtgcagaacataccgacttgtttgatatgtaaacaaagtatgagtgtttccaaagagtataaccttagaagacactaccagaccaaccactccaagcattatgaccagtatacggagcgcatgagagatgaaaaactgcatgaactgaagaaaggccttcgcaagtacctgttgggctcttccgacactgaatgcccagagcagaaacaggtttttgccaacccaagccctactcagaagtctcctgtgcagcctgtagaagacttggctgggaacctctgggaaaagctgcgtgaaaaaatcagaagtttcgtcgcatattctatcgccatcgacgagattaccgacataaataatactacacaactggccatattcataagaggtgtagatgagaatttcgatgtatctgaagagttactggacacagtgcccatgactgggaccaaatcgggcaatgagatcttcctcagagtggaaaagagcctgaagaagttttgcatcaactggagtagactagtgtctgtcgcttccaccggcactcctgccatggtggacgcaaataacggcctggtaaccaagttgaagtctcgcgtcgcaacattttgcaaaggggccgagctgaagtccatttgttgcataattcaccccgagtccctgtgtgcccaaaagctcaaaatggatcatgtgatggatgtggttgtgaaatccgtgaattggatctgctccagaggtctcaaccatagtgaatttactacccttctgtatgagcttgacagccagtatggatccctgctctattacacagagattaaatggttgagccgcggcctggttttaaaaaggttcttcgagtcgctggaggaaattgattcgtttatgtcctcaaggggtaaacccctcccccagctctcgagtatagactggattcgggacctagctttcttggtggatatgacaatgcacctgaacgcgcttaacatcagcctccagggacattcacaaatcgtgactcagatgtacgatctgattagggcctttctggctaagctgtgcctgtgggaaacccacctcacaagaaataatctggcccacttccctaccctcaaactggtaagccggaatgaatccgacggcttgaactatatacctaaaatagccgaactcaagaccgaattccagaagaggctgtcagacttcaagctgtacgagtctgagctcaccctgttttcctcaccattctcgaccaaaatcgattccgtgcatgaggagctgcagatggaggtcatagatctacagtgtaatactgtgctgaaaaccaagtatgacaaagtcggcatccctgagttctacaagtacctgtggggatcgtacccaaagtacaagcaccactgtgctaagatattatccatgtttggctctacatacatatgcgagcagctgttctcaataatgaaactgagcaagaccaagtactgcagtcagcttaaagattctcagtgggattccgttctccacatcgctacttag

SEQ ID NO: 19326 - DNA, 1095 bp, Artificial Sequence
  Description of Artificial Sequence: Synthetic coding sequence
atgaccggcaccaagagcggcaacgagatcttcctgcgggtggagaaaagcctgaagaagttttgcatcaattggtcccgattggtctcagtggcctccacaggaacccccgcaatggtggacgccaataacggattggttaccaagcttaaatctcgggttgccaccttttgcaagggtgccgagttaaaaagtatctgttgtatcatccaccccgagtcgctatgtgcccagaaactaaaaatggatcacgtcatggatgtggttgtgaagagcgtgaactggatctgctcgcgtggtttaaaccacagcgaatttaccacattgctgtacgagctcgatagtcagtatggatctctgctgtactacacagagatcaagtggctctccaggggtttagtgttgaaaagattctttgagtcactcgaagagattgactccttcatgtcctccagaggcaaaccccttccacagctctcttccattgattggattagagatttagccttcttggtcgacatgactatgcacctcaatgctctgaacattagcctccagggccattcccagatcgttacccaaatgtatgacctgattcgtgctttcctggccaagctgtgcctatgggaaacccatctgactaggaacaacctagcccacttcccgaccttgaaattggtgtctcggaacgagtctgacggattaaattacatccccaagattgccgaactgaagactgaattccagaagcggctgtcagacttcaaactctatgaatcagagctgacgttgttcagctcaccattcagtacaaaaatcgattccgtgcacgaagaactgcaaatggaggtcatcgacttgcagtgcaatacagtcctcaagaccaaatatgataaagttgggatacctgagttctacaaatatttatggggctcctatcccaagtataaacaccattgtgctaaaatacttagcatgttcggctccacttacatttgcgagcaactgttttcgattatgaaattgagcaagaccaagtactgtagccagctgaaggatagccagtgggattccgtgctgcacatcgcaacctag
